United States Patent 9,328,346 (POLYCOMB-ASSOCIATED NON-CODING RNAS) - sequence listing, part 116

SEQ ID NO: 140400 - RNA, 22 nt, Homo sapiens
cugugugagcguguucucacac

SEQ ID NO: 140401 - RNA, 321 nt, Homo sapiens
aaaaaaaguaauuaaaaagaaugacgugaggauuguuugagcccaggaguuggagaucagccugggcagcacuagggagaacucgucccuacaaaaaauuuaaaaaauuagcugggugugguggugcgcaccuguagucccagcuacucgggaggcugaggcgggaggauggggaggaucgcuugagcccaggaguuggaagcugcagugagcuaugauugcaccacugcacuccagucggggagaaagaaugagacccugucacaaacaaacaaaaaagcaaaaagaaugacggaagguuaggaaagaagcagagcaacg

SEQ ID NO: 140402 - RNA, 71 nt, Homo sapiens
uaaccagaguacuuuccucacaugguugugagguuaaucagcuuagagugugugugugugugugugugugu

SEQ ID NO: 140403 - RNA, 46 nt, Homo sapiens
uaucaaagaaaaaaggacugagugcagaagaaaagagagccugcau

SEQ ID NO: 140404 - RNA, 44 nt, Homo sapiens
agguucugaaaucucaguuguuucagggaagccaaaagcaugca

SEQ ID NO: 140405 - RNA, 400 nt, Homo sapiens
ucgcaaauauguaaauuuuuaaauauuauccaacuaggcugggcacaguggcucaugccuguaaucccagcacuuugggaggccgaggcgggcagauaacuugaggucaggaguucgagaccagucugaccaacguggugaaaccccaucucuaccaaacauacaaaaauuagccaggugugguggcacaugccuguaguccuagcuacucgggaggcugagguaggauaaucacuuaaaccugcgaggcagagguugcagugagcugagaucacgccacugcacuccagccugggcaacacagcgagacucugucucaaaaaaaaaaauuaaaaauuuuaaaaaucuuauccaacuaaauguacugaacugucuuuuaccuguaacaguguuuaucauu

SEQ ID NO: 140406 - RNA, 41 nt, Homo sapiens
cgugaccacgcccuggccugcgcuaaggccccggcgucggc

SEQ ID NO: 140407 - RNA, 64 nt, Homo sapiens
ggaguuggggcggccggagggcagaugacucugagaaggugcggaucuucgauucuaaggggag

SEQ ID NO: 140408 - RNA, 57 nt, Homo sapiens
guauuaguaaaauggaauuuaucugccuuuuaagaacauaacagaauugguauagau

SEQ ID NO: 140409 - RNA, 46 nt, Homo sapiens
gaucccuugcaauuuuuguucuuauuuaugccugaugugucccauu

SEQ ID NO: 140410 - RNA, 49 nt, Homo sapiens
aacuuguuuuguuguuguuguuaagauaaaauacaucaagagcucauaa

SEQ ID NO: 140411 - RNA, 50 nt, Homo sapiens
uuagccaugccucuacaguaaaaguuauuaaagcuagauagaccacaguc

SEQ ID NO: 140412 - RNA, 80 nt, Homo sapiens
cuagcuauucaaaagugaaaaggcagaacuuagaaguaccaccucccccaccccuaucaaaauaagaaaugcuguauucu

SEQ ID NO: 140413 - RNA, 49 nt, Homo sapiens
aaaagaagacagaggaaggaagaaaaaagaaaacuggcauagcaaccag

SEQ ID NO: 140414 - RNA, 44 nt, Homo sapiens
ucugcaggcacaaaauuauccacacccagguacguggcccccgg

SEQ ID NO: 140415 - RNA, 84 nt, Homo sapiens
gcccuugucagcggccacacaguauugguguaagcaggaguuugggcagcacuuuacaaacugaaaaaggcucugguuucugaa

SEQ ID NO: 140416 - RNA, 45 nt, Homo sapiens
uuucgaauaccauccagccacuugccugaugcugcaacagccuuc

SEQ ID NO: 140417 - RNA, 45 nt, Homo sapiens
gaaauuuuccucuucauauuugguccacugcucuuuaggcaagau

SEQ ID NO: 140418 - RNA, 50 nt, Homo sapiens
uuaugaaagaagagggauauugaaaacugguuuaguuuuuauuacaagug

SEQ ID NO: 140419 - RNA, 27 nt, Homo sapiens
uuccuugccaucucaaucccucuucca

SEQ ID NO: 140420 - RNA, 44 nt, Homo sapiens
uaggacauauaaugacuuuuuguuuccaaaugcauugugacuuc

SEQ ID NO: 140421 - RNA, 66 nt, Homo sapiens
ugcuaaaaccuucacuguaaagaaaaagcucagcugaaauuaagggaagcagagaacaaauaaaag

SEQ ID NO: 140422 - RNA, 26 nt, Homo sapiens
gaagagaaguuuuaauucgggaauga

SEQ ID NO: 140423 - RNA, 47 nt, Homo sapiens
gagaaagucaguuauaaaaauccaaacuccauccacuguugcccaga

SEQ ID NO: 140424 - RNA, 43 nt, Homo sapiens
agaucuauaggguacagagaaaugagauugucuggcucugaaa

SEQ ID NO: 140425 - RNA, 49 nt, Homo sapiens
uaggaagcaacauccaaaaaugcuuaauaaaaugcuuuuaagcugcaua

SEQ ID NO: 140426 - RNA, 49 nt, Homo sapiens
guuuuuaaguaugaauguauuucauucauauuuccucucacaaaggaaa

SEQ ID NO: 140427 - RNA, 58 nt, Homo sapiens
ccgagaagaggcugggguguguggaccgauagugcgggauaccgaaaaggugguccaa

SEQ ID NO: 140428 - RNA, 229 nt, Homo sapiens
ugcucauccucuucaagccccucaucaggugaguggccacgggcagggcugguggucccggcuugccuggaacucugaagcugggaggcugggcagccuggggaccaccaggugcggcugggcuuccgucugaacuggguggguguugaggggagaguggaggccaccggaagcgggcccccacaacccaggcccuuucuuccaccaacagcuucaaguucgggcagaa

SEQ ID NO: 140429 - RNA, 51 nt, Homo sapiens
uucccaagcccggaccccagcgggcucugaaccuggccccugccccaccag

SEQ ID NO: 140430 - RNA, 78 nt, Homo sapiens
gcuggacguccgcuccggaucuucgcgauggggcgcgggggucggcgcggcuaggagugcggcgaguggagcgguggg

SEQ ID NO: 140431 - RNA, 52 nt, Homo sapiens
auaaaauaucuuuuagcugggguaaaagcaaauuaauuuuuccuuugcacga

SEQ ID NO: 140432 - RNA, 45 nt, Homo sapiens
gaaacugccaacaaaaaugauucuucaaagaaguugucuguugag

SEQ ID NO: 140433 - RNA, 45 nt, Homo sapiens
agacacaacuugaacacauucuucuucguccugauacauauauug

SEQ ID NO: 140434 - RNA, 55 nt, Homo sapiens
guguuuguucuuacuuaauauguuuugauuaauauguaucacuaaaacauuuccu

SEQ ID NO: 140435 - RNA, 46 nt, Homo sapiens
ggaauaaugggaaaggcauuccaguaguagaacacaagguagagaa

SEQ ID NO: 140436 - RNA, 45 nt, Homo sapiens
acaguagaaacagcuugcaaagaauacaaacacaguuuuaagcag

SEQ ID NO: 140437 - RNA, 45 nt, Homo sapiens
aacauuuugauggugaagauuacacaugcauaacauuccaaccag

SEQ ID NO: 140438 - RNA, 53 nt, Homo sapiens
aucgcuuuaucuuuucagauuguuuuuuucuugucuuuuggcaugcccuguaa

SEQ ID NO: 140439 - RNA, 46 nt, Homo sapiens
agcugaaacccacuguuguuaauggaagcuugguagcaugauggua

SEQ ID NO: 140440 - RNA, 49 nt, Homo sapiens
agacuucaggauggccagcucuccugugaucucaguucuucaguggguu

SEQ ID NO: 140441 - RNA, 46 nt, Homo sapiens
aaauaagcaggaacuuuccuucuacaguauuccugaauuugacgaa

SEQ ID NO: 140442 - RNA, 39 nt, Homo sapiens
ggggaaagaaggagagagagacuagaauucaugcaguaa

SEQ ID NO: 140443 - RNA, 50 nt, Homo sapiens
auaggcuuuaaaccuggccagcggaaaguuuuauuuaccuguuucaagag

SEQ ID NO: 140444 - RNA, 46 nt, Homo sapiens
gagaugucggcuuaucaucauggagaaguaagcauuaagauuggaa

SEQ ID NO: 140445 - RNA, 34 nt, Homo sapiens
accuccuuaaguuccuuuaugaugauaaucaacg

SEQ ID NO: 140446 - RNA, 57 nt, Homo sapiens
gacuuguaauucaguugggaaggaugaguaagauuuauguagaugaaugaugaaugg

SEQ ID NO: 140447 - RNA, 44 nt, Homo sapiens
aauuuaaaggauauugaucuaggagagaaguagguguaggggaa

SEQ ID NO: 140448 - RNA, 46 nt, Homo sapiens
auuauaaagaauaucauacugacacaacugugaaauuuguggugaa

SEQ ID NO: 140449 - RNA, 46 nt, Homo sapiens
cuuuuugaucauaugggaugucugaagaaauaugaaacugugcaag

SEQ ID NO: 140450 - RNA, 54 nt, Homo sapiens
ggagcagaaucuacaaagcuuaacaaucaagcccguuucauuuuagagaagaua

SEQ ID NO: 140451 - RNA, 48 nt, Homo sapiens; identical to SEQ ID NO: 46155

SEQ ID NO: 140452 - RNA, 45 nt, Homo sapiens
agcaugaugauaguuccuccgauucaggaacuccuucaggcccag

SEQ ID NO: 140453 - RNA, 47 nt, Homo sapiens
uucagaucuuuggaaagaggauuuagcggcauuuguugaagaacugg

SEQ ID NO: 140454 - RNA, 46 nt, Homo sapiens
gaagaauaauuccugaaauuacagcuaugaaggcagaugccagcaa

SEQ ID NO: 140455 - RNA, 101 nt, Homo sapiens
uaaaaguggaauuugaugaagaauucaguggagcaccaguagaaggugcaggagaagaggcauugacuccaucaguuccuauaaauaaaggucccaaaccu

SEQ ID NO: 140456 - RNA, 47 nt, Homo sapiens
gagugagaaaaacaccuacaucaucugguaaaccuagugcaaagaaa

SEQ ID NO: 140457 - RNA, 53 nt, Homo sapiens
gugucaugguuauuuugaguaugcaagacaaaaggaaagcaccaaacauacag

SEQ ID NO: 140458 - RNA, 47 nt, Homo sapiens
agguuaacauaagaugccuccgugagaggcugguggucagcccuggg

SEQ ID NO: 140459 - RNA, 46 nt, Homo sapiens
uuucauaucuacauuucaagaaauuaccauuguaacuugauaagag

SEQ ID NO: 140460 - RNA, 58 nt, Homo sapiens
uuccugugcuuuuaauguaucucuuuacaugaucugagagaggauucaaguugauaga

SEQ ID NO: 140461 - RNA, 39 nt, Homo sapiens
ucacucauagcauuucuauauuugaaaguagcccaauau

SEQ ID NO: 140462 - RNA, 54 nt, Homo sapiens
gccuuuguuuauuuaaacaugaacugaugguaacuguacauuuugugcuaaaau

SEQ ID NO: 140463 - RNA, 46 nt, Homo sapiens
aaaugaggccucuauuuuuacaaaacugcuucuaaaguugccagau

SEQ ID NO: 140464 - RNA, 55 nt, Homo sapiens
uugaaauauagguauucuguaucuacagcauaugaacuccugaguucuaguauug

SEQ ID NO: 140465 - RNA, 42 nt, Homo sapiens
caagaaaacucagcugagagcaugcagccccagagaggagaa

SEQ ID NO: 140466 - RNA, 46 nt, Homo sapiens
uuugcaaaggaagaagugauuggcauggugaccagagcucacaagg

SEQ ID NO: 140467 - RNA, 44 nt, Homo sapiens
guaaagcaugcuuuuguuucuuuaagcuacugauucugggauuu

SEQ ID NO: 140468 - RNA, 44 nt, Homo sapiens
cuuaugaaugccauuucauuucagucuuguaauaaguggcagau

SEQ ID NO: 140469 - RNA, 31 nt, Homo sapiens
cucuuugucuugaauccuguugcaaaugaau

SEQ ID NO: 140470 - RNA, 46 nt, Homo sapiens
aagaaucuugccucgauaacaaauguauugugaacuuuucaccaaa

SEQ ID NO: 140471 - RNA, 46 nt, Homo sapiens
aaaauuaaccugugggucgcugacuuuuccugaaucugaucaagag

SEQ ID NO: 140472 - RNA, 82 nt, Homo sapiens
aggggcucggcaaggagaaggaaggggagaagggggaagcgcaggagaaaaggguagccggggagccgggaagcgggcggga

SEQ ID NO: 140473 - RNA, 40 nt, Homo sapiens
cagaacgagcauuuaaauuaagucagcaaagucagaauuu

SEQ ID NO: 140474 - RNA, 28 nt, Homo sapiens
ugacuggacuaagaaugacguacuuaua

SEQ ID NO: 140475 - RNA, 47 nt, Homo sapiens
aauuguuuauuaaguaugaauuuuacaaacuuuacuuauauuagcgg

SEQ ID NO: 140476 - RNA, 33 nt, Homo sapiens
guaugcacccaucuuggcuuaccugugaaauca

SEQ ID NO: 140477 - RNA, 47 nt, Homo sapiens
ggcgccccauucgucagccccacgccuccuccaggauccgggcccag

SEQ ID NO: 140478 - RNA, 48 nt, Homo sapiens
acauaaauugggguuucacaauucuuacauuauuugucugucacagaa

SEQ ID NO: 140479 - RNA, 30 nt, Homo sapiens
acucaguauaugaccaacagagcagaacau

SEQ ID NO: 140480 - RNA, 34 nt, Homo sapiens
gacauuuuuuuucacuuauccauuauaaaaaguu

SEQ ID NO: 140481 - RNA, 49 nt, Homo sapiens
ugaauuugcauuuuccuuucugguugaaaucuugucaguuuacucaugc

SEQ ID NO: 140482 - RNA, 46 nt, Homo sapiens
gguuugaggaugguaacauuuacucguuguccuuugaccugaagau

SEQ ID NO: 140483 - RNA, 50 nt, Homo sapiens
auccauacugccaguacauuggccauuuguauuuauuaaaauugaucgau

SEQ ID NO: 140484 - RNA, 51 nt, Homo sapiens
uagaguuggcuaucuggauagagacagaguaaggauugaguggagcuuggu

SEQ ID NO: 140485 - RNA, 51 nt, Homo sapiens
gggcagaagugaguaaaagcugugucuagagaggaagaaacauuaguggga

SEQ ID NO: 140486 - RNA, 56 nt, Homo sapiens
ugagggauuguggcuggaguacuuagugaucugggaaggcuucauggaagagguga

SEQ ID NO: 140487 - RNA, 45 nt, Homo sapiens
aggcaucuucauuuugcaagagaauguauauuacauugucuuuua

SEQ ID NO: 140488 - RNA, 77 nt, Homo sapiens
gaaaggggcaagggaggcuggaggcuggcguccuucccacgcaccgauggcugugaucucuccgugcuggggagagg

SEQ ID NO: 140489 - RNA, 41 nt, Homo sapiens
ucuuccaaccagcaaaccgagaaagaaacaaacacccccaa

SEQ ID NO: 140490 - RNA, 42 nt, Homo sapiens
gcuguugcugcacuuccgcuucucucccagcgagagagagac

SEQ ID NO: 140491 - RNA, 44 nt, Homo sapiens
cucagcagcagccugaaaacuugcuacaaguaucucaaucagac

SEQ ID NO: 140492 - RNA, 46 nt, Homo sapiens
auggucaugucaucuuccaguguguccagagcucggagaaccagau

SEQ ID NO: 140493 - RNA, 45 nt, Homo sapiens
cacuguuugguauuucucagccagauuucuaaacucaagggagau

SEQ ID NO: 140494 - RNA, 32 nt, Homo sapiens
gaucucccuugaguuuagaaaucuggcugaga

SEQ ID NO: 140495 - RNA, 4190 nt, Homo sapiens
gcaugugaccucugaacaggagugggacaagguuagucucauaaaacagugucugugugugauguauuagacagagcuggcaguccucauagugaagcucagaacaagaaaaguuguccaguauuuucagccccucugguuuuacaauucaucuguuuagguugaaugucucaucauaaacaguuuauuccagaguuaauuccaaaccagcagcuauguaggauaucagccaggcuaggaguaggguacuggagagaagugcuuaucuagacaaagggauguaauugaccaugaagauuaaaacuacacaucaaaacauaagguaggguuaggagucuugccuauuuuucauaggaaugguguuugugagacuuacucaucacuucuguggaaguaaagacauuuuauuuauuuauuuuaaagccagucagauuuagcaggcagagacauuucagacaucuaaaguguugauguauuucauaccuuuaacugugcuuaaauuaggaucuccgaaaagaugcugcuacauggucacuacguuaguguagguccaaggucuugggccucuuaauuuuucaaaccucaaaacuugacagcaguuaucuuuggaacugcugauuugugcuuccuaaguuaacagcauacaaugacugcuagaaaucaauuucugcauuuaaggugaaguuagccggguacuaugguuuaccuguaaucucagcacuuugggaggcugaggugggaggaucauuugagcccaggaguuagacacaagccuaagcaacauagcgagaccccgucuuucaaaaaauuaaaaaaugagcagggaauugguggcaugugccuguggucccagcuacucuggaggcugaggugugggaggauugcuugagcccaagaguugaagguugcagugagccaugauugugccacugcacuccaacgugggugacagagcaagacaccaucugaaagaaaauaaaguugaaguuaaaacuucuggccaagaaccagcacugguuaugauaguaacucauuuucuguugugcagauuuauucaggaaacuuaauuuuagguuguugaauagaaguuuugaucagauaaaauugaauuaaaaaaaauuuuuuuugagacagggucuugcuguuauccaggcugguguguaguggugugaucacggcuccccgcagccucaaccuccugggcucaggugauccucccaccucagccuaccgaguagcuguaacuacagugcaugacaccauaccaggcucauuuuuguacauuuuuuguagagagaggguuuugccauguugcccaggcuagucucaaacuccuggcaucaaacaguccucccacucuggccucucaaauguugggauuacaggcaugaccagccaauuauuucaaggaguuauuuuuuuucuucuacuuugggggaagaugaauuauauaagucuccauuuuaggaguauuucuaccaaaagaacuauuaucuucaaauauauuuuuggauaguacuauagauauacuaauuuuuuuuuaaauuucuaguaauucuuuugaagauuuuguauagcuguccaaagccaauuucugucuaccuaauuucagcaagauuucacucuuuucauguuacuuuugucccagaacaaauuucaagugcuuucucuucaccugugcauucuucccccugauuagucucuggcuuuguauuacuuucagucagagacgacuuuuuuuuuuugagacagggucucacucugucacccagacuggaaugcaguggcacagacaaggcagccuugaccuucugggcucaagcaaucuuccuugcccucagccuccugaguaacugggaccacaggcacguugccaccaugccuggcuaauuuauuuuaauuuuuauuauuuuugagacaggguauugcucugucacccaggcuggaguguaguggcaugaucaaggcucacugcagccuucaccuccugugcucaagcaguccucucaccucagccuccccauuagcugggacuauagguccacaccacuacaccaggcuaauuuuuguaauuuuuugguagagacaggguuucaucguguugccuaggcuggucuugagcuccugggcucaagcgauucaccugccuuagccucccaggugugagccacuacacucagccuuuuaaaauuuuuuacagagaugaggucuugcuuuguuggccaggcuggucuaaaacucuugggcucaagcaguccccucuccacagccucccaaaauuccgggauuacaggcgugaacuucggucauuuccuaacuuuuacccuuccuaaugacacuccagagcuuaccuucuuuacuuuugcuucuuaaguuaacuaauagacaauuauuguauguggauauugcauuaaguugucuuaggauacccuuuucagaggaggacagcuuuugacaaauugcugucgcggaaaaaaaaaguauuuggcaauuaagaguugcauuuacugaaaucucuguugagagaggggaaguuacguugucucuaaaagaaaaacuaaaaagaaaaggggaaguuuuagcaaaguuguuaaagccugacacuuaagucauacuaccuaguuuugaacucuuagccccugccacagacacggcagccccuugaaccuuccuggguucaagcgagccuccuacuucagcccccugaguaacugggaccacuggccugugucacugugccuggcuaauuuuuuuuuuuucucacaugggcaauguugggcaaguuaaaucgacuucuuugugccucaguuuccucaucugaaauggagaucauacugcuauguaccugauacaauguuugugaggauugaaugugcagaguucuuuuuuucuguuguuguuguuuugagacggagucucacucugucgcccaggcuggagugcaguggcgcgaucucggcucccugcaagcuccaccuccuggguucacgccauucuccugccuuagccuucugaguagcugggacuacaggcacccgccaccaggccagcuaauuuuuuuguauuuuuaguagagacgggguuucaccgucuuagccaggauggucuugaucuccugaucucgugauccgcccgucucagcuucccaaagugcugggauuacaggcaugagccaucgugcccggcugaaugugcagaguucuuaaaaccgugucaagaacauaaaauaguuauuuguucuuucauauaaugaugauuuugagggccugcggaucuugacauguuaucagauuggucaaaaaaagauuaaaccauaguugguauuguccuaguuccuguuaccagaauauuccaucuuucaucguugccuucucucauaguuuuauguaucaaaaaguuuauuguaaagcuagggcgggcacggugucuugggcugguaaucccagcacuuugggaggccaaggcuggcagaucaguugaggucaggaguucgagaccagcguggccaacauggugaaaccccgucucuacuaaaaauaaaaaauuagcuggaugugguggugggugcuuuaauuccagcuacucaggaagcugaggcaggagaaucacuugaacccaagaggcagagguugcagugaguugagauugugccagugcacuccagcccaggggacaaagugagacuugaucucaaaaaaaaaaaaaaaaaaaaaguuauuguaaagcuagacacggugguauuugccuacaaucccagcuguucgggaagcugaggcagaaagauugcuuggguccaguaguuugagucuaacgugggcaaauauaugagacuccaucucaaaaaaaaaauaaaaaauaaaaauaaaaaaauguuuacuaguuuuuuucaguagccuuuuauuauaguagcaguacauguguauuguagaaauuuggaaaauacaagugaaaaauaaaaacaucaaauucccgucagccagagacugcuaugaaauguuuugagcacauccuucuugaauguuuuuuaaauccugguauguauauuuguauuuuaaaaucaaaaugcauucuuacccauucucuuuugaaccugcuuuuuuguagcuaaugaucucuaguguguccauuucaguaaaaauuccauuauuaaagugcuuuaaaaaucgucucuuacaguacugccacuaugu

SEQ ID NO: 140496 - RNA, 52 nt, Homo sapiens
ggccuguuuuugcagaaaacaaacaucauccgugacuaucuggaagaccagc

SEQ ID NO: 140497 - RNA, 48 nt, Homo sapiens
uuaagaaguuaggggauuuugcuaagccggagaauauugacuuggccg

SEQ ID NO: 140498 - RNA, 1143 nt, Homo sapiens
gguagggaagggggcuccucuggguggauacggggcuaaagggagugggguaggaguaaggguggauuuugcugugcuauauucaaggauaugauuccuuaaaaagacgaugacuccaguuuauuacgcugggaguuucauagcacccgccuuugcuuccagccaccaaacucagcucagccuugagguuaagccugcuccuuuucagaaccuucuuucuggauuuacuauuuucuacagcuauccuaaacuaguuagguucuuuuccucacaguuaagucaaggucuuuggcuuagauuuauggggagugcuggguaaaaccugggugaagcuguuaucauuaaaaagucuucauuaagcaccuaauuacugcuguccuuuuccuagacccggcauaaaaagaaccugguccgguagaccuagccucucaguaugcuaggaacuuacacuuuuuaguugccuuuaccaaguauugcagauacuacugcaaauaagugaagaaaguaacagcauuuaacugauuugggaacuugguuugaucuuguucuaaugaccaacuucgaauggugguugaaaguaaaaucuguaucgccgucuuauguuuccauuuaccuagaaauacuuuaccuuugagcacaggaaauuaauccccuucugguuguucucccccuggcauugguuuuaaauauauaaugauuauguuuguuguaggaaaaauagaaaaacaacuacaauagaaaauucuucccauauauuauuuugaaauacauauuuccgauccgauaauccauugcucuagcauggaaaauguuggauuuacuuguguuugcuuuuuccaaauaaaauggaacuuuuguggcuacauuauagaauuguuuuagacugcuuaauucuguguguuguugagaaagggaggaguggggaagguaaaaaucuugacauacuuucuucguggguauuuuuucuugagcgauuccaucuuaguugauuagcaguuagcaauugcccauucaacagaagguuuucuuaccuuuuugugauaaugauagcuaacgacaucauuucuucuuuuuucccucucuucuuguugucucuaggugauggccauugccacuuuggcugccuguuauaauaaccagcag

SEQ ID NO: 140499 - RNA, 31 nt, Homo sapiens
gcugucaaagccaucauauaucaguauaugg

SEQ ID NO: 140500 - RNA, 33 nt, Homo sapiens
uuguuuugcuagaagaugggucugagucgggga

SEQ ID NO: 140501 - RNA, 58 nt, Homo sapiens
ugacaaacgacagguagaugggggaguaguggcuucgggaaaucagcugacaguuggg

SEQ ID NO: 140502 - RNA, 99 nt, Homo sapiens
uggcugcccugagcuggcaguaccugaccacucucucccagguaacagaagacuauguucagacuggagaacacugaucccaaauuuguccauagcuga

SEQ ID NO: 140503 - RNA, 50 nt, Homo sapiens
guuguguucucuuuauuuuuuuccuacuacuuuaaucccuaaaagaacgc

SEQ ID NO: 140504 - RNA, 104 nt, Homo sapiens
cugcauaugugacugucaugagauccuacuuaguaugauccuggcuagaaugauaauuaaaaguauuuaauuugaagcaccauuugaauguucguaauaguaga

SEQ ID NO: 140505 - RNA, 59 nt, Homo sapiens
gaggcuggcgcggcgcggagagugggcuggaggccggggcgggacgcguugugcagcgg

SEQ ID NO: 140506 - RNA, 72 nt, Homo sapiens
cacggggagucguggggggaccagcuccugcaggaaggcgacgacgaaagcucagccguggugaagcuggcg

SEQ ID NO: 140507 - RNA, 68 nt, Homo sapiens
aauccccugcacuucuacgaagcccgauucagcaaccucuacguaaguucagcccccuccuggcacuu

SEQ ID NO: 140508 - RNA, 51 nt, Homo sapiens
cuggaggggagagcaagaauuguucgcagccacguacgcgucccaggcaga

SEQ ID NO: 140509 - RNA, 36 nt, Homo sapiens
gaacgaguuuuagggccccuggaccuacugcagcgc

SEQ ID NO: 140510 - RNA, 80 nt, Homo sapiens
gcaucaucuccacucaggacuuccccagggaaacgcaguauguggacuaugauuuccccaccgacuucccggccaucgcc

SEQ ID NO: 140511 - RNA, 75 nt, Homo sapiens
ccuuuucuggcggacaucgacacgagccacggcagaggccgaguccuguaccgagaggacaccucccccgcagug

SEQ ID NO: 140512 - RNA, 42 nt, Homo sapiens
gcgcgcacauagcgggcggccaggcccagcacugcgggggag

SEQ ID NO: 140513 - RNA, 46 nt, Homo sapiens
agcagguaggcgcuuacgaggaggucaagcgcggggcgcugcccuc

SEQ ID NO: 140514 - RNA, 46 nt, Homo sapiens
uuauuuuuagaaccaucucuaaguauacaaguauuucuaauuauau

SEQ ID NO: 140515 - RNA, 41 nt, Homo sapiens
ggaauuaaaacuuuugucugguccuuuucugggguggggga

SEQ ID NO: 140516 - RNA, 85 nt, Homo sapiens
gcugaguuauauagaucucuguaauguggggaauguuuuguuuaucuggaauuuaagucagguugaaagggcuaaaaagaaugga

SEQ ID NO: 140517 - RNA, 31 nt, Homo sapiens
uguugacuugguucaaagguugauagucauu

SEQ ID NO: 140518 - RNA, 47 nt, Homo sapiens
cuacagcccauccaagagaguucagacugagucugagauaucacugu

SEQ ID NO: 140519 - RNA, 44 nt, Homo sapiens
uagagaaauuccauaagauaaggagguuguagagacugugaaga

SEQ ID NO: 140520 - RNA, 31 nt, Homo sapiens
gguaggagagucacuggagaaggugguagag

SEQ ID NO: 140521 - RNA, 59 nt, Homo sapiens
ccaggcaguuuuggcaucugaugggucugauagcuacgcccucuuucuuuauccugcca

SEQ ID NO: 140522 - RNA, 53 nt, Homo sapiens
ggaggcugaugaucugaagucagaaggaccauauuucagcuugacuagcacug

SEQ ID NO: 140523 - RNA, 52 nt, Homo sapiens
uccuauuugaauauaaggacuuuuaggaaguaccugaacacaagugaccaua

SEQ ID NO: 140524 - RNA, 107 nt, Homo sapiens
gagguaggggugcccucgcuuuuauucguuuccugaauauagaagccagauagaauacauugguuacuuccuggccuccuuuaacugcuucuugacuucauuaaauc

SEQ ID NO: 140525 - RNA, 46 nt, Homo sapiens
uaagcaaccuggggaucccuggagugugggcuuuccauaucggcag

SEQ ID NO: 140526 - RNA, 90 nt, Homo sapiens
ccacucuucuguuccccugggacguuccuucagccaugcuacagcccuggaaagugacuauaaugaggacaauuuggauuacuaugaugu

SEQ ID NO: 140527 - RNA, 43 nt, Homo sapiens
auggccaauaaguagguguuggaugcaagggggaggacagauc

SEQ ID NO: 140528 - RNA, 41 nt, Homo sapiens
uaaaucugggcccccuaccucucccagagauguuccuucuu

SEQ ID NO: 140529 - RNA, 45 nt, Homo sapiens
ggaugagagagagaccagaagcccagcuccaccagagguagacag

SEQ ID NO: 140530 - RNA, 58 nt, Homo sapiens
guagggcuggaugcuuccguuuucgggguacgguggugggguuucccaggaaggagcc

SEQ ID NO: 140531 - RNA, 44 nt, Homo sapiens
auccagcccuacccagauggagggccagugccuucggaaaugga

SEQ ID NO: 140532 - RNA, 50 nt, Homo sapiens
guugugauuuuucucuuaaguggguaggugaaaaguuuagcaaaaagaag

SEQ ID NO: 140533 - RNA, 116 nt, Homo sapiens
gugcuggcucagaugaacaugccagauucauacucuguugugagacaagccuagcgcuucccuugguuggggagauaugcuugugaugugugggagaggagagcccacagggaaag

SEQ ID NO: 140534 - RNA, 29 nt, Homo sapiens
gaaugggguggaggauggguagagaauga

SEQ ID NO: 140535 - RNA, 45 nt, Homo sapiens
uaaggccaaguaucaaagauuuucacaaagggauuugagguaaag

SEQ ID NO: 140536 - RNA, 54 nt, Homo sapiens
guugucaagucaaaaaguuacccaagcaccugccguguaccugucucugacucg

SEQ ID NO: 140537 - RNA, 33 nt, Homo sapiens
aggggcuugagccaggccuggggucaaagucug

SEQ ID NO: 140538 - RNA, 48 nt, Homo sapiens
agaaaaguuaaaaacaaacaaaaaaaacauuaaauagaaaaaaaagag

SEQ ID NO: 140539 - RNA, 350 nt, Homo sapiens
uuuuaucugaauauuaugaaaacggcuuuuuuuuuuuuuuuuuuuugagauggagucucucucugucgcccaggcuggagugcaguggugcgaucucggcucacugcaagcuccgccugccagauucacgccauucuccugccucagccucccgaguagcugggacuacaggcgcccaccaccacgccuggcuaauuuuuuguauuuuuaguagagacgggguuucaccguguuagccaggauggucucagucuccugaccucgugauccgccugccucggccucccaaagugcugggauuacaggugugagcugccgggcccagccaaauggcuguucuuuagaccuau

SEQ ID NO: 140540 - RNA, 39 nt, Homo sapiens
aaguuaacacuucaaucgcgcuuaacauauacaagcuuu

SEQ ID NO: 140541 - RNA, 51 nt, Homo sapiens
acagcuugggccccacucgcagaucuuccaagaaauuauggaggacuagga

SEQ ID NO: 140542 - RNA, 42 nt, Homo sapiens
ucagucuucacguauaaugcugccaacaaggaaaccugugaa

SEQ ID NO: 140543 - RNA, 45 nt, Homo sapiens
cuucugccagcucauuagagccaaaguguaguggaguagaaggag

SEQ ID NO: 140544 - RNA, 56 nt, Homo sapiens
gguuuuucuaaagcaaagagccagccaaacaggccuccaauuggugugagggggag

SEQ ID NO: 140545 - RNA, 103 nt, Homo sapiens
cacucaaacugcugagggacuugacccagagaacuaccugagcauuaagaccaacauucaaggccaggugccuuacgucucagcaaauuucacagcccacauc

SEQ ID NO: 140546 - RNA, 46 nt, Homo sapiens
gagagaugugggcugugaaauuugcugagacguaaggcaccuggcc

SEQ ID NO: 140547 - RNA, 52 nt, Homo sapiens
aaccuuguuucagcugaugaguucaggcugcuuuaaaaaaaaaaaaaaucac

SEQ ID NO: 140548 - RNA, 44 nt, Homo sapiens
auaaugacgaagaaagagugcuuagauuugcugugaccaaucaa

SEQ ID NO: 140549 - RNA, 43 nt, Homo sapiens
auuuaaaccuacuggggagaauggucuuuaccuuuaaaugucc

SEQ ID NO: 140550 - RNA, 41 nt, Homo sapiens
gaaaaugucuuaagaaggauacuguguucuuuacuuacuau

SEQ ID NO: 140551 - RNA, 239 nt, Homo sapiens
ggaucuagauuaggagucacucugggcaagucuccccccauagcagugggguugugguugccaaguuaacuugagaguauagaccagguuccugagucagcaucuguuacaauggagaacaacagggucauguccucauugaaggcucaguauaagacaagaaccugauucucuccuguuguuauuucuccauuuuaauagaagauucuguacaaaguggggugggagacacgggucag

SEQ ID NO: 140552 - RNA, 45 nt, Homo sapiens
caggauuggcagauguacauguuccuauuuccauuuuacauggca

SEQ ID NO: 140553 - RNA, 46 nt, Homo sapiens
ccuggaagcuacaggugugagugccggagugguuaugaguuugcag

SEQ ID NO: 140554 - RNA, 51 nt, Homo sapiens
acuagaugggcgagcauauauggcuuccuuggcggagacguuccuguagca

SEQ ID NO: 140555 - RNA, 48 nt, Homo sapiens
uaauuuuuacagguuuaguuuuacagccaguuuuacagccuauuccag

SEQ ID NO: 140556 - RNA, 44 nt, Homo sapiens
cuauggauggaacuacugcuuuguuuuauuuucagccaagccuu

SEQ ID NO: 140557 - RNA, 20 nt, Homo sapiens
aauucucagagcugcuuuuu

SEQ ID NO: 140558 - RNA, 29 nt, Homo sapiens
uugguaaugguuugauccauagucgcucu

SEQ ID NO: 140559 - RNA, 44 nt, Homo sapiens
uggccccaacugcuaucucugacuggucucauguuugauggggu

SEQ ID NO: 140560 - RNA, 46 nt, Homo sapiens
gagaaagaaauucaugguuggguugaaaaguagcaaauaguaacga

SEQ ID NO: 140561 - RNA, 23 nt, Homo sapiens
ugugcuuuaaguugcaggaauua

SEQ ID NO: 140562 - RNA, 37 nt, Homo sapiens
agaggagaggaugcuggagaaagggggggaaagggca

SEQ ID NO: 140563 - RNA, 36 nt, Homo sapiens
auguggcugggccuugaugacagacccuccuggcaa

SEQ ID NO: 140564 - RNA, 40 nt, Homo sapiens
uaggagaaggaaggccaggaggccaggcauggggucuuga

SEQ ID NO: 140565 - RNA, 58 nt, Homo sapiens
guuuucucaaaaauggaggaaaaaaaaggguggcugucucgaauggcaucgacacagu

SEQ ID NO: 140566 - RNA, 46 nt, Homo sapiens
acagaucuggugaauccccgugccaucgcuguggauccaauccgag

SEQ ID NO: 140567 - RNA, 46 nt, Homo sapiens
cgucaucuuuagauggagaaaacagaagaauucugaucaauacaga

SEQ ID NO: 140568 - RNA, 42 nt, Homo sapiens
aauaauuauguuuaaugcccuacuuuggcagaaacuuaccag

SEQ ID NO: 140569 - RNA, 31 nt, Homo sapiens
uacuaaaaacuggagacuaguaauaggacag

SEQ ID NO: 140570 - RNA, 46 nt, Homo sapiens
auucaaaacaaccucaaguaccccuucagcaucguaagcuaugcag

SEQ ID NO: 140571 - RNA, 42 nt, Homo sapiens
uagaagugaucugcauagcuuacgaugcugaagggguacuug

SEQ ID NO: 140572 - RNA, 53 nt, Homo sapiens
guaaacauuuaucauuaauauuuaaaagaucaaauucauucaacuaagaauua

SEQ ID NO: 140573 - RNA, 46 nt, Homo sapiens
ccauggauuccuucuggccaagaaauuaaagcacaugugaucaaua

SEQ ID NO: 140574 - RNA, 51 nt, Homo sapiens
guacccacagaaaguaaaguaucacauuuauaaauaccaaagauguaacaa

SEQ ID NO: 140575 - RNA, 31 nt, Homo sapiens
uuaccuccugugucaaaaccaagaauauguu

SEQ ID NO: 140576 - RNA, 95 nt, Homo sapiens
uuauaaaugcuuauaaguacacuagacuguaagaacuccacuaaauuguuauaggcugguaucuuuugagaugacaccaaaauuaaaauugggag

SEQ ID NO: 140577 - RNA, 51 nt, Homo sapiens
uuagagcacuagaaaggcacuggggagauucucagcuuaaaacauccagca

SEQ ID NO: 140578 - RNA, 45 nt, Homo sapiens
caaguuccaaaugaggcagaagaauguccguaucucuccucuugu

SEQ ID NO: 140579 - RNA, 41 nt, Homo sapiens
aguagcaguaauuaaaacuucauuugauucgcaccuggggc

SEQ ID NO: 140580 - RNA, 44 nt, Homo sapiens
cgcggaaacgggcgggucuggcggcccaacccccugcugccagu

SEQ ID NO: 140581 - RNA, 48 nt, Homo sapiens
gguaagauguagccuguuauuccucugacgcuggaaugucguagagau

SEQ ID NO: 140582 - RNA, 44 nt, Homo sapiens
ccauuuggccaaagcaaucugcauggcugaguuuacagucaagg

SEQ ID NO: 140583 - RNA, 54 nt, Homo sapiens
aaagcagcgcuggggaguuugugggagacaaaggugaagaggagagugggaaga

SEQ ID NO: 140584 - RNA, 29 nt, Homo sapiens
cccacuuugagaacaccuggaggagcugu

SEQ ID NO: 140585 - RNA, 38 nt, Homo sapiens
gggagggggaaggcaggaaggaagggcuagggcaccag

SEQ ID NO: 140586 - RNA, 44 nt, Homo sapiens
ccaggucggcccccugcaaacaaaggguuuuccagccccauaug

SEQ ID NO: 140587 - RNA, 366 nt, Homo sapiens
uguguguguguuuuguuuuuuuguuuguuuuuugcccaggcuggagugcccaggcuguugugcaauggcacgaucucggcucacugcaagcuccgccucccggguucacaccauucugccucagccucccgaguagcugggacuacaggcacccaccaccaugcccagcuaauuuuuguauuuuuaguagagacgggguuucaccauguuagccaggaugcucuugaucuccugaccucaugaccucaugauccacccaccuuggccucccaaaguauugggauuacaggugugagccacugcaccuggccgaacccacauguuaaggccuggcagcuuccacuuuggugcucuggcggaagccag

SEQ ID NO: 140588 - RNA, 29 nt, Homo sapiens
ucuacccucuaaguuucugaucugacagg

SEQ ID NO: 140589 - RNA, 47 nt, Homo sapiens
auuuuaacauuuuuacaauaaaacaugagguggacaggccagcuugg

SEQ ID NO: 140590 - RNA, 37 nt, Homo sapiens
uucucuagccguuugcagaggccgccacccagcaggg

SEQ ID NO: 140591 - RNA, 45 nt, Homo sapiens
ucuuuccaagaaggaagagaccuacaacgaccucaucaagcagau

SEQ ID NO: 140592 - RNA, 46 nt, Homo sapiens
aacuggaaggugagcauguuuguggaaguccacaaagccauuaaga

SEQ ID NO: 140593 - RNA, 67 nt, Homo sapiens
cuugaccugugugucgguuacauugccagucccccaaagccccuuuagcuuccuucaaagagucacu

SEQ ID NO: 140594 - RNA, 45 nt, Homo sapiens
uaauccuggaguguagggggaaccuucagagcuguaggggguaag

SEQ ID NO: 140595 - RNA, 33 nt, Homo sapiens
ucuugugaugacuaaaugaaaaugcuuacaagg

SEQ ID NO: 140596 - RNA, 65 nt, Homo sapiens
uggcuuccuagauagagcuaaaccugagcugcagaggcccugcugccaaugggauugauugagug

SEQ ID NO: 140597 - RNA, 67 nt, Homo sapiens
gggcuugcccguuucccucugccccugacucccagccaucagguggccagggaacaucucuggaacc

SEQ ID NO: 140598 - RNA, 38 nt, Homo sapiens
cuugguuggacgagaaacuggccaggguggcugugagc

SEQ ID NO: 140599 - RNA, 38 nt, Homo sapiens
ugaaaaccugcucccaucuggcaggggcuugcccuccu

SEQ ID NO: 140600 - RNA, 67 nt, Homo sapiens
uucagggucuuaggucucagauuagacgguggaagaggaguuaugggugugagaggugcuugaugaa

SEQ ID NO: 140601 - RNA, 68 nt, Homo sapiens
uggcuguggcccugagugauuuggacucugcugcuugugugaucucgccuuucuggaccccugccguu

SEQ ID NO: 140602 - RNA, 40 nt, Homo sapiens
cugggcauuucucguggcggcaaaucauaaaaugugaggc

SEQ ID NO: 140603 - RNA, 48 nt, Homo sapiens
gcuccccagggagucucuccagcccuggacuuugcuccuccugcgucu

SEQ ID NO: 140604 - RNA, 44 nt, Homo sapiens
ugagcaccagcuucuccucccacuaguuuuccagauaagaggca

SEQ ID NO: 140605 - RNA, 47 nt, Homo sapiens
ccuguguugccaggccuagcucucaggaugcucagugagugugugga

SEQ ID NO: 140606 - RNA, 40 nt, Homo sapiens
gcuugggcaaccaauaguuacaagcacuuacuuggccaca

SEQ ID NO: 140607 - RNA, 50 nt, Homo sapiens
ugggcugggauguuaccugugucuccuugaaccaguuuugugggcuaggu

SEQ ID NO: 140608 - RNA, 27 nt, Homo sapiens
agaccuggcuccaaacaaaacacagcc

SEQ ID NO: 140609 - RNA, 46 nt, Homo sapiens
guuguagauggaagaggcuggagagaugggcaaauguugaaggggc

SEQ ID NO: 140610 - RNA, 41 nt, Homo sapiens
ucugcaggauggacccaacaggcuguagccacaggccaggg

SEQ ID NO: 140611 - RNA, 38 nt, Homo sapiens
ggcucagccucugaacugugugugugguuggugguggu

SEQ ID NO: 140612 - RNA, 194 nt, Homo sapiens
ucucaggagaugaccucaagccagaguggggucuuggauuagaaagaacagcugggaaccugggaggucaaagcugcaguuagccuggauugcgccacugcacuccagccugggcaacagagcaagagcuugucucaaaaaaagaaaaaaaagauuaaagaaaaaaaaaaaccuaacugguaaaggaagggaga

SEQ ID NO: 140613 - RNA, 100 nt, Homo sapiens
uauggggcgggacggggaggggcaaugaccaggcagucugccccaggagcuugcaccucccucuugggccugugaagauuguugcucuguaacugagcuu

SEQ ID NO: 140614 - RNA, 44 nt, Homo sapiens
uuauuucagguacucuuuacaguauguauucaaguaagcaagcu

SEQ ID NO: 140615 - RNA, 58 nt, Homo sapiens
ugcaaaaugaguguuuggugaggcuccaauagaguagaaacauuaggcaagaugucua

SEQ ID NO: 140616 - RNA, 64 nt, Homo sapiens
uuguggggaggggguugcuuuaugauuucccuugaggaaacaauuccucuagagaacaaguuuu

SEQ ID NO: 140617 - RNA, 25 nt, Homo sapiens
ugccuaucuagucgucgcucauuuu

SEQ ID NO: 140618 - RNA, 38 nt, Homo sapiens
gggaggagagugugugcggaauugggguggguggggga

SEQ ID NO: 140619 - RNA, 42 nt, Homo sapiens
caucugcucaaggaguucccgugccugggucaggagggccug

SEQ ID NO: 140620 - RNA, 42 nt, Homo sapiens
gggcccucugcucaccucggccaucaucuucuaccuggccau

SEQ ID NO: 140621 - RNA, 53 nt, Homo sapiens
cuccaaauucaaacagcuguuuucagaggcuggagggcgggcggacugguagc

SEQ ID NO: 140622 - RNA, 89 nt, Homo sapiens
ggccccacgcagcuccccgcacuccgugggccaacuuggccaagcaacucuguccggggagcggugcuugcggggggugaguaccgggc

SEQ ID NO: 140623 - RNA, 42 nt, Homo sapiens
ucccgcuccuuacgcauccgcgguccagggcgcccuuucagc

SEQ ID NO: 140624 - RNA, 41 nt, Homo sapiens
uggggcaugguauuaagugcaagaagugcggagauggagac

SEQ ID NO: 140625 - RNA, 95 nt, Homo sapiens
cccaccaccaccucaggucccaggcaggccaggucuagagggauaaaaagaagggucccuggcccacccccugcccaccccccacccgccacccc

SEQ ID NO: 140626 - RNA, 42 nt, Homo sapiens
auccaacauucuuaggaucaggguggugugugugugaggggg

SEQ ID NO: 140627 - RNA, 46 nt, Homo sapiens
ggggaccagugcccacagcuuaccuauccucaccccuugccucccc

SEQ ID NO: 140628 - RNA, 54 nt, Homo sapiens
cuugccaaccucucacauugugccuuaauuuuuauuuuuuuuuaaaggagggaa

SEQ ID NO: 140629 - RNA, 30 nt, Homo sapiens
ggagacagacaaaugaacaaauaaaccaau

SEQ ID NO: 140630 - RNA, 48 nt, Homo sapiens
gacuacaggcacacgccccccacaccuagcugaaucuuacgaggcaag

SEQ ID NO: 140631 - RNA, 46 nt, Homo sapiens
gggaauguauucugccuuggcagguuuuugugauauaggugaggag

SEQ ID NO: 140632 - RNA, 58 nt, Homo sapiens
acaauuaaacauuuaaguccagguuucaagucaguguaacaacugaagcaaugugcag

SEQ ID NO: 140633 - RNA, 36 nt, Homo sapiens
gagcagaaguugagugugcauaccaagagucuacaa

SEQ ID NO: 140634 - RNA, 39 nt, Homo sapiens
ucugcuguuuccgcuucauaugaaacaaccuugucucaa

SEQ ID NO: 140635 - RNA, 46 nt, Homo sapiens
uuugccacuuuuuguugugagacguaugaagaaaaugugucauuaa

SEQ ID NO: 140636 - RNA, 57 nt, Homo sapiens
cuaggucaaaaugaaauuccucagcacugaagacggugagaaaaacaaacacacaaa

SEQ ID NO: 140637 - RNA, 51 nt, Homo sapiens
uucuuaugcucauaaagcaucuuccauugccaaauccuccagcuuuuguuc

SEQ ID NO: 140638 - RNA, 45 nt, Homo sapiens
ucagaaggaauaauugaggaauaccuagcauucgaucacauagau

SEQ ID NO: 140639 - RNA, 46 nt, Homo sapiens
gagaagagggauuucaugggaagaaaucagaagcagcuacagagaa

SEQ ID NO: 140640 - RNA, 62 nt, Homo sapiens
gacuauccaagagccccuaaccaccggucauaucauuagcauacaaaaaaaaacaccacuuu

SEQ ID NO: 140641 - RNA, 53 nt, Homo sapiens
ggguauuauaagaguuuuaggagcuaugugccucaaccaggggcagagaccaa

SEQ ID NO: 140642 - RNA, 55 nt, Homo sapiens
uaucaguaugcauguauugagugccaaccaagcaaccacaaaaacuccuggggag

SEQ ID NO: 140643 - RNA, 47 nt, Homo sapiens
uucugguggguaaguguagguuuugaacuuguccuugaaagaugggg

SEQ ID NO: 140644 - RNA, 55 nt, Homo sapiens
aucuaaaagucaccuggcuagagaagacaaucaaauccagaaguucauagaacaa

SEQ ID NO: 140645 - RNA, 24 nt, Homo sapiens
caccaggagacgcaauccaccacc

SEQ ID NO: 140646 - RNA, 79 nt, Homo sapiens
ucagauggaagcaaaguacugcaaaucuuccaaaggaggagggaaaaaaucugcucucaagaaagaaaagaaauaaugg

SEQ ID NO: 140647 - RNA, 48 nt, Homo sapiens
aacauuccaaagaaaauauuagcaguaggaaucagaucauuaaagaug

SEQ ID NO: 140648 - RNA, 45 nt, Homo sapiens
aggaagaggccaaagaagcagaaaugagcagaaaggaguuggggc

SEQ ID NO: 140649 - RNA, 49 nt, Homo sapiens
gugcagccucuuaucuaggcaaaacaggcccuucaaauuuucaccggaa

SEQ ID NO: 140650 - RNA, 67 nt, Homo sapiens
gagaggucccauccuauaaugccuuugucaaagaaucgaaacaaaagaugaaugcaaggaaaaggag

SEQ ID NO: 140651 - RNA, 46 nt, Homo sapiens
aaagcacagacuccaugaucugauccaugucacccuugaaguccag

SEQ ID NO: 140652 - RNA, 49 nt, Homo sapiens
cugauauuaagcaggccuaucuggacuucaagggugacauggaucagau

SEQ ID NO: 140653 - RNA, 59 nt, Homo sapiens
gaacaguggacgaggacucuccugugcucacccaagaccgagacugggaggcguauugg

SEQ ID NO: 140654 - RNA, 45 nt, Homo sapiens
gcucucuguucucugucacugagaacggaauagacuuuucccagg

SEQ ID NO: 140655 - RNA, 56 nt, Homo sapiens
aaaagucuauuccguucucagugacagagaacagagagcaguguacgaugagcagg

SEQ ID NO: 140656 - RNA, 43 nt, Homo sapiens
agugcauacuauaucauguuucuuggaagcuccugucagcugg

SEQ ID NO: 140657 - RNA, 44 nt, Homo sapiens
augaaaaaaugaggaaguggggcaaaggauggggcacgccugcu

SEQ ID NO: 140658 - RNA, 45 nt, Homo sapiens
caugauggcggcugaagggagacuacggcagcacuagcuuagcag

SEQ ID NO: 140659 - RNA, 40 nt, Homo sapiens
ggaggcuugagaaccacggggguuggcacuggcuggcaag

SEQ ID NO: 140660 - RNA, 41 nt, Homo sapiens
cuuaccccaccuuuguucucuccagcgaacugugacugucu

SEQ ID NO: 140661 - RNA, 46 nt, Homo sapiens
cccuggaacucugccacuguccuucagcaaacguaccaugcccaca

SEQ ID NO: 140662 - RNA, 45 nt, Homo sapiens
caccaccaucgagaaccagcccugguuugcggccaucuacaggag

SEQ ID NO: 140663 - RNA, 44 nt, Homo sapiens
agugauuacccaaagaaggaggacuacaucgucuaccugggucg

SEQ ID NO: 140664 - RNA, 46 nt, Homo sapiens
ugugcgcagccaucccggacuauacagaccaucugccugcccucga

SEQ ID NO: 140665 - RNA, 47 nt, Homo sapiens
gacuguugugaagcugauuucccaccgggagugucagcagccccacu

SEQ ID NO: 140666 - RNA, 91 nt, Homo sapiens
aacgggcaccacccgcuuucuugcugguugucauuuuugcaguagagucaucuccaucagcuguaagaagagacugggaagauaggcucug

SEQ ID NO: 140667 - RNA, 75 nt, Homo sapiens
ggaguuaaaaagggcagggcaucuccugugcaugggugaagggagagccagcucccccgacggugggcauuugug

SEQ ID NO: 140668 - RNA, 55 nt, Homo sapiens
gaaguguaacagcugaggucucuugagggagcuuagccaaugugggagcagcggu

SEQ ID NO: 140669 - RNA, 43 nt, Homo sapiens
ugucucaguuucacuuucacauagaugucccuuucuuggccag

SEQ ID NO: 140670 - RNA, 41 nt, Homo sapiens
uuauauuucacuauuuuuauuuauauuuuuguaauuuuaaa

SEQ ID NO: 140671 - RNA, 37 nt, Homo sapiens
cgcugcacagucugucucuucgccgguucccggcccc

SEQ ID NO: 140672 - RNA, 80 nt, Homo sapiens
ccugguggcucugcagaccccuguaacccacagcugugacucauaaccgaggugauuccuggaggagguggagcccacgu

SEQ ID NO: 140673 - RNA, 48 nt, Homo sapiens
uuauccaaaaggaugaacaaagagagcaggaggggaaggaggaugaga

SEQ ID NO: 140674 - RNA, 37 nt, Homo sapiens
uuuuaaacacagagagugaguccaauucaauaaugaa

SEQ ID NO: 140675 - RNA, 23 nt, Homo sapiens
ugaucauuuauagcucauaaaau

SEQ ID NO: 140676 - RNA, 56 nt, Homo sapiens
uguggcuaugaaacaagcuuaccuucacaucauucuucucauauaggccauucaug

SEQ ID NO: 140677 - RNA, 40 nt, Homo sapiens
uccacagcauuucuuuuuugagaaauuagaguagauacag

SEQ ID NO: 140678 - RNA, 32 nt, Homo sapiens
uugcuuucuggcugauuugggcccagccuuuu

SEQ ID NO: 140679 - RNA, 24 nt, Homo sapiens
uagugggccacauaaguucaggug

SEQ ID NO: 140680 - RNA, 37 nt, Homo sapiens
gaagcagcaguuuccugucuacagcacagcuccccag

SEQ ID NO: 140681 - RNA, 41 nt, Homo sapiens
gaaagcaggccaaaggcccuuuugcauaauauggcaguaag

SEQ ID NO: 140682 - RNA, 36 nt, Homo sapiens
ggaaugagaaaagcacguucgguuagagggcaguga

SEQ ID NO: 140683 - RNA, 36 nt, Homo sapiens
cuccacaucuccucucuacccaguaccccauuuucc

SEQ ID NO: 140684 - RNA, 29 nt, Homo sapiens
ggaaacuuuuuuuuauucucuacuccauc

SEQ ID NO: 140685 - RNA, 94 nt, Homo sapiens
uaaacugacauauucucuuuggaaaaucacuugcuagaauuuguuagcggacauaaaaaaagucauaccugggaauuccacuuaugagaauaua

SEQ ID NO: 140686 - RNA, 46 nt, Homo sapiens
gcauaucucucuucaaaaucugauccucagugguuugaacagucuc

SEQ ID NO: 140687 - RNA, 48 nt, Homo sapiens
aucucaagauccuaucauaggcuauuugugugauuggcaauuagggca

SEQ ID NO: 140688 - RNA, 118 nt, Homo sapiens
uaggaauaguagaaagagcguuuauguaggaaguggggcuugggaggaugguuagauguagggaggaaggaaaauacucuaggugcaaugaauggcaugaccaagucaugagggccug

SEQ ID NO: 140689 - RNA, 49 nt, Homo sapiens
agccaggcaaaggaauuuagaauugggcaggagggaagcuuuguaguug

SEQ ID NO: 140690 - RNA, 33 nt, Homo sapiens
ucugcacugacgcuagauuugacaagagaauaa

SEQ ID NO: 140691 - RNA, 46 nt, Homo sapiens
caucaauuagauaaucucgagcaggcacugaguaagggucugacug

SEQ ID NO: 140692 - RNA, 46 nt, Homo sapiens
cgagauuaucuaauugaugggucaaggggcauccucucuggaacau

SEQ ID NO: 140693 - RNA, 42 nt, Homo sapiens
cuauggaagauuuggucacuuacacaaagaaucuugggccag

SEQ ID NO: 140694 - RNA, 46 nt, Homo sapiens
ugcauaaauuagaguucagugauggugucuguuguuuaaauaagug

SEQ ID NO: 140695 - RNA, 46 nt, Homo sapiens
uccuucuaaaucaguuaucauccuggcccucacccuggcuccaucu

SEQ ID NO: 140696 - RNA, 50 nt, Homo sapiens
caaggcauagaggaagcuuuaaaaaaucgcaauuuuacuguagaaaaaau

SEQ ID NO: 140697 - RNA, 76 nt, Homo sapiens
gugccaucaagagcugcuucucucauuaaaaaaauguagucaguugaguuuucagggcuaggauuaggcacuuggg

SEQ ID NO: 140698 - RNA, 55 nt, Homo sapiens
uuuaccaguuuucacaguuuuagcaauagggaacccaauuccacucuguuuagca

SEQ ID NO: 140699 - RNA, 46 nt, Homo sapiens
ugaagagagcauuggccuccauagacuccaaacugaaccaggccaa

SEQ ID NO: 140700 - RNA, 57 nt, Homo sapiens
aacucugugcaggcaaagaacgcagggagauucugggaacuugcaaaaugcuagggc

SEQ ID NO: 140701 - RNA, 20 nt, Homo sapiens
caucuauaccaaaacuugag

SEQ ID NO: 140702 - RNA, 47 nt, Homo sapiens
aaaaagccaagcauguucaugaaaaccacauguacugugcuauuggg

SEQ ID NO: 140703 - RNA, 46 nt, Homo sapiens
aaagcucagcagguaucucagggucuggaugugcucacagcaaaag

SEQ ID NO: 140704 - RNA, 45 nt, Homo sapiens
gguggaccggaaggagaagagcagauucgaggugcuuuggcugaa

SEQ ID NO: 140705 - RNA, 26 nt, Homo sapiens
uaagaaaaaaaccccugcagcacaug

SEQ ID NO: 140706 - RNA, 50 nt, Homo sapiens
uuuauuucuguguugauacuugguugagguucuuugguuggaaggaccug

SEQ ID NO: 140707 - RNA, 46 nt, Homo sapiens
gccggucugcuguuggccacagcccgguugguuuuggucugcaggu

SEQ ID NO: 140708 - RNA, 42 nt, Homo sapiens
cacggcccugcagaaccugcagaccaaaaccaaccgggcugu

SEQ ID NO: 140709 - RNA, 46 nt, Homo sapiens
cuuguggccgaagggcaucgucuggcuaauguuaugauggggccuu

SEQ ID NO: 140710 - RNA, 46 nt, Homo sapiens
aguggaccagcugacagcccagcuggcugaccuggcugccagaggg

SEQ ID NO: 140711 - RNA, 54 nt, Homo sapiens
augcaagugcucgugccugaggacucuccccuuccccucuggcagccaggucag

SEQ ID NO: 140712 - RNA, 42 nt, Homo sapiens
uuuaaggaucuaaaagcucggaugcaggaggccaugacucag

SEQ ID NO: 140713 - RNA, 45 nt, Homo sapiens
cugacacuuccugagucauggccuccugcauccgagcuuuuagau

SEQ ID NO: 140714 - RNA, 45 nt, Homo sapiens
aagcuguuggcaguggcagccacggcgccuccugaugcgccuaac

SEQ ID NO: 140715 - RNA, 46 nt, Homo sapiens
uaaauagacaacuauggaaaugucaagaagcauuacauuuuuggaa

SEQ ID NO: 140716 - RNA, 1901 nt, Homo sapiens
uuccacggccugaggugguuucucuugaggugagcaucuuaaggaacaaauguaaaaagagagacccuaucuaucuaucaguagugcacuacaaguuaaacaaugguuauguguauuuuccagauauauuuauucaguaaauuaaagaagauaugccuguuugagcuuuuuauguccacaguacuguacuuuauacauaguagguaacugagaaguaucuugauuuuaaaaaguuuagcaguuggaaauuuuauaaagauagggaucuuuucaccuugucacuuagaaacaacuauccuguuaaaccauaacagacaauaugcacuaaaucaugagaugacaacacgccuaacucaaaugcuuuugcugcuugcugauguuagaaguagcaguuuagucccuucaccaaaaauuuaaccauagcuaauuaaaugcauauuaucauacaauauaguauggcuuuugucuguuuuauuuuguucaguucaagaagagauugggaagaugguuagcaaaaauaaacuauauuugguauaugaauauguuugugaugaaugggaauuuacuacauauggaauaguuucauuuuguauuuuuaaugaccuuucucaaauacaguuuugcuuucuccccaacuggggauaaauagacucaaaauuagaggcugagaauuuuccccucaauuuucugugucaucuaggguaauaaaacaaggcagugaucaaggauacaaaaaacucugguacaaaguugugucuuggacaugcuuuuucuuuguuugauucuccuauaccuuacucuggcauauacaggacccacacaaugggaguuacuccagcugugaaugucagggaaacucccaaccacgggccucagaugguauuuuucuuaacuagucuuucacagcaggaugaccuuuacuuuauguaugucaggcuguuucucagaccacaugcauggauauauagacauauagaaucccucaccauuuucaacuuucagaacugcuguauuuaaugcuuggagugaauauuuuuguguuucuagugcuaucucauuggcugaauuuccaaaaaugagauugauagugaugaucuaauaucaguugcccuccuaugacacagggcuuugggcaguuuaguucucuuugaccucccuagggcagucacccaagaaaccaaagcuagacacaacacagcaauguuucaugagcuucuaaagccuauagacuucuacagucagaccaauaauacagcaucucaacuuccaagcuauuuguauuaaaaaugguuaaauuauauugacauuuugucaucacaaaaauggggaaaaauuauaguggauauauauuuccuacacaauuaaggguccaauaucucuaauuccuguacuauaacacacuaguuguauuucaguuccugaucucaucccaggucaaaucuuuugauguuaauccugaagcaugauuuauguuugauaauuucauuguaauaauuucaguaugggguaaucauuugguaugggauuuggaauauuaaacaaaaacauuuaaugauuauaucaccauaaaugauacuauuagcaauaaucaugaaguuggccacaagagggcguguaaaaucacaauaaaauucuaaaaccuguaauucugccaggcucugguuuuacugagaaauuugaaaauuaacacuaguaaguagccagauuuuuuucuaaaauuaacauaaaauauucuguagaggaaaugcauucuacauauauguguguguguguguguguguauacacgcauacacacucuuaagugaauaaacauuuagacuauuaugaagagccaaguucaauugcuugauaugcuuuuuuacuuuuggauuuuuuuuuccagacucguuacugggcauc

SEQ ID NO: 140717 - RNA, 62 nt, Homo sapiens
uacaaccugacucugacauucuccugcuuaaacccuucaguggggccuguacuuucacagag

SEQ ID NO: 140718 - RNA, 28 nt, Homo sapiens
uagcugcccucucaucaaauaccuugag

SEQ ID NO: 140719 - RNA, 46 nt, Homo sapiens
agcuuggugcuacggccgagaaggcggcugcgguugguacugcuaa

SEQ ID NO: 140720 - RNA, 46 nt, Homo sapiens
gccgucuucacugaggccugaaugccuuccacuguugauuuauuag

SEQ ID NO: 140721 - RNA, 46 nt, Homo sapiens
aggcauucaggccucagugaagacggcccgagaacucacaccccag

SEQ ID NO: 140722 - RNA, 32 nt, Homo sapiens
gauguuaaguuuuuaaguugguugaguacaaa

SEQ ID NO: 140723 - RNA, 47 nt, Homo sapiens
gccugaaggugaggucccuccaccuaggccuccaccaccagaggaaa

SEQ ID NO: 140724 - RNA, 54 nt, Homo sapiens
uacugcucacuuuucaucauuuaggggaaaauaggcaaaaguuauucauagggc

SEQ ID NO: 140725 - RNA, 43 nt, Homo sapiens
ccucaaagaaaauuccauauaaacuacuuccucuugaguacag

SEQ ID NO: 140726 - RNA, 43 nt, Homo sapiens
augguagaagcuuugccucagaagaccuugaggggauagagag

SEQ ID NO: 140727 - RNA, 34 nt, Homo sapiens
guguuggaggggaggguaugagagggagaaaagc

SEQ ID NO: 140728 - RNA, 46 nt, Homo sapiens
gagcgaaucccaaccauaagcacccagcucaaaauccuguccacag

SEQ ID NO: 140729 - RNA, 46 nt, Homo sapiens
gguggccuucacuguggacaggauuuugagcugggugcuuaugguu

SEQ ID NO: 140730 - RNA, 46 nt, Homo sapiens
agaucauuuuccuucuuuuuaguagagguuucugugccagccaggc

SEQ ID NO: 140731 - RNA, 45 nt, Homo sapiens
gaguugcugggagcugaaaaaucacauccuggccuggcacaucag

SEQ ID NO: 140732 - RNA, 53 nt, Homo sapiens
aauguguuucuguauaaagccuguauucucaaacacaguuacacuugugcacc

SEQ ID NO: 140733 - RNA, 53 nt, Homo sapiens
ggagccaaggaaagagaaacagagggaaguguccccuagggaacaagggcaga

SEQ ID NO: 140734 - RNA, 59 nt, Homo sapiens
aaaacaauuuugggaggcacagcaauuuucuucuuaguaacugauuugccugggcccug

SEQ ID NO: 140735 - RNA, 43 nt, Homo sapiens
gggaagguggccucuguggagccccagcauaugggggccugga

SEQ ID NO: 140736 - RNA, 157 nt, Homo sapiens
aaguacaguuuuauauugugggaaacuagaaggauuaaacugaggaagggcaggaaaugaauccaggcccccauaugcuggggcuccacagaggccaccuuccccuguagcagcaaagcucacuucugaaaaggacccagguagcacagcccaggga

SEQ ID NO: 140737 - RNA, 57 nt, Homo sapiens
uuuaccaugccccugagcaaugucugugcuagggaaacuucccgucccauauccugc

SEQ ID NO: 140738 - RNA, 44 nt, Homo sapiens
uguucaugggauggcuaccuuggcgggcugaggcaggauauggg

SEQ ID NO: 140739 - RNA, 45 nt, Homo sapiens
ccaggguguggcccugccaucuucccagcagggccacucccggca

SEQ ID NO: 140740 - RNA, 41 nt, Homo sapiens
aggcagugacuaagcauggagugccgggaguggcccugcug

SEQ ID NO: 140741 - RNA, 49 nt, Homo sapiens
aguauuucccagcacaugaaaccuuauuuuuucccaaagccagaaccag

SEQ ID NO: 140742 - RNA, 47 nt, Homo sapiens
uaaaggcauuaauauugcauuuauaucaggcaagcaacuauacaaau

SEQ ID NO: 140743 - RNA, 46 nt, Homo sapiens
gauauaaaugcaauauuaaugccuuuaaaguaugaaucuaugccaa

SEQ ID NO: 140744 - RNA, 58 nt, Homo sapiens
agcaaauuaaaaaaaaaaaaaaaaaaaaucccugaaugaugauuagagacaucaccgc

SEQ ID NO: 140745 - RNA, 65 nt, Homo sapiens
cucagacuguggccagaauggugaugcuuaagccaaguaugaauggcuauuaacauacugagguu

SEQ ID NO: 140746 - RNA, 48 nt, Homo sapiens
cauuuugguagcucuggcugugcuaucaauaaaaagaugaaagcaaca

SEQ ID NO: 140747 - RNA, 48 nt, Homo sapiens
uaggggaaauucccuuuucauauugugugcuucccaaagcuauaguca

SEQ ID NO: 140748 - RNA, 45 nt, Homo sapiens
ugguauuguauuuuuuauaaauaagauuuuuauguaaagcuuaga

SEQ ID NO: 140749 - RNA, 49 nt, Homo sapiens
accuucugaucuuagccaucccaaaccaguaucugucccgagaggaaau

SEQ ID NO: 140750 - RNA, 29 nt, Homo sapiens
aagcuguagugauaaccucucuccuaaaa

SEQ ID NO: 140751 - RNA, 46 nt, Homo sapiens
aaaguuccaagugaggacaugagaagaggccaaaauuccucaggac

SEQ ID NO: 140752 - RNA, 52 nt, Homo sapiens
auaaaugguucuauuuguuuuucauuuuuugucuuuuuaagguacuaacaug

SEQ ID NO: 140753 - RNA, 42 nt, Homo sapiens
accgugucagcucacaaaaguauguugaugcaucagccagaa

SEQ ID NO: 140754 - RNA, 47 nt, Homo sapiens
guugugagccagucugucugugauuauuucuuugaagcucaagagaa

SEQ ID NO: 140755 - RNA, 72 nt, Homo sapiens
cuuccaagaauauuuugacuauuguaaaugcauugcuugugaauuacccaggaugauuauaaaauguuuagu

SEQ ID NO: 140756 - RNA, 43 nt, Homo sapiens
ucacugcgaugcccucacucccugccuuaucugauaaagaccu

SEQ ID NO: 140757 - RNA, 25 nt, Homo sapiens
gagucugaggaaacccaaccugcug

SEQ ID NO: 140758 - RNA, 41 nt, Homo sapiens
ggauggcuggaguuuucucuguguuuuguuucccugggcug

SEQ ID NO: 140759 - RNA, 34 nt, Homo sapiens
gggguggugccggagggggggaugaugggucgag

SEQ ID NO: 140760 - RNA, 38 nt, Homo sapiens
gcaccuccuccaggcggcagccgcaguuucucaggcag

SEQ ID NO: 140761 - RNA, 45 nt, Homo sapiens
gccccgccccccuccgcccucgagccccgcccccuugcccuagag

SEQ ID NO: 140762 - RNA, 43 nt, Homo sapiens
gagcgguggggggccggcgagggugugaggaagacuagugagg

SEQ ID NO: 140763 - RNA, 43 nt, Homo sapiens
uccacauccaccacacccaaacccaccuacucugcgcccagac

SEQ ID NO: 140764 - RNA, 54 nt, Homo sapiens
ugggcgcagaguagguggguuugggugugguggauguggaguagaguugaagcg

SEQ ID NO: 140765 - RNA, 99 nt, Homo sapiens
gaaggagguuugcuagcuuugggguaugaaguauuuuuuaaaaacguggaaggaugggaugguugugcuugggagaguuucugaaagaugaugcuaaga

SEQ ID NO: 140766 - RNA, 102 nt, Homo sapiens
uuagaacuugcaaaaucuguggcagaaaaucuccuggggacaagggauugguaggggugggacaaggcggcaggugugaagaaaguggguggagcuguacag

SEQ ID NO: 140767 - RNA, 47 nt, Homo sapiens
uucauuauguuaaacuugaucuggagucuucaagggaguguccggca

SEQ ID NO: 140768 - RNA, 81 nt, Homo sapiens
gguuagauuacaaaugguguccuaugccccaugaaggaguuuaagcccuguaauugguagaagguguugggacguguuaaa

SEQ ID NO: 140769 - RNA, 98 nt, Homo sapiens
gagaguguuagacagaaguugugaagggguagugauaaagaauuacagaugugggaaauaggaaaugaagaccaacgaaccaaguauguuugggguug

SEQ ID NO: 140770 - RNA, 42 nt, Homo sapiens
gaucuggcuuucagucuccuaguucucuacaguguacccuca

SEQ ID NO: 140771 - RNA, 32 nt, Homo sapiens
aaccuucaaguuuuuauagaaaaaaaaugaaa

SEQ ID NO: 140772 - RNA, 40 nt, Homo sapiens
caugaugagauuuuuucuuaggaaucuaucacaaaccuga

SEQ ID NO: 140773 - RNA, 51 nt, Homo sapiens
agaucugggauuuuuaguuggacugcaugcucaccaugaccacuugugugg

SEQ ID NO: 140774 - RNA, 90 nt, Homo sapiens
caauagccaaacuagugagcaaccaagagaaaguggugcuuugaaacaaugugauauguggaaggguuaagaaacugggauaugaguggu

SEQ ID NO: 140775 - RNA, 50 nt, Homo sapiens
cacauuugaaagucauuuacaauucaacaaauggacagaguauuccagac

SEQ ID NO: 140776 - RNA, 46 nt, Homo sapiens
guucucaaagucaccaacaaaggccuugccuccuauaaggacccag

SEQ ID NO: 140777 - RNA, 44 nt, Homo sapiens
aaugaucuccgcaauguggauuggaauaaacuuuuaaggagagc

SEQ ID NO: 140778 - RNA, 31 nt, Homo sapiens
uauuaucuccuugacuugucacaauaacugc

SEQ ID NO: 140779 - RNA, 46 nt, Homo sapiens
auuaaaccacugaagauaaaacuuuaucuuugacuuggugagggaa

SEQ ID NO: 140780 - RNA, 52 nt, Homo sapiens
ucacauauucuaagagagacuuccauuaucacugcgcacuuuguagcauuaa

SEQ ID NO: 140781 - RNA, 46 nt, Homo sapiens
uuucacuuuagugagaaugucuucauaaaauuuauuaagugucaag

SEQ ID NO: 140782 - RNA, 48 nt, Homo sapiens
uauuguaaugugaaagacgagguggaucaaauacuugcuguuccaggg

SEQ ID NO: 140783 - RNA, 87 nt, Homo sapiens
ggccuuuuccugucuguagcucgacaggcguuacagaagagcaaccuaacuuuacuuacaaguucaauuuuucuuccucaguauuuu

SEQ ID NO: 140784 - RNA, 45 nt, Homo sapiens
gcgacucuuccacaauucaagggaaggaguggaacuagccuggug

SEQ ID NO: 140785 - RNA, 39 nt, Homo sapiens
aaacagaucauaaacauuaucuugggaaagagaaacaua

SEQ ID NO: 140786 - RNA, 33 nt, Homo sapiens
aauuuugacuaaacuguuggaaacuaaauuaca

SEQ ID NO: 140787 - RNA, 39 nt, Homo sapiens
ugccgaauuuuuugcguaauaguauaguauauaagagaa

SEQ ID NO: 140788 - RNA, 51 nt, Homo sapiens
cacugggugaaagguuacucacaugcuuucaaaguaucauugcacagauua

SEQ ID NO: 140789 - RNA, 48 nt, Homo sapiens
gaucaugagucaaggaauaugcgcagccucuagaagcucaaaaaagca

SEQ ID NO: 140790 - RNA, 45 nt, Homo sapiens
auuuuauagcagaaugaaauaaagagcuagcauugagaacacuuu

SEQ ID NO: 140791 - RNA, 55 nt, Homo sapiens
uccaacaacuuguuaguaaguuauuuugagugccacugagauuuccaggccagau

SEQ ID NO: 140792 - RNA, 168 nt, Homo sapiens
gguuguuuuaagaucaguuuuuuguuuguuuauuauauuuuaagagacggugucccugucuugcccaggcucgucuugaacuccugagcucaagcaauccuccugcuucagcuucccaaauaacuggaauaaaucugccauauuuuuucuauauggcuuccauuucag

SEQ ID NO: 140793 - RNA, 43 nt, Homo sapiens
uagcuucuuaacuugggcuguuccacaucuuaaucuaggauga

SEQ ID NO: 140794 - RNA, 62 nt, Homo sapiens
aaacaagcaaaaugaaaaugaaaagaucaaaugcauuuauuugaaauuagucaguaugugac

SEQ ID NO: 140795 - RNA, 46 nt, Homo sapiens
cccauaguuuacauuaggguuuacuccugguguuguauauucuaug

SEQ ID NO: 140796 - RNA, 42 nt, Homo sapiens
cugcuuucauaguuacacagaauuauuucucaauuuaaguag

SEQ ID NO: 140797 - RNA, 44 nt, Homo sapiens
gguuaaucuuuuuuucaaagcaucaaaaauaauuaagaugaaau

SEQ ID NO: 140798 - RNA, 53 nt, Homo sapiens
uguaaaagaaaaaaaaaaagcaugcugguuguauaaaaagaaacauuuuaaac

SEQ ID NO: 140799 - RNA, 79 nt, Homo sapiens
gcagagggagguaacuucuagauugagauuugaagucagaguccauccagaaaguagggaagacauuuuauguagagaa

SEQ ID NO: 140800 - RNA, 56 nt, Homo sapiens
accaucuuuagcauagaagccuuccuugugcucacuugcucaucucauucucacaa

SEQ ID NO: 140801 - RNA, 58 nt, Homo sapiens
cauuucuugacauaggagcugccuugacugggcuuaaaaaggccugaaaggcagcuua

SEQ ID NO: 140802 - RNA, 33 nt, Homo sapiens
ucccauggcacccaccaagggugcuuucuaggu

SEQ ID NO: 140803 - RNA, 39 nt, Homo sapiens
uuggugggugccaugggaugggggaauacagucaaaagg

SEQ ID NO: 140804 - RNA, 31 nt, Homo sapiens
ccaccucagguggaggcgcagcgggaagagc

SEQ ID NO: 140805 - RNA, 51 nt, Homo sapiens
ccccuucuucaagauuuucccugcugucuccccuucccugcucaaccagag

SEQ ID NO: 140806 - RNA, 67 nt, Homo sapiens
auacuaacuaaaagucaaacaugcaagaaaauauaaaauaugcaucagacaguuuuaggaugagguu

SEQ ID NO: 140807 - RNA, 47 nt, Homo sapiens
gugaaacaacuuauuauagaugcacagcauuagucucauacacaaua

SEQ ID NO: 140808 - RNA, 40 nt, Homo sapiens
aaauuauuaggaaauaggucuggaaaaacguggcccaugu

SEQ ID NO: 140809 - RNA, 47 nt, Homo sapiens
ucuucugaauuuuaagaaagcuuugucagaaucaguaacuugccuau

SEQ ID NO: 140810 - RNA, 49 nt, Homo sapiens
uucugggacaauagugucaaguauaaaaggauuauaaagguuuuaggac

SEQ ID NO: 140811 - RNA, 45 nt, Homo sapiens
caucuccaugaaaugccagugucucuuagcagauaaaauacaaac

SEQ ID NO: 140812 - RNA, 31 nt, Homo sapiens
aggugucuaugaauaugugaagugaguauau

SEQ ID NO: 140813 - RNA, 404 nt, Homo sapiens
auguuguuuuaauuaaaggagcaguguguuuuuaaauuuaauuaugguaccuugaagaucugauacuagcuguaagcuaaggauucuuuggguuuucaagauuuuuuuuuuggagacggaguuucacucuguugcccaggcuggagugcaguggcgugaucugggcucacugcaacaccugcuuccugguuucaagugauucuucugccucagccucccagguagcugggauuacaggugcgggccaccaugcccggcugauuuuuuguauuuuuaguagagacagguuucaccauguuggucaggcuggucucgaauuccugaccucaaaugaucugccaucuucagccucccaaaaugcugggauuacaggcgugagcuacagugcccagccaguuuucaag

SEQ ID NO: 140814 - RNA, 37 nt, Homo sapiens
uauagcugggaagugaugaauaaauuugaccauuaaa

SEQ ID NO: 140815 - RNA, 51 nt, Homo sapiens
agccagcauauagaaugcgauaccuaaaaaguguguaagagugugguauag

SEQ ID NO: 140816 - RNA, 59 nt, Homo sapiens
uaacaauuggugacauaguuuacuaauuuaaacucuuggugaagcauagugcacauuac

SEQ ID NO: 140817 - RNA, 45 nt, Homo sapiens
cagacaugggacgagauugaggaagugucaguggagacuuugucu

SEQ ID NO: 140818 - RNA, 116 nt, Homo sapiens
aggagaugaccugccauagguuggaggcaggcucugcuuggauccuguguaaacagggcauagugugagugucuccccauaaguaaaagcuguguugugaagaugaacucacaguu

SEQ ID NO: 140819 - RNA, 77 nt, Homo sapiens
ugaaaauuacugagcaagauuagugggggaugaaauggaugaacauuggggaaagcugugauccuuguuaccuuugc

SEQ ID NO: 140820 - RNA, 48 nt, Homo sapiens
uccuggcaauuccugacagcauuucuuuuaaaccuggccaccuuucca

SEQ ID NO: 140821 - RNA, 55 nt, Homo sapiens
ugcugcuacugcaagggcugccuuuggcaggaagccuucagucaacuuucugggc

SEQ ID NO: 140822 - RNA, 95 nt, Homo sapiens
ugaguuuucugccacgauguaacuuaacagauccucuuguuuuuccuuaaaugguacaaggguuugcaccgaaaugguaauucaucugugucugu

SEQ ID NO: 140823 - RNA, 80 nt, Homo sapiens
ucacuaaugugucacaacauguauuauuuaucauuuuaguaaauggauauuuuaacaagcaacaauuugcaaauuuaagc

SEQ ID NO: 140824 - RNA, 62 nt, Homo sapiens
gcuguccucucuccauacacuguccccaggggcagcuccagccacauggggggcuuucagau

SEQ ID NO: 140825 - RNA, 46 nt, Homo sapiens
ugccugcaucaggcagcauggaggucccagcaaaggggucucacua

SEQ ID NO: 140826 - RNA, 44 nt, Homo sapiens
uacagagcuagaauauuuuuagggaaucuuuggacauaggaagg

SEQ ID NO: 140827 - RNA, 48 nt, Homo sapiens
gcugacuggcugacuggaacauuuucacaucugggcugagucuuuaaa

SEQ ID NO: 140828 - RNA, 39 nt, Homo sapiens
aaaguauugugaggacuuuuauaaacccccucucuccag

SEQ ID NO: 140829 - RNA, 40 nt, Homo sapiens
agcuaagcuaggugaucuagcagcauaugguccuggagag

SEQ ID NO: 140830 - RNA, 140 nt, Homo sapiens
cuugaaacaagcccuggcacagacgcaaauccuggcgugcaccaccucuuccucucccccgcuccccacucuaacaugacaagaagugucugucccagaaguaaucugauugugcaccuagaguaccuguuuucugccug

SEQ ID NO: 140831 - RNA, 56 nt, Homo sapiens
caauaaaucuauauguuucuuuaguuaaaaaaaaaacagcaacaaaguguuuauug

SEQ ID NO: 140832 - RNA, 36 nt, Homo sapiens
uacugugcuauagcagaagaaagaaggcuaagacag

SEQ ID NO: 140833 - RNA, 46 nt, Homo sapiens
gcgagguucccagaugaaagggggugauauaccagaagaagaggca

SEQ ID NO: 140834 - RNA, 25 nt, Homo sapiens
ucccccaacauuugcacucaaugaa

SEQ ID NO: 140835 - RNA, 48 nt, Homo sapiens
gugcaaauguugggggaguggggguuaaacagagaccuauucuaagug

SEQ ID NO: 140836 - RNA, 45 nt, Homo sapiens
uaggcaaauccucuucugacugggauuguucuguuugugagugcu

SEQ ID NO: 140837 - RNA, 33 nt, Homo sapiens
aaguaaaaacaaaucuaaauuaagaaagugucu

SEQ ID NO: 140838 - RNA, 49 nt, Homo sapiens
cccccugcuuuggaaagcaugggcaauuuggauauggcacaaaaaagau

SEQ ID NO: 140839 - RNA, 46 nt, Homo sapiens
ucugugagugggcaaaauacauucauaagguuccagcucagaagaa

SEQ ID NO: 140840 - RNA, 46 nt, Homo sapiens
cacaccuagucgcuguggccugaggcaaugaucucucacaacugac

SEQ ID NO: 140841 - RNA, 45 nt, Homo sapiens
agcugucagccccagcaggcaggaguuagaauugucuggaauugc

SEQ ID NO: 140842 - RNA, 57 nt, Homo sapiens
aaagcaaacugacucuuggucgguuuauuacuauuuuuaaauucccuacugacaagg

SEQ ID NO: 140843 - RNA, 44 nt, Homo sapiens
ugguucucucuguaguaagaguagagaagaaugguagaugugaa

SEQ ID NO: 140844 - RNA, 44 nt, Homo sapiens
uucguggcauugccuaacuauagucaagcuaaugacccauguag

SEQ ID NO: 140845 - RNA, 79 nt, Homo sapiens
cccugugaaugugucauguugugcuggccugauuccccaacaucagccccagggagccagcagcuggagcagcugucau

SEQ ID NO: 140846 - RNA, 88 nt, Homo sapiens
auaaauaagugucaagugaaguauuacuugaauuuaggacuugaagagagagaaagggguaugaguaguuggaggggaagauuugcua

SEQ ID NO: 140847 - RNA, 56 nt, Homo sapiens
gucucaugcuuaccuauuucucugugccaguauaguagaccuguuuucaagccuag

SEQ ID NO: 140848 - RNA, 50 nt, Homo sapiens
cccaucaaguauaauuaagaagaaugcccaccaaaucaauugugugagaa

SEQ ID NO: 140849 - RNA, 234 nt, Homo sapiens
cuucagcaaacaguuuuaguuggaugcuuaguauauaccagucacugagauuggugcuugagggaagggagauaaaugaauggaugagacauggcccuuaccuaaugaggugagccaacacauagacaaguaaugcuaaaacaauguagugccuuuaaaaggccuuuguacuaucucccuagagaagagagaguugcugacucacugaauaacaguguugaggcagcauuuuca

SEQ ID NO: 140850 - RNA, 48 nt, Homo sapiens
cuccauuucuccacaaggaaaaguuuccccauucuuuaagacccagau

SEQ ID NO: 140851 - RNA, 54 nt, Homo sapiens
cuuaucacuccugcuuacuauugguuuuuguguccuuuuggcaauuuucuagug

SEQ ID NO: 140852 - RNA, 45 nt, Homo sapiens
ucacaaacuaaaaagccauccuuauauucaaacaugcuuuaaaau

SEQ ID NO: 140853 - RNA, 31 nt, Homo sapiens
auguaaccuccaguggugguucaugaacaaa

SEQ ID NO: 140854 - RNA, 31 nt, Homo sapiens
augucaggcacuguuguaggcacuggggaca

SEQ ID NO: 140855 - RNA, 77 nt, Homo sapiens
aauaauguaagugaguauauagcaugucagcugugagaaaugcuauggagaaaaauaaagcagaguaagggaauuaa

SEQ ID NO: 140856 - RNA, 45 nt, Homo sapiens
uguugagaauaagcuguaggcggcaccaagguggcagcugggagg

SEQ ID NO: 140857 - RNA, 47 nt, Homo sapiens
gauggaguuaucuaucacugagauaaacagagguaacagaaguaaag

SEQ ID NO: 140858 - RNA, 64 nt, Homo sapiens
uaguuuuuaacgaaguauuccaggauaucuacagugacaaacucaggguaaaagcaaaucaggu

SEQ ID NO: 140859 - RNA, 39 nt, Homo sapiens
auuaaccucuaacccaauuagucaccaaacugacagcau

SEQ ID NO: 140860 - RNA, 35 nt, Homo sapiens
aaauucuguuacuuacuuccuacuaugcugauugg

SEQ ID NO: 140861 - RNA, 50 nt, Homo sapiens
gugcucauuaugugcuugaaauagagugugugcaggagccagagcagucg

SEQ ID NO: 140862 - RNA, 70 nt, Homo sapiens
gcuaucucaguaccccaucucccucaccccucacgcuuccucagguuucucucucaugcuagcuuggaau

SEQ ID NO: 140863 - RNA, 26 nt, Homo sapiens
aaaauacuggccgccugaguucuggc

SEQ ID NO: 140864 - RNA, 46 nt, Homo sapiens
cuugggucucacauucucauucuuugaaucuuuuauggcauaaugg

SEQ ID NO: 140865 - RNA, 45 nt, Homo sapiens
guuucacuguuucauguuuguaacuuucauuccuuuugaagugua

SEQ ID NO: 140866 - RNA, 91 nt, Homo sapiens
cagaggugguggugauaauauuauugagaaagugacuagugucugacuuuucuagcuuguuaauaaccacuuaccuaugucccaucuccuc

SEQ ID NO: 140867 - RNA, 46 nt, Homo sapiens
agagaaguauaaugagcaggggaggugauacaauaaaaaucuauau

SEQ ID NO: 140868 - RNA, 65 nt, Homo sapiens
aaaugucuauuaaucuagcgauucuucuguaucuauuuuuugcucgccuauucacuuggucuccu

SEQ ID NO: 140869 - RNA, 75 nt, Homo sapiens
auagaaucaaauugccauuuacucagaccuuuuucugacuggaauccauuuuacuuuauuauaagggauuuuuuu

SEQ ID NO: 140870 - RNA, 50 nt, Homo sapiens
guagugguaaguuguguuuuuccuauguguuguacaaugacuucccauua

SEQ ID NO: 140871 - RNA, 51 nt, Homo sapiens
aaacuauuguuccuaacgcagggaaaugcuuuguacauauuuauucaucug

SEQ ID NO: 140872 - RNA, 52 nt, Homo sapiens
gagugagagaaaucccuuuuguacaauaaagggagcaagagccguggaguag

SEQ ID NO: 140873 - RNA, 49 nt, Homo sapiens
cucuugagcuaaauaaagguaagauugcugccuaaaggaaagauaggcu

SEQ ID NO: 140874 - RNA, 46 nt, Homo sapiens
auuucucuaugcuagauguauaguuugaaucauuguaguucugcag

SEQ ID NO: 140875 - RNA, 46 nt, Homo sapiens
caaaauuguccuuugagcuuaggaauuuuuaagacagucuagggag

SEQ ID NO: 140876 - RNA, 40 nt, Homo sapiens
caaaaaacugaagaaaugauuaaagaaaagcuacagcggg

SEQ ID NO: 140877 - RNA, 52 nt, Homo sapiens
aauuacuuuuaacuagagauuagauaagcuucuucuuuugcuucuggauaac

SEQ ID NO: 140878 - RNA, 46 nt, Homo sapiens
aaagacauuucaggaaaucauaacuacuugugacaacaccaaagga

SEQ ID NO: 140879 - RNA, 53 nt, Homo sapiens
cuggaagaaccaugacauguaaaugcaguugcugcugccuuuccaacagagaa

SEQ ID NO: 140880 - RNA, 76 nt, Homo sapiens
ucuauuuauuaaaugcugauacuauucucuaaauuucugccuaggucuguaaccagugaugaaggauccaugaaug

SEQ ID NO: 140881 - RNA, 31 nt, Homo sapiens
ugaguccuucccagaugcagcaugaccagau

SEQ ID NO: 140882 - RNA, 53 nt, Homo sapiens
cccacucggccuggugccaccaccaaaaucaccaccaccuccaccuacauuuc

SEQ ID NO: 140883 - RNA, 46 nt, Homo sapiens; identical to SEQ ID NO: 46859

SEQ ID NO: 140884 - RNA, 46 nt, Homo sapiens; identical to SEQ ID NO: 46860

SEQ ID NO: 140885 - RNA, 45 nt, Homo sapiens
uuagugguaaggcugcucagggagggcacacugcacuggcuggaa

SEQ ID NO: 140886 - RNA, 46 nt, Homo sapiens
cagggacagucucgcaaaaagggacacccgaguuaugcaccaccca

SEQ ID NO: 140887 - RNA, 45 nt, Homo sapiens
aauugcuuuaaaaauacuuccucuagccaucccccagcuagagga

SEQ ID NO: 140888 - RNA, 54 nt, Homo sapiens
uugcucacuucaagcgaacaacuuuccuuaaaaagcacaggaugcuaggcagau

SEQ ID NO: 140889 - RNA, 47 nt, Homo sapiens
accccucagauggggacccccucaccagggaaggggagcuugacaga

SEQ ID NO: 140890 - RNA, 55 nt, Homo sapiens
gucccuuucuccccaacccugaaaaaaaucaaccaaucaauuccuauuugucaca

SEQ ID NO: 140891 - RNA, 89 nt, Homo sapiens
uaaaccuccaaaauguuguuuuuccaacuaauacucucccaccuuuuauuauuuauuuccauucguagugacacuaggacccccagaug

SEQ ID NO: 140892 - RNA, 47 nt, Homo sapiens
ugcgggacuacaaagccauaagcaaugcuaugaaggcaucugggggu

SEQ ID NO: 140893 - RNA, 74 nt, Homo sapiens
cugccaugcucucccccaugucaccucugcagccacagcgcuguucaguugugugcugucagugcuuccaacag

SEQ ID NO: 140894 - RNA, 43 nt, Homo sapiens
cagcacacaacugaacagcgcuguggcugcagaggugacaugg

SEQ ID NO: 140895 - RNA, 76 nt, Homo sapiens
cuuuuggaugugagugugucuguguguguauccaccuuagggagaaaacggauuucauaauuucauugaacaaauu

SEQ ID NO: 140896 - RNA, 46 nt, Homo sapiens
aaagugguagaauuuauuaucucaaaagugauaaugggaaugcuau

SEQ ID NO: 140897 - RNA, 51 nt, Homo sapiens
aauaaaaauaaacaucaaacaagaaagugcagauguaaaugugauuggaaa

SEQ ID NO: 140898 - RNA, 47 nt, Homo sapiens
gggguggaagacuguggccgguacccuucugugauugaauuugguaa

SEQ ID NO: 140899 - RNA, 29 nt, Homo sapiens
agguguuugucuuuuacucaaaguaacag

SEQ ID NO: 140900 - RNA, 46 nt, Homo sapiens
uaccaaagcuuuaccugugugaauucugucuuaaauauaugaaaag

SEQ ID NO: 140901 - RNA, 28 nt, Homo sapiens
gaacuaaccagcuugaaaugucaaaagu

SEQ ID NO: 140902 - RNA, 47 nt, Homo sapiens
auuuuugguuggcacaacuggaaggggugguggugcuacuggcaucc

SEQ ID NO: 140903 - RNA, 81 nt, Homo sapiens
ccugcccugaaagaacagcccauucuuaccauccuaacaagacugauucccuugcccaugagaagacguuccauggauuua

SEQ ID NO: 140904 - RNA, 45 nt, Homo sapiens
uuuucuggccuucccuuucuuuauuccucuuacacuuuucacaac

SEQ ID NO: 140905 - RNA, 47 nt, Homo sapiens
augggaauaugagcaaaauuuauugccaaaaccuuugcuuguuagcc

SEQ ID NO: 140906 - RNA, 46 nt, Homo sapiens
cauaaaaaaggaauggcucgacaucauaauacaacguuuugugguc

SEQ ID NO: 140907 - RNA, 50 nt, Homo sapiens
acugggugacucccugggauguuauuuucucuaucucugaaguuauuuga

SEQ ID NO: 140908 - RNA, 39 nt, Homo sapiens
cagaaguauaaugucuccugcauaaugaucaugccccag

SEQ ID NO: 140909 - RNA, 46 nt, Homo sapiens
gauuuucagcucucugaaauuuugccuauaaucuuguacaguacaa

SEQ ID NO: 140910 - RNA, 54 nt, Homo sapiens
aucuaaaucuauauuguuagguauuaaaagauuaaggucugauuaaaguguaaa

SEQ ID NO: 140911 - RNA, 47 nt, Homo sapiens
gaguuaagaagugcagugaaagauuugaauaaaguugaagagacugg

SEQ ID NO: 140912 - RNA, 57 nt, Homo sapiens
gcuucuucacugugaaauuaccauuuuucgcuuuguaaucaguaagcaucuggugag

SEQ ID NO: 140913 - RNA, 43 nt, Homo sapiens
caucuucuuucugaugcaacugaaaugaucuuaagauagaggc

SEQ ID NO: 140914 - RNA, 47 nt, Homo sapiens
cauaacuuauuauucuuuaaugauugccuugacugcacucacccagg

SEQ ID NO: 140915 - RNA, 373 nt, Homo sapiens
ucuauuuuccauuuacccaguuaagauauauagaagagacgcauuuuuccuugcuuuucuuuuuaaagacugggucucacucugucacccaggcuggaguacaguggcgugaucauagcucacugcagcauugaauuccugagcuaaagugauccucccaugucagccucccaaguagcugggauuacaggcacaugccaccauuccuggccauuuuucagggggagggguggggggucagcuagagacaggcucuugcuuuguugcccaggcugguuuccaacuccuggcuucaaguuaugcuccugccucggccucccaaggcacugggauuacaggugugagccacuaugcccugagcuguuguuaaaac

SEQ ID NO: 140916 - RNA, 140 nt, Homo sapiens
auauguccuuuuuugggggcaaauacagucaucauuuuaaaugaagucgaagaguuauuucuguaaacaaaacaaaaguccuccuugucauacuagacagcaaggaagcaaaaauuguuagggucaugucaaaaagacuc

SEQ ID NO: 140917 - RNA, 46 nt, Homo sapiens
gagcauacugagcugcagugcaaguaggagaucagcaaaauccaga

SEQ ID NO: 140918 - RNA, 65 nt, Homo sapiens
augagaacuguuuucccauuuuucuuuuuuugugggaagaacagcaccagcagacacuguaagau

SEQ ID NO: 140919 - RNA, 96 nt, Homo sapiens
guguacaggaaaauugcucuuuccuccuccuagguugcugagcaguucuaaaauuugugguagaucuuuaggcacuagaaacagaacuuagagaaa

SEQ ID NO: 140920 - RNA, 47 nt, Homo sapiens
aguuaaugcucugauuugugacccagaggcacuuucaguuagguaau

SEQ ID NO: 140921 - RNA, 44 nt, Homo sapiens
acucuuuucacuauaaauuuuauuuauauuuuagaaaguauagg

SEQ ID NO: 140922 - RNA, 62 nt, Homo sapiens
ugcugaggccaaagcauuugaaaacuaccgauuuaaaguauaaaccauugcuauucaagugu

SEQ ID NO: 140923 - RNA, 61 nt, Homo sapiens
guccaugcuguuaaccagaacuaguuugucugcacaauggaaguugagaagcagaggugua

SEQ ID NO: 140924 - RNA, 90 nt, Homo sapiens
uucucaggugauguugaugccacaggucuccacacugagaucuugauaaacagcauuuauucaaguucuuauauaauuaugucaugccca

SEQ ID NO: 140925 - RNA, 46 nt, Homo sapiens
uuagagucaucagauuuccugugcucaaaagcugccauaaaucccu

SEQ ID NO: 140926 - RNA, 52 nt, Homo sapiens
uuugguguuugaggagguucauaugguuugguuugguuccagguaguggaag

SEQ ID NO: 140927 - RNA, 65 nt, Homo sapiens
gucgggggagaucccugucccuauccaugcccuugccugagaacauuauucuacuaugguccauu

SEQ ID NO: 140928 - RNA, 87 nt, Homo sapiens
acucccugcuuucuccuggccuuugcaagcacagugcaaggguguuugcugaaaaagaccacugggcuuucaguguacccacaccca

SEQ ID NO: 140929 - RNA, 46 nt, Homo sapiens
ucagucauagccugaagucuguguccaagggagugucucaggagac

SEQ ID NO: 140930 - RNA, 83 nt, Homo sapiens
ugccugcugguuugaguggccuaacccauuuaggcucaggcccugacagggugugugugcaccacuucggggugugaaagcau

SEQ ID NO: 140931 - RNA, 94 nt, Homo sapiens
cguggguuuucugaugcuggcugcugcugccuuccggauuagggacuguagcggggagacagaacaaaggaacacaugugcuucuggguaagcu

SEQ ID NO: 140932 - RNA, 66 nt, Homo sapiens
cauaauggcauucagauuaaagccaucaaaaugcaaaaugcugugauuauacccuucgaggguuca

SEQ ID NO: 140933 - RNA, 86 nt, Homo sapiens
aaugcaucagaggcauugauuucuucuuuaacaaaaaauaacccuaaaauugagaaaauucuugagaaugcagccauuuuggaaau

SEQ ID NO: 140934 - RNA, 50 nt, Homo sapiens
uccaagaugacgcucuuccaauaugccagguaggagagacggcccagauc

SEQ ID NO: 140935 - RNA, 70 nt, Homo sapiens
ccuggcauauuggaagagcgucaucuuggaguaucucuaccaccaccaugagaggcacaucagcaucaag

SEQ ID NO: 140936 - RNA, 79 nt, Homo sapiens
gcaauuagcagagcgacgggcaugugcccacaugacauugccaccacucugcagcaccuccacaugaucgacaagagag

SEQ ID NO: 140937 - RNA, 45 nt, Homo sapiens
cauguggcucaauaucaacuuuucccgucuaaugaugacaaaucu

SEQ ID NO: 140938 - RNA, 66 nt, Homo sapiens
gucaucauuagacgggaaaaguugauauugagccacauggaaaagcugaaaaccuguuccagagcc

SEQ ID NO: 140939 - RNA, 63 nt, Homo sapiens
aaugaacuugauccagacagucugagguggaccccaauuuuaauuucuaaugcugcagugucu

SEQ ID NO: 140940 - RNA, 45 nt, Homo sapiens
uagcucuaguugacaggauuucuuguuccuccuucucccagcagc

SEQ ID NO: 140941 - RNA, 75 nt, Homo sapiens
uccugucaacuagagcuaacaguaggcaaucaccugcaaaaguacaaucgaaaaauaaauauuugcauuccccgg

SEQ ID NO: 140942 - RNA, 32 nt, Homo sapiens
ucucuuuagacagcuccagcagcugcccucgc

SEQ ID NO: 140943 - RNA, 93 nt, Homo sapiens
agagccggccagucacaggggagcgagggcagcugcuggagcugucuaaagagagcagugaagaagaagaggaggaggaggacgaggaggagg

SEQ ID NO: 140944 - RNA, 92 nt, Homo sapiens
agaggaggaagaagaggaagaagaagaagaagaagaagaaaauauucaaagcucucccccaagauugacgaaaccacagucaguugccauaa

SEQ ID NO: 140945 - RNA, 41 nt, Homo sapiens
guagcccagugaugucucuagauagaccauaucaucuccaa

SEQ ID NO: 140946 - RNA, 45 nt, Homo sapiens
gaggaguguguauucauguguuguauauauaauaaaagaaauuug

SEQ ID NO: 140947 - RNA, 42 nt, Homo sapiens
uuaccugaagguuagcuuuuaaccaagcauauugaacccuuc

SEQ ID NO: 140948 - RNA, 56 nt, Homo sapiens
uuuguacuaaagaagaaaaggggucguaaacgcaggaggaucaacagcaguguaac

SEQ ID NO: 140949 - RNA, 46 nt, Homo sapiens
guccugagaaaagcauuccagcaucagccugggaagaaaagacaaa

SEQ ID NO: 140950 - RNA, 47 nt, Homo sapiens
cggcacuucucaaggaaacauucuacaucacauauguguucuuuuca

SEQ ID NO: 140951 - RNA, 33 nt, Homo sapiens
cuagaagauugguguaaucuaaagaucuuaaga

SEQ ID NO: 140952 - RNA, 44 nt, Homo sapiens
uugcugauguaagguuugcauauuaaagacacuuagaaacaaac

SEQ ID NO: 140953 - RNA, 48 nt, Homo sapiens
gucuuagugaagagacaaaaacgggaaggaaaaaaaacagucuuagaa

SEQ ID NO: 140954 - RNA, 41 nt, Homo sapiens
gacaaucccgaaccucuaaagugcaaacaaguguggccaaa

SEQ ID NO: 140955 - RNA, 45 nt, Homo sapiens
guacaccccgccagaaacacccauggagccugacgagcagguaac

SEQ ID NO: 140956 - RNA, 76 nt, Homo sapiens
aaaaccagaagaugaucucaucaaaccugaggaagaggaagaggaggaggaggaggaagaggaagaagaggaagaa

SEQ ID NO: 140957 - RNA, 107 nt, Homo sapiens
aaauguagaaaaagauccagauggugcuaaaagccaagaaaaagaggaaccagaaaucuccacggaaaaagaagacucugcacguuuggaugaucacgaagaggagg

SEQ ID NO: 140958 - RNA, 42 nt, Homo sapiens
gagcugcccagagaaagcuucaaagaaguacuggaaaaccag

SEQ ID NO: 140959 - RNA, 49 nt, Homo sapiens
aaagacugaacggccuggacagucucagagucgauuuccaugguugcug

SEQ ID NO: 140960 - RNA, 46 nt, Homo sapiens
uguaguucuguaggcuucuacaggccucuugagucucggcacaauc

SEQ ID NO: 140961 - RNA, 46 nt, Homo sapiens
ccaaaguccacagauugccaccacgcucgacgauugccaacagucg

SEQ ID NO: 140962 - RNA, 65 nt, Homo sapiens
cccugcucuggaaaacagcuacgcccaaaucagcccagaucaaagugccaucucagugccaucuc

SEQ ID NO: 140963 - RNA, 45 nt, Homo sapiens
gccagcagcuggcucagugcagcauggcugcuaacuucaccccac

SEQ ID NO: 140964 - RNA, 45 nt, Homo sapiens; identical to SEQ ID NO: 46962

SEQ ID NO: 140965 - RNA, 46 nt, Homo sapiens
ucccugggggaccccaagcacaagcuaccaugaccccaccccccaa

SEQ ID NO: 140966 - RNA, 64 nt, Homo sapiens
gccaauauuugaugcagccauguuccguugcaaaagaggcggcggcagauucauuggaggagga

SEQ ID NO: 140967 - RNA, 46 nt, Homo sapiens
auacaauaacugaaaugcuaaaggcauuuacauggaguggacaggg

SEQ ID NO: 140968 - RNA, 49 nt, Homo sapiens
cagauuucuuuggggaaaaaaggcagcuuucuguuuuauaaaugcagac

SEQ ID NO: 140969 - RNA, 45 nt, Homo sapiens
aaaaagcuguacauuuuaacauaaaauaaauuaugaugagccauu

SEQ ID NO: 140970 - RNA, 43 nt, Homo sapiens
auuuugggaaaauaaauuauuuaguguaaauuggaguuauggg

SEQ ID NO: 140971 - RNA, 115 nt, Homo sapiens
gaggugagcgggagcugaggcugaggagaggggagcuuggggggcgccugcugccaagggugaguggggagucugggauggagccgggggcugccgagggaccgcgaccuggagg

SEQ ID NO: 140972 - RNA, 40 nt, Homo sapiens
ugggggcuuuugaaagcugcgcagugggggaaaaagaucg

SEQ ID NO: 140973 - RNA, 48 nt, Homo sapiens
guggacccggaagaagagaugcucuggguuuggcagcggggaugagga

SEQ ID NO: 140974 - RNA, 40 nt, Homo sapiens
cugguggugauggagggcaggauuuagguuugacuagaag

SEQ ID NO: 140975 - RNA, 38 nt, Homo sapiens
gugaaucacugauuugccuaaaggacugggggaaguag

SEQ ID NO: 140976 - RNA, 355 nt, Homo sapiens
uugagccaguuucucauuuuccauuauauugauuagauuuuggauguagcauauuuauuuauuuauuuagagacagagucucacuucguugccgaagccuggugcaguggcgugaugucaguucauagcaaccuucgccucccggguucaagcaauucucccaccucagccuccccaguagcugggauuacaggcgcgugccaccaugcucggcuaauuuuuuguguuuuuaguagagacgaggucucacuauguugcucaggcugguuuugaacuccucggcucaaggcauccaccccccuuggccucccaaaguuggguuuacaggcgugaaccaccgcagccugccagugua

SEQ ID NO: 140977 - RNA, 45 nt, Homo sapiens
uaaucaccaucugaacauggauuuugcuucuguaaaaguaagcau

SEQ ID NO: 140978 - RNA, 45 nt, Homo sapiens
uuuagucaaggguaggguuucucaauagcagcaccauggcauuug

SEQ ID NO: 140979 - RNA, 46 nt, Homo sapiens
uaacuauuauauaguagcauacaauuaaagggcaugcacugaccug

SEQ ID NO: 140980 - RNA, 34 nt, Homo sapiens
acacucaaaucaagaauuauuacauugugggaaa

SEQ ID NO: 140981 - RNA, 46 nt, Homo sapiens
cggacccauaacugacuugaauucugaucaguaccaguacaugaau

SEQ ID NO: 140982 - RNA, 45 nt, Homo sapiens
uccaugagcgagugccugacaugcagaccuauccaccacucccag

SEQ ID NO: 140983 - RNA, 60 nt, Homo sapiens
uuguuaauuuccuucucuggucauugugacauaguuauuaacaaaggauuuugaguuuga

SEQ ID NO: 140984 - RNA, 45 nt, Homo sapiens
aguaucuuuuuagugcuucuaugcguauuagguaacuagcugcag

SEQ ID NO: 140985 - RNA, 43 nt, Homo sapiens
gcaugcaaagaauuguuuucuccugaaaagaaacuuacagcac

SEQ ID NO: 140986 - RNA, 42 nt, Homo sapiens
cauucuuggcuguuggaaguaaacagucucagacauacuugg

SEQ ID NO: 140987 - RNA, 118 nt, Homo sapiens
cuaaaccauagugaagauaguauuuauguuuacauuuuaucugugaauguggcuaagcagagaagcuacauggcuuuggucuacauauuuuuugaccuuguauuugguucuguaguug

SEQ ID NO: 140988 - RNA, 41 nt, Homo sapiens
gacaagaaagcugucuuguagaauaguccaauugcuuucuu

SEQ ID NO: 140989 - RNA, 41 nt, Homo sapiens
cauauaccaguuacuuuacguacaauaaaggaauggggaag

SEQ ID NO: 140990 - RNA, 37 nt, Homo sapiens
agcacagcaaggcagucacaccaaggugggaaaagag

SEQ ID NO: 140991 - RNA, 42 nt, Homo sapiens
gcuagcggagcgguggcggcggccccccucaggacaccacca

SEQ ID NO: 140992 - RNA, 62 nt, Homo sapiens
agacauuugagugaaacacacauggcaguauuuuuuccaaguuucaauauuuaaauucccag

SEQ ID NO: 140993 - RNA, 45 nt, Homo sapiens
acggcucgugcuuuaauuuuuuuucaguuauagcuuaggcccugg

SEQ ID NO: 140994 - RNA, 53 nt, Homo sapiens
acuuugugaaauuuuuuuuacuuaaaaaauuuuuguuuugagauuauuuuagg

SEQ ID NO: 140995 - RNA, 51 nt, Homo sapiens
guuggauuucuggggauuuacauugaucauaucugucgcuugguuuuuuug

SEQ ID NO: 140996 - RNA, 47 nt, Homo sapiens
guggugugaguauggucugacuuucacagaaaaguggaacacugaua

SEQ ID NO: 140997 - RNA, 101 nt, Homo sapiens
aauggauaucagaagauuuggccuuaauauauuuccauugugaccagcagcaggcuuuuuucccccaagaagaugaucaaaacaaaggaugaucucaacaa

SEQ ID NO: 140998 - RNA, 45 nt, Homo sapiens
gcgcuacccaccaauaaugaaauagaccuuuaugaaaacugugca

SEQ ID NO: 140999 - RNA, 46 nt, Homo sapiens
caucagucuccagggacacuucccaccaccgaggcuuaccagguag

SEQ ID NO: 141000 - RNA, 45 nt, Homo sapiens
cugcaagccccgcccgagagagccgggcgcgaucugguggccgcg

SEQ ID NO: 141001 - RNA, 51 nt, Homo sapiens
cacccuccaccaggggacaugguggccacuuggcuuuagccuuggaugcca

SEQ ID NO: 141002 - RNA, 44 nt, Homo sapiens
ggcagcgccccuagugacucacuuuccucaucuggagaggcuga

SEQ ID NO: 141003 - RNA, 43 nt, Homo sapiens
uguguguagggagcccucucugagggcugccccagauucaugg

SEQ ID NO: 141004 - RNA, 46 nt, Homo sapiens
uucuauaaaaagucaaaugauauuuuuucaacuuuuauaaaguuug

SEQ ID NO: 141005 - RNA, 46 nt, Homo sapiens
gaagcgcuugucgcacggcccguuggccgacacccaguugcagaug

SEQ ID NO: 141006 - RNA, 42 nt, Homo sapiens
guguggcaggaacuggggcggguagccggcguaggccccggc

SEQ ID NO: 141007 - RNA, 45 nt, Homo sapiens
cgugcggaggucaggcugccacccucuguaguucccuaaccccaa

SEQ ID NO: 141008 - RNA, 45 nt, Homo sapiens; identical to SEQ ID NO: 47022

SEQ ID NO: 141009 - RNA, 46 nt, Homo sapiens
uuuucugcguuuggauuuuaucccuugauucuuuggguugguaaac

SEQ ID NO: 141010 - RNA, 43 nt, Homo sapiens
gaggcccgggcacugaaauucuggggccugcgacagggccggg

SEQ ID NO: 141011 - RNA, 42 nt, Homo sapiens
guacacacaugcagaguucagccuacauguucauugaggaaa

SEQ ID NO: 141012 - RNA, 52 nt, Homo sapiens
ggagcaaaauaaguagaacuucuugggacaggagaucuaggguacuccagaa

SEQ ID NO: 141013 - RNA, 46 nt, Homo sapiens
uguuugcuugagauccucuauuuuuauaguucaauauuauuaaggu

SEQ ID NO: 141014 - RNA, 48 nt, Homo sapiens
acggcggggcgccccggucaggccguuuuuuuccccaaagagccccca

SEQ ID NO: 141015 - RNA, 29 nt, Homo sapiens
cagccauuauucaucuucuuaaaaaguuc

SEQ ID NO: 141016 - RNA, 49 nt, Homo sapiens
acauggcauuacuguuuuuuaaaaucuucgauauacaaaaauucuaguu

SEQ ID NO: 141017 - RNA, 48 nt, Homo sapiens
acgagcacuuucuuugcagguaggcagccagugcaggcccagcagcaa

SEQ ID NO: 141018 - RNA, 46 nt, Homo sapiens
gcugcuguuucuaauacguuauuuugacacacaauuaacugcaaaa

SEQ ID NO: 141019 - RNA, 39 nt, Homo sapiens
caauaucaaacauggcugagaaaagcuccaauccuggca

SEQ ID NO: 141020 - RNA, 57 nt, Homo sapiens
gguccaagauucccacucaaaggaagccaggcauuugacucuguuguacaaauuucc

SEQ ID NO: 141021 - RNA, 51 nt, Homo sapiens
aaugagucugaucccagggaaggaggaagagaagaaggcacaaccauggag

SEQ ID NO: 141022 - RNA, 46 nt, Homo sapiens
uggcacaggcgggaaguccaucuacggaagccgcuuuccugacgag

SEQ ID NO: 141023 - RNA, 60 nt, Homo sapiens
ggccuuguggaagcucucagugguagagcuggggcgggaccuggggcaggaccccaggac

SEQ ID NO: 141024 - RNA, 56 nt, Homo sapiens
uuggaugacauugcgcuacacuguugcucacccgggucacccguccucacagguug

SEQ ID NO: 141025 - RNA, 68 nt, Homo sapiens
auguccaugcacccagguggccgcguugggcugucagccaaggugccugaaacgauacgugugcccac

SEQ ID NO: 141026 - RNA, 55 nt, Homo sapiens
uguuagaccucggccaggacccaccacauugcuuccuaauacccacccuuccuca

SEQ ID NO: 141027 - RNA, 48 nt, Homo sapiens
augcuugacaaggggugggugacaucauguccacaaagaugcccagaa

SEQ ID NO: 141028 - RNA, 41 nt, Homo sapiens
uuuaauauugucuuccuaauugggauaauuuaauuaacaag

SEQ ID NO: 141029 - RNA, 36 nt, Homo sapiens
cuucuagucaaucuuguuaauuaaauuaucccaauu

SEQ ID NO: 141030 - RNA, 56 nt, Homo sapiens
acaucagcucacuaccauuguuuugcuggucccuccuaggcgggcccuggcagaag

SEQ ID NO: 141031 - RNA, 42 nt, Homo sapiens
gggcacaugccacaugcagauuuuggugcuuucccaaacuuc

SEQ ID NO: 141032 - RNA, 45 nt, Homo sapiens
cuuuuauuuuuucuuucuucuguuaaaacuauugaauugccagga

SEQ ID NO: 141033 - RNA, 45 nt, Homo sapiens
gagcaauucuuuaucuuauuaaaguaagaaaaacaguucccaaag

SEQ ID NO: 141034 - RNA, 23 nt, Homo sapiens
agugagaacagaacagaauauaa

SEQ ID NO: 141035 - RNA, 24 nt, Homo sapiens
caauauguguuauuuuguguuugg

SEQ ID NO: 141036 - RNA, 48 nt, Homo sapiens
auugucauacacacuaauaaaaaaaguauuuuuuauuuugugauuaga

SEQ ID NO: 141037 - RNA, 48 nt, Homo sapiens
auguuucuuagggucuuuuuucuuguuauuucuccaguagagacugga

SEQ ID NO: 141038 - RNA, 38 nt, Homo sapiens
ccccauguuaaugacugaaauauaucuuucuagccaau

SEQ ID NO: 141039 - RNA, 51 nt, Homo sapiens
uuccuguaaauauuaccuccuuggugaggcuguccuuuaauccccugguag

SEQ ID NO: 141040 - RNA, 33 nt, Homo sapiens
gaaaauuuuuuaaaucuuaauuuaaucuugaca

SEQ ID NO: 141041 - RNA, 46 nt, Homo sapiens
uguggcaagcuugaugccuuugcagaaaaguauuuccccauggaag

SEQ ID NO: 141042 - RNA, 45 nt, Homo sapiens
auacguaauuuuauaagguauucuguugagugaucauuguuuaaa

SEQ ID NO: 141043 - RNA, 66 nt, Homo sapiens
ccucuuucuuccuccgcucuuucucuucccucucguuuaguuugccugggagcuugaaaggagaaa

SEQ ID NO: 141044 - RNA, 54 nt, Homo sapiens
guaaaugaauugcuauuuuucaauuccuuagucuuuugugauugaugaaaguau

SEQ ID NO: 141045 - RNA, 44 nt, Homo sapiens
ucuaguuggauuggaugcugcuggcaagacaaccauucuguaua

SEQ ID NO: 141046 - RNA, 51 nt, Homo sapiens
guauuuguuaaaaauacacauugaguccauagguccuagcuaaggccugag

SEQ ID NO: 141047 - RNA, 347 nt, Homo sapiens
auucuaauaaugggccaggugccauggcucaugccuguaaucccaacacuuugggaggccaagauggguggaucacuugaguccaggaguucgagaccacaugggcaacguggugaaaccccaucucuacaaaaaauagaaaaauuagcuaggugugguggcacgcaccuguagucccagcuacuugggaggcugaggcgggaggaucauuugagcccagggggucaaggcugcagugagccaagauugugcuacugugcuccuaggcaacagaguugagacccugucugagaaaagaagcuaauauuuguaucucuaagaauugauaacuaccuuccuuuuuuuaa

SEQ ID NO: 141048 - RNA, 42 nt, Homo sapiens
gggucuuauuuuugugguagauagcaacgaucgugaaagaau

SEQ ID NO: 141049 - RNA, 55 nt, Homo sapiens
cuuauuugaaggcauaugauuguuugcucuggauuuaaaaacugaaggauaugag

SEQ ID NO: 141050 - RNA, 46 nt, Homo sapiens
uuggauaucuaaccaaggacauguuugauaaaauuggucuaggcuu

SEQ ID NO: 141051 - RNA, 47 nt, Homo sapiens
guuuguaucuugguuauuaaacaguaucugggacugguuugggcaga

SEQ ID NO: 141052 - RNA, 49 nt, Homo sapiens
agcguaaaugccuggacauagcucuugugcaaccuuuaaauaaauuguu

SEQ ID NO: 141053 - RNA, 42 nt, Homo sapiens
cacuacucagcucucuugcacugaggaaauuuuucccccuac

SEQ ID NO: 141054 - RNA, 46 nt, Homo sapiens
cugguugcaaagaauugauauuuagaugguuuuuaauacucagcag

SEQ ID NO: 141055 - RNA, 42 nt, Homo sapiens; identical to SEQ ID NO: 47108

SEQ ID NO: 141056 - RNA, 39 nt, Homo sapiens
aaagauggugcucggcgccccucccucccagccccugaa

SEQ ID NO: 141057 - RNA, 45 nt, Homo sapiens
gagaaaccauguugacaaagaugaaguuaaccuuuggaaauuagc

SEQ ID NO: 141058 - RNA, 56 nt, Homo sapiens
ugauuagugaaaaugagcaauuuuuaacuuguguaauuauuuauacccugaacacc

SEQ ID NO: 141059 - RNA, 51 nt, Homo sapiens
caauguuuugugguagguacuauucccauuuuacagaugaggagacuaaag

SEQ ID NO: 141060 - RNA, 77 nt, Homo sapiens
cugagaacaauagcucucuccauacauaauagcaaaguaaucaagguaaaauuuacuuugagcuauccucaguccaa

SEQ ID NO: 141061 - RNA, 69 nt, Homo sapiens
auuuauguauauaugauaauauuuuuugugauacauguauacauaauacaaaaagaucugccuuaacac

SEQ ID NO: 141062 - RNA, 46 nt, Homo sapiens
uuuacagacacuuauguaauauauacaugcuuugguaaaugaaugg

SEQ ID NO: 141063 - RNA, 60 nt, Homo sapiens
guuuucaguagugaccuguuuugacuguuacauucuugacccuuauuaaauagugucuug

SEQ ID NO: 141064 - RNA, 52 nt, Homo sapiens
cagagaaaauuaaaaucuuaguaguuugaauugaugugguuucaugguaugg

SEQ ID NO: 141065 - RNA, 46 nt, Homo sapiens
ggaacuuucagaauccuaugcauuucugaugguugaucgauaccag

SEQ ID NO: 141066 - RNA, 44 nt, Homo sapiens
aauuuuuccgucuuuucuaggugucuaucuuucuagguaugcug

SEQ ID NO: 141067 - RNA, 21 nt, Homo sapiens
aaugaaaacacaaugaguaga

SEQ ID NO: 141068 - RNA, 46 nt, Homo sapiens
aaaucccuccagcacuguuuuauaaggaaacauacuuagguccaaa

SEQ ID NO: 141069 - RNA, 46 nt, Homo sapiens
gaauggaauguauugcagccuuuaugaaguuguggaaaagacaaga

SEQ ID NO: 141070 - RNA, 50 nt, Homo sapiens
auacugaagcauaucuaguuuggguagagggauugggucaaacaucagau

SEQ ID NO: 141071 - RNA, 57 nt, Homo sapiens
aacauaauuuuauguuuguauuacauggcuuguuuucuucugaaagccugacuacaa

SEQ ID NO: 141072 - RNA, 57 nt, Homo sapiens
gagagugaguauugagaauucggacaaugagggguuuaucagaaaauuacaauaucu

SEQ ID NO: 141073 - RNA, 66 nt, Homo sapiens
uuuaguaacucuaaagcaucauuugccaggauaaauauuaggcaauucaaaauuaaugagaauuuu

SEQ ID NO: 141074 - RNA, 97 nt, Homo sapiens
gaacuuuaauacuguguauuaagcuaaaguucccacuaauggcuuuauuucacuguuggauuaaggaugaguuucucaguuguggcuacucagcauc

SEQ ID NO: 141075 - RNA, 48 nt, Homo sapiens
aaagguucaaccaaugcagcaccacaggagaggcaugagagcaugcca

SEQ ID NO: 141076 - RNA, 46 nt, Homo sapiens
aaaaguauguaagugaauuuuuuaagcgagguuuugguucagguaa

SEQ ID NO: 141077 - RNA, 44 nt, Homo sapiens
aaaucccauauugauacuuguuugcaugccuauauuuuucggcc

SEQ ID NO: 141078 - RNA, 45 nt, Homo sapiens
cuauuugaagaaaauagaaaacuucagcaguuuaguccacuuuca

SEQ ID NO: 141079 - RNA, 46 nt, Homo sapiens
guggggacucagacacagaagauaugagaagcaaaacugucuugaa

SEQ ID NO: 141080 - RNA, 33 nt, Homo sapiens
gccgcagauaacauauugcagcccuuuacuucu

SEQ ID NO: 141081 - RNA, 46 nt, Homo sapiens
uucuucucauacaggccaugucuugcaagucuauguuuggguucau

SEQ ID NO: 141082 - RNA, 46 nt, Homo sapiens
uggauaguuaccgugucguucaugauggcugucuauccucagacag

SEQ ID NO: 141083 - RNA, 347 nt, Homo sapiens
uuguccuuuuauauuccuuuauuuuuuuugagacggagucuugaugucuccccaaggcuggaguguaguggcaugaucucggcucacugcaagcuccaccuccuggguucaugccauucuccugccucagccucccgaguagcugggacugcaggcgccugccaccaugcccggcuaauuuuuuguauuuuuaguagagacgggguuucaccaugugagccaggauggucucgaucuccugaccucgugauccgccugccucggccucccaaagugcugggauuacaggcgugagccaccacgccuggccauauuccuuuauuuuuauaguugaagaaguauaauau

SEQ ID NO: 141084 - RNA, 60 nt, Homo sapiens
auauucuuaugcuuuuuauuaagcaacuugucucuucagauucagugugucuuagucuag

SEQ ID NO: 141085 - RNA, 46 nt, Homo sapiens
acagccuauuggcucacuuggacaugaugcugacuugaggcggcag

SEQ ID NO: 141086 - RNA, 46 nt, Homo sapiens
ucaucagugcucaauccuaaggcuuuguugacugugucugucagag

SEQ ID NO: 141087 - RNA, 45 nt, Homo sapiens
agacacagucaacaaagccuuaggauugagcacugaugaugccua

SEQ ID NO: 141088 - RNA, 48 nt, Homo sapiens
agaggugcugugaguaugcuucagggaaugauuuuuuucuuugaaaaa

SEQ ID NO: 141089 - RNA, 40 nt, Homo sapiens
uuuguagcugagaaguagccuuaucugccuuaagcaguca

SEQ ID NO: 141090 - RNA, 41 nt, Homo sapiens
ggauccaaauuuaauuagcgugaauaauuuugaagauugca

SEQ ID NO: 141091 - RNA, 81 nt, Homo sapiens
uauggaguuuagcaugcagacugcugaaugaagacuguuggcagaaacugaguuuuugauaaggugagguagcugcagaga

SEQ ID NO: 141092 - RNA, 45 nt, Homo sapiens
aguaauuuuuuagcggguaaaauuguguauacgucuucuaagcaa

SEQ ID NO: 141093 - RNA, 28 nt, Homo sapiens
ucuaaggaccaucccauaaguagggcac

SEQ ID NO: 141094 - RNA, 52 nt, Homo sapiens
gaggcagagccgccugcagugagcgaaaccacagagaggacaguguuaggag

SEQ ID NO: 141095 - RNA, 42 nt, Homo sapiens
cuucugaucauauuguaccuggugauauggcccgggaaccag

SEQ ID NO: 141096 - RNA, 54 nt, Homo sapiens
uuugguuaaaaucaugaaagacguccagaaaaauacugugaaauuuuauauuca

SEQ ID NO: 141097 - RNA, 46 nt, Homo sapiens
uuuacuuaccaugacuggaauuucauuagaggaagcagagggacca

SEQ ID NO: 141098 - RNA, 29 nt, Homo sapiens
ggaauaucuuaucaaauuaggcaauacag

SEQ ID NO: 141099 - RNA, 46 nt, Homo sapiens
ccauucacagauaacuaguacauuucagucuuuucuugagcuuuua

SEQ ID NO: 141100 - RNA, 47 nt, Homo sapiens
cuggacauucacaucuagugugaguguugugacuaagugaacuugug

SEQ ID NO: 141101 - RNA, 49 nt, Homo sapiens
uugugugaguaguguauaauuuuaaaacuuaaacaaacuguguauuuca

SEQ ID NO: 141102 - RNA, 85 nt, Homo sapiens
gaagaggauaugucucuggauucaggggaugaaaucucacauauagaaguaugcagcaauuuucauucagaaauaugggagaaag

SEQ ID NO: 141103 - RNA, 47 nt, Homo sapiens
gucaauuaaauaugucccaucaguuuagucauuuuaauguucucacu

SEQ ID NO: 141104 - RNA, 96 nt, Homo sapiens
agacauuuuuggggacaccauaugcccuuucaucaagucagucucaagaaaaugagaauuacuucuuaucugcuuauacugaaagcuuggauagag

SEQ ID NO: 141105 - RNA, 45 nt, Homo sapiens
ucgauaccucaagauuuaucuaacagugcaguuucauuuagauaa

SEQ ID NO: 141106 - RNA, 56 nt, Homo sapiens
auauauagcuaucacauuuguaagauucuguuuuuagcauaaaaaucaauagggau

SEQ ID NO: 141107 - RNA, 39 nt, Homo sapiens
cucuucggguugaucucucuuuuccccguuuuuccaggg

SEQ ID NO: 141108 - RNA, 39 nt, Homo sapiens
ccuggguuagucgcaccccuccagcucaccgcacagcaa

SEQ ID NO: 141109 - RNA, 46 nt, Homo sapiens
gcagcucagauggcgacuugugcguuuucagcggcaucucccggag

SEQ ID NO: 141110 - RNA, 46 nt, Homo sapiens
cccagagaggaggagcuggagaucaggaggcgugagccgccaagag

SEQ ID NO: 141111 - RNA, 42 nt, Homo sapiens
cgcagugaaccggagcugaagcgggcacuggcgcccgggccu

SEQ ID NO: 141112 - RNA, 44 nt, Homo sapiens
cagcuucuucaggcgguuggggaaauggagggauaggaagaggc

SEQ ID NO: 141113 - RNA, 47 nt, Homo sapiens
gaguccgccuuguccuuuagaaaacacuugggccuccgcuuugggag

SEQ ID NO: 141114 - RNA, 40 nt, Homo sapiens
ggggaguuucgagggggcaaugcggagagugcgcagcgaa

SEQ ID NO: 141115 - RNA, 38 nt, Homo sapiens
gcgaaacugguccucugggggccuccgagggccccugc

SEQ ID NO: 141116 - RNA, 78 nt, Homo sapiens
agcagccggaugcacaccuaaagucucgcaacacccaacuccuccuccgcaggcagucccuuaagagaauagauaaaa

SEQ ID NO: 141117 - RNA, 43 nt, Homo sapiens
cgcauccuggagaauggaaaucugggguuuccccagcuaggag

SEQ ID NO: 141118 - RNA, 51 nt, Homo sapiens
cugccguuccuccccacuggugacuucuccaccuguaggcggcggcggagc

SEQ ID NO: 141119 - RNA, 39 nt, Homo sapiens
gggugggagggagagugaaaaaucagaauuugggagaaa

SEQ ID NO: 141120 - RNA, 43 nt, Homo sapiens
auuuccuuaaggacguucuucagccagacuagggaggggagaa

SEQ ID NO: 141121 - RNA, 43 nt, Homo sapiens
auaaucaguuuacgagccgauguggggaaagccacuuccagau

SEQ ID NO: 141122 - RNA, 51 nt, Homo sapiens
cuccugggcuuaauauuccaauggacuucuggagagggaagaaaggagcag

SEQ ID NO: 141123 - RNA, 46 nt, Homo sapiens
ccuucacauacgcggugagcgcagcagggguggugaacgccaugag

SEQ ID NO: 141124 - RNA, 86 nt, Homo sapiens
ugcggcgacaacaucgacuauggcuaccgcuuugccaaggaguucguggacgcccgcgagcgggagcgcauccacgccaagggcuc

SEQ ID NO: 141125 - RNA, 103 nt, Homo sapiens
ugcaaguuccacuggugcugcuacgucaagugcaagaagugcacggagaucguggaccaguuugugugcaaguagugggugccacccagcacucagccccgcu

SEQ ID NO: 141126 - RNA, 29 nt, Homo sapiens
ugguuccgguugcaauucuuggggaaaaa

SEQ ID NO: 141127 - RNA, 84 nt, Homo sapiens
uuuuuuuuccuguuaccaucuaagaacucugugguuuauuauuaauauuauaauuauuauuuggcaauaaugggggugggaacc

SEQ ID NO: 141128 - RNA, 64 nt, Homo sapiens
gaaugaaggggaaauaacacauacccuaacuuagcuguguggacaugguacacauccagaaggu

SEQ ID NO: 141129 - RNA, 47 nt, Homo sapiens
aacaaaacaaaacaaaacaaaccucccuuccccagcagggcugcuag

SEQ ID NO: 141130 - RNA, 66 nt, Homo sapiens
gauacuugguuaguaaauuauaauaguaaaaauaauacaugaaucccauucacagguucucagccc

SEQ ID NO: 141131 - RNA, 40 nt, Homo sapiens
cuugaguucugacucacugaaaugcguguuggguugaaga

SEQ ID NO: 141132 - RNA, 43 nt, Homo sapiens
ugguuuaaaaaacaaacaucgaaaggcuuaugccaaauggaag

SEQ ID NO: 141133 - RNA, 31 nt, Homo sapiens
uuuuuggacuaaaaaucuggucacggauaaa

SEQ ID NO: 141134 - RNA, 45 nt, Homo sapiens
uuccgcggcuuagguagggggagaaaccaagauguuuaugcuuaa

SEQ ID NO: 141135 - RNA, 46 nt, Homo sapiens
agcguagaaugaguggcuggcauuugaaaaacaaguuagccaagaa

SEQ ID NO: 141136 - RNA, 42 nt, Homo sapiens
acagaaaccgacaggggccaggcgcccgguggcuccgaagcg

SEQ ID NO: 141137 - RNA, 48 nt, Homo sapiens
aauuugaauauauauuugagugucucaugaucagggaacuguagggau

SEQ ID NO: 141138 - RNA, 46 nt, Homo sapiens
gaaucaaucaucugcguggcccuagucccccuccaauggcuggugg

SEQ ID NO: 141139 - RNA, 36 nt, Homo sapiens
cuaagaagcagacaaccggacaugcgcauucauagc

SEQ ID NO: 141140 - RNA, 39 nt, Homo sapiens
gcagaauggacuccucaucuuuauauucacgaaaaagca

SEQ ID NO: 141141 - RNA, 72 nt, Homo sapiens
ccggccauaaugacccaggcugagaagggugauacggagaacggaaaggagaagggcggcgagaaggagaag

SEQ ID NO: 141142 - RNA, 42 nt, Homo sapiens
uguucgggaaauaaguggacaaacacaucucaucacccugag

SEQ ID NO: 141143 - RNA, 42 nt, Homo sapiens
aauaucugcauuuuuugucauagugguguucugcgggugagu

SEQ ID NO: 141144 - RNA, 51 nt, Homo sapiens
uaguauucauuaauuaaacauagaauauuagcuaaacaguucuggguacac

SEQ ID NO: 141145 - RNA, 47 nt, Homo sapiens
caccagagacccuuuccagcuccucucgcccuaucccacucagauga

SEQ ID NO: 141146 - RNA, 63 nt, Homo sapiens
ucaccagcaucgcagaccucacgggccaggucgcucuguacaccuucugccccaaggccaacc

SEQ ID NO: 141147 - RNA, 51 nt, Homo sapiens
ucuacauagucuuaaaaguggaaaauagucuugucaggucagcgagcuauu

SEQ ID NO: 141148 - RNA, 55 nt, Homo sapiens
aacucaagugacaccuucauauccaacuucuuucauucaaauuaauuuuuggagu

SEQ ID NO: 141149 - RNA, 202 nt, Homo sapiens
auucucuuaaaucuuugugggguaguggugguggugguggugguuguuuucaaaagacaaggucucacuguguugcccaggcuggucuugaacuccugggcucaagcaauucucccgccucagccucccgaagugcuagcaugggccaccauguccagccucuugaaucuuuugggaacaguguauuuuuauucugugcaag

SEQ ID NO: 141150 - RNA, 49 nt, Homo sapiens
gaggcucagagcuguuuaggaaucugcucgagauucgcaaagguaauaa

SEQ ID NO: 141151 - RNA, 87 nt, Homo sapiens
gaagcuuuggcuuagauuuuuaugcguccuauuuagucauuccuuuuugaaacuuacaaaugauuucuagauacaaaagcugcagaa

SEQ ID NO: 141152 - RNA, 38 nt, Homo sapiens
cuauucccauccauaaaaaugcaaaaugaaaguuccaa

SEQ ID NO: 141153 - RNA, 23 nt, Homo sapiens
aauaagacauuagcuuugaacac

SEQ ID NO: 141154 - RNA, 37 nt, Homo sapiens
aauugucuguagcaugguaucaagaaaaucugucugu

SEQ ID NO: 141155 - RNA, 51 nt, Homo sapiens
ggauaagguuuguacagcuaaagcucuagcuuuguccuaaguaacaaagag

SEQ ID NO: 141156 - RNA, 55 nt, Homo sapiens
gauccgaguaacuguuuaaucuggauuuugcaguagccugcuaccugguuuccca

SEQ ID NO: 141157 - RNA, 71 nt, Homo sapiens
aaucauagccaggaucaugacaguggcccacgaggcccuaccuuaucuggccccucuaccccaggccucau

SEQ ID NO: 141158 - RNA, 37 nt, Homo sapiens
cagucugcuccaucuggacacaagcaucugacgguag

SEQ ID NO: 141159 - RNA, 59 nt, Homo sapiens
gggucuggauucagaagaaauggagagguugccaggagaugccucccagaaagagccca

SEQ ID NO: 141160 - RNA, 123 nt, Homo sapiens
cugggugucccuucugcugcccaccauucaguccagccugaaaucaccaccccggugcuaaucacuccagccuccaucacacaguccaaugaaaagcaugcuccaaccuacacaaucccguug

SEQ ID NO: 141161 - RNA, 63 nt, Homo sapiens
agcccuguucucagucccacucugccagcugaagcuccuacugcacagguuccccccagcuua

SEQ ID NO: 141162 - RNA, 47 nt, Homo sapiens
uaagccaugccagucugauugccaaccagagccccuucagggcccca

SEQ ID NO: 141163 - RNA, 46 nt, Homo sapiens
ccucccaagcguugaucuucuccagaaacucagguugaccccacag

SEQ ID NO: 141164 - RNA, 45 nt, Homo sapiens
uaucugucugucuuuucuucauaaacauuucagucuaugcagcag

SEQ ID NO: 141165 - RNA, 45 nt, Homo sapiens
gccagcuccccuucuccucuaacuauuggaacgccagaaagucag

SEQ ID NO: 141166 - RNA, 41 nt, Homo sapiens
gaacaaagacaaccacaaccuaugacuggagcagaauaagu

SEQ ID NO: 141167 - RNA, 46 nt, Homo sapiens
aaauuuauauauucaaaguauuuacuuaaaauucagaagccagaag

SEQ ID NO: 141168 - RNA, 50 nt, Homo sapiens
uuaucugugugauuccuuaagaaacauguuuuuaaaauauguguucuaaa

SEQ ID NO: 141169 - RNA, 44 nt, Homo sapiens
acggccaaccgccuacguaucagcuccauccaggccaccacugc

SEQ ID NO: 141170 - RNA, 48 nt, Homo sapiens
agcuacccaaaguuacacacagggagaucugauuugagccccagcagu

SEQ ID NO: 141171 - RNA, 92 nt, Homo sapiens
caggcagcggcggggcugauugggggaagaggggaggagggcgguggcacgugggugcagaacccugggauccauugugaaaaggaggucua

SEQ ID NO: 141172 - RNA, 48 nt, Homo sapiens
agcagugcuccgggcucaugacaggguugugagggcugcgugauggau

SEQ ID NO: 141173 - RNA, 1112 nt, Homo sapiens
ucaugcugucaggaaugcuucuuggcagggcauggugguucaugccuguaaucacagcacuuugggaggccaaggugggaggauugcuugagcccaggaguuccagaccaaccugggcaacacagugagaccccauagcuuaaaaaaaaaauuuuuuuuuugagauggagucuugcucuaucgcccaggcuagagugcagcagcacaaucuuggcucacugcaaccucugccucccagguucaacugauucuccugcccuagccuccugaguagcugggacuacaggcauccgccaccgcaccggcuaauuuuuguauuuuuaguagagaugggguuucaccaucuuggccaggcuggucucuugaccucaggugauccacccaccucggccucccgaagugcugggauuacgagugugaaccacugcccccggccaaacauuuuuuuuaauuggcuagguguggugauguguaccuguagucccagcuacaugggaggcugaggcagaggaucacuugagcccaggaaguugaggcuguagugagccuugaacaugccacacacugcagcaugggugacagagugagacugugucucaaaagaaagaaagagagagagagagaaagaaagaaaggccaagaaaagaaaaauaguugggcaugguguuacauguaugccagcacuuugggaggccaaggcagaagguucgcuugaggccaggaguucaagaccagccuggguaacauuagcaagacccugucuccaaaaauaaauaauguuucggccaggcgcagugacucaucccuuuaaucccagcacuuugggagguguaggcgaguggaucaccugaaggucaggagaucgagaccagcuuggccaacauggugaaacccugucccuacuaaaaauacaaaaaauuagcuggacgugguggcgggcgccuguaaucccagcuacucaggaggcugaggcaggagaaucacuugaacccgggaggcagaaguugcggugagcugagauugcaccauugcacucuggccugggcaacaaaauugaaacuucuucucaaaaaaaaaaaagaaugccucuugggcaagcagucugugccagg

SEQ ID NO: 141174 - RNA, 36 nt, Homo sapiens
acuguguguguguauguauauguuuaaaauaugcaa

SEQ ID NO: 141175 - RNA, 54 nt, Homo sapiens
caacaaguccccccaggguuucugacccacagcuuuggggagguuaaugccugg

SEQ ID NO: 141176 - RNA, 29 nt, Homo sapiens
agauuuacuacaaaaauuuaccacaucuc

SEQ ID NO: 141177 - RNA, 105 nt, Homo sapiens
gcugucacuccccauuuccacccccaguccugggcaaccacuaaucuaauuuucugucucuaaauuuaacucuucuagacauuucauauaaaugcaauuauacag

SEQ ID NO: 141178 - RNA, 42 nt, Homo sapiens
gucuggccucuuagcauaauuuuuagagggucauccauguug

SEQ ID NO: 141179 - RNA, 56 nt, Homo sapiens
gccgugugacuuuaggcaagucacuuucugugaaccuuaguggccccauccuccga

SEQ ID NO: 141180 - RNA, 43 nt, Homo sapiens
cccugaccccccccuucuggguggaaucacagccacagauccc

SEQ ID NO: 141181 - RNA, 34 nt, Homo sapiens
uuccuuauucuuagcacacugccucccaccccca

SEQ ID NO: 141182 - RNA, 65 nt, Homo sapiens
cuguaugggaggccauggccuucgccagcaucuauaagcuggacaaccuuguggccauucuagac

SEQ ID NO: 141183 - RNA, 63 nt, Homo sapiens
aucaaucgccugggccagagugacccggccccacugcagcaccagauggacaucuaccagaag

SEQ ID NO: 141184 - RNA, 68 nt, Homo sapiens
aggggcccagcauuggcugaggaggcuguggaggggagggagcagggcaggugccgugcaaggcuuug

SEQ ID NO: 141185 - RNA, 89 nt, Homo sapiens
gccugugacuacacuaaguaacaggaugcuugggguuaccuugcaguagcacagcauacgcaggccuguguucccugaugacugaccuc

SEQ ID NO: 141186 - RNA, 61 nt, Homo sapiens
cuuuggccaggccaagcaccagccaacagccaucauugccaagaccuucaagggccgaggg

SEQ ID NO: 141187 - RNA, 82 nt, Homo sapiens
ucuuggcaugggaagccccuccccaaaaacauggcugagcagaucauccaggagaucuacagccagauccagagcaaaaaga

SEQ ID NO: 141188 - RNA, 61 nt, Homo sapiens
agauccuggcaaccccuccacaggaggacgcacccucaguggacauugccaacauccgcau

SEQ ID NO: 141189 - RNA, 45 nt, Homo sapiens
cacuggccaagcugggccaugccagugaccgcaucaucgcccugg

SEQ ID NO: 141190 - RNA, 32 nt, Homo sapiens
ucuuuuacccaagugauggcguugcuacagag

SEQ ID NO: 141191 - RNA, 54 nt, Homo sapiens
ggccagacaccugggguguuuucucucgcauucccuuugucuucaagguugugg

SEQ ID NO: 141192 - RNA, 45 nt, Homo sapiens
agaucaacauccgcgugcuggaccccuucaccaucaagccccugg

SEQ ID NO: 141193 - RNA, 58 nt, Homo sapiens
aagugggaagccggcugagcugcugaagauguuugguaucgacagggaugccauugca

SEQ ID NO: 141194 - RNA, 58 nt, Homo sapiens
ggcgggggucuauacauuccugagauucugggaaaggugcucaaagauguacugagag

SEQ ID NO: 141195 - RNA, 42 nt, Homo sapiens
guuugcagccagugcagguucuggggaagaagcguggagggu

SEQ ID NO: 141196 - RNA, 48 nt, Homo sapiens
gccauugagggggcaacauagugaucuuuaacagcaaggaggugggag

SEQ ID NO: 141197 - RNA, 42 nt, Homo sapiens
gacguucgaugcccacaucuaugaggggcgcgucauccagau

SEQ ID NO: 141198 - RNA, 32 nt, Homo sapiens
aagcgagaggcacucgaccccaaggggucaau

SEQ ID NO: 141199 - RNA, 50 nt, Homo sapiens
gaaauguuggggguggggggggccuagauagaucuuugcaugugccugug

SEQ ID NO: 141200 - RNA, 51 nt, Homo sapiens
ugcugccgauauagcucaguguguagagcuuugugcauuuguagcuauggg

SEQ ID NO: 141201 - RNA, 56 nt, Homo sapiens
ggcccggaacagcgcagcaccgggucggugcuccaacaugggcuucgaagcugcca

SEQ ID NO: 141202 - RNA, 46 nt, Homo sapiens
guaaggucuggcacugcgcgucaguagccgggccuucuaagcccgg

SEQ ID NO: 141203 - RNA, 50 nt, Homo sapiens
caacccagaauacauaaccugggggccggagagccagcugggacccagag

SEQ ID NO: 141204 - RNA, 26 nt, Homo sapiens
gaaagucucuucaaacacaccaagaa

SEQ ID NO: 141205 - RNA, 46 nt, Homo sapiens
gucaaaauugacaauuuuguaucugaugcuuuucagggaaucacug

SEQ ID NO: 141206 - RNA, 53 nt, Homo sapiens
ucucaaacauaaagugaaacagaauuugaacuguaagcaagcauuucucagga

SEQ ID NO: 141207 - RNA, 70 nt, Homo sapiens
gaacuagccauaucaguucuucuuuccagucauucagcauuguaguaagaaaacacuugguaaggcagau

SEQ ID NO: 141208 - RNA, 42 nt, Homo sapiens
aaauguaaguuuuauuuacagaucaggccacagguuacaaaa

SEQ ID NO: 141209 - RNA, 33 nt, Homo sapiens
aaauguaaguuuuauuuacagaucaggccacag

SEQ ID NO: 141210 - RNA, 58 nt, Homo sapiens
uuuucuaguuccuucugccugucaaguuucugcugcuguuuuaguucuucaagcuguc

SEQ ID NO: 141211 - RNA, 46 nt, Homo sapiens
ccuuaaagggagcacuguuuggaacuccugggucuuuccuaggcuu

SEQ ID NO: 141212 - RNA, 33 nt, Homo sapiens
uaauuuucgaugauguucucgaaccuauuaaaa

SEQ ID NO: 141213 - RNA, 80 nt, Homo sapiens
acuuaccuuuuuuuggauuuuauaccgcuuauggcaggucaugcguuuacuugcuuucuuuaacucuacaaagaaacaca

SEQ ID NO: 141214 - RNA, 33 nt, Homo sapiens
caaggcugccacugagacagaaaguaaggaaug

SEQ ID NO: 141215 - RNA, 46 nt, Homo sapiens
aagcuaaauuugccgaguuagaagguggagaugaugauauugaaga

SEQ ID NO: 141216 - RNA, 92 nt, Homo sapiens
uagacccugaauucuguucuagagggacucccaagagaaaacacaaaacuagucuuuaggugguguugauuuucccaucucauuccaguauu

SEQ ID NO: 141217 - RNA, 63 nt, Homo sapiens
acugcuaaauagaauacaaaguccuuauucaauucauugugcccacucuguaaugcuuuucua

SEQ ID NO: 141218 - RNA, 51 nt, Homo sapiens
uuuaauuacauuaaacugcauuuucuguuaguaucccagucacauauuuaa

SEQ ID NO: 141219 - RNA, 42 nt, Homo sapiens
gcaguaaccacucuuugguccucauggggaacccugcagcua

SEQ ID NO: 141220 - RNA, 46 nt, Homo sapiens
ccaacucaagcccaagcacaauccauucuuaccagcagugguaagg

SEQ ID NO: 141221 - RNA, 44 nt, Homo sapiens
caaagcuggagaaccaugcuuugugaucaggacuaugcgcucau

SEQ ID NO: 141222 - RNA, 45 nt, Homo sapiens
ucccauauuaauugccaucauaugcaaaagaacucuuagcuguaa

SEQ ID NO: 141223 - RNA, 47 nt, Homo sapiens
ugcaaagcaaugauuuacacaguuuagggagccacaccguguucugg

SEQ ID NO: 141224 - RNA, 46 nt, Homo sapiens
ugaugaaccaaggaguggccccuaugguagggacuccagcaccagg

SEQ ID NO: 141225 - RNA, 46 nt, Homo sapiens
aaggaggauaauuuuuauugcauuuuacuguacaucacaaggccau

SEQ ID NO: 141226 - RNA, 61 nt, Homo sapiens
agguaugcauggaggugauuuauuuuuaaacauaacaccuaaccuaacauggguaagagag

SEQ ID NO: 141227 - RNA, 46 nt, Homo sapiens
guuuaauuacuguacuuauuaaaucaugagggcaaaagaguguaga

SEQ ID NO: 141228 - RNA, 45 nt, Homo sapiens
uucaucuaaagcuuuuuaauccaaauaaauacagaguuugcaaag

SEQ ID NO: 141229 - RNA, 55 nt, Homo sapiens
guguguguguuguguuaauucuuucucauguugggagugagaaugccgggccccu

SEQ ID NO: 141230 - RNA, 31 nt, Homo sapiens
aauguuuuauccucccuuugguaccuuaauu

SEQ ID NO: 141231 - RNA, 46 nt, Homo sapiens
accuggaccgagugcucaugggcuaccagaccuacccgcaggcccu

SEQ ID NO: 141232 - RNA, 76 nt, Homo sapiens
cuccuggaugaggacuguguccacuacccacugcccgaguuugccaaagagccgccgcagagagacagguaccggc

SEQ ID NO: 141233 - RNA, 46 nt, Homo sapiens
ugacgcgggacagcuaccugacgcacugcuuccuccagcaccucau

SEQ ID NO: 141234 - RNA, 43 nt, Homo sapiens
gcuccacgacggccuccgccgcuacuucucagagccacugcag

SEQ ID NO: 141235 - RNA, 43 nt, Homo sapiens
ggccccugcccaguacccgagugagcaccucauccaggccacc

SEQ ID NO: 141236 - RNA, 55 nt, Homo sapiens
ccccgggccucccucuacaucaccaccccagguuuggugccaggcugcuccuuau

SEQ ID NO: 141237 - RNA, 25 nt, Homo sapiens
gacuguggucaucgccaagaccccc

SEQ ID NO: 141238 - RNA, 49 nt, Homo sapiens
gcuagagcugcucgugggguaccgcuuugucacugccaucuucgugcug

SEQ ID NO: 141239 - RNA, 50 nt, Homo sapiens
cugcgcgcccucugaggccgucaaguccgccgccauccccuacuggcugu

SEQ ID NO: 141240 - RNA, 82 nt, Homo sapiens
gcugagaaccgcuacuuugaaauggggcccccagacguggaggaggaggagggaggaggccagggggaggaagaggaggagg

SEQ ID NO: 141241 - RNA, 44 nt, Homo sapiens
gcgggaggagggccagggugaacagggcgaggaggaggaugagg

SEQ ID NO: 141242 - RNA, 42 nt, Homo sapiens
gcgccugagcacacugauccggcaggccaucgagcggcagcu

SEQ ID NO: 141243 - RNA, 46 nt, Homo sapiens
aacaugccgagccggagguccagguggugccggggucuggccagau

SEQ ID NO: 141244 - RNA, 42 nt, Homo sapiens
aggcagcuuccgaugauuuaagggacgugccaggagcuguug

SEQ ID NO: 141245 - RNA, 54 nt, Homo sapiens
agaggcucuggcccuagguugcgagugggaaucccagcccugcugugugcuggu

SEQ ID NO: 141246 - RNA, 45 nt, Homo sapiens
gaggcccuggccagcagccucucguccacugacagucugacuccc

SEQ ID NO: 141247 - RNA, 62 nt, Homo sapiens
gccucagugagacuggcggccgaugcccaguguucacccugcuggcggcagucaggaacaug

SEQ ID NO: 141248 - RNA, 51 nt, Homo sapiens
gucucgaccuguggggcucagaggacucggggucauuucacugggcugugg

SEQ ID NO: 141249 - RNA, 45 nt, Homo sapiens
ugaggucacaccugugagauguggaagagaauuccugagcgugga

SEQ ID NO: 141250 - RNA, 46 nt, Homo sapiens
acgcagaacuuggugugaggucuugggaaaacaguucaacccgaug

SEQ ID NO: 141251 - RNA, 105 nt, Homo sapiens
gugaagacucccggcucucagcugcccccugcaucagacccagcagcuccccucccacuguggcucccgcaucugccucccugccccagcccauccucucuaacc

SEQ ID NO: 141252 - RNA, 64 nt, Homo sapiens
gacacuguggaagugcugaaagcaauucagaaagccaaggaggucaaguccaaacugagcaacc

SEQ ID NO: 141253 - RNA, 46 nt, Homo sapiens
cuccuggacaaccuguggccauagugccugacuguaaacccaaagg

SEQ ID NO: 141254 - RNA, 33 nt, Homo sapiens
ccccaggaaaaagcucccuugcaucuccugccc

SEQ ID NO: 141255 - RNA, 86 nt, Homo sapiens
gaacaacccucugagcaucauccccgacuaccggaccaaggugcuggcucaguucggagagagggccucagaggugagccccagca

SEQ ID NO: 141256 - RNA, 59 nt, Homo sapiens
cagauggaggagguccggagcauaggcagccucccgugucuggagcacgugucucugcu

SEQ ID NO: 141257 - RNA, 50 nt, Homo sapiens
ccugcacaagcucuacucacuggucaaccuggaucuccgggacaacagga

SEQ ID NO: 141258 - RNA, 45 nt, Homo sapiens
gcaccuguauaaccuugugcaucuggaccuguccuacaacaagcu

SEQ ID NO: 141259 - RNA, 49 nt, Homo sapiens
uuggcaggcauugaccacgcuugaccugagccacaacagcgucuccgag

SEQ ID NO: 141260 - RNA, 49 nt, Homo sapiens
uagccaaaaguggaaccugaguuauaugguaacuauguuugacuuuuug

SEQ ID NO: 141261 - RNA, 51 nt, Homo sapiens
guuugaggcaggcuccgcuacuuguagaaguuuugacauauuuggaauuag

SEQ ID NO: 141262 - RNA, 49 nt, Homo sapiens
cagaguaagacaguugaaccuuucuuggaucacuaaagagccuagaaau

SEQ ID NO: 141263 - RNA, 45 nt, Homo sapiens
auuccaggauuguaacaaaauaguaaggacaacccuaaagucuag

SEQ ID NO: 141264 - RNA, 32 nt, Homo sapiens
ggagacagaggacaaauagcggguaguucccg

SEQ ID NO: 141265 - RNA, 48 nt, Homo sapiens
uggauggaaucagggaaaagggucaggcuucgcaggccuugaagaaag

SEQ ID NO: 141266 - RNA, 40 nt, Homo sapiens
gaggggccccggccuggaagaccguuacagggguccagga

SEQ ID NO: 141267 - RNA, 39 nt, Homo sapiens
agggucugcgauugcgaggagggggcugggacgggggau

SEQ ID NO: 141268 - RNA, 58 nt, Homo sapiens
agcaagcagggcaggccacacggcagucuccgaucucaucucaccccccugcagaagg

SEQ ID NO: 141269 - RNA, 41 nt, Homo sapiens
ggagggccuggacauggcgcugaggggccgccccgcgggaa

SEQ ID NO: 141270 - RNA, 36 nt, Homo sapiens
cccagcccuguauauggauuuaucuuccuguucaaa

SEQ ID NO: 141271 - RNA, 46 nt, Homo sapiens
ccacgccaccucccugagaagcagaauggccuuagugcagugcgga

SEQ ID NO: 141272 - RNA, 31 nt, Homo sapiens
ccugggugggcugggggaggggcaggccuca

SEQ ID NO: 141273 - RNA, 48 nt, Homo sapiens
aacccucccugcauuccuccucccuucccccacagcauuugucucuga

SEQ ID NO: 141274 - RNA, 47 nt, Homo sapiens
gaugacgaggaggaugacgugcagaacaccaacucugcccuuagguc

SEQ ID NO: 141275 - RNA, 45 nt, Homo sapiens
cggcuguggcagugcccacacacucgcagcccucacccaccccca

SEQ ID NO: 141276 - RNA, 42 nt, Homo sapiens
guggagaaggaggucguggaagccacggacagcagagagaag

SEQ ID NO: 141277 - RNA, 83 nt, Homo sapiens
uggcaggagcugcuggcacugcugaaguguguggaggcugagauugcaaacuaugaggcgugccucaaggaggagguagagaa

SEQ ID NO: 141278 - RNA, 61 nt, Homo sapiens
ugaauaaaacucuccuaagaaucuccugagaaaugaacccuccugugguugcuggccugag

SEQ ID NO: 141279 - RNA, 51 nt, Homo sapiens
aaaauauuguccaaagauauaucaacaacaugagguugucaguuuaauuuu

SEQ ID NO: 141280 - RNA, 38 nt, Homo sapiens
cuuuucaguacucugaaguucaauuuaauagccuugaa

SEQ ID NO: 141281 - RNA, 46 nt, Homo sapiens
cccguauucugccuccgaggcccaguggggcuggcuguggggugag

SEQ ID NO: 141282 - RNA, 26 nt, Homo sapiens
acauccaagucaaaugaagcacagaa

SEQ ID NO: 141283 - RNA, 40 nt, Homo sapiens
guugugacaaucuuuacaauuuaauuacuguauuauaaua

SEQ ID NO: 141284 - RNA, 40 nt, Homo sapiens
gaagguguaccaagagagaacauucaucaggguuccaaaa

SEQ ID NO: 141285 - RNA, 53 nt, Homo sapiens
ccgugcuagagaaaaaccauacaguguugggcaggacagaugacaggacaaac

SEQ ID NO: 141286 - RNA, 26 nt, Homo sapiens
uggcuccugcaaagaaggguggcgag

SEQ ID NO: 141287 - RNA, 51 nt, Homo sapiens
ccuuucucaaaguggucuuuaugcagguaauaauaauagaaaaugccuaug

SEQ ID NO: 141288 - RNA, 50 nt, Homo sapiens
gauguguauuauaauaccagcuucugcucuagaacuacuuugggugaaau

SEQ ID NO: 141289 - RNA, 45 nt, Homo sapiens
uggucugcacccaaugaagggaaaccccaaaguacugucucaaau

SEQ ID NO: 141290 - RNA, 75 nt, Homo sapiens
gcuguuuuuaauuuaucacauacaccagaacuucuauccugcaucacuuauauguaaaugaugcuguuaccaaaa

SEQ ID NO: 141291 - RNA, 46 nt, Homo sapiens; identical to SEQ ID NO: 47447

SEQ ID NO: 141292 - RNA, 56 nt, Homo sapiens
guuacuauuuggagagagaagcaguugccugccaaauugaagacuaccuuucaaau

SEQ ID NO: 141293 - RNA, 46 nt, Homo sapiens
aaagguuuuuuuaauaaaaugccauuuuguggaaacuggaguagau

SEQ ID NO: 141294 - RNA, 80 nt, Homo sapiens
agcuucaaacugugcuuuuucaggaaaaaggcacuuugauauucacguagaaauucaaccuaagaggaaagaucccacag

SEQ ID NO: 141295 - RNA, 41 nt, Homo sapiens
caacaccucaaaaacagucagcuuugaagcuuugcccauca

SEQ ID NO: 141296 - RNA, 36 nt, Homo sapiens
aucuguauggugguuauacaaauguauguuauguga

SEQ ID NO: 141297 - RNA, 45 nt, Homo sapiens
gggucaugaaacuagugccuuguuaauacuggaaaagauaacaga

SEQ ID NO: 141298 - RNA, 45 nt, Homo sapiens
ugcagaacugacuuuacaagauaacaguaaaaauacugcccucca

SEQ ID NO: 141299 - RNA, 43 nt, Homo sapiens
gacuauugaggagucuacuuuaccauggccuuauaacauagug

SEQ ID NO: 141300 - RNA, 46 nt, Homo sapiens
aacgaaggugcugcugagauguuaauugauacauuaggugccagca

SEQ ID NO: 141301 - RNA, 45 nt, Homo sapiens
cauguguagaacugcuuuuagaacaggaaguuuuccagaaaacgg

SEQ ID NO: 141302 - RNA, 46 nt, Homo sapiens
ugauagaaccagugcagaagagaaguaaaaagaauuaugcauggua

SEQ ID NO: 141303 - RNA, 50 nt, Homo sapiens
uuuaaacaaugacaacaugaaucguguguuauuuccucagugugccaaua

SEQ ID NO: 141304 - RNA, 26 nt, Homo sapiens
uaauaguauuuuuauuucuuuaagaa

SEQ ID NO: 141305 - RNA, 69 nt, Homo sapiens
guaugcacagaauggcuucucacguuuccccagcaaaguccauaaugacaguagugcugaaggugagaa

SEQ ID NO: 141306 - RNA, 46 nt, Homo sapiens
guuuagagcuucuaguuggcaauggggccgaugucaauaugaaggu

SEQ ID NO: 141307 - RNA, 385 nt, Homo sapiens
uaccaaaauuauccugaauucuauuuuuuugucuuguuuuguuucgagauaaggccucgcuccauugcccacccuggagugcaguggcaugaucacagcucacugcagccuuaaccucccaggcucaaguaauucuucugucucagccucccaaguaacugagacuacaggugcaugccaccauacccagcuaauuuuuuuuuauuuuugguggagacagggucucacuguguugccuaggcuggucucaaauuccugggcucaagugauccucccacuucagccucccaaagugcugagauuauaggcaugagccauuaugcccaccccuaaagucuuaaaauuuuccuucuguccucucucaaguuaacaugauucauugaug

SEQ ID NO: 141308 - RNA, 45 nt, Homo sapiens
ggucaaacuacucuugucuagaggugccaauauuaaugcuuuuga

SEQ ID NO: 141309 - RNA, 28 nt, Homo sapiens
gaauccuugccucuacugcaguuaaggu

SEQ ID NO: 141310 - RNA, 47 nt, Homo sapiens
guacaaaccaaguuaauuguuucauuucuucuuuuguuuauaaggcc

SEQ ID NO: 141311 - RNA, 25 nt, Homo sapiens
ccuuuacacagagcaguugcaucuu

SEQ ID NO: 141312 - RNA, 49 nt, Homo sapiens
acaagggacugcuguuuuauauucuuuucugucuuaaugaguaggaaau

SEQ ID NO: 141313 - RNA, 40 nt, Homo sapiens
uaaaugaugaugagugcuuugaaaaaauugaaagguagau

SEQ ID NO: 141314 - RNA, 25 nt, Homo sapiens
aagcaaaucuuuugguuuguuuagg

SEQ ID NO: 141315 - RNA, 44 nt, Homo sapiens
uauauugaaacagacaugaauauauuuuggagaugaaaguaaaa

SEQ ID NO: 141316 - RNA, 33 nt, Homo sapiens
acauuuugccacauuugcuuucuguauuuauua

SEQ ID NO: 141317 - RNA, 42 nt, Homo sapiens
uuaaaugagggcaggaagguauugaggcaaaagggaaaacac

SEQ ID NO: 141318 - RNA, 47 nt, Homo sapiens
guucgagcacuaauauuuaagaaagaagauguuaacuuucagguaaa

SEQ ID NO: 141319 - RNA, 55 nt, Homo sapiens
aaacuucuggcuaaugucaaaagugauuauugcuacagggaagaaaacuuguaga

SEQ ID NO: 141320 - RNA, 40 nt, Homo sapiens
uugauuuuuuuuuuuaauuaggccuuuuuuuuccaaguag

SEQ ID NO: 141321 - RNA, 50 nt, Homo sapiens
ucuuucuuuuugucauauacagaaacaaaaggcuucuacuuacaagaaau

SEQ ID NO: 141322 - RNA, 44 nt, Homo sapiens
aaugcuaauccauguaagauaauuugaugccccaaacagaccuu

SEQ ID NO: 141323 - RNA, 46 nt, Homo sapiens
cugugacuuuuaucacauagcuuggaauuuaguguuuuaaaagauc

SEQ ID NO: 141324 - RNA, 49 nt, Homo sapiens
caccaaaaacaaugauuguuuugugcaaguaaauuucagagauagagca

SEQ ID NO: 141325 - RNA, 46 nt, Homo sapiens
ucucugaaugaagacuguuuaauggaagcuguauucauguggagau

SEQ ID NO: 141326 - RNA, 35 nt, Homo sapiens
guuuaagcuuugcauucuagaaaauaaaauacacc

SEQ ID NO: 141327 - RNA, 45 nt, Homo sapiens
uguaccucuuuaacagauuuuuaaggcuuuauucccuauccaaau

SEQ ID NO: 141328 - RNA, 39 nt, Homo sapiens
ggcuuugacauuuauuuauggcuuugggaaauuuauagg

SEQ ID NO: 141329 - RNA, 46 nt, Homo sapiens
aaacuaacacagguuaguuuucuagaauacaccuaauaugccaaaa

SEQ ID NO: 141330 - RNA, 48 nt, Homo sapiens
ugaauugcaacaagcacauugauauaugugaaacuuaaaggcaggcug

SEQ ID NO: 141331 - RNA, 51 nt, Homo sapiens
uaggcuucuuaugucagauucaaacauauugaaauauuuuuuagaguauaa

SEQ ID NO: 141332 - RNA, 59 nt, Homo sapiens
uccaaggauaguuuaugucuucuaacauuuuagaaggcauuaauuacuacaauaguaau

SEQ ID NO: 141333 - RNA, 43 nt, Homo sapiens
guaaagccucuucuauuugaaaccuuuguuuaaaauacaugac

SEQ ID NO: 141334 - RNA, 36 nt, Homo sapiens
aggaaaaaaaaaccaugguacuucuacugacaagau

SEQ ID NO: 141335 - RNA, 23 nt, Homo sapiens
uauguggagguaaaauugcuggg

SEQ ID NO: 141336 - RNA, 49 nt, Homo sapiens
gguuuuaaucaaauagaaauguucagacacacaggauaaaauaaaauau

SEQ ID NO: 141337 - RNA, 44 nt, Homo sapiens
cugcuagaguuaggaagaaagccauaagagauugcuaucacaag

SEQ ID NO: 141338 - RNA, 47 nt, Homo sapiens
auauuuuaguacagaucgagaacauuaaguacuaggcaaaaguuuga

SEQ ID NO: 141339 - RNA, 34 nt, Homo sapiens
aaccauuacagguuuuggaagaguagauuacaaa

SEQ ID NO: 141340 - RNA, 45 nt, Homo sapiens
acugugaaggcaagccaggaaggauggaugggauaaucaggagau

SEQ ID NO: 141341 - RNA, 40 nt, Homo sapiens
ggucagcuagauuauuuuguuuggaguaaugaagaagaua

SEQ ID NO: 141342 - RNA, 46 nt, Homo sapiens
guuuuuagagggcaucuuauauguuguuuuauuagccauuggaauu

SEQ ID NO: 141343 - RNA, 44 nt, Homo sapiens
acaacuguucuguccuauaagagagccacuagccacauguagca

SEQ ID NO: 141344 - RNA, 93 nt, Homo sapiens
uugccauuguuuuccugaacagaagauguugaacagauuugaagggaaaauaacuuggauguuuuggaaaacuauuuugaaagugagcacccc

SEQ ID NO: 141345 - RNA, 52 nt, Homo sapiens
cauuuucccccucuuuuaaggaaaaggaaaauuaaugugugacauuuacaca

SEQ ID NO: 141346 - RNA, 41 nt, Homo sapiens
ggugugggccgcugggacgcccgcucggcggggugguugcg

SEQ ID NO: 141347 - RNA, 49 nt, Homo sapiens
aaaggaaggaagagggcggggaguccucagaggaggaggcgggaccggc

SEQ ID NO: 141348 - RNA, 46 nt, Homo sapiens
cagaauaaaugccuagagagagcauuuggagaccgcauccagguau

SEQ ID NO: 141349 - RNA, 33 nt, Homo sapiens
gacaccgggaccggucugccuucuccuucccuu

SEQ ID NO: 141350 - RNA, 44 nt, Homo sapiens
agauuauguauguaaaguccagcacaauaacguuccuuucauuu

SEQ ID NO: 141351 - RNA, 46 nt, Homo sapiens
ucuccaugcaugucaguuagaggagcugccauauuguccuuagcuu

SEQ ID NO: 141352 - RNA, 42 nt, Homo sapiens
ucuuaucccaaguugucaucccuaauuuugcuuggcuugauu

SEQ ID NO: 141353 - RNA, 48 nt, Homo sapiens
aaacuuguaaaaccguagguuuuuaaauuauguggaaaacugaggggg

SEQ ID NO: 141354 - RNA, 50 nt, Homo sapiens
ucuuguauuuucucuugauuaggacacccaaauuaaaccuaauccucuua

SEQ ID NO: 141355 - RNA, 48 nt, Homo sapiens
uuuugguaauugagucauuacuuggcuuauacuuccuuuggguuuuau

SEQ ID NO: 141356 - RNA, 46 nt, Homo sapiens
agacuucuuccagagccugcaauuucuucaauaaugucgggggaaa

SEQ ID NO: 141357 - RNA, 46 nt, Homo sapiens
uggagauugaaaaccugggcaaucugaagugccugaaugaccacuu

SEQ ID NO: 141358 - RNA, 46 nt, Homo sapiens
agaggauuggcuuguccagaaccaucaggacccauguaagguagag

SEQ ID NO: 141359 - RNA, 40 nt, Homo sapiens
uuuucuuuuauugcaggaaguauuacuuaauucaccucua

SEQ ID NO: 141360 - RNA, 53 nt, Homo sapiens
ggaucauuaaaugaauggacuuggugauauaguacuaacaagcacgaccugaa

SEQ ID NO: 141361 - RNA, 34 nt, Homo sapiens
gacaucguauuaagauuaauauuuugcaguuacg

SEQ ID NO: 141362 - RNA, 40 nt, Homo sapiens
cccagaagcccacccuggugugugagcaccucuacuggaa

SEQ ID NO: 141363 - RNA, 46 nt, Homo sapiens
gagggagcagcucuggcucagcugaugggaacugcaucgcuaagag

SEQ ID NO: 141364 - RNA, 46 nt, Homo sapiens
ggccauaacaagcguaaucauuuggaauaucucugggaacugcugg

SEQ ID NO: 141365 - RNA, 41 nt, Homo sapiens
gaugcuuugccucugaaugagcugcccaaucugugggaugg

SEQ ID NO: 141366 - RNA, 64 nt, Homo sapiens
gggcuggggcccagagccuuacccuggaggaggucuguccagcugggucccagccccacccugc

SEQ ID NO: 141367 - RNA, 40 nt, Homo sapiens
aguggcugugggaacauuugggcagaaaauuaucccuggu

SEQ ID NO: 141368 - RNA, 43 nt, Homo sapiens
cuacacgaccaaugguaccgugcacgucgucgucaacaaccag

SEQ ID NO: 141369 - RNA, 35 nt, Homo sapiens
auugagaggcgcagcagguuucuccugccucugca

SEQ ID NO: 141370 - RNA, 33 nt, Homo sapiens
acaggugccugugcugaagaaguacgcagacaa

SEQ ID NO: 141371 - RNA, 42 nt, Homo sapiens
gccugugggggaguugcagcuguggcuguccagcugucccag

SEQ ID NO: 141372 - RNA, 50 nt, Homo sapiens
agcuccuucccccagaccccccagugcguggugugugggcgcugcuagca

SEQ ID NO: 141373 - RNA, 112 nt, Homo sapiens
gagcugggcaaaaccuguguaggucucgcuguggguuugcuggggaccaagggggugaugaaaaggggaggggcggagcuccugcccaggagaggggcuguggggccccagg

SEQ ID NO: 141374 - RNA, 65 nt, Homo sapiens
augugucagcuucugugugaaaugcagccacagcucauguguaccaaaguagaaaaccaaaucac

SEQ ID NO: 141375 - RNA, 85 nt, Homo sapiens
cugggguuuuaaaaauuauauccccuacuuuguccugugugagaaggaacuugugcaagcaguuucaugguccccaguggucuuu

SEQ ID NO: 141376 - RNA, 46 nt, Homo sapiens
uucauauguuggugagaauuuuguuuaggauggaaagagaaaacag

SEQ ID NO: 141377 - RNA, 50 nt, Homo sapiens
gcacccauuuccucccaugagcugcugugggguugucuagucaaagaaag

SEQ ID NO: 141378 - RNA, 43 nt, Homo sapiens
uggggaagacuuccuggagagguggcgcuucgugggggucuga

SEQ ID NO: 141379 - RNA, 42 nt, Homo sapiens
gggugccagcaacagcgagcccagcgagccggacagccccac

SEQ ID NO: 141380 - RNA, 48 nt, Homo sapiens
aagggagugcugaccugagaaaacgaaugucccgguuagaagaagaac

SEQ ID NO: 141381 - RNA, 46 nt, Homo sapiens
ggcgcgggaggaugcggagaggaggaaccagcuguugcagagggaa

SEQ ID NO: 141382 - RNA, 50 nt, Homo sapiens
ugggaaaaucacuaaccuuuuccagccuuggcuucuccauuugcaaaacg

SEQ ID NO: 141383 - RNA, 33 nt, Homo sapiens
cuguagccagcagcuagauaaauauucggaaaa

SEQ ID NO: 141384 - RNA, 41 nt, Homo sapiens
aaggccaagaaggcaguguugaaagguguccacagccacaa

SEQ ID NO: 141385 - RNA, 53 nt, Homo sapiens
gauggaugggcaaagaagaguuuuguuuaucauauuagaucauaguucuugau

SEQ ID NO: 141386 - RNA, 65 nt, Homo sapiens
augagaauuuucuuuacagaaagcaguugguuauuauaaaugaugaccguucaggagggcaagga

SEQ ID NO: 141387 - RNA, 54 nt, Homo sapiens
ccagggacuggggaaccaauuggcuguuacagggugguggagucaaaaaagaac

SEQ ID NO: 141388 - RNA, 36 nt, Homo sapiens
ccagugagguggcucugagccuguuucagaaggggc

SEQ ID NO: 141389 - RNA, 48 nt, Homo sapiens
uauuacaauguagcacgugcucaaaagcucucugagcucagggaacaa

SEQ ID NO: 141390 - RNA, 61 nt, Homo sapiens
auauagggccugaagugguacaaagagagugugugccaacagaauaucaugaaauacaaaa

SEQ ID NO: 141391 - RNA, 46 nt, Homo sapiens
uggauuuaaaagcacaguuccgcauuucaccgaagaagaaaaguau

SEQ ID NO: 141392 - RNA, 236 nt, Homo sapiens
acaacaaacaaguuugugggggggcggggguugguuuuauuuuuaaagauuuguagcugagcgugacaguauguaucuguagucccagcuauuugggaggcuguggcuggaugauagcuugagcccagcagcuugaggcugcagugagccaugauugcaccauugcacuccagccugggugacagagagagacccuaacucaaaaaauaaaauaaaauaaagauuugaaacuaaag

SEQ ID NO: 141393 - RNA, 36 nt, Homo sapiens
gggaaugacucggggacuuuauuauaugacuuuuuu

SEQ ID NO: 141394 - RNA, 47 nt, Homo sapiens
cacagaagcgguaaaugucguauacaccuuuuaaacauuuuggagau

SEQ ID NO: 141395 - RNA, 56 nt, Homo sapiens
auuggagagguagaacaauuuaggaaagaguaauguucuagaaacuaaggagagag

SEQ ID NO: 141396 - RNA, 59 nt, Homo sapiens
ucucuagagguguguggaauggaaagagguggcccaaggaggaagagagagagagagaa

SEQ ID NO: 141397 - RNA, 41 nt, Homo sapiens
acugugauccuaucaaauauaguaaugcuagaaauauaggu

SEQ ID NO: 141398 - RNA, 46 nt, Homo sapiens
cagggaaucauaaaucaugccaaagccaguugucuugccaccacca

SEQ ID NO: 141399 - RNA, 43 nt, Homo sapiens
uuguggaggagacaguuaaacaaugagacaaauacauuucaga

SEQ ID NO: 141400 - RNA, 50 nt, Homo sapiens
ggguugccaaguggagaguugaguaaaugaagcuagagcucaggaaagau

SEQ ID NO: 141401 - RNA, 431 nt, Homo sapiens
gaacuugguuagaaagucagucaagcccgugugcaguggcucacgccuauaaucccagcacuuugggaggccaaggcagguagaucaucugagguuaggaguucgagaccagccuggccaacauggugaaaccccuuaucuacuaaaaauacaaagauuagccaggcauggucgugggugccuguaaucccagcuacucaggagauugaggcaggagaaucacuugaacucgggagguggagguugcagugagccgagauugcgccacugcacuccagccugggcgacagagcaagacucagucucaaaaaaacaaaaacaaacaaacaaaaaaccagucaguacucuagggaagaaauaacaauagcuauauuaugacauaguagugaguugaagauaacugaauagccaaaauauauuuuggagauagu

SEQ ID NO: 141402 - RNA, 42 nt, Homo sapiens
cgcuugcuucuuaaugaaagacaugucaaugaaggacuaggc

SEQ ID NO: 141403 - RNA, 48 nt, Homo sapiens
cacaucuauaaugcuguuaaaaacagacauaacugaaaaauacaccag

SEQ ID NO: 141404 - RNA, 30 nt, Homo sapiens
uaauacaaagcaaguuuuguacuuuuuguu

SEQ ID NO: 141405 - RNA, 46 nt, Homo sapiens
gcugcggugaacuuuugugugugcauauguuuucaguucucuuggg

SEQ ID NO: 141406 - RNA, 45 nt, Homo sapiens
ucgcggcgccagcaucguggaggacaagcugguggaggaccugag

SEQ ID NO: 141407 - RNA, 55 nt, Homo sapiens
cuagguucaauauuuuggcauuaaaacugcuguggcaacaagagaaagaggacuc

SEQ ID NO: 141408 - RNA, 196 nt, Homo sapiens
aaagcauuuaaaaaaaucucaaucaccuaauauauucuguguuucuaagacuagagugggacuacaaagguuaacaauuucuuagacguuaaaaaagcuuuaagaaagaagaccugucucucuuacaaugcacauucucugcaaacaagggugauaaauggguagauagaucuggggaugucuugaacacaaagca

SEQ ID NO: 141409 - RNA, 46 nt, Homo sapiens
auuuagaaaacucagggauaagguuguucuugagggaaaaugagau

SEQ ID NO: 141410 - RNA, 99 nt, Homo sapiens
cagaagugugggugcccugggcacccaagacuuggaacuggcaucugaaguagggaacagucuugugcgacugagcccuugagcuguggggucugugcu

SEQ ID NO: 141411 - RNA, 63 nt, Homo sapiens
aacccugguagucagugucauaacugaauugcaggacacccaguuuguaucugcagagaacug

SEQ ID NO: 141412 - RNA, 56 nt, Homo sapiens
ugaugaaucuagcagggcacagaaagcuaggcagcaguggaacugagaaugaaguu

SEQ ID NO: 141413 - RNA, 61 nt, Homo sapiens
uaaaacauuuugaagaaaggacaguaauguauucccaacagguaggauuuacaggaugaag

SEQ ID NO: 141414 - RNA, 42 nt, Homo sapiens
ccguuugggggugcuaaagcugguguuaagaucaaucccaag

SEQ ID NO: 141415 - RNA, 90 nt, Homo sapiens
aaaucucaaacacauuuuauagucuugaaugguuucagacuuuauucagucauauuugucacccauaucugcaauaucuccagcuuaauu

SEQ ID NO: 141416 - RNA, 57 nt, Homo sapiens
gauucauuggaauacugaaagaaaacacagcuuaaacucuaguaauuugauuuauuu

SEQ ID NO: 141417 - RNA, 47 nt, Homo sapiens
ccugagccugaacccugauccugucacauguguguuuagcaucagcu

SEQ ID NO: 141418 - RNA, 48 nt, Homo sapiens
aacccucuugcuucagauuuuaggaaaugauuauaagcuccaagaauc

SEQ ID NO: 141419 - RNA, 40 nt, Homo sapiens
aagagaaugaacauugaccuuucaaaagcuuuuccaaaag

SEQ ID NO: 141420 - RNA, 66 nt, Homo sapiens
ccuaaguucugcaggacccugaugucuccacccuucucauccccuuauaucucuguguaccaaaau

SEQ ID NO: 141421 - RNA, 37 nt, Homo sapiens
ugggugggugaagcuguugcauguuuaacauguauag

SEQ ID NO: 141422 - RNA, 40 nt, Homo sapiens
uggaaagugagcaaauaggagcuggagagcgccagagagc

SEQ ID NO: 141423 - RNA, 48 nt, Homo sapiens
uguugucgucauugacuucaugagauuuuuaaggugacuaagggaagg

SEQ ID NO: 141424 - RNA, 55 nt, Homo sapiens
agaguaacaugcugcuuaguggggguauaagcccuccuuaucaaguagagaaaaa

SEQ ID NO: 141425 - RNA, 45 nt, Homo sapiens
agguccuggcauugaugugccugcuccagacaugagcacagguga

SEQ ID NO: 141426 - RNA, 55 nt, Homo sapiens
uagacaaguagacauaaaauaauaugcacaucaagauuaugauugaaugagagaa

SEQ ID NO: 141427 - RNA, 42 nt, Homo sapiens
ccuuaguuccucuuuaaauggaagcccucugagggaaaaauc

SEQ ID NO: 141428 - RNA, 44 nt, Homo sapiens
aaaucucuaaauguucauauucuacccauuuucaaggucuagcc

SEQ ID NO: 141429 - RNA, 56 nt, Homo sapiens
agaggaagagaaacaauagcguucaguuugucugaagguaaggcauauuuauaaag

SEQ ID NO: 141430 - RNA, 48 nt, Homo sapiens
auucacuacaauugggauaaauugcuagaaguuguuuugaagcuauga

SEQ ID NO: 141431 - RNA, 53 nt, Homo sapiens
aagagcugguuucaagcaggugugacucagcuaagugugcauuugaagacuug

SEQ ID NO: 141432 - RNA, 73 nt, Homo sapiens
cucugugccuccauuuccuccuaugcaaaaugacaguaguaauaguaccuacuuugugagacucaugagcauu

SEQ ID NO: 141433 - RNA, 45 nt, Homo sapiens
ucauugaugaaauuuucaaucccauggaagacaccacggccagua

SEQ ID NO: 141434 - RNA, 45 nt, Homo sapiens
gaagcuucuuacaugagcauuuuaggaaugacaccaggguuugga

SEQ ID NO: 141435 - RNA, 53 nt, Homo sapiens
ucuaugagauauuuacaucguuuuggugcuaaauguauugcuguuggugaguc

SEQ ID NO: 141436 - RNA, 57 nt, Homo sapiens
ugaugggaguauauggaauccagaugguauugacccaaaggaacuggaagacuucaa

SEQ ID NO: 141437 - RNA, 80 nt, Homo sapiens
uggaggccgacugugacauacugaucccagcugccagugagaagcaguugaccaaauccaacgcacccagagucaaagcc

SEQ ID NO: 141438 - RNA, 32 nt, Homo sapiens
aaaugagucuacaccaaaaaguuacuagaaau

SEQ ID NO: 141439 - RNA, 46 nt, Homo sapiens
cacucaaaguaagauacugucacuccuccagcauucaaguagagau

SEQ ID NO: 141440 - RNA, 45 nt, Homo sapiens
uugaccuucaaauaugaaagggauucuaacuaccacuugcucagu

SEQ ID NO: 141441 - RNA, 45 nt, Homo sapiens
ugagaaagacaucgugcacucuggcuuggcauacacaauggagcg

SEQ ID NO: 141442 - RNA, 45 nt, Homo sapiens
ccugggauuggaccugagaacagcugccuauguuaaugccauuga

SEQ ID NO: 141443 - RNA, 47 nt, Homo sapiens
accauucucaacaagucaauccaagucagcccguuaaggagaaagaa

SEQ ID NO: 141444 - RNA, 46 nt, Homo sapiens
agguuaggcuuguuaagugauuaaaggcaauuuuauuacagcagca

SEQ ID NO: 141445 - RNA, 26 nt, Homo sapiens
acagugaaugccuauagaaauaauaa

SEQ ID NO: 141446 - RNA, 73 nt, Homo sapiens
uggacuguaucauaauuauaguaagcaaauucugacaguuuuaaugaaaauagccuccaccauuuugcaggua

SEQ ID NO: 141447 - RNA, 98 nt, Homo sapiens
uauuuggccagggccuuuugaacaguaguguccccaugaagugcuagauaauauauguguaagagucagcuuuuuuuuuuuuuuuaacucuaacaccc

SEQ ID NO: 141448 - RNA, 52 nt, Homo sapiens
ggaccccuucuggggguccggcaggugacacagggcggcugggcuggggggu

SEQ ID NO: 141449 - RNA, 44 nt, Homo sapiens
ggcauaacugcuggcagcaccgacgaacccccaaugcugaccaa

SEQ ID NO: 141450 - RNA, 49 nt, Homo sapiens
gugagugcaccugcuaccacggcccuuccccagucucaauaaaaagcca

SEQ ID NO: 141451 - RNA, 65 nt, Homo sapiens
acagugaccaacacagucacaaaugccaucacccaugcagcagagagucuggacaaacuuggaca

SEQ ID NO: 141452 - RNA, 39 nt, Homo sapiens
uuuugagggggaagacaucauaaacauuuagacauagua

SEQ ID NO: 141453 - RNA, 58 nt, Homo sapiens
aagaaguggugaaggagguggugggacacgccaaggagacuggagagaaagguacagc

SEQ ID NO: 141454 - RNA, 40 nt, Homo sapiens
ggcucacugagcucgucucccggcagccaaggcccuggcg

SEQ ID NO: 141455 - RNA, 36 nt, Homo sapiens
cuuggccccucaggaacccugguccccugcucuacc

SEQ ID NO: 141456 - RNA, 46 nt, Homo sapiens
gaaggccuggcccaccgcaccgagaaggccaccgagggagccagug

SEQ ID NO: 141457 - RNA, 44 nt, Homo sapiens
uugaggccaucugccccccaacaggagggugaggcauccaaaga

SEQ ID NO: 141458 - RNA, 41 nt, Homo sapiens
cuguggcaguguaagugguggccugggcuaggauuccuacc

SEQ ID NO: 141459 - RNA, 43 nt, Homo sapiens
ggccccuucagagggccucuuccugcugugucuggaagaagug

SEQ ID NO: 141460 - RNA, 46 nt, Homo sapiens
guggcccccacccucuccacacgggagcggcuacagccaggucacg

SEQ ID NO: 141461 - RNA, 25 nt, Homo sapiens
cuuggucuuuuccaccgcacccacc

SEQ ID NO: 141462 - RNA, 58 nt, Homo sapiens
gugcagugggggcggggagggagggagggagggaaggagguucagccucaccuuccuc

SEQ ID NO: 141463 - RNA, 41 nt, Homo sapiens
gcugauauuugugauuuggcuccggacgcuguggggaggaa

SEQ ID NO: 141464 - RNA, 54 nt, Homo sapiens
agccugugugacugugcaaacacaggggcacaggggagggagcucaauaugucc

SEQ ID NO: 141465 - RNA, 36 nt, Homo sapiens
uaucugaaauuuuccauaauaaaaaguuuaaagaag

SEQ ID NO: 141466 - RNA, 39 nt, Homo sapiens
agugaucuggugucaggacuguaaaauacgccuaugaaa

SEQ ID NO: 141467 - RNA, 42 nt, Homo sapiens
gggcccuguucaaacuccagcacugaccauucaccggcggaa

SEQ ID NO: 141468 - RNA, 44 nt, Homo sapiens
cuaggccugggcccggccggcggcgcucgaggcggggagggaag

SEQ ID NO: 141469 - RNA, 45 nt, Homo sapiens
ggcuuccggggcgucgaaagugaccucccuuuccugggcggcgcg

SEQ ID NO: 141470 - RNA, 80 nt, Homo sapiens
uuucacagagaauaugaaacuggugucaaaaugacauccagauuugggaaaacauacaguaggaaagguggaaauggcag

SEQ ID NO: 141471 - RNA, 49 nt, Homo sapiens
gauauccaagaaauuccgaagaaaccuaaaguggaagaagaaaguacug

SEQ ID NO: 141472 - RNA, 67 nt, Homo sapiens
augagucucuaccaguuucuucaaagaauuuagcccagguuaaguguuccucuuauucagaaucuag

SEQ ID NO: 141473 - RNA, 45 nt, Homo sapiens
uuucugauaaaugcuucccuuuggaggacacuuuacuugggaaag

SEQ ID NO: 141474 - RNA, 50 nt, Homo sapiens
ccaauaaauuuuuuuaauuugcuuaaagcuguaaugaguauuuguguaag

SEQ ID NO: 141475 - RNA, 45 nt, Homo sapiens
cauauucacaaaaaugcugaugacaguacuaagaaacccaaugca

SEQ ID NO: 141476 - RNA, 46 nt, Homo sapiens
cuccaaucaagggaucuguuagaacugguuuguuugaaugggauaa

SEQ ID NO: 141477 - RNA, 48 nt, Homo sapiens
uuggauagugauccccuuuuggagaugaaggaugacgauuuuaaaaau

SEQ ID NO: 141478 - RNA, 46 nt, Homo sapiens
caaagcaaacagugaaucgaguaaagauggccugaaucaggcaaag

SEQ ID NO: 141479 - RNA, 46 nt, Homo sapiens
acuauggaacgcagcauggaugaguucacugcauccacuccugcag

SEQ ID NO: 141480 - RNA, 42 nt, Homo sapiens
aaaggauguuaaacuugaauuuuuugguuuugaagaucauga

SEQ ID NO: 141481 - RNA, 66 nt, Homo sapiens
aaaauuaaguauuuuggcuuugaugaucucagugaaagcgaagaugaugaagaugaugacugucaa

SEQ ID NO: 141482 - RNA, 44 nt, Homo sapiens
agaaaacuuggauuuuacagaggacuugccuggugugccugaaa

SEQ ID NO: 141483 - RNA, 51 nt, Homo sapiens
ugcauugcaguacuucuucagaguucauuuaguuguacuucgugcugauug

SEQ ID NO: 141484 - RNA, 365 nt, Homo sapiens
acaucaucacauaacaauuaauaauaacauuuaauacuuacaaagcacuuuuuuuuuuuuuuuuuuaaagacagucucgcuuugucgcccaggcuggagugcaguggcgcaaucucggcucacugcaaccuccaccucccggguucaacugauucucccgccucagccuccugaguagcugguacugcaguuacucaccaccaugccuggcuaauuuuuguauuuuuaguagagacgggguuucauccuguuggccaggcuggucucaaacuccugaccucagucgauccgccugccuuggccucccaaagugcugggauuacaggcgugagccaccacacccgacagcacauauucuuucaggc

SEQ ID NO: 141485 - RNA, 46 nt, Homo sapiens
cagccaagcuacugaaugaaaaagacaugaacaaaauuaaagaaaa

SEQ ID NO: 141486 - RNA, 44 nt, Homo sapiens
gaugaggaugaagagaaacugguagccucacuauggggagcaga

SEQ ID NO: 141487 - RNA, 46 nt, Homo sapiens
uuuggauugccacaauuauuucauauucuuccuuuuuagguaacug

SEQ ID NO: 141488 - RNA, 46 nt, Homo sapiens
acaaaaguuuuaagaguacagauuuuggacacaaaaugacagugug

SEQ ID NO: 141489 - RNA, 54 nt, Homo sapiens
auauauacauaguagauauuuaaaaauauguguauauuaaaaauacauauaaaa

SEQ ID NO: 141490 - RNA, 45 nt, Homo sapiens
gguucugucuuauuacagcaaccucuuccugauaucucuguccua

SEQ ID NO: 141491 - RNA, 49 nt, Homo sapiens
ggccuuuagccuauccagaacaauaccacauggaguuaacuuucuccaa

SEQ ID NO: 141492 - RNA, 32 nt, Homo sapiens
uuguuauuuuggguaguaucuugagaauccuu

SEQ ID NO: 141493 - RNA, 72 nt, Homo sapiens
auuacagcauugugaagaacugauucagcaguacaaccgugcugaggacagcauaugcuuagcugacaguaa

SEQ ID NO: 141494 - RNA, 57 nt, Homo sapiens
uuucagaguggggcagcaccaaaacaggagagcaggacggucucauaggcacagcgc

SEQ ID NO: 141495 - RNA, 46 nt, Homo sapiens
ccaucuguaguggagaaggggaugauaguuuaaggauagguggaca

SEQ ID NO: 141496 - RNA, 42 nt, Homo sapiens
aucagcuauuccuugagcgagagcgggcagcccagcuagcag

SEQ ID NO: 141497 - RNA, 48 nt, Homo sapiens
aaauacagugggugucaacugaaaagacugaugguacagaagagaaac

SEQ ID NO: 141498 - RNA, 52 nt, Homo sapiens
acaaaggcuauuggcugauuauaggguuguuuaaauuguuuguuuccuaugg

SEQ ID NO: 141499 - RNA, 52 nt, Homo sapiens
gaaucauugugaguguucucuuucagaugggggguugggcauagguggauua

SEQ ID NO: 141500 - RNA, 26 nt, Homo sapiens
uuguugcaguaaaugcugcuuugugg

SEQ ID NO: 141501 - RNA, 42 nt, Homo sapiens
uuguugccccuccauuccugggacauugcacauugccacugg

SEQ ID NO: 141502 - RNA, 355 nt, Homo sapiens
uuuguuauuucaggccuuuuucuuugcauuuaugaaaguaggucggcaugcugccucacaccuguaauuccagcacuuugggaggccaaggugcguggauuacuugagcccaggagcucgagaccagccuggccaacaugaugaaaccacgucucugcuaaaaauacaaaaauuagccaggcaugguggcacgugccuuuaaucccggcuacccgggaggcugaggcaugggaaucacuugaacccaggagguagagguugcagugagcugagauuacaccacugcacuccagccuggguaacagagugacuguuucauuuaaaaaaaaaaaaaaaaaaguaaauguguacacaa

SEQ ID NO: 141503 - RNA, 46 nt, Homo sapiens
gaaaucuaucucuagagugauugaauauuuggaacauugcuagcug

SEQ ID NO: 141504 - RNA, 43 nt, Homo sapiens
gauauauuuucuaauguucaguacaauaaauauaaggaagcua

SEQ ID NO: 141505 - RNA, 46 nt, Homo sapiens
uacgccaguguaacgugggaaccauugagauuguauuugcccugag

SEQ ID NO: 141506 - RNA, 62 nt, Homo sapiens
uauuuauuaaucauuggauuuagggaaagggacagauuuuuggugaaccugacuuguggcag

SEQ ID NO: 141507 - RNA, 46 nt, Homo sapiens; identical to SEQ ID NO: 47797

SEQ ID NO: 141508 - RNA, 43 nt, Homo sapiens
aucccagaagaaacugaagaaacaaaaacuuauggcacgggag

SEQ ID NO: 141509 - RNA, 45 nt, Homo sapiens
cacauugagaugauccuuacggaaaaggaacagauuguuccuaaa

SEQ ID NO: 141510 - RNA, 46 nt, Homo sapiens
acugcucaggccaucaaggguaugcauauacgaaaagccacgaagu

SEQ ID NO: 141511 - RNA, 46 nt, Homo sapiens
cuuuucguauaugcauacccuugauggccugagcaguuucacgagu

SEQ ID NO: 141512 - RNA, 63 nt, Homo sapiens
caagugaauagcgaaccauuuucacagauuaccucaggcugcuuaggaaaagagcucucuccc

SEQ ID NO: 141513 - RNA, 101 nt, Homo sapiens
ugaggaaaaugcuucauuaguuuccccuagcagacuuuuacuucucuuacacugcuacaccauuacuuucuugagacauuuguaaguucuuugauacagaa

SEQ ID NO: 141514 - RNA, 51 nt, Homo sapiens
uauuguaauuaaugucauaagugauuuggagcuuugguaaagggaccagag

SEQ ID NO: 141515 - RNA, 63 nt, Homo sapiens
uugugucaugagaauguaagucuuuuuucuacuuuaaaauuuaguagguucacugaguaacua

SEQ ID NO: 141516 - RNA, 55 nt, Homo sapiens
gcauuaaauaguuuguacaagcagcuuucguugaaguuuagaagauaagaaacau

SEQ ID NO: 141517 - RNA, 45 nt, Homo sapiens
auguuccuucuguaugauacccagaaaguaaucaagcgugcagaa

SEQ ID NO: 141518 - RNA, 45 nt, Homo sapiens
ucaucagagcugcaugguacacagcuggcauugugggaggccucu

SEQ ID NO: 141519 - RNA, 63 nt, Homo sapiens
aaguagauuaguguuugcuugugagugugauugauuaggaauaguguuaauguugugauauag

SEQ ID NO: 141520 - RNA, 44 nt, Homo sapiens
auacuggaacaacaaaagcgugauuuauauuugaguuuuuagaa

SEQ ID NO: 141521 - RNA, 55 nt, Homo sapiens
aaagauuagauaaaauauauuggagggaaggguuauuaaauggaaagaauacugu

SEQ ID NO: 141522 - RNA, 38 nt, Homo sapiens
ugaacuucaugaugagaggcucuugggugguaagucag

SEQ ID NO: 141523 - RNA, 46 nt, Homo sapiens
ucaguaugucaaggauagaauucauuccaccuauauguacuuagca

SEQ ID NO: 141524 - RNA, 55 nt, Homo sapiens
gcuguuggucuuggagcauugugcuacuauggcuugggacugucuaaugagauug

SEQ ID NO: 141525 - RNA, 41 nt, Homo sapiens
ggcagcauuggaaccaucgauggaaaaaauauuuaaaagua

SEQ ID NO: 141526 - RNA, 46 nt, Homo sapiens
caggaauaugccaccaaaacaagaauugggauccggcgugggagaa

SEQ ID NO: 141527 - RNA, 46 nt, Homo sapiens
ccccuguugugaagaauuccaucacgaagaaucaauggcuguuaac

SEQ ID NO: 141528 - RNA, 59 nt, Homo sapiens
agucuaauguaagggaaaccugguugguaacugaguuuacuuguuuacuuugaaagacu

SEQ ID NO: 141529 - RNA, 54 nt, Homo sapiens
cccaucuaguauaaugugcccuggagcuaagauaauccaguuuuuagcaugcuu

SEQ ID NO: 141530 - RNA, 215 nt, Homo sapiens
cuucuaaccugucagaagcgggauucccacucugggcuguuacgccacauggaggucacucugagcuggaccucuucggccccaaccaguggacugaguacugaggaagauacaggacagccauagguugagaugauguaauggcacgaaaguuccaaaagcgcuggguguuuucccaaaggccgggugccgaauuuuaagacccuuaauaguuc

SEQ ID NO: 141531 - RNA, 89 nt, Homo sapiens
aaacucaucaaugcucacggaggcauaagcccuuggauuagggucgguaguauuuuccccauuuuauagcaacgacaucugagucuuag

SEQ ID NO: 141532 - RNA, 98 nt, Homo sapiens
gcaggggcagagguguuguggguugacagggaaguuugcugccggguucucaucugaaucuagcgggcugggugaacuuucucggggaccaggcaccc

SEQ ID NO: 141533 - RNA, 45 nt, Homo sapiens
cuacuguccaagggaucgcugaugauuacgauaaaaagaaacuag

SEQ ID NO: 141534 - RNA, 43 nt, Homo sapiens
ugaugaugauuuuuuuuuuuuuacacaauucucuguagacuag

SEQ ID NO: 141535 - RNA, 45 nt, Homo sapiens
ucagaccacuucucaucguucagggauggacugcaaccuuaauuu

SEQ ID NO: 141536 - RNA, 64 nt, Homo sapiens
ugcucagaagcuccaggcauuuuguuucuggugaccgccccuaaugggauaucggugaucacug

SEQ ID NO: 141537 - RNA, 79 nt, Homo sapiens
acagccucucuuucuccuccacauacugcagccucccuccaugcaucccacauacaagcacucccccacuccccagcgu

SEQ ID NO: 141538 - RNA, 47 nt, Homo sapiens
agauaguguccauggcuggagccgacccuuugaguccccuugagugu

SEQ ID NO: 141539 - RNA, 52 nt, Homo sapiens
uggacuggugccacgggagugccuuguccacugucccccuguguccaccagc

SEQ ID NO: 141540 - RNA, 45 nt, Homo sapiens
uuacauuguggcuggcgucuucaucgccaucucgcuguugcaggu

SEQ ID NO: 141541 - RNA, 45 nt, Homo sapiens
agcaaaaaguugugaacacacaguguggauaugaugucaggauuc

SEQ ID NO: 141542 - RNA, 73 nt, Homo sapiens
agucaccaaauccccgccauguuuugaugccucuccuuucuuuucuguucagugccaccguccuuuuuucauu

SEQ ID NO: 141543 - RNA, 49 nt, Homo sapiens
cauguggaacacuuugguuuugagaagaaaauaaaucagaaaccauuaa

SEQ ID NO: 141544 - RNA, 59 nt, Homo sapiens
ggccuuuacuccaucugguccccaucccucuuaucucucucauguguggcugcaccugg

SEQ ID NO: 141545 - RNA, 67 nt, Homo sapiens
accaucugacgcuauuccuauccccuuccuccccgggaccuuuuccccuuccucccugggaccuuuu

SEQ ID NO: 141546 - RNA, 41 nt, Homo sapiens
gcuuguugcccuguggcaggggugcuggggaggcagugagg

SEQ ID NO: 141547 - RNA, 55 nt, Homo sapiens
uguauuugggugggcgccuuucuguuguggugcacaugggguauggguuccugca

SEQ ID NO: 141548 - RNA, 32 nt, Homo sapiens
ggagcaguuccacucagggugguaaaaggagg

SEQ ID NO: 141549 - RNA, 38 nt, Homo sapiens
ucauggaaagcuguuaggcaggggcuggaaugucuguu

SEQ ID NO: 141550 - RNA, 21 nt, Homo sapiens
ugguccuuuuuggcuucaaau

SEQ ID NO: 141551 - RNA, 25 nt, Homo sapiens
aagaucucacuuugaugugcagagg

SEQ ID NO: 141552 - RNA, 82 nt, Homo sapiens
gccucagggagauacuauuuccuuugucguugacuguccuggagauggaagucuuggccaaccaccaucagaggaagggcug

SEQ ID NO: 141553 - RNA, 61 nt, Homo sapiens
gcccuggaggacaaagcuauggcuauagucuggguugagguggaguggggggcgagugaca

SEQ ID NO: 141554 - RNA, 37 nt, Homo sapiens
ccuuucgccuugggcuguguuacucuccucaccuggg

SEQ ID NO: 141555 - RNA, 47 nt, Homo sapiens
ucauucuccccagcugguuucugaggucagacagaaggagggucugg

SEQ ID NO: 141556 - RNA, 57 nt, Homo sapiens
agcggagaaggaaaacugaaauguuucuuuucaacaguuuauugcaauaguuuccuc

SEQ ID NO: 141557 - RNA, 38 nt, Homo sapiens
aggauaauuugggggcaugggguguauguagcucagga

SEQ ID NO: 141558 - RNA, 50 nt, Homo sapiens
uaagcaucuuacagccauaaucuuuaugccuuucaggcguggaaacauag

SEQ ID NO: 141559 - RNA, 65 nt, Homo sapiens
uggaagaaacacaaagcauuuucuauaaagauguuuugguguauguugaagauaaauaaauaguc

SEQ ID NO: 141560 - RNA, 23 nt, Homo sapiens
ccuguuccagcuggagaacaggu

SEQ ID NO: 141561 - RNA, 51 nt, Homo sapiens
ggagacuguguuuaaauuuugccucuauuuugucaacagguucuaggagac

SEQ ID NO: 141562 - RNA, 300 nt, Homo sapiens
ugugccuuuuuuuuuuuuccuucagacagggucucacucuguugcccaggcuggagugcaguggcccuaucacagcucacugaggccuccaccuuccuggcucaagugauccucccgccucagccuccugaguagcagggaccacaggcaugcagcaccacacccagcuaauuuaaagaauuuuuuguagagauuggaucuugcuauguugccuaggcuggugucaaacuccugggcacuugauuugugcuucuuaauucaggggcuacuuauugaacauauuuagcagucuucagaaag

SEQ ID NO: 141563 - RNA, 41 nt, Homo sapiens
caagaccugcugagggcuugcacugagccaccgagaggagc

SEQ ID NO: 141564 - RNA, 45 nt, Homo sapiens
gguuuuugaggggggcaugccaaaaucagaguuggugguaguggu

SEQ ID NO: 141565 - RNA, 66 nt, Homo sapiens
cugguaagguagacuguaucaggacuauuacgauagauguaggaauuaucgcaauggauuuugcag

SEQ ID NO: 141566 - RNA, 77 nt, Homo sapiens
gauugcugugccucauuacaaaugcauaugauguuugagugcuguuguuugaaauuauuuuucuuuucgggucuuca

SEQ ID NO: 141567 - RNA, 86 nt, Homo sapiens
uaauauucuguuuaggcccacuaaggcaaaauagccccaaaacaagacugacaaaaaucugaaaaacuaaugaggauuauuaagcu

SEQ ID NO: 141568 - RNA, 52 nt, Homo sapiens
uuccacucgugucccuaaggagugagaaacccauuuauacucuacucucagu

SEQ ID NO: 141569 - RNA, 82 nt, Homo sapiens
guucuggaagcugcuaagaugaucaaaccacagacuuuggccucagagaaaaaaugauugugugaaacugcccagcucaggg

SEQ ID NO: 141570 - RNA, 59 nt, Homo sapiens
agggcauucuucuugagcaccgagaaaaagaauuuggagacaaaguaaaccuacuuucu

SEQ ID NO: 141571 - RNA, 44 nt, Homo sapiens
uauagguccuggcugugaggcuccacaagcagcauggagcccua

SEQ ID NO: 141572 - RNA, 48 nt, Homo sapiens
uggaaggagaaggcuucauccuugggggaguuuucguggugggaucag

SEQ ID NO: 141573 - RNA, 48 nt, Homo sapiens
ccagagaagccuccguuccaggcucggaagaaguuguaccacacuccc

SEQ ID NO: 141574 - RNA, 70 nt, Homo sapiens
ugcggaucuguccucccugaaaagcauguuggaccagcugggcgucccccucuaugcagugguaaaggag

SEQ ID NO: 141575 - RNA, 41 nt, Homo sapiens
ucuguuuaguaaguaaggaagcuugcgaaaggaaggcagga

SEQ ID NO: 141576 - RNA, 45 nt, Homo sapiens
uccaagccccagaaagcggcccuggaguaccuggaggauauagac

SEQ ID NO: 141577 - RNA, 44 nt, Homo sapiens
uguguuggcaagcagcaaugccaaggcagcagcccccagggcuc

SEQ ID NO: 141578 - RNA, 44 nt, Homo sapiens
cacacacauggagguuccugcaccguggagcucaccagggcauc

SEQ ID NO: 141579 - RNA, 62 nt, Homo sapiens
cuuguauaggaaagagacagggucucgaagcuggaaacugaauuuggggcggugggggcagu

SEQ ID NO: 141580 - RNA, 25 nt, Homo sapiens
gauguuuagaauaugaugcugucuc

SEQ ID NO: 141581 - RNA, 42 nt, Homo sapiens
gcugaaccagcgcuuugagggaaggagagggaaacagaggag

SEQ ID NO: 141582 - RNA, 56 nt, Homo sapiens
uaaaagacacgacccuaagcgggcacagagacgaggacgaggacugccagguccgc

SEQ ID NO: 141583 - RNA, 45 nt, Homo sapiens
cuuuccugggcgaucugcuucaaccauuuuuuuuuuugccgguga

SEQ ID NO: 141584 - RNA, 50 nt, Homo sapiens
uuggcaaauauggacgaauaguggaaguacucuugauaaaagaccgugaa

SEQ ID NO: 141585 - RNA, 45 nt, Homo sapiens
uuugucaccuuugaaagcccagcagacgcuaaggaugcagccaga

SEQ ID NO: 141586 - RNA, 44 nt, Homo sapiens
gaaguggggguccuucuccuaagagaucugcaccuucaggacua

SEQ ID NO: 141587 - RNA, 43 nt, Homo sapiens
gguaaguauaaucucguggugguggugcauaaucucuuguauc

SEQ ID NO: 141588 - RNA, 33 nt, Homo sapiens
gaagugaucucuacucaaguugugacaggguug

SEQ ID NO: 141589 - RNA, 27 nt, Homo sapiens
caagaggugcuggcccuggaggaagcc

SEQ ID NO: 141590 - RNA, 49 nt, Homo sapiens
auuauaaauagaaaccgaggcuggaacacugcccccuuucccauuauug

SEQ ID NO: 141591 - RNA, 46 nt, Homo sapiens
agugagaacucuuggagcuacuccguccagacucaugcugugcguc

SEQ ID NO: 141592 - RNA, 46 nt, Homo sapiens
acugugacagcccaccucgcucacagacaccacaagauaccaacag

SEQ ID NO: 141593 - RNA, 53 nt, Homo sapiens
gagaaaaacagcucacagucugaggaagaugauauugagagaaggaaggaagu

SEQ ID NO: 141594 - RNA, 42 nt, Homo sapiens
auuccccccaaggaguuccucuuuaaacacccgaagcgcacg

SEQ ID NO: 141595 - RNA, 46 nt, Homo sapiens
caucucugcugcucucucauuugcuggccaucggauuggggaucua

SEQ ID NO: 141596 - RNA, 43 nt, Homo sapiens
cuugguucguuaguggauuacuucugagcuugcaacauagcuc

SEQ ID NO: 141597 - RNA, 75 nt, Homo sapiens
agcacaaaggagaggauugaauucaccaaugcagagugauaaagacgaaaagauacugagcaggugccuucagca

SEQ ID NO: 141598 - RNA, 45 nt, Homo sapiens
uuucccauuauugcuaaagugcaauucuacccaggagcccugcag

SEQ ID NO: 141599 - RNA, 47 nt, Homo sapiens
ccaagaguucucacugugacagcccaccucgcucacagacaccacaa

SEQ ID NO: 141600 - RNA, 45 nt, Homo sapiens
uuggagagaaaaacagcucacagucugaggaagaugauauugaga

SEQ ID NO: 141601 - RNA, 49 nt, Homo sapiens
aaaaaacuggaaauggaaaaaaaaauaaaucuuugccaaauccuucaaa

SEQ ID NO: 141602 - RNA, 58 nt, Homo sapiens
ugcucaauguuaccacagcaggcuuucuagaagcacucugacaguguuacucccuaau

SEQ ID NO: 141603 - RNA, 59 nt, Homo sapiens
aaccccuacuuuaaagauuuauucccuugacuucuuacauuuugcucacuccugaacca

SEQ ID NO: 141604 - RNA, 36 nt, Homo sapiens
uguaaagucuaaaaucuuaauucuaaauccacaguu

SEQ ID NO: 141605 - RNA, 47 nt, Homo sapiens
auaaucacagaaguaaguuuaauaauuuguccuauuuuucucuguca

SEQ ID NO: 141606 - RNA, 50 nt, Homo sapiens
acccgaaguucauuuccuuugucucccuaaaacugaacuguaauuuuggg

SEQ ID NO: 141607 - RNA, 78 nt, Homo sapiens
agauugcccaguuagauuugaauuucagauaaacaauuaguuuuuuaauauuuuacauggaauauuuggaaaauacuu

SEQ ID NO: 141608 - RNA, 104 nt, Homo sapiens
cauuuuuaaaaauuguguuaagucuauguauaauacuacugugaguaaaaguaauacuuuaauaaugugguacaaauuuuaaaguuuaauauugaauaaaagga

SEQ ID NO: 141609 - RNA, 51 nt, Homo sapiens
agcaaugacagucuuaagccaaacauuuuauauaaaguugcuuuuguaaag

SEQ ID NO: 141610 - RNA, 48 nt, Homo sapiens
aagaauuagaaaacuucaggaacuuguuacagaauauucauuaaagaa

SEQ ID NO: 141611 - RNA, 51 nt, Homo sapiens
cuuuuaaaaauaauuauuuccuaucaaaaugauuaaagaaaagcaugaaau

SEQ ID NO: 141612 - RNA, 52 nt, Homo sapiens
aaguggaccuaguuaugaauuccaucuaaccagacaagaaauaguaucauua

SEQ ID NO: 141613 - RNA, 62 nt, Homo sapiens
uucgacugcauuuuagaaauauuucaagaauuauggauuguguugguuguuuuaaaugucgu

SEQ ID NO: 141614 - RNA, 45 nt, Homo sapiens
aucugccuaaacagcuuccaggaacuagaaagugagggggaagau

SEQ ID NO: 141615 - RNA, 318 nt, Homo sapiens
agauaugaauauauaguacucauagaaguagagaguaggccauagaaguagagaguaggccaggggcaguggcucaggccuguaauuccagcacuuugggaggcugaggugggaggauugcuugagcccuggaguucaagaccagcuugggcaacaucgugugaaacccugucuuuaauuaaaaaaaaaaaaaaaaaaaguagagaguagaaugaugguuaccacaggcuggggguggggaguggauggggaaaacggagauguugauccauggguacaaaguuucaguuagggagaauaagauuuagugaucuacug

SEQ ID NO: 141616 - RNA, 84 nt, Homo sapiens
cgcaggucauuuccuuugcauuuugaugagaauucauuuuuugcuggggauaaaaaagaagcacacaaacuaaagguaauuacu

SEQ ID NO: 141617 - RNA, 67 nt, Homo sapiens
uuuggguacugagaggcacacauuuuuaguuuuaagagccauucuuuuaguauuugauaauguauua

SEQ ID NO: 141618 - RNA, 46 nt, Homo sapiens
auuaaacuuuauacauuaauagaagagugacaauuaauguacaaga

SEQ ID NO: 141619 - RNA, 45 nt, Homo sapiens
aauaaaauucaggaugaggaaaacaaaauguuacuucuggaaaua

SEQ ID NO: 141620 - RNA, 102 nt, Homo sapiens
uucuaggccacagacaauuaaaagaccuuuaaauccuuuggcuucuggucaagguaaauuacuuauuugcguuguuauauuauuucucagccagggaacuuu

SEQ ID NO: 141621 - RNA, 48 nt, Homo sapiens
uuaauuauuuuacaguuaaauugauuucagagaacaauuauaauaggu

SEQ ID NO: 141622 - RNA, 102 nt, Homo sapiens
gaaaacuguuuuaaguaugugucauuuucauuuagaaaaauuccuauaagauguggugauuucucuuuauaaacaaaaucauaaugauuuaaaauuaaaaau

SEQ ID NO: 141623 - RNA, 44 nt, Homo sapiens
gacauaacaguuccuuuucuagguauauacucaaaaaaauuaaa

SEQ ID NO: 141624 - RNA, 50 nt, Homo sapiens
ucuaaaaauauucuuaguuuauaaauacagauaauguuagcuuagcagag

SEQ ID NO: 141625 - RNA, 59 nt, Homo sapiens
agaaauuauuauauauuguuaucaaaauggugagaucauaauuuucuaaaacaucagau

SEQ ID NO: 141626 - RNA, 46 nt, Homo sapiens
uggagugucuugggagcagcugggagaggcauuuaacccagcgggu

SEQ ID NO: 141627 - RNA, 62 nt, Homo sapiens
gacacuugcuaauauguugagugguggauggaaauaagcccaggauuauaacuuagucagag

SEQ ID NO: 141628 - RNA, 40 nt, Homo sapiens
acuguuucaaaccauaaaagaaauaaugcuguuuguaaug

SEQ ID NO: 141629 - RNA, 42 nt, Homo sapiens
uuuuuuuuuuuuuuuuuuuuuuugaccuagcucaguuagaga

SEQ ID NO: 141630 - RNA, 60 nt, Homo sapiens
uggcuauaucgugcaaaucauaaaacuuuucuucauuaaaucuucuuucugaaauuuggu

SEQ ID NO: 141631 - RNA, 42 nt, Homo sapiens
auacauacuaugucauucuuacacauaaauucuuugauaguc

SEQ ID NO: 141632 - RNA, 46 nt, Homo sapiens
accuuaugaacauaugaagccaagcuuucucaacccagcuaaagaa

SEQ ID NO: 141633 - RNA, 33 nt, Homo sapiens
uagagauggucugguuauguugcaccuguaaua

SEQ ID NO: 141634 - RNA, 42 nt, Homo sapiens
cguggcauccgcccaggaaauacuggaagucaagaccauauu

SEQ ID NO: 141635 - RNA, 48 nt, Homo sapiens
auagugucaaggaagaugaggacugaaaguuuuccauuguauuuagug

SEQ ID NO: 141636 - RNA, 40 nt, Homo sapiens
uaaacauauauuuauaucuuguuacauuuggcuuugaaaa

SEQ ID NO: 141637 - RNA, 50 nt, Homo sapiens
ucugaacuaucucaauuuuuauuuuaauauguaugguaagugucaugaua

SEQ ID NO: 141638 - RNA, 40 nt, Homo sapiens
uuguaaauuugacauaauaauucaggagguuuagaauuag

SEQ ID NO: 141639 - RNA, 49 nt, Homo sapiens
gacuuaaaacaguguuggggacauagauguaauuuuuauauguucugac

SEQ ID NO: 141640 - RNA, 50 nt, Homo sapiens
gugggaagagcuggguaaggaaaggcuuaagagacugagaaaauaggaga

SEQ ID NO: 141641 - RNA, 36 nt, Homo sapiens
uaaacagcauuuaguguccaguuguaagaaguacuu

SEQ ID NO: 141642 - RNA, 45 nt, Homo sapiens
guuaagaaaaauacugacagacauguacagaauuauuucagugaa

SEQ ID NO: 141643 - RNA, 383 nt, Homo sapiens
gcaauuggccaggugcgguggcucaugccuauaaucccagcacuuuggguggccgaggucgguggaucaccuaaggucagcaguuuaagaccagccuggccaacauggugaaacccugucucuacuaaaaauacaaaacuuagcuggguguuguugcacaacaccuguaauuccagcuacuugggaggcugaggcaggagaaucacuagaacucuggaggcggagguugcaaugagcugagaucgcaccacugcacuccagccugggugacacaguaauacuccaucucaaaauaauaauaauaauaauaauaauaauaauaauaauaauaauaauaacagcaauuaucugguacauuugugucucuguacaaaugugccaga

SEQ ID NO: 141644 - RNA, 46 nt, Homo sapiens
uucauuccaugaauauaccacaguuuauuuuccucuuuggacaucu

SEQ ID NO: 141645 - RNA, 42 nt, Homo sapiens
ggcauuuuuugcuuguuuuagcuuuauguaaacagucucauu

SEQ ID NO: 141646 - RNA, 28 nt, Homo sapiens
cuucuguaauuucuaauuuacuauugau

SEQ ID NO: 141647 - RNA, 46 nt, Homo sapiens
uguuaaaacauucauauguuaagcaugacuuacuaagauagcaauu

SEQ ID NO: 141648 - RNA, 38 nt, Homo sapiens
ucauagauguuucaaaaaauauuuuugggaagccaaug

SEQ ID NO: 141649 - RNA, 25 nt, Homo sapiens
guugugguaaagauuauuuaagaca

SEQ ID NO: 141650 - RNA, 47 nt, Homo sapiens
uuuuugguccaccuuuucaccccaucauaacccuuugguacggaguu

SEQ ID NO: 141651 - RNA, 163 nt, Homo sapiens
cugccuggccacauucuagagaagagaaagaaagcaggcccuucacauggagacucccagggguaggacuucaauuucugccuucuaccacuguccccaccaacacccuauaccccucccucaggaaacucaccauuuugaaguaaccuuuccagcccuggug

SEQ ID NO: 141652 - RNA, 70 nt, Homo sapiens
ucacauuuucgauggugucacugggcuccaccucaagggugauggucuugccgguaaggguuuucacgaa

SEQ ID NO: 141653 - RNA, 50 nt, Homo sapiens
gugauggucuugccggucagggucuucacgaagaucugcauaccaccucu

SEQ ID NO: 141654 - RNA, 46 nt, Homo sapiens
gucuugccggucagggucuucacgaagaucugcauaccaccucuca

SEQ ID NO: 141655 - RNA, 33 nt, Homo sapiens
gcccacgcgcguguacacacacacccccccaca

SEQ ID NO: 141656 - RNA, 121 nt, Homo sapiens
aaugacagccagucaccccuuggcgaacgccugcuaaggcuccgaagagccgggccaccgaucuagcucccggcugaaagcagccgaccuugucacgcgcggggccgggaaugggagggag

SEQ ID NO: 141657 - RNA, 42 nt, Homo sapiens
agagggagcggcuguuagucauugcuccggguccauuaccga

SEQ ID NO: 141658 - RNA, 42 nt, Homo sapiens
gauaaagaaauggaguuuuauuauuguauaucaaauggagua

SEQ ID NO: 141659 - RNA, 6730 nt, Homo sapiens
ugaaauuuacuuauugcccaguauagagaaugauguguuaguugaccaaauacuuguucuaaauauauuguuggcacggauguggugaaaagggaacacuuuuacacugcugguggaaauguaaacuaguacaaccacuauggaaaacaguguggagaugccuuaaagaacuaaaaguagaacuaccauuugaccagcaauccuacaacuagguauauacccagaggaaaagaagucauuauaugaaaaagauacuugcacacacauguuuauagcaacauaauuuccaacugcaaaaauguaaaaccagcccaaaugcccaucaauuaaugaguagauaaagaaaaugugggauucccgggcaagauggcugaauaggaacagcucuggucugcagcucccagcaagaccaaugcagaaagaagacgggugauuucugcauuuccaacugagugguacuuggaaugccagcaagacagaaccauucacuccccuggaaagagggcugaagccagggagcugaguggucuugcucuguggaucccacccccaacggagcccaacaagcuaagauccacuggcuugaaauucucacugccagcacagcagucugaagucaaccugggauguuccagcuugguggggggaggggcauccaccauuauugaggcuugagugggcaguuuuccccucacaguguaaacaaagccagucggaaguuugaacugggugcggaacccaccacaguguggaaaagccaugguagccagacugccucucuagauuccuccacucugggcagggcaucucugaaagaaaggcagcaguuccagucaggggcuuauagauaaacucccuucucccuaggagagagcaccuggcggaagggauggcugugggcacagcuucagcagacuuaaacauuucugccugcuggcuccgaagagagcaacagaucucccagcacagugcucgagcuuugcuaagggacagacugccuccucaagugggucccugaaccccgcgccuccuaacggggagacaccucccagcaggggucgacagacacuucguacaggagaacuccagcuggcauccggcaggugccccucugggacgaaacuuccagaggaaggagcaggcagcaaucuuugcuguucugcagccuccacuggugauacccaggaaaacagggucuggaguggaccucgagcaaacuccagcagaccugcagaagaggggccugacuguuacaaggaaaacuaacaaacagaaagcaauagcaucaacaucaacggaaaggacgcccacgcagaaacccccauucaaaagucaccaacaucaaagaccaaacguagauaaauccgcgaagaugaggaaaaaccagagcaaaaaggcugaaaauuccaaaaaccagaauaccucuucuccuccaaaggaucacaacuccucgccagcaagggaacaaaacuggacagagaaugaguuugaugaacugacagaaguaggcuucagaagguggguaauaacaaacuccuccaaguuaaaggagcauguucuaacccaaugcaaggaaacuaagaaacuugauaaaagguuagaggaacugcuaacuauaauaaccaguuuagagaagaacauaaaugaccugauggagcugaaaaacacagcaggagaacuucgugaugcauacacaaguaucaauagcugaaucgaucaagcagaagaaaggauaucagagauuggagaccaacuuaaugaaauaaagugugaagacaaaauuagagaaaaaagaauuaaaaggaaugaacaaggccuccaaaaauaugggacaaugugaaucaaccaaaccuauguuugacugguguaccugaaagugacggggagaauggaaccaaguuggaaaacacacuucaggauauuauccaggagaacuuauccaaccuagaaagacaggccaacauucaaauucaggaaauauagagaacaccacaaagauacuccacgagaagagcaaccccaacacacauaaucaucagauucaccaagauugaaaugaaggaaaaaaauguaaagagcagccagagagaaaggcuggguuacccacaaaaggaagcccaucagauuaacagcauaucucucugcagaaacccuacaagccagaagagagugggggccaauauucaacauucuuaaagaaaauaauuuucaacccagaauuucauauccagccaaacuaagcuuccuaagugaaggagaaauaaaauccuuuacagacaagcacaugcugagggauuuuguccccaccaggccugccuuacaagagcuccugaaggaagcacuaaaccuggaaaggaacaacugguaugagccacugcaaaaacauacaaaaaugcaaagaccaucaacgcuaugaagaaacugcaucaacuaaugggcaaaauaaccagcuagcaucauaaugacaggauaaaauucacacauaacaauauugaccuuaaauguaaaugggcuaaaugccccaauuaaaagacacagacuggcaaauuggauagagucaagacccauuggugugcuguauucaggaaacccaucucacgugcagagacacacauaggcucaaaauaaagggauggagaaauauuuaccaaacaaauggaaugcaaaaaaaagcaaggguugcaguccuaguuucugauaaaacagacuuuaaaccaacaaagauaaaaaaagaaaaagaaggggauuacauaaugguaaagggaucaaugcaaaagaagagcuaacuauccuaaauacauaugcacccaacauaaaagcacccagguucauaaagcaaguucuuagagaccuacaaagagacuuagacucccacacaauaauagugggagacuuuaacaccccacugucaauauuagacagaucagcgagacagaaaauuaacaaggauauccagaacuugaacucagcucuggaccaagcagaccuaauugacaucuacagaacucuccaccccaaaucaucagaauauacauucuucucagcaccacaucgcacuuauucuaaaauugaccacauaauuggaagcaaaauacuacucagcaaaugcaaaagaacagaaaucauaacaaacagucccucagaccacagugcaaucaaauuagaauucaggauuaaaaaacucacucaaaacugcacaacuacauggaaacugaacaaccugccccugacuacuggguaaauuaaggcagaaaaaaagaaguuauuugaaaccaaugagaacagagacacaauguaccagaaucugcaguguuuagagggaaauuuauagcacuaaaugcccacaugagaaagcgggaaagaucuaaaauugacacccuaacaucacaauugaaagaacuagagaagcaagagcaaacaaauucaaaagcuagcagaagacaagaaauaacuaagaucaagccgggugcgguggcucaggccuauaaucccagcaccuugggaggccaaggcggguggauggaucaugaggucaggagaucgagaccauccuggcuaacacggugaaacccccgucucuacuaaaaauacaaaaaaauuagcugggugugguggugggugccuguagucccagcuacuagggaggcugacgcaggagaauggcaugaacccgggaggcagagcuugcagugagccgagauugugccauugcacuguagccugggcgacagagugagacucugucucaagaaaaaaaaaagaacuaacuaagaucagagcagaacugaaggagauagagacauaaaaagccauucaaaaaaucaaugaaucuaggagcugguuuuuuugaaaugauuaacaaaauagauagaccacuagccagacuaauaaagaagaaaagagagaagaaucaaauagacacaauaaaaaaugauaaaggggauaucaccacugaucccacagaaauacaaacuaccaucagagaauacuauaaacaccucuacaaaaauaaacuagaaaucuagaagaaauggauaaauuccuggacacauacacccucccaagacuaaagggacuucuucccucccaggaagaagucgaauccgugaauagaccaauaacaaguucugaaacugaggcaguaauuaauagccuaccaaccaaaaaaagcccaggacuagauggauucacagcugaauucuaccagaggugcaaagaggagcugguaccauuccuucugaaacuauuccaaacaauagaaaaagagggaauccucccuaacucauuuuaugaggccagcaucauccugauaccaaaaccuggcagagacauaacaaaaaggaaaauuucaggucaauauccuugaugaacaucgaugcgaaaauccucaguaaaauacuggcaaacugaauccagcagcacauuaaaaagcuuauccaccacgaucaagucagcuucaucccugggacgcaagguugguucaacauaugcaaaucauuaaauauaauccaucacauaaacagaaucagugacaaaaaccacaugauuaucucagaucuggaaaaggccuuugauaaaauucaacaccccuucaugcuaaaaacacucaauaaacuagguauugauggaacguaucugaaaauaauaagagcuauuuaugacaaacccacagccaauaucauacugaaugggcaaaagcuggaagcauucccuuugaaaaccgucauaagacaagaaugcccucucucaccacuccuauuuaacagaguauuggaaguucuggcuaggggaaucaggcaagagaaagaaauaaagaguauucaaauaggaagagaggaagucaaauugucucuuuuuacagaugacaugauuguauauuuagaaaccucauugucucagcccaaagcugauaagcaacuucagcaaagucucaggauacaaaaucaaugugcaaaaaucacaagcauuccuauacaccaauaacagacaaacggagagccaaaucaugagugaacucccauucacaauugcuacaaagagaauaaaauaccuaggaguaaaacuuacaagguaugugaaggauuucuuuaaggagaacuacaaaccacugcucaaggaaauaagagaggacacaaacaaauggaaaaacauuccaugcucauggauaggaagaaucaauaucaugaaaauggccauacugcccaaaguaauuuauagauucaaugcuauccccaucaagcuaccauugacuuucuucacagaauuagaaaaaacuacuuuaaauuucauauggaacaaaaaaagagcccauauagccaagacaauccuaaguaaaaagaacaacgcuggaggcaucacgcuaccugacuucaaacuauacuacaaggcuauaguaacaaaaacagcaugguacacaugccaaaacagauauauagaccaauggaacagaacagaggccucagaaauaacaccauacaucuauaaccaucugaucuuugacaaaacugacaaaaacaagcaauuaggaaaggauucccuauuuaauaaaugguguugggaaaacuggcuagccauauguagaaaacugaaaguggaccccuuccuuacaccuuacacacaaauuaacuuaggauggauuaaagacuuaaaccuaagaccuaaaacucuaaaaacuguagaagaaaaccuaggcaauaccauucaggacauaggcaugggcaaagacuucaugacuaaaacaccaaaggcgauugcaacaaaagccaaaauugacaaaugggauuuaauuaaacuaaagagcuucugcacagcaaaagaaacuaucaucagagugaauaggcaaccuacagaaugggagaaaauuuuugccgucuaugcaucugacaaaggucuaauauccagaaucuacaaggaacuuaaacaaauuuacaagaaaaaaacaaacauccccaucaaaaagugggguuguaaaguauaauaaaaaaagaaaaugugagauauacauacacacacacacacacacacacacacgcacacacaugccauggaauacuacucagccaugaaaaggaacaaaauggcauucacagcaacccggguggaacuggagacuauuauucuuuuuuuuuuuuuuuugagacagagucucgcucuguugccaggcuggagugcaguggugcgaucucggcucacugcaaccccugccuccugucaaagcaauucuccuaccucagccucccaaguagcugggacuauaggcacgugccaccaugcccagcuaauuuuuguauuuuuaguagagacgggguuucaccauguuguccaggauagucucuaucuucugacuucgugaucugccggccucggccucccaaagugcugggauuacgggugugagugacugcacccggucacuggagacuauuauucuaagugaaguaacucaggaauggaaaaccaaacaucauauguucucacucauaaacaggagguaaacuuugaggacacaaaggcauaagaaugauacauuggacuucgggggcugguggggaacagguggaagggggaugaaggauaaaagacuucacauuggguacauuguauacugcucuggugaugggugcaccaaaauuucagaaauugccacuaaagaacuuauuuauguaaccaaacaccaccuguccccccaaaagcuacugcaauaaaaauauauuaaaaaauauauacauau

SEQ ID NO: 141660 - RNA, 34 nt, Homo sapiens
uguagcuauuuaaguacaaaguaccuucucauga

SEQ ID NO: 141661 - RNA, 46 nt, Homo sapiens
gaagguuugggacucuauauuuugacaguuccccucuggugcagaa

SEQ ID NO: 141662 - RNA, 42 nt, Homo sapiens
aaauugguuauuaugcuuacuguucuaaucuggugguaaagg

SEQ ID NO: 141663 - RNA, 48 nt, Homo sapiens
cauuuugguuucauugaaacaguaucuaauuauaaauuagcuguagau

SEQ ID NO: 141664 - RNA, 32 nt, Homo sapiens
uuagaacaacacacagaagaauugguccaguu

SEQ ID NO: 141665 - RNA, 54 nt, Homo sapiens
ugguuuuuguuaaaggcuuaaaaacacugauauguaaaauuccaaaggggaguu

SEQ ID NO: 141666 - RNA, 69 nt, Homo sapiens
ccuaaauugaauaauuuuugugucucuuauggggaaauuuugucauuaaagaaugcucggagaggguug

SEQ ID NO: 141667 - RNA, 38 nt, Homo sapiens
uguuuaaauguuaucauuucagccauauuugcuugagg

SEQ ID NO: 141668 - RNA, 41 nt, Homo sapiens
acuuugccgaauguuauacagcuaagauagagucagaacuu

SEQ ID NO: 141669 - RNA, 45 nt, Homo sapiens
uuauuugguguaguacuugaaaguugguuaacauaaaaugacuaa

SEQ ID NO: 141670 - RNA, 61 nt, Homo sapiens
uuuguucagugugcucguucauaugccuguugagguuuaugauuucaugaaauuucauauu

SEQ ID NO: 141671 - RNA, 46 nt, Homo sapiens
uugaugagcugaagacugauuacaagaauccuauagaccaguguaa

SEQ ID NO: 141672 - RNA, 45 nt, Homo sapiens
uuguugauugcaugugcgcguuucccccccaaaucauacuuugac

SEQ ID NO: 141673 - RNA, 51 nt, Homo sapiens
cugacaucagaaaaccuacauugccuaaggcuggcacagaguuggccccaa

SEQ ID NO: 141674 - RNA, 47 nt, Homo sapiens
aaaguauuuguugaguauaaaucacugugcuaggcaauuagaagaga

SEQ ID NO: 141675 - RNA, 38 nt, Homo sapiens
cugccuucucuguagccugggucauccacuucuccaaa

SEQ ID NO: 141676 - RNA, 93 nt, Homo sapiens
augcagucauguaggccugagcuguccgucuuucaccguuaggugggaggagcguauggguggacuugaaggacauggacguggcuggaauga

SEQ ID NO: 141677 - RNA, 44 nt, Homo sapiens
aacuggagccuggaggcugcaucuacuucaccugucacugcuga

SEQ ID NO: 141678 - RNA, 46 nt, Homo sapiens
ggugacuaaguucuaaagaugcaaauccaugugcagaaagagaugg

SEQ ID NO: 141679 - RNA, 45 nt, Homo sapiens
uaggucaaagguugaaggccaaagguaagaccagaggguuugcga

SEQ ID NO: 141680 - RNA, 45 nt, Homo sapiens
uaaaagcagcagugccuuuuuuuguauuuacccauugacccccac

SEQ ID NO: 141681 - RNA, 28 nt, Homo sapiens
cauugcugcugauauguuguuuuuucac

SEQ ID NO: 141682 - RNA, 39 nt, Homo sapiens
guucccuggggaagccuccucacccauggcccacugccc

SEQ ID NO: 141683 - RNA, 46 nt, Homo sapiens
ggaguccauggaauuuguggaucccggaguugcuggagaaucagau

SEQ ID NO: 141684 - RNA, 46 nt, Homo sapiens
agcuggguggaggagaagaaaacaacccaggggccuggugagaagc

SEQ ID NO: 141685 - RNA, 51 nt, Homo sapiens
ucuuaucuguuucaacaaacaguacgcaccgcagaaagcuggggaggcagc

SEQ ID NO: 141686 - RNA, 48 nt, Homo sapiens
uaggcagaguguuggugagcguuaacuaggauugugauaguaggaaug

SEQ ID NO: 141687 - RNA, 32 nt, Homo sapiens
uucaaacauuuagaaaacaggagcaaauagau

SEQ ID NO: 141688 - RNA, 46 nt, Homo sapiens
aguguuaaaagcuauggaaggaaaauggauaacagaucaguuggua

SEQ ID NO: 141689 - RNA, 32 nt, Homo sapiens
ggaagauaucuauagacauauuuuauaaacac

SEQ ID NO: 141690 - RNA, 56 nt, Homo sapiens
cucccuuaccuaaucugcugugccacuguggccuccuugucuguccucaaacauac

SEQ ID NO: 141691 - RNA, 66 nt, Homo sapiens
uuugccccaggucacacaaauaguuaaguguugguacaagaauuaaaauucagacagcuuggaccu

SEQ ID NO: 141692 - RNA, 68 nt, Homo sapiens
uucgaaaucuaaacagcuacaaguucuugguuaagaaaauugaaaaauuagugugauuagcugcagga

SEQ ID NO: 141693 - RNA, 71 nt, Homo sapiens
guaaaucaucagugauuacguccuuuaccaaaguaagaaaacagguuuguagggaggcagaagucaguuuc

SEQ ID NO: 141694 - RNA, 73 nt, Homo sapiens
ggggcuacugaacgcaggggauuccgcugagccuccagccccugagcguccaccuucggcccagcugggggac

SEQ ID NO: 141695 - RNA, 42 nt, Homo sapiens
aaggggccggucucccggcgccgccggcccagacgccaggac

SEQ ID NO: 141696 - RNA, 60 nt, Homo sapiens
ccugagcgacugcggcggcggcggcggcggcggcggcgccucggagcgggcggcccgggc

SEQ ID NO: 141697 - RNA, 106 nt, Homo sapiens
cuuagccgcuauuuaaguuaguagugcuuaaagagcuacgguugaaguuaacuguuaaggugugugugugugugugagugugugugugugaugacuuuguggaaag

SEQ ID NO: 141698 - RNA, 46 nt, Homo sapiens
acagugucuccaguuugguccgaagcaauugcuggugagacuuggg

SEQ ID NO: 141699 - RNA, 45 nt, Homo sapiens
uuuaacucuuaaugauucagcgucagcauuaugaagagacauuua

SEQ ID NO: 141700 - RNA, 31 nt, Homo sapiens
cccgugaaaauccagagacagaaagcuugau

SEQ ID NO: 141701 - RNA, 46 nt, Homo sapiens
uugaacauuugcuacuuuuucuuucuauacaggugaauuugcugug

SEQ ID NO: 141702 - RNA, 104 nt, Homo sapiens
uuuucaugaaagaaacauuauaugaugaaguucuugcaaaacagaaaagagaacaaaagcuuauuccuaccaaaacagauaaaaagaaagcagaaaagaaaaag

SEQ ID NO: 141703 - RNA, 71 nt, Homo sapiens
agaagaugaucaaguugcaccuguuccauugaaugucguugaaacuucaaguaguguuagggaaagaaaaa

SEQ ID NO: 141704 - RNA, 121 nt, Homo sapiens
agaaggaaaagaaacaaaagccugugcuugaagagcaggucaucaaagaaagugacgcaucaaagauuccuggcaaaaaaguagaaccugucccaguuacuaaacagcccaccccucccuc

SEQ ID NO: 141705 - RNA, 27 nt, Homo sapiens
cagaagaagucuaaaaauggaagcggu

SEQ ID NO: 141706 - RNA, 43 nt, Homo sapiens
uguaguggaguaagaaagcuagaaaaaguuauuggugagagcg

SEQ ID NO: 141707 - RNA, 92 nt, Homo sapiens
guccugugguagauaagagagagguuauugauuugcuuaaaccugaccaaguagaagggauccagaaaucugggacuaaaaaacugaagacc

SEQ ID NO: 141708 - RNA, 47 nt, Homo sapiens
ccuuugcugaaguuauuauuuguguuuuuuaaaugccaacucuuugu

SEQ ID NO: 141709 - RNA, 57 nt, Homo sapiens
uucagagaacuacacaucuauggcaccucuguagccauggguauauucugacagggu

SEQ ID NO: 141710 - RNA, 53 nt, Homo sapiens
ucauucauagcagcuuacauuuugguuucauauucucucuuuugaucuagcag

SEQ ID NO: 141711 - RNA, 46 nt, Homo sapiens
gaaggaagaugcugcugcuacaaaggaucgguguaagcaguuaacc

SEQ ID NO: 141712 - RNA, 62 nt, Homo sapiens
gaugacagagaaagaaagaagcaaugugguuauaacaaggaugaaagaucgaauuggaacau

SEQ ID NO: 141713 - RNA, 62 nt, Homo sapiens
uagaaaaggaacauaauguauuucaaaacaaaauacaugucaguuaucaagagacucaacag

SEQ ID NO: 141714 - RNA, 51 nt, Homo sapiens
agugauaugcagacuguguuaaaucuuuuaaaucaauuaggcauuaucaag

SEQ ID NO: 141715 - RNA, 46 nt, Homo sapiens
auauuuuagcaagcagguuuuuguguuaucuauaugauuauggccc

SEQ ID NO: 141716 - RNA, 50 nt, Homo sapiens
ucuuuguuuucuaaguuuuauguguguaaaauaauuuuaguuucagcaag

SEQ ID NO: 141717 - RNA, 47 nt, Homo sapiens
uuugauaguaauugguuagacuuuuguguuuuuacauuuguuucuaa

SEQ ID NO: 141718 - RNA, 79 nt, Homo sapiens
uaaauaaacuacgccaggauuaugcuagguuggugaaugagcugacugagaaaacaggaaagcuacagcaagaggaagu

SEQ ID NO: 141719 - RNA, 40 nt, Homo sapiens
aguggaucagauguauauaguaguagcuaucuugauagaa

SEQ ID NO: 141720 - RNA, 55 nt, Homo sapiens
aauaccaagguucaacuacaagaagcugagagaaggugggaagaaguucagagcu

SEQ ID NO: 141721 - RNA, 61 nt, Homo sapiens
ucauguaaacuuuguauauaauuuuggguaaaauuuccucucucuuccaucugugaagaaa

SEQ ID NO: 141722 - RNA, 44 nt, Homo sapiens
gcaaagacuaaugcaguuaauggaaucagagcagaaaaggguga

SEQ ID NO: 141723 - RNA, 49 nt, Homo sapiens
auauuagucauggaauggauaauuuuauuauuaaaaguuguuacuaagg

SEQ ID NO: 141724 - RNA, 42 nt, Homo sapiens
auucuuuagcaagugaacgugaucguuuaacaaguaaagaag

SEQ ID NO: 141725 - RNA, 46 nt, Homo sapiens
cuaggauauacagaauaugaauuucuuauuaaaagcugaagugcag

SEQ ID NO: 141726 - RNA, 35 nt, Homo sapiens
caauuugauuguguaaguaaaaaauauaaugguuu

SEQ ID NO: 141727 - RNA, 41 nt, Homo sapiens
agauugcuggaagagcaacuacaacaugaaauuucaaacaa

SEQ ID NO: 141728 - RNA, 51 nt, Homo sapiens
gaagcuacagacucuuguuucugaacagguaaggcuuuuccuaaauuacaa

SEQ ID NO: 141729 - RNA, 37 nt, Homo sapiens
uuccacuuuucuuuaaccccuuucuaucccacaguca

SEQ ID NO: 141730 - RNA, 40 nt, Homo sapiens
gaacaguuuaguuauguaaaaauuucaguccuuuuacccc

SEQ ID NO: 141731 - RNA, 48 nt, Homo sapiens
agacuguggaagaauuacuugaaacuggacuuauucagguggcaacua

SEQ ID NO: 141732 - RNA, 45 nt, Homo sapiens
agaaaauucaucucugacaaaagaaguucaagacuuaaaagcuaa

SEQ ID NO: 141733 - RNA, 46 nt, Homo sapiens
cugcauuucuuuauugaaggauccaugagaaagauggaaagaucaa

SEQ ID NO: 141734 - RNA, 46 nt, Homo sapiens
gaauaccaugaaggcuguuuuggaagagaaagagaaagaccuagcc

SEQ ID NO: 141735 - RNA, 59 nt, Homo sapiens
ggaaaaugaauugaagagguuagaagccaugcuaaaagagagggagagugaucuuucua

SEQ ID NO: 141736 - RNA, 55 nt, Homo sapiens
uguacaagaugaaaacaaauuguuuaagucccaaauugagcagcuuaaacaacaa

SEQ ID NO: 141737 - RNA, 31 nt, Homo sapiens
uucuuagcaagucaguuuaaauacuguagag

SEQ ID NO: 141738 - RNA, 23 nt, Homo sapiens
gggcuuuguauggucaacaguag

SEQ ID NO: 141739 - RNA, 47 nt, Homo sapiens
ucuggaaugaguuagauucuuugaaggaugcaguugaacaccagagg

SEQ ID NO: 141740 - RNA, 77 nt, Homo sapiens
ugagaggugguucaaauuuugguaauuaaguguguuagaggcuuuagaaccugacuacauuuauacuagaaagggaa

SEQ ID NO: 141741 - RNA, 43 nt, Homo sapiens
acaaacaauuuaguggaauuucuuaacuuuucucauaccagag

SEQ ID NO: 141742 - RNA, 20 nt, Homo sapiens
auaaacuacguguuuuggag

SEQ ID NO: 141743 - RNA, 58 nt, Homo sapiens
cuccuugagcucaaguuguaccauugggugugaagauuucuaaugaauuguaauagag

SEQ ID NO: 141744 - RNA, 64 nt, Homo sapiens
uaaaauugaaguguguagaccuugaaucagugauagauuucaaauuucacauauaaauguuggg

SEQ ID NO: 141745 - RNA, 27 nt, Homo sapiens
agcaacagguggaagcuguugaguugg

SEQ ID NO: 141746 - RNA, 55 nt, Homo sapiens
aguguacauuuagucuugguucagauuuauaaugugagaauguuaaauaguguuu

SEQ ID NO: 141747 - RNA, 49 nt, Homo sapiens
aaaaaaaggcaaaagaauguauggcuggaacuucagggucagaggaggu

SEQ ID NO: 141748 - RNA, 65 nt, Homo sapiens
agcacaaguugaaagaagcugaugaaaugcacacauuguuacagcuagagugugaaaaauacaaa

SEQ ID NO: 141749 - RNA, 60 nt, Homo sapiens
cagaagcuacagagaaguguugagcaagaagaaaauaaauggaaaguuaaggucgaugaa

SEQ ID NO: 141750 - RNA, 41 nt, Homo sapiens
cagaauuuacaguugcugaugguacucuaaugcacuugcag

SEQ ID NO: 141751 - RNA, 45 nt, Homo sapiens
gaacaagagcuagagcgauuaagaagcgaaaauaaggauauugaa

SEQ ID NO: 141752 - RNA, 94 nt, Homo sapiens
gaaaggaaauuuuaaguguguuaacuuuuccuuuguugcauugcuagcugagaagagaacgagaacauuuggaaauggaacuagaaaaggcaga

SEQ ID NO: 141753 - RNA, 46 nt, Homo sapiens
caguuaaaugaaacacucacaaaacuuagaacugaacaaaaugaaa

SEQ ID NO: 141754 - RNA, 32 nt, Homo sapiens
uauaagcacauaauauguagagagggaucuaa

SEQ ID NO: 141755 - RNA, 39 nt, Homo sapiens
uggagcuuauccagucaaaaauaguaaaagcugcuggag

SEQ ID NO: 141756 - RNA, 61 nt, Homo sapiens
uuugugcuuuaguugccccaucuguaaaaggcaaugauaauaguaccuauccuguaggguu

SEQ ID NO: 141757 - RNA, 42 nt, Homo sapiens
uuuucugaaagaaaaaauggauauauuucugauauucauaga

SEQ ID NO: 141758 - RNA, 101 nt, Homo sapiens
augucuguaagucuaaaucagacuguaacacaguuacagcaguugcuucaggcgguaaaccaacagcucacaaaggagaaagagcacuaccagguguuagg

SEQ ID NO: 141759 - RNA, 67 nt, Homo sapiens
acauaaauaaacucacuucacuagaggaaauauuccuucuuuaucucucagaacuuccagaugacag

SEQ ID NO: 141760 - RNA, 45 nt, Homo sapiens
acagagugaaguaauugggaaacuguucauuugaggauaaaaaag

SEQ ID NO: 141761 - RNA, 45 nt, Homo sapiens
cauguaaucuuuuaucuuauuuugcucaauaaaauuguucagaag

SEQ ID NO: 141762 - RNA, 70 nt, Homo sapiens
guucuucuaugacauuauuaaaaguugugucccugauacuugcaucaaucuguccuuucucacuacagaa

SEQ ID NO: 141763 - RNA, 138 nt, Homo sapiens
agaauaaagaauagucaggggcagacuucuugaucccccaaaagagaagagagagacguggaagggaggaguggggaugccugugaagccggccauacccuuggguuuggcguaggaaaacuaauucauuuccuggag

SEQ ID NO: 141764 - RNA, 40 nt, Homo sapiens
gcugugggcaauagcuguguugcucacagaguuagagcua

SEQ ID NO: 141765 - RNA, 46 nt, Homo sapiens
aguggugcagccugagagacgccuuuggaaugaagcaggugaccaa

SEQ ID NO: 141766 - RNA, 35 nt, Homo sapiens
uuguuaaucuccaauauuaucugaaauuuguugag

SEQ ID NO: 141767 - RNA, 51 nt, Homo sapiens
aaauggaaaaguuauauaugcauaaaccuuuucuuccuggauuuggcagau

SEQ ID NO: 141768 - RNA, 53 nt, Homo sapiens
gcaaccaaacaccaccaaaaauaaaaucaaacaaaacuaaguugugaaggaag

SEQ ID NO: 141769 - RNA, 45 nt, Homo sapiens
gaaaaacgaagggccuuagaggggccuacaaaccagcaacaugaa

SEQ ID NO: 141770 - RNA, 45 nt, Homo sapiens
auggguaccaaugcagucaccagccaucucaaucaguccccagcu

SEQ ID NO: 141771 - RNA, 75 nt, Homo sapiens
uuccaucuccccacugucagaucccuuguccaccuccucuuccugcaugcagagguccuaucccaugaccuauac

SEQ ID NO: 141772 - RNA, 46 nt, Homo sapiens
uccccccucuagcaccucagucccgaccauugccagcagcagugcu

SEQ ID NO: 141773 - RNA, 45 nt, Homo sapiens
acaacagcagaauggaggucaaaacaaagugagaccugccaaaaa

SEQ ID NO: 141774 - RNA, 52 nt, Homo sapiens
aguggcuuucagaccucuuucuucaacaagaucaugucuuccccuuggagcu

SEQ ID NO: 141775 - RNA, 46 nt, Homo sapiens
ggcccugggcuucuugucccgcagccaccccccggaaacagcgccg

SEQ ID NO: 141776 - RNA, 36 nt, Homo sapiens
ugugguuuggggguugaucuuggagaacuuuuuugu

SEQ ID NO: 141777 - RNA, 43 nt, Homo sapiens
ugccucgccuaguccgugcucuuuuuaaguuagugcuggaacg

SEQ ID NO: 141778 - RNA, 48 nt, Homo sapiens
uuagaucuuaggguagaaaagcaugacuuuugugcucugaauuuaaau

SEQ ID NO: 141779 - RNA, 45 nt, Homo sapiens
ccguucugggcuucucccgcgaucuuugcguuuuggcccccagau

SEQ ID NO: 141780 - RNA, 36 nt, Homo sapiens
aaaaguaagugauuguucuuuuacagugcgauguau

SEQ ID NO: 141781 - RNA, 51 nt, Homo sapiens
auuauuuuagguuuucguaaauaauuuuuuugccucuuucaaaagguuaac

SEQ ID NO: 141782 - RNA, 46 nt, Homo sapiens
cacuccuucguacaacuucgugcugauuauagaucugcccgccuug

SEQ ID NO: 141783 - RNA, 44 nt, Homo sapiens
aacaguguuguuccaauuauuauuuuuuuuuauuuuaaauuuua

SEQ ID NO: 141784 - RNA, 45 nt, Homo sapiens
ugcuuacguaagaaaacaaguggagaagauuaaaaauuccaugga

SEQ ID NO: 141785 - RNA, 46 nt, Homo sapiens
cugaaugccuucagaagaaaaaagaaauaauugaacaaauggagau

SEQ ID NO: 141786 - RNA, 62 nt, Homo sapiens
gagcaucagugauuagaggaggagggugaauauuggaguagagagacugaugagggaggggu

SEQ ID NO: 141787 - RNA, 45 nt, Homo sapiens
cuauuaugauucgaaaaaccaucaaaagagauccauuggcacagg

SEQ ID NO: 141788 - RNA, 46 nt, Homo sapiens
ucuugucuaagcuuaucaaauccauuuucauuuccuauuuggagaa

SEQ ID NO: 141789 - RNA, 46 nt, Homo sapiens
uguaggguuauucccauuguguugauguuuauauaaagcagugcca

SEQ ID NO: 141790 - RNA, 34 nt, Homo sapiens
aauuuuaucauagaaagugacuagggagacgaua

SEQ ID NO: 141791 - RNA, 64 nt, Homo sapiens
gaaaaagcaggaacaaugucaucuuccuacccuaguaggcuacugcauagaagaucccugaguu

SEQ ID NO: 141792 - RNA, 41 nt, Homo sapiens
gaauaugaauaugugugugugugugugugugugugugugug

SEQ ID NO: 141793 - RNA, 47 nt, Homo sapiens
aauaauuucagucccugucuccugaaaaaaaauuugaugaaggagaa

SEQ ID NO: 141794 - RNA, 46 nt, Homo sapiens
aggaagcagcagacaucauucagaaguugcaccuaauugcccaaga

SEQ ID NO: 141795 - RNA, 47 nt, Homo sapiens
aguuagaggggguaaacacacccagacaacgggcaguggaggcucag

SEQ ID NO: 141796 - RNA, 62 nt, Homo sapiens
uuuuguagaucaucucguauauaacuucuguuaucuuuaguuaguagcaauaagaguaguag

SEQ ID NO: 141797 - RNA, 45 nt, Homo sapiens
guuugcaguuugguuaacagauuuucagaucaugucacacuaaug

SEQ ID NO: 141798 - RNA, 97 nt, Homo sapiens
uagauuauuagaagaauuuguaaaucauauucaggaacuccagauaauggaugaaaggauucagaggaaaguagagaaacuagagcaacaaugucag

SEQ ID NO: 141799 - RNA, 68 nt, Homo sapiens
gcagaugaauauauugaacgucuuguauggagaaccccaggaggaggcucuagagguggaccugaagc

SEQ ID NO: 141800 - RNA, 62 nt, Homo sapiens
auccuagcuucuuugaguuuuugggugguuccaacacauuguauuggaucugcuuuugggaa

SEQ ID NO: 141801 - RNA, 47 nt, Homo sapiens
guacuuuugaaccgauggguuaguugguuuaacaagauacagaaaua

SEQ ID NO: 141802 - RNA, 47 nt, Homo sapiens
aaagaauuuuggaggaagaauuaaaggaauuugauuacugaggaguu

SEQ ID NO: 141803 - RNA, 46 nt, Homo sapiens
cugauuaaucuggccagaugaaagucuaaccuaauucaauggugac

SEQ ID NO: 141804 - RNA, 31 nt, Homo sapiens
cugggggaaguuuuaagaaggcuuuuuauac

SEQ ID NO: 141805 - RNA, 62 nt, Homo sapiens
aaagguuucauuuaguaauggcauauagaaauuggauguugauggaugaguagagauuuuuc

SEQ ID NO: 141806 - RNA, 44 nt, Homo sapiens
gucuugucgcugggguccucgcgggaauaauaggaggaagccac

SEQ ID NO: 141807 - RNA, 133 nt, Homo sapiens
uuggggccgaggugggcugggcggccggucggcagagaggggaagccgggugucccaagggaggaggguugcuuuuguuugugggggcaagagggaaagucuggaagguucggguguuggaagaugucuacuc

SEQ ID NO: 141808 - RNA, 42 nt, Homo sapiens
cugugcgccgcgccucugaggcgcagcaugugaagcggagac

SEQ ID NO: 141809 - RNA, 130 nt, Homo sapiens
ucguguuuaaccgucuuuaauuacccgcccgcauccucaaacacuuuacagucauuuaauuugaacaugguucuguucagauacaggccuuauuagucucucgauuacaaccauaaucagggaagagugu

SEQ ID NO: 141810 - RNA, 63 nt, Homo sapiens
acauggaugucagcaaacuugguguggucauauuggagaauuaaaucuuacaagcauuuucgg

SEQ ID NO: 141811 - RNA, 59 nt, Homo sapiens
gaaacugguuguagauguggccaaacacuaguaacacuggcuuguguagaguauaauug

SEQ ID NO: 141812 - RNA, 39 nt, Homo sapiens
ggacgguuuuuaaaaauuaacauaguauuggcaguacca

SEQ ID NO: 141813 - RNA, 79 nt, Homo sapiens
gcuuuguaucaugugcucacaagcauauuguuucuguugaauuuuacuacagaaagaugacauccuuuuaaggaauauu

SEQ ID NO: 141814 - RNA, 50 nt, Homo sapiens
uguuaaaacuguggguacuacuuuauauucuugaaaacugcucuuucagu

SEQ ID NO: 141815 - RNA, 47 nt, Homo sapiens
uuuauuaaaauagaaauuucuguaaaauuaaagcuuuuaacauaaag

SEQ ID NO: 141816 - RNA, 43 nt, Homo sapiens
aaaauuuuuaauuuuuuuuuccugaucgaaaucuaccauucag

SEQ ID NO: 141817 - RNA, 48 nt, Homo sapiens
ggcaauguauucuucauaacuguuuguuuauuuuuaaggccaugguag

SEQ ID NO: 141818 - RNA, 50 nt, Homo sapiens
uuucauuuuuguuguguuuugaaauaaaagacuuaaauguaaguauguag

SEQ ID NO: 141819 - RNA, 82 nt, Homo sapiens
agagcaucacccuaacucuagagagaaugggagaccucuugaguuaggaggcucuuguaauuauagugagaguugauggcag

SEQ ID NO: 141820 - RNA, 45 nt, Homo sapiens
aaacaauugaaaaggcaaauagagcuacguguguaaaaguuggga

SEQ ID NO: 141821 - RNA, 44 nt, Homo sapiens
aaaagucuuuaaguauacuaacauuucacacaaaaccugcccua

SEQ ID NO: 141822 - RNA, 47 nt, Homo sapiens
ucaauauuaaauuuuccauucuugaauauugguaccucagugauuag

SEQ ID NO: 141823 - RNA, 32 nt, Homo sapiens
uagaugcacuuuuucuuuugagaguaagggaa

SEQ ID NO: 141824 - RNA, 50 nt, Homo sapiens
gauuugaaaugugcaagcugucuaaauaagaugcagucaaauaaaguaug

SEQ ID NO: 141825 - RNA, 45 nt, Homo sapiens
gggcccaaagaacauuaacacaacaauaaaaugugcuguacaggu

SEQ ID NO: 141826 - RNA, 46 nt, Homo sapiens
accagcauguuggggacugugcaggucacauaccagaucucuagga

SEQ ID NO: 141827 - RNA, 46 nt, Homo sapiens
acuagcauguuaggaauaguggaggacacauaccagaucucaagga

SEQ ID NO: 141828 - RNA, 70 nt, Homo sapiens
gcaaaggaggcauccgccgggccccuccccgaagggcgggguccacggcaucuccugcccagucugaccu

SEQ ID NO: 141829 - RNA, 42 nt, Homo sapiens
acucagcucguggccccacugaugagcuucccuccgcccuau

SEQ ID NO: 141830 - RNA, 89 nt, Homo sapiens
gaaaacucguagaugccagagacaggagucgaaaaagaugccuguggcuggaggaaaagcuaauaaggacaggacagaagacaagcaag

SEQ ID NO: 141831 - RNA, 21 nt, Homo sapiens
cagcuguuuuugauucccaua

SEQ ID NO: 141832 - RNA, 47 nt, Homo sapiens
uauugugaaggaaaugaugucuaugaugucaugcuaaaucagguaag

SEQ ID NO: 141833 - RNA, 55 nt, Homo sapiens
aacaacaacaaguacuaucugauucagcuauuagaagaugaugcccagaggaacu

SEQ ID NO: 141834 - RNA, 44 nt, Homo sapiens
aauccuuucaccuuucccuucucccuuuccugccuguuugucag

SEQ ID NO: 141835 - RNA, 46 nt, Homo sapiens
aaaguugaucuguaauguucaggccauggaagaaaugaugauggaa

SEQ ID NO: 141836 - RNA, 42 nt, Homo sapiens
gugaaaacagagcuacaaagcccagaacacccauuggaccaa

SEQ ID NO: 141837 - RNA, 42 nt, Homo sapiens
agcgacuauaccaugaccuugcuggauuuguuugaaguggag

SEQ ID NO: 141838 - RNA, 48 nt, Homo sapiens
guuuaauuuccuucagcuguggugaauguugauauuaaauaaaccaga

SEQ ID NO: 141839 - RNA, 30 nt, Homo sapiens
ccucauacuguuuccagaccauuaucccuc

SEQ ID NO: 141840 - RNA, 41 nt, Homo sapiens
gcauuuuaugugcuaaguauucagaaauagauguuauacug

SEQ ID NO: 141841 - RNA, 53 nt, Homo sapiens
agcuguaccgcgucacccaccgaagcaauauuuuuaccgcguugccuacagac

SEQ ID NO: 141842 - RNA, 41 nt, Homo sapiens
cugaucugggggguccucauacagggcugggcccucuccug

SEQ ID NO: 141843 - RNA, 62 nt, Homo sapiens
guuaauggaauggaggacaugcuucauauggaaugcaaugcaggaagauaaaauggaggaag

SEQ ID NO: 141844 - RNA, 41 nt, Homo sapiens
gggcaggugcugugacccgggaaccuggcacacugggccca

SEQ ID NO: 141845 - RNA, 46 nt, Homo sapiens
caguucucucacauccaucugggaagaccaaacguugcuuucagag

SEQ ID NO: 141846 - RNA, 79 nt, Homo sapiens
aguuaagaauuuuuuuuuaagaccugucagcaggaaaagaccuuuaauagcuauuuuuuuaaacucuuuaacacaagac

SEQ ID NO: 141847 - RNA, 62 nt, Homo sapiens
gagcuugcuugcuggacugaggaggcagguaauuaaguuagggcaauagauaagaauacaug

SEQ ID NO: 141848 - RNA, 45 nt, Homo sapiens
uuuggagaucguuucccugccaugucugaugccuacgaccggacu

SEQ ID NO: 141849 - RNA, 65 nt, Homo sapiens
ggccccagcuuugagacuguggcagaaugucgugugcugcagaagcugggagcagacgcuguugg

SEQ ID NO: 141850 - RNA, 46 nt, Homo sapiens
gauuaugaaagccuggagaaggccaaccaugaagaagucuuagcag

SEQ ID NO: 141851 - RNA, 51 nt, Homo sapiens
ccuguccuucaccuuucccacuuucuucuaccagacccuucuggugccaga

SEQ ID NO: 141852 - RNA, 73 nt, Homo sapiens
caagagcuggagcccgugcccuaccacacaucuguggagaugcccaggauuugacucgggccuuagaacuuug

SEQ ID NO: 141853 - RNA, 47 nt, Homo sapiens
aauaccucuuggauuuuauuuaaugucauaauguugucagaauaaag

SEQ ID NO: 141854 - RNA, 41 nt, Homo sapiens
cuuuaauagcuauuuuuuuaaacucuuuaacacaagacugg

SEQ ID NO: 141855 - RNA, 64 nt, Homo sapiens
gccccagcuuugagacuguggcagaaugucgugugcugcagaagcugggagcagacgcuguugg

SEQ ID NO: 141856 - RNA, 63 nt, Homo sapiens
ggagacggaccuggccaaccuuguacucuagaagccugauugggaccuaagagagaugcgggc

SEQ ID NO: 141857 - RNA, 43 nt, Homo sapiens
ccuucaucuucuccuccacugcaacugguuuggccuggaaacc

SEQ ID NO: 141858 - RNA, 45 nt, Homo sapiens
gaaaaggaggaggguuuccaggccaaaccaguugcaguggaggag

SEQ ID NO: 141859 - RNA, 64 nt, Homo sapiens
ugaaggcccuagagaaaaccagguacagagacaaggaaaauggggagccaaagaccaagcagcu

SEQ ID NO: 141860 - RNA, 40 nt, Homo sapiens
ccacagagugucuucuagccaguccagguccacagccgcc

SEQ ID NO: 141861 - RNA, 45 nt, Homo sapiens
cagaguucguccuggcagggcucccaaaucucaacagcgcaagag

SEQ ID NO: 141862 - RNA, 54 nt, Homo sapiens
caggauucaaaagaacaucuuugcguuuucuaccggcuccccaucaucguacua

SEQ ID NO: 141863 - RNA, 58 nt, Homo sapiens
uggaccaaugaaggucagugaaaccuuucuuuaggaguuuuuauugaaucuguauuua

SEQ ID NO: 141864 - RNA, 46 nt, Homo sapiens
ccuaaaacucucuucuuagcucucaccuccuguauuacuaucucau

SEQ ID NO: 141865 - RNA, 45 nt, Homo sapiens
caaaccacagggccgggaugacagauacugugaaagcaucaugag

SEQ ID NO: 141866 - RNA, 46 nt, Homo sapiens
gaggagacagguggcagugaucgcuacugcaacuugaugaugcaaa

SEQ ID NO: 141867 - RNA, 58 nt, Homo sapiens
gcgagugguugaccuuacacuuacuccuuaaauagcagugaguaaugcauuugagcug

SEQ ID NO: 141868 - RNA, 44 nt, Homo sapiens
uucucauuaacccuuuaggacucugaaggguauggaccuacgug

SEQ ID NO: 141869 - RNA, 46 nt, Homo sapiens
uccaucagacucucccuacuugucccauauuugcaaggggagggga

SEQ ID NO: 141870 - RNA, 55 nt, Homo sapiens
uagacaccuagaucaggacagaggaugcauaugcccucuccaccuuaacaucaaa

SEQ ID NO: 141871 - RNA, 45 nt, Homo sapiens
cccgaagaaagaguuccagacucgcugcucugggacagggugcga

SEQ ID NO: 141872 - RNA, 42 nt, Homo sapiens
ggaacuugaaugcuugggcuaacuuccuuagcugggacagga

SEQ ID NO: 141873 - RNA, 41 nt, Homo sapiens
aguuaggucguuacugcuucaccagacugugaggaacagga

SEQ ID NO: 141874 - RNA, 42 nt, Homo sapiens
cucuucucucucuaaucuucauuauucuuucuuauccucaaa

SEQ ID NO: 141875 - RNA, 45 nt, Homo sapiens
cggauucacacagaaacacaugaccauguggcgucccagauggag

SEQ ID NO: 141876 - RNA, 44 nt, Homo sapiens
cucuuugucuguuugucucuccaucugggacgccacauggucau

SEQ ID NO: 141877 - RNA, 43 nt, Homo sapiens
gagacaagggccugacucccaauuauaguguauggggagagag

SEQ ID NO: 141878 - RNA, 45 nt, Homo sapiens
cugcgggaagcccgagccggggcgggcccgagucaaaggcaagug

SEQ ID NO: 141879 - RNA, 46 nt, Homo sapiens
gguugguuagggugcuauuguaguagcagcuaguggguggcuguug

SEQ ID NO: 141880 - RNA, 34 nt, Homo sapiens
auuuaggcagcuuccuaaugcuuucccacucuuu

SEQ ID NO: 141881 - RNA, 50 nt, Homo sapiens
gaaaagaaaagugcgaugaggcaaaugugaagcuguauggggaggugaca

SEQ ID NO: 141882 - RNA, 56 nt, Homo sapiens
caucccgggcacuaugugaauuuggggugaguucucuugguacuccagcugugguc

SEQ ID NO: 141883 - RNA, 46 nt, Homo sapiens
gguacauaaaaaguguugugccaaagaagaggcagauggcagugag

SEQ ID NO: 141884 - RNA, 46 nt, Homo sapiens
auugaggaauccugcacuguaggagcccacaaucagcgaggcacag

SEQ ID NO: 141885 - RNA, 48 nt, Homo sapiens
ccuuuuaauuacauuuauuuuaaugcugaauuuacucccgugccauaa

SEQ ID NO: 141886 - RNA, 93 nt, Homo sapiens
aacgcaucauucggacaggccguacaggucacugguugaaccaugggaaggaacacugcuuggugagcagcaguggggcccaauucaauaggu

SEQ ID NO: 141887 - RNA, 46 nt, Homo sapiens
uggcuuucucuuccucugggucacaggcagguaaugcaauucaguu

SEQ ID NO: 141888 - RNA, 27 nt, Homo sapiens
accaagucuuuacucagagaggaauua

SEQ ID NO: 141889 - RNA, 45 nt, Homo sapiens
uucuguucuacccaagucuccugcacugcuugccuuccaguggua

SEQ ID NO: 141890 - RNA, 44 nt, Homo sapiens
gacguucgcccuucugcaaguaguucgcgguuccuccucacgcu

SEQ ID NO: 141891 - RNA, 46 nt, Homo sapiens
ugcagggaugucacagaagaaguaauccaccugauugggcccacag

SEQ ID NO: 141892 - RNA, 46 nt, Homo sapiens
caccaaaugggauggguuugacaccuaaagugaaguucaucaugag

SEQ ID NO: 141893 - RNA, 46 nt, Homo sapiens
gguuccccagcugagugaggauguaaaugaugaagaagaccaggaa

SEQ ID NO: 141894 - RNA, 49 nt, Homo sapiens
uguaagugaaugcuuuugucggaugauugaugccuaggaauuaugagau

SEQ ID NO: 141895 - RNA, 42 nt, Homo sapiens
aggaucauucuccugauuuauauucacuggagcuggcagguu

SEQ ID NO: 141896 - RNA, 44 nt, Homo sapiens
gcaaacucaguguuugaagaccuuucagucaccuugcgccagcu

SEQ ID NO: 141897 - RNA, 46 nt, Homo sapiens
uauuuucugaggaaacuccuguuguuuugcaguuggcucccaguga

SEQ ID NO: 141898 - RNA, 46 nt, Homo sapiens
ggagaagcugaagguguugaccaggguacuggacauaccagaagag

SEQ ID NO: 141899 - RNA, 62 nt, Homo sapiens
aauagaaggccaccaaaaggggaaaagaggaaauaauacaguaaucguuaauccagcaaaaa

SEQ ID NO: 141900 - RNA, 48 nt, Homo sapiens
gcagauuugaagaggcauguggaauuccuuguggcagagaauuaaaga

SEQ ID NO: 141901 - RNA, 56 nt, Homo sapiens
cauuaaauguaaccuuuugccuuccaaauuaaagaacuccaugccacuccuccaua

SEQ ID NO: 141902 - RNA, 41 nt, Homo sapiens
uugaauuuccuggauaagaguucuggagauggcagcuuauu

SEQ ID NO: 141903 - RNA, 72 nt, Homo sapiens
ccaacuaaguugagaguuugauauuaaaaaaaaaauucuguaauauagcugaucuuacaugaauuugggggu

SEQ ID NO: 141904 - RNA, 28 nt, Homo sapiens
aacucagcuauaugugcacugugccaca

SEQ ID NO: 141905 - RNA, 41 nt, Homo sapiens
uuugcugauuuucucuuugccagcaccauccugcaccuugu

SEQ ID NO: 141906 - RNA, 41 nt, Homo sapiens
ugccugagaauacagaucaacccacagaacaaagcggauuu

SEQ ID NO: 141907 - RNA, 54 nt, Homo sapiens
auguauauaugcauucauuucuguuagaguagaauuguuggguccucggguaug

SEQ ID NO: 141908 - RNA, 56 nt, Homo sapiens
cuuuauaaacucugcuacccauuaaaugaauauucuauuagaaaauaauucacauu

SEQ ID NO: 141909 - RNA, 39 nt, Homo sapiens
uguuagaaucuucaaggggauggaguguggcaguggaga

SEQ ID NO: 141910 - RNA, 46 nt, Homo sapiens
caugucaagauuguucuuacugucuagaaugcucugcccccagauu

SEQ ID NO: 141911 - RNA, 60 nt, Homo sapiens
uggccuuccggccucugguuuccaguccaucuucuacuguguuugcaggcuugauuugac

SEQ ID NO: 141912 - RNA, 48 nt, Homo sapiens
ucuuuucucucgggcuucaucucuuguguggggaguuucauccuagcg

SEQ ID NO: 141913 - RNA, 51 nt, Homo sapiens
gacgcugcggaguggagcucaaguacucuucuaagaaccgcgaaaugacag

SEQ ID NO: 141914 - RNA, 46 nt, Homo sapiens
uaguaucacuguaaaguggaacagccaccaggaagauggugcagag

SEQ ID NO: 141915 - RNA, 27 nt, Homo sapiens
cucacacucagcccaccuucccuauuu

SEQ ID NO: 141916 - RNA, 42 nt, Homo sapiens
ugggaggccacuucauacucagugcugucaaccaugguggag

SEQ ID NO: 141917 - RNA, 49 nt, Homo sapiens
aaagggaggaagguugcacagugugacacaaaggcuuguucccaugcug

SEQ ID NO: 141918 - RNA, 48 nt, Homo sapiens
acagauacacucugguaugacuagauuuccccaucacuccaagcuaga

SEQ ID NO: 141919 - RNA, 42 nt, Homo sapiens
ugggcaggugcggggaggaggggcuaccagcugagucagggg

SEQ ID NO: 141920 - RNA, 42 nt, Homo sapiens
aaauggaaaacaggaaaacacaugugugacucuggccggcag

SEQ ID NO: 141921 - RNA, 48 nt, Homo sapiens
uggacgcuggauuacaagcauggcagcucaggcagcagaaguugcagg

SEQ ID NO: 141922 - RNA, 48 nt, Homo sapiens
ggauucaggcuaaaacaaccacguccccaaccaggaaaggagggcacu

SEQ ID NO: 141923 - RNA, 27 nt, Homo sapiens
uuagucggcgaacuggggucugguucc

SEQ ID NO: 141924 - RNA, 47 nt, Homo sapiens
gcgccuuugucuucgguaggcacugaacuugaauuccuagaccgcug

SEQ ID NO: 141925 - RNA, 46 nt, Homo sapiens
ccgagcgugagcagggggagcaggagacaacgggggggucuugggg

SEQ ID NO: 141926 - RNA, 63 nt, Homo sapiens
aggauaaacacaccccgggcuuaugacccuugguugaggagcagcugcuucaggacuugggga

SEQ ID NO: 141927 - RNA, 51 nt, Homo sapiens
cccuccucagggguagaggaaggagugacauuuaaccuuugguauaccaga

SEQ ID NO: 141928 - RNA, 27 nt, Homo sapiens
gccucccggggaccuacguacccacac

SEQ ID NO: 141929 - RNA, 52 nt, Homo sapiens
uacuugcaagccguaaaacuucugcauggcagcgauggccgcugagagugac

SEQ ID NO: 141930 - RNA, 50 nt, Homo sapiens
aggcgcccccgaugugguguuccagacaaguuuggggcugagaucaaggc

SEQ ID NO: 141931 - RNA, 24 nt, Homo sapiens
ugccacauacgaggccauucgcaa

SEQ ID NO: 141932 - RNA, 69 nt, Homo sapiens
cauggaagcccucggcaaagaagaucaugaugucggccugcuucucauggcccucacggauguaggcau

SEQ ID NO: 141933 - RNA, 83 nt, Homo sapiens
gagggcggcuuccuggcccaugccuacuucccaggccccaacauuggaggagacacccacuuugacucugccgagccuuggac

SEQ ID NO: 141934 - RNA, 70 nt, Homo sapiens
ccaauguuggggccugggaaguaggcaugggccaggaagccgcccucaccaucgaagggcgugcugucgc

SEQ ID NO: 141935 - RNA, 86 nt, Homo sapiens
aucuuccugguggcugugcacgagcugggccaugcccuggggcucgagcauuccagugaccccucggccaucauggcacccuuuua

SEQ ID NO: 141936 - RNA, 102 nt, Homo sapiens
cagcacaaaauucuccguguccauccacugguaaaagggugccaugauggccgaggggucacuggaaugcucgagccccagggcauggcccagcucgugcac

SEQ ID NO: 141937 - RNA, 45 nt, Homo sapiens
gggcagaaaacacgaggggcauuucagacuuaggaggaggcgggg

SEQ ID NO: 141938 - RNA, 60 nt, Homo sapiens
ucaggguuccccaccaagaugcccccucaacccaggacuaccucccggccuucuguuccu

SEQ ID NO: 141939 - RNA, 76 nt, Homo sapiens
ccaguucuggcggggccugccugcguccaucaacacugccuacgagaggaaggauggcaaauucgucuucuucaaa

SEQ ID NO: 141940 - RNA, 45 nt, Homo sapiens
cccaagcacauuaaggagcugggccgagggcugccuaccgacaag

SEQ ID NO: 141941 - RNA, 37 nt, Homo sapiens
cccuuaaccccaggccucccucagaaaccaccaccac

SEQ ID NO: 141942 - RNA, 45 nt, Homo sapiens
ggacaggguggggacagggguuuugaguaaugaggaccugcugcu

SEQ ID NO: 141943 - RNA, 57 nt, Homo sapiens
ccguuucaacgaagagcucagggcaguggauagcgaguaccccaagaacaucaaagu

SEQ ID NO: 141944 - RNA, 51 nt, Homo sapiens
acaaggggaacaaauacuggaaauucaacaaccagaagcugaagguagaac

SEQ ID NO: 141945 - RNA, 61 nt, Homo sapiens
ccaucgggaggccggccggaugaggggacugaggaggagacggaggugaucaucauugagg

SEQ ID NO: 141946 - RNA, 42 nt, Homo sapiens; identical to SEQ ID NO: 48407

SEQ ID NO: 141947 - RNA, 45 nt, Homo sapiens
cugccguggugcugcccgugcugcugcugcuccuggugcuggcgg

SEQ ID NO: 141948 - RNA, 42 nt, Homo sapiens
cauggcgucugaagaagaagacugcaaggcccaccgccagca

SEQ ID NO: 141949 - RNA, 42 nt, Homo sapiens
ccaccgccggcccgcccacuccuaccacaaggacuuugccuc

SEQ ID NO: 141950 - RNA, 105 nt, Homo sapiens
caggggaacccuguagcuuugugucuguccagccccaucugaauguguugggggcucugcacuugaaggcaggacccucagaccucgcugguaaaggucaaaugg

SEQ ID NO: 141951 - RNA, 41 nt, Homo sapiens
ucagagguuaagguaugucaggggauggaaaaggagcagau

SEQ ID NO: 141952 - RNA, 67 nt, Homo sapiens
cacuacucuuucuggcuaaaaggaaucuaaucuuguugaggguagagacccugagacagugugaggg

SEQ ID NO: 141953 - RNA, 31 nt, Homo sapiens
gguggggacugccaagccacccuaagaccuu

SEQ ID NO: 141954 - RNA, 48 nt, Homo sapiens
aggcuccuuccuuggaaguucccugggguaggugaggcagaggcagau

SEQ ID NO: 141955 - RNA, 51 nt, Homo sapiens
caggggugcagcugucagguaggguggggccggugggagaggcccggguca

SEQ ID NO: 141956 - RNA, 56 nt, Homo sapiens
gcccaaacucaggcagcuggggcugaggcccaaaggcagaacagccagagggggca

SEQ ID NO: 141957 - RNA, 51 nt, Homo sapiens
cuugcugcccaggcagcguggaggggaaggguagggcagccagagaaagga

SEQ ID NO: 141958 - RNA, 40 nt, Homo sapiens
uggcccaaggagacuucaaugggugggcugggugggggag

SEQ ID NO: 141959 - RNA, 83 nt, Homo sapiens
ccauugaagucuccuugggccaccaaaggugguggccaugguaccggggacuugggagagugagacccaguggagggagcaag

SEQ ID NO: 141960 - RNA, 45 nt, Homo sapiens
auaauuauuauauaugaauuccauucaaaucguuccuuuuuguua

SEQ ID NO: 141961 - RNA, 44 nt, Homo sapiens
uguucaaccuuuccacaaagaauaaauuguguuucacauuccuu

SEQ ID NO: 141962 - RNA, 46 nt, Homo sapiens
ggggggcuccauggcccgggcucgacccguacucuggaugccaggg

SEQ ID NO: 141963 - RNA, 46 nt, Homo sapiens
gugcagcccagggcgaugaccaggagcaggccgcacacuaggcugc

SEQ ID NO: 141964 - RNA, 45 nt, Homo sapiens
uaggaagggggugccugcugcugcacaaucucagccuccauccgg

SEQ ID NO: 141965 - RNA, 42 nt, Homo sapiens
cugggcaaccugcguucucugcuacagaucuuacgccaggau

SEQ ID NO: 141966 - RNA, 44 nt, Homo sapiens
gggcaccugggccaccuccuggagucauauccuggcguaagauc

SEQ ID NO: 141967 - RNA, 34 nt, Homo sapiens
gucuccgccgcuggggcuugcucccucgaaccaa

SEQ ID NO: 141968 - RNA, 45 nt, Homo sapiens
gcaggcacccccacugcccaucaaggcuccccucccaucugcuag

SEQ ID NO: 141969 - RNA, 46 nt, Homo sapiens
ccaacccggagccccccuggaccccacacagcaguccuggcccugg

SEQ ID NO: 141970 - RNA, 40 nt, Homo sapiens
guugaggucaaaaauaaaggaaucauacaucucaaaauuu

SEQ ID NO: 141971 - RNA, 64 nt, Homo sapiens
ggggugggagcugaagcuuugguggggaggucagaacuagggguugagggagcuugagcucagu

SEQ ID NO: 141972 - RNA, 73 nt, Homo sapiens
agcuuccccaaaccucccccaacuccaccguacagggccagaggccuagucuggggguuugccuguguaucag

SEQ ID NO: 141973 - RNA, 82 nt, Homo sapiens
gcauaucccacucauagcuuccuuuucuuugcccucccauuuuauuuuagaagcagaugccacgcuacuaaagaagucagag

SEQ ID NO: 141974 - RNA, 46 nt, Homo sapiens
cccccugccaacuauaucugagcugcaaucacugcugcugcuguca

SEQ ID NO: 141975 - RNA, 48 nt, Homo sapiens
ugagguuaaugggaguaauaaggagcauaaugggcagcuggagagcug

SEQ ID NO: 141976 - RNA, 44 nt, Homo sapiens
guccagguuuaaauauauuaugcagcagcggggagcagugaccc

SEQ ID NO: 141977 - RNA, 86 nt, Homo sapiens
ccaaacaaagcacuuuguccuucugcaguaacuccaguccugaccuccauggagucugucccuggaaggagacaggcauuugagag

SEQ ID NO: 141978 - RNA, 45 nt, Homo sapiens
ugcucacaugguccccucugcacggagcccucugccaagccagau

SEQ ID NO: 141979 - RNA, 46 nt, Homo sapiens
ggcccuagcccucacucaugggccuggaauuggggaguggagggag

SEQ ID NO: 141980 - RNA, 46 nt, Homo sapiens
uuccuuggcuucagccuugcccagcugccagagggugggagcagga

SEQ ID NO: 141981 - RNA, 57 nt, Homo sapiens
agaaacugcaauaaaauggcaggaagaacauagguauagauaugcuggguuagagga

SEQ ID NO: 141982 - RNA, 63 nt, Homo sapiens
gagguggcuaguaaagaagucuuuuuggcugaaccaucagagccaaaaggaagaaaggaacuc

SEQ ID NO: 141983 - RNA, 54 nt, Homo sapiens
ucuuaccacucaugccccacuccuggaccccaugcuguagaacucuauggcuag

SEQ ID NO: 141984 - RNA, 48 nt, Homo sapiens
agaaauaacuuggccuugaauucugcuuauaaccucucagaauucagg

SEQ ID NO: 141985 - RNA, 38 nt, Homo sapiens
ggagcgcccugggacccaacugcugucccuccccaguc

SEQ ID NO: 141986 - RNA, 41 nt, Homo sapiens
gaugcgggagccagaggccagggaggacuacuucggugagu

SEQ ID NO: 141987 - RNA, 62 nt, Homo sapiens
ccugggcagcccuggagcucuagccggggccggagugggagcggcggggcccuuggagagac

SEQ ID NO: 141988 - RNA, 47 nt, Homo sapiens
cccgcgggguucggcugccaggaaagccgccacucguaucccccggc

SEQ ID NO: 141989 - RNA, 84 nt, Homo sapiens
gggcgggggcuggcggagcuggagguagccggcccugcagcaaucgcaccagcggcaucagcaugggcuacgaccagcgccacg

SEQ ID NO: 141990 - RNA, 55 nt, Homo sapiens
ccggcccucagcccccgcucuagcuucgccaguagcucggccagcgacgcgagca

SEQ ID NO: 141991 - RNA, 65 nt, Homo sapiens
gccccgaggagcuacugggggaccuggggaugagccguuggagccggcccgggagcaagguuccc

SEQ ID NO: 141992 - RNA, 69 nt, Homo sapiens
ugggucugacgggacccccgggccgggcaaggggcgccuaaguggguuggggggaccuaggaagucagg

SEQ ID NO: 141993 - RNA, 41 nt, Homo sapiens
ggggcgagaggccccaggcccgagggcauggagcgguuagg

SEQ ID NO: 141994 - RNA, 42 nt, Homo sapiens
agcggauugcagcuucugggaacggcuguuggcucggcaaug

SEQ ID NO: 141995 - RNA, 45 nt, Homo sapiens
gggugcuuacauugccucccagacggugaagaaggugauagagau

SEQ ID NO: 141996 - RNA, 39 nt, Homo sapiens
gaaguauacugugaaguauaaaaggacggagaaagagau

SEQ ID NO: 141997 - RNA, 44 nt, Homo sapiens
auucaccuccagcccuccaagcugauaaaucucuggucagucaa

SEQ ID NO: 141998 - RNA, 83 nt, Homo sapiens
ggggaccagagagaaggcgggaugaggaggcgagaaggaaggggauagaggagugggaaacaggauagcaggaaggggagagg

SEQ ID NO: 141999 - RNA, 37 nt, Homo sapiens
agggagagaggugcgaggggagaagggaaagaggcag

SEQ ID NO: 142000 - RNA, 44 nt, Homo sapiens
accuggcugucagucagugggagccaauagaugcagggagcugc

SEQ ID NO: 142001 - RNA, 38 nt, Homo sapiens
guuccuugcggcggcggucacgggaccuugaucgggaa

SEQ ID NO: 142002 - RNA, 54 nt, Homo sapiens
guucccgcacugcccguuccugcucccgcugcucugcccgggggugcuguggug

SEQ ID NO: 142003 - RNA, 46 nt, Homo sapiens
uacgcucugucucauccucagagaugcgagagucaucagcaugaag

SEQ ID NO: 142004 - RNA, 47 nt, Homo sapiens
gugcuggcuucuaaguagcuacaucucugcagucagaccacuggagg

SEQ ID NO: 142005 - RNA, 79 nt, Homo sapiens
caagucagcaaugaugaccgcccggagggcaguguugaagaugaggagaagaaagagguaaacauccaagccaccuauu

SEQ ID NO: 142006 - RNA, 45 nt, Homo sapiens
ugaccauggacacaagugaaaacagaccugaaaaugauguuccag

SEQ ID NO: 142007 - RNA, 19 nt, Homo sapiens
agacaagaaagaauggcca

SEQ ID NO: 142008 - RNA, 60 nt, Homo sapiens
ugggagcuaacuugugagauuaagagugggagaguggguuugguguucuugggggaagcu

SEQ ID NO: 142009 - RNA, 57 nt, Homo sapiens
gguguuugggugguagagggggugagauuugagauagaaguuggggacgaagacaga

SEQ ID NO: 142010 - RNA, 43 nt, Homo sapiens
aauggaaggggagguggugguggugcggggaggcuaaaacaga

SEQ ID NO: 142011 - RNA, 65 nt, Homo sapiens
aagagauaagcguuaaguccucacggcaaaccccgaguucggcuggauuggucucucuggagaag

SEQ ID NO: 142012 - RNA, 43 nt, Homo sapiens
ugccgcuccgccaauacaauagagccagccacuaccagcagcc

SEQ ID NO: 142013 - RNA, 55 nt, Homo sapiens
agagaugacagacaacuuuguuuuauagagucuuuaauaaggucacccugcccca

SEQ ID NO: 142014 - RNA, 64 nt, Homo sapiens
cugaucuuccccgccccauauagcagcacucucacuucacugucuuaucuacuuuagagccuca

SEQ ID NO: 142015 - RNA, 47 nt, Homo sapiens
cgaggguuggcaugaguacgugccugggcuacaucucucugcuugga

SEQ ID NO: 142016 - RNA, 42 nt, Homo sapiens
ucucucuaacaccuccuguuccugggaucuuguuuugggucu

SEQ ID NO: 142017 - RNA, 49 nt, Homo sapiens
ugauccucuuccuccucagcagguuggcugcccucagacaguuuagcug

SEQ ID NO: 142018 - RNA, 22 nt, Homo sapiens
ccugcuaauuuucaaauuuaaa

SEQ ID NO: 142019 - RNA, 46 nt, Homo sapiens
ugguuucucaucaucagagucaccuuucucuucagaaauugaggag

SEQ ID NO: 142020 - RNA, 56 nt, Homo sapiens
auccagguuuuaauauggagaaaacggaaugaggggcauacucuauaagccaaagg

SEQ ID NO: 142021 - RNA, 45 nt, Homo sapiens
cucuccaggcugcucugaaagucaggaggcagcagggaagccacu

SEQ ID NO: 142022 - RNA, 46 nt, Homo sapiens
guaucugaaagaugucacuuuacagaaacaguguguaccauuccga

SEQ ID NO: 142023 - RNA, 42 nt, Homo sapiens; identical to SEQ ID NO: 48491

SEQ ID NO: 142024 - RNA, 46 nt, Homo sapiens
aacuccccggguuccuccggauguccucggauguuuccgucuccac

SEQ ID NO: 142025 - RNA, 45 nt, Homo sapiens
ccuagagaugaggcgcuggggcgcuuggguguuuggggcgggucc

SEQ ID NO: 142026 - RNA, 42 nt, Homo sapiens
cauucugcccacagaguuggcacuuacccaguaacaucggga

SEQ ID NO: 142027 - RNA, 42 nt, Homo sapiens
ggacccaaccuaguggcgacauuaggggguuugccuguucaa

SEQ ID NO: 142028 - RNA, 421 nt, Homo sapiens
acuaaggcuguggacaggaugggcaugguaacaagccaacaagccucauacucuauucuuuuuuuuuauuuuuugagacggagucucacucugucacccaggcuggagugcaguggugcaaucucagcucacugcaaccucugucuccccguuaaagugauucuccugccucagccucaugaguagcugggacuacaggcaugaaucaccaugcccggcuaauuuuuguauuuuuaguagagacaggguuucaguauguuggccaggcuagucuugaacuccugaccucaaaugauccaccuaacucagccucccaaagugcugggauuacaggaaugaacuaccgccccugcccccacacucuauucugaaugcauguaugggcacaugugcaugccuguccccuuucacucagugauaa

SEQ ID NO: 142029 - RNA, 34 nt, Homo sapiens
ccgccaauccuggucucuccuacuccuccccgcc

SEQ ID NO: 142030 - RNA, 33 nt, Homo sapiens
gcugggagggagggagagagggaggaagggagg

SEQ ID NO: 142031 - RNA, 48 nt, Homo sapiens
cugugggagagaagggaagcaggagagaaagaaggagaaagggauauc

SEQ ID NO: 142032 - RNA, 60 nt, Homo sapiens
ggagagcaggaacagaacagagaaaugcccuuggaagaaguggaguugguggaugggugg

SEQ ID NO: 142033 - RNA, 36 nt, Homo sapiens
ugcacgcaugcuggugugcaugcugggcugccuggc

SEQ ID NO: 142034 - RNA, 48 nt, Homo sapiens
ucuagaauacagucugggucccacacugugucucagugagacuguuga

SEQ ID NO: 142035 - RNA, 45 nt, Homo sapiens
gugcccuagaauaaguggggagugggauuaauaaucgcaggaccg

SEQ ID NO: 142036 - RNA, 42 nt, Homo sapiens
gcacacaaacacuauuuuacuuuuuuaaaaucauaaaacggc

SEQ ID NO: 142037 - RNA, 45 nt, Homo sapiens
guguaauauguaaugaucguauuaaaaacaauaaauaaagcccag

SEQ ID NO: 142038 - RNA, 26 nt, Homo sapiens
gaucaaggaaauguccugaccccagg

SEQ ID NO: 142039 - RNA, 97 nt, Homo sapiens
cuugcuuuaaaauuacuaauaauuucaagaccguuaacacuagaacauuaaaccaaacauucaggacccuucuaagcgcagaggccaucaaagcuag

SEQ ID NO: 142040 - RNA, 56 nt, Homo sapiens
aaaauugucaacccaaagggugaagaaaagccaucuauguacugaacccgggacua

SEQ ID NO: 142041 - RNA, 51 nt, Homo sapiens
gggguagcaauccagguaagaaaaggguaacugaagauacuuagagugggg

SEQ ID NO: 142042 - RNA, 48 nt, Homo sapiens
cuugacuucccuccgggccccacuggacauccccaucccagacccucc

SEQ ID NO: 142043 - RNA, 16 nt, Homo sapiens
cuucugacugcaguga

SEQ ID NO: 142044 - RNA, 42 nt, Homo sapiens
ugcccuggcccgagucgugccauccuacaugcaggcagugaa

SEQ ID NO: 142045 - RNA, 43 nt, Homo sapiens
uugcugugcacugcacaaggccugucaaagcugccccucggaa

SEQ ID NO: 142046 - RNA, 43 nt, Homo sapiens
agcucauggaugaggauguggaagaagaggaugacucagagau

SEQ ID NO: 142047 - RNA, 42 nt, Homo sapiens
gggucugaugggugagggccuggcgccccacuuggaacagau

SEQ ID NO: 142048 - RNA, 42 nt, Homo sapiens
ucauggagcaccugcgggaauuccuguuaacaggccgugagg

SEQ ID NO: 142049 - RNA, 51 nt, Homo sapiens
guggagaaccuagguagugauggcaguggggagcuuggggaagggggauga

SEQ ID NO: 142050 - RNA, 46 nt, Homo sapiens
ccagcugguaaguguggcucuguccuucuggugucccuaccuccaa

SEQ ID NO: 142051 - RNA, 39 nt, Homo sapiens
gacugaaauucaggcuaaguuagacugaacuuaccagau

SEQ ID NO: 142052 - RNA, 45 nt, Homo sapiens
auggcagaacuauugcuguucucucccuuucuucaugcccuguug

SEQ ID NO: 142053 - RNA, 46 nt, Homo sapiens
ccugcugcaucucuggcuacguguccagccacuucuaccggcagau

SEQ ID NO: 142054 - RNA, 45 nt, Homo sapiens
ggacucuggacccauuuggacuuccaccuagaauuccauggagac

SEQ ID NO: 142055 - RNA, 31 nt, Homo sapiens
ucugcgccuggggagaucuugugugaccaac

SEQ ID NO: 142056 - RNA, 46 nt, Homo sapiens
uggcugagucuuuguaugagauccgcuuucgggaaaacguggagaa

SEQ ID NO: 142057 - RNA, 46 nt, Homo sapiens
ugggauagagagacgugggguagggugaggcggggagggggccaau

SEQ ID NO: 142058 - RNA, 50 nt, Homo sapiens
agaagauggagccugaaccaaagagguggaggcaagcaucuggaagauau

SEQ ID NO: 142059 - RNA, 38 nt, Homo sapiens
caggggacaucugagacuccaagugugggccagggcca

SEQ ID NO: 142060 - RNA, 55 nt, Homo sapiens
gcucuugggacacaugaaaugagucuuauuuagcugggcacaguaaaaucaaaug

SEQ ID NO: 142061 - RNA, 47 nt, Homo sapiens
auggugugaguugcuuuugaggguggccaugugagcaccuuggccag

SEQ ID NO: 142062 - RNA, 45 nt, Homo sapiens
aggggcaggagcugacuucgugaugcuggguggcaugcuggcugg

SEQ ID NO: 142063 - RNA, 75 nt, Homo sapiens
cuccugagggcuccugcaguaacucuguacuucucuaucugcacacacaaaaugcccaaggcacucacuggggag

SEQ ID NO: 142064 - RNA, 88 nt, Homo sapiens
aaauauuuguaauccuuaauaauuaaacuuuggauuuguuaaaauacugccuugaugugaaggaggggaauuaagguuuccauaaggu

SEQ ID NO: 142065 - RNA, 42 nt, Homo sapiens
uguuccaugggcucagccagguucacugagucaguaacagag

SEQ ID NO: 142066 - RNA, 42 nt, Homo sapiens
aacuugaacaagaguauggggaacccuuucuggcugccaugg

SEQ ID NO: 142067 - RNA, 43 nt, Homo sapiens
cccauucagacaauuccaggcuuaccugaaauuuccacaccca

SEQ ID NO: 142068 - RNA, 41 nt, Homo sapiens
aacguugaggaucuugggccucuguaacccagagccuucga

SEQ ID NO: 142069 - RNA, 46 nt, Homo sapiens
cuccacauaaacaaucuugaagcugccaucauccugccgcugccag

SEQ ID NO: 142070 - RNA, 53 nt, Homo sapiens
gacagaagguagcuggcagggcaggccugguggccuggggcugggguaucacg

SEQ ID NO: 142071 - RNA, 46 nt, Homo sapiens
caggugcuccaggggcuucauguucucgucgaaguagauguccaug

SEQ ID NO: 142072 - RNA, 46 nt, Homo sapiens
auaagcaggcauccagcaccccguggucaaacuggaaggagggaug

SEQ ID NO: 142073 - RNA, 45 nt, Homo sapiens
aucucauugcgggggucaaagggcaacuggaacuccccagcgucu

SEQ ID NO: 142074 - RNA, 55 nt, Homo sapiens
uaggcaggugauugggaaaguuaaugggauugaggggcugagggccuggcagggg

SEQ ID NO: 142075 - RNA, 43 nt, Homo sapiens
gcuuuaaccauuaaaacugaagucugaaauuuggucaaccuug

SEQ ID NO: 142076 - RNA, 42 nt, Homo sapiens
gccccugacuuccuucuagggcagucuggccugcccacaaac

SEQ ID NO: 142077 - RNA, 92 nt, Homo sapiens
ggaggagggugagaagagaaggcauucaggguaaaagggaauuaucugcuucaucauggaaagaggcagggaguguaaugugggggcacgag

SEQ ID NO: 142078 - RNA, 45 nt, Homo sapiens
uccgggcgcaacauaggaaguggggcuacgauguggcggucaaga

SEQ ID NO: 142079 - RNA, 39 nt, Homo sapiens
ggagauggagugacuucuggggcuugguccuuucgcaga

SEQ ID NO: 142080 - RNA, 34 nt, Homo sapiens
uuuauuaccucacaguuucugugggucagaaguc

SEQ ID NO: 142081 - RNA, 42 nt, Homo sapiens
agagacucccucuggcuccuaucccaccucuuugcaugggac

SEQ ID NO: 142082 - RNA, 57 nt, Homo sapiens
uucaagcacaagaauccagccccugacaacuuucuucugcccucucuugccccagaa

SEQ ID NO: 142083 - RNA, 41 nt, Homo sapiens
gggaacagcagccccauguggagcgcaucuucagcgugggg

SEQ ID NO: 142084 - RNA, 54 nt, Homo sapiens
ccucccaaccaggaguaccugaagggccucugcagcccagaacugcaggaugaa

SEQ ID NO: 142085 - RNA, 42 nt, Homo sapiens
gaugaucaguggccugacugaagccuuugucauggcucagag

SEQ ID NO: 142086 - RNA, 42 nt, Homo sapiens
ggcugagcugggacuucacgccaggaccaucuuccggagccu

SEQ ID NO: 142087 - RNA, 45 nt, Homo sapiens
cucccccuagugacggcagggagucccuggacacuggaucuaugg

SEQ ID NO: 142088 - RNA, 45 nt, Homo sapiens
agaggcgugggagagagaaguggcccucaggccacagucaguggg

SEQ ID NO: 142089 - RNA, 48 nt, Homo sapiens
aacccccauggcacuguggagaccggggugacugcggagaccggggag

SEQ ID NO: 142090 - RNA, 21 nt, Homo sapiens
uuauucuauuuauaucuagau

SEQ ID NO: 142091 - RNA, 66 nt, Homo sapiens
auaaagggcaaguguggaagaguuuuguguaggugauaagcaugcuuucuuggggcagggcagggg

SEQ ID NO: 142092 - RNA, 64 nt, Homo sapiens
cugcuuuauguguguguguauggggaugggaggacuuaacggaaguugaaccaguugguucuag

SEQ ID NO: 142093 - RNA, 59 nt, Homo sapiens
gaugagaggcaaguccuaagcuucuuauagacagggauguugacuuuguucugcugcag

SEQ ID NO: 142094 - RNA, 97 nt, Homo sapiens
cccaaacuugugacaaguucuuuuggcaacugaaggaccaagaagggaaacggugaugagagagacugcucauuguaacuuucaaaaccccgucuuu

SEQ ID NO: 142095 - RNA, 54 nt, Homo sapiens
aucaucuagggugacauuccuugaaguaaaucccaggagaaucuaggccaaaga

SEQ ID NO: 142096 - RNA, 62 nt, Homo sapiens
cguaaaggagaaguggggcagcugcaggacauguagagaaaccaaacugggaaaucuuacaa

SEQ ID NO: 142097 - RNA, 37 nt, Homo sapiens
caaccugaugagauuacggccuugagacaauaaggug

SEQ ID NO: 142098 - RNA, 39 nt, Homo sapiens
ugcaccacagcgcuggggagagggaugaaggcucggcgg

SEQ ID NO: 142099 - RNA, 46 nt, Homo sapiens
ugccuccacgagccugcaccaaagucucaagcuuuguacacuggau

SEQ ID NO: 142100 - RNA, 49 nt, Homo sapiens
ucaccuugggggcccacaauaucaaagaacaggagccgacccagcaguu

SEQ ID NO: 142101 - RNA, 26 nt, Homo sapiens
gacaauggaggaggaagugagggcaa

SEQ ID NO: 142102 - RNA, 43 nt, Homo sapiens
uagcaaugaaagggugaaagaaagaccaagugagucuuugcgg

SEQ ID NO: 142103 - RNA, 42 nt, Homo sapiens
ccugcaaccccgacugcccaccccuuggggauucuugccucu

SEQ ID NO: 142104 - RNA, 40 nt, Homo sapiens
aaggccugccuggcacugaugucacacaaaauccauaaca

SEQ ID NO: 142105 - RNA, 49 nt, Homo sapiens
agaaggacugccagugugaacgucucuuccauggcaauuacagcagagc

SEQ ID NO: 142106 - RNA, 50 nt, Homo sapiens
aaugucaccuugggggcccacaauaucaaggaacaggagcggacccagca

SEQ ID NO: 142107 - RNA, 56 nt, Homo sapiens
aggaaggcugcccaggucagagcuguugguguugacuccuuccagaaacaaaugcu

SEQ ID NO: 142108 - RNA, 24 nt, Homo sapiens
agaaaggaaaauuugaagauaugg

SEQ ID NO: 142109 - RNA, 47 nt, Homo sapiens
guuuaauggucacaaaaauguuagcacugcuaccacucagcacgugu

SEQ ID NO: 142110 - RNA, 39 nt, Homo sapiens
aacuuacacuaagacuuuucaguuuuauuuaaagaccca

SEQ ID NO: 142111 - RNA, 56 nt, Homo sapiens
ccgcgagaggagcggaggccuuuggcgacagugaggaggacggagaggauguguuc

SEQ ID NO: 142112 - RNA, 37 nt, Homo sapiens
gaggaguuaaguaauuaagagcugaugucauuaauau

SEQ ID NO: 142113 - RNA, 49 nt, Homo sapiens
aaaagaagauacuuccccaaagaagaaaaagaaaaaauugaggcagaga

SEQ ID NO: 142114 - RNA, 109 nt, Homo sapiens
ugaaaaagaaaaaagcaaaggccgggaagcuaaaagacaaguccaaaccagaccuggagagcuccuuggaaaguuuaguuuuugauuuaaggacaaagaaaagaauuuc

SEQ ID NO: 142115 - RNA, 48 nt, Homo sapiens
aaaagggugaaauaagagauuuaaagacgaaaacaagagaagauccca

SEQ ID NO: 142116 - RNA, 48 nt, Homo sapiens
ggcuacauuccgacagcagagaagagaaacaaaacacuaaaagugcaa

SEQ ID NO: 142117 - RNA, 48 nt, Homo sapiens
agacagugccaugagugcugaggaggauaccgaugucagaggcaggag

SEQ ID NO: 142118 - RNA, 42 nt, Homo sapiens
gaugccuguaucugcccaaacgccaaagggccggagguugag

SEQ ID NO: 142119 - RNA, 64 nt, Homo sapiens
aauuauuauaugguugacugaggaagcaaaauucuuuugugugaagaggauuuaaugaucaguu

SEQ ID NO: 142120 - RNA, 46 nt, Homo sapiens
aaaaauaucagaaaaggcaugauucugacaaggaagaaaaaggcag

SEQ ID NO: 142121 - RNA, 35 nt, Homo sapiens
cuuugaugguugucccauuuacaacaaugguccau

SEQ ID NO: 142122 - RNA, 80 nt, Homo sapiens
gauagaaccugcuggguauuuuuccugaugacuaaaaauuucaaaauaucugaaaacugucuuuuaaauaauuugggaaa

SEQ ID NO: 142123 - RNA, 45 nt, Homo sapiens
uuuggaagcaggagcuuuuguaaauguccagcaaagcaaugguga

SEQ ID NO: 142124 - RNA, 42 nt, Homo sapiens
ggugcuucugucaaccuuaugaagaguuuauugggaccugca

SEQ ID NO: 142125 - RNA, 51 nt, Homo sapiens
ccggccuaaagacauacauuuggcaacuccauaccaaggccuagaucauga

SEQ ID NO: 142126 - RNA, 51 nt, Homo sapiens
aucaugaucuaggccuugguauggaguugccaaauguaugucuuuaggccg

SEQ ID NO: 142127 - RNA, 70 nt, Homo sapiens
aaaucuuggccauuuguggguuuuuucuuguaagaaaggggaaaucuggaucuguacugacaccugcguu

SEQ ID NO: 142128 - RNA, 30 nt, Homo sapiens
aauucuuccugauucugauucuguggacug

SEQ ID NO: 142129 - RNA, 26 nt, Homo sapiens
uaaauucuuaauaaauuauuagcaga

SEQ ID NO: 142130 - RNA, 69 nt, Homo sapiens
aaggucuuacuaggguaagagucuuuuucugauggagcacgacacacacauugguauucccugccuugg

SEQ ID NO: 142131 - RNA, 50 nt, Homo sapiens
auuacuugguguuugcuguccugcagggaaggaguuggagcacgaaguuc

SEQ ID NO: 142132 - RNA, 56 nt, Homo sapiens
gaauguaaaauuucucaacuuuuaaauguggcauaugccgaagugauaauauuuug

SEQ ID NO: 142133 - RNA, 52 nt, Homo sapiens
uuguaauugacuuaaauucaguuauugauagaauauuaagcauacuuggaac

SEQ ID NO: 142134 - RNA, 68 nt, Homo sapiens
ccugaagcugaaccauccuaguaguaguggcauuuggcuguugaguccuuggaaugggacuagugaga

SEQ ID NO: 142135 - RNA, 43 nt, Homo sapiens
guggcuuauuaaccuauuuuccaacugaggaauucucaggcag

SEQ ID NO: 142136 - RNA, 52 nt, Homo sapiens
uaggggaacaauaucuguuuuagcuggaauugccauuuaauaaaaauaggaa

SEQ ID NO: 142137 - RNA, 50 nt, Homo sapiens
guuguaaauauuucccuaaaauuuggacauuucuccaguaaaacgugucu

SEQ ID NO: 142138 - RNA, 44 nt, Homo sapiens
uagaggaagucaagggggcaacuuugaaggcccuaauaagcguc

SEQ ID NO: 142139 - RNA, 43 nt, Homo sapiens
cucagaccugucaucaguuguaaauccaccgugaucagagacg

SEQ ID NO: 142140 - RNA, 45 nt, Homo sapiens
ggaccagaaggagccgcaaauaugggaacuccaaugaugccagau

SEQ ID NO: 142141 - RNA, 44 nt, Homo sapiens
aacuuuaaaauaguauaaaacuuaaaaccauuucugauggugca

SEQ ID NO: 142142 - RNA, 47 nt, Homo sapiens
cuggggugcuauuuaauauaauccauguaauuuuaaggauuuuagga

SEQ ID NO: 142143 - RNA, 79 nt, Homo sapiens
guguugugcacagaagugcacucaguguuuguagucuauaacucaucaagggaauuaugugugucgccaaugcauguuu

SEQ ID NO: 142144 - RNA, 80 nt, Homo sapiens
uugaagcaaaaggcuuuuguaauuuaucauuuuuggggggacuguuuaugcuguuugugguaucuacauaucaguaagaa

SEQ ID NO: 142145 - RNA, 43 nt, Homo sapiens; identical to SEQ ID NO: 48670

SEQ ID NO: 142146 - RNA, 41 nt, Homo sapiens
uaucauuacuagauuuuccuuugcuuggaaucuaggcaugu

SEQ ID NO: 142147 - RNA, 47 nt, Homo sapiens
ggcacacaguugugaauuuccucaagugauucuuauuaauauuugau

SEQ ID NO: 142148 - RNA, 25 nt, Homo sapiens
uuuuaauguucccuuuaguguagug

SEQ ID NO: 142149 - RNA, 49 nt, Homo sapiens
acuucuauuugucguugccuccauuucugauuuaguauuuaacaaguaa

SEQ ID NO: 142150 - RNA, 42 nt, Homo sapiens
gcuagucaguaucuaagaucuucuauacuucauauugaggau

SEQ ID NO: 142151 - RNA, 49 nt, Homo sapiens
uuauuaguuugaauuaguaacagaagauccucagaaggcauaaaaauuu

SEQ ID NO: 142152 - RNA, 44 nt, Homo sapiens
cugaguacuuauacagaguaauguuaaaagaaacagcucaaacg

SEQ ID NO: 142153 - RNA, 64 nt, Homo sapiens
cuguauggaucacuagaccuuggcauuuauugaauauuaaugccucagauauuacacauuuggc

SEQ ID NO: 142154 - RNA, 60 nt, Homo sapiens
cgaggucacgaauuuuauguuugucauauuauaguuacuuagauguaaacugagagaauu

SEQ ID NO: 142155 - RNA, 84 nt, Homo sapiens
augagacauacugaaaugaaaauaguugaauuuuucauggauccugggaguguuaguggaaggcaugcuugaugugguucaaca

SEQ ID NO: 142156 - RNA, 44 nt, Homo sapiens
uugauuuacauauuucacauuuuaaauaauaauuucauguaaca

SEQ ID NO: 142157 - RNA, 45 nt, Homo sapiens
gcgugaggaagaaaugauccgacacagagaacaggaggaacugag

SEQ ID NO: 142158 - RNA, 47 nt, Homo sapiens
agaacucagacgcuuggaagaacucagaaaccaagaguugcaaaaac

SEQ ID NO: 142159 - RNA, 64 nt, Homo sapiens
cagcagcgugagcagguugauagaaacaucagagaagccaaagagaaacuggaggcagaaaugg

SEQ ID NO: 142160 - RNA, 71 nt, Homo sapiens
guuuugcucaaccugggacauuugaauuugaguaugcaucucgauggaaggcucuugaugaaauggaaaag

SEQ ID NO: 142161 - RNA, 97 nt, Homo sapiens
uugagguggugguacagcauuuaacagccacauuugaugucgucaauugaguuuaaagucuaucaagagaaagagguaauaaauaauuaacuacaau

SEQ ID NO: 142162 - RNA, 46 nt, Homo sapiens
accccucguccagucauuguggaacccauggagcaguuugaugaug

SEQ ID NO: 142163 - RNA, 64 nt, Homo sapiens
caaugagcugcuagagcaagcauuuucucaguuugguccaguagagaaagcuguugugguugug

SEQ ID NO: 142164 - RNA, 47 nt, Homo sapiens
cagaacccuggcugaaauugcaaaagcagagcuggacggcaccauuc

SEQ ID NO: 142165 - RNA, 42 nt, Homo sapiens
caucaaccgggaccguggcuucggcuucauccgcuuggugag

SEQ ID NO: 142166 - RNA, 45 nt, Homo sapiens
uuuauaguacaucuuguuugucucccugugaaaacaacuggaauc

SEQ ID NO: 142167 - RNA, 46 nt, Homo sapiens
aaucacuugugcaaauugcaaaaagccuuuacagaagggacagaca

SEQ ID NO: 142168 - RNA, 45 nt, Homo sapiens
gacaauuguuauugaugaugaagaggacauagaaacaaauggagg

SEQ ID NO: 142169 - RNA, 46 nt, Homo sapiens
agcuuguccuuuagucaguagaucuaggaacucaccaguggaagau

SEQ ID NO: 142170 - RNA, 25 nt, Homo sapiens
ggcaggcgggaguggaacugcaggg

SEQ ID NO: 142171 - RNA, 41 nt, Homo sapiens
aguccuggccccacgggguuugguuuugaggggucccaagu

SEQ ID NO: 142172 - RNA, 47 nt, Homo sapiens
agagcuguaggccucacaguggugacgcggggucauccgggggcccg

SEQ ID NO: 142173 - RNA, 44 nt, Homo sapiens
aucucugguuuuccaaaggcccuggaaacuucaugauauccuuu

SEQ ID NO: 142174 - RNA, 57 nt, Homo sapiens
gucagauuaauagacugcugugacaacacuuuuuaggagguggacaccauaauuauu

SEQ ID NO: 142175 - RNA, 49 nt, Homo sapiens
gaaagaagguagauuguugaugggaagaagggguggaaaacucaauaaa

SEQ ID NO: 142176 - RNA, 46 nt, Homo sapiens
aacugacuugaauuaagccaguguucuugacacccacugggccaag

SEQ ID NO: 142177 - RNA, 64 nt, Homo sapiens
uccauguuugccugauuggaugcuuauucacuuuguguuuucuuuuguuuuauuuuguccaauu

SEQ ID NO: 142178 - RNA, 169 nt, Homo sapiens
aauaacuuuuauccagauggcaacauauuugcaaaauuugcccagauccuauuacaauacuaaaaauagaaaauuucaccuccauauuccugagguguaauuucauuagacuaguuuuaguuuaaaaagaccuucuucagauuggaccaaauaauacuuauaagaucag

SEQ ID NO: 142179 - RNA, 51 nt, Homo sapiens
caaagggcacugaaacacacaauugacuggacagguccacgcgccaugaca

SEQ ID NO: 142180 - RNA, 48 nt, Homo sapiens
ccuguccagucaauuguguguuucagugcccuuugguaaagagacugu

SEQ ID NO: 142181 - RNA, 120 nt, Homo sapiens
uuuauuuuuagguguuuuuuuuuuccccuuaaaaaacuugaagugauaugcagcaguaaucuauuuguuuugcauuguucuugguguuuuguguuucccagaucccucaagcuuucucag

SEQ ID NO: 142182 - RNA, 47 nt, Homo sapiens
ucacauguaaugacacauaugcuauaugcaaucagguagaaaaaccg

SEQ ID NO: 142183 - RNA, 67 nt, Homo sapiens
uugguuuaggguguuagcugcuaugaaccuguugccccuuucgaucguguauuuauguagguuuauc

SEQ ID NO: 142184 - RNA, 53 nt, Homo sapiens
cuuaagagguuuugugcuuucuagcuuuuccucccuuugaugauuggguuuua

SEQ ID NO: 142185 - RNA, 46 nt, Homo sapiens
augccuucaacaagcucacugcaagcagcacuccuccuacgcugga

SEQ ID NO: 142186 - RNA, 46 nt, Homo sapiens
uucugaacuggucgaaacauuacuaucaagucagcaagacccaguu

SEQ ID NO: 142187 - RNA, 50 nt, Homo sapiens
uucagcugguuuuugauaugcugguuuugcaaaagcacaacacagagaug

SEQ ID NO: 142188 - RNA, 45 nt, Homo sapiens
caucucuguguugugcuuuugcaaaaccagcauaucaaaaaccag

SEQ ID NO: 142189 - RNA, 40 nt, Homo sapiens
gggaaggagaggcgaaaaacacgcccuugauggaugagag

SEQ ID NO: 142190 - RNA, 43 nt, Homo sapiens
ggccucaccuuacuuccuguaccaggagagaugcucaucaaua

SEQ ID NO: 142191 - RNA, 42 nt, Homo sapiens
guggcaccaugcccagcauuuuuggggucaaaaacaaagggg

SEQ ID NO: 142192 - RNA, 42 nt, Homo sapiens
uucagcggcaugcgcuggcacaggaaagacaagcgggccaag

SEQ ID NO: 142193 - RNA, 53 nt, Homo sapiens
uaugguuauuaucauaaucuaucauucauucauccaguaacuauuuauugaga

SEQ ID NO: 142194 - RNA, 132 nt, Homo sapiens
auggacacaggugugugggaaaguauguauacaggugugugcaguaaagauauggauacagguauugggggaagguguggaaguggaugugugggaugggcaugggugcaguagugugugguugucagggca

SEQ ID NO: 142195 - RNA, 45 nt, Homo sapiens
gaagccaaacucagcccagccaagcuugugcgccucuuuuccacc

SEQ ID NO: 142196 - RNA, 47 nt, Homo sapiens
caaguaagcacucaaucaacuuuagcuagugcuaguauuaguauuag

SEQ ID NO: 142197 - RNA, 43 nt, Homo sapiens
cagagcuucugccuucaaaauuuccucccuucauggguccaaa

SEQ ID NO: 142198 - RNA, 46 nt, Homo sapiens
uuaaugccaccaacaaauaucuuuuucacaguuaagugggcaucug

SEQ ID NO: 142199 - RNA, 46 nt, Homo sapiens
uccacaacucuuccauccaccuuguguggccuugcauucauagcug

SEQ ID NO: 142200 - RNA, 46 nt, Homo sapiens
auggcuccucaggcucucaucaguuguuucaaagcucaacccucca

SEQ ID NO: 142201 - RNA, 40 nt, Homo sapiens
gaccaguuuucguuguauuguuguucaauuaaauggugau

SEQ ID NO: 142202 - RNA, 46 nt, Homo sapiens
uggguucugaucccaggacugcuacuguggcagucauggcuagaac

SEQ ID NO: 142203 - RNA, 40 nt, Homo sapiens
aggagaaacguuucaauaugacauuguuuuccaguuaguu

SEQ ID NO: 142204 - RNA, 59 nt, Homo sapiens
uuauaugaaauguccagaauaggugagucuguagagauacuguagauuacugguugcgu

SEQ ID NO: 142205 - RNA, 57 nt, Homo sapiens
acuguuugauccugguaguucugaaagagaccaguguggucuccugugaauguuagg

SEQ ID NO: 142206 - RNA, 63 nt, Homo sapiens
agcuuggccaugcacacaaaucauccagggaucauccaagauucuguauugguaaccagcucc

SEQ ID NO: 142207 - RNA, 28 nt, Homo sapiens
uucuucccgggcggccccacccgggacc

SEQ ID NO: 142208 - RNA, 46 nt, Homo sapiens
guccacuucccggagccgcugcccagccucugcgggggggcuuugg

SEQ ID NO: 142209 - RNA, 73 nt, Homo sapiens
aagugugucuuauuguuuuuuacuaaguccuauaaaacuaugguuuuauuuaagguuaggaacugcauagaga

SEQ ID NO: 142210 - RNA, 43 nt, Homo sapiens
guagcaagcucauuuuuuuuccccagaaaaugucagguagcua

SEQ ID NO: 142211 - RNA, 46 nt, Homo sapiens
cuuugagaccaugaaacuugcuguuaugcaagcauaugacccagag

SEQ ID NO: 142212 - RNA, 42 nt, Homo sapiens
gcuaauccuucugcuuggccuugucauugucuuugguccuac

SEQ ID NO: 142213 - RNA, 42 nt, Homo sapiens
agaaugaguagucaggaacuggucacuuugaaugugggaggg

SEQ ID NO: 142214 - RNA, 27 nt, Homo sapiens
uuuauguuguguuuuagaaacagcacg

SEQ ID NO: 142215 - RNA, 35 nt, Homo sapiens
gaaauuaucuuuucaguagaauucuagccucaauu

SEQ ID NO: 142216 - RNA, 49 nt, Homo sapiens
uaagaaaccaaaucccuuugauguuucuuuauuuucaaugauaccagau

SEQ ID NO: 142217 - RNA, 49 nt, Homo sapiens
uuuugauuacuucauccuugaaauuucuacuauaauuaaguacuucguu

SEQ ID NO: 142218 - RNA, 34 nt, Homo sapiens
ggcccacagcccagaauauaaaccaccagacuug

SEQ ID NO: 142219 - RNA, 61 nt, Homo sapiens
aguuugauauucuuuucucagcuugcuguuuaagaagcagcagcagcaacagcaacagcag

SEQ ID NO: 142220 - RNA, 55 nt, Homo sapiens
cagguaucuuuagaacagccuuaaugaguuaaauaggaaaagagagacagcauuu

SEQ ID NO: 142221 - RNA, 57 nt, Homo sapiens
agguuagagaacauuaagaugaaaaguggaaaauacaguuaccugaguaucugggaa

SEQ ID NO: 142222 - RNA, 34 nt, Homo sapiens
uaaagaugaauucugagguguguuuaagagugaa

SEQ ID NO: 142223 - RNA, 45 nt, Homo sapiens
ugauugaauacuuacauaaugcauuggaacaugacaugagauuaa

SEQ ID NO: 142224 - RNA, 71 nt, Homo sapiens
acagcuacccgcauacacacucacccauacuacuuugaacaugaaugcccuaaagagaaaugaaagcagaa

SEQ ID NO: 142225 - RNA, 53 nt, Homo sapiens
uuuaaaggaucuuccuuuuagaaagacaaguuuuaaauauugaaauugauauu

SEQ ID NO: 142226 - RNA, 39 nt, Homo sapiens
uuaguuuuuuuccuuugauaggaauuuuucaccuuaaac

SEQ ID NO: 142227 - RNA, 48 nt, Homo sapiens
auauacuuuuagccagagaaccacggaaauagcuacgaaacguuagga

SEQ ID NO: 142228 - RNA, 42 nt, Homo sapiens
gugcaaugugauguuuuucaaauugugucuaacggagcuccc

SEQ ID NO: 142229 - RNA, 56 nt, Homo sapiens
cgcguuaaggauguauuagaucuugaguucuuuuccgcgcuggaggcaccacuaga

SEQ ID NO: 142230 - RNA, 38 nt, Homo sapiens
ugcgagugggcggcggcgggcggaauguggcgggagcg

SEQ ID NO: 142231 - RNA, 49 nt, Homo sapiens
agccugaagaaguagcagagcgggacucgggagguggcaguggugggac

SEQ ID NO: 142232 - RNA, 44 nt, Homo sapiens
aaauuacuuuaaaaaucgccaaaaauuacuuggagcaaagggca

SEQ ID NO: 142233 - RNA, 46 nt, Homo sapiens; identical to SEQ ID NO: 48850

SEQ ID NO: 142234 - RNA, 46 nt, Homo sapiens
auaucuuuacugcucagagcacuuuuuuuuuuuuuuuuuuggagaa

SEQ ID NO: 142235 - RNA, 43 nt, Homo sapiens
ggagcggggagggcgaaaguuggggagagggggcgggggagag

SEQ ID NO: 142236 - RNA, 43 nt, Homo sapiens
cacgugacgggguuggcagcguucgggccccggcugggagggg

SEQ ID NO: 142237 - RNA, 47 nt, Homo sapiens
uagauauucacgguuuauuuucagaauauuuaaaagaugcuucaaag

SEQ ID NO: 142238 - RNA, 45 nt, Homo sapiens
ccugucucaguuuggccuggaaauccaccacaagcacuugcugcu

SEQ ID NO: 142239 - RNA, 46 nt, Homo sapiens
auuuauacaaaaguugcuaauguguuucauaaagauuuagcaugag

SEQ ID NO: 142240 - RNA, 46 nt, Homo sapiens
cauggguagguagucuuaagauccuucaacuuucaaaaaccacagu

SEQ ID NO: 142241 - RNA, 55 nt, Homo sapiens
gcuagggugugucaaaugaaacugaaacauugccaugaaaccuauuagguuagaa

SEQ ID NO: 142242 - RNA, 42 nt, Homo sapiens
auauuugcugugugcacuuuaugccuuuggagcacaguggga

SEQ ID NO: 142243 - RNA, 63 nt, Homo sapiens
uaguaggugcagaaaagaggcuguugacuaauugccuuauugacaauuaauagaguauuuuau

SEQ ID NO: 142244 - RNA, 49 nt, Homo sapiens
uguggacacaaugcccaaacuugacuauugcuuugcuaucucuuugcgu

SEQ ID NO: 142245 - RNA, 56 nt, Homo sapiens
auuaugccugugucaguaaggaaaguuucuguuugagucauuugaccaagucaaca

SEQ ID NO: 142246 - RNA, 68 nt, Homo sapiens
ucagcugggccuugagauaauauugaaugaguccuuaaggcagcaaaaaaaauauuugaugccaagaa

SEQ ID NO: 142247 - RNA, 64 nt, Homo sapiens
uuaguggcuuuuaaaauguuauugccagaacuugcuucuaguuuaucuuuuucaucuugucacu

SEQ ID NO: 142248 - RNA, 45 nt, Homo sapiens
ccauugagggacauacgcccuauuuucccaaaaguuguucucaag

SEQ ID NO: 142249 - RNA, 52 nt, Homo sapiens
ugaaagauuuagaaccagaagaaacuuaggaaaucauucaguccaauccuuu

SEQ ID NO: 142250 - RNA, 37 nt, Homo sapiens
uuaacugagaaucucuuuuccuuccuaggcuaaguaa

SEQ ID NO: 142251 - RNA, 57 nt, Homo sapiens
gaagggaaauacaucuaggggaaacaucaugucuuuuaggcccuuuaugucacugaa

SEQ ID NO: 142252 - RNA, 46 nt, Homo sapiens; identical to SEQ ID NO: 48880

SEQ ID NO: 142253 - RNA, 51 nt, Homo sapiens
augcucgccgguuuccggcguuccgcuccggccagccagagucucugucuc

SEQ ID NO: 142254 - RNA, 46 nt, Homo sapiens
cuaagucaccagcaccagagccaacaagaaacaguucuuggccagg

SEQ ID NO: 142255 - RNA, 56 nt, Homo sapiens
gucuugacuguguuaucugucuuuaccaggccaguaacuucuuuggucuggucauc

SEQ ID NO: 142256 - RNA, 54 nt, Homo sapiens
ugcauggagaaggaugggcccaauguggccaagaugguaacgggaccaguagag

SEQ ID NO: 142257 - RNA, 43 nt, Homo sapiens
aaugugcacacacacagucacacagcuuccuggcuugcgcaag

SEQ ID NO: 142258 - RNA, 58 nt, Homo sapiens
uucgaggguuggaagcguaucaucaaaccacaucagagugcugggggccaccugccac

SEQ ID NO: 142259 - RNA, 45 nt, Homo sapiens
uguuggccaaugcccggagcaggcccucuuuccauccccugucgg

SEQ ID NO: 142260 - RNA, 106 nt, Homo sapiens
cugacaaucagagacccucuccagcccucaacauggcucacuccucauucuugguucucaguccgagggucagggcugggcagagacaaagggaaucaggggcggg

SEQ ID NO: 142261 - RNA, 46 nt, Homo sapiens
gagcuacuugaagaggcuaugugguaccuuccugggugggcccaag

SEQ ID NO: 142262 - RNA, 45 nt, Homo sapiens
gagcccuggucucugaucucuuugauggugggacacuguggccau

SEQ ID NO: 142263 - RNA, 60 nt, Homo sapiens
ggggcuguggaagccaucucugaccggaucugcauccacaccaaugcgcacgucagcgug

SEQ ID NO: 142264 - RNA, 41 nt, Homo sapiens
auccugcugaagcuuggaacuucuggacaagaaaaggccug

SEQ ID NO: 142265 - RNA, 46 nt, Homo sapiens
ccugugagcaccacgucaacggcucccggcccccaugcacggggga

SEQ ID NO: 142266 - RNA, 46 nt, Homo sapiens
auacaauuccuacagcgucuccaauagcgagaaggacaucauggcc

SEQ ID NO: 142267 - RNA, 46 nt, Homo sapiens
ggagcuuucucuguguauucggacuuccugcucuacaagucaggug

SEQ ID NO: 142268 - RNA, 86 nt, Homo sapiens
gccauccgcauccugggcuggggaguggagaauggcacacccuacuggcugguugccaacuccuggaacacugacuggggugacaa

SEQ ID NO: 142269 - RNA, 54 nt, Homo sapiens
acuguggaaucgaaucagaagugguggcuggaauuccacgcaccgaucaguacu

SEQ ID NO: 142270 - RNA, 46 nt, Homo sapiens
cacggcagauuagaucuuuucccaguacugaucggugcguggaauu

SEQ ID NO: 142271 - RNA, 103 nt, Homo sapiens
ggccugucgugccaguccugggggcgagaucgggguagaaaugcauuuuauucuuuaaguucacguaagauacaaguuucagacagggucugaaggacuggau

SEQ ID NO: 142272 - RNA, 100 nt, Homo sapiens
gcagcgguggcucacauggccugucugcacuguaaccacaggcugggauguagccaggacuuggucuccuuggaagacaggucugauguuuggccaaucc

SEQ ID NO: 142273 - RNA, 98 nt, Homo sapiens
agugccguagggaguaccugcugccccagcugacuguggcccccuccgugauccauccaucuccagggagcaagacagagacgcaggaauggaaagcg

SEQ ID NO: 142274 - RNA, 54 nt, Homo sapiens
aguucccccaguaccuccaagcaaguagcuuuccacauuugucacagaaaucag

SEQ ID NO: 142275 - RNA, 44 nt, Homo sapiens
augauucuuuaauagaaguuuuauuuuuucgugcacucugcuaa

SEQ ID NO: 142276 - RNA, 77 nt, Homo sapiens
agaaaccagcuuuuacuguuuuugaaaaauuacagcuucacccugucaaguuaacaaggaaugccugugccaauaaa

SEQ ID NO: 142277 - RNA, 47 nt, Homo sapiens
aaaaguauuuaauuugaagcaccauuugaauguucguaauaguagaa

SEQ ID NO: 142278 - RNA, 51 nt, Homo sapiens
aaggauggauguuguguucucuuuauuuuuuuccuacuacuuuaaucccua

SEQ ID NO: 142279 - RNA, 54 nt, Homo sapiens
aacagaagacuauguucagacuggagaacacugaucccaaauuuguccauagcu

SEQ ID NO: 142280 - RNA, 47 nt, Homo sapiens
aucaucuccaccauccggacgcagaaucuucccaacugucagcugau

SEQ ID NO: 142281 - RNA, 33 nt, Homo sapiens
gcugucaaagccaucauauaucaguauauggaa

SEQ ID NO: 142282 - RNA, 46 nt, Homo sapiens
gcugccuguuauaauaaccagcagguguucaaaggggcagugaaga

SEQ ID NO: 142283 - RNA, 45 nt, Homo sapiens
aaguuaggggauuuugcuaagccggagaauauugacuuggccgug

SEQ ID NO: 142284 - RNA, 57 nt, Homo sapiens
acagaaagcuuuugauacugauuuuguucagaaggaaaguagaaaauuuuaugacug

SEQ ID NO: 142285 - RNA, 43 nt, Homo sapiens
cuggccucaagagguaacagauucaggguauuuugggggaaaa

SEQ ID NO: 142286 - RNA, 71 nt, Homo sapiens
ucuaugggccuguuuuugcagaaaacaaacaucauccgugacuaucuggaagaccagcaaggaggaagaga

SEQ ID NO: 142287 - RNA, 85 nt, Homo sapiens
cgguuuccauuucagaucucccuugaguuuagaaaucuggcugagaaauaccaaacagugauugccgacauuugccggagaaugg

SEQ ID NO: 142288 - RNA, 50 nt, Homo sapiens
uagaguuagagauuccauccucuugaaagcacaguugccccgggaagagu

SEQ ID NO: 142289 - RNA, 87 nt, Homo sapiens
caauauuuaaaaaaaaaaaaaaaaaaaaaaaaaggaauguuuggggaagacucuugcggugcaaaggcuguuucagauugcugagau

SEQ ID NO: 142290 - RNA, 28 nt, Homo sapiens
aagcccuuuuuguccacaguugccagag

SEQ ID NO: 142291 - RNA, 43 nt, Homo sapiens
agauucucaggcuagcucacaaaagccugccgacuguaugaug

SEQ ID NO: 142292 - RNA, 49 nt, Homo sapiens
ggggaaaugcggugagugauggaggcagcgccucuggcuuggaggaaag

SEQ ID NO: 142293 - RNA, 45 nt, Homo sapiens
ucagcagcagccugaaaacuugcuacaaguaucucaaucagacca

SEQ ID NO: 142294 - RNA, 31 nt, Homo sapiens
ucuuuccuuucuacagaaagacuguuagaga

SEQ ID NO: 142295 - RNA, 38 nt, Homo sapiens
cuugauuuuauaaaacuuacuuuuuaguggaagagaga

SEQ ID NO: 142296 - RNA, 41 nt, Homo sapiens
gcuuguuuacuccuuaagucaauguauuggugacuguugau

SEQ ID NO: 142297 - RNA, 37 nt, Homo sapiens
aaggaggaugugggcagggacgggguacagaggauag

SEQ ID NO: 142298 - RNA, 34 nt, Homo sapiens
uugcacagaaagucuguuuguuuuugugacaugu

SEQ ID NO: 142299 - RNA, 45 nt, Homo sapiens
cgucccccagggcgaggaugauucugaguauuuggagagagacgc

SEQ ID NO: 142300 - RNA, 337 nt, Homo sapiens
cccugagccaguggagaauuaaggacagagcagaaccggcugggcacgguggcucgcaccuguaaucccagcacuuugggaggccgaggcggguggaucacuaggucaggaguucaagaccagccuggcuaacaugaugaaaccccgucucuacuaaaaaugcaaaaauuggcugggugugguggugggcgccuguaaucccagcugcucgggaagcugaggcaggagaauugcuugaacccgggaggccgagauugcagugagaugagauugugcuacugcacuccagccugggugacagagugagacuccgucucaaaaaaaagaaaagaaaaga

SEQ ID NO: 142301 - RNA, 18 nt, Homo sapiens
ccucccagccacacuccc

SEQ ID NO: 142302 - RNA, 46 nt, Homo sapiens
gauaacugucuguagcuaugccgggcuuaccuacguggcugggggu

SEQ ID NO: 142303 - RNA, 47 nt, Homo sapiens
ccuuggacaccccauagaugguccugggucucugaauacagagaucg

SEQ ID NO: 142304 - RNA, 394 nt, Homo sapiens
aaaauaaaauguauuuuaggcugggcacaguagcucacaucuguaaucccagcacuuuggaaaggugaggugggcagaucacuugaggcgggcagaucacuugaggccaggaguuagaagaccagccugggcaacauagcgagagcccaucucuaccaaaaauaaaaaaaauuagccaggcguggugguaugugccuguagucccagcuacucgggaggcugaggcaggagaaucacuugaacccaggagguggagguuauagugagccgggauugcaccacugcacuacagccugggugacagacugaggcuccaacucaaaaaaaaaaaaucuguaucuauaucuauaucucuauauaucuauaucuauagcuauauauagcaguuauuuag

SEQ ID NO: 142305 - RNA, 62 nt, Homo sapiens
gacagagaccaauacagguaacauucguuucagagacaacacuuaccagcauggagugguuc

SEQ ID NO: 142306 - RNA, 46 nt, Homo sapiens
agggcauuguagcugccauuccaucuguucuagggagaacauucau

SEQ ID NO: 142307 - RNA, 48 nt, Homo sapiens
ccacucuucucugcaugcuuggaccuguuccacuuucaaaauguguca

SEQ ID NO: 142308 - RNA, 57 nt, Homo sapiens
cacccaggacucuaggggagagaaggcacguucucaacaaauggcccuuugauccau

SEQ ID NO: 142309 - RNA, 29 nt, Homo sapiens
ucccgauauuuucaauuccgaaucuucua

SEQ ID NO: 142310 - RNA, 71 nt, Homo sapiens
cucgggagucuucuuacucugucuuuucccaaaaaugcagucaagaucuguuuugcuccgagaugacagau

SEQ ID NO: 142311 - RNA, 33 nt, Homo sapiens
ucauggucucuccacgggggcuugccugggcac

SEQ ID NO: 142312 - RNA, 56 nt, Homo sapiens
acucucaaccuugauuuccccacuagccaggaguacacagagggcaggggcccggu

SEQ ID NO: 142313 - RNA, 59 nt, Homo sapiens
ucagauaagagaggcuuccaagggacugugagcaaaacccaagaaacagggcagcuugg

SEQ ID NO: 142314 - RNA, 39 nt, Homo sapiens
ggaggucuguugcuuguguauguauaccaacauauacgu

SEQ ID NO: 142315 - RNA, 66 nt, Homo sapiens
aucagaaccaucaugagauaucaucccacacccauuaggagaguuauuaucaaaaagauaagagau

SEQ ID NO: 142316 - RNA, 49 nt, Homo sapiens
aguaagugcucaacaaaggcacaaagacaccaaacccagcuggaccaag

SEQ ID NO: 142317 - RNA, 47 nt, Homo sapiens
ggcuagagagagcugcuuaaugcggggguagccacccucccacauca

SEQ ID NO: 142318 - RNA, 86 nt, Homo sapiens
gccauccgcuuggcaaaguacuccuggauggugaaggcgcugguugucgugguuucguucuccucuggaguggagggacuggcauc

SEQ ID NO: 142319 - RNA, 44 nt, Homo sapiens
cuucccccuuuuacguuccaccugcgucucagaaaugucagacc

SEQ ID NO: 142320 - RNA, 53 nt, Homo sapiens
gagcugcucuucugcuggcgcgcucuucuucuuggccacucgcuccugggccu

SEQ ID NO: 142321 - RNA, 33 nt, Homo sapiens
cucuacugguuuuugcagcuuuuucuucccucu

SEQ ID NO: 142322 - RNA, 40 nt, Homo sapiens
cuugggggaaauguggcgagagggcaggacucggcagccc

SEQ ID NO: 142323 - RNA, 62 nt, Homo sapiens
ccaccaggcaggggccagcagugccaugcuggaggcugggcggcgagcugggaggagcaggc

SEQ ID NO: 142324 - RNA, 43 nt, Homo sapiens
auugauacccaggccacugcugugcugguggcucauguugcag

SEQ ID NO: 142325 - RNA, 53 nt, Homo sapiens
gguggccgcauggaggacagcagaggcugcccauugagggaucccagagggug

SEQ ID NO: 142326 - RNA, 73 nt, Homo sapiens
gaggcuccccgaugugagggcgggguacuucagggcugccgggcagaccgugggcauggccaugagugucccc

SEQ ID NO: 142327 - RNA, 43 nt, Homo sapiens
gaacuggaagagggaaggcgcaaugcugugaagggggaggcgc

SEQ ID NO: 142328 - RNA, 86 nt, Homo sapiens
ugaugagaaauugacauguccgugcacaugcaugaggcggcgacaggauuuguguguaaacaguguggagagguggaggagggcau

SEQ ID NO: 142329 - RNA, 42 nt, Homo sapiens
caacucgccccugcggcacgcccggcccggcugcgcccccac

SEQ ID NO: 142330 - RNA, 43 nt, Homo sapiens
aggugugcagccugugacagacaggggcuuagagaugcaaaca

SEQ ID NO: 142331 - RNA, 46 nt, Homo sapiens
cugaguuuuuugguuugcccuuaaaaaaauaauaauuuggcaucca

SEQ ID NO: 142332 - RNA, 50 nt, Homo sapiens
ccaggagcugcagaggaagggagaggcacaauaaccuacauggacccaag

SEQ ID NO: 142333 - RNA, 46 nt, Homo sapiens
cugcuuccacagagaaaacauuuucucuuuccuccucuugaacuua

SEQ ID NO: 142334 - RNA, 44 nt, Homo sapiens
gaggacacagccaagggccauaucguccugcuccaggaggcuga

SEQ ID NO: 142335 - RNA, 45 nt, Homo sapiens
uugagggaaauggucuggacuuauucccagcacuguuucaggcaa

SEQ ID NO: 142336 - RNA, 52 nt, Homo sapiens
caaaauaugguaaagugaacccaucugucugcauuuucuacucugagcccau

SEQ ID NO: 142337 - RNA, 48 nt, Homo sapiens
aggagauguccuuagccauaccagggaauguauccugaacaguaggag

SEQ ID NO: 142338 - RNA, 53 nt, Homo sapiens
uguuucccucugcugcacugccauucacaugacauugcucgguucugaaccug

SEQ ID NO: 142339 - RNA, 37 nt, Homo sapiens
gugcauuuuaacaauguguggcuaucggaugcaagga

SEQ ID NO: 142340 - RNA, 41 nt, Homo sapiens
cacagccaccgugcgugugugugugcacgcacacaagugug

SEQ ID NO: 142341 - RNA, 50 nt, Homo sapiens
aaccccgaaccacagagagaguuuguuuuacuguucugccuguuccaguu

SEQ ID NO: 142342 - RNA, 45 nt, Homo sapiens
gagcagcacagcuggauggagggucaggugaccgucuggcugcug

SEQ ID NO: 142343 - RNA, 46 nt, Homo sapiens
ccccaaacugaucauggcuuugagaccgauccugacccuuuccugc

SEQ ID NO: 142344 - RNA, 49 nt, Homo sapiens
ggacucugaucaguucaagcgggaggaggauuucuacuacacagaggug

SEQ ID NO: 142345 - RNA, 79 nt, Homo sapiens
ccaccaccucugcacaaagcccaguccuccggcccagaacauccuggcccggaguccucccugcccucaggggcucuca

SEQ ID NO: 142346 - RNA, 59 nt, Homo sapiens
gcaagucagcuccuggguccuucuggcacauucaggcagaucaugcauaccagguaugg

SEQ ID NO: 142347 - RNA, 50 nt, Homo sapiens
cucaccacacaucuacaccagugucagcugggcugcugcccccuccgccg

SEQ ID NO: 142348 - RNA, 57 nt, Homo sapiens
ggccaucuugcuuucagcccccaaacguguugaagauguccuugugcugcccccucc

SEQ ID NO: 142349 - RNA, 81 nt, Homo sapiens
uccggagccggucgcuaagcuucagcgagccccagcagccagcaccugcgaugaaaucucaucugaucgucacuucuccac

SEQ ID NO: 142350 - RNA, 68 nt, Homo sapiens
uggcaucgagcaccgggaccaguggugcacggccugccgguggaagaaggccugccagcgcuuucugg

SEQ ID NO: 142351 - RNA, 137 nt, Homo sapiens
acugagcugugcugcagguucuacucuguuccuggcccugccggcagccacugacaagaggccagugugucaccagcccucagcagaaaccgaaagagaaagaacggaaacacggaguuugggcucuguuggcuaag

SEQ ID NO: 142352 - RNA, 101 nt, Homo sapiens
aaacaaaaauauuuuucccccuaaaauaggagagagccaaaacugaccaaggcuauucagcagugaaccagugaccaaagaauuaauuacccuccguuucc

SEQ ID NO: 142353 - RNA, 48 nt, Homo sapiens
cagguucugacuuuuaccaggggcaaaaaaaaaaaaagcaagagggag

SEQ ID NO: 142354 - RNA, 41 nt, Homo sapiens
cagguugugugccccuaaaucaagauuugcuuccacagaag

SEQ ID NO: 142355 - RNA, 53 nt, Homo sapiens
cauucugauuacagugcugauguuuagaaauaaauagcagugugacugggaaa

SEQ ID NO: 142356 - RNA, 44 nt, Homo sapiens
ugaggccugcagguggccuauuuugacucagacggugaaaaaag

SEQ ID NO: 142357 - RNA, 53 nt, Homo sapiens
ggcuggucaucugcugaccacaccccagauccgcccucuccugcgugcacccc

SEQ ID NO: 142358 - RNA, 55 nt, Homo sapiens
auggccacaccaguccacucuucugcaguauccucccuggcagaacacggagaau

SEQ ID NO: 142359 - RNA, 52 nt, Homo sapiens
ggggucggcaccaggaauuauuauagaaagaucggcuacagauuacaaggcc

SEQ ID NO: 142360 - RNA, 60 nt, Homo sapiens
aauuuuucuuucaaaaaacaagaggcagaaagaaauuuagcucuuuaggugagcagaggu

SEQ ID NO: 142361 - RNA, 46 nt, Homo sapiens
ugcuuuuucuuggcuggcuaacaaaaggaaaguuacuaugacagag

SEQ ID NO: 142362 - RNA, 41 nt, Homo sapiens
aaucguacaaggccgauggaucacacagugauggugaagaa

SEQ ID NO: 142363 - RNA, 46 nt, Homo sapiens
cgugugacuguuucaguuugccaagcuaauugcuaugcagcaagau

SEQ ID NO: 142364 - RNA, 43 nt, Homo sapiens
gcuuccccauuccuuaucuaggacagcaggucacuggggaagu

SEQ ID NO: 142365 - RNA, 44 nt, Homo sapiens
aaauaaagacccaaagaaauggcugaaccugaguguuuuuauac

SEQ ID NO: 142366 - RNA, 49 nt, Homo sapiens
aacaggggaaaagcauacacauuuauugcauauaaauuuuauggaacag

SEQ ID NO: 142367 - RNA, 97 nt, Homo sapiens
cugggaaaaucgcugugauaucagguaacugggggagggcgaaguucaugauuccuucccauuuugaacuuggcaccacagugaaaacuauguuggu

SEQ ID NO: 142368 - RNA, 61 nt, Homo sapiens
cagggauuuggcaugcugcugauggaggaagcagaaagaauagcuagagaagaacaugggu

SEQ ID NO: 142369 - RNA, 35 nt, Homo sapiens
gagaugugagaaccagagaaguuggaauccaagaa

SEQ ID NO: 142370 - RNA, 48 nt, Homo sapiens
uuauuuugaaauucagcucuuuuaucucacugcaaguuauaugcaaac

SEQ ID NO: 142371 - RNA, 46 nt, Homo sapiens
guaauuguaaaugucugguagcauagcaugcacuguggguugugga

SEQ ID NO: 142372 - RNA, 45 nt, Homo sapiens
gcaugguaaccugagagagcuggcacuugcaagaaugaaagaccu

SEQ ID NO: 142373 - RNA, 46 nt, Homo sapiens
aagcucagauagucaguaaucucaucuagguuuucaacuccuagaa

SEQ ID NO: 142374 - RNA, 59 nt, Homo sapiens
gcuagauaguaaaauuuugaaauaaaagugcucagaaaaauguuaauugcuaacuuaaa

SEQ ID NO: 142375 - RNA, 41 nt, Homo sapiens
cauauugaggguuuuggauuuuucuuaauggaaauaagaua

SEQ ID NO: 142376 - RNA, 46 nt, Homo sapiens
uggaaaucaggaagauauaagaguuacucuccuagugaccugguug

SEQ ID NO: 142377 - RNA, 43 nt, Homo sapiens
gcagccagcuggggugauguaguauaagaaaugacuugccaaa

SEQ ID NO: 142378 - RNA, 44 nt, Homo sapiens
uauuuuuccaguuuacaagauagagcccugccagcugaguagau

SEQ ID NO: 142379 - RNA, 55 nt, Homo sapiens
gaaagaagugaaugguggugauuggugacugauuggaagugaggauaagagagaa

SEQ ID NO: 142380 - RNA, 49 nt, Homo sapiens
agcgacauuuaagugacauguugaccuauggcugcacaaggcuggagau

SEQ ID NO: 142381 - RNA, 55 nt, Homo sapiens
cauaauauaugaauauuuauuuuuauuugaaaaauguuuucccucaaacccaaua

SEQ ID NO: 142382 - RNA, 38 nt, Homo sapiens
agaaauacugcagguuuuuuaaaaauaccaguuggaau

SEQ ID NO: 142383 - RNA, 45 nt, Homo sapiens
auauuucaucucuguaccauuuuuuacugugcaauuugguuugaa

SEQ ID NO: 142384 - RNA, 42 nt, Homo sapiens
gcagaacuucaaauuuuauugagguauuuucaagauagggua

SEQ ID NO: 142385 - RNA, 82 nt, Homo sapiens
cuguauaauuuugguguuuuaaaauuuauugagacuuguuuuguggcccagcauauguggucucucuuggugaacaugccau

SEQ ID NO: 142386 - RNA, 52 nt, Homo sapiens
augagguuuuucuugauaucuuauuaauuucuaauuuauuuucauuuuggcc

SEQ ID NO: 142387 - RNA, 25 nt, Homo sapiens
uuuaauuauuauucaauucaaaaua

SEQ ID NO: 142388 - RNA, 40 nt, Homo sapiens
cucuucuuuuucuagugauuuaauaagguauaaaagcuug

SEQ ID NO: 142389 - RNA, 42 nt, Homo sapiens
gaucugagucacccauucacuagaaugcaaauguugccaaau

SEQ ID NO: 142390 - RNA, 36 nt, Homo sapiens
ugcuuucagagccuaacuuugcaagcugugcuaggu

SEQ ID NO: 142391 - RNA, 46 nt, Homo sapiens
aagauacaugcuuuuaaggaguugaaauuuuauuugaaaugcagua

SEQ ID NO: 142392 - RNA, 45 nt, Homo sapiens
auaaaguggaguuuauugugauggguggaacguuuauggcccuuc

SEQ ID NO: 142393 - RNA, 49 nt, Homo sapiens
gguggaaauaggaaauuuccuacaaaggaguacaaagaacuagucgggg

SEQ ID NO: 142394 - RNA, 46 nt, Homo sapiens
acugcccugguggaccugauucugauuuugaguauuccacccaguc

SEQ ID NO: 142395 - RNA, 46 nt, Homo sapiens
gccugguggauaucauugcugccgucccuccucaguaucgcaaggu

SEQ ID NO: 142396 - RNA, 43 nt, Homo sapiens
aguagugcugagguugagaaagguggagucagaauaguccuuu

SEQ ID NO: 142397 - RNA, 38 nt, Homo sapiens
uuuuuccuccaugccuuauuuuccucuucccuucuccc

SEQ ID NO: 142398 - RNA, 73 nt, Homo sapiens
cauuuccuucaugaagucuuuuccuacucauuuacucuuccaguucuugauacacucaagagcuauacaagug

SEQ ID NO: 142399 - RNA, 50 nt, Homo sapiens
uuguggcugcauuuuuaucucugguggcucugcuacggcggcgcagaaau

SEQ ID NO: 142400 - RNA, 39 nt, Homo sapiens
aauauuaugauggggguaaguaauuguacuuuuugguuu

SEQ ID NO: 142401 - RNA, 41 nt, Homo sapiens
uaaaagguauaaggugaauuggucaguguaggggagcaaua

SEQ ID NO: 142402 - RNA, 42 nt, Homo sapiens
auuuucagguuuaaaguuuguaacauuccaucuuuacccuuc

SEQ ID NO: 142403 - RNA, 46 nt, Homo sapiens
cuuuuccagcagccauaauuuuaaaaguugcuuugaauauggcaag

SEQ ID NO: 142404 - RNA, 62 nt, Homo sapiens
uccaccgcggagcagcagcgcucaacucacgaagcucaggauaccagacucgcggcggccgc

SEQ ID NO: 142405 - RNA, 48 nt, Homo sapiens
ggguggacaucccagggucuuuuuauuguuuucuguugcaucccagac

SEQ ID NO: 142406 - RNA, 42 nt, Homo sapiens; identical to SEQ ID NO: 49110

SEQ ID NO: 142407 - RNA, 77 nt, Homo sapiens
cauccaugucagcuguuuucuucagguuagaccacggcguauauaccacauuaacguuguucaucuugcagccugcc

SEQ ID NO: 142408 - RNA, 40 nt, Homo sapiens
cccagaagagggaugaggcuuuccagggguuuagcaaccc

SEQ ID NO: 142409 - RNA, 45 nt, Homo sapiens
cauuccucucuucacgaucucugcauucuuucucugcugcuaggu

SEQ ID NO: 142410 - RNA, 46 nt, Homo sapiens
cagcgcgcgcccucggccuccucgcgcagcagcuucuccaccaggu

SEQ ID NO: 142411 - RNA, 46 nt, Homo sapiens
ggggucggccuggcaggagcagcacagcagcuccuuguccucgagg

SEQ ID NO: 142412 - RNA, 45 nt, Homo sapiens
cuucaacacaaguguaacucaacugcauuugccuaaccccaucca

SEQ ID NO: 142413 - RNA, 42 nt, Homo sapiens
ucuccucggccauggcauccagaauggccugcuccuccacuc

SEQ ID NO: 142414 - RNA, 46 nt, Homo sapiens
gagacaccaggagacggaagaggaaaugaagacucuccucuacagg

SEQ ID NO: 142415 - RNA, 48 nt, Homo sapiens
cugguaccuccgagugugaccuuauuugggaauggggugguuguacac

SEQ ID NO: 142416 - RNA, 43 nt, Homo sapiens
gcgguguuggggucaaagcugaaggguacugcaagcagaggcg

SEQ ID NO: 142417 - RNA, 45 nt, Homo sapiens
guggggaggaaaccuuauaaauuaaacacauggcccccuuagaga

SEQ ID NO: 142418 - RNA, 39 nt, Homo sapiens
cuuuugagauucuagaacacaugggagcuuuuuauuuuc

SEQ ID NO: 142419 - RNA, 46 nt, Homo sapiens
ucauacagggaaccacacccaacacuuagacaugcgaacaagcagc

SEQ ID NO: 142420 - RNA, 38 nt, Homo sapiens
cccgcuccucucuucuccucucccuccaggugcucaga

SEQ ID NO: 142421 - RNA, 46 nt, Homo sapiens
uaggaguuugucaagucaaagaagggagaugagggaauuugauaag

SEQ ID NO: 142422 - RNA, 78 nt, Homo sapiens
cauuuaaaauacuggagaaggagucagucguguccacagagagcccuagcaaagugagaucaugguauaugcuaugau

SEQ ID NO: 142423 - RNA, 50 nt, Homo sapiens
aaacauuuauuaagcaccuugagacagaauauuaagaugaauuuagugga

SEQ ID NO: 142424 - RNA, 22 nt, Homo sapiens
accuuggcauugguugccaaga

SEQ ID NO: 142425 - RNA, 95 nt, Homo sapiens
ccuggggugugaacccagggcagaugucuccauggccgaggcugcgcccauacucuacccaguagggcacaagaggagguugucagggcauaaac

SEQ ID NO: 142426 - RNA, 42 nt, Homo sapiens
caucugggaccccgacagcguuaaaaccaucucugccaagac

SEQ ID NO: 142427 - RNA, 46 nt, Homo sapiens
ugaccagcaccaaugcagccaaagucuucaaccuuuacccccggaa

SEQ ID NO: 142428 - RNA, 42 nt, Homo sapiens
cuucacccugauuccggagggcaccaauggcacugaggagcg

SEQ ID NO: 142429 - RNA, 46 nt, Homo sapiens
aucugggggguuauguauuugcccugaaauacuucgcccuggugau

SEQ ID NO: 142430 - RNA, 42 nt, Homo sapiens
gaagauuuuaugcaagagaaugccauggaaagauuauauuau

SEQ ID NO: 142431 - RNA, 45 nt, Homo sapiens
ccugacugugguguguuugcccuugagggcccuguguuuggggaa

SEQ ID NO: 142432 - RNA, 67 nt, Homo sapiens
aagugagguagauauuccugugcacagagagaaggggaauccagcuccucauagagcagcuccccac

SEQ ID NO: 142433 - RNA, 42 nt, Homo sapiens
cuuagcuguggcccagaaguccacucagccuuugucuaaaga

SEQ ID NO: 142434 - RNA, 54 nt, Homo sapiens
ggaauuuuuauauuuuguuuuacuuugcagcugaguaaacugaagcucagagcu

SEQ ID NO: 142435 - RNA, 25 nt, Homo sapiens
gcugaggucaucgcccaggcacgga

SEQ ID NO: 142436 - RNA, 43 nt, Homo sapiens
uguaggauagaacuugauccagggagucuugccugaucagaua

SEQ ID NO: 142437 - RNA, 73 nt, Homo sapiens
ugcaggagcagcagaggauccuggaucugggcaucacgggccccgagggacaugugcugagccgaccugagga

SEQ ID NO: 142438 - RNA, 46 nt, Homo sapiens
gugugauccgggauauuggcgccauagcccaaguccacgcagaaaa

SEQ ID NO: 142439 - RNA, 43 nt, Homo sapiens
gaggcucugccccgcacggcgugugugggagcggcacucagaa

SEQ ID NO: 142440 - RNA, 46 nt, Homo sapiens
cguguacauggcuuucaaagaucgcuuccagcuaacggauugccag

SEQ ID NO: 142441 - RNA, 84 nt, Homo sapiens
aagagucuuggguuuauuucucugaucuuccacagacuaacugugugacccuggguaauuugcugaaauuuuaugggucucagu

SEQ ID NO: 142442 - RNA, 47 nt, Homo sapiens
guguucagggaaacaccuauugcuuuaggguucuggggacuuccagg

SEQ ID NO: 142443 - RNA, 86 nt, Homo sapiens
acucuugucaacaagaaccucggggguuugcggggaagagccaggccacaucaucuuccugggucucgcugggcuuggcuagagac

SEQ ID NO: 142444 - RNA, 44 nt, Homo sapiens
ucccuagaauuauuuuggagaacaaauuuccagggauugggaag

SEQ ID NO: 142445 - RNA, 50 nt, Homo sapiens
gacagucucaggagaguguugggcagccccuuccuacaaaccuggaugga

SEQ ID NO: 142446 - RNA, 59 nt, Homo sapiens
gguggccuuacccagugcaguaacaugagccuucauugaugauaagagaagaugaggcu

SEQ ID NO: 142447 - RNA, 48 nt, Homo sapiens
gcauguggacaucagugaguggcauaagggcauccaggaggagaugga

SEQ ID NO: 142448 - RNA, 51 nt, Homo sapiens
gacaagccugcucgcugccuuugaccaguggagggaaugggccgacagcaa

SEQ ID NO: 142449 - RNA, 26 nt, Homo sapiens
cuccugccaucauguuaacuggguga

SEQ ID NO: 142450 - RNA, 42 nt, Homo sapiens
uuacagauaccagauauguguguacccauuuauuuacuaauc

SEQ ID NO: 142451 - RNA, 36 nt, Homo sapiens
ggaggggucuuugccgcagcaaaagcugguccgguu

SEQ ID NO: 142452 - RNA, 34 nt, Homo sapiens
ugauuuuggggugguggugguaaugggauuauua

SEQ ID NO: 142453 - RNA, 37 nt, Homo sapiens
cugauuuuauuuuaccauuauuuuucuuccgcuuuau

SEQ ID NO: 142454 - RNA, 28 nt, Homo sapiens
cacacuugcauccacaucuacauacaca

SEQ ID NO: 142455 - RNA, 67 nt, Homo sapiens
ugugggucuuagugucaccaguacuuauccuucuucuuaggagggauuuguuuuuuuaaucuuaaag

SEQ ID NO: 142456 - RNA, 32 nt, Homo sapiens
caaaaagcugcucuauuuaguacugauugaga

SEQ ID NO: 142457 - RNA, 52 nt, Homo sapiens
cuguuguguaguaaacaggccccucgugguaaauggagagcagugaauggag

SEQ ID NO: 142458 - RNA, 78 nt, Homo sapiens
auaggaaauguccugaauaaacaaaucuauggagacgggaaguagauugaugguggccaggguuugggaguagcaggg

SEQ ID NO: 142459 - RNA, 32 nt, Homo sapiens
acguuguguauguaaguagauguucuucugug

SEQ ID NO: 142460 - RNA, 33 nt, Homo sapiens
guauuuacauuuguuacgguggugcugggcuga

SEQ ID NO: 142461 - RNA, 53 nt, Homo sapiens
cauuggcaccuaagaccugcuacuuucuuugacuuaauauauugaguccagaa

SEQ ID NO: 142462 - RNA, 33 nt, Homo sapiens
cgagggacaucccccucugagugcagcaccugg

SEQ ID NO: 142463 - RNA, 66 nt, Homo sapiens
cuauuguuugauucucuccuucuaaaacuugcuguccugagccacaguucaaucuaccaaauaagg

SEQ ID NO: 142464 - RNA, 45 nt, Homo sapiens
guuaaugaugaccagucguucuaugcagacauauacauggaagau

SEQ ID NO: 142465 - RNA, 29 nt, Homo sapiens
ggugcggaguaggagguaggaugugggcu

SEQ ID NO: 142466 - RNA, 68 nt, Homo sapiens
gauguuuaggccaagggggaaaugguuguagccccuuaacacacacuccgcagcaguaacugggaggu

SEQ ID NO: 142467 - RNA, 44 nt, Homo sapiens
uaucagagaagggucagcgucacguggcugccagcaucuuugag

SEQ ID NO: 142468 - RNA, 24 nt, Homo sapiens
aucaguguagaagaguguuuggag

SEQ ID NO: 142469 - RNA, 42 nt, Homo sapiens
gcccgccccccagcuuccuugagcuaaugaagguaauacggg

SEQ ID NO: 142470 - RNA, 54 nt, Homo sapiens
cucacacuaguccauccucuaccaucacgaugacuuucaaauugugcucugcag

SEQ ID NO: 142471 - RNA, 24 nt, Homo sapiens
ugacacccuaauuucauguguuuu

SEQ ID NO: 142472 - RNA, 54 nt, Homo sapiens
uuuucauauguuugaugaaaacuggcucaagauguuuguaaauagaaucaagag

SEQ ID NO: 142473 - RNA, 41 nt, Homo sapiens
uugaggcauuuuacuaaccuuauacccuuuuuggccugaag

SEQ ID NO: 142474 - RNA, 80 nt, Homo sapiens
gaaaagccccuggaaaugcgugugaccugugaagugguguauugucacaguagcuuauuugaacuugagaccauuguaag

SEQ ID NO: 142475 - RNA, 47 nt, Homo sapiens
cuggcccugcuauguacugguuguggaaccuuaggcaaguuauuuaa

SEQ ID NO: 142476 - RNA, 49 nt, Homo sapiens
auucgauugauaacaggagagcucacaaagccaugagaaugaacugaaa

SEQ ID NO: 142477 - RNA, 50 nt, Homo sapiens
uguucucaauccagugaaagcaaugauauuauccccauggaccaguggaa

SEQ ID NO: 142478 - RNA, 122 nt, Homo sapiens
uaggguuaggaaacuuaaaaaagcaguuaaaggacuguuauuguacuugaucuuauagaauguuuuuauauguguuuauaaggacuauauauaauuuucaagcuuuucuaagaugaggaagu

SEQ ID NO: 142479 - RNA, 88 nt, Homo sapiens
cuuuuuuuaauggaagaaacaauaauuuaaaaauuaauuucuuuaggauuugggaaaauugauuuucuuccugaauaagaagaaaguu

SEQ ID NO: 142480 - RNA, 45 nt, Homo sapiens
acaauagcaggcugucguauauaagaugaucugacuggagcauuu

SEQ ID NO: 142481 - RNA, 25 nt, Homo sapiens
ugcacaccagcagggaccauagcuc

SEQ ID NO: 142482 - RNA, 44 nt, Homo sapiens
gcagauuaaggaaauguaaacagugacuauuuuuaggaaugcag

SEQ ID NO: 142483 - RNA, 49 nt, Homo sapiens
acauggauuaaggacugcuuauggugaaagaguaagaauacaacgagau

SEQ ID NO: 142484 - RNA, 60 nt, Homo sapiens
ucacguuauagcaauauuugcacaguuggaagcaccaaccaaggucuguaaagauaguuu

SEQ ID NO: 142485 - RNA, 48 nt, Homo sapiens
uuaccuucacaguaauggugcuggcacguaguagacacucaguaaaug

SEQ ID NO: 142486 - RNA, 45 nt, Homo sapiens
caauggagacauggagaagauucuuuuggaugcacaacaugaauc

SEQ ID NO: 142487 - RNA, 46 nt, Homo sapiens
gguggagcuacccaugaacagcagcaauggcaaugauaauggcaau

SEQ ID NO: 142488 - RNA, 27 nt, Homo sapiens
ccacaccaagcugcuuggguacauuuu

SEQ ID NO: 142489 - RNA, 22 nt, Homo sapiens
aaauucuaguguauaacugagc

SEQ ID NO: 142490 - RNA, 41 nt, Homo sapiens
aauaggauccagacauugauuugaaaguccuucaaaaaagu

SEQ ID NO: 142491 - RNA, 46 nt, Homo sapiens
uguuaagaaaacuaucaacuuccuuaagaauguuugaauaagauuc

SEQ ID NO: 142492 - RNA, 37 nt, Homo sapiens
uuacucccuucuugccucucacucuguucguuuuuuu

SEQ ID NO: 142493 - RNA, 63 nt, Homo sapiens
ucuuacagagguggaaguacacucagccugcaugggacaucaaaauguugcuuugggacaucu

SEQ ID NO: 142494 - RNA, 49 nt, Homo sapiens
agggauuuucaucuuccuuugacccuuuaacaacaacaacaaaaagggc

SEQ ID NO: 142495 - RNA, 67 nt, Homo sapiens
gcaguugaaaguuaacggacgaggcugauagacaacccaggccagggucuuuucauaacauuccgcu

SEQ ID NO: 142496 - RNA, 79 nt, Homo sapiens
ugagugcggggccgaggcucugugaaggggaugggggaggaggagcagccccggccgccgccaccggcgcggcgcggga

SEQ ID NO: 142497 - RNA, 48 nt, Homo sapiens
aaaaaucuguauaugaauacauuuucccuaagcggugauacauuaucc

SEQ ID NO: 142498 - RNA, 74 nt, Homo sapiens
agacuuauaaaacauuuuuaacaaguuagaacuuuuuuguuauucagucauauaaaauagcagaaaacuaacau

SEQ ID NO: 142499 - RNA, 37 nt, Homo sapiens
uauagguuuuauuaaggauuucacaaucuauaaaugc

SEQ ID NO: 142500 - RNA, 40 nt, Homo sapiens
aaggaaaaaaaaccuacuacugaauaaaagugacaaagaa

SEQ ID NO: 142501 - RNA, 47 nt, Homo sapiens
auucaucacugugguguucuccaugucugcuagccauuuagguaagg

SEQ ID NO: 142502 - RNA, 46 nt, Homo sapiens
gacagccuagacuucaauaagaaaauccuucacacagccuggcacc

SEQ ID NO: 142503 - RNA, 46 nt, Homo sapiens
cagaaacacaaagcgagacauaacccuagaagcaucgcgggaaaac

SEQ ID NO: 142504 - RNA, 58 nt, Homo sapiens
uucuuguucugcuuguuugacugaguguacugucuauuuucacaguguugucaugacu

SEQ ID NO: 142505 - RNA, 31 nt, Homo sapiens
uaccagguauuugaguuuuuucuuucaauga

SEQ ID NO: 142506 - RNA, 46 nt, Homo sapiens
aaacagcuguaacacauuuguauacagcagcaguaaaggaacuauu

SEQ ID NO: 142507 - RNA, 45 nt, Homo sapiens
uuaauaaaauguuaucuagacauuguggauaucaagccugccaau

SEQ ID NO: 142508 - RNA, 91 nt, Homo sapiens
uacauaucacaucaacucaauuucuauuaauagugauuaugaaacauauuuaucugcagaugauuugcggauuaaucuuuggcaucuggaa

SEQ ID NO: 142509 - RNA, 45 nt, Homo sapiens
gaaagggacaaaagaccagaaggguauaacuugaaagaggaggau

SEQ ID NO: 142510 - RNA, 49 nt, Homo sapiens
gaucuuuaauaaggaggauggauuuaaacaggccacaagacaacuggac

SEQ ID NO: 142511 - RNA, 40 nt, Homo sapiens
agcuucaaauauuuuagacacuguucuuuggcaucagaug

SEQ ID NO: 142512 - RNA, 69 nt, Homo sapiens
ugggugcccguuuuucugaucaugaaagcuuuccccagccaguccauugagaugcguacccucugccuu

SEQ ID NO: 142513 - RNA, 45 nt, Homo sapiens
accagaguuugacuacuugaaaaguuuagaaauagaagaaaagau

SEQ ID NO: 142514 - RNA, 97 nt, Homo sapiens
agucuaaaaugcaggauuuauauuaaaaaucgaguugccugcuuaaugguauugugguuuccuuguagacuauaaugauaaauuuugugagacuggg

SEQ ID NO: 142515 - RNA, 39 nt, Homo sapiens
auauaccucuaugauuuuguuuuuggauucuguaagaua

SEQ ID NO: 142516 - RNA, 205 nt, Homo sapiens
ccuuuucaugugucucauucuucuuaacuauauuuaagaauucuagauggagaguuuuguagaaacucaguaacaugucuuuugagaauuacuuagugguguaaauaucagcauguuuuuaagugauagauuaaguaaagaugaugauggugauugacucuucacuucugaaacuugaucuugacuauuaauuugguguguuuug

SEQ ID NO: 142517 - RNA, 52 nt, Homo sapiens
cccacugaagauucuaaagugcuaauauuuuaacuacauuuucuuguaagaa

SEQ ID NO: 142518 - RNA, 84 nt, Homo sapiens
guaauguagucagaauauuaguauuuaguauuuuccuaaaggcuguuaguaauacauuaauuuguaauuaaauuccaaauuuaa

SEQ ID NO: 142519 - RNA, 52 nt, Homo sapiens
ucguuuguuguccaagucaaaaucaaguguggaaaaaauggcugaaaauuuu

SEQ ID NO: 142520 - RNA, 52 nt, Homo sapiens
ucuaaaauacaaguuugucaauuaaaagcuaauuuggaacuauuuugccuga

SEQ ID NO: 142521 - RNA, 71 nt, Homo sapiens
aaucucaucagaggauguuggaauuuuaaaagaaguguguguuuauugaauacaauguccaauauauagac

SEQ ID NO: 142522 - RNA, 80 nt, Homo sapiens
agaauuuaaucauucuggagaauuacuagcaacaggagauaaaggugguagaguugucaucuuucaacaggagcaggagg

SEQ ID NO: 142523 - RNA, 91 nt, Homo sapiens
uuauuaguggaucaaaauauuuaugaaagaacuuuagauucauguuauuucugaugggugguugauguacuucaaagauauacuucauaga

SEQ ID NO: 142524 - RNA, 50 nt, Homo sapiens
uuuugaaccuuuggcuguauguguucuauuguguuucuuauaauacauaa

SEQ ID NO: 142525 - RNA, 62 nt, Homo sapiens
uggcacauuuugguuguaacaucuguaugugcuuuggcauuaguuugauaugacuuuguguu

SEQ ID NO: 142526 - RNA, 47 nt, Homo sapiens
gaguaagcuaacauauacaguuucuuaacuuuuucagagccucaguu

SEQ ID NO: 142527 - RNA, 67 nt, Homo sapiens
gaaggaaugguuggaaccuguucccaucaggaacagaugaguaggucaagcuuuauucacuuuuaag

SEQ ID NO: 142528 - RNA, 45 nt, Homo sapiens
cuugcuuccacaaguggggcaagaugcugggaugcugcuucagag

SEQ ID NO: 142529 - RNA, 26 nt, Homo sapiens
uucuguacuuugaaacugggauugaa

SEQ ID NO: 142530 - RNA, 49 nt, Homo sapiens
ugaagcgcuaguaggaguaagugacaggaccuacuuugaauagccagag

SEQ ID NO: 142531 - RNA, 47 nt, Homo sapiens
acgagcauaauaaggagaauucaguauccuuggaaacccuggaacgg

SEQ ID NO: 142532 - RNA, 44 nt, Homo sapiens
ugucacaguuaucgaaacagucuuuuaaagaaugucuagagggc

SEQ ID NO: 142533 - RNA, 38 nt, Homo sapiens
uauucucaggagauagagugaauaagcuauugggagag

SEQ ID NO: 142534 - RNA, 59 nt, Homo sapiens
ucuuucuucuccuugacauaaaaugagcauuauuuuuuuuucuagcaacagaaccaauu

SEQ ID NO: 142535 - RNA, 67 nt, Homo sapiens
ucugcucuaaucuugaguuaugccuguguuuacacacuuacugaaacuucugugcuggauucuaaau

SEQ ID NO: 142536 - RNA, 46 nt, Homo sapiens
acuaccugaaacaccuauuaaaauauuccucccuuucuaacuacau

SEQ ID NO: 142537 - RNA, 47 nt, Homo sapiens
uuuuggaaaacacgucucugccauugugagcuugacagccucccaau

SEQ ID NO: 142538 - RNA, 54 nt, Homo sapiens
uuaaauaggaaaacugaaggauuggaaauagcuaaaaaauuuuaguuaauaucc

SEQ ID NO: 142539 - RNA, 50 nt, Homo sapiens
auaaaaugguauuucuauaucuugucaauuuuaguauuuccagcugacuu

SEQ ID NO: 142540 - RNA, 44 nt, Homo sapiens
gaaaggggaagagaaaugguaaaaggcaggaugauugagaugua

SEQ ID NO: 142541 - RNA, 47 nt, Homo sapiens
uccuuuauagcacuuuguuacguagauaucauaugguaccccacauc

SEQ ID NO: 142542 - RNA, 75 nt, Homo sapiens
uuucuacugauugguuaaauaauuuucuuuagagguuguuaaauauuuuaacguaagcauauucuuagcaucgua

SEQ ID NO: 142543 - RNA, 41 nt, Homo sapiens
uuuuuuuucagguggugggugguagccgaacucucuuauuu

SEQ ID NO: 142544 - RNA, 57 nt, Homo sapiens
aaugauauucagugguguuuuucucaggugaaaggagcaguagaugaugauguagca

SEQ ID NO: 142545 - RNA, 49 nt, Homo sapiens
gacauuuucaaucauuucgaccucaguacuugcacgugaaauagaaaca

SEQ ID NO: 142546 - RNA, 48 nt, Homo sapiens
agggcgauugggaaauggaucggguggcuaguaaaagccaaguaagac

SEQ ID NO: 142547 - RNA, 61 nt, Homo sapiens
gacugcucaggggagaacguugaaagcuaauaauaggaauuuuaaaaaguauucacaagag

SEQ ID NO: 142548 - RNA, 45 nt, Homo sapiens
cacaaacacugcuaauuaauaguccucuuuucugugcugccaggg

SEQ ID NO: 142549 - RNA, 46 nt, Homo sapiens
uagucacauguuuucauuuaucuugcauaaauaucuagugguaggg

SEQ ID NO: 142550 - RNA, 44 nt, Homo sapiens
auaaacaugcaugcaucguuuuguuguuuucuaacaggaucacu

SEQ ID NO: 142551 - RNA, 33 nt, Homo sapiens
guggcccccuauuuuuacuuuuuucuuacauaa

SEQ ID NO: 142552 - RNA, 46 nt, Homo sapiens
guauaucuacacuugcaaauacuaaagccacuucccaguucaaagg

SEQ ID NO: 142553 - RNA, 40 nt, Homo sapiens
ccuccagugugggcagcucuguagaaauuaguuuagaaaa

SEQ ID NO: 142554 - RNA, 45 nt, Homo sapiens
gggaagaaaacccauggaaaguagcaguguugugaguugcagaga

SEQ ID NO: 142555 - RNA, 45 nt, Homo sapiens
ccauggguuuucuucccaaauccucacucuggcuuuuagauucuu

SEQ ID NO: 142556 - RNA, 45 nt, Homo sapiens
augacagucuuuuugugaauuaggcauuaaacgauugcauugcag

SEQ ID NO: 142557 - RNA, 65 nt, Homo sapiens
ucaaaaugcagaaaaccuuugucaguucuuuaaaauuucaccagauuuaaacauaaagugugaaa

SEQ ID NO: 142558 - RNA, 79 nt, Homo sapiens
aaaaaauaagucagaaagugaaaaugaaccaaaagcuggaacugacaguccuguuucuugugcuucuguaacugaagaa

SEQ ID NO: 142559 - RNA, 92 nt, Homo sapiens
caccgaaacagcccaagaagcaggccaaggagauggacgaggaagacaaggcuuucaagcagaaacaaaaagaggagcagaagaaacucgag

SEQ ID NO: 142560 - RNA, 43 nt, Homo sapiens
aacuucucuauucccugccauaacaucuuuugccccguauagc

SEQ ID NO: 142561 - RNA, 47 nt, Homo sapiens
gaaaaaaaaaaaacccaacaacuuagcggaaacuucucagagaaugc

SEQ ID NO: 142562 - RNA, 45 nt, Homo sapiens
ugggauguaugacaucuguaaauccuucuuguacagcgcugcuaa

SEQ ID NO: 142563 - RNA, 42 nt, Homo sapiens
gaaaagcauucgucaaagagagcuuaaaaugcaucgccaacg

SEQ ID NO: 142564 - RNA, 45 nt, Homo sapiens
aagcggaacccugaagccaucacugaggucguccagcugcccaau

SEQ ID NO: 142565 - RNA, 46 nt, Homo sapiens
uccagagugggaaaacugacaaagcuuccaacucucuagggcaugg

SEQ ID NO: 142566 - RNA, 46 nt, Homo sapiens
cuuuguuucccuugaucaauauuauucuucuguuuccuguucccua

SEQ ID NO: 142567 - RNA, 59 nt, Homo sapiens
agggaugggagaucagaaaccacccaccaggaucuaaucacccucugaaauagacacag

SEQ ID NO: 142568 - RNA, 67 nt, Homo sapiens
cucguggguguguuugggcacaguggucugucugcaggauguggaagaggcuggccauguuaggccc

SEQ ID NO: 142569 - RNA, 51 nt, Homo sapiens
cauggccagccucuuccacauccugcagacagaccacugugcccaaacaca

SEQ ID NO: 142570 - RNA, 89 nt, Homo sapiens
gauuacagaagccuaguuucaugcaauuuucuuuaagggggauagaaaauaggaacuacuuuaaaaaaaucaaaccaggcacaguacac

SEQ ID NO: 142571 - RNA, 46 nt, Homo sapiens
aguacccucuuuuaccaacuuccucugccauguuuuuccccugcuc

SEQ ID NO: 142572 - RNA, 45 nt, Homo sapiens
guggucucaggggagcaggggaaaaacauggcagaggaaguuggu

SEQ ID NO: 142573 - RNA, 57 nt, Homo sapiens
acauucauguaacucuccagccauuguaauuugaagauguggaucccuuuagaacgg

SEQ ID NO: 142574 - RNA, 46 nt, Homo sapiens
uuaaaugcaugucuuaaaugcucauaaagauguuaaauggaauucg

SEQ ID NO: 142575 - RNA, 45 nt, Homo sapiens
cucagagcuuuaaaaguaucuuuaacaauugucuuaaaaccagag

SEQ ID NO: 142576 - RNA, 73 nt, Homo sapiens
uaguuucucagggucacuguccuugaacccaacagucccuuaugagcgucacugcccaccaaaggucaauguc

SEQ ID NO: 142577 - RNA, 46 nt, Homo sapiens
cagauuguuaagggcauuuuuauacucagaacugucccauccccag

SEQ ID NO: 142578 - RNA, 42 nt, Homo sapiens
ccuuagccucuuggaaaucagguagaccauauucuaaguuag

SEQ ID NO: 142579 - RNA, 42 nt, Homo sapiens
uauguauuguagauacauauauagauaucaucguggggagaa

SEQ ID NO: 142580 - RNA, 46 nt, Homo sapiens; identical to SEQ ID NO: 49350

SEQ ID NO: 142581 - RNA, 46 nt, Homo sapiens
cagcaugaacaugggccgguccuccagguagguggucugcugcacc

SEQ ID NO: 142582 - RNA, 114 nt, Homo sapiens
cugccucucggccucagccgcgcagaccgaccccaccacgggcuaccgccggcuccugcgcuucuccucccagauccacaacaauggccaguccgacuuccggcccaagaacgg

SEQ ID NO: 142583 - RNA, 47 nt, Homo sapiens
cggccguucuugggccggaagucggacuggccauuguuguggaucug

SEQ ID NO: 142584 - RNA, 42 nt, Homo sapiens
gggggaacgugcauuucucggggggagugggaguguugacaa

SEQ ID NO: 142585 - RNA, 27 nt, Homo sapiens
cgaggaugugcgguuuucguggugaag

SEQ ID NO: 142586 - RNA, 41 nt, Homo sapiens
ccggcgcucaugaggcuaaugauguuguccuggcaccaguu

SEQ ID NO: 142587 - RNA, 56 nt, Homo sapiens
ggcucagcgauggcugcucuuucuccccacagaucaaacugcccugaggccuaaga

SEQ ID NO: 142588 - RNA, 44 nt, Homo sapiens
cagagagcaaccuucccuauuacuccacuucaaaggagccaccc

SEQ ID NO: 142589 - RNA, 42 nt, Homo sapiens
ugguuccgggugucuuuguccccccggugucgcugcccuggc

SEQ ID NO: 142590 - RNA, 42 nt, Homo sapiens
cgcuccccaguugccgcgggauggcaagccggcgugggggaa

SEQ ID NO: 142591 - RNA, 33 nt, Homo sapiens
cucaggugaauaggaaaggggaaaguaaggcug

SEQ ID NO: 142592 - RNA, 46 nt, Homo sapiens
caaccggaucugccggagaagccaccaccacccugagcccccugcc

SEQ ID NO: 142593 - RNA, 46 nt, Homo sapiens
cgggaacaaaugaucaaugaucggauugguuauaaaccccaaccca

SEQ ID NO: 142594 - RNA, 46 nt, Homo sapiens
acaccagggcaccgcagccaauaaaccgaaaguguuacagccaaua

SEQ ID NO: 142595 - RNA, 58 nt, Homo sapiens
gggggcauuauuuucauuguaauguucauuucccaccccugcuccagccucgauuugg

SEQ ID NO: 142596 - RNA, 57 nt, Homo sapiens
cccccaccagcaaggggcuggggccagggagcagagcuuccacaagacauuucgaag

SEQ ID NO: 142597 - RNA, 53 nt, Homo sapiens
ggcggggacuggagccugcugcccuuggucgccuagacuggauagugggggug

SEQ ID NO: 142598 - RNA, 60 nt, Homo sapiens
acaccaucaccaaaaaagguuuccaccugcgauacaccagcaccaaguuccaggacacac

SEQ ID NO: 142599 - RNA, 44 nt, Homo sapiens
gggcucgggagcagaccuuggccaggugccagaggagaggcggg

SEQ ID NO: 142600 - RNA, 29 nt, Homo sapiens
cccaggcuggggcgcuacuguggcucagg

SEQ ID NO: 142601 - RNA, 46 nt, Homo sapiens
uggccacaggcagccgcauguuccugcgcuucuacucagauaacuc

SEQ ID NO: 142602 - RNA, 56 nt, Homo sapiens
aggagggggcuggauguuugcagcaguuacuaaggaggugagagauggagcuggua

SEQ ID NO: 142603 - RNA, 84 nt, Homo sapiens
cuggccggacagaacuggugcucucuucuccccacugugcccguccgcggaccggggacccuuccccgugcccuacccccuccc

SEQ ID NO: 142604 - RNA, 41 nt, Homo sapiens
cagguccuaggaacaggcaguucaagaacguggguggaugg

SEQ ID NO: 142605 - RNA, 59 nt, Homo sapiens
caaauaucgaggagagacugcucccagcucacgaagcacaggaggcccagcagggaggg

SEQ ID NO: 142606 - RNA, 41 nt, Homo sapiens
cccccaacaagaacugcaucuggcagcugguggcccccacc

SEQ ID NO: 142607 - RNA, 46 nt, Homo sapiens
agcuacaagugcagcugugaccccggguacgagcuggccccagaca

SEQ ID NO: 142608 - RNA, 45 nt, Homo sapiens
acuguggcuaugagaagccugaugacaucaagagcacguccagcc

SEQ ID NO: 142609 - RNA, 42 nt, Homo sapiens
ugucugagggcuuccacgugggccucacauuccaguccuuug

SEQ ID NO: 142610 - RNA, 52 nt, Homo sapiens
aaggacuauggccacauucaaucgcccaacuacccagacgauuaccggccca

SEQ ID NO: 142611 - RNA, 45 nt, Homo sapiens
uagaucauccugaacuucacgucccuggaccuguaccgcagccgc

SEQ ID NO: 142612 - RNA, 42 nt, Homo sapiens
ucuccuccccugaauaccccaauggcuacucugcucacaugc

SEQ ID NO: 142613 - RNA, 45 nt, Homo sapiens
gggaccgccacguuuccaucguucgugagaacauccagccaggua

SEQ ID NO: 142614 - RNA, 47 nt, Homo sapiens
ugggagaagcacaccugugucaccuuccuggagcgcacugacgagga

SEQ ID NO: 142615 - RNA, 51 nt, Homo sapiens
cccccagcugccagagcaccaacgggcagccucagaggggagccuguggga

SEQ ID NO: 142616 - RNA, 49 nt, Homo sapiens
uaucagaacuuuuccuugacuuccugccucucugacuucagcucaucuc

SEQ ID NO: 142617 - RNA, 47 nt, Homo sapiens
guucucccaccucccgcugcugcaguucuuguauggauagggccuug

SEQ ID NO: 142618 - RNA, 104 nt, Homo sapiens
uuugauuggacucuacauuaaaguccaaucagcgggaggggauuuugaaaguuucgaguaaggaauauauagcauauaguaguauauagcagagccacacucau

SEQ ID NO: 142619 - RNA, 42 nt, Homo sapiens
gcaagccacggcugauuguguccagcagcucccaggcacccg

SEQ ID NO: 142620 - RNA, 24 nt, Homo sapiens
cgcuaccuggcacugggcagugau

SEQ ID NO: 142621 - RNA, 59 nt, Homo sapiens
aggcaccccugggacaccuaacgcccaguucccgugaccccaacugcaggcccccccua

SEQ ID NO: 142622 - RNA, 47 nt, Homo sapiens
gcugccccuuggcaaacacaaggugauauggcacguugugggcggag

SEQ ID NO: 142623 - RNA, 43 nt, Homo sapiens
gggggggccaccccugacccauggcuugcggacccugcgucca

SEQ ID NO: 142624 - RNA, 44 nt, Homo sapiens
cagccugcuuuaccgcaaguuuguccacccgucccugucccgcc

SEQ ID NO: 142625 - RNA, 45 nt, Homo sapiens
cgaagcugagcacggucucguagcugcgcuccuuggccugcacga

SEQ ID NO: 142626 - RNA, 130 nt, Homo sapiens
gccagggagcccagagauggcagccggggagcaggggugagaaggugacggggggguauuggcagaagcguggagcuggagucagaccuuccuuccuggcucuggcacugagcguaagcagcggcuccug

SEQ ID NO: 142627 - RNA, 88 nt, Homo sapiens
ggaccugcgcuccaucucugacgcaccugccccugccuaccaugacccccucuaccuggaggaccaggugucccaccggaggccaccc

SEQ ID NO: 142628 - RNA, 46 nt, Homo sapiens
cccuaauccgcagccagagccugcguguggucaagaggaagccacc

SEQ ID NO: 142629 - RNA, 44 nt, Homo sapiens
gccuuucauaaggccuggcacauguguccugguugugugugugu

SEQ ID NO: 142630 - RNA, 45 nt, Homo sapiens
agcuccugcagaccagugcgcgcucggggaguuggcgagcgggug

SEQ ID NO: 142631 - RNA, 45 nt, Homo sapiens
ccagggguccagcgugcacagcugcgacucggcgccggccgggga

SEQ ID NO: 142632 - RNA, 46 nt, Homo sapiens
aagaaaaggaagcaaaagaggcucuggccugcuccuccuugcccag

SEQ ID NO: 142633 - RNA, 52 nt, Homo sapiens
ugugugugugucauggauuccauggggcugagggccagaacguguuaggacg

SEQ ID NO: 142634 - RNA, 46 nt, Homo sapiens
cugguagcaggagcuaggcgaggcuuugcgggaguuugaaagccgg

SEQ ID NO: 142635 - RNA, 44 nt, Homo sapiens
uguaacggauccggaagcagucccaccaagucggaggaguuucu

SEQ ID NO: 142636 - RNA, 53 nt, Homo sapiens
ucuaaugccaagccaagaagucucagucauuuuuugcaggcagcagggagcag

SEQ ID NO: 142637 - RNA, 37 nt, Homo sapiens
aggaaggaggcaggcccaccgggacuggggggaggcg

SEQ ID NO: 142638 - RNA, 26 nt, Homo sapiens
caggaaacaccccaagcggugacagg

SEQ ID NO: 142639 - RNA, 54 nt, Homo sapiens
auugcguguugcgggugggaggugggagaggggcugcggaucugacgggaagac

SEQ ID NO: 142640 - RNA, 42 nt, Homo sapiens
ccagcccuccaccaaaucccaacgugcucgccuugguagcca

SEQ ID NO: 142641 - RNA, 46 nt, Homo sapiens
acguggacuggaaagaagucaagcuggggguguaagguagggcagg

SEQ ID NO: 142642 - RNA, 52 nt, Homo sapiens
gagggcgcaaacaugaacucugugugccagagcccagacuggcuuugcccug

SEQ ID NO: 142643 - RNA, 54 nt, Homo sapiens
cugaggaaaggagcccacccuauuuccaccccaccuccugccccucccaacccg

SEQ ID NO: 142644 - RNA, 46 nt, Homo sapiens
ggauggaccgggggaacucccugcccugugugcuggagcagaaggu

SEQ ID NO: 142645 - RNA, 49 nt, Homo sapiens; identical to SEQ ID NO: 49433

SEQ ID NO: 142646 - RNA, 109 nt, Homo sapiens
agacagaauggaggaagcggaaggcgucucggaggggagcagaggaagaggaggaggaggaagaugacgacucuggagaggagaugaaggcucucagggagcgucagag

SEQ ID NO: 142647 - RNA, 48 nt, Homo sapiens
uccaaguuuccugcagcccagcccccagaccccaaccagccagccaaa

SEQ ID NO: 142648 - RNA, 66 nt, Homo sapiens
caucuguucuuccucccacagagaccucccgcccagauuccaacaucuacaagaagccucccaucu

SEQ ID NO: 142649 - RNA, 44 nt, Homo sapiens
cugugggaggaagaacagaugaggaggaggacaugcugauggca

SEQ ID NO: 142650 - RNA, 57 nt, Homo sapiens
ccuccuggggccuacuuagcccugaggcgagcauauaccccagagagugggggacug

SEQ ID NO: 142651 - RNA, 52 nt, Homo sapiens
cucggcccccagaaccacuggaaccccccggaccagccugccccauuuccac

SEQ ID NO: 142652 - RNA, 46 nt, Homo sapiens
ggguuccagugguucugggggccgaggccugagagaugauuccagg

SEQ ID NO: 142653 - RNA, 22 nt, Homo sapiens
gaaggauccaagaaagcagagg

SEQ ID NO: 142654 - RNA, 37 nt, Homo sapiens
cauguggcucagauguagagggguggacaccuuugga

SEQ ID NO: 142655 - RNA, 87 nt, Homo sapiens
gccauccuggacaucgagcggcccgaccucaugaucuacgagccucacuucacuuauucccuccuggaacacguggagcugccucgc

SEQ ID NO: 142656 - RNA, 93 nt, Homo sapiens
ggagggaauaagugaagugaggcucguagaucaugaggucgggccgcucgauguccaggauggccuuguccuuggggauggcagccagguccu

SEQ ID NO: 142657 - RNA, 48 nt, Homo sapiens
uucugcagccguuccaugcagcacggagcucgcccgccgggucacucg

SEQ ID NO: 142658 - RNA, 38 nt, Homo sapiens
auuguugccacaguaacugcggggguggggcuggguag

SEQ ID NO: 142659 - RNA, 30 nt, Homo sapiens
gacacaacgguaaaaaacauuggaguaggg

SEQ ID NO: 142660 - RNA, 58 nt, Homo sapiens
aaaccaaaccagagagagaccuaggagaagauggcugcacagaugcgucucugggugg

SEQ ID NO: 142661 - RNA, 48 nt, Homo sapiens
cuggcacacagggcuucggagucuccccgcgugcaugcguccugcaac

SEQ ID NO: 142662 - RNA, 41 nt, Homo sapiens
uaucuggggggagcccacugugggcccuguucagugggagg

SEQ ID NO: 142663 - RNA, 44 nt, Homo sapiens
uggucaugaauaggguaggaggugcaggugccuggagaaagcag

SEQ ID NO: 142664 - RNA, 43 nt, Homo sapiens
agaauggagggaugcaaccagguccucaguacugagacuugag

SEQ ID NO: 142665 - RNA, 46 nt, Homo sapiens
gcaaggguccccagagguagaguuggaaugagcugaugccaggaag

SEQ ID NO: 142666 - RNA, 53 nt, Homo sapiens
aggaauuggaagagagcugucccuugcucugaguuuucucagguggaaugaga

SEQ ID NO: 142667 - RNA, 40 nt, Homo sapiens
caucuggcaccagugaccuuguggggaaaggagccaagaa

SEQ ID NO: 142668 - RNA, 44 nt, Homo sapiens
acacccagcaauuacuugaggacaaaggguugggggccccccag

SEQ ID NO: 142669 - RNA, 46 nt, Homo sapiens
gccggcgcucgccaucaacugagacuguagcugcacccaccuccca

SEQ ID NO: 142670 - RNA, 40 nt, Homo sapiens
cuuccggccgcccaaccccgcuucccgcccccgcccuccu

SEQ ID NO: 142671 - RNA, 39 nt, Homo sapiens
gcggcccgcggacgccaggagccuccucgggcagcgaga

SEQ ID NO: 142672 - RNA, 47 nt, Homo sapiens
cgaggaggcuccuggcguccgcgggccgcccgggcuccgccgggcuc

SEQ ID NO: 142673 - RNA, 48 nt, Homo sapiens
auuccacgacccaggccugcaccccacccccaacucccagccccggaa

SEQ ID NO: 142674 - RNA, 57 nt, Homo sapiens
agacuguaggaagggacuuuuguuuguuuguuuguuucaggaaaaaagaaagggaga

SEQ ID NO: 142675 - RNA, 45 nt, Homo sapiens
agaaguacaucuguaugaacaagaggggcaagcucaucgggaagg

SEQ ID NO: 142676 - RNA, 40 nt, Homo sapiens
ggucuagcucuguccagauggcugagguugggccugggau

SEQ ID NO: 142677 - RNA, 47 nt, Homo sapiens
cuccagccccguuccaggccuuuugcuucacacauccagggggagcc

SEQ ID NO: 142678 - RNA, 37 nt, Homo sapiens
ugcacuggguggcccaggagagacuggcagcccagag

SEQ ID NO: 142679 - RNA, 41 nt, Homo sapiens
guuuggccagucugugagggucaggaauagagcaggagaca

SEQ ID NO: 142680 - RNA, 67 nt, Homo sapiens
cuggagaagccucaucuggcagcuggagguaucagccaaccucacaaugaguaucuaggguagacaa

SEQ ID NO: 142681 - RNA, 49 nt, Homo sapiens
gggcagggcgcggcgggugacgggaccgcgcgcagggugcagagcaggg

SEQ ID NO: 142682 - RNA, 71 nt, Homo sapiens
auaaccccacccuuuacauuuugugcagugauuauuuuuuaaagucuucuuucauguaaguagcaaacagg

SEQ ID NO: 142683 - RNA, 73 nt, Homo sapiens
auuugccguggaaacuuuaauuuguucuugaacagucaagaaaaacauuauugaggaaaauuaauaucacagc

SEQ ID NO: 142684 - RNA, 52 nt, Homo sapiens
uauuuaucgacugugucaugacaaggaaacuuacaaacugcaacgcagagaa

SEQ ID NO: 142685 - RNA, 56 nt, Homo sapiens
caguccuaucugauucaugagcacaugguuauuacugaucgcauugaaaacauuga

SEQ ID NO: 142686 - RNA, 42 nt, Homo sapiens
gaaaauggcugcgucuucgaguggugagaaggagaaggagcg

SEQ ID NO: 142687 - RNA, 47 nt, Homo sapiens
gaacuuauagaaaugcuggcaauuucaagaaaccaaaaguuguuaca

SEQ ID NO: 142688 - RNA, 57 nt, Homo sapiens
aaauuggcacuuaaucagggaaaaauucaucaugaaaugcaaguuuuagaaaaagaa

SEQ ID NO: 142689 - RNA, 25 nt, Homo sapiens
cccauucacaaauuaguuguagaaa

SEQ ID NO: 142690 - RNA, 42 nt, Homo sapiens
uagauauaugugguuuugaagauucuuaggugacuauguaca

SEQ ID NO: 142691 - RNA, 44 nt, Homo sapiens
cuggguucaaaucccagucuuccaaaauaaaacuauuuggguuu

SEQ ID NO: 142692 - RNA, 43 nt, Homo sapiens
cauugaagcagauuuccagcaacaagugcuuugggggauugca

SEQ ID NO: 142693 - RNA, 42 nt, Homo sapiens
gcaaaaugaaauuugcugucuacuuaccaccaaaggcagaaa

SEQ ID NO: 142694 - RNA, 39 nt, Homo sapiens
gauuuugcuagaagagcauuagguauugcuaaaagcaag

SEQ ID NO: 142695 - RNA, 101 nt, Homo sapiens
guuucuggugagggguacuauagucauaucucuuggcuaaacaauaauaaccagaagcccugaggcauugugucauagguacucuaauaauagggcccuaa

SEQ ID NO: 142696 - RNA, 42 nt, Homo sapiens
ccagaacgagucgcagggccccauucaagggcaagaggagca

SEQ ID NO: 142697 - RNA, 46 nt, Homo sapiens
ugggacuuuggcacuggugcuggauuuuauguugaugccacugaag

SEQ ID NO: 142698 - RNA, 42 nt, Homo sapiens
caauauuguuaguauuggaacuaaacuuuucuaguguugaga

SEQ ID NO: 142699 - RNA, 42 nt, Homo sapiens
auugaucaagggaaagaugaccaguuucuuuuagauggacag

SEQ ID NO: 142700 - RNA, 113 nt, Homo sapiens
ucauagcuacuacuucauugcaaccuuuauuacugaccacaucagacaucaugcuaaauaccugaaugcaugaaaaaacuccaaauaagagaaucucuucaggauuauaaaag

SEQ ID NO: 142701 - RNA, 30 nt, Homo sapiens
gagccugugggcagcaccaccaaggcaggc

SEQ ID NO: 142702 - RNA, 60 nt, Homo sapiens
ccagcagcccucugucccccaauauaaugaacugacuaaaaucaagagagcaccccaaag

SEQ ID NO: 142703 - RNA, 44 nt, Homo sapiens
accagagagggagcuggaggaaaaaaaaacugagcagcacauca

SEQ ID NO: 142704 - RNA, 40 nt, Homo sapiens
augaaguaaagaauuguuuuccccaaguaauaucuggcac

SEQ ID NO: 142705 - RNA, 40 nt, Homo sapiens
cauuuaaaaggaaaaaaaagaauuuuaucuuagccagaau

SEQ ID NO: 142706 - RNA, 26 nt, Homo sapiens
gaugccccuggcaguaauguacaauu

SEQ ID NO: 142707 - RNA, 66 nt, Homo sapiens
ccaauuauugugaguaaagauugguaauuaagauuuccuuuuaaaguggagaaaaggaaacuaaau

SEQ ID NO: 142708 - RNA, 28 nt, Homo sapiens
gaaaacauucgauguguuuaaacggugu

SEQ ID NO: 142709 - RNA, 46 nt, Homo sapiens
uucauucuucuccuauauugugcauuugaaauuaaaccccauauaa

SEQ ID NO: 142710 - RNA, 27 nt, Homo sapiens
uuuuuaucuaccuaaccuauggguacu

SEQ ID NO: 142711 - RNA, 46 nt, Homo sapiens
guaaaugaugauucuauaauaguuuuauuucuaaauaauagauaua

SEQ ID NO: 142712 - RNA, 64 nt, Homo sapiens
uauuacaguuaggguuuacauuguacuggggcuguuaaaccauuucacauucuuuguagcagug

SEQ ID NO: 142713 - RNA, 59 nt, Homo sapiens
gcaauuguagaauuauuuuggugacuuuuuuauucuuuuuauagaguccaaacucaacu

SEQ ID NO: 142714 - RNA, 90 nt, Homo sapiens
guccugggaggaauggaggugaguccaggcacaccucaucugugccuucagugacaacccaccaggagacuuauuuuacacgcugaggac

SEQ ID NO: 142715 - RNA, 37 nt, Homo sapiens
aauagcuggcccugauggaaaaaggaagucacaagga

SEQ ID NO: 142716 - RNA, 44 nt, Homo sapiens
ggugauguuaauuuaucacccaaucaagauauaaguccauuucu

SEQ ID NO: 142717 - RNA, 45 nt, Homo sapiens
aagacaggguaaggauggguucaguagaguuacauggagugaaau

SEQ ID NO: 142718 - RNA, 29 nt, Homo sapiens
gggaaugucgaggaggauugagagaauau

SEQ ID NO: 142719 - RNA, 46 nt, Homo sapiens
uacagagagaaguguuuuaaaccuauauccuaugggaucagcagaa

SEQ ID NO: 142720 - RNA, 50 nt, Homo sapiens
acauaacuuuuuaguaaauuaaaaauuuaaacugaauaagaccaauagaa

SEQ ID NO: 142721 - RNA, 57 nt, Homo sapiens
aaaaggaaagaauugguauaucaaguaguacuguauuuauaugggguagugccaaau

SEQ ID NO: 142722 - RNA, 47 nt, Homo sapiens
gaauuugauuacuguagacaccucauauaaguguaaucaguacagua

SEQ ID NO: 142723 - RNA, 42 nt, Homo sapiens
aacacaaggcagcacuucaguacuaugucuggggccauuuua

SEQ ID NO: 142724 - RNA, 41 nt, Homo sapiens
gccacuuuauuaauucauauaaaguuaguaauauuauacac

SEQ ID NO: 142725 - RNA, 17 nt, Homo sapiens
gagauuaucaugggaac

SEQ ID NO: 142726 - RNA, 55 nt, Homo sapiens
gguagcuaagguauuugaauuuauuuuucacaaaauacucuauauagcaguauau

SEQ ID NO: 142727 - RNA, 47 nt, Homo sapiens
agcuacagaagacuuuuuaaaagcuguagaauaaagucucaucauac

SEQ ID NO: 142728 - RNA, 47 nt, Homo sapiens
ugaagacugaagagcaguguagggguagaggagaaauagugugaauu

SEQ ID NO: 142729 - RNA, 51 nt, Homo sapiens
agagcccagcacggcucccagagccaagaggaagagugggauucagggaga

SEQ ID NO: 142730 - RNA, 47 nt, Homo sapiens
aaacugccagaagcaguaacauggcuggaguguagguugugaggagg

SEQ ID NO: 142731 - RNA, 25 nt, Homo sapiens
aggcuucuguuuuguagucacgaag

SEQ ID NO: 142732 - RNA, 76 nt, Homo sapiens
agcaaaaaaccaaaaagaacgaaaagaauaucagcagugauacucaguggggauggugaaauguuuccuuucagau

SEQ ID NO: 142733 - RNA, 41 nt, Homo sapiens
ugcagaaagagccagcuuccugaugguccuauaacccguau

SEQ ID NO: 142734 - RNA, 49 nt, Homo sapiens
gguuccgaagcauugccuguaaagaacagggcggucucuugaacaaaau

SEQ ID NO: 142735 - RNA, 43 nt, Homo sapiens
gcauaagugucuauagaauuugggucaguaucuccuaagacau

SEQ ID NO: 142736 - RNA, 18 nt, Homo sapiens
uaaucuguauuguaaaua

SEQ ID NO: 142737 - RNA, 44 nt, Homo sapiens
cuuggggcagagugccauaguggaaauaaaacuacauuuugguu

SEQ ID NO: 142738 - RNA, 127 nt, Homo sapiens
auguucuacaaaaucauacauucagaauaaucuggcuaaugggaaauauugguuuggggcagucuggcuuaugggaaauauugguuuggggcagucuggcuuaugggaaauauuaaguugggaccaa

SEQ ID NO: 142739 - RNA, 36 nt, Homo sapiens
acccagucuuuggucauaagccugacagcacgguga

SEQ ID NO: 142740 - RNA, 54 nt, Homo sapiens
uucuuagaaauguaaacaugggacuuagaauuacgaugcaguaaugcauuuggc

SEQ ID NO: 142741 - RNA, 44 nt, Homo sapiens
uguggauggucuuaaaaaugaguuaucauuaugaauaguuugau

SEQ ID NO: 142742 - RNA, 26 nt, Homo sapiens
ccaucacugaauucugggggccuuuu

SEQ ID NO: 142743 - RNA, 52 nt, Homo sapiens
uaaaaacaaaccuauaauuugugauaaugggugaaaaugugauuagaauuca

SEQ ID NO: 142744 - RNA, 41 nt, Homo sapiens
guuucuuuuuuuauuauccaaggaaugagauaugccagaaa

SEQ ID NO: 142745 - RNA, 49 nt, Homo sapiens
gaguccuagaacaguuuacuuaaugauaguguuauuuuaauuuucaauu

SEQ ID NO: 142746 - RNA, 61 nt, Homo sapiens
ccuugagaaguuguucuucgcauccagaaccaugggcaaugcucuaugguauaaaaacccc

SEQ ID NO: 142747 - RNA, 39 nt, Homo sapiens
aguaacuugccaagaacagagagccagggagugacauug

SEQ ID NO: 142748 - RNA, 58 nt, Homo sapiens
ggaggggagaugcugggguugaggcccuuaccuuuauuuauguuguucacugguacag

SEQ ID NO: 142749 - RNA, 44 nt, Homo sapiens
uaaaucacugugauccugcauacuccuugcccagaccccuccug

SEQ ID NO: 142750 - RNA, 45 nt, Homo sapiens
ugcaauuuaaggcaauuuugugugugugugugugugugugugugu

SEQ ID NO: 142751 - RNA, 68 nt, Homo sapiens
cugccucuugaaaauaauucucuccccucuggccauuccggccaggggucggagguuccccacaccuc

SEQ ID NO: 142752 - RNA, 45 nt, Homo sapiens
uuuuuuuuuuuuuggugcugauuuauuaaguagugucguuuugaa

SEQ ID NO: 142753 - RNA, 27 nt, Homo sapiens
caaucuuagcuuuugauugauuaaggu

SEQ ID NO: 142754 - RNA, 50 nt, Homo sapiens
uugguguuggcggugaugcugauaacauaaaugagauaagaaagaugaaa

SEQ ID NO: 142755 - RNA, 61 nt, Homo sapiens
ucugcuuaucaagggcucugaagaccgauuuagugaucccugagguguguuaguaaugaua

SEQ ID NO: 142756 - RNA, 75 nt, Homo sapiens
agauuuugcuccuugucaacugaagaaauuucauguauggagaccuggacuguucaaccccagguauaaacggug

SEQ ID NO: 142757 - RNA, 39 nt, Homo sapiens
uguagcuggagcuuccauguccugguuuaggaaacacaa

SEQ ID NO: 142758 - RNA, 31 nt, Homo sapiens
gauucaaggccagacgaaugaugcaaaauuu

SEQ ID NO: 142759 - RNA, 44 nt, Homo sapiens
uuucccccagcuuugccacuguuaaccuguuuggcuguaaagag

SEQ ID NO: 142760 - RNA, 25 nt, Homo sapiens
ccuaagauacuuauagcccugucac

SEQ ID NO: 142761 - RNA, 42 nt, Homo sapiens
uauagagggcacgucccucuacgucaucgcccgcugcgccuc

SEQ ID NO: 142762 - RNA, 42 nt, Homo sapiens
ggagcgagcgcggugcagccggagcggcgcucggggggaggg

SEQ ID NO: 142763 - RNA, 45 nt, Homo sapiens
cuuaaagaaaaucauauauggggucacaccauccucacgguaguc

SEQ ID NO: 142764 - RNA, 28 nt, Homo sapiens
acacccucguggaaaaaaagagggaaca

SEQ ID NO: 142765 - RNA, 31 nt, Homo sapiens
uuuuuuuccacgaggguguuuuuggcugcaa

SEQ ID NO: 142766 - RNA, 44 nt, Homo sapiens
ugcucgauuuuguugucaauagcuaccacacuugcaccagagga

SEQ ID NO: 142767 - RNA, 35 nt, Homo sapiens
gauguuuuguggaaccagugcaucccuaaguucag

SEQ ID NO: 142768 - RNA, 45 nt, Homo sapiens
ucuuagccugcgccuggauuucuccuauuuuuuauuuccgccuug

SEQ ID NO: 142769 - RNA, 44 nt, Homo sapiens
gugacuagcucugcuggagaugaggggagggaggggauacaagg

SEQ ID NO: 142770 - RNA, 51 nt, Homo sapiens
augaaaggguggauggaaugugaugcguuaggaaagaaagggagggccaac

SEQ ID NO: 142771 - RNA, 48 nt, Homo sapiens
auuccuuuccucucucugugccccagcuuccuccucuguagcguggag

SEQ ID NO: 142772 - RNA, 69 nt, Homo sapiens
caugcucggugcguguuagcuauuguuaugauuguuugggauucugcagguuguuaagugguggcugaa

SEQ ID NO: 142773 - RNA, 47 nt, Homo sapiens
gucuucugucuagucaccaccccaucccucucagggugcuuaacacc

SEQ ID NO: 142774 - RNA, 58 nt, Homo sapiens
gguguucgggaaaugucaguagagugagcggaucugcugagaguacacaguuuucccc

SEQ ID NO: 142775 - RNA, 19 nt, Homo sapiens
gaaacagagagccacguga

SEQ ID NO: 142776 - RNA, 27 nt, Homo sapiens
ugauuaaacaucagcucgauauggcag

SEQ ID NO: 142777 - RNA, 44 nt, Homo sapiens
agccccugugcuccugaagcuuauauucuaguuggggaaacaga

SEQ ID NO: 142778 - RNA, 42 nt, Homo sapiens
agcaggauuuauucagugagcaagucuggaaagggcugcucc

SEQ ID NO: 142779 - RNA, 93 nt, Homo sapiens
caccugagaguugaaggagcauccccucccugcuuugcgauggcuccagagacaagacgugugcccugcccccaccccacauugucuacuuug

SEQ ID NO: 142780 - RNA, 44 nt, Homo sapiens
acccccggggugauauuugggugguaguagaaaauuuuguauuu

SEQ ID NO: 142781 - RNA, 46 nt, Homo sapiens
ucagcuggcccagcccuagacucauuucuuaguaaaaugcacauac

SEQ ID NO: 142782 - RNA, 32 nt, Homo sapiens
uuuuagccuauuccuccccuuauuuaaaaaaa

SEQ ID NO: 142783 - RNA, 46 nt, Homo sapiens
acagggaggaauucuuccacagaauauucaggaccagaaccaagau

SEQ ID NO: 142784 - RNA, 42 nt, Homo sapiens
auucaccaaaucccuguaucgacauccguaaagccacaaggu

SEQ ID NO: 142785 - RNA, 45 nt, Homo sapiens
cauuuuugguauuagacucaucauuccaaugacaucuggauuaug

SEQ ID NO: 142786 - RNA, 45 nt, Homo sapiens
aguaacaucagcuaugaaagggauggagaacaagauaauugugaa

SEQ ID NO: 142787 - RNA, 49 nt, Homo sapiens
gaguccagcugccuaauucugaauauauauauauauauaucuuuucacc

SEQ ID NO: 142788 - RNA, 46 nt, Homo sapiens
cauugauguggccaaggucaacauccugauucggccugauggagag

SEQ ID NO: 142789 - RNA, 45 nt, Homo sapiens; identical to SEQ ID NO: 134328

SEQ ID NO: 142790 - RNA, 57 nt, Homo sapiens
aggauauuugggcugucuccggagucgcagugucuucggccgccggaagguggguga

SEQ ID NO: 142791 - RNA, 56 nt, Homo sapiens
ccgcacgucacccaccuuccggcggccgaagacacugcgacuccggagacagccca

SEQ ID NO: 142792 - RNA, 46 nt, Homo sapiens
uggguguaagaccguguuugucggaggauuaccagaaaaugcuacu

SEQ ID NO: 142793 - RNA, 42 nt, Homo sapiens
ucauuaagccuuguccucuggugucaauuuuuauaggcgauu

SEQ ID NO: 142794 - RNA, 27 nt, Homo sapiens
gacacugacaaagaugaacagucccaa

SEQ ID NO: 142795 - RNA, 42 nt, Homo sapiens
cucucuccucuggcagcccccagcagcugugucucugcuggg

SEQ ID NO: 142796 - RNA, 46 nt, Homo sapiens
cagcauugcaaaauugccuugguaauuguggcuuuugcagcugcug

SEQ ID NO: 142797 - RNA, 42 nt, Homo sapiens
aggauucaggccgccuucauguggacuuugcccaggccaggg

SEQ ID NO: 142798 - RNA, 36 nt, Homo sapiens
agauuucugaugagaagagggaugugauugauccuu

SEQ ID NO: 142799 - RNA, 69 nt, Homo sapiens
cugugccuuuaauaaagggcauaugcagugcagauacagauaucaucucacuuuucccuccagccuaga

SEQ ID NO: 142800 - RNA, 37 nt, Homo sapiens
cagaaaugaaaugagaugggcguggauuccaguggug

SEQ ID NO: 142801 - RNA, 45 nt, Homo sapiens
aaagcacaucugcacauucuagcuucuaaacugcauccaguucag

SEQ ID NO: 142802 - RNA, 47 nt, Homo sapiens
acuccauauugaauggcaaacuucauaaccuauuucauguucugugg

SEQ ID NO: 142803 - RNA, 45 nt, Homo sapiens
uccccauugcauuuagagaauauucacugucccuagcugacagag

SEQ ID NO: 142804 - RNA, 46 nt, Homo sapiens
uacagguaucuuccaggacccaaccaugagguucaaagcuccuaaa

SEQ ID NO: 142805 - RNA, 46 nt, Homo sapiens
aaaaaggaauuuuaugaaguguuaaaauguuugcccaugucuguag

SEQ ID NO: 142806 - RNA, 33 nt, Homo sapiens
gccaaugcauuaagugcuggaaacauuauuucc

SEQ ID NO: 142807 - RNA, 42 nt, Homo sapiens
uguuugcauugaaaauucaacuuagcugcaaguuucagccaa

SEQ ID NO: 142808 - RNA, 67 nt, Homo sapiens
gagcucauaagacuuuggcccaucauauaauggguauaaauacaugauuugaaguuggacagaugua

SEQ ID NO: 142809 - RNA, 47 nt, Homo sapiens
caugcagagagcuuguuaaagcagagucuguugggccccaucccuag

SEQ ID NO: 142810 - RNA, 45 nt, Homo sapiens
ccauuauaugauuuucauaaccacuaagggaguuaguagagacuc

SEQ ID NO: 142811 - RNA, 66 nt, Homo sapiens
ugaaaaaaccaagguacagaauagcguauauaauauuagcaccuuuguguaaguaaaaaagguuuc

SEQ ID NO: 142812 - RNA, 47 nt, Homo sapiens
uuuagucaguagggguaaucuaggcaggagauuuauuggauuuaaaa

SEQ ID NO: 142813 - RNA, 56 nt, Homo sapiens
uuaauuacccuauugaaaaagaauacaagaaauggagaauggcccagaaaauguug

SEQ ID NO: 142814 - RNA, 51 nt, Homo sapiens
acaccagaagauuuggaagagcuuugauguccuuuuuuauaauagagccuu

SEQ ID NO: 142815 - RNA, 46 nt, Homo sapiens
ucacugucagcuccaaaugcagcugagauuuguuccuuguccagaa

SEQ ID NO: 142816 - RNA, 54 nt, Homo sapiens
cucuugcaugucgcugaauugauuaaauaccaguugguaauuuaacauugugga

SEQ ID NO: 142817 - RNA, 35 nt, Homo sapiens; identical to SEQ ID NO: 49701

SEQ ID NO: 142818 - RNA, 44 nt, Homo sapiens
ucuuuccaccugacuuuuccuuguuucaaguguuaagccaccuc

SEQ ID NO: 142819 - RNA, 52 nt, Homo sapiens
aaauuuccgcacuaaucacaugugacacccaccuccaaugccugaugguguu

SEQ ID NO: 142820 - RNA, 46 nt, Homo sapiens
gaaugcucaaagugagcagcucaugggcauccgccgcgaagaagaa

SEQ ID NO: 142821 - RNA, 46 nt, Homo sapiens
gggaacagagugauuuaaauugcuccaguuguuucuccguacguag

SEQ ID NO: 142822 - RNA, 60 nt, Homo sapiens
aagcuguuuucacauguaaugacagccgagggcaccaucuccugaaagagaaauagacca

SEQ ID NO: 142823 - RNA, 41 nt, Homo sapiens
ucuugcccaaggaauucaaauaaauauuuauuuugggugga

SEQ ID NO: 142824 - RNA, 46 nt, Homo sapiens
cuguuucucuauucccgaggcuuuucuuuaugagaugugccuccaa

SEQ ID NO: 142825 - RNA, 42 nt, Homo sapiens
uauucaguaaauucucacaaugugugugggaccauauccuuu

SEQ ID NO: 142826 - RNA, 45 nt, Homo sapiens
agaaggugauguucuuucaggucauuaaaaugugggggacuaugg

SEQ ID NO: 142827 - RNA, 45 nt, Homo sapiens
aggcuccuaaggaauauuguaauugaugcuggaucaucaguguca

SEQ ID NO: 142828 - RNA, 241 nt, Homo sapiens
acaaaggauugaaaaccacuggccuguaaugugaggaugauggcugucauauagugcuuaacuggcaccucagcacuugcaaaggcuuuuuaaggaggcacugguaagaauaaaauauugcuaccugaaaaauuauacucaccagaaaugcaaaacaaaucauuuuaaugaacaaagcagaaacuuuuuuugugaggaugugagaaagguuaccucuuuucccaccuauuaggugggaaag

SEQ ID NO: 142829 - RNA, 26 nt, Homo sapiens
uggagucggggcucauacaaaaggag

SEQ ID NO: 142830 - RNA, 49 nt, Homo sapiens
ucuaaggaaacuuuccacagaauuuuaaacaacugaugcauccauacuc

SEQ ID NO: 142831 - RNA, 66 nt, Homo sapiens
auauauuauuuugugaaacuuuguguuugaaaauguuuauuucuguuuaugguguaaucauucuga

SEQ ID NO: 142832 - RNA, 43 nt, Homo sapiens
guuuugauuuuucucaauuuaagauacagaaauacagcaagcc

SEQ ID NO: 142833 - RNA, 64 nt, Homo sapiens
gaauuaguaauugugguauagaaauguuuuauagugaaagauucaaauuugcuuuucaagaaaa

SEQ ID NO: 142834 - RNA, 227 nt, Homo sapiens
gaggacaaagguugugucuugcuuuugucucucucuucccucccugcaacucucucuccccuccucccacucucuucccccuccccccuccucccacugucucucaccucccccaccccccacucucucucaucucucgcuguguccuguguauguguggguguguguguauuuggguguguaaauguugguucuuccacuacuggauuuuguaaucuaggauaaau

SEQ ID NO: 142835 - RNA, 52 nt, Homo sapiens
aacuuaaauuguaaaacauguugaaauuuuaaaaauuaauguuaauauggaa

SEQ ID NO: 142836 - RNA, 63 nt, Homo sapiens
aaacccacuguuaaaauuuaaaaaggugcuuuaaaauaaaacgccuauaaagauugugcagua

SEQ ID NO: 142837 - RNA, 46 nt, Homo sapiens
uuuguaugagcagcugucauaauuaaaagccgauaaaaguuuaaac

SEQ ID NO: 142838 - RNA, 45 nt, Homo sapiens
cagguucaccagucugucucauugccccuaacugcacuaugcaaa

SEQ ID NO: 142839 - RNA, 47 nt, Homo sapiens
uaaauugaugaguuuuacuuuauauuguuuacauuuaaauauuaggu

SEQ ID NO: 142840 - RNA, 54 nt, Homo sapiens
auagaacuugaauucaguauguuaaaaugauguuuuauauuuuugcaaucaaua

SEQ ID NO: 142841 - RNA, 84 nt, Homo sapiens
cuagaauggccugcaagcuguagcagagaaucagagacaucugucaacaaccuuccauuacugguacauguuggcaugaugucu

SEQ ID NO: 142842 - RNA, 27 nt, Homo sapiens
uauuuuugauugagaguguuggagaga

SEQ ID NO: 142843 - RNA, 41 nt, Homo sapiens; identical to SEQ ID NO: 49733

SEQ ID NO: 142844 - RNA, 42 nt, Homo sapiens
aauauaaguuuagauaauuuucaugaucuguugagaagaaag

SEQ ID NO: 142845 - RNA, 382 nt, Homo sapiens
aagguaggagauaaagacuucggcgauuugggcugggcgcggugauucacgccuguaaucccagaacucugggaagccaauggggguggggguggaucacuugaggucaggaguucaagaccagccugggcaacauggugaaaccccgucucuaccaaaaauacaaaaauuagccaggcgugguggcaggcaccuguaaucccagcuacuugggaggcuaaggcaggagaauugcuugaaccugggaggcagagauugcagugagcugagauugugccacuguacuccauccugggcgacagagacagacuccgucaaaaaaaaaaaaaaaagacugugacaauuugaaaacaccuugccaguuucauuauaagcaggaagu

SEQ ID NO: 142846 - RNA, 47 nt, Homo sapiens
cauauauaacuuuucuuaguuaacuuuguucauaacagugguguuug

SEQ ID NO: 142847 - RNA, 63 nt, Homo sapiens
cauauuaggaaaaguauucaaaaaaacaaaguaguaaucuaucaaugguucagaacuauaaug

SEQ ID NO: 142848 - RNA, 46 nt, Homo sapiens
gccgcuaucagaaaucuaggauuuuucaucucagugucccucagau

SEQ ID NO: 142849 - RNA, 45 nt, Homo sapiens
ggaucuacaguguuccgagugucugagaccacaaaaucagcagac

SEQ ID NO: 142850 - RNA, 45 nt, Homo sapiens
uuuguaaaaaucaaacuugugaaaggacccuggauccauauagaa

SEQ ID NO: 142851 - RNA, 45 nt, Homo sapiens
ccuaccgaucuguuaaaucaggauuacaggaagcagcuaagacaa

SEQ ID NO: 142852 - RNA, 96 nt, Homo sapiens
aacauuaugcaauuuugcgggugaucuggcagcagaagucauuacagaagcugagaaaauagcaaaaguccgaaauuguaugcuuuucaagcaaaa

SEQ ID NO: 142853 - RNA, 48 nt, Homo sapiens
aaguugagaguagugaaaguggagagcucccagaaguggaugugaagu

SEQ ID NO: 142854 - RNA, 46 nt, Homo sapiens
acuaaaaagcucaagggagaauuagccaaagaguuugcaccugcua

SEQ ID NO: 142855 - RNA, 46 nt, Homo sapiens
uaagagcaaaucagugaucccaaauauagauaaaaaugcaguauac

SEQ ID NO: 142856 - RNA, 46 nt, Homo sapiens
uuuaaaggagaaaaccccuccauuuucccacugugaucaggcagug

SEQ ID NO: 142857 - RNA, 46 nt, Homo sapiens
ugcccaagugcauauugccacaaaaaacagagaagaaaaagcagcu

SEQ ID NO: 142858 - RNA, 42 nt, Homo sapiens
cuaucacaaguugaugugaccuuuacaacaaaggcagcaguu

SEQ ID NO: 142859 - RNA, 46 nt, Homo sapiens
gucguuugacuuugaagacaaaguagugaaguuguaugcaaaagau

SEQ ID NO: 142860 - RNA, 56 nt, Homo sapiens
aaaaauaaaucuaaaaauaaauccuuaaugauuaaagauagcauucaaaaauuugc

SEQ ID NO: 142861 - RNA, 46 nt, Homo sapiens
cuaggcucaguucuucguacccaccauacuaauacccuaucaaaua

SEQ ID NO: 142862 - RNA, 48 nt, Homo sapiens
auccauagaggaugacuuugucacugcuuuugagcacuuagaagagga

SEQ ID NO: 142863 - RNA, 36 nt, Homo sapiens
guacaccuuggacacauucuugcaucagaagcacca

SEQ ID NO: 142864 - RNA, 38 nt, Homo sapiens
aaggaauggauaguaaguuucauaacauuucaggagac

SEQ ID NO: 142865 - RNA, 46 nt, Homo sapiens
ugcagucuaaaugaaaaugaaauuauuuguaugaagaauauaaaua

SEQ ID NO: 142866 - RNA, 38 nt, Homo sapiens
caggucuugggauggguaggauuucuacaugggaagac

SEQ ID NO: 142867 - RNA, 45 nt, Homo sapiens
aaucuaguucuuuuuauuggugauagauauuuacagaccaaaagc

SEQ ID NO: 142868 - RNA, 45 nt, Homo sapiens
ccuauuagucuuugagcauuuccuugcauucuggcacaguuagau

SEQ ID NO: 142869 - RNA, 43 nt, Homo sapiens
aaucuuauuauuugaauuaguaacauugaacuacugcaaagau

SEQ ID NO: 142870 - RNA, 47 nt, Homo sapiens
ugcuguucaccuauuagguauuauucuguuuuauuuuucuaguguuu

SEQ ID NO: 142871 - RNA, 37 nt, Homo sapiens
aaguuguguuuauuguugcugaauaaguaguuuugaa

SEQ ID NO: 142872 - RNA, 50 nt, Homo sapiens
uugucucacaguuugcagggcugcuccuuuuaaacuggccaugccaacau

SEQ ID NO: 142873 - RNA, 49 nt, Homo sapiens
ggaagagaaagaaaaaugcuuuaucaguuuaaaaacagccuggaaagau

SEQ ID NO: 142874 - RNA, 24 nt, Homo sapiens
cugucuuguggucugcauuuuauu

SEQ ID NO: 142875 - RNA, 46 nt, Homo sapiens
uaauuuuaggaacuuacugucuggaaaaggaacucaaaccaauuug

SEQ ID NO: 142876 - RNA, 38 nt, Homo sapiens
cauuucuauguucucuagcaaaagaaaauucuuagugu

SEQ ID NO: 142877 - RNA, 51 nt, Homo sapiens
cuaacacagaaagcuuuuccaaguuaauaauuucuaaaauuaaauaucagg

SEQ ID NO: 142878 - RNA, 118 nt, Homo sapiens
ucucucucccccuuuguauucucagugucuagcuacacauaauaggacuuugauaaauauuuuugaaugaagguaauagaaaacccgaacuucucuauauuuguguacuuucacaaac

SEQ ID NO: 142879 - RNA, 53 nt, Homo sapiens
uggaaauuauaggaaaaaggaacuugaauugguaauuuggcaaagauuuggga

SEQ ID NO: 142880 - RNA, 44 nt, Homo sapiens
cacugaagcaccucuguggcuugauauuuugcugugggugaaau

SEQ ID NO: 142881 - RNA, 42 nt, Homo sapiens
gaaaaagaaagaaaagaaagaaagaagaaagggagagaaaga

SEQ ID NO: 142882 - RNA, 53 nt, Homo sapiens
auuuaauagcacauugauugccguuauuaucaguaguaggagaaucaaucaac

SEQ ID NO: 142883 - RNA, 61 nt, Homo sapiens
uacagcaaauaaguaggcuuuuauuaagcuaaucaauguugaauaaaauguauaagcaaau

SEQ ID NO: 142884 - RNA, 45 nt, Homo sapiens
gaaccuccuauggauugcaccaaaaggaacaacagaagcaccgua

SEQ ID NO: 142885 - RNA, 45 nt, Homo sapiens
caagagacacugccacugaaauagccaucaaugugaaggcgcugu

SEQ ID NO: 142886 - RNA, 42 nt, Homo sapiens
auauguuaaaugauaagggaaaauaaaaugaguaaaacaaga

SEQ ID NO: 142887 - RNA, 45 nt, Homo sapiens
gaauuuaauaauaaaagagaggagcacccugaaaaaugcagguaa

SEQ ID NO: 142888 - RNA, 46 nt, Homo sapiens
gagauggauauucagaaaaaugugucaugaacaauuacuuugggau

SEQ ID NO: 142889 - RNA, 50 nt, Homo sapiens
uggaucuaguacuuuuuugcucaauaaauauuuguccauuguuaagugua

SEQ ID NO: 142890 - RNA, 47 nt, Homo sapiens
uuuaucauuaucucuuuuuaaucuggacuuuuugccaacaguuaaaa

SEQ ID NO: 142891 - RNA, 38 nt, Homo sapiens
aucaagacuucuuauucccuccauguaagucucaagaa

SEQ ID NO: 142892 - RNA, 47 nt, Homo sapiens
aaaacuaccaucuuugcuuucauugguucacaacaggaccuucuuac

SEQ ID NO: 142893 - RNA, 48 nt, Homo sapiens
cauuuauacuagaaaauuuugcgcugugugaaauggaauauuauuuga

SEQ ID NO: 142894 - RNA, 43 nt, Homo sapiens
ucuuuauacuaaaauaaaauccuuuuugcuuucaguuuaagau

SEQ ID NO: 142895 - RNA, 48 nt, Homo sapiens
agcagugguauuacagaugguagaagggaggaugccuuuucucucguu

SEQ ID NO: 142896 - RNA, 41 nt, Homo sapiens
gcugcucuacaaugauagugauugccuugcacuggggcuga

SEQ ID NO: 142897 - RNA, 45 nt, Homo sapiens
uuucucuuuggguauuaacaaucauuagauugaauuaucccuuuc

SEQ ID NO: 142898 - RNA, 46 nt, Homo sapiens
uuugcugaaaucauuuagaauugaggcauuuguguaauuccaaaua

SEQ ID NO: 142899 - RNA, 26 nt, Homo sapiens
ccucaauauuguucuuaaggggagaa

SEQ ID NO: 142900 - RNA, 48 nt, Homo sapiens
aauuucccaugugcguuguaauaguuccaaaacaaugcccuguguuaa

SEQ ID NO: 142901 - RNA, 48 nt, Homo sapiens
agaaguuagucuuuguaucuuggaaauaaacagauuaguaguaagaaa

SEQ ID NO: 142902 - RNA, 44 nt, Homo sapiens
uuuuugaagaagggcaauggaauuuaccuagacgucacuguggu

SEQ ID NO: 142903 - RNA, 46 nt, Homo sapiens
ucccauuauuagaaaucuuuagucaucucauucccugugagcugaa

SEQ ID NO: 142904 - RNA, 87 nt, Homo sapiens
guucccucugacuucagugauuccucccccaucugucacggugggaauccuaccaauucuucaaagcuuauuucagauaacccauuu

SEQ ID NO: 142905 - RNA, 45 nt, Homo sapiens
uacugacuuucaaaaguguuuuguuacgauuaaauuguaaugauu

SEQ ID NO: 142906 - RNA, 48 nt, Homo sapiens
aauuggaacuaugggaagaaguucauucagagagauuuggcacauagg

SEQ ID NO: 142907 - RNA, 40 nt, Homo sapiens
cuuaggaaaauacacugcugcuagcaggugaggucauagg

SEQ ID NO: 142908 - RNA, 43 nt, Homo sapiens
uuaaaagaagagucauuuuucacacucgggccaaacuucaaga

SEQ ID NO: 142909 - RNA, 52 nt, Homo sapiens
ccuuccaagugaaaagcucagcaagccuucgaguccugccuggcucugcaua

SEQ ID NO: 142910 - RNA, 45 nt, Homo sapiens
gacaguggcaagaaagagggacggggaacagguaacguccaaguu

SEQ ID NO: 142911 - RNA, 40 nt, Homo sapiens
cagccuuauuccugggugggggaggcaguugcagcuuucc

SEQ ID NO: 142912 - RNA, 48 nt, Homo sapiens
ccuccugagacgcuuuccugcuuuauaauuuuuuccauuuugacugug

SEQ ID NO: 142913 - RNA, 47 nt, Homo sapiens
cuugccagaaauaacucuaauuaacauuagggguacuucauuccaga

SEQ ID NO: 142914 - RNA, 45 nt, Homo sapiens
uaaucuguauauaaaauaacuuuuucuuuccuuaaaucuuucaga

SEQ ID NO: 142915 - RNA, 51 nt, Homo sapiens
aggcauauugaaaugcuguaugacauaaccgcucuuaucuuugaggcaaug

SEQ ID NO: 142916 - RNA, 48 nt, Homo sapiens
agguuaaguccaagaauuaaacuuuaaucauucaaauuuaaaaaagga

SEQ ID NO: 142917 - RNA, 42 nt, Homo sapiens
gguccuagggaguaaccaugggacugagcagcugagguagga

SEQ ID NO: 142918 - RNA, 46 nt, Homo sapiens
ugucagccuggugugggaucauguucagcugcuugggugcaguaag

SEQ ID NO: 142919 - RNA, 52 nt, Homo sapiens
caguggaauaugaaguuaggucgucagcugagaaucaagauggagaggguau

SEQ ID NO: 142920 - RNA, 40 nt, Homo sapiens
uccauacaagccacuuuauccauaaaaugcaguaggggca

SEQ ID NO: 142921 - RNA, 35 nt, Homo sapiens
gagaauuacuggagcaauguccuuauauaugcgag

SEQ ID NO: 142922 - RNA, 44 nt, Homo sapiens
cagcucuggugacgccgaggacaccgcgugggccggguugucag

SEQ ID NO: 142923 - RNA, 57 nt, Homo sapiens
caaaucucauuuugccgagauauuaaaaugcauuuaauggucaaugcauggcuauaa

SEQ ID NO: 142924 - RNA, 44 nt, Homo sapiens
guguccucuuaggguggugaugaauaucaaaauaauggccuaau

SEQ ID NO: 142925 - RNA, 48 nt, Homo sapiens
uuugaagccucucuucuaaagugccuauuaucaguaaauaugggugag

SEQ ID NO: 142926 - RNA, 34 nt, Homo sapiens
auccuuccaaaagauauaaauuacacuucuaaca

SEQ ID NO: 142927 - RNA, 45 nt, Homo sapiens
ucgguaaccuucaaggucucucauuuggaucugcaacagugagag

SEQ ID NO: 142928 - RNA, 45 nt, Homo sapiens
aaaacuaucauacuuacaugcccuucucuucacucugggguaagc

SEQ ID NO: 142929 - RNA, 46 nt, Homo sapiens
uuaccuacuaacaauauuaguuuaaaaccuaggguagccagaggau

SEQ ID NO: 142930 - RNA, 80 nt, Homo sapiens
gacaagucugacggcacuaucaguuuuauuaacaugcugcccuccugcuccuuuggcucgaaauguaucuauucgcaaau

SEQ ID NO: 142931 - RNA, 31 nt, Homo sapiens
ggaaaaggcugaaaaaagucugcaagaagaa

SEQ ID NO: 142932 - RNA, 24 nt, Homo sapiens
acucaauccaaauaauuccacugc

SEQ ID NO: 142933 - RNA, 44 nt, Homo sapiens
ggugcagaugcuaauuucagugucuggauuaaaaggugucaaga

SEQ ID NO: 142934 - RNA, 45 nt, Homo sapiens
gguaugacugguaucaaacagaaucucaaguagucauuacacuua

SEQ ID NO: 142935 - RNA, 43 nt, Homo sapiens
uaaaaucuuugaauuuccuuuuucauacaguagagggagacaa

SEQ ID NO: 142936 - RNA, 92 nt, Homo sapiens
auucgggcuguaaacucagcaaaugcguuaucauagaaaaucuggaaaagauaaaggaguuuaggaaguaaucacucagacucaccacucag

SEQ ID NO: 142937 - RNA, 24 nt, Homo sapiens
aaguauaauuucaaguugagguca

SEQ ID NO: 142938 - RNA, 53 nt, Homo sapiens
uuuguuuucuggccuugaugagcuuuauauucauauuguguuguguaauugaa

SEQ ID NO: 142939 - RNA, 41 nt, Homo sapiens
acuagguugucuaguuauuuucuaauuauuugugugccaag

SEQ ID NO: 142940 - RNA, 50 nt, Homo sapiens
uauugccuauuaaaauaaucuuacuuuuuugaugggagaguauggagugg

SEQ ID NO: 142941 - RNA, 55 nt, Homo sapiens
caucuccuuauacaagaaauugggauaaauugguuggugagaucaaagaagaaga

SEQ ID NO: 142942 - RNA, 107 nt, Homo sapiens
aaauauuguuuugaguuuauauugagcuauauauuuuaucuguauaaucuauuauauauguauugcauagaguuuauauugagcuguauauaauagccaauauuugg

SEQ ID NO: 142943 - RNA, 42 nt, Homo sapiens
aaggaaaguugaaaucaauccuccugaugauauggaauggaa

SEQ ID NO: 142944 - RNA, 45 nt, Homo sapiens
acagagacuaugacaggacagucacucugcucuccccuccccguc

SEQ ID NO: 142945 - RNA, 82 nt, Homo sapiens
uaagauggcuuuacaggaagcaaugugccuucgauucuugagacacgguguauaucuaugcgcacagccuuuccuuucagcu

SEQ ID NO: 142946 - RNA, 42 nt, Homo sapiens
cgggguguccgggucggugcugcaaugggacacgccgcugau

SEQ ID NO: 142947 - RNA, 45 nt, Homo sapiens
agaagauugauuguagauaauucuaggauuagguauuuuggguaa

SEQ ID NO: 142948 - RNA, 47 nt, Homo sapiens
ucucaaagucauccaccaagccugccuuggccacauuggccuuguag

SEQ ID NO: 142949 - RNA, 44 nt, Homo sapiens
uuagcaccugucucguccccaguggcuuuuccagaacuacugcc

SEQ ID NO: 142950 - RNA, 45 nt, Homo sapiens
ugucugccauuuuuugaccauggaacacauuuugucacggguaag

SEQ ID NO: 142951 - RNA, 46 nt, Homo sapiens
caguaaucagcuugaauuuucuaaaugcaacuucaucauucugcaa

SEQ ID NO: 142952 - RNA, 46 nt, Homo sapiens
gugacgagcgucuuuccaauauuucuuauauugaacauagcaggug

SEQ ID NO: 142953 - RNA, 609 nt, Homo sapiens
uauuuggcuuuugaauccuguaaagaaaagcaccaacacaaauaaaugcauaaucaaauaauuuagauucauuaacauauaguggauaaaggaagguauucuagaagagaguuucucaaccucagugcuauugacacuuuggacauucuguugggucuguccuccuguguacuguacaacauuuagcagcaucucuggucuuuaccacuagaugacaaggcuccugaggcccuugacaagagggucaugacuaugccaagucaacccucccaacacaccagcucugguccuuaccaugugcuuuuuccuuagcuuauuuuacugucucuucuuucccuaucuggagacaccuacaaccaucaaccaguacuaguuuuauuauucacucaagcuccugcagacaaaguccacaguccucaugauaagaagucaccugcaacacacuccguguaacuaacuguacuuauuguauucccagagcuaagcagugagcauauauacaaccucaggucaaaccacaaagacaaugcucauaggaacaaugcucauaggaacaaaaaugaaaauagccacacauacgguuuuuccuugucuaagagguagcagcag

SEQ ID NO: 142954 - RNA, 42 nt, Homo sapiens
uucaucucagugacugcuuugguugcuucuucaggagaugag

SEQ ID NO: 142955 - RNA, 46 nt, Homo sapiens
uuaauuucucaucaucaauagugucauccaaguucuuaauguagag

SEQ ID NO: 142956 - RNA, 703 nt, Homo sapiens
auaugauuuuaccacuuauuucuuuuccauucaucucuuccacagccuagagaggaaaaauaugucuuuaaaauaaaguugcagcgauggggucuuauucuggaggucuaagucccaaaaaauauucuuucuacuauaggacuaaaaacuaaauucacuccaccucugaagucugucacacaaauccaaacuuccucaucuguaaagugagguuaauauuuaaauggguuauugauccagauaauauagaaauaguacagguguauaaacacaagugugcugacaugagccuagggcgauauaauauuccggcugccaguaaauucugcaggugcuuuuguggguauuuaagugauaaauauugagggucuggcacaaugcuuugcccacaaguagcugccgugcuguuaucaaaucagcacucacugggcuuuaguucucucaccuuugcagcauaacaaacgucuguccuauucuuucaacaacugauagcugaggugacagguaugugccaagugcuuuguaaacaccuacaugaaguuaacaugcggaacccaggaagaugaucccagaguauaguaaugguacaucuacuaccagauacucagaccgucccagcucuagguaggugcuagcaagacccuacccauacucuggggcaaccucuuaaaagcuuuucccaaucuuugugguauacucaccu

SEQ ID NO: 142957 - RNA, 210 nt, Homo sapiens
caccuugacacuuagggucuuaccuauuaccaaaggacagaacuauuaguaacaccaucuugagcacagcucaggaacagaaggcuucccucuggaaacucacuugaagcaaaucucuggagcagugcccucaucucuuaagaaaaaacagaugggucugguagacugugaaaggagacaaggaaccccaacuuaccaaacugacugaau

SEQ ID NO: 142958 - RNA, 96 nt, Homo sapiens
ccagauuuucucaaagagggaucccucugagaccacaugaugcggauuggcuuucccuuaaucacaucaaaguucaugguguccaaagcccgcuca

SEQ ID NO: 142959 - RNA, 41 nt, Homo sapiens
cugcgaagcccgaaagcggcggaggcggcagcgacccgggg

SEQ ID NO: 142960 - RNA, 40 nt, Homo sapiens
uuuucagaaucccuuccauuacagguuguaaguacaccgg

SEQ ID NO: 142961 - RNA, 72 nt, Homo sapiens
agccuggaaaaugcguuggaaggugaaguuaguuguaauacucauuuuugucuacuagguacgaucacaaaa

SEQ ID NO: 142962 - RNA, 39 nt, Homo sapiens
ggaggucggcgguggcgggagcgggcuccggagagccug

SEQ ID NO: 142963 - RNA, 25 nt, Homo sapiens
ggcagccccgcgcugagcucgccga

SEQ ID NO: 142964 - RNA, 24 nt, Homo sapiens
gcgaauccggcccgcgacgcggcg

SEQ ID NO: 142965 - RNA, 46 nt, Homo sapiens
gccugucccaaggaaaaaaaaauuggaaacauacccacaugcaaac

SEQ ID NO: 142966 - RNA, 45 nt, Homo sapiens
gaaaccacuaaccgccgcgggagcgcagugcacgaaaggguuuag

SEQ ID NO: 142967 - RNA, 52 nt, Homo sapiens
caguguuaaaaaauguaggcuuaaguuauacuaggagagaagauagcuggaa

SEQ ID NO: 142968 - RNA, 91 nt, Homo sapiens
uugaaaaguauuugguuauuucaguuugucaauuuucugcucuggaggcacuaagaagauaagggaugacugagcuuuuuacagaguaggg

SEQ ID NO: 142969 - RNA, 62 nt, Homo sapiens
uuuucuauuaaaaaaaaccacgcuuuuuaauguuugugacuuaaacagaauugagguaguuu

SEQ ID NO: 142970 - RNA, 47 nt, Homo sapiens
ggaauccugcuuguacaggggugaugguaccuuguuauugcaucaga

SEQ ID NO: 142971 - RNA, 82 nt, Homo sapiens
gagaacuggccucuacaaaucccagagaccgugcguaacacacaucaagacagaaccuguugccauuuucagccaccagagu

SEQ ID NO: 142972 - RNA, 48 nt, Homo sapiens
ggccccgacccaggcccucccugaguucaccaguauauucagcucaca

SEQ ID NO: 142973 - RNA, 48 nt, Homo sapiens
agggccaccuguaccagcuacugaauacaccggaucuagauaugccca

SEQ ID NO: 142974 - RNA, 51 nt, Homo sapiens
auacacaaugccaagucaguuucuuccacaacaggccacuuacuuuccccc

SEQ ID NO: 142975 - RNA, 46 nt, Homo sapiens
ucacaaaacauccaaccugucagauacaauagaaggaguaaccccg

SEQ ID NO: 142976 - RNA, 49 nt, Homo sapiens
ggccggugauguucccucacuaaggccuucuugcccugucaccgcucag

SEQ ID NO: 142977 - RNA, 52 nt, Homo sapiens
aaacaaaacucauuuucuuccauagcaaauaauuuugcucugagaaagccau

SEQ ID NO: 142978 - RNA, 38 nt, Homo sapiens
gaacuauuguuuuuuucacuuuuggaaguccuugagag

SEQ ID NO: 142979 - RNA, 44 nt, Homo sapiens
ugaaugcuuauaccugcgauucaggaacuugaccugccggcaaa

SEQ ID NO: 142980 - RNA, 40 nt, Homo sapiens
ucucuuauguaauagcuuuuuuugguuuucuuucuguccu

SEQ ID NO: 142981 - RNA, 70 nt, Homo sapiens
ugaagcacccuagcauuucuuuggaaaauaauuguaauugcuuuaaaaugucaaguuaccuuauguuuua

SEQ ID NO: 142982 - RNA, 42 nt, Homo sapiens
agcaccccuuauagauguggauguucgcauguauuauuugua

SEQ ID NO: 142983 - RNA, 80 nt, Homo sapiens
gaugucuacaaggggcggaacacauugcuauuacucuaaaguugcucccaaguauacuguuuugucuuuauaaaucaaca

SEQ ID NO: 142984 - RNA, 33 nt, Homo sapiens
aaauagaauugcuggaguggagauagaaauaau

SEQ ID NO: 142985 - RNA, 42 nt, Homo sapiens
aaugaucucuccuggucuguucagaggcuuucuagaaggagu

SEQ ID NO: 142986 - RNA, 55 nt, Homo sapiens
augaauuucuuuaauaaguguuuccuauuuuucucccuuuugauuuuuagaagca

SEQ ID NO: 142987 - RNA, 75 nt, Homo sapiens
cuuaacauuuuuguaaaguauguuaaugacuuuaucagcguggauaguaugcauguuuaacuugaacauaguuuu

SEQ ID NO: 142988 - RNA, 45 nt, Homo sapiens
gaaaguuucacguuaacagcaugagaacuuaaaaauacaguugau

SEQ ID NO: 142989 - RNA, 60 nt, Homo sapiens
gggaacaaaaacuaauaguacugugcaaaaauuuuuuuugugaucaauuuacaucuacaa

SEQ ID NO: 142990 - RNA, 50 nt, Homo sapiens
uuaugaauauuuagugguuuugaaaguuaaacagcuggcaagcuuugggg

SEQ ID NO: 142991 - RNA, 41 nt, Homo sapiens
acucaagggaagagaacugugaaagaauggaauggguaggu

SEQ ID NO: 142992 - RNA, 46 nt, Homo sapiens
agccauacaaguguaccugggaaggcugcgacuggagguucgcgcg

SEQ ID NO: 142993 - RNA, 45 nt, Homo sapiens
cccgugugacccguuccagguccccugggcucccucaaaugacag

SEQ ID NO: 142994 - RNA, 46 nt, Homo sapiens
cuaaaacuggaaauguauauuuuguauauuugagaaaacagggaau

SEQ ID NO: 142995 - RNA, 49 nt, Homo sapiens
caagauuuuacuuggcauugaguaguuuuuuucaauaguagguaauucc

SEQ ID NO: 142996 - RNA, 75 nt, Homo sapiens
aaucagcuuuauagguuuauuacaaguuuuuuaggauucuuuuggggaagagucauaauucuuuugaaaauaacc

SEQ ID NO: 142997 - RNA, 91 nt, Homo sapiens
augaauacacuuacaguuaggauuugugguaagguaccucucaacauuaccaaaaucauuucuuuagagggaaggaauaaucauucaaaug

SEQ ID NO: 142998 - RNA, 61 nt, Homo sapiens
ugaugaugcaguuuucauauaucgagauguucgcucgugcaguacuguugguuaaaugaca

SEQ ID NO: 142999 - RNA, 45 nt, Homo sapiens
gaugcuguuaaccaaagggcagaauaaauaagcaaaaugccaaaa

SEQ ID NO: 143000 - RNA, 29 nt, Homo sapiens
acagcuguauaguuguagaauuuuuugag

SEQ ID NO: 143001 - RNA, 43 nt, Homo sapiens
uauguuaucuucuaugccuggggaugggaaaaugcaggcaggu

SEQ ID NO: 143002 - RNA, 46 nt, Homo sapiens
ccacacaccaccugacaucagagguuugcauccaaaaggccucaac

SEQ ID NO: 143003 - RNA, 46 nt, Homo sapiens
auuuacagccuuuggcugaacagcucuugcaccaauucuugcccau

SEQ ID NO: 143004 - RNA, 46 nt, Homo sapiens
ugucgggacacuuagcgggacuggugucaacaacuugguuugagug

SEQ ID NO: 143005 - RNA, 46 nt, Homo sapiens
cagauacugaaaauaggaguauuuuacuuauuucucaagagacaga

SEQ ID NO: 143006 - RNA, 26 nt, Homo sapiens
gcagcccagaggauuugcggcugcag

SEQ ID NO: 143007 - RNA, 45 nt, Homo sapiens
ggggacaaaggugggacaagaggcucuguaaucaucucucgggca

SEQ ID NO: 143008 - RNA, 41 nt, Homo sapiens
gcuggcaaaggcgcaggugcccguggagcugcacgccacca

SEQ ID NO: 143009 - RNA, 35 nt, Homo sapiens; identical to SEQ ID NO: 49967

SEQ ID NO: 143010 - RNA, 46 nt, Homo sapiens
aagugaauagcgaaccauuuucacagauuaccucaggcugcuuagg

SEQ ID NO: 143011 - RNA, 46 nt, Homo sapiens
uguucuuaaagugaacacgaagauuggaaccucuugauuugccuga

SEQ ID NO: 143012 - RNA, 45 nt, Homo sapiens
aacugcucaggccaucaaggguaugcauauacgaaaagccacgaa

SEQ ID NO: 143013 - RNA, 49 nt, Homo sapiens
acagagaagacacagccuccggcggucagagauagcuaaacacagagaa

SEQ ID NO: 143014 - RNA, 35 nt, Homo sapiens
auuugguuauuaaguugauuuuuaaggaguaauca

SEQ ID NO: 143015 - RNA, 47 nt, Homo sapiens
ccacauuuucuccuaucagguuaccuggacccaugguugugucacag

SEQ ID NO: 143016 - RNA, 49 nt, Homo sapiens
guaugaacuuuuccaacuuggcaacuguacauuuccccaucuccgaccu

SEQ ID NO: 143017 - RNA, 102 nt, Homo sapiens
cccuuucugguguaaucaaggcgcugccugcuuuuuugagggaauugaugauguucacuggaaggaaaaugggacauuaguucaaguagcaacuauaucagg

SEQ ID NO: 143018 - RNA, 50 nt, Homo sapiens
acuccaaguacagggaagaaagaaacguaccaaacacacaagguggaugg

SEQ ID NO: 143019 - RNA, 46 nt, Homo sapiens
ucaaccaaauggcaaagugggugaaacaggacaaugaaacaggaau

SEQ ID NO: 143020 - RNA, 98 nt, Homo sapiens
aggaccuuuaacaaguuggcugaauuuggagcagaguucaagaacauagaaaccaacuauacaagaauauuucuuuacaguggagaaccuacuuaucu

SEQ ID NO: 143021 - RNA, 78 nt, Homo sapiens
gggaaaugaaacaucuguuuuugggccaacaggaaacaagacucuugguuuagccauaaaaagauuuuauuaccccuu

SEQ ID NO: 143022 - RNA, 46 nt, Homo sapiens
guugagucucuugcaaauuuuugaugcagugauugugcacaaacag

SEQ ID NO: 143023 - RNA, 46 nt, Homo sapiens
gauuuuacuuuugugaauuccuuagccuuucuuccuuggugcauaa

SEQ ID NO: 143024 - RNA, 31 nt, Homo sapiens
acuaacuuuacaacuucuauaacuuuuggaa

SEQ ID NO: 143025 - RNA, 41 nt, Homo sapiens
ggauugcuguaaagauguaaguuguguauguuuggcagguc

SEQ ID NO: 143026 - RNA, 52 nt, Homo sapiens
uuuucuuaguuucuuaaacgugcagugaaacuuuuagguuuuccccucuuca

SEQ ID NO: 143027 - RNA, 43 nt, Homo sapiens
ggugugugcucauauuguccaagcuauucgcauggaagcuacc

SEQ ID NO: 143028 - RNA, 46 nt, Homo sapiens
gcugaccugaaagaacauaugguuggaaucauauucagcaggagua

SEQ ID NO: 143029 - RNA, 70 nt, Homo sapiens
uuggaaagcucaucucuggagaugcugaaccuacaccagaacaagaggaaaaagcacuauugucaucacc

SEQ ID NO: 143030 - RNA, 124 nt, Homo sapiens
gauuccaggcacauuggcuggguaacaagugaacuuccaggaggggauaaucacaucauaaaaauugaauuaaaaggcccagaaaauacacugagaguucgacaagucaaaguccugggcugga

SEQ ID NO: 143031 - RNA, 44 nt, Homo sapiens
uauuauagggaauuaucuauuuacagaacacuaaauugacaagu

SEQ ID NO: 143032 - RNA, 43 nt, Homo sapiens
uaaaguuaccucaaugaccuucuuaacuggcaaagcaguagaa

SEQ ID NO: 143033 - RNA, 45 nt, Homo sapiens
uuuguauuacucugguggcacuuaauaauaaucuuugaccuauag

SEQ ID NO: 143034 - RNA, 80 nt, Homo sapiens
aucuuaguauucaugcacuuucauuucugaauuuagcaacaagcuuuaucaccuggaauuucaccaaccaaacaucauug

SEQ ID NO: 143035 - RNA, 69 nt, Homo sapiens
ugacagacggcuccacagaaaccuuuugggaaucaggagaugaagauaaaaacaaaacuaagaacauca

SEQ ID NO: 143036 - RNA, 96 nt, Homo sapiens
ucuucccuuuugagacauccgucuccugagcuuucucggcuaaucucagcccacagcucucuuucuaaaggagaacgaaauuuccaguggccaguu

SEQ ID NO: 143037 - RNA, 49 nt, Homo sapiens
gagaguaacauauuuaaucuuucugaaccuugguuuccucaguaaaagu

SEQ ID NO: 143038 - RNA, 46 nt, Homo sapiens
uagcauuggaaaagcaccacugaaagaugaacaggaaaugagagca

SEQ ID NO: 143039 - RNA, 32 nt, Homo sapiens
cagcaccugcgaugacagcagugaauuuaaga

SEQ ID NO: 143040 - RNA, 46 nt, Homo sapiens
uccucgggaacguucuaaaucagacucuuacacacuugauccagau

SEQ ID NO: 143041 - RNA, 71 nt, Homo sapiens
cagacagccuggcucuaaugccucaaagaaaagcauaaaauagaaugaaggagagacacugaaugaaggca

SEQ ID NO: 143042 - RNA, 40 nt, Homo sapiens
auuuucaguuuuuuauaccacuugaaacccuucagucaga

SEQ ID NO: 143043 - RNA, 61 nt, Homo sapiens
acuguccugagccauagagaaauagagcgugacuauacacacuuaacacaugcacggaagc

SEQ ID NO: 143044 - RNA, 23 nt, Homo sapiens
uuauacuagaaaauuuaaauuca

SEQ ID NO: 143045 - RNA, 24 nt, Homo sapiens
aagacauuuaaaguugauuuaaag

SEQ ID NO: 143046 - RNA, 36 nt, Homo sapiens
caacucuuaaaaucucagcauuugcuuaccgcuacu

SEQ ID NO: 143047 - RNA, 43 nt, Homo sapiens
cuuugaauguucaucugagaaugggaugggaauggagggagaa

SEQ ID NO: 143048 - RNA, 46 nt, Homo sapiens
agauccauaaugaugaugguguguggcugaggcugaaugaugagac

SEQ ID NO: 143049 - RNA, 46 nt, Homo sapiens
cggggcuucgcauccguagccacccuucccuucagagugagcagau

SEQ ID NO: 143050 - RNA, 179 nt, Homo sapiens
aaggauaaauuguggaaaggaaguagaagugagagaauggaguuugauauaaaucggagaagagauguaagaccuuauuagaggggguuguaauaccaaagggagguguuagugaagauucuaaaguuugugugcuaaucgaaaugauucacuaaauugagaguaauugaugaugcaug

SEQ ID NO: 143051 - RNA, 42 nt, Homo sapiens
uugucagcuaucagaugcuacugagagauugcugaggaugaa

SEQ ID NO: 143052 - RNA, 43 nt, Homo sapiens
guuugcuuccuuuuacuguaaguacaggaggaguuagaaguag

SEQ ID NO: 143053 - RNA, 52 nt, Homo sapiens
cauucccaaacaguaucugugaaauguuaauucaggucccaggaaaggaaau

SEQ ID NO: 143054 - RNA, 46 nt, Homo sapiens
aaagggucuagcucuuucucauucaccaacuauauuagaagcacuu

SEQ ID NO: 143055 - RNA, 51 nt, Homo sapiens
uaucuaauuuuuagagaaauuuauuaaagaccuacuauguaucuggauugc

SEQ ID NO: 143056 - RNA, 48 nt, Homo sapiens
ugcauagaauuauugaagaggagccuucuauuauacaauuuuauagaa

SEQ ID NO: 143057 - RNA, 46 nt, Homo sapiens
agcacgugcagcuugagcaguaacggcacaaaccaaaccagaggac

SEQ ID NO: 143058 - RNA, 47 nt, Homo sapiens
ugugcgcuugaggaacuauggaagccguacagccaauggagauggag

SEQ ID NO: 143059 - RNA, 49 nt, Homo sapiens
gaaaggaacguacacaacggaugacucacccagugauauagcugagauc

SEQ ID NO: 143060 - RNA, 49 nt, Homo sapiens
aauucucuucacucuguaaaagcuagugcuaaccgauuuacaaaaacaa

SEQ ID NO: 143061 - RNA, 41 nt, Homo sapiens
ggcccccgccacccucaucugugagaacaggaaggagagag

SEQ ID NO: 143062 - RNA, 46 nt, Homo sapiens
uuguugaguauucuucacuggagcuggaccaccuuagucuuaggag

SEQ ID NO: 143063 - RNA, 45 nt, Homo sapiens
gauauuuuacuugguggucuuggucuguuuggagguagaggagaa

SEQ ID NO: 143064 - RNA, 46 nt, Homo sapiens
uauucuaaagaagauuauagugugguaaacagguuugaaaguaugu

SEQ ID NO: 143065 - RNA, 46 nt, Homo sapiens
cagcuaugcaggacuuaaaaauggguguugcaaguacagaggaaga

SEQ ID NO: 143066 - RNA, 45 nt, Homo sapiens
uuauuuaccaucaagagaguuagugaaacuguugaacacuaaaga

SEQ ID NO: 143067 - RNA, 49 nt, Homo sapiens
uauauuauaauuguuacauaugcauauuucaugccuucauccccaacac

SEQ ID NO: 143068 - RNA, 37 nt, Homo sapiens
guuaaggccuucaucauaaauuacccaaacuacuaua

SEQ ID NO: 143069 - RNA, 69 nt, Homo sapiens
guggucugugucugugguugucucaccauggaaacaggaguauuuaugaagucuggaaagauagagagc

SEQ ID NO: 143070 - RNA, 42 nt, Homo sapiens
accuuuggaaggguccugcauugggcaggaauagaccaacau

SEQ ID NO: 143071 - RNA, 25 nt, Homo sapiens
cagaaagcagaugccaagacaggau

SEQ ID NO: 143072 - RNA, 49 nt, Homo sapiens
aaacuaaagaagucaucacagagauaaguuggagacuguguacugagaa

SEQ ID NO: 143073 - RNA, 62 nt, Homo sapiens
aaagguuugguugaggguagugauuggggacagggagaaaaccacaaagcaauauggcugaa

SEQ ID NO: 143074 - RNA, 83 nt, Homo sapiens
uucaaaguuggauugcaaaagccaaggguaaagaaaaggcuuaaagcaagcucaaugaaggaaauugugagaagggaggagga

SEQ ID NO: 143075 - RNA, 44 nt, Homo sapiens
uguuauuuacacauuccaaacaaaaauuuuuauauucuggaaug

SEQ ID NO: 143076 - RNA, 69 nt, Homo sapiens
ugaguauacaagacggguuuuguacuuuauaaauuauauuuaagauauuaacuuuuaugugaaauggug

SEQ ID NO: 143077 - RNA, 58 nt, Homo sapiens
aaguauuuguaagauaauuugauugauuuaaauugaacuucuugauuaucuauuugag

SEQ ID NO: 143078 - RNA, 59 nt, Homo sapiens
gauuuguaguaaacucgguaacauuuuuauuuugguuuuguagcaagauuaauacaaau

SEQ ID NO: 143079 - RNA, 58 nt, Homo sapiens
ggguuaggugcccccuuuaccaucaauauaaagcccaagcuccuuucucucucucucu

SEQ ID NO: 143080 - RNA, 43 nt, Homo sapiens
aaaugauuuauuuuauuuuauuaaaauaaauuuggcuguauau

SEQ ID NO: 143081 - RNA, 46 nt, Homo sapiens
cugucaaauuuagaguguuuucaaauuugaagacauuuuugauguu

SEQ ID NO: 143082 - RNA, 57 nt, Homo sapiens
ugaaggguacuuugauauuuaauuugacauuuaugaaauuuuauuagagggcaguag

SEQ ID NO: 143083 - RNA, 47 nt, Homo sapiens
caagaagaaaaacggcaacguguaaucagaaggcacagauuagagga

SEQ ID NO: 143084 - RNA, 46 nt, Homo sapiens
uguugcaaggccugugcaagagaguuagauggucaagaggcaagac

SEQ ID NO: 143085 - RNA, 25 nt, Homo sapiens
aaaagaacagguaauuggacucugu

SEQ ID NO: 143086 - RNA, 37 nt, Homo sapiens
gauuuuuuauuuuugagcaaaugugcuggcuuacucc

SEQ ID NO: 143087 - RNA, 48 nt, Homo sapiens
uaugggcaaagcucacacuuguguuuuaaugaagaauggagaggugug

SEQ ID NO: 143088 - RNA, 67 nt, Homo sapiens
gaaggaaagauugugguauauacagccugcaauaauggaaguaguucuguuauuucuaaagauggag

SEQ ID NO: 143089 - RNA, 44 nt, Homo sapiens
uuuccaggaucuaacaagaauacaugugaauuacaacuugggaa

SEQ ID NO: 143090 - RNA, 48 nt, Homo sapiens
uauggagauacaugcaguauugaugaaauaugguauucuagccaagau

SEQ ID NO: 143091 - RNA, 46 nt, Homo sapiens
gucuacuucagaaugauggauuuuuucuuuaucuauuaugcaagga

SEQ ID NO: 143092 - RNA, 46 nt, Homo sapiens
uaaaacauuuguguguguguguguuucaucuucaccacuaaaugac

SEQ ID NO: 143093 - RNA, 61 nt, Homo sapiens
aauaauuggaggaaggauggguagauggaaauauggacaaacagggauagaugaaaggaug

SEQ ID NO: 143094 - RNA, 36 nt, Homo sapiens; identical to SEQ ID NO: 50079

SEQ ID NO: 143095 - RNA, 44 nt, Homo sapiens
caaggaagccaaaguuuucaaacugcugcauacuuugacaagga

SEQ ID NO: 143096 - RNA, 50 nt, Homo sapiens
ccaaaacaguacaauuaguuucuaaauugaggggacuuuuuuuuguauuc

SEQ ID NO: 143097 - RNA, 25 nt, Homo sapiens
ugugcagaguggagaaucagauagu

SEQ ID NO: 143098 - RNA, 43 nt, Homo sapiens
gaggacaaucaucagauggcuuuugguaaauaacauugauaga

SEQ ID NO: 143099 - RNA, 45 nt, Homo sapiens
agacguuauuuauuguaggaauaugucaggaaguaaugcgggauu

SEQ ID NO: 143100 - RNA, 42 nt, Homo sapiens
ggaauucauucuggaaauggaggcuuuggcuaggauggggca

SEQ ID NO: 143101 - RNA, 45 nt, Homo sapiens
uauaugguaaaaaggaaagugaugccaagagggaacugauagacu

SEQ ID NO: 143102 - RNA, 46 nt, Homo sapiens
uuccaaccagcauggcacuguauguuuuuccacacaaaauagaaau

SEQ ID NO: 143103 - RNA, 110 nt, Homo sapiens
ggugguauaaccaugcacuugggaggcaccauagcacaguggcuaaauguuagagcacuggagguagacucccuuaguucacgucuaccuuuuucuacuuguguuaaauu

SEQ ID NO: 143104 - RNA, 46 nt, Homo sapiens
gccaaucaaaaucggaacauucuguuggggaaagggguuggacagg

SEQ ID NO: 143105 - RNA, 48 nt, Homo sapiens
ucaugucuuacucuuuuauuuuuggucucagugacuguguagaaugug

SEQ ID NO: 143106 - RNA, 58 nt, Homo sapiens
gaguauauuacauaacuucuaugccucaguuuuuuaaauauguagaauggggaucaua

SEQ ID NO: 143107 - RNA, 51 nt, Homo sapiens
aaccuaauggacucagugacuuugaugacagucuaacaaagugguuaagag

SEQ ID NO: 143108 - RNA, 51 nt, Homo sapiens
cagauguagaggaagaauguucugggaauuuauaaaggccuugaaauggga

SEQ ID NO: 143109 - RNA, 50 nt, Homo sapiens
ugccaggcaguauugcagaugcugaagauguagcggugagcaagauagac

SEQ ID NO: 143110 - RNA, 46 nt, Homo sapiens
uaggcaucauauccuauucguuuugauaaucccaaugucuagcaca

SEQ ID NO: 143111 - RNA, 61 nt, Homo sapiens
gaaggauauucaaguauaggagguugggugggauaugcaaauaugggaggcuaaauggaga

SEQ ID NO: 143112 - RNA, 92 nt, Homo sapiens
auaacuuuugaggaaguggucagaauagagggauguggugaggagugaauggaauguguuuuugguaacucaaggggauuucaaaguugagg

SEQ ID NO: 143113 - RNA, 64 nt, Homo sapiens
gaggaaaguagacuugggguuucggcucugaaugaaugauagaauuauuuguauagggacacaa

SEQ ID NO: 143114 - RNA, 47 nt, Homo sapiens
gcugcaguuucucgugugugugugugugugugugugugugugugugu

SEQ ID NO: 143115 - RNA, 29 nt, Homo sapiens
cucuuuuccccaguguuuucggagggaug

SEQ ID NO: 143116 - RNA, 41 nt, Homo sapiens
gucuguuugauaucacaggcaaagcauucagccuuuuacca

SEQ ID NO: 143117 - RNA, 45 nt, Homo sapiens
ugcuuagaaauccagauucuuugacccuaugcaucaaacuuuuaa

SEQ ID NO: 143118 - RNA, 51 nt, Homo sapiens
aaaucuucauauugucuguaacauuaauuaacuuauggagccuaacagaag

SEQ ID NO: 143119 - RNA, 42 nt, Homo sapiens
guucaaauuuuauauuuuucucucuggcuuucuauucuugau

SEQ ID NO: 143120 - RNA, 47 nt, Homo sapiens
cuucaccacaaaacucccuacccucugugguacuucgcaccuacgau

SEQ ID NO: 143121 - RNA, 56 nt, Homo sapiens
gaaaugcuaccaaacggcccaaacagaauugcagccguuuuguaacucuuucuugg

SEQ ID NO: 143122 - RNA, 47 nt, Homo sapiens
gucaccuguuuaaccacuuuuccauguuuguuaccccagucacacag

SEQ ID NO: 143123 - RNA, 36 nt, Homo sapiens
uuaguuggaaaccggaagauugauauaaaauucagc

SEQ ID NO: 143124 - RNA, 45 nt, Homo sapiens
uuuauaugucaggauaggagugguagaaugguuugagauaaggaa

SEQ ID NO: 143125 - RNA, 46 nt, Homo sapiens
agggauuggaauaaaaugaaaaaaugcauagucuaugccacuucca

SEQ ID NO: 143126 - RNA, 34 nt, Homo sapiens
gagauaauugguugaaaaagauaaaauugcucuu

SEQ ID NO: 143127 - RNA, 47 nt, Homo sapiens
auaauuccacacauauaacauuuugagaugacaaaauguuaggaaca

SEQ ID NO: 143128 - RNA, 53 nt, Homo sapiens
augugucuuucccucugaucuccugacaucuagaauuaagaucuguguagcag

SEQ ID NO: 143129 - RNA, 23 nt, Homo sapiens
gggaggaauugaggaguuggagg

SEQ ID NO: 143130 - RNA, 44 nt, Homo sapiens
agucaugaaagggauagaauuacuacuuuugagggcuggggaaa

SEQ ID NO: 143131 - RNA, 43 nt, Homo sapiens
agaaaaagaaacucagggaucacugggagaagccauggcauua

SEQ ID NO: 143132 - RNA, 45 nt, Homo sapiens
cagacuaguuaccuuauggucaccacuccugcaacaacaacaaau

SEQ ID NO: 143133 - RNA, 46 nt, Homo sapiens
acucaguagacuaaagaaggaaucuauuugcccuacuccaccagug

SEQ ID NO: 143134 - RNA, 42 nt, Homo sapiens
uuuccauggacuggaaaaccuggaauuccugcaagcagauaa

SEQ ID NO: 143135 - RNA, 46 nt, Homo sapiens
ccaucacgaccuuuccaacuaagcuuauuaaauaacggcuugacga

SEQ ID NO: 143136 - RNA, 46 nt, Homo sapiens
gcaaacucagcacaggucucugccuccuuggguuuaucaguaaaaa

SEQ ID NO: 143137 - RNA, 66 nt, Homo sapiens
gucagcuucuggcaggcuggccucaggcggagucugggucacagggaggagcagcagcaggguggg

SEQ ID NO: 143138 - RNA, 43 nt, Homo sapiens
ggaaaaggcagagacaguuuggcgaaaaagacacagggaagga

SEQ ID NO: 143139 - RNA, 44 nt, Homo sapiens
aaagcaauuaaguggucaccucaacauaagggggacaugauccg

SEQ ID NO: 143140 - RNA, 47 nt, Homo sapiens
uggcaaugaaacagugucuaggcuuuagggcugaauuacaaugacau

SEQ ID NO: 143141 - RNA, 41 nt, Homo sapiens
cugauugacaaaacaacggcugcauuucaacaaggaaagau

SEQ ID NO: 143142 - RNA, 47 nt, Homo sapiens
gugguaggaaacacaaagagaaugugaaagacuacuaucagaaaugg

SEQ ID NO: 143143 - RNA, 46 nt, Homo sapiens
gcguuugcuuugcacuucggaaccuguugcguuuugacccacggag

SEQ ID NO: 143144 - RNA, 45 nt, Homo sapiens
ggaggccggacgaggacgacgagaucucugccauuuuggagccca

SEQ ID NO: 143145 - RNA, 46 nt, Homo sapiens
uaacuucucggcggugcccccuccccgcggcggcaguuugcccuuu

SEQ ID NO: 143146 - RNA, 44 nt, Homo sapiens
ggaggaggagcgcucugcccggccgccgcuaccugcggggagcu

SEQ ID NO: 143147 - RNA, 23 nt, Homo sapiens
ugcacacccagugccggcuccgg

SEQ ID NO: 143148 - RNA, 48 nt, Homo sapiens
aauuaugcacagugaggcuccugcccauccaauaaacagagcggcucc

SEQ ID NO: 143149 - RNA, 25 nt, Homo sapiens
auuugguuuguucguuuuugagggg

SEQ ID NO: 143150 - RNA, 148 nt, Homo sapiens
uucucacaccuuuaggaugaggauuauaacaauaacuacaucgcaaaguuguuguaauuaaaugaauuagugcguguucaaaaccaaaccagaccaagugguucaauaaauaucugcugaauaaauaaaugaaugaacaaaguggcac

SEQ ID NO: 143151 - RNA, 50 nt, Homo sapiens
ugccaacaggucuccugguuuucaauaauuagaguugaugcuuagcacag

SEQ ID NO: 143152 - RNA, 43 nt, Homo sapiens
gugguacuuaauuugaugauggagauuucuguccugggcaacu

SEQ ID NO: 143153 - RNA, 43 nt, Homo sapiens
cgucgcacauacuggaaccaauagaagaacuuucagaggaaga

SEQ ID NO: 143154 - RNA, 51 nt, Homo sapiens
cuuuaacuuaauuauuuaaaacuauaauuucuguagaguguaguuaaugga

SEQ ID NO: 143155 - RNA, 44 nt, Homo sapiens
ugacagguggaaagaagaagaaaaggagaaacuaguugaugaaa

SEQ ID NO: 143156 - RNA, 44 nt, Homo sapiens
ggaaaaguauuucacagaggaggcaguggucagucauaucaaau

SEQ ID NO: 143157 - RNA, 49 nt, Homo sapiens
ggaaucacuggaguagagcuggucuggcugaggucaccuagauagagaa

SEQ ID NO: 143158 - RNA, 75 nt, Homo sapiens
ccuccauguuugggugaauggugaugcuuucugugauggagggccagggucgggaggcaauuucaaggaggaaga

SEQ ID NO: 143159 - RNA, 39 nt, Homo sapiens
uuguggacccagaagcuacagaggacccuggguuucugu

SEQ ID NO: 143160 - RNA, 62 nt, Homo sapiens
uuuuagguaggggaagggcaugaucuaauuaauguguaccuuagcaugacccuucuagcugu

SEQ ID NO: 143161 - RNA, 34 nt, Homo sapiens
uauaaaugauauuauacuuauagaucuguacuaa

SEQ ID NO: 143162 - RNA, 60 nt, Homo sapiens
guggucucauucucauucucauaccacuucucuuugucucuacucccuuugcuuuaagaa

SEQ ID NO: 143163 - RNA, 46 nt, Homo sapiens
uuauaguuuaauguauuuuaauagcaaacuuacaggaacagcacag

SEQ ID NO: 143164 - RNA, 45 nt, Homo sapiens
uuggacgauuuaacguuauuaaagcaacuuagaaaagagcagaca

SEQ ID NO: 143165 - RNA, 31 nt, Homo sapiens
ggggagaaacuggugcauguuagaagggaag

SEQ ID NO: 143166 - RNA, 32 nt, Homo sapiens
cccucuuuuauugguaaagaaaaugcagaaaa

SEQ ID NO: 143167 - RNA, 51 nt, Homo sapiens
cuuaguuuuuuauuuuccuuauagcucaaaucuaauccaagugaaaaugaa

SEQ ID NO: 143168 - RNA, 46 nt, Homo sapiens
ugcagcguuugcguucacaagcacuuaacgcuuuuggaaguggaga

SEQ ID NO: 143169 - RNA, 51 nt, Homo sapiens
gaugcagaacuacgggaacuucgagcugaauguuuuauaaaagaaggagaa

SEQ ID NO: 143170 - RNA, 42 nt, Homo sapiens
gcuauuaggguuuguucugaaguuuuacagauggaaccugac

SEQ ID NO: 143171 - RNA, 34 nt, Homo sapiens
cuuucuuuccuguguaacaaccacuuagucuuaa

SEQ ID NO: 143172 - RNA, 43 nt, Homo sapiens
acccagauaacuuccagaaugaagaagaaaagaaaaaagcuga

SEQ ID NO: 143173 - RNA, 64 nt, Homo sapiens
acacuggagcugagauucuucucuucacagccuugcagaguaagucagugccuacaaguguaag

SEQ ID NO: 143174 - RNA, 45 nt, Homo sapiens
cugaguuuuuauagggaauuucauguaacaagacugguuuagaaa

SEQ ID NO: 143175 - RNA, 75 nt, Homo sapiens
aaggaauuacuuuagauagauaggaauugcuaccuuuauucuggaaagguuuuguuucugccucaaagcauuuug

SEQ ID NO: 143176 - RNA, 53 nt, Homo sapiens
uuuaauucacugugggaggcauccugaccacggacauccauaacagcaaagca

SEQ ID NO: 143177 - RNA, 60 nt, Homo sapiens
uccugaaacauagguggacaaauuuuuaacugagagacaaaaaucacauaguugaauuga

SEQ ID NO: 143178 - RNA, 30 nt, Homo sapiens
accuuacagcuuucauuuugcuuuaauguu

SEQ ID NO: 143179 - RNA, 52 nt, Homo sapiens
agaaaguaacaacuguugaguuucagccuugauggcugucggcaguuuucug

SEQ ID NO: 143180 - RNA, 45 nt, Homo sapiens
uuguuaguggcaguuuauccuguaauuucaaaugacguuaagagg

SEQ ID NO: 143181 - RNA, 48 nt, Homo sapiens
ucuguggcugaaacacuuaccugcaguggaaagccgagcaaggaggag

SEQ ID NO: 143182 - RNA, 48 nt, Homo sapiens
aaaauauuacucuugcugugagguuuuaguuuguuuugaaugagaaaa

SEQ ID NO: 143183 - RNA, 41 nt, Homo sapiens
gcagauggagaugaucuuccuucagcucgaacuuucuguga

SEQ ID NO: 143184 - RNA, 82 nt, Homo sapiens
cugaagguuaaagacuuaggaguugaucauguagucaaggaccauaaucacaauugucauagguauagcaauauguagugau

SEQ ID NO: 143185 - RNA, 52 nt, Homo sapiens
gaaaggaugcaaggaauguuguaaagaaugaaguaaucaaacucagugguag

SEQ ID NO: 143186 - RNA, 44 nt, Homo sapiens
aauaaauauauauaacaugaagaauugaugacuaaauccugaaa

SEQ ID NO: 143187 - RNA, 49 nt, Homo sapiens
uuucaggccuauguuguaaaaagaguuuuaaguacucuaaguuuuuuug

SEQ ID NO: 143188 - RNA, 46 nt, Homo sapiens
gaaaauaauuucuaaugguuaauccaguuuaugcauaauaccaaug

SEQ ID NO: 143189 - RNA, 65 nt, Homo sapiens
uuuuauuuccaauaacauguuguacuucaguguuaauauucauuaugcuuucagucuuuagccag

SEQ ID NO: 143190 - RNA, 47 nt, Homo sapiens
auaaaugaagggaagaaggaauugagucuggacuugccgcauaugga

SEQ ID NO: 143191 - RNA, 36 nt, Homo sapiens
uugaugguaagauuuauucaaauucuugauuuuaau

SEQ ID NO: 143192 - RNA, 24 nt, Homo sapiens
ucuuugcagaaauugugaggcaga

SEQ ID NO: 143193 - RNA, 52 nt, Homo sapiens
auagcugucauaaaucuuugacuuuugaauauuuacauucuucaguauaauu

SEQ ID NO: 143194 - RNA, 59 nt, Homo sapiens
cagaagaaaguugaccuugugucacuauuuauuuuaugcccugaucagacuagcaacuu

SEQ ID NO: 143195 - RNA, 45 nt, Homo sapiens
cccaauaagaccaaugaaaucgccaaugccaauucccaucagcag

SEQ ID NO: 143196 - RNA, 49 nt, Homo sapiens
ccaaggaagcacggaagcgcagugaagagcgccuccaggccaagaagga

SEQ ID NO: 143197 - RNA, 45 nt, Homo sapiens
acgguuugguggccacugaggugucgacgugguuuuaugucagag

SEQ ID NO: 143198 - RNA, 46 nt, Homo sapiens
uuguuggaccaggugugaucagacugcuaucugaauaaaauaagau

SEQ ID NO: 143199 - RNA, 42 nt, Homo sapiens
uuuuguauuugcaggguuugucauuaauaauuaaugccccuc

SEQ ID NO: 143200 - RNA, 44 nt, Homo sapiens
ccucugggagcuggagaaucgcucugguggauggguguacagau

SEQ ID NO: 143201 - RNA, 49 nt, Homo sapiens
agugguggaggaacuucaucccacugaaauuccuuuggcauuugggguu

SEQ ID NO: 143202 - RNA, 46 nt, Homo sapiens
aucuccgacaccaugguggcccagcucgugcagcggcuccagaggu

SEQ ID NO: 143203 - RNA, 24 nt, Homo sapiens
gagggaacuugggguccauugaag

SEQ ID NO: 143204 - RNA, 41 nt, Homo sapiens
gagguagguaccuggcuggccuuuucggagugggaggggag

SEQ ID NO: 143205 - RNA, 60 nt, Homo sapiens
ugggguuugggggugacccgugaaaugacuucauagcucugagggacuguugugcauguu

SEQ ID NO: 143206 - RNA, 87 nt, Homo sapiens
ggggggcagugauucuggggacuggaucuucacaauccgagaaaaagaucccaagaaucucgagaauggagcucuucagccaucgga

SEQ ID NO: 143207 - RNA, 45 nt, Homo sapiens
augcaaagaaaacuuccuacuugaccgagcucaucgacagguaca

SEQ ID NO: 143208 - RNA, 47 nt, Homo sapiens
uuauguuuuuaaauaucaguuaaaaauaccuuuuucaaaaccucaga

SEQ ID NO: 143209 - RNA, 41 nt, Homo sapiens
ucagauaaaccaaccauggaaugacaguuuuugaacagcug

SEQ ID NO: 143210 - RNA, 67 nt, Homo sapiens
ucauuccuuugccuaacugcuugguugugccacaggccugugcugggcagaaggagguggggcagcu

SEQ ID NO: 143211 - RNA, 49 nt, Homo sapiens
aacguccugcugucugagcauggcgaggugaagcuggcggacuuuggcg

SEQ ID NO: 143212 - RNA, 41 nt, Homo sapiens
agaaauacugaaaggacucgauuaucuccauucggagaaga

SEQ ID NO: 143213 - RNA, 42 nt, Homo sapiens
gagguggccagagaagaggugugccgaagagugggccuggca

SEQ ID NO: 143214 - RNA, 70 nt, Homo sapiens
augaacuuucacuuuuacuguuuaaaaguaaaaauaucuuuggaagcugaggaauggcugcugggagaag

SEQ ID NO: 143215 - RNA, 34 nt, Homo sapiens
uugucuucaguuaaguuaggcugcaggguugaga

SEQ ID NO: 143216 - RNA, 53 nt, Homo sapiens
ccagaauccuccaugucccagccauuauaccccuggaguuuucugccacugag

SEQ ID NO: 143217 - RNA, 54 nt, Homo sapiens
cguuguaguuucaguguuuacuuuuugggaaauuaaaccagcuaggauacuuaa

SEQ ID NO: 143218 - RNA, 74 nt, Homo sapiens
uauccauugaggucaaaccaaggaaaccaggguuaaagaauggaggaagaaugccaacaagaagagcaaauguu

SEQ ID NO: 143219 - RNA, 45 nt, Homo sapiens
gaaagugguugccauaaagaucauugaucuggaagaagcugaaga

SEQ ID NO: 143220 - RNA, 59 nt, Homo sapiens
ccucucgauuaaucacccaauugauauguuuagugcaguacuuuaaguggaaguuggau

SEQ ID NO: 143221 - RNA, 61 nt, Homo sapiens
uuuuauaaaaaggacagcuugauuuucagauuuugggagggcguauuggaaagacugauaa

SEQ ID NO: 143222 - RNA, 46 nt, Homo sapiens
caaugcuuuaaaauggcugacauaucagucagcgcuagggucggug

SEQ ID NO: 143223 - RNA, 49 nt, Homo sapiens
acugagucuggugacugauuaauuaggucauuugugcuagcaacauggg

SEQ ID NO: 143224 - RNA, 49 nt, Homo sapiens
ggggugagcggggcaggcuucagugaugauggugauggagggagggagg

SEQ ID NO: 143225 - RNA, 24 nt, Homo sapiens
aggggacugcuuugauugaguuuu

SEQ ID NO: 143226 - RNA, 49 nt, Homo sapiens
agugcugggugccccuuuagaaggcauugcagcacuucagggaagagga

SEQ ID NO: 143227 - RNA, 45 nt, Homo sapiens
cauccgagacguggguucggagagcaccuuggggacuugcugaac

SEQ ID NO: 143228 - RNA, 41 nt, Homo sapiens
cugaagaagaaacacauccaagugaaacugagaggucagcu

SEQ ID NO: 143229 - RNA, 48 nt, Homo sapiens
gccccaggcgcaucuggccguugagcgggugcggguggccgccugggg

SEQ ID NO: 143230 - RNA, 42 nt, Homo sapiens
cgccgccacuguugguggugguguagcccgagagggcaggag

SEQ ID NO: 143231 - RNA, 46 nt, Homo sapiens
aaagucuauugguugcaagacaacuugagugauuuggcuccgcgaa

SEQ ID NO: 143232 - RNA, 22 nt, Homo sapiens
cggccaagcggcguuaugcaca

SEQ ID NO: 143233 - RNA, 46 nt, Homo sapiens
gacuuugaacuuggcucagcucuucugugcccugcagagagaggag

SEQ ID NO: 143234 - RNA, 45 nt, Homo sapiens
gagcagcaaaggcgaaaucaaagcgaaagagagaaugggucaaag

SEQ ID NO: 143235 - RNA, 40 nt, Homo sapiens
gggagggaggccggggcgggagacuagggggugcgggggg

SEQ ID NO: 143236 - RNA, 82 nt, Homo sapiens
cucccaggucucggcugcggugggcugcguucgccaccgccuccguugauuucgaugggcgccgccaacgcugcagcggcag

SEQ ID NO: 143237 - RNA, 44 nt, Homo sapiens
aaaucaacggaggcgguggcgaacgcagcccaccgcagccgaga

SEQ ID NO: 143238 - RNA, 36 nt, Homo sapiens
cgcggucacuaguuccgggcccagcgcccaggcccg

SEQ ID NO: 143239 - RNA, 42 nt, Homo sapiens
gacgccuggacuccgccugccgccccggcgcccccgccgcgg

SEQ ID NO: 143240 - RNA, 39 nt, Homo sapiens
agaguugaaagcccgucgguucugcaaagaggagcaguc

SEQ ID NO: 143241 - RNA, 46 nt, Homo sapiens
aucgagccccacuccccaaggcagagagaguucgacguucccaagg

SEQ ID NO: 143242 - RNA, 41 nt, Homo sapiens
ucucuuuuuuuuaaaacaacauacugugaacuuuguaagga

SEQ ID NO: 143243 - RNA, 85 nt, Homo sapiens
ucauguuuugaguuugagugugugugugcaugaggcauaucauuaauaguaugugguuacauuuaaccauuuaaaagucuuagac

SEQ ID NO: 143244 - RNA, 70 nt, Homo sapiens
gcuuaagaggguuuuuuguuuguuuguuuguuuguuuguuuuaagaaaucacucucuaguaacaggagac

SEQ ID NO: 143245 - RNA, 41 nt, Homo sapiens
cagagcaaaguuaccggacagcaauuaaacacagaaggaaa

SEQ ID NO: 143246 - RNA, 57 nt, Homo sapiens
agauuaaaucccaaguauguucaugccaugaauaaucuuggaaauaucuuaaaagaa

SEQ ID NO: 143247 - RNA, 58 nt, Homo sapiens
gcaaaaaccuggcugauaaaggcaaccagacagcugccaucagauacuaccgggaagc

SEQ ID NO: 143248 - RNA, 39 nt, Homo sapiens
uccucugggcuugcuacucacuuuguauuguaaaguccc

SEQ ID NO: 143249 - RNA, 24 nt, Homo sapiens
cuuaggaaaaaggccagugguaug

SEQ ID NO: 143250 - RNA, 25 nt, Homo sapiens
cauaggauuuuggccaggagcagga

SEQ ID NO: 143251 - RNA, 42 nt, Homo sapiens
uugagcugacaggugucgaggugauccucaggacagcaagcc

SEQ ID NO: 143252 - RNA, 46 nt, Homo sapiens; identical to SEQ ID NO: 139890

SEQ ID NO: 143253 - RNA, 46 nt, Homo sapiens
gcuuugucucggcauggccuguaauggugaaaguguuugcugccag

SEQ ID NO: 143254 - RNA, 45 nt, Homo sapiens
guuaaaguggaucacuguuccuugguuuguaaacauaugcaccuc

SEQ ID NO: 143255 - RNA, 58 nt, Homo sapiens
cgagcaguuccuuucccaccaaugcacacuugugccugcaguuuggcaaguuuuuccu

SEQ ID NO: 143256 - RNA, 46 nt, Homo sapiens
ugaaaaagugguuguugagggcaaugacagccccagcauugaaggu

SEQ ID NO: 143257 - RNA, 42 nt, Homo sapiens
cucuucaaggggucuacauggaaacugugaggaggggagauu

SEQ ID NO: 143258 - RNA, 50 nt, Homo sapiens
aagaaaaaguaucccuaaugaccucaccaaccaaucaaggauuuauaaaa

SEQ ID NO: 143259 - RNA, 48 nt, Homo sapiens
gccagaggauaaauauacugcccagcuggaugcugaagacaaagaaga

SEQ ID NO: 143260 - RNA, 46 nt, Homo sapiens
cucaaagucauccaccaagccugccuuggcuacaugggccuuguag

SEQ ID NO: 143261 - RNA, 65 nt, Homo sapiens
uaccccagaacuaaaaggccauugcuaauucccugaaauccuggaaugagacccucaccuccagg

SEQ ID NO: 143262 - RNA, 41 nt, Homo sapiens
gacacgcugggggucggcaccuucggcaaagugaaggguga

SEQ ID NO: 143263 - RNA, 44 nt, Homo sapiens
cggcgcggccagcacaggccgggugggggugggggugggguagg

SEQ ID NO: 143264 - RNA, 43 nt, Homo sapiens
guguuuguaaaaaaaaaaauguucauuuuugcccccaucccuu

SEQ ID NO: 143265 - RNA, 44 nt, Homo sapiens
aacacaaacaccaaauucaggauagugguuacuucugaggacag

SEQ ID NO: 143266 - RNA, 58 nt, Homo sapiens
gauugguguuauguguauauaugucugauaguaaucuguugaacauuaaccaaaguca

SEQ ID NO: 143267 - RNA, 83 nt, Homo sapiens
ugacugggcauaaaguagcugugaagauacucaaucgacagaagauucggagccuugaugugguaggaaaaauccgcagagaa

SEQ ID NO: 143268 - RNA, 47 nt, Homo sapiens
caggcuucuacuuggggaccuuugcaguugcuauucccucucccagu

SEQ ID NO: 143269 - RNA, 49 nt, Homo sapiens
ucaucaguacaccaucugauauuuucauggugauggaauaugucucagg

SEQ ID NO: 143270 - RNA, 80 nt, Homo sapiens
cuguuccaacagauccuuucugguguggauuauugucacaggcauauggugguccauagagauuugaaaccugaaaaugu

SEQ ID NO: 143271 - RNA, 44 nt, Homo sapiens
auugucuuuuucuccuagauuuuguuagucuauagugucauauu

SEQ ID NO: 143272 - RNA, 45 nt, Homo sapiens
aucuucuauaccccucaauauuuaaauccuucugugauuagccuu

SEQ ID NO: 143273 - RNA, 46 nt, Homo sapiens
aacaccaagggcacgccauacccuugaugaauuaaauccacagaaa

SEQ ID NO: 143274 - RNA, 46 nt, Homo sapiens
cagaugaaauuacagaagccaaaucagggacugcuacuccacagag

SEQ ID NO: 143275 - RNA, 49 nt, Homo sapiens
auuaaaauaaaugauuucucacugagaggaacuuuucuaccagguuggg

SEQ ID NO: 143276 - RNA, 67 nt, Homo sapiens
aguauaaaaacuuagugggagcuacccuuaaacacaguagaggagaucaggguuagguuacuugaga

SEQ ID NO: 143277 - RNA, 74 nt, Homo sapiens
aauuuuuaauuccucugccaugcauucaugugugacaaaucccugacaccugcauagacauuccuaggccagaa

SEQ ID NO: 143278 - RNA, 39 nt, Homo sapiens
gcagcuggagggagguagaggcuguuauuuagguugcag

SEQ ID NO: 143279 - RNA, 46 nt, Homo sapiens
uuuuucagcagaucgguuuugagaauuaguauagaaagauguaaag

SEQ ID NO: 143280 - RNA, 88 nt, Homo sapiens
ggaauagacauaaggaaaugauugcagguggaaaaauaaauuaaguaaucaaacuauauaggaaacagagguaacccaauaguagcca

SEQ ID NO: 143281 - RNA, 46 nt, Homo sapiens
gcucucuugggaauauaccauacccugggaaggggaaaguuaggaa

SEQ ID NO: 143282 - RNA, 41 nt, Homo sapiens
guugcccugaauuucuagucugauuguucuguguguaagau

SEQ ID NO: 143283 - RNA, 40 nt, Homo sapiens
ggaagaacauaaacagguuaaaauauuuguuaaucuguau

SEQ ID NO: 143284 - RNA, 23 nt, Homo sapiens
cgagaaaaaauguaauuaccuuu

SEQ ID NO: 143285 - RNA, 32 nt, Homo sapiens
cuggguuaagagaaguacuuuaauugggccaa

SEQ ID NO: 143286 - RNA, 76 nt, Homo sapiens
auauggaacaggaggagggaauacaaaucuuuaaaccaagucauaaggaacagugaaggauaguuaugaaaaggau

SEQ ID NO: 143287 - RNA, 61 nt, Homo sapiens
gguaagcuugaggaggacagcuuaauuugaaugauggccuuaaacaccagguugaugaagu

SEQ ID NO: 143288 - RNA, 49 nt, Homo sapiens
gauuccuuuucaaagcaauagaaauaaguuugguuaggguuuuuggaaa

SEQ ID NO: 143289 - RNA, 53 nt, Homo sapiens
cauagcucuggaaggucauuauuguuucuacuuuaaaaacgaauuaaucuugg

SEQ ID NO: 143290 - RNA, 62 nt, Homo sapiens
uuuuugucuuguuuguuuuuuguuuuaccauauccuuuuuaaaaugauuuucauauaucccu

SEQ ID NO: 143291 - RNA, 44 nt, Homo sapiens
ucuauagaauaagaaaauaagaaaaauaauuaugaugccaggac

SEQ ID NO: 143292 - RNA, 45 nt, Homo sapiens
cgggauucaagcauuaggcccagaaauacuguugccgaaagucaa

SEQ ID NO: 143293 - RNA, 55 nt, Homo sapiens
auaaaaaccaagaaaaucauuaccagcaaccuggucuaaaauuaaaacacuaaca

SEQ ID NO: 143294 - RNA, 36 nt, Homo sapiens
ugauuuuuuaaaaggcaggaaagauaaaagauuaaa

SEQ ID NO: 143295 - RNA, 51 nt, Homo sapiens
caaaauauuauuccauaaaaauaccuuauuuuccaguguaaauauauaaug

SEQ ID NO: 143296 - RNA, 81 nt, Homo sapiens
cuguaguguaacuuugaugaauuuuguguguguguauauauauauauauacacacacacacacacacaaccaaguaacaag

SEQ ID NO: 143297 - RNA, 57 nt, Homo sapiens
auaauuuuucauuagaaagcucauuauaauuaagcaaaaaauaagugagugaaccag

SEQ ID NO: 143298 - RNA, 49 nt, Homo sapiens
aaaauagaagaaaagaaacuugauucuaaaauuuucuggaagaauaaac

SEQ ID NO: 143299 - RNA, 35 nt, Homo sapiens
auaaaguacaaaaacuaguuugggaagcaucccag

SEQ ID NO: 143300 - RNA, 68 nt, Homo sapiens
agccauuccguuauuauauggacaaaggguaugaaaagacaauccaaagauauuuuaaauaucagguu

SEQ ID NO: 143301 - RNA, 47 nt, Homo sapiens
auguauacuuuuacuuugaaauacuaaauuuuauagaugcagcacca

SEQ ID NO: 143302 - RNA, 46 nt, Homo sapiens
cuacuugaagugcuuuaugauauauuucgucuuccucuaccuguug

SEQ ID NO: 143303 - RNA, 34 nt, Homo sapiens
uuucuugcugcauaauugugacaggaaauuaaua

SEQ ID NO: 143304 - RNA, 356 nt, Homo sapiens
cuuauaaaccuuauuuuauuccauuuuguuuauuuucucuaacagauucuuucaugccagguguggugacucacgccuguaaucccaacacuuugagaagccaaggcaggcggaucacuucaggccaggaguucgagaccagccugaccaacauggugaaacugugucucaacuaaaaauacaaaaauuagccaugcaugauggcauaccccuguagucccagcuacucaggaggcugacacacgagaauugcuugaacccggaaggcagagguuauacugagcugagaucuugccguugcauuccagccugggcaacagagcaagccucuugucuuaaaaaaaaaaaaaaaauuu

SEQ ID NO: 143305 - RNA, 51 nt, Homo sapiens
uuugucuuuuaauucuuaaaagauaccauuuccuguucaagaauaccaaua

SEQ ID NO: 143306 - RNA, 48 nt, Homo sapiens
uauuuaauaauuugucuuuuaggcugcaaaauacuaauaguguaauaa

SEQ ID NO: 143307 - RNA, 44 nt, Homo sapiens
ucaauuguauagugggucuuagcccugacauaugaggaugacau

SEQ ID NO: 143308 - RNA, 22 nt, Homo sapiens
uagucacuaguuaugagacugg

SEQ ID NO: 143309 - RNA, 23 nt, Homo sapiens
uuaaaaugcuggaaaaaugcagu

SEQ ID NO: 143310 - RNA, 41 nt, Homo sapiens
auaggccugcagacucuaugcaacaaaacauuuaaggguau

SEQ ID NO: 143311 - RNA, 42 nt, Homo sapiens
cuacaugauaaaaacaaaacgauuuccucugaagcucuugau

SEQ ID NO: 143312 - RNA, 32 nt, Homo sapiens
uuaaauuuagugacucauugugauacuaugug

SEQ ID NO: 143313 - RNA, 47 nt, Homo sapiens
gauggugauaacuauguucgucggaguaaccaaaggugcguacccag

SEQ ID NO: 143314 - RNA, 45 nt, Homo sapiens
auuuaaauuagccaagagauauaguaaucaucuuuauuauacuag

SEQ ID NO: 143315 - RNA, 27 nt, Homo sapiens
acuaauuuacuuucuguuuuaaagaau

SEQ ID NO: 143316 - RNA, 46 nt, Homo sapiens
gcugugauauucuaaaaugucacaacugggaugcugugaggcauag

SEQ ID NO: 143317 - RNA, 103 nt, Homo sapiens
ucaccaagaauuuugguacagagaaucacagagaaaauacaagccgagagagguuaguaguagaaaguucaacgagcucacauaugaagauacguagccaaag

SEQ ID NO: 143318 - RNA, 45 nt, Homo sapiens
cagucccuuaaagcacccucuauugcuacaauuaaaagucuagca

SEQ ID NO: 143319 - RNA, 68 nt, Homo sapiens
gagaauccagcuaucuucuauuaagccagacuuuugaagagaucugcaaaaaauguaaaauaaugcca

SEQ ID NO: 143320 - RNA, 50 nt, Homo sapiens
ugauucauuaccacaguuuuaagaguuucaguuaccauuguaugcaagag

SEQ ID NO: 143321 - RNA, 45 nt, Homo sapiens
gaggaaaagauaaguuugcuugcaauuuacacauuccauggggaa

SEQ ID NO: 143322 - RNA, 46 nt, Homo sapiens
ggucuuggauaacuaaacugccuuuccagagaaccaaaugucagag

SEQ ID NO: 143323 - RNA, 44 nt, Homo sapiens
uuguaaaaaguagacuuuauggugaaaaauacaugcagugccaa

SEQ ID NO: 143324 - RNA, 52 nt, Homo sapiens
auaauucacgcaaaaucuugaagucauuuuugcuauugaaauaaaccuuaau

SEQ ID NO: 143325 - RNA, 29 nt, Homo sapiens
gucacaguuuuugguuccucuuuucuuuc

SEQ ID NO: 143326 - RNA, 73 nt, Homo sapiens
aaauuaacucugugggugggggcggggggcauagcucuaaucuaauauauaaaaugugugaugaaucaacaag

SEQ ID NO: 143327 - RNA, 42 nt, Homo sapiens
gaggcuauggaacuuaacacuccccauuggagcaagcuugcc

SEQ ID NO: 143328 - RNA, 46 nt, Homo sapiens
guuggcuucacccauguuuggagacaaggacagucucccaacaaac

SEQ ID NO: 143329 - RNA, 113 nt, Homo sapiens
cuggcucuuguggccauguuccaguauccccaaaagccccaaguaugcugggacuaaugaccucaccugaaaauguacuaaaggcacuagaaaaaaacuacaugaacucccug

SEQ ID NO: 143330 - RNA, 52 nt, Homo sapiens
acucacagaaaccgaguugacuaagccuaacuaccuuuaucuccuuccaaca

SEQ ID NO: 143331 - RNA, 42 nt, Homo sapiens
gaaggccccagugcuacguucacgaaggucacgacuccggau

SEQ ID NO: 143332 - RNA, 46 nt, Homo sapiens
aggcauugauuguggacaaccuaaagccagaauccuucuaugaguu

SEQ ID NO: 143333 - RNA, 69 nt, Homo sapiens
ccuucagacaacccucacgugcugguggauacauugacaucccacuccuucacucugaguuggaaagau

SEQ ID NO: 143334 - RNA, 32 nt, Homo sapiens
aaggcuucauggaaggagggaauaucgugggg

SEQ ID NO: 143335 - RNA, 46 nt, Homo sapiens
cagucagaggagugcugguuuguguggcuugagcuggagggguggg

SEQ ID NO: 143336 - RNA, 46 nt, Homo sapiens
uggacuggugugaccauacccaggaugugcucggugauuuccagug

SEQ ID NO: 143337 - RNA, 45 nt, Homo sapiens
ggugcuucuccugcuucuguaauagucaucucugcagaccccgaa

SEQ ID NO: 143338 - RNA, 68 nt, Homo sapiens
uauaauguaguuguagaaaaccuagacaaaccauccaguucagagcuccauuccauuccagcaccagc

SEQ ID NO: 143339 - RNA, 92 nt, Homo sapiens
ugguuaauuucagcucccucagaggccccugaugucuggagaauugugagcuuggagccaggaaaucauacugugaccuuauucuggaaggu

SEQ ID NO: 143340 - RNA, 46 nt, Homo sapiens
gaaauggagugaauggaguggucagaacuucaccacacuugaagcu

SEQ ID NO: 143341 - RNA, 49 nt, Homo sapiens
acaaccuuccuuaucaucaggaauugaaaaugguauuucagauccagau

SEQ ID NO: 143342 - RNA, 32 nt, Homo sapiens
auucgucacaaacauugcuaggugggagaagg

SEQ ID NO: 143343 - RNA, 46 nt, Homo sapiens
aaaauuuaauucccaaauuagaguugcaauagcaaagggucagaag

SEQ ID NO: 143344 - RNA, 15 nt, Homo sapiens
aggaacagaucaaaa

SEQ ID NO: 143345 - RNA, 40 nt, Homo sapiens
ggucaguggggagaaaauagggagauguaggucaaaggau

SEQ ID NO: 143346 - RNA, 48 nt, Homo sapiens
accaaguaaauccuucaaucaggcagaaaggaguuggaaggaucagug

SEQ ID NO: 143347 - RNA, 41 nt, Homo sapiens
aagaaugcggagaagugagcuaacucuaccugguggcaaaa

SEQ ID NO: 143348 - RNA, 41 nt, Homo sapiens
ugagcaagaagaaugagaaauuaaaucaaggcaguuucagu

SEQ ID NO: 143349 - RNA, 41 nt, Homo sapiens
ggggucaagaagagacacugcacugaggggcugaguaggga

SEQ ID NO: 143350 - RNA, 78 nt, Homo sapiens
aauaucaugaaaaagaauauuaagucccaaauggcagcauagcuauugccuaacuaauuuaggcaaaaagggaaggga

SEQ ID NO: 143351 - RNA, 55 nt, Homo sapiens
acgguguaggugagauccuagugaagcuccugaaacuagaaguggcaggagaagg

SEQ ID NO: 143352 - RNA, 23 nt, Homo sapiens
gaggagaaugcucaggaagucaa

SEQ ID NO: 143353 - RNA, 16 nt, Homo sapiens
agauuccuuaaggaga

SEQ ID NO: 143354 - RNA, 47 nt, Homo sapiens
agugaagucauagaggacaggaggugaugguaaacaauacaauggaa

SEQ ID NO: 143355 - RNA, 69 nt, Homo sapiens
uuucaugaaguguugcaaaauaaguaucagaacaagaacguacuuuguuugaugcuuauauugcauaau

SEQ ID NO: 143356 - RNA, 52 nt, Homo sapiens
aaacaggcuuguuuguuucaucugugauuuaugugaugcaccagcaccaagg

SEQ ID NO: 143357 - RNA, 41 nt, Homo sapiens
cccgagauggccagcgggcgcgccgagaguauccuggagcc

SEQ ID NO: 143358 - RNA, 45 nt, Homo sapiens
caggucaccucuccgaaggaaaaacauuucaagcucccucccauc

SEQ ID NO: 143359 - RNA, 34 nt, Homo sapiens
cuaugucuggaaagacauacacaaggagccagua

SEQ ID NO: 143360 - RNA, 40 nt, Homo sapiens
guccaucccuaauggaguacucagcagcuguuagagaaug

SEQ ID NO: 143361 - RNA, 19 nt, Homo sapiens
acauuuuaaagaauaaucu

SEQ ID NO: 143362 - RNA, 111 nt, Homo sapiens
uuuggaccauuuaaacuauauauauauauauauauauauauauauauauauauauauauauauauauuauauguauguauauauuuuaaaagauuaugauagcuuacacua

SEQ ID NO: 143363 - RNA, 65 nt, Homo sapiens
ugaaugagggggaagaagccuaugauuuuggagaucugaaagaagaguggcuuaggcagagggaa

SEQ ID NO: 143364 - RNA, 25 nt, Homo sapiens
ugccacucucucucaguaagaucau

SEQ ID NO: 143365 - RNA, 107 nt, Homo sapiens
ugcucucugucucuuccuccccaccuaugcugaacucucaggucaugcuggauauucaguacuggauacucauagagcucagcaucuagguggggagggagggacaa

SEQ ID NO: 143366 - RNA, 89 nt, Homo sapiens
ggccuuccugaggaagugaguguuaauuugaaugaugagaagagucaggggaaggugauuccccaugauaggaaugacaagugccaggg

SEQ ID NO: 143367 - RNA, 49 nt, Homo sapiens
auacacgucucuccuuuggucaccggcuuccagucuccuccagggccuu

SEQ ID NO: 143368 - RNA, 84 nt, Homo sapiens
cccuugguggaucaagcuuggugcaugugaggaauggaagaaggcccuggaggagacuggaagccggugaccaaaggagagacg

SEQ ID NO: 143369 - RNA, 35 nt, Homo sapiens
gauggcuguuuuugaaagguucugcuuugugcgga

SEQ ID NO: 143370 - RNA, 28 nt, Homo sapiens
gcuauauuuugagaggguguagguuagg

SEQ ID NO: 143371 - RNA, 54 nt, Homo sapiens
uuuuauaaagcuucugauuaaacuuacauaauaaaaaaggauuuguuauuuaaa

SEQ ID NO: 143372 - RNA, 51 nt, Homo sapiens
gacccaugcacgucagcccauccuuagccucgacuugauaagcuguuguac

SEQ ID NO: 143373 - RNA, 26 nt, Homo sapiens
aucuuagauuaugcuucucaaaacaa

SEQ ID NO: 143374 - RNA, 93 nt, Homo sapiens
auccaauuuuucauugaaagaacuuagaaaaguggcugcuccuuaauaaacaguauuuaaauaaugcauaauaucugaaauauauguauaaau

SEQ ID NO: 143375 - RNA, 81 nt, Homo sapiens
ccuccagagcaguagaaauggacuggagggagaggauggggaaagagucaaggcauguuuuagguaaaaguggcaagucag

SEQ ID NO: 143376 - RNA, 80 nt, Homo sapiens
cacauuuuguugcuuauuuugucucuguuccccugucccccaaccccucucuauauacauaaauaugguggcgguggugg

SEQ ID NO: 143377 - RNA, 63 nt, Homo sapiens
cuuuuuuccccugucaaugccuuauuccuuagaggagcacaaauuuuuauacgauuucaggag

SEQ ID NO: 143378 - RNA, 45 nt, Homo sapiens
uuacguauguuugaaacgaccauccuggaugguggacaauaaaag

SEQ ID NO: 143379 - RNA, 25 nt, Homo sapiens
ucccucucucuuauaccccccuucu

SEQ ID NO: 143380 - RNA, 25 nt, Homo sapiens
uuucauugcauagugcuuacauauu

SEQ ID NO: 143381 - RNA, 43 nt, Homo sapiens
uuuauuacuguuuaaauuuaauauacuucauaauaaccuaaag

SEQ ID NO: 143382 - RNA, 48 nt, Homo sapiens
aggugggggugacuaggaguuucaaaguuuuguuuaaaaacuuggaag

SEQ ID NO: 143383 - RNA, 55 nt, Homo sapiens
gguuguaccgcauuuuaagacugaaaaaacagauugauaguaacuuuaccaaugu

SEQ ID NO: 143384 - RNA, 64 nt, Homo sapiens
agaaauaagccgugauucuaccacuugaaaauaguaaguacuguuuuuguguauuccugucugg

SEQ ID NO: 143385 - RNA, 46 nt, Homo sapiens
acucugaauggcaaagauacacuucaucacuggaguugggccucag

SEQ ID NO: 143386 - RNA, 45 nt, Homo sapiens
cauaacauuuuguugugugagucaagaaaaaguguuaucagcacu

SEQ ID NO: 143387 - RNA, 41 nt, Homo sapiens
auuugugaaaaaaaaauuuuacagaauuuuuaaacaaguag

SEQ ID NO: 143388 - RNA, 49 nt, Homo sapiens
augguaguauuuguauguauuugucugcccucugccauuucagccuuau

SEQ ID NO: 143389 - RNA, 45 nt, Homo sapiens
uaauauccuucacuuugaaugaaguaggaguauggggauaaacug

SEQ ID NO: 143390 - RNA, 41 nt, Homo sapiens
uuuuucuucagugucucuuuccugauuuacccugcucccag

SEQ ID NO: 143391 - RNA, 93 nt, Homo sapiens
uggaaaaauacuuuccuacaauguaucguguucaucagaugaggaaacacagucccuuucugaaaucccugauccucagcacaaagcagagau

SEQ ID NO: 143392 - RNA, 69 nt, Homo sapiens
agugcauuucagagauacaaaccccaggcagcagugcugcuggagaugcacagggguuguggcaggugc

SEQ ID NO: 143393 - RNA, 41 nt, Homo sapiens
uguggucaaaagggagaagaaaauuucccaccguaacagga

SEQ ID NO: 143394 - RNA, 51 nt, Homo sapiens
guccuuccugugccuugaucuugauguccuagucccaguaugucacuaccu

SEQ ID NO: 143395 - RNA, 45 nt, Homo sapiens
guagucgcaagucauguuggggucguaaugccaggugaggagaau

SEQ ID NO: 143396 - RNA, 46 nt, Homo sapiens
accaugccuuauggacuggagaaaaguucccucaaacagcacugaa

SEQ ID NO: 143397 - RNA, 45 nt, Homo sapiens
cuguuugagggaacuuuucuccaguccauaaggcaugguuccgac

SEQ ID NO: 143398 - RNA, 42 nt, Homo sapiens
agccuaucccaguccauccugauuauucuaaaagcucaggug

SEQ ID NO: 143399 - RNA, 78 nt, Homo sapiens
acacuuuaaaaaaagaggcugagaagguuagagcauuaggaaugugcuaaggucaaaaaagagaguggacagcuuaau

SEQ ID NO: 143400 - RNA, 37 nt, Homo sapiens
aucaagcaaugaugauuucuuccuggaaaaaggaaca

SEQ ID NO: 143401 - RNA, 46 nt, Homo sapiens
caaucauggagcguaauaauugauauccuugauuucugcauccaua

SEQ ID NO: 143402 - RNA, 46 nt, Homo sapiens
auaucaauuauuacgcuccaugauuggauauauagaagaauugggu

SEQ ID NO: 143403 - RNA, 45 nt, Homo sapiens
ucccauuguugcaccaaauuuuacuguugaggauacuucugcaga

SEQ ID NO: 143404 - RNA, 43 nt, Homo sapiens
agaacuuagaggcuuuuuaagaggauauuuguuuuacuuugga

SEQ ID NO: 143405 - RNA, 46 nt, Homo sapiens
ccuuuuccaaaguaaaacaaauauccucuuaaaaagccucuaaguu

SEQ ID NO: 143406 - RNA, 40 nt, Homo sapiens
auauucuauuucaucaguagaaaaacuccacuugagagug

SEQ ID NO: 143407 - RNA, 99 nt, Homo sapiens
gcauuugaaacggguuagagauuagugcuaacauacuucauuuuaaaaauaggucguucugacauaaaaguuaagaauauuacugacauaucccagaag

SEQ ID NO: 143408 - RNA, 64 nt, Homo sapiens
auugccauucucaucccaguggcaguggcugucauuguuggaguggugacaaguauccuuugcu

SEQ ID NO: 143409 - RNA, 31 nt, Homo sapiens
ucuuauagacuuggagcacagugugggaaga

SEQ ID NO: 143410 - RNA, 25 nt, Homo sapiens
cuggucugcgguacaguuccaaagg

SEQ ID NO: 143411 - RNA, 52 nt, Homo sapiens
aaucaaaauaguaauaguuguagaacuauagaauagucuauuuugguaacca

SEQ ID NO: 143412 - RNA, 46 nt, Homo sapiens
cuucuacccugauauuccaaauccagaaaacuguaaagcauuacag

SEQ ID NO: 143413 - RNA, 46 nt, Homo sapiens
gcucuuaaaacauuggaaaugaauccuuguaccccaaauaauguug

SEQ ID NO: 143414 - RNA, 47 nt, Homo sapiens
auuuacauugauguucagucgauguaucagccucaagcaaaaccaga

SEQ ID NO: 143415 - RNA, 79 nt, Homo sapiens
caaguugaaucugaugaugaggaagcaaagaaugagccagaauggaaaaaacguaaaauuugaagaaucucauuugaga

SEQ ID NO: 143416 - RNA, 46 nt, Homo sapiens
uuaaugauuuauauuuaauaauugaguuguaauuuauuccccacau

SEQ ID NO: 143417 - RNA, 42 nt, Homo sapiens
uaccuucacugaggcuguuuuccugauccaugaaguugggca

SEQ ID NO: 143418 - RNA, 45 nt, Homo sapiens
cccaccuauaaaggauccauuuaaagucauguugaguuguaggca

SEQ ID NO: 143419 - RNA, 45 nt, Homo sapiens
gcacucucucuuccuauauugugaagaacauugcuuuggacaaga

SEQ ID NO: 143420 - RNA, 46 nt, Homo sapiens
uauguuccgugagccccgccaacggaguacaaggaaacagcuggag

SEQ ID NO: 143421 - RNA, 66 nt, Homo sapiens
auagcaguuuuuucaagaguaacagucuauuccaagugugaacaagaaagagugcuggucuuggaa

SEQ ID NO: 143422 - RNA, 52 nt, Homo sapiens
uuggaacuggaaauggauuggcuaaagucuauuacgaccccaacaagaguca

SEQ ID NO: 143423 - RNA, 50 nt, Homo sapiens
cagagcaccacuuauuuuccuuaccaguaaugaauucauaggaucauaac

SEQ ID NO: 143424 - RNA, 59 nt, Homo sapiens
caaggaguagcauuacacagggagaacuugagcuaucagcacugcaaaugcuaacugaa

SEQ ID NO: 143425 - RNA, 46 nt, Homo sapiens
auucagacuauagucagccuccauuauuuguacuuagggagggaag

SEQ ID NO: 143426 - RNA, 57 nt, Homo sapiens
ucacaaaaaaguuuuuguguucuuauuaagagagaauauugauguuuuaauucagag

SEQ ID NO: 143427 - RNA, 80 nt, Homo sapiens
augaaagugcuaacauuuucaaguugauugaaaaggccuggugugguauaaauguuauauauaacauauaaaauuauaca

SEQ ID NO: 143428 - RNA, 39 nt, Homo sapiens
ucuaguauuacuaugaagucuuaauuugcggguucugaa

SEQ ID NO: 143429 - RNA, 43 nt, Homo sapiens
uucacucuagcguaggaguuaucaguauguuguggauggcuga

SEQ ID NO: 143430 - RNA, 48 nt, Homo sapiens
gacugcuguuucaguccagaugauaagcucauagucacugguacaucu

SEQ ID NO: 143431 - RNA, 44 nt, Homo sapiens
ugggacauccgacaauuuaauaaaccacuuuuuucagccucggg

SEQ ID NO: 143432 - RNA, 50 nt, Homo sapiens
uagugcuuaguaaagcuugcuuugauuuuuguuaaugcaccuuugccagu

SEQ ID NO: 143433 - RNA, 46 nt, Homo sapiens
ccaugugcagaguguauggcauauccuaggaauacaauaaauauuu

SEQ ID NO: 143434 - RNA, 32 nt, Homo sapiens
aucaccucuguaaggacauuccuguccccuag

SEQ ID NO: 143435 - RNA, 29 nt, Homo sapiens
ugaaacacuuacuuuugcauacugauuau

SEQ ID NO: 143436 - RNA, 30 nt, Homo sapiens
guccuuaaauucucuauagguuaaccagau

SEQ ID NO: 143437 - RNA, 51 nt, Homo sapiens
gucuugauacagcugaauucauccuuuucuucacuuuacuauuaaaggggu

SEQ ID NO: 143438 - RNA, 57 nt, Homo sapiens
ggguguugaaugagcagaggucaucaugaacacaguguacacuugaauggugaugga

SEQ ID NO: 143439 - RNA, 50 nt, Homo sapiens
guuuuuccggcaucaagcgggggaauggaccaucacaggcuugcggauga

SEQ ID NO: 143440 - RNA, 50 nt, Homo sapiens
auagcucuugugugcuuccuuggucuuagaucugcgggccucagccugau

SEQ ID NO: 143441 - RNA, 47 nt, Homo sapiens
caauaagcuguaaaaagcuucuuguuuuauguauagaugguaaaaca

SEQ ID NO: 143442 - RNA, 47 nt, Homo sapiens
uuaugaaggugaauuuccugaauuuagaccuaauuuaaacuucagug

SEQ ID NO: 143443 - RNA, 46 nt, Homo sapiens
auggaaaccucauagcagcugccugccagaauggaagcauacagau

SEQ ID NO: 143444 - RNA, 49 nt, Homo sapiens
ccuucaagaaaaauuaaaccaagaucucuaaagugauuuccaugcaaaa

SEQ ID NO: 143445 - RNA, 43 nt, Homo sapiens
uaaaagaucaggugaauugaauuaacucuaucuggugguacuu

SEQ ID NO: 143446 - RNA, 47 nt, Homo sapiens
auagcuucuaaagaugaauuauaaaauuaaaguuuuugauaaauuau

SEQ ID NO: 143447 - RNA, 43 nt, Homo sapiens
uuuuacuucuuuaaucauaguuuuauuuugaacugugucagag

SEQ ID NO: 143448 - RNA, 43 nt, Homo sapiens
uauauauuaaauaagcacacauacaacaaaaguagguguuggu

SEQ ID NO: 143449 - RNA, 38 nt, Homo sapiens
auuugugaacucaccuacuauuuuuuguaaccccaaaa

SEQ ID NO: 143450 - RNA, 42 nt, Homo sapiens
ggauaugacuaugauguuaaguuuugggauuuugcuggaaug

SEQ ID NO: 143451 - RNA, 61 nt, Homo sapiens
agggggcaauagaagcucuuuggcaagcauccaguuuuucccuuugccugucuauagugga

SEQ ID NO: 143452 - RNA, 24 nt, Homo sapiens
gaaaguagaaagaugaggaggaug

SEQ ID NO: 143453 - RNA, 47 nt, Homo sapiens
aggaagaaaugaacagagagaaagaauuaagaagacaaaaugaagau

SEQ ID NO: 143454 - RNA, 44 nt, Homo sapiens
uaauccuuuuucuuccuagugcccccacaauuguagagugagau

SEQ ID NO: 143455 - RNA, 41 nt, Homo sapiens
cgaaggacagcuguggaaagaagucgcaaaacacuggguaa

SEQ ID NO: 143456 - RNA, 41 nt, Homo sapiens
gacccgcagcuugcggucaccaugggcuucacgggguucgg

SEQ ID NO: 143457 - RNA, 37 nt, Homo sapiens
aaugauagaaacaaagauaguauuugcucccuacagc

SEQ ID NO: 143458 - RNA, 34 nt, Homo sapiens
ccuauuacuuuguauuuauuuuaaaaauguuaaa

SEQ ID NO: 143459 - RNA, 43 nt, Homo sapiens
ucucauuagaagcugcuugguuuaucuuucauucaucuagccu

SEQ ID NO: 143460 - RNA, 48 nt, Homo sapiens
uuuacuuauuuaaaugaucauacauaauaauauuuuuaacaacagaau

SEQ ID NO: 143461 - RNA, 46 nt, Homo sapiens
uccugguuuuggcgaccccuguagacauaguaauucuuggacucag

SEQ ID NO: 143462 - RNA, 30 nt, Homo sapiens
guuugucugguggaaugcaguugcuuccag

SEQ ID NO: 143463 - RNA, 33 nt, Homo sapiens
gaagcagggugguuuagccaaagauguaggaaa

SEQ ID NO: 143464 - RNA, 44 nt, Homo sapiens
cuucaaauugcaauugauaauucuagaaauauuuuauauacacg

SEQ ID NO: 143465 - RNA, 42 nt, Homo sapiens
uguccaaauagcagugauugaaaauucugaaucacuggacug

SEQ ID NO: 143466 - RNA, 46 nt, Homo sapiens
auauuuuagcacuuguccauucagacagccauuagcacggccuaau

SEQ ID NO: 143467 - RNA, 48 nt, Homo sapiens
uuauggugugucaaccaugauacuuuuccuuuccaaaagccaaugaug

SEQ ID NO: 143468 - RNA, 53 nt, Homo sapiens
guuuucuuaguauuuguauuuuauuguauguuaguuaugcaucaguguuacug

SEQ ID NO: 143469 - RNA, 31 nt, Homo sapiens
uaaacuuuugaaaaaucuuucauuuuuacag

SEQ ID NO: 143470 - RNA, 40 nt, Homo sapiens
cuuuauuaccuauuucauuguuuguuauaagagguaucau

SEQ ID NO: 143471 - RNA, 45 nt, Homo sapiens
caaaguugaucaaaacagaguucguuauauggauuuacucuggcg

SEQ ID NO: 143472 - RNA, 64 nt, Homo sapiens
uggggaaaauuaccuuaucuccacaaauaagauaaggcaucuuuggcagcuugucacugggcug

SEQ ID NO: 143473 - RNA, 45 nt, Homo sapiens
uauagagugggguauuuugauugcauuuuuguauccuaucacuua

SEQ ID NO: 143474 - RNA, 45 nt, Homo sapiens
guauacauguauuauugauaagauauguugagaaucccagccaag

SEQ ID NO: 143475 - RNA, 44 nt, Homo sapiens
aacaacugaaaugagauuauuuauuauuuuaacauaaggauuaa

SEQ ID NO: 143476 - RNA, 41 nt, Homo sapiens
cguuucccggucccguccagacgcugucuggcgagaucgga

SEQ ID NO: 143477 - RNA, 47 nt, Homo sapiens
cuugcuugguaucucugcuuucuuauugucuucauacugccucugga

SEQ ID NO: 143478 - RNA, 42 nt, Homo sapiens
cagucauaugcaagaucaggaggguuuuccaucacuggaaag

SEQ ID NO: 143479 - RNA, 45 nt, Homo sapiens
ugaaaacguauuuuaaggcagccaaacugaugacagagaaagcag

SEQ ID NO: 143480 - RNA, 46 nt, Homo sapiens
gauuuauucaguucagagacaccgucgaacucaaguacaauggcag

SEQ ID NO: 143481 - RNA, 50 nt, Homo sapiens
auuucuaagacaauguucaugacuaguagagaugagauggugggaaauag

SEQ ID NO: 143482 - RNA, 45 nt, Homo sapiens
aagggcuggagauauugauaauaaaagguuuaggcaucacuauag

SEQ ID NO: 143483 - RNA, 41 nt, Homo sapiens
ccauauggauucaucuaucucucacaagaauacucaaccaa

SEQ ID NO: 143484 - RNA, 85 nt, Homo sapiens
cgagucucccucuaaaaaauuuaaagaaaaaagagguagaguuauuauucuauuauaauaaauaauacuauuuuaacauuauucu

SEQ ID NO: 143485 - RNA, 46 nt, Homo sapiens
ccuuagagcuuuccaauaauuauugcugggugucuaaaugcuucag

SEQ ID NO: 143486 - RNA, 81 nt, Homo sapiens
cucgguuuccagcaguuuaugggagaugaugauaugacaucagacuuaguuaaugaaggaaaagaauuaaucagaaaaggu

SEQ ID NO: 143487 - RNA, 55 nt, Homo sapiens
auuaauuugaaauuuaauuucuuaagaaucuuacuaauuuggaauaauuagcuaa

SEQ ID NO: 143488 - RNA, 40 nt, Homo sapiens
uuuuaauacuuucagguauauacgcuaaguauccugacag

SEQ ID NO: 143489 - RNA, 46 nt, Homo sapiens
aagugaauggagaccucaaauaauaacuguauucauaaaacucgug

SEQ ID NO: 143490 - RNA, 55 nt, Homo sapiens
uucuuaugucccuagaauauuugcaacucuuacugaauccaugcuacauuuggug

SEQ ID NO: 143491 - RNA, 46 nt, Homo sapiens
auccucuuuguaauuuaaugauugacuaauugaauaccuuuggcaa

SEQ ID NO: 143492 - RNA, 46 nt, Homo sapiens
aacgauuugucacaugcugggcaguaaaggucaucauagagcucag

SEQ ID NO: 143493 - RNA, 44 nt, Homo sapiens
cuucggcuuuccucgccuucucugcauucuguucuuccacaagu

SEQ ID NO: 143494 - RNA, 50 nt, Homo sapiens
ucauauucuuccuuccaugcaaaauucuuuugagugcagaaacucugcca

SEQ ID NO: 143495 - RNA, 55 nt, Homo sapiens
ugcagucccuucugugucagcaaggguagucugugugaccaacaggagauggcag

SEQ ID NO: 143496 - RNA, 42 nt, Homo sapiens
cuccuccucgcuggcgucgcgccgcacccccagcgccucaua

SEQ ID NO: 143497 - RNA, 42 nt, Homo sapiens
ggcggcgcuggcaguccucuccggcgggaguccgccgcccgc

SEQ ID NO: 143498 - RNA, 52 nt, Homo sapiens
cuuacgucuaauuaguguagcauuuacaagaaagaaaaauuaagaucuuaaa

SEQ ID NO: 143499 - RNA, 84 nt, Homo sapiens
ccacugcagauguuuuuguaacaccagcugaggagaaaccaauagaaauacaguggguaaaaccagagccaaaaguugauuuga

SEQ ID NO: 143500 - RNA, 52 nt, Homo sapiens
aggagaaaagaggaggugacucuagaaaucuugaagcaggaguuuggcacga

SEQ ID NO: 143501 - RNA, 46 nt, Homo sapiens
gaugaauuaccacauuaugcuuuguuaaaagaacucuuaauucagg

SEQ ID NO: 143502 - RNA, 46 nt, Homo sapiens
aacugaagaugacuggaaacuguuugaaagguucucggccccuuuu

SEQ ID NO: 143503 - RNA, 54 nt, Homo sapiens
uaauuugaaauagguuugauauacuuaggcuuuucacccaaucccuuagugauu

SEQ ID NO: 143504 - RNA, 99 nt, Homo sapiens
aggaacggauucucaucuuuucuuccagaggaauaaauuuuagaacaagacauuuaaugcaggacuugagaauguugaugccucauucuaaagcaggug

SEQ ID NO: 143505 - RNA, 58 nt, Homo sapiens
uguagacgugaaaaucuauuuuaaaauucagugucaaagcuaugucauuugaacuuug

SEQ ID NO: 143506 - RNA, 55 nt, Homo sapiens
uaugagcuuuacuuguauucaacagacauugaaugugccaugcacuguaccaagu

SEQ ID NO: 143507 - RNA, 64 nt, Homo sapiens
uuucuuacuaguuguucaguuguuuuuuuuuuuuaauguuuuuggagaguagugcuuuuccuug

SEQ ID NO: 143508 - RNA, 47 nt, Homo sapiens
cucccggccagacugggcacggaguuugcagcuaauccuugugcacg

SEQ ID NO: 143509 - RNA, 46 nt, Homo sapiens
gcggagccgccagcuaagcggcacgccacagcagaggagguggagg

SEQ ID NO: 143510 - RNA, 49 nt, Homo sapiens
cggggaccccgagacuaguaagcgaugcugucccgcgggcgggcuggug

SEQ ID NO: 143511 - RNA, 46 nt, Homo sapiens
caggaagagucuguuacuuuucgaauuaauuuaacuguccuuuuag

SEQ ID NO: 143512 - RNA, 91 nt, Homo sapiens
ggcaguuuucagcaggaguacaaugucaaaaaagcuguucuugauaguuuaacacaagucucuuuucaggauuagacucagagauucuagc

SEQ ID NO: 143513 - RNA, 36 nt, Homo sapiens
uauuucagaauauuaaagccccuaaauacauaugga

SEQ ID NO: 143514 - RNA, 52 nt, Homo sapiens
ucauauuggauuuucuauagagaagaagcacaauggggaagauaggagcaag

SEQ ID NO: 143515 - RNA, 43 nt, Homo sapiens
uuggaaaauagcuaauccucauccaccucaaaaaugucagugc

SEQ ID NO: 143516 - RNA, 120 nt, Homo sapiens
gggucuuacuccuuggaggccaugugggccaugagguccaccauccuguugcuguagccaaauucauugucauaccaggaaaugagcuugaaaaagugguuguugagggcaaugacagcc

SEQ ID NO: 143517 - RNA, 41 nt, Homo sapiens
ggugcucaguguagcccaggaugcccuugagggggcccucc

SEQ ID NO: 143518 - RNA, 28 nt, Homo sapiens
uuacuuuucucuuaaggugucauggaga

SEQ ID NO: 143519 - RNA, 47 nt, Homo sapiens
gugauccacuaggaaaggggauagaacaccggcauuuaaggaaugcg

SEQ ID NO: 143520 - RNA, 33 nt, Homo sapiens
cugaugaacuucccaaucagaugagcauggaug

SEQ ID NO: 143521 - RNA, 46 nt, Homo sapiens
uuccaagcuuugugacaccuccagaaguugaaccauucccucgccu

SEQ ID NO: 143522 - RNA, 56 nt, Homo sapiens
guaaaaagacagauuaaaacaacuagaacaguacagguuuuauuuauauggcucga

SEQ ID NO: 143523 - RNA, 46 nt, Homo sapiens
ucccacaugaacauuucccaacuaagcccuucaggugcuacagaag

SEQ ID NO: 143524 - RNA, 33 nt, Homo sapiens
ugauuucaucaagucccucuaaugaacuuccuu

SEQ ID NO: 143525 - RNA, 50 nt, Homo sapiens
aacaaauauauauuuaccuuaaugagccuguuccaauguggggguggggg

SEQ ID NO: 143526 - RNA, 66 nt, Homo sapiens
aacgaaaucuucagccuuugcugauugagggaaagaucagaaaaaaacgaggugaaaaugaaccag

SEQ ID NO: 143527 - RNA, 39 nt, Homo sapiens
ccugcacaucagccguucuucccccggcccccucccgcc

SEQ ID NO: 143528 - RNA, 47 nt, Homo sapiens
cuucgcucggcucuagcagucgaacacccucuuggucguucgcucgc

SEQ ID NO: 143529 - RNA, 41 nt, Homo sapiens
cgccgccgacaaggagcgggcggcgggcggcggcgccggca

SEQ ID NO: 143530 - RNA, 59 nt, Homo sapiens
aguuucccgggcagucuccggguuggauuugcacccuggggucuacacggguuaaaaac

SEQ ID NO: 143531 - RNA, 44 nt, Homo sapiens
uuaacugaagaagaagaaaaaaaaaacauccccagcaagcagau

SEQ ID NO: 143532 - RNA, 48 nt, Homo sapiens
aggugaagcauauuaacaugcuguuuuucggugauugggucuuaagaa

SEQ ID NO: 143533 - RNA, 24 nt, Homo sapiens
ugcuccuuaaaagcaaaaaauuuu

SEQ ID NO: 143534 - RNA, 44 nt, Homo sapiens
uauguguuaggugcaguaaggauguacauagggaggaugcuuug

SEQ ID NO: 143535 - RNA, 82 nt, Homo sapiens
aucugccauugucuccggucauuucaacaccacugcagauaguggauggcucagcagcugugaggugcucuugaccaaggag

SEQ ID NO: 143536 - RNA, 46 nt, Homo sapiens
uuaauugaauuagcauugagaggaagguuacaacuagaggcuugug

SEQ ID NO: 143537 - RNA, 23 nt, Homo sapiens
uaaaacuuguuuagggaaauuag

SEQ ID NO: 143538 - RNA, 54 nt, Homo sapiens
uguuuaguuauuuaggcaaacuugaaaguuaucagucauagaguggggaaguaa

SEQ ID NO: 143539 - RNA, 75 nt, Homo sapiens
aagaggaaguggagcuuagauuaggccuuugaaggguaagaaugagaugcaaagaaagaaauauacuuguucaga

SEQ ID NO: 143540 - RNA, 50 nt, Homo sapiens
aggaauaacauauuaaucaggaagcuuuuuuuuuuagucuauuaguugca

SEQ ID NO: 143541 - RNA, 46 nt, Homo sapiens
ggaauccauuaaaauugcauuaucaguuaagaaauguacgggaacg

SEQ ID NO: 143542 - RNA, 45 nt, Homo sapiens
gagauguauacuuagcaaaauuauuuuuaaauugaaacagcacag

SEQ ID NO: 143543 - RNA, 32 nt, Homo sapiens
gaaugaaaacuguuauagauaauacaaauaaa

SEQ ID NO: 143544 - RNA, 28 nt, Homo sapiens
cauagauuuuuaaaugugguuguauugu

SEQ ID NO: 143545 - RNA, 46 nt, Homo sapiens
gaaaaugugcaccgcaugauacguuacauaugacaaagaaguccag

SEQ ID NO: 143546 - RNA, 37 nt, Homo sapiens
agcgagugcgggcgcagcgggccgucgcggaggagga

SEQ ID NO: 143547 - RNA, 46 nt, Homo sapiens
aaagcagcaggaggaggacagcgaggaggaggaagaggaccuggau

SEQ ID NO: 143548 - RNA, 78 nt, Homo sapiens
ucaccucgugaauuuuugugauaucuuugcuugcuacuacuuuucuuaaacuuuauauuucaaaauucuggcuugcag

SEQ ID NO: 143549 - RNA, 45 nt, Homo sapiens
gcuaguguuuauggagugcuuaccugccagacacuguucuaauaa

SEQ ID NO: 143550 - RNA, 45 nt, Homo sapiens
ggaaggggaggaccccaauaaggcugaggaguugcccucagaaaa

SEQ ID NO: 143551 - RNA, 52 nt, Homo sapiens
uuucagaagauaauaguuacaaaaagaauuauuuaguaaucaccaaagguug

SEQ ID NO: 143552 - RNA, 65 nt, Homo sapiens
caugcaguauguccaaaggaugaaaucaaaauggaugcugaagacaggaaugaagaacaaugcca

SEQ ID NO: 143553 - RNA, 45 nt, Homo sapiens
ugaugguaacuucagaaauuuaauguggauuaugguacgaugaca

SEQ ID NO: 143554 - RNA, 29 nt, Homo sapiens
gaagcuggggacuauggaauuggugaaag

SEQ ID NO: 143555 - RNA, 48 nt, Homo sapiens
aaaugauuuccauuuuaucauuggugauuggugauuaugugcuauuua

SEQ ID NO: 143556 - RNA, 37 nt, Homo sapiens
gguagacguacccccagcuccgggccacuucugucag

SEQ ID NO: 143557 - RNA, 90 nt, Homo sapiens
cugaaguuuaauggaucccaaccacucuuuuccauacugagacucggggaaucucuaaccaagguagaacccacaucucgagccugagaa

SEQ ID NO: 143558 - RNA, 47 nt, Homo sapiens
auauuuuuuuuagaaguauaaauuauugccugugaacugaaagagag

SEQ ID NO: 143559 - RNA, 41 nt, Homo sapiens
uuggagcaucuaugguacaagaaggaaggcugugccccaaa

SEQ ID NO: 143560 - RNA, 57 nt, Homo sapiens
gccaagcucuauuuacuaugucauguugaaauauuaaaaaaaaaauacacuggagau

SEQ ID NO: 143561 - RNA, 48 nt, Homo sapiens
caugcacacuuuuucaagaagcuauuggugacgguugcuuugccaagg

SEQ ID NO: 143562 - RNA, 43 nt, Homo sapiens
ucaggacugaaagggcccauccgggggagguggugcagugcau

SEQ ID NO: 143563 - RNA, 48 nt, Homo sapiens
uaaggaucagccuaugaaccuuucaaagucuaguuaagagaauaaaag

SEQ ID NO: 143564 - RNA, 32 nt, Homo sapiens
cauguccacaccucucuccccuuuggcgcaaa

SEQ ID NO: 143565 - RNA, 78 nt, Homo sapiens
gcuauuuuaagcagauuguuuugcaacagauuaagaauugggucccaaaguggguuauuucaaggcauuuuugaagac

SEQ ID NO: 143566 - RNA, 49 nt, Homo sapiens
ggcuguucaucaaagugccacccuccuacuuacauaauugacucuugug

SEQ ID NO: 143567 - RNA, 32 nt, Homo sapiens
caagcaauggaaacuuggacugaaauuugaug

SEQ ID NO: 143568 - RNA, 50 nt, Homo sapiens
guucccauuucugcccagaucccagucuccguguuuggcugcagccagau

SEQ ID NO: 143569 - RNA, 43 nt, Homo sapiens
acauucaaacucuaaucacuguuacaauauguugcauguguga

SEQ ID NO: 143570 - RNA, 57 nt, Homo sapiens
augggauguauucuucugcugcugcuuauuaaauaaagaaagccugaguguucuuag

SEQ ID NO: 143571 - RNA, 48 nt, Homo sapiens
ccuccagcaguccauaagccccuugaggauagaauccugucuucauca

SEQ ID NO: 143572 - RNA, 104 nt, Homo sapiens
uucucgaauuaaaaaaaaugaagauucuuuaaggauuggcugugcagcauuggucuuuguggucccuguauauuauaccucaggagucugcuucacuuuuaagu

SEQ ID NO: 143573 - RNA, 54 nt, Homo sapiens
ugcaucuucaaaccagaagucccauucuucaucuuugucuagcaucuaguggau

SEQ ID NO: 143574 - RNA, 52 nt, Homo sapiens
cuaagaaucaaaccuuauugagaguggcugcauugaccccggauaccucugg

SEQ ID NO: 143575 - RNA, 47 nt, Homo sapiens
auguauuuucugccccaccccacccccagaugcugcuacaguucgga

SEQ ID NO: 143576 - RNA, 69 nt, Homo sapiens
auaguuggguuugcuaugcagaggaauuauuuaaaauguuuacacuuagaagugugaacacuguaagac

SEQ ID NO: 143577 - RNA, 39 nt, Homo sapiens
augccaccgccgcagggaggaaaauaaacaggcgaacgg

SEQ ID NO: 143578 - RNA, 44 nt, Homo sapiens
uuaacaaacuaugcacuuaagguuaagugacaucaacaaaaaag

SEQ ID NO: 143579 - RNA, 45 nt, Homo sapiens
uauguucaggauuguuuugauaccuaucuuauaauaaaaaauguu

SEQ ID NO: 143580 - RNA, 44 nt, Homo sapiens
uaaugauguccaaagaaaauaugaagcuuccacagccacuggaa

SEQ ID NO: 143581 - RNA, 47 nt, Homo sapiens
aagauaugacauuuacaagguggacaggcaugauuauugggccacca

SEQ ID NO: 143582 - RNA, 34 nt, Homo sapiens
guugaaauucucuacuguuuacuucuuuucaaag

SEQ ID NO: 143583 - RNA, 53 nt, Homo sapiens
uauuguuacauccuuuuccagacacuguagaugcuauaauaaaaauagcuguu

SEQ ID NO: 143584 - RNA, 43 nt, Homo sapiens
aacagcaugucauagaaaccuugauuggcaaaaagcaacagau

SEQ ID NO: 143585 - RNA, 74 nt, Homo sapiens
uaaggauaaaaugcuggucaucgagcaguguaagaacuccagagcuguaaccauuuuuauuagaggaggaaaua

SEQ ID NO: 143586 - RNA, 62 nt, Homo sapiens
gagcucacagccgagaagcugggcuuugcuggucuuguacaggagaucucauuugggacaac

SEQ ID NO: 143587 - RNA, 45 nt, Homo sapiens
guguugagggguguuuugauagcccugccuuaaauaacugcauca

SEQ ID NO: 143588 - RNA, 44 nt, Homo sapiens
aaagagacuggugcuaaccuagcaauuugucaguggggcuuuga

SEQ ID NO: 143589 - RNA, 36 nt, Homo sapiens
agaaauacgaaaaggagaaauuugaagagaugauuc

SEQ ID NO: 143590 - RNA, 53 nt, Homo sapiens
gagagacguugacuuugagcuuaucaaaguagaaggcaaagugggcggcaggc

SEQ ID NO: 143591 - RNA, 73 nt, Homo sapiens
gggucaacaguugucaccgacagauggcugagauugcugugaaugccguccucacuguagcagauauggagcg

SEQ ID NO: 143592 - RNA, 61 nt, Homo sapiens
gagcaggcugcucguguugcuauugaacaccuggacaagaucagcgauagcguccuuguug

SEQ ID NO: 143593 - RNA, 46 nt, Homo sapiens
agcugaugguggaacuguccaagucucaggaugaugaaauuggaga

SEQ ID NO: 143594 - RNA, 48 nt, Homo sapiens
guggauaaggauggagaugugacuguaacuaaugauggggccaccauc

SEQ ID NO: 143595 - RNA, 48 nt, Homo sapiens
ggcagcaaaggcuguagcaaauacaaugagaacaucacuuggaccaaa

SEQ ID NO: 143596 - RNA, 48 nt, Homo sapiens
gcucgggagacgccggcgccuaauccugggcucggaaugugggggcca

SEQ ID NO: 143597 - RNA, 43 nt, Homo sapiens
ucgaugaauaugggcgcccuuuccucaucaucaaggaucagga

SEQ ID NO: 143598 - RNA, 42 nt, Homo sapiens
guuuugcucuugauuuucucucuggggaggcacacccggcaa

SEQ ID NO: 143599 - RNA, 48 nt, Homo sapiens
gcacgggaaaggaguccgcggaggagcaaaaccacagcagagcaagaa

SEQ ID NO: 143600 - RNA, 45 nt, Homo sapiens
uggauccugcucaccuugggcuugguggccugcgugucggcggag

SEQ ID NO: 143601 - RNA, 44 nt, Homo sapiens
ccgcagcugccuccaccugggcgccaggagcucugucgggccag

SEQ ID NO: 143602 - RNA, 46 nt, Homo sapiens
ucucuacuauucagucuauuuugugaaaaaugucacaaagacucag

SEQ ID NO: 143603 - RNA, 41 nt, Homo sapiens
ucaacaaguugauagcuucucauaauuuaugcugcccacua

SEQ ID NO: 143604 - RNA, 31 nt, Homo sapiens
cagaggcucagagaaguuaggugacuugccc

SEQ ID NO: 143605 - RNA, 63 nt, Homo sapiens
aaggagaaucagucaaaacuuaaguccaggugucuucauucccagcuaagcuguuucaugcag

SEQ ID NO: 143606 - RNA, 46 nt, Homo sapiens
agauuuagcaauguuuuucucauucuguagugguuuucuuuuuccg

SEQ ID NO: 143607 - RNA, 45 nt, Homo sapiens
uacugguuuaagcuguguaggcuucccuugcagguuauuaguccg

SEQ ID NO: 143608 - RNA, 65 nt, Homo sapiens
cugaugaggauguagagaguccagagcugacaacaucucgaccacuuccaaagauacuguugacu

SEQ ID NO: 143609 - RNA, 65 nt, Homo sapiens
agugcugcuccaaaaguggaaaccacgacgcugaauauacagaacaagauaccugcucagacaaa

SEQ ID NO: 143610 - RNA, 63 nt, Homo sapiens
ccagucaccugaagaaacugauaaagagaaaguucaccucucugacucagaaaggaaaaugga

SEQ ID NO: 143611 - RNA, 75 nt, Homo sapiens
cccagccgaagaggauacaaauguguauacugagaaacacucagacagucuguuuaaacggacagaaguccuagc

SEQ ID NO: 143612 - RNA, 48 nt, Homo sapiens
ugaccuuggagaacgcaaaccauccagugcugcuuaucagaaggcacc

SEQ ID NO: 143613 - RNA, 46 nt, Homo sapiens
cuauuuaugagaucacugaacuuuucaaaauaaagcuuuugcauag

SEQ ID NO: 143614 - RNA, 86 nt, Homo sapiens
ggguaggcagggaggcucuguguguuaaaaugagggucucacugcuuuaggauugaaguggcuggaaagagugaugccuggggaag

SEQ ID NO: 143615 - RNA, 53 nt, Homo sapiens
uaagaccaucccucugacagacaacacagugauugaggagcaccuggggaagu

SEQ ID NO: 143616 - RNA, 47 nt, Homo sapiens
gugaguuuacuggugcagagaaccauugcaagacuuugccuaaagaa

SEQ ID NO: 143617 - RNA, 45 nt, Homo sapiens
gucauuaugcuguggcuccaggugagggugaggacugggccuaua

SEQ ID NO: 143618 - RNA, 39 nt, Homo sapiens
ggagagugguauuggggauaccaccuaggcugcacuggg

SEQ ID NO: 143619 - RNA, 75 nt, Homo sapiens
agcgaaggagacggaggaaucaaagaugacuucugcuuuccaguuuuaggagaugaccugcaucuuaacugagcu

SEQ ID NO: 143620 - RNA, 45 nt, Homo sapiens
uaaaggccuuucuacucaggcuaaugacaaacacaauaaaggcag

SEQ ID NO: 143621 - RNA, 44 nt, Homo sapiens
gcacugcauccaaaacucucaucccaggaauuaaauaaggucag

SEQ ID NO: 143622 - RNA, 40 nt, Homo sapiens
agugaauauugguggcaggguauuaagaagcuuauaaugg

SEQ ID NO: 143623 - RNA, 40 nt, Homo sapiens
aguauaagagaauaugcugucuugggagaaguaccaucaa

SEQ ID NO: 143624 - RNA, 46 nt, Homo sapiens
acuccucugauguccugguuuauguuaccagcaaugacacuacggu

SEQ ID NO: 143625 - RNA, 69 nt, Homo sapiens
cugagcaauaguucuguuauuucacuuuugccaugagccucucugagcuuguuuguugcugaaaugcua

SEQ ID NO: 143626 - RNA, 44 nt, Homo sapiens
cgcuggagucgaucaacucuaggcuccaacucguuaugaaaagu

SEQ ID NO: 143627 - RNA, 69 nt, Homo sapiens
gauccuaaaauuccuguccuguucucugucucuucuagguugggggccgucccgcuccuaaggcaggaa

SEQ ID NO: 143628 - RNA, 90 nt, Homo sapiens
acucugacgaagacguggaucugcucucgcuuuagcugcucgcgguccuccagaucauguccgcgacuccugcgacuccgcgcggaaaaa

SEQ ID NO: 143629 - RNA, 45 nt, Homo sapiens
uguuacccaccucucauuaacucuuagccugaacucccagaccgc

SEQ ID NO: 143630 - RNA, 91 nt, Homo sapiens
ucuccucucuccucuccccucucuucucucuccucucucgucuccuggggcaucccggguggagggauguaggggucgcuccucggugcca

SEQ ID NO: 143631 - RNA, 56 nt, Homo sapiens
cggguugggguuugugguggauauuugggccaaaacuggaaagacacuugggguaa

SEQ ID NO: 143632 - RNA, 49 nt, Homo sapiens
agaaggacguucaaccuccaaagcagcaaccaaugauauauaucugugg

SEQ ID NO: 143633 - RNA, 50 nt, Homo sapiens
auuacgugacuuuuuguuuuauuguauauguaauuuaacacacaauaaag

SEQ ID NO: 143634 - RNA, 42 nt, Homo sapiens
gccagauauuugcugcugcccaaacugcaccuuacccagguu

SEQ ID NO: 143635 - RNA, 43 nt, Homo sapiens
uaucuggcuugaaucauggcuggauguuuacuguauuauuuag

SEQ ID NO: 143636 - RNA, 42 nt, Homo sapiens
cugugcauuaagauguugcugaggauugcgaacuccugcagc

SEQ ID NO: 143637 - RNA, 48 nt, Homo sapiens; identical to SEQ ID NO: 51034

SEQ ID NO: 143638 - RNA, 57 nt, Homo sapiens
gccaugaaguaaccugaaggaggugcuggcugguagggguugauuacaggguuggga

SEQ ID NO: 143639 - RNA, 46 nt, Homo sapiens
gggaggagaaacauacaaaaccaaacccuuugcugcgaccacccuc

SEQ ID NO: 143640 - RNA, 45 nt, Homo sapiens; identical to SEQ ID NO: 51038

SEQ ID NO: 143641 - RNA, 42 nt, Homo sapiens; identical to SEQ ID NO: 51039

SEQ ID NO: 143642 - RNA, 81 nt, Homo sapiens
cacggcugcccgcagggccacaggccgcgaccuuuccgugagaggaggagagcgagugccggggcugggggccggagccgg

SEQ ID NO: 143643 - RNA, 42 nt, Homo sapiens
gacaaaaaucaaccggaauugaaaacuacucaacggccgcag

SEQ ID NO: 143644 - RNA, 32 nt, Homo sapiens
cuuggagcugcugcggggccgcgggcgggcgg

SEQ ID NO: 143645 - RNA, 69 nt, Homo sapiens; identical to SEQ ID NO: 51043

SEQ ID NO: 143646 - RNA, 45 nt, Homo sapiens
uggcugaggcguccccgccuuccgccccgcccgccccugccucca

SEQ ID NO: 143647 - RNA, 46 nt, Homo sapiens
uuucauauuagacuuuuuguuaaauaaacuucuguaauagucaaaa

SEQ ID NO: 143648 - RNA, 42 nt, Homo sapiens
caaagcucacccucccgagcugaaaaaauuuauggacaagaa

SEQ ID NO: 143649 - RNA, 40 nt, Homo sapiens
ccaugugaggggcccccccuuaucccaccuuuccggcuag

SEQ ID NO: 143650 - RNA, 45 nt, Homo sapiens; identical to SEQ ID NO: 51062

SEQ ID NO: 143651 - RNA, 97 nt, Homo sapiens
caggccgaggcggggaggaucccuuaggccgcaguaggggaggcgggucggccgaggcggggagaaacccuuaggccgcaggcggggaggcggggcu

SEQ ID NO: 143652 - RNA, 46 nt, Homo sapiens
gaggaauagagugggacguaaagucgagaaaugcaaguauuugcag

SEQ ID NO: 143653 - RNA, 46 nt, Homo sapiens
gcuuguacacgaggauaaagccucucuccaagugccugccgaugug

SEQ ID NO: 143654 - RNA, 45 nt, Homo sapiens
cagauguggcugaucagccaaggggauggcuucagccagaggcac

SEQ ID NO: 143655 - RNA, 45 nt, Homo sapiens
ucauggagucugaacgucggaaaaauggaugguuuuggccaguuu

SEQ ID NO: 143656 - RNA, 45 nt, Homo sapiens
cauuuggcaguaucuacagacauucuugguuaucacaacuguggg

SEQ ID NO: 143657 - RNA, 51 nt, Homo sapiens
augcacaagacagccucccacaauuacccaguccaaagaugcaauaaugca

SEQ ID NO: 143658 - RNA, 42 nt, Homo sapiens
uguggauuccugaugauguaggaugacugagacugacuggag

SEQ ID NO: 143659 - RNA, 68 nt, Homo sapiens
ucaaacacgacauuuccagagaaggauuaaucagaaucuguuaccugguagcaauuuaccugcuagac

SEQ ID NO: 143660 - RNA, 32 nt, Homo sapiens
augaagccauuuccacacucagaauaacaaaa

SEQ ID NO: 143661 - RNA, 41 nt, Homo sapiens
ucuuacuuggcagaaagaaguucucguagauagggcuggag

SEQ ID NO: 143662 - RNA, 116 nt, Homo sapiens
aaaaaaaguacuuucucccaacuuauuaauaagauucacaaagguugcucuuggugccugggauaauaccucccaacuccaucccugugucuaaggggccuaucugaucuguccgg

SEQ ID NO: 143663 - RNA, 45 nt, Homo sapiens
cugacuuuuuuaaguuauuugauuuuaacaaauuuaaacagccac

SEQ ID NO: 143664 - RNA, 56 nt, Homo sapiens
aggcuugagacacuuuguauuuauguuaacauagaucaaaaaugaaaagauggaaa

SEQ ID NO: 143665 - RNA, 41 nt, Homo sapiens
cuuccuugcugguagaaccccuuucauuaucaaaugaggcu

SEQ ID NO: 143666 - RNA, 39 nt, Homo sapiens
gcaacagcucagagucucucucuaagggaagaaggagaa

SEQ ID NO: 143667 - RNA, 46 nt, Homo sapiens
uucagaaaacauggcaucugcaucaauaaugacacuugggugggca

SEQ ID NO: 143668 - RNA, 57 nt, Homo sapiens
gguccauuuucaccuuacuauuuauuaaacaaaaauaaacucccuucucuaccccaa

SEQ ID NO: 143669 - RNA, 64 nt, Homo sapiens
auaauaagagaaauggguuauaaacuggagaauaaaacaaauauccaugagacuauaaugaugu

SEQ ID NO: 143670 - RNA, 28 nt, Homo sapiens
uccuucugucuuaccuaauuucauuugu

SEQ ID NO: 143671 - RNA, 63 nt, Homo sapiens
acauagcuacuagucucaggccuacacugaaacaaacugugggaaaccuuaauuuacccuuca

SEQ ID NO: 143672 - RNA, 49 nt, Homo sapiens
cccaaguugaagcugaacauggaacacucgcuaguaagaucuuggggaa

SEQ ID NO: 143673 - RNA, 21 nt, Homo sapiens
ccaggaaucgucucagguagc

SEQ ID NO: 143674 - RNA, 25 nt, Homo sapiens
uagcuacagaugaagugacuuaaau

SEQ ID NO: 143675 - RNA, 46 nt, Homo sapiens
uuugaaacuccugucuauaguaucuuaccuuguguuaugacaccug

SEQ ID NO: 143676 - RNA, 45 nt, Homo sapiens
guuucuugguacauaaaguuaggacuaauauagaaaacaugcccu

SEQ ID NO: 143677 - RNA, 49 nt, Homo sapiens
ugaaauggcaagucugaagagcaauaaauaaacacagguuucuucugag

SEQ ID NO: 143678 - RNA, 41 nt, Homo sapiens
aaacuuuggaaaauuugaaagggcacaaaguaaagaaaagg

SEQ ID NO: 143679 - RNA, 46 nt, Homo sapiens
caccagucagggucgacagaaaacagguggcacacuaaaccugggc

SEQ ID NO: 143680 - RNA, 45 nt, Homo sapiens
aacauuuaauuuggugauuacccucacaaaaagaaacugcacaaa

SEQ ID NO: 143681 - RNA, 33 nt, Homo sapiens
agggcuacgagcgucuccugaagaugcaaaacc

SEQ ID NO: 143682 - RNA, 32 nt, Homo sapiens
ggccggcccggaggcugggcugggcgaguaac

SEQ ID NO: 143683 - RNA, 80 nt, Homo sapiens
ucuucgaaagacacucucucaagcaggacuaagagccuucugagcccagcgacuucugaagggccccuugcaaaguaaca

SEQ ID NO: 143684 - RNA, 20 nt, Homo sapiens
guauuuaaaaaacauuuaau

SEQ ID NO: 143685 - RNA, 59 nt, Homo sapiens
uugcugccacccugucuaauccagcaucucucacucaagccagugcagccaccccuaac

SEQ ID NO: 143686 - RNA, 58 nt, Homo sapiens
aauguugauguuguccuguuaauuuauaggcguuuuuuggggauguggagguaguugg

SEQ ID NO: 143687 - RNA, 63 nt, Homo sapiens
uacaauuuguuuuugcauuuuuguuuugaaaguuuaacaaaugacuguaucuaggcauuucau

SEQ ID NO: 143688 - RNA, 56 nt, Homo sapiens
aagcacugguuucaagaauauggaggcuggaaggaaauaaacauuacgguacagac

SEQ ID NO: 143689 - RNA, 47 nt, Homo sapiens
acaggcaggucacagaaaggcagguuucauuucuuaucacauaagag

SEQ ID NO: 143690 - RNA, 48 nt, Homo sapiens
cuaccuccaaccccugcucccacacagugacagaccggaaagugaaga

SEQ ID NO: 143691 - RNA, 46 nt, Homo sapiens
augcccggcgccaucuaucagccaagaagcuaccaaacuggcagau

SEQ ID NO: 143692 - RNA, 45 nt, Homo sapiens
ugagcccgaauggcaccagacucucucccauugccccugcuccug

SEQ ID NO: 143693 - RNA, 45 nt, Homo sapiens
gauuuuaagaaauacguugaaaacagaccuguuacaccaguaucu

SEQ ID NO: 143694 - RNA, 73 nt, Homo sapiens
agggcuggugaggaggaggaugacgagcgggggaggaguggggagggggccguugcccugcagcgagguuggg

SEQ ID NO: 143695 - RNA, 42 nt, Homo sapiens
gcgagcccauuggccggcgccucacacaccuuugccguugau

SEQ ID NO: 143696 - RNA, 48 nt, Homo sapiens
ccacugcugcacacagcuggugucggugccgcgcuuuuacccccaagu

SEQ ID NO: 143697 - RNA, 48 nt, Homo sapiens
ggugggaagaggauucggacucgucacacugcagagcagcagagcgag

SEQ ID NO: 143698 - RNA, 47 nt, Homo sapiens
uuccuuuaaaaaauuuccacugcaccguauugcaacguucgagcacu

SEQ ID NO: 143699 - RNA, 90 nt, Homo sapiens
ccauccggggagagccaucgcucacugacccaggaaggugucaaacgaggaaguagcagcaguaacagguaccgaggcagacagccuagc

SEQ ID NO: 143700 - RNA, 56 nt, Homo sapiens
ccuccuucucuuccuuagagacggaaccuaggcccaagacggugaauuggcgccga

SEQ ID NO: 143701 - RNA, 75 nt, Homo sapiens
ucucuccuccaggaggagucuggaaauguaugggagcauuuuggguugucccaauguggagaucgcuaaucagca

SEQ ID NO: 143702 - RNA, 57 nt, Homo sapiens
agcuuacaauugggggugggagaggguggcaggucuuacgagcaggcaggucugugu

SEQ ID NO: 143703 - RNA, 49 nt, Homo sapiens
ucagucauguuuguuacuagguauuuccucaaaaaucaagagagauucu

SEQ ID NO: 143704 - RNA, 42 nt, Homo sapiens
ggggccgagggcggcggggaccgcggguugggagaccggccg

SEQ ID NO: 143705 - RNA, 45 nt, Homo sapiens
agcgagcagauccgggcgcaggcugaggagaggaggaagacccug

SEQ ID NO: 143706 - RNA, 1190 nt, Homo sapiens
gcccggcagcgcuacgaggaccaacugaagcagcaggugagcucagccuccccugcgaggcgccugcgucccugagaacguagguggcuuugugggaccagucagugggucagaggccacggggcaagaacgcugggguugcugacggugggugcuagagcaggggaaacuacucggacagacacgcaccagcacacguguacaggcacacaugcagacgugugcacacauguacauggagacacaggcaccuacccacacggacacacacuccucgcacacacacucccagcacacacagacaggugcacccacuucugcacacacgggcacacacacaccccugcacacacgggcccacacacagacacccccacacagaggccugcacucacacacccgcaaacauacccccacacaacacgggcaggcacacacccacauggacacucacaccuguaaacacacccccauacagacagguacgcacauacaccccgcacacacacacacagauacgcacacacacaccacacacagguacguacccccccacacacacacaggcgcacacauaccccccacaggcucacuggcacccgcgcacucgggcacacacacagccccacacacacaggcgcacacccacacacacaugggcaugcccccccauagacggacacacacacacccacacacaugggcgcgcguacaccccccuauacacaugggcacagcccccccgcacacaugggcacgcacacaacccccccacaugggcgcacagaccccacacacacauacgggcacacacgccuucccgucacagggacacacacacacacccgcacaugggcacacacccacacacgggcguacacacccccccccacaggcacgcacaacccccccaccccccgcacggguacacacacacacacacacacacacccaaacgggugcacaacccacccacacaugggcacaaucacccccacacacaugggcacagucacccgccugcacauucgggcaccgucaccccccgcaaacgggcaccgucacaccccgcaaacgggcacacucaccccccugcacacucgggcacagucaucccccgcacacaugggcacagucacagguuuuaaaggcuuuucucuuuuucugcggcuucuucucagcaacuucuc

SEQ ID NO: 143707 - RNA, 886 nt, Homo sapiens
uccgaaggaaggcguccgcuucauccacaaagagcaggaggcugugaacgagagggaggccaagcagggcgagagugacaccaggagcagcccacagcagcguccggccgcggcaggagcaggccaagcaggcagauccccacggggucaggcucugccccaucagcagcccuaaguccuggacucgacagaagccgaucagccuggccucugggcagcugaccacggcccagccucagaaggccgugggaaaccaaccacacacgggggcgacgaacuccgccccacaggcuucacccccacccggcccagugcagcacugguggccgcuuagaguccacgacagggacaggucuucuaaagugaaaggucaaaggccagaggggagggugccaaccaugagcaucgugguuccaacgaggacagccgaggccacaagggugcccgggcugugcccugcgcggggucacugugggaccuauugaagggagugugccaugcugucuucagcuaacuuucaaaugguucuagaaaaggcaaccagugcccacgcccaccugcaggcguguuggggggagggcggcuguggaggagccuccccugcagcugugaagacuccucucccccugcacccacccaccucccuucugcccugagccaaguaucccacuggcagccuccacacgcugggggccucguguccaccaggguccacacucaggggacuuucccuccgagggacccuccacugggccuccugcguggccacaaggacagagcugcagaaagacaggguccccaagagacaccuggacccccuucccagaaggcagccugcugggccgcagccaagggccuggugcaugcuguggggacgucucacccg

SEQ ID NO: 143708 - RNA, 71 nt, Homo sapiens
cagcaaccaaccagagcaguucgacugggccaucaaugaccgcaucaaugagaugguccacuucgaccugc

SEQ ID NO: 143709 - RNA, 45 nt, Homo sapiens
cuggugagaauguauuuugacaaguauguucuuaagccggccaca

SEQ ID NO: 143710 - RNA, 46 nt, Homo sapiens
uggacucaggauggggagggcucguccccacgcccaggcccuuccg

SEQ ID NO: 143711 - RNA, 25 nt, Homo sapiens
ccccucccuagccagugccuacaac

SEQ ID NO: 143712 - RNA, 44 nt, Homo sapiens
agugauucauccaagccaugugguaaaaucaggaauuugaagaa

SEQ ID NO: 143713 - RNA, 46 nt, Homo sapiens
gugaaccaauuacuguucccagauguaugaaaauggccuacaacau

SEQ ID NO: 143714 - RNA, 38 nt, Homo sapiens
uguucuuuauaagauacuuguuaaaagaaaccacuugg

SEQ ID NO: 143715 - RNA, 59 nt, Homo sapiens
auaaugacuacuguuguguuuuaaagguagaaaccuuccuucgugauguugcauugcag

SEQ ID NO: 143716 - RNA, 42 nt, Homo sapiens
aguauuccaugggaagacuguugugauuauuuccuuucccca

SEQ ID NO: 143717 - RNA, 48 nt, Homo sapiens
agugaucaucgaguucaucacugucacuuuacugauggauacucugag

SEQ ID NO: 143718 - RNA, 58 nt, Homo sapiens
ucaagucccuuccaagucuaaaauucuuuaagucuauucaucugcaacugaacuugga

SEQ ID NO: 143719 - RNA, 81 nt, Homo sapiens
aagacucugagacagaaauacacauggaacuauaagaaguagaaguccaguuuaguggcaauggaguaaauaagagacaaa

SEQ ID NO: 143720 - RNA, 111 nt, Homo sapiens
gaacaaggauaaacuuacguuuuaaagaaucgcauugguuggaaaauugacuguaagauuagcaagugugggaaguagugagaccuguuaggaggccauuuuaguaguuga

SEQ ID NO: 143721 - RNA, 49 nt, Homo sapiens
aagggagagccaacaggauuugcugauggguuggagauggagugaaaga

SEQ ID NO: 143722 - RNA, 73 nt, Homo sapiens
ccaaauggaguugucccggagcagaugcucauucaagucugugguucacaguagacauggggacuggaugagu

SEQ ID NO: 143723 - RNA, 89 nt, Homo sapiens
uucccuugagagucaguagagauagagaagaggucuuggggacugagcucuggagcauuucaaugaucauaauugggaaauggaagagg

SEQ ID NO: 143724 - RNA, 39 nt, Homo sapiens
auccaagagaauucguguccuagaagacaagugcaaaag

SEQ ID NO: 143725 - RNA, 42 nt, Homo sapiens
uaacugaaacaaauagggaaaauaguaaauguguguccugaa

SEQ ID NO: 143726 - RNA, 46 nt, Homo sapiens
uguggugggugauucuuaccauuacuugguucuuagcugcaggaag

SEQ ID NO: 143727 - RNA, 42 nt, Homo sapiens
ccggaaccaagaaaaacuaaagaaauuuaugauucgaauugg

SEQ ID NO: 143728 - RNA, 42 nt, Homo sapiens
ugugaguuuuucuuaaagcacaauucuaaaguuaaacacaaa

SEQ ID NO: 143729 - RNA, 45 nt, Homo sapiens
cacaagcugaaggucauuuccaaauccaugggaaccagcacagga

SEQ ID NO: 143730 - RNA, 43 nt, Homo sapiens
aagaaucacuguuacauucuucuuuugcacuuaaaguugcauu

SEQ ID NO: 143731 - RNA, 50 nt, Homo sapiens
cacccaacuacaagcaguguucauggaguucauugaauuauggcauagau

SEQ ID NO: 143732 - RNA, 69 nt, Homo sapiens
aagugguuucaauauuuuuuuuaguugguuagaauacuuucuucauagucacauucucucaaccuauaa

SEQ ID NO: 143733 - RNA, 108 nt, Homo sapiens
ggacaggaaguaaaaagggccugagggaggaauuaaguuggcuagaggggaugggugaggagagagaggagguuggagaaguggccacugcaguauggugggaaagag

SEQ ID NO: 143734 - RNA, 47 nt, Homo sapiens
ugcuauaaauaaaacuacagcagaacgggggaauaguguugcuaucu

SEQ ID NO: 143735 - RNA, 42 nt, Homo sapiens
aagaaggcgucgguggauuuuacaagggaauugcuccuaauu

SEQ ID NO: 143736 - RNA, 56 nt, Homo sapiens
cuuauuugggggaaucuguugaauaacaagggggagugcucacaaauaaucuugag

SEQ ID NO: 143737 - RNA, 103 nt, Homo sapiens
gaguaacauacuauaauuuuuaugcuuccauguaauuaaacucauuuaauaaaguuaaaaucuaaugaugacaggguguggggguuaauucugaaugcaugug

SEQ ID NO: 143738 - RNA, 47 nt, Homo sapiens
aguuauuacaaguuaaguucagccuugagaauuaaaucuacagaagu

SEQ ID NO: 143739 - RNA, 42 nt, Homo sapiens
uuuuuggcauuuguagaaugguacaaguuucugugaaaaaau

SEQ ID NO: 143740 - RNA, 44 nt, Homo sapiens
aaaccaaguuggacuuacagagagguaagauaaguugguaggga

SEQ ID NO: 143741 - RNA, 47 nt, Homo sapiens
acgaguauuugcaaaaccauuccuugcuucgcuggauggucaccgug

SEQ ID NO: 143742 - RNA, 44 nt, Homo sapiens
gcaaagcauccagagaagcuggcuacuguccuuucuggggcgug

SEQ ID NO: 143743 - RNA, 67 nt, Homo sapiens
ucucaagacuaaauuucguuaggaauacuguuuaguauuuucuucuuuaaaccuaagaaauuauaaa

SEQ ID NO: 143744 - RNA, 70 nt, Homo sapiens
gaaucuaacucagcggaauuguauccguacaauacaagcacaugaaggcuuuguacgaggaauauguacu

SEQ ID NO: 143745 - RNA, 71 nt, Homo sapiens
cgcuuuugugggacuucuuuuuucacuguaaguauaauaccauuaagucauuaaauuugaucaacauaggu

SEQ ID NO: 143746 - RNA, 47 nt, Homo sapiens
gacaaaacugugaagcaguggaaaauggaugggccaggcuauggaga

SEQ ID NO: 143747 - RNA, 45 nt, Homo sapiens
aucaucacuggaaagaagcuguuuuugccacauguggacagcaag

SEQ ID NO: 143748 - RNA, 45 nt, Homo sapiens
aguugugcaucugacaggaauauaguacuguacgauaugaggcaa

SEQ ID NO: 143749 - RNA, 46 nt, Homo sapiens
auacaaucuguuggaacccuauggaagcuuucauuuuuacagcagc

SEQ ID NO: 143750 - RNA, 48 nt, Homo sapiens
auuuacuuuuagguauuuuuggguauuuugauuaaauugacauagcug

SEQ ID NO: 143751 - RNA, 47 nt, Homo sapiens
ucagcuuacaucacgagaaaaagcagccaaggauuauaaccagaaau

SEQ ID NO: 143752 - RNA, 86 nt, Homo sapiens
uuucagcauuauccucauauaaaacguauagcucgucaucgacaucuaccaaaaucuaucuauagccagauucaggaacagcgcau

SEQ ID NO: 143753 - RNA, 46 nt, Homo sapiens
aucguauuaaacacagcaagccuggaucugugccacuugugucaga

SEQ ID NO: 143754 - RNA, 38 nt, Homo sapiens
cgagggaggagaccgggcggggaggcuggguuuggggc

SEQ ID NO: 143755 - RNA, 44 nt, Homo sapiens
uggagggcaagcgugucuugaacagaacggcaggaggaugggug

SEQ ID NO: 143756 - RNA, 45 nt, Homo sapiens
uguagaaaguggccuggagggccgacuggaaaaucgcugagggau

SEQ ID NO: 143757 - RNA, 46 nt, Homo sapiens
guggaucuggcaauuuuaugggucgcggaggaaacuuuggaggugg

SEQ ID NO: 143758 - RNA, 42 nt, Homo sapiens
acuggagcccagagccgacuucuucaaucacagagaccagac

SEQ ID NO: 143759 - RNA, 45 nt, Homo sapiens
accacacacucauuccugccaauucggaugaguuuguugauagaa

SEQ ID NO: 143760 - RNA, 49 nt, Homo sapiens
aaucuucucuuugauaacagccauagcuugacugaggacagaaaggccu

SEQ ID NO: 143761 - RNA, 42 nt, Homo sapiens
ucaauacuggaaaacuuucaagucuaggauuuacagccagga

SEQ ID NO: 143762 - RNA, 59 nt, Homo sapiens
cagagaauuaauuauucuaacauauuggccucuuuguacuggaaaaguauucaguggua

SEQ ID NO: 143763 - RNA, 39 nt, Homo sapiens
auauuaauauuucuaaaauuuugucaguaguuacucaga

SEQ ID NO: 143764 - RNA, 46 nt, Homo sapiens
uagaaggaaaacucuauucaucuauugaucaugaaagcaguacaug

SEQ ID NO: 143765 - RNA, 46 nt, Homo sapiens
acugaagaugauuugacaguaaccauacggcuuccagaagacagua

SEQ ID NO: 143766 - RNA, 56 nt, Homo sapiens
cuggguaacauauuuuauguucuuuugaacuagggauucacucugugugugugugu

SEQ ID NO: 143767 - RNA, 44 nt, Homo sapiens
aaugauuguauccuacaagucuuuaacauuuguucaggcugguc

SEQ ID NO: 143768 - RNA, 46 nt, Homo sapiens
cgugauauucuccguggaaagucagugccacauuaugcugcuauug

SEQ ID NO: 143769 - RNA, 46 nt, Homo sapiens
agcuacccuacuucuucgaauagagaaagaggaauuggauaugaaa

SEQ ID NO: 143770 - RNA, 48 nt, Homo sapiens
cauuggaacaggugaacguggaaauagcgcuucugaaaaaugggaggu

SEQ ID NO: 143771 - RNA, 59 nt, Homo sapiens
augugcuguauccuauuucuucugguccuuuucucauugauuaacuaccuggagcauac

SEQ ID NO: 143772 - RNA, 68 nt, Homo sapiens
gucaucgaugccuauugaaauuuuauuuauuuauuuuuaaauuuauauuaguuucuguauaaaugaau

SEQ ID NO: 143773 - RNA, 43 nt, Homo sapiens
acuaaugcccauuuccucacuguaucauaagugcuaauuggca

SEQ ID NO: 143774 - RNA, 44 nt, Homo sapiens; identical to SEQ ID NO: 51253

SEQ ID NO: 143775 - RNA, 42 nt, Homo sapiens
ugaucauaacuaguuggcuguguagaggaauagcugguagga

SEQ ID NO: 143776 - RNA, 46 nt, Homo sapiens
aggugggccuagaucaagaucugguccuucauccauggguccacca

SEQ ID NO: 143777 - RNA, 46 nt, Homo sapiens
acggcguugguaugguuuauauggauucacuuucauccuucuagca

SEQ ID NO: 143778 - RNA, 46 nt, Homo sapiens
gcuaagaaaaagaauucaauuuguaguccugauuugaauacuagaa

SEQ ID NO: 143779 - RNA, 51 nt, Homo sapiens
ucucaaaaugccaauguaaaauuuaacuuacagcaauauucaccagcagaa

SEQ ID NO: 143780 - RNA, 50 nt, Homo sapiens
cuguuucauagacagugggcucacauguuccugauagugcugcaguugcu

SEQ ID NO: 143781 - RNA, 52 nt, Homo sapiens
gugcauuaaaguuguaaacgguaacaugaaacaaaugaaaguucuugcuaua

SEQ ID NO: 143782 - RNA, 46 nt, Homo sapiens
ugaaacccuaggcagaggaggagaaauugaagguccagggcaauga

SEQ ID NO: 143783 - RNA, 46 nt, Homo sapiens
gucuuaugaagaccuauuaaaaaaauacuucauagagccugccuua

SEQ ID NO: 143784 - RNA, 116 nt, Homo sapiens
guugccauggugacaguggaccuuuccagugcagcauaugccagcaucuuugcacggacaaauaugacuucacaacacauauccagaggggccugcauaggaacaaugcacaagug

SEQ ID NO: 143785 - RNA, 111 nt, Homo sapiens
ccaacugcaaacggugccuccaaggagaaaacgaaggcaccaccaaauguaaaaaaugaaggucccuugaauguaguaaaaacagagaaaguugauagaaguacucaagau

SEQ ID NO: 143786 - RNA, 85 nt, Homo sapiens
cuugccaaaacuaugugccuuaucccaccuucaaucugccuccucauuuuucagcuguuggaucagacaaugacauuccucuaga

SEQ ID NO: 143787 - RNA, 24 nt, Homo sapiens
gacuuccagagugaagcugauugg

SEQ ID NO: 143788 - RNA, 48 nt, Homo sapiens
gcaaccuuugcacauucagauaaaaaguccucaggaaaguacuggaga

SEQ ID NO: 143789 - RNA, 46 nt, Homo sapiens
ggcagcaaugaggagcaagucaauggaagcccguuagagaggaggu

SEQ ID NO: 143790 - RNA, 46 nt, Homo sapiens
agacucccaggccuuuaaacaucauuaaacaaaacaacggugagca

SEQ ID NO: 143791 - RNA, 46 nt, Homo sapiens
uauauaaaucagauuucagauugauucgauuuaaaauggcuaagau

SEQ ID NO: 143792 - RNA, 55 nt, Homo sapiens
ucagcuguuauugggugguuugaagagauaagcguucuuuaaggccaggauaugg

SEQ ID NO: 143793 - RNA, 75 nt, Homo sapiens
gccaagugcucuguuccucuggcuaugacugugucugucgaccucaaaacagcucguugccauaucugaugaagg

SEQ ID NO: 143794 - RNA, 45 nt, Homo sapiens
uuccucuccucuccugggccuaaacauggcccagaauuuauuaau

SEQ ID NO: 143795 - RNA, 44 nt, Homo sapiens
gaguauguaugugaauugagagaacuccaacauaguaauaaaaa

SEQ ID NO: 143796 - RNA, 21 nt, Homo sapiens
aaagaaagagaggagagaugu

SEQ ID NO: 143797 - RNA, 39 nt, Homo sapiens
ggagaauauaauaacuauuuugaauauaaaccacugaga

SEQ ID NO: 143798 - RNA, 46 nt, Homo sapiens
uguagaaaaaaaaugccauguuuugguauuuuagccuuaauaaccu

SEQ ID NO: 143799 - RNA, 52 nt, Homo sapiens
aaaucucaaagccgaugagguuacuauagaccaucuggagaaagaugaauua

SEQ ID NO: 143800 - RNA, 45 nt, Homo sapiens
uaaucauuuaaacauucaaauaaaacucaauguuucuuuuuagau

SEQ ID NO: 143801 - RNA, 24 nt, Homo sapiens
acacacacacacacacacucucuc

SEQ ID NO: 143802 - RNA, 27 nt, Homo sapiens
gauuugaaagacauacuggggagacuc

SEQ ID NO: 143803 - RNA, 49 nt, Homo sapiens
agaauaaacuaguuugacugggaggguucagagaagggugauggguaau

SEQ ID NO: 143804 - RNA, 50 nt, Homo sapiens
cuugagcugagcugugaaguuuacacagguuucugacaguugagaggagg

SEQ ID NO: 143805 - RNA, 42 nt, Homo sapiens
aguugccugaagcuucuuaagaagaagcccuggaaacaaaau

SEQ ID NO: 143806 - RNA, 44 nt, Homo sapiens
gguagacuguaaucaggaagaugugccuaucagggauggaaaaa

SEQ ID NO: 143807 - RNA, 28 nt, Homo sapiens
auugaauaaugcccaauguauaagucag

SEQ ID NO: 143808 - RNA, 46 nt, Homo sapiens
uggauuugguugguaauuguuuguacucacauuuacaucuggacau

SEQ ID NO: 143809 - RNA, 46 nt, Homo sapiens
acugcuagucucucuuaaaguaugguaaugaggcuaauuaggagag

SEQ ID NO: 143810 - RNA, 44 nt, Homo sapiens
cauuggguuuggaauucacuuucuggcuccauaucacgaucaga

SEQ ID NO: 143811 - RNA, 24 nt, Homo sapiens
cacucuaaccacccuuuuguacac

SEQ ID NO: 143812 - RNA, 35 nt, Homo sapiens
guuuucaucuuuaucugagacaugugaugaacugu

SEQ ID NO: 143813 - RNA, 44 nt, Homo sapiens
agcauaaaugugcacauacacuguaaaauugugggguguaggga

SEQ ID NO: 143814 - RNA, 46 nt, Homo sapiens
ugaaucaucaagaaagaaaggggcuaaaaauuccaaagcaguaggg

SEQ ID NO: 143815 - RNA, 42 nt, Homo sapiens
aaauaucaaucuuaaucugauauaugggcuuuucauuaaacu

SEQ ID NO: 143816 - RNA, 45 nt, Homo sapiens
auuuugguuaguagcuaccuguuggaaaguagaaagaugaaaggu

SEQ ID NO: 143817 - RNA, 46 nt, Homo sapiens
ugcucaaggacgcaucaaaugaaugaacaaagacuagagacagagu

SEQ ID NO: 143818 - RNA, 49 nt, Homo sapiens
agcaaaguaguuauuucuucaaugaggguuuccauguugaccggucaug

SEQ ID NO: 143819 - RNA, 46 nt, Homo sapiens
ugucuauuaaaguagcgcauaauuuccagagcaguucucuugagau

SEQ ID NO: 143820 - RNA, 48 nt, Homo sapiens
aacaucucuguugugcccaagguuauggagauuuucuugcagucauag

SEQ ID NO: 143821 - RNA, 60 nt, Homo sapiens
cucuucagguuuuuugugugugugucugccauugaggaguauaaaacuuuuuucaaaguc

SEQ ID NO: 143822 - RNA, 44 nt, Homo sapiens
cucuaugccuagaaauaaacucugaaaaguuagaaacuaaauau

SEQ ID NO: 143823 - RNA, 42 nt, Homo sapiens
gcaguaaauauuaucauccuuagcuuuccauauuuuuguuca

SEQ ID NO: 143824 - RNA, 48 nt, Homo sapiens
acacuuaaaaaaggacaauguggauggaucuagcuauugacaugagau

SEQ ID NO: 143825 - RNA, 55 nt, Homo sapiens
gaggagaauggaagagagaaagggagggaggaagauuggaagcaauugagauaug

SEQ ID NO: 143826 - RNA, 65 nt, Homo sapiens
ucacuugaauuguaguuaaugucuuuccuguuguugccuccuguaccagacuacaaguuacguaa

SEQ ID NO: 143827 - RNA, 24 nt, Homo sapiens
uguuuuguuuggugggugagggac

SEQ ID NO: 143828 - RNA, 49 nt, Homo sapiens
auugugaagcuaucugguccuuuuuaaaaauauaacacucuucugagga

SEQ ID NO: 143829 - RNA, 49 nt, Homo sapiens
aauuuuaaucugucugacuuucacagucaucuucaguaugaacagaaga

SEQ ID NO: 143830 - RNA, 40 nt, Homo sapiens
acccagauaaaaauuccacauaccuaagaaggcaucaggu

SEQ ID NO: 143831 - RNA, 45 nt, Homo sapiens
guuuaaggaacacuaaaaggccuauguuuauucaguuaaacuuga

SEQ ID NO: 143832 - RNA, 24 nt, Homo sapiens
uuaagcuuuagcuaaugaagacac

SEQ ID NO: 143833 - RNA, 46 nt, Homo sapiens
ggaaaauuaguauggcaucuuaccccuacugucagauuuugaaaau

SEQ ID NO: 143834 - RNA, 23 nt, Homo sapiens
ccaaauucaugcuaauagggacc

SEQ ID NO: 143835 - RNA, 98 nt, Homo sapiens
agaugaauucuguggucuaagacaaucgaauucuuugggcugauacaccugugaauguuagcaauaacaauaacagacaaaaggaaugacagcagaaa

SEQ ID NO: 143836 - RNA, 47 nt, Homo sapiens
cccguguguuucgauaauuguagaaauagaauauuauaaaugcagag

SEQ ID NO: 143837 - RNA, 44 nt, Homo sapiens
auguugucauaguaaccagaauuauaaaacgaauuuaaagagga

SEQ ID NO: 143838 - RNA, 48 nt, Homo sapiens
gauaccagaugugacaaacaaaaaugauuuucuauuuuggcucuggcu

SEQ ID NO: 143839 - RNA, 44 nt, Homo sapiens
gggugacgagagacuuugggucuguggugcucugugguccggga

SEQ ID NO: 143840 - RNA, 48 nt, Homo sapiens
gaaagaugccccaaagucuuaaguacccccagggaaaguagaucaaag

SEQ ID NO: 143841 - RNA, 52 nt, Homo sapiens
aauacaguauaaggagccacagagaggaauuuuaagauuuuuuuuaagggag

SEQ ID NO: 143842 - RNA, 46 nt, Homo sapiens
aauagguccugcuccaauaggaacucuuauaccucuuuaaagagau

SEQ ID NO: 143843 - RNA, 46 nt, Homo sapiens
cauagccucaacacuuaauaacauuccuagcacuuaacagauguuc

SEQ ID NO: 143844 - RNA, 48 nt, Homo sapiens
uaauuuucuauuuuucacauucauuuuagagggaagaaugauacaguu

SEQ ID NO: 143845 - RNA, 52 nt, Homo sapiens
uugaaaauauuuuuguaacagguuucuauaagaagguguggguacaaguguu

SEQ ID NO: 143846 - RNA, 54 nt, Homo sapiens
aaaucaaaauaaugaguacuaacugacaaggaccauuuaauaaucuacccagcu

SEQ ID NO: 143847 - RNA, 77 nt, Homo sapiens
guagagacgaguaugaaauauauuuaaaacucauuacgauacuuuaguucauuugcuauuuguacaaaggaagcuca

SEQ ID NO: 143848 - RNA, 44 nt, Homo sapiens
aaguuuuacuacauaguuagguaauagucaaaauuaacacaaau

SEQ ID NO: 143849 - RNA, 32 nt, Homo sapiens
cuucauuuccuguccuacacugguggauguuu

SEQ ID NO: 143850 - RNA, 84 nt, Homo sapiens
gauuuguuuucauuagcuaacuaauggcucugugcauugagccuguugcucuuuacuaccagaauuguguagugcugggcaugu

SEQ ID NO: 143851 - RNA, 47 nt, Homo sapiens
augagaaaauaagucacagcaaauuacggaauuuaaauuuuaacaaa

SEQ ID NO: 143852 - RNA, 31 nt, Homo sapiens
uagccuguuucuccugaucuccuagggcaca

SEQ ID NO: 143853 - RNA, 31 nt, Homo sapiens
ucaaacacaaauacauucccuuagguaauua

SEQ ID NO: 143854 - RNA, 46 nt, Homo sapiens
acaaaauacaaucucuguugccucucauccaguggauaauagagaa

SEQ ID NO: 143855 - RNA, 78 nt, Homo sapiens
gugcucgacauuguuguuagcaguaaacguuuauaauacguuuaaguuuagauuaauucgucucuucaugaggacauu

SEQ ID NO: 143856 - RNA, 47 nt, Homo sapiens
uaauaacaauuuuauuuuaugaggaaacgugauauccccuggaaaac

SEQ ID NO: 143857 - RNA, 44 nt, Homo sapiens
aauuuuuuauucuaaauauuggucacagaaaaaugaaugcaucu

SEQ ID NO: 143858 - RNA, 45 nt, Homo sapiens
ggaucugagccauuauaggcccucaauacauuagcugaaugcagu

SEQ ID NO: 143859 - RNA, 47 nt, Homo sapiens
gagaaaaugugagucuucucccuguauuuguucaauaaauugaaagg

SEQ ID NO: 143860 - RNA, 65 nt, Homo sapiens
gaagaagggauaugaauuaucuagauaggaauuagagagaauauuuaagaaaacacagaguuaac

SEQ ID NO: 143861 - RNA, 46 nt, Homo sapiens
uggguaauaaaagcaucuuuuaaucauuugcuauuugauauggcau

SEQ ID NO: 143862 - RNA, 41 nt, Homo sapiens
aaagcuaaagacucaucagauuauuucagcuuagcacagag

SEQ ID NO: 143863 - RNA, 49 nt, Homo sapiens
ccgggaugaggguagcucaagggacuagggaccguggcaagauggugaa

SEQ ID NO: 143864 - RNA, 61 nt, Homo sapiens
auuauaaaaugcauuuuacuuccgccuuugaacauaauuuuauuccaauuuuauuccaugu

SEQ ID NO: 143865 - RNA, 82 nt, Homo sapiens
gauuguaaaguacauuauguaacuucauucaucauguagaccucagacagauacuuuaauuuuuuuuugaaaaggucuugua

SEQ ID NO: 143866 - RNA, 49 nt, Homo sapiens
gacuugaaagaaagggagaaaaaaauccuccccuauuauucauuaauga

SEQ ID NO: 143867 - RNA, 47 nt, Homo sapiens
uaaauugcuagggcuaaaaaugcuagggaugagguaauaggaagcuu

SEQ ID NO: 143868 - RNA, 30 nt, Homo sapiens
gugauuaaguacaggccaauaaugggaaga

SEQ ID NO: 143869 - RNA, 50 nt, Homo sapiens
auguacuuuguaaugcugaugcaguaacauuaaagaauaaaagacagagg

SEQ ID NO: 143870 - RNA, 52 nt, Homo sapiens
aagucaacaacuugaugauuugguuucauauaaaagauguacaccuggggga

SEQ ID NO: 143871 - RNA, 60 nt, Homo sapiens
aacaaacaaacaaacagauuaaucagauuaauaaacagcaacaugaagguggauggagcu

SEQ ID NO: 143872 - RNA, 41 nt, Homo sapiens
ccugaccuguuuuauaaauugugggaauagccuuuuuagau

SEQ ID NO: 143873 - RNA, 46 nt, Homo sapiens
caaaaauugguguaauauucacacuucucuuacuuuguaccacaga

SEQ ID NO: 143874 - RNA, 44 nt, Homo sapiens
aagcauuaugacagcuugggaacuuaaagugaguacaguaaaga

SEQ ID NO: 143875 - RNA, 43 nt, Homo sapiens
guuuaggauaccucugauucucgugagaauucuguggggcaua

SEQ ID NO: 143876 - RNA, 41 nt, Homo sapiens
acuugaaaaacaaaaacagguauagcuagagggccacagca

SEQ ID NO: 143877 - RNA, 24 nt, Homo sapiens
agucuuuguuucacaccuaagagu

SEQ ID NO: 143878 - RNA, 51 nt, Homo sapiens
gguuuauuuaggauaaaaagcagagacauaaaugcuacaaacauauauggu

SEQ ID NO: 143879 - RNA, 44 nt, Homo sapiens
gaucacagaauuuaugguaguucuuuugaaaauugucugaagau

SEQ ID NO: 143880 - RNA, 46 nt, Homo sapiens
auaucuaauggauagcuggaaacguaggcugucauagggaauagag

SEQ ID NO: 143881 - RNA, 45 nt, Homo sapiens
uguggguuucaggagaggagguggccucuagggugaggcuaggga

SEQ ID NO: 143882 - RNA, 49 nt, Homo sapiens
cgaugaugccuguuuuguucacagucagauguucaaaucagaauuuugg

SEQ ID NO: 143883 - RNA, 41 nt, Homo sapiens
cuuugcugcaaaagaaucaugucaaggggcugcugaugaau

SEQ ID NO: 143884 - RNA, 25 nt, Homo sapiens
cacagcuuuauaucagugguuagga

SEQ ID NO: 143885 - RNA, 47 nt, Homo sapiens
ugagcauucuuagauguuggaagugaagaguauacagaagguggccc

SEQ ID NO: 143886 - RNA, 33 nt, Homo sapiens
ugucucugcuucugugccauauagauguauuuc

SEQ ID NO: 143887 - RNA, 89 nt, Homo sapiens
uuguugauaccggacagacuauugagaugcaaaaauguucuuuuggggacaguccauuggcagccaaacagacguuuaaacaagugaca

SEQ ID NO: 143888 - RNA, 38 nt, Homo sapiens
agagcaaguauauuaauacauuuauauauacaguuucu

SEQ ID NO: 143889 - RNA, 72 nt, Homo sapiens
uuaagacaccuaacagaauuaagaaacagcccauucucauugugaauuugacaccaauucuacuuugguggu

SEQ ID NO: 143890 - RNA, 43 nt, Homo sapiens
aaauuccaacccuaugauuuauuaucuucaaaggcuguaaucu

SEQ ID NO: 143891 - RNA, 80 nt, Homo sapiens
uacaaucugcuaacuccagacucuaaaaugggagagccaguuucugagaguguggugaagagagagaagcuggaagagaa

SEQ ID NO: 143892 - RNA, 47 nt, Homo sapiens
gauaaaucuuacaugagcucacuauuacgaaaauucaccauauggac

SEQ ID NO: 143893 - RNA, 48 nt, Homo sapiens
caaaguaagaaaaauuuuuggagccuuuguucucccuuucaucaagag

SEQ ID NO: 143894 - RNA, 46 nt, Homo sapiens
accaaaugugauuuuauuacccaaguggaagaagagauuucccgac

SEQ ID NO: 143895 - RNA, 41 nt, Homo sapiens
ggcucugucauuaaucagaaugaucuagccaaaaguucaga

SEQ ID NO: 143896 - RNA, 42 nt, Homo sapiens
uugggaaaauggcaggacaagauaacagucaaagcaggagau

SEQ ID NO: 143897 - RNA, 46 nt, Homo sapiens
cucauccaccgaauuagaacaacauuuucuucagacucacccaaac

SEQ ID NO: 143898 - RNA, 45 nt, Homo sapiens
auuguucucacuguguauuuguuuuuacccuagaaaagaauagau

SEQ ID NO: 143899 - RNA, 46 nt, Homo sapiens
gcaccaggcaagaugcugagcuggacagcaaaaucuuggcccuuca

SEQ ID NO: 143900 - RNA, 46 nt, Homo sapiens; identical to SEQ ID NO: 51414

SEQ ID NO: 143901 - RNA, 46 nt, Homo sapiens
gucaagguuugagcccaguuucaguggccucaaaaaacccacaagu

SEQ ID NO: 143902 - RNA, 46 nt, Homo sapiens
ccucaagauauggccugcacccccucaggggacucacuggagacaa

SEQ ID NO: 143903 - RNA, 90 nt, Homo sapiens
gcauguucaagauccaucuucuagcaguaagaaggacuugaaaagcgcaguucugagugagaaggcuggcuucaauuaugaaagccccag

SEQ ID NO: 143904 - RNA, 113 nt, Homo sapiens
gguacagaaagcaagguaucuggaaagaacaaagaauuuucugcagaucagaugucagaaaauacggaucagagugaugcugcagaacuaaaucauaaggaggaacauagcuu

SEQ ID NO: 143905 - RNA, 44 nt, Homo sapiens
ccauaaacacauauauguauuuuauaaacauaacauguguacau

SEQ ID NO: 143906 - RNA, 48 nt, Homo sapiens
cacaaagauuacuaaccucuguggaaaaguacccugacuuuacagcgu

SEQ ID NO: 143907 - RNA, 46 nt, Homo sapiens
gaauguuauagaaagauugcacaguauuuaacaagcugugaguuaa

SEQ ID NO: 143908 - RNA, 57 nt, Homo sapiens
ccaaugcuauugucauuuucaccucuggauuuuaaagaauugugguaaauaccaugc

SEQ ID NO: 143909 - RNA, 48 nt, Homo sapiens
aauuaugcugagaccaagcaugcuuccucuggcuuauucugcccugcu

SEQ ID NO: 143910 - RNA, 45 nt, Homo sapiens
uuugaacaaagguaacacuuuuugauuuguguaauuuuuuaguag

SEQ ID NO: 143911 - RNA, 64 nt, Homo sapiens
gugaauuguuccugagguuuaaaucuuacgguuacuugucguggacuuugcuuuuaacccaaau

SEQ ID NO: 143912 - RNA, 45 nt, Homo sapiens
ucugauggacacaauaauguagaacuugacuuugguuagaaagag

SEQ ID NO: 143913 - RNA, 52 nt, Homo sapiens
uuuacuuugauggcuuaucugugaaaaugacauuuaucuuuuguuauuauac

SEQ ID NO: 143914 - RNA, 43 nt, Homo sapiens
gagagauaauaaguacaaaagaaaaauacagauagggccugag

SEQ ID NO: 143915 - RNA, 44 nt, Homo sapiens
ugccauuuuggaaaaucacggcuagaguuuaagcgagguaagug

SEQ ID NO: 143916 - RNA, 45 nt, Homo sapiens
ggacagacgcuuugccuucugucugguuccuguuugggaucuaga

SEQ ID NO: 143917 - RNA, 47 nt, Homo sapiens
cuccguauggucuccaaagugggaaaacagcacaggacugccuuugg

SEQ ID NO: 143918 - RNA, 41 nt, Homo sapiens
gugauuucuuucuuucuuucuucucuucugcucccuuuuuc

SEQ ID NO: 143919 - RNA, 42 nt, Homo sapiens
uaagggugggggagggaaaggggggggaggcaggaaagaccu

SEQ ID NO: 143920 - RNA, 23 nt, Homo sapiens
uuaaacaaaaaacaacacccccu

SEQ ID NO: 143921 - RNA, 86 nt, Homo sapiens
uaauaguguuggugucuugaaacugacguaaugcgcggagacugagguccugacaagcgauaacauuucugauaaagacccgaucu

SEQ ID NO: 143922 - RNA, 46 nt, Homo sapiens
ggcucgccgcggccggggccggucccggcgggcggcggcggcgggu

SEQ ID NO: 143923 - RNA, 51 nt, Homo sapiens
ucgguuuggcggccacgcacugccccccaccugccccccacuaccccaagg

SEQ ID NO: 143924 - RNA, 50 nt, Homo sapiens
cuuuacauucaauaugaugugccuguaaaccaaggaguuuuccccguuug

SEQ ID NO: 143925 - RNA, 49 nt, Homo sapiens
aagaaaaauacauccaaauaaagacuuuauuauuaacagaccagauagc

SEQ ID NO: 143926 - RNA, 48 nt, Homo sapiens
uauuuauuguaaguuuuaguacugaucuccuuuuccagugcugcacac

SEQ ID NO: 143927 - RNA, 45 nt, Homo sapiens
ccugccuacuacaaggacagacugaugggaaauuaugcaccuggu

SEQ ID NO: 143928 - RNA, 50 nt, Homo sapiens
caguaacacuggcaaucuuccuguuaaccacucuccuuagggaugguauc

SEQ ID NO: 143929 - RNA, 47 nt, Homo sapiens
uuacugcauugaaaaggaaaaccugucugagaaaaugccugacaguu

SEQ ID NO: 143930 - RNA, 48 nt, Homo sapiens
uauagcuaguguuugauucacuagugcuuacaaauugcccccaugugu

SEQ ID NO: 143931 - RNA, 54 nt, Homo sapiens
ccgcaaaguucuacagcuucuugguucuuaaaaagcagcaagcuauugagcuga

SEQ ID NO: 143932 - RNA, 45 nt, Homo sapiens
ugaagaugcaucagggggcgaucaagaucaggaagaaagaagaug

SEQ ID NO: 143933 - RNA, 59 nt, Homo sapiens
agaacuucugccagaaaaagagaaggagaaagagaaggaaaaagaagaugaugaagagg

SEQ ID NO: 143934 - RNA, 76 nt, Homo sapiens
uagagcagauggaaauaccaccuguagagcuucccccagaagaaccuccaaauaucugucagcuaauaccagaguu

SEQ ID NO: 143935 - RNA, 77 nt, Homo sapiens
aguagcaagugguauuuagggaggccuuuuaaaguaucuugguuuugacagaaaaugguaaggaaugaguccagagg

SEQ ID NO: 143936 - RNA, 92 nt, Homo sapiens
gaagagccaagccgccuccaggagucagugauggaggccagcagaacaaacauagaugagucagcuaugccuccaccaccaccucagggagu

SEQ ID NO: 143937 - RNA, 73 nt, Homo sapiens
ucuauaauacuguucaaaacuguaugaccuauguuuucucuucauaugaccaauugcagaugagcccauuauu

SEQ ID NO: 143938 - RNA, 46 nt, Homo sapiens
aaauguuugggcagggaaaugcauuggaucugauugccuuauuuaa

SEQ ID NO: 143939 - RNA, 64 nt, Homo sapiens
aaagaauuugaaaauccagagguuccuagagaggaccagcaacagcagcaucagcagcgugaug

SEQ ID NO: 143940 - RNA, 43 nt, Homo sapiens
cucuuuacacgcugucuuacaccgcuuguaccagaagaccuua

SEQ ID NO: 143941 - RNA, 44 nt, Homo sapiens
gacagugucaaagaguuggauagcaagacaauuagagcccaacu

SEQ ID NO: 143942 - RNA, 45 nt, Homo sapiens
uucaguggaucccguugaaccaaugccaaccaugacugaucaaac

SEQ ID NO: 143943 - RNA, 46 nt, Homo sapiens
ggaugaggaugauaauguaucaaguaagcauuucauguucagugau

SEQ ID NO: 143944 - RNA, 68 nt, Homo sapiens
uuaaccauuuagaauaugaagaucaauauaaggaugauaauuuuggagaaggaaaugaugguggaaua

SEQ ID NO: 143945 - RNA, 68 nt, Homo sapiens
aguaagcacuacuacuucuaaccuccuauuagagucugaacagagcaccagcaaucugaaugagaaaa

SEQ ID NO: 143946 - RNA, 55 nt, Homo sapiens
gcccagcaguucagcuugaaucagaguagaguggaagagauaaccaugagagaag

SEQ ID NO: 143947 - RNA, 49 nt, Homo sapiens
uauuaaagucagcuacuggauuggccaggcuauacucagagccauaauu

SEQ ID NO: 143948 - RNA, 28 nt, Homo sapiens
uaagcaguaguauuagcuuccaaaugua

SEQ ID NO: 143949 - RNA, 46 nt, Homo sapiens
uuacuuuaccugaagaauuucaugacuuugaucagccacugccuga

SEQ ID NO: 143950 - RNA, 81 nt, Homo sapiens
cucaauuggcugaacuguguuucaugcccacugaagaacagguauuagcagagaggaaugagacaucugucaauguggggg

SEQ ID NO: 143951 - RNA, 96 nt, Homo sapiens
uuagcuuccuguccucauacuuuagcauugugguuuacagggugacugcaugaagcaccaagcaagcccuaccuauucacaaagcaggaaagaggg

SEQ ID NO: 143952 - RNA, 95 nt, Homo sapiens
augcuuuccaauuaauggaaacuuaguuaaaaaguagcuuaaacaauaagggaaauaacaggcuuaauuaacuaaaauuuuggaaacagggagau

SEQ ID NO: 143953 - RNA, 77 nt, Homo sapiens
aauguuuaaaagcuuuuuuuguuaccuuagaacuuguugugcuuuauggcgugguuugggaaaguaucuggggaugu

SEQ ID NO: 143954 - RNA, 56 nt, Homo sapiens
ugcuguaagucacauaaaaugcucauaaauacagaaccugagagucauaaguaggg

SEQ ID NO: 143955 - RNA, 79 nt, Homo sapiens
auaccucauuuuaccuacuccuaggcuaaacucugaaccagacuaauccagaaagaaagcuuuugcccaaacaccacuu

SEQ ID NO: 143956 - RNA, 54 nt, Homo sapiens
gaagaaccacuggcccuauuugcagagcuuucccagaauauguagccuggaauc

SEQ ID NO: 143957 - RNA, 21 nt, Homo sapiens
acacuacaaacgaguaugaga

SEQ ID NO: 143958 - RNA, 47 nt, Homo sapiens
auaagaagcuaaccaaagcccauguguucgaguguaauuuagagagc

SEQ ID NO: 143959 - RNA, 26 nt, Homo sapiens
auauaaaggaaauauccugcaguuaa

SEQ ID NO: 143960 - RNA, 42 nt, Homo sapiens
uuugucuauuuugaauuuuuauauaaugugugagauuuaggu

SEQ ID NO: 143961 - RNA, 44 nt, Homo sapiens
gcaauuauaauuacacuuucuccuuauucagauauacaccagga

SEQ ID NO: 143962 - RNA, 29 nt, Homo sapiens
aguucaaguuccacuuccauuaaauacua

SEQ ID NO: 143963 - RNA, 46 nt, Homo sapiens
ugaacugcauaaagguuaggcagcuuaacugcuaguuaaugacaau

SEQ ID NO: 143964 - RNA, 34 nt, Homo sapiens
aagagguagcuccguucugaucugaguuagguau

SEQ ID NO: 143965 - RNA, 45 nt, Homo sapiens
acuccgcggguaaaaauggcugucugggaggaggcgguggcgggc

SEQ ID NO: 143966 - RNA, 31 nt, Homo sapiens
aaagcacugcgcgugcgcuaucuuacgcuau

SEQ ID NO: 143967 - RNA, 56 nt, Homo sapiens
aaacucacauuuccaucuggcccagagacuacccccuauuaucccugggcccacuc

SEQ ID NO: 143968 - RNA, 53 nt, Homo sapiens
augcaguccuguccagccagagccuguuuguagaaaucccagauggauuauua

SEQ ID NO: 143969 - RNA, 49 nt, Homo sapiens
gaugaggacuaauagucauagaggaugcuuuacccaagagccacagugg

SEQ ID NO: 143970 - RNA, 44 nt, Homo sapiens
uaaagaacaguauaaacauauuauucacauguaaucaccaauag

SEQ ID NO: 143971 - RNA, 47 nt, Homo sapiens
gacuucugauauuaaaugcuuucuucuacuuggaagaggccagagaa

SEQ ID NO: 143972 - RNA, 48 nt, Homo sapiens
cugcugugacaaaauugccuccaaucaaagugacccagaagaagcagu

SEQ ID NO: 143973 - RNA, 42 nt, Homo sapiens
cagccagccugaagaacaugguggaccaauuggccaauugug

SEQ ID NO: 143974 - RNA, 46 nt, Homo sapiens
acgacuacuccaugguguugacaggagcugcuauuuaccacaagug

SEQ ID NO: 143975 - RNA, 42 nt, Homo sapiens; identical to SEQ ID NO: 51508

SEQ ID NO: 143976 - RNA, 23 nt, Homo sapiens
gagguagaagguaugugcacaua

SEQ ID NO: 143977 - RNA, 41 nt, Homo sapiens
ucgaaguggcugcaccguuuuaccuuccugcuagaaaugua

SEQ ID NO: 143978 - RNA, 37 nt, Homo sapiens
cuuaccuucuugcuuaggauaucauauguuucuuuua

SEQ ID NO: 143979 - RNA, 56 nt, Homo sapiens
gcaauuaccacuugggcuaaguuuaagguucugaacugucaguagacauuuaaccu

SEQ ID NO: 143980 - RNA, 63 nt, Homo sapiens
ggcucuuuuauuguuaauccccucuuuucccccugcacccccucccugccacuguacucaggu

SEQ ID NO: 143981 - RNA, 56 nt, Homo sapiens
gagguggcagcccugacugucaaagucacaaggcagaggcuagugaugcaacagug

SEQ ID NO: 143982 - RNA, 51 nt, Homo sapiens
cugaagcccucaauauugagcccaaguuucucagggcuucucuauuagaag

SEQ ID NO: 143983 - RNA, 43 nt, Homo sapiens
auaacaaaaucagcuuugcuuuaaugcugcacaauuagcagcu

SEQ ID NO: 143984 - RNA, 29 nt, Homo sapiens
uccuacguccuuaccucuagcagguagaa

SEQ ID NO: 143985 - RNA, 46 nt, Homo sapiens
uucuuguuuuccugcugucugggauggaguagcagaugccaaggaa

SEQ ID NO: 143986 - RNA, 43 nt, Homo sapiens
ugcaucuaagaaaaagcucacuuaccuccagcaccuccaagug

SEQ ID NO: 143987 - RNA, 47 nt, Homo sapiens
uuccucagaauaugugaauggcuaucaaaaauacagagacaggacag

SEQ ID NO: 143988 - RNA, 42 nt, Homo sapiens
uaaagagaaacaucagcuucuggcuuccuuagaugccauguu

SEQ ID NO: 143989 - RNA, 64 nt, Homo sapiens
gaaauaaguucaaggaaagaaaaagaagaguaugaauggaagauuauucauccaucaauccauu

SEQ ID NO: 143990 - RNA, 45 nt, Homo sapiens
uuugcuucuguccaaauggcuuuucugugccucaucuguugauag

SEQ ID NO: 143991 - RNA, 47 nt, Homo sapiens
uggaauaaaaagaaaacaacuuuucuuuguaagguuagagauuugau

SEQ ID NO: 143992 - RNA, 46 nt, Homo sapiens
ucauauauaauauggcagaacugauagcuauaauaaacagcaaagu

SEQ ID NO: 143993 - RNA, 48 nt, Homo sapiens
gaggaugacauuuauggcaugaaucauggagauggaaaccagcucagg

SEQ ID NO: 143994 - RNA, 58 nt, Homo sapiens
uuucucaucuccuuuaauuuucuuucuaucaguauuauuacugauauuacaauuuugg

SEQ ID NO: 143995 - RNA, 54 nt, Homo sapiens
aaauaaaauauaguugauucauuucauauaauuuggaauuuaaaccaggaauau

SEQ ID NO: 143996 - RNA, 44 nt, Homo sapiens
aaauccaguuggcaguugaauuccugcaguuuuaugggaauuuc

SEQ ID NO: 143997 - RNA, 46 nt, Homo sapiens
uuaaucgaccucuuuaaauacauggagguacccccuuucucguuuu

SEQ ID NO: 143998 - RNA, 58 nt, Homo sapiens
cugcaaaaggcuuagaagugcugugaggugauagcacucuuucucuguaggcuuuuug

SEQ ID NO: 143999 - RNA, 23 nt, Homo sapiens
cucugagaugagacggaugaaau

SEQ ID NO: 144000 - RNA, 45 nt, Homo sapiens
cuaugucccuaauagaagcaguaauggggaaucugucaugaugac

SEQ ID NO: 144001 - RNA, 59 nt, Homo sapiens
gcuaaaacgaaggcucaggaaauccaaaagauuuuugcaguauuugaauagaaaaaaga

SEQ ID NO: 144002 - RNA, 46 nt, Homo sapiens
auuuucugggucaucucgaugaaacuagcacuaagcaaagccaugg

SEQ ID NO: 144003 - RNA, 39 nt, Homo sapiens
cuuugaauuugggggauaggcuuagaaauagcaucagua

SEQ ID NO: 144004 - RNA, 49 nt, Homo sapiens
ucucuaggccucaguuuccucaucaauaaaauggggacuguaagugaga

SEQ ID NO: 144005 - RNA, 42 nt, Homo sapiens
aaccagccagcugagaaucaguuacuugaaauagcugcuggu

SEQ ID NO: 144006 - RNA, 87 nt, Homo sapiens
ccuuuauuuuacuauaaaauucaugaacuucuuuggucuacacaaauccaucuuccauuuuccauggcuuaccucauuuaagccaau

SEQ ID NO: 144007 - RNA, 47 nt, Homo sapiens
aguucaaaauaaggugacagucuacaaaucccuggaagacuggagca

SEQ ID NO: 144008 - RNA, 52 nt, Homo sapiens
gaaucaugggagcagaaugaucauuucuccuauaaucuggggucccagccuu

SEQ ID NO: 144009 - RNA, 58 nt, Homo sapiens
uauauugguuuuauaagaaauguuaaagaaugggagaggugauaaaacaguugcaggg

SEQ ID NO: 144010 - RNA, 43 nt, Homo sapiens
caugccaguuugggucacaaauggacaucuuaugggggcaaga

SEQ ID NO: 144011 - RNA, 59 nt, Homo sapiens
auuauauccuuguauaggugggauuacaaauaagacuccaaauauaggcugguuugaac

SEQ ID NO: 144012 - RNA, 67 nt, Homo sapiens
ugguagggcauuuguuuugaauaauucacagaugcagaguguuugcagaaccguaaugggguuuuga

SEQ ID NO: 144013 - RNA, 119 nt, Homo sapiens
cauuugaagugagggauaaucuuguggcucugagccccuaaccuguggugucugcauuaacucuggguaauuacugucagaauugaauucaaucauuagauaucaaguagguuuccagg

SEQ ID NO: 144014 - RNA, 42 nt, Homo sapiens
guucugugaccccuucuagcaaacgauugaacuugaggaggg

SEQ ID NO: 144015 - RNA, 48 nt, Homo sapiens
cugucauuagaagcuuggaacuucuaacccacccuaccccuauucucc

SEQ ID NO: 144016 - RNA, 39 nt, Homo sapiens
gggaaccuuuuccucuauguugaaauacuuccuuggaau

SEQ ID NO: 144017 - RNA, 38 nt, Homo sapiens
ccaauccucagcuuucaucuuguuuuagcagucuucca

SEQ ID NO: 144018 - RNA, 51 nt, Homo sapiens
ccaugaaaacaucucaaaugauugugcuggguguguaagcaaggcaggguu

SEQ ID NO: 144019 - RNA, 43 nt, Homo sapiens
aagugcaagaauugugagagaaauggcauauuuaggaaagaaa

SEQ ID NO: 144020 - RNA, 147 nt, Homo sapiens
gccucaguuacauuguccucuuccuuagugguaugcuucccaugguuauaauuugaagacgcuucuggccuucaaauauagugcuagcuagcaagggcacagaagaaugaaacagaguuguuugugggaaacaugaagcagaagcga

SEQ ID NO: 144021 - RNA, 68 nt, Homo sapiens
ucacuuaccugauuuguuucucuauccaaucucaguugaguuccucuaagacagggugaugguggugg

SEQ ID NO: 144022 - RNA, 31 nt, Homo sapiens
uguauuagaaaacuauccuuuaaguucuaaa

SEQ ID NO: 144023 - RNA, 15 nt, Homo sapiens
cugaauagcaagggg

SEQ ID NO: 144024 - RNA, 36 nt, Homo sapiens
uauugagagaaaauugguuucucaauagcaguggaa

SEQ ID NO: 144025 - RNA, 46 nt, Homo sapiens
caugaaauagaagguuaccugcuguuuaaguagcuaguuucuugau

SEQ ID NO: 144026 - RNA, 45 nt, Homo sapiens
aauuucccaagauguguuaauuaucauugccacacaagugcaaca

SEQ ID NO: 144027 - RNA, 46 nt, Homo sapiens
ugcuuuucgcauuuuccuucuuuuauauaccaccaugguauagaac

SEQ ID NO: 144028 - RNA, 45 nt, Homo sapiens
gcugcccuuauuuuuccagauggaaaaacggauuacccaggauuc

SEQ ID NO: 144029 - RNA, 51 nt, Homo sapiens
uugaaaugagugcaggugguugcaguccacucccuccccaaacaggacaaa

SEQ ID NO: 144030 - RNA, 108 nt, Homo sapiens
gaauuugcccacuuacuaaggcuuugagggcaggggaggugaaguaguauugugggagaggaguaauaaauguguuuucuuuucaguuucuacagugaguggucuguu

SEQ ID NO: 144031 - RNA, 44 nt, Homo sapiens
uacuuugugauauaccugaugucucugcugagugggcccuugga

SEQ ID NO: 144032 - RNA, 49 nt, Homo sapiens
uagcaaaagggaagucguggaaagaggucuguggcuugugccuuugaga

SEQ ID NO: 144033 - RNA, 53 nt, Homo sapiens
auaaauuuugauuuaacugaagcaaaugaaaucaauguaguuacucccuuccg

SEQ ID NO: 144034 - RNA, 37 nt, Homo sapiens
ucaaguagggugagugggaagagguuucuaccaacau

SEQ ID NO: 144035 - RNA, 37 nt, Homo sapiens
ugauguacuccagaccauaguaauguggcuuagccga

SEQ ID NO: 144036 - RNA, 50 nt, Homo sapiens
ugggcagcugccaacauguuuuauaggugagacacuugucuuugccaaaa

SEQ ID NO: 144037 - RNA, 46 nt, Homo sapiens
uaagagaccugagccauguuuaccuuagccacuguucacauugaga

SEQ ID NO: 144038 - RNA, 46 nt, Homo sapiens
cugcucuccugaauguuuaaugcaaaccuuaauauuuacaauagca

SEQ ID NO: 144039 - RNA, 27 nt, Homo sapiens
cuuguguugcuugucuugucgggagac

SEQ ID NO: 144040 - RNA, 45 nt, Homo sapiens
acucugcugauugaccagaauaaaagcuccaucuauuuuuaagau

SEQ ID NO: 144041 - RNA, 52 nt, Homo sapiens
uugauggauucuggggccaagcauuaagauaggacggugcacagaugacuug

SEQ ID NO: 144042 - RNA, 49 nt, Homo sapiens
uuaagaaauguaggaauagcaguuuugcaaaggaucucagcaauucuaa

SEQ ID NO: 144043 - RNA, 79 nt, Homo sapiens
guuucuccuauaaaaauguuagcugcuuggcccagaaugggcuaagauguucaaugacagagauugaguguucaauugu

SEQ ID NO: 144044 - RNA, 58 nt, Homo sapiens
uggguaacauuauagagaaguguuccagaauuaaaguagugcucugcuggccuguacc

SEQ ID NO: 144045 - RNA, 38 nt, Homo sapiens
aaagacagcuuuguauuaaaaccauggggguucagagu

SEQ ID NO: 144046 - RNA, 48 nt, Homo sapiens
agaggugaggaaggagaggcaggaggaagaaaacaauacaaaucaggc

SEQ ID NO: 144047 - RNA, 50 nt, Homo sapiens
ugguacugaagaguuaauaauacucaucuaucuuuguguuacucaccugu

SEQ ID NO: 144048 - RNA, 74 nt, Homo sapiens
uaguauuagagcuguccuauuguauaacaguagagauggcugcuuugauggacacuucuuguaagccguaguau

SEQ ID NO: 144049 - RNA, 37 nt, Homo sapiens
aaagcacugacuggucugggaccaugggcugcaaagu

SEQ ID NO: 144050 - RNA, 53 nt, Homo sapiens
ucuuuaaaaaugugaauauuuuuucagaugauaaaaaugagauucagacaguu

SEQ ID NO: 144051 - RNA, 27 nt, Homo sapiens
uuuuugcuuguuuugaugagauuuggg

SEQ ID NO: 144052 - RNA, 42 nt, Homo sapiens
ucuagcaaggggagaaggugaagccugagaugggguagagug

SEQ ID NO: 144053 - RNA, 26 nt, Homo sapiens
gcagcagagggaguacacuuuuaaug

SEQ ID NO: 144054 - RNA, 78 nt, Homo sapiens
gccaucaucauuaucuuuauuuaaccuauagcacagcccugugagguguuaucacugccauuuacagauauguaaagc

SEQ ID NO: 144055 - RNA, 46 nt, Homo sapiens
uagaucguggaauuuuggauacauuuaugcauuuugauguaaccug

SEQ ID NO: 144056 - RNA, 49 nt, Homo sapiens
cccaugcccucuggccccguccuacugcauucauuucccaaggcugcug

SEQ ID NO: 144057 - RNA, 58 nt, Homo sapiens
ugggaacacguuuccauucacagugccuuuucaguuguagguuaguuuuuacugggag

SEQ ID NO: 144058 - RNA, 24 nt, Homo sapiens
cugcuuucuaaaccaauggcaaga

SEQ ID NO: 144059 - RNA, 24 nt, Homo sapiens
ucuuccccacgugaugccgaagaa

SEQ ID NO: 144060 - RNA, 65 nt, Homo sapiens
aaaaucccagaauacuguaacaaaagggcacuucuuuaugcuagaaggagauaauuucacuuuaa

SEQ ID NO: 144061 - RNA, 42 nt, Homo sapiens
acauuguuggguuaaccuugggaguccaaagcugauccuaag

SEQ ID NO: 144062 - RNA, 43 nt, Homo sapiens
gaccuuagguauuuucuuuuuguuguuucuaaccauuuucuaa

SEQ ID NO: 144063 - RNA, 47 nt, Homo sapiens
aauucugaacuuucacucuaguguuuaaaacacaucaauauuuaaua

SEQ ID NO: 144064 - RNA, 58 nt, Homo sapiens
cguuggugggaauucuagugcucauaaugcacuggaagauuuuuuucuggacuacgua

SEQ ID NO: 144065 - RNA, 61 nt, Homo sapiens
aguggcauuugucaguaguaaguaaaacgagcaaaguggauggguggcaagacuuugacau

SEQ ID NO: 144066 - RNA, 42 nt, Homo sapiens
accucucucaaccacucugugguuauuuuauuugaggguggu

SEQ ID NO: 144067 - RNA, 54 nt, Homo sapiens
uguuucuuuucccauugcucuucucucagccucuugugucagcccugcccaggc

SEQ ID NO: 144068 - RNA, 43 nt, Homo sapiens
gaaaagcaggaaagaggaauuacauuuucuagaaacagaagcc

SEQ ID NO: 144069 - RNA, 52 nt, Homo sapiens
guaggacagccugaggguuaaguuacaccauggaugaaaagcugaugcaugg

SEQ ID NO: 144070 - RNA, 34 nt, Homo sapiens
cuugguuuggaauugcaggccuaccgcacaccga

SEQ ID NO: 144071 - RNA, 42 nt, Homo sapiens
acuuuaaauaacucuuauuaguaauuggauuuguggcagauu

SEQ ID NO: 144072 - RNA, 72 nt, Homo sapiens
aacaaagacagaggaagagagaauugcaaaaggcguuaguaugaaucugugguuugcggacugguaauuagg

SEQ ID NO: 144073 - RNA, 39 nt, Homo sapiens
caauuuauggaagcaaggcaaaaacauagacaaagcaca

SEQ ID NO: 144074 - RNA, 51 nt, Homo sapiens
gagcuuauugccugcuggaggagauaaaacuuuuggaaaugggguagaaug

SEQ ID NO: 144075 - RNA, 42 nt, Homo sapiens
gcagaguaauuugaccaagucauacugguuguauaugggagu

SEQ ID NO: 144076 - RNA, 70 nt, Homo sapiens
ggucuuuaaguaugaauggagauauaaguugaauggaaauauaccagguauuucaggacaaagagaacac

SEQ ID NO: 144077 - RNA, 45 nt, Homo sapiens
gcuucaggcauuugguuuugcuucacacuucaaagaacugaaaag

SEQ ID NO: 144078 - RNA, 58 nt, Homo sapiens
aauaaaccuaagaggguuaaguacuauuaugauuuccauuuuacacgaaaggaaacug

SEQ ID NO: 144079 - RNA, 48 nt, Homo sapiens
aaauuucaauuucagauaaauagcagauauuuuuucguauuaaguaug

SEQ ID NO: 144080 - RNA, 45 nt, Homo sapiens
uaacuuuccuuacucaccugaucuaaugaaccuaugcugcuuugg

SEQ ID NO: 144081 - RNA, 79 nt, Homo sapiens
cagccggcugcauuguguccccaauucaaacaaggaucccccaacacugcaacagucuaggauugucuccuaaauucuu

SEQ ID NO: 144082 - RNA, 65 nt, Homo sapiens
gaguuacaugaaguggaaugguuugacucaaagugcagaaaugggacuacauaaaucuguuaggu

SEQ ID NO: 144083 - RNA, 28 nt, Homo sapiens
cuuuaauugcaaaacuggaaguucagau

SEQ ID NO: 144084 - RNA, 27 nt, Homo sapiens
agugguuugcucuggugcagaucacuu

SEQ ID NO: 144085 - RNA, 46 nt, Homo sapiens
ccuuccucaaauaguagaggagcuggcggaaguaaaggucuugaag

SEQ ID NO: 144086 - RNA, 47 nt, Homo sapiens
gggaaaugaagggaaggaugaguagcaaagacacauuaaacagaaua

SEQ ID NO: 144087 - RNA, 30 nt, Homo sapiens
accacuuugucuauuuuuuuaaaaaaugaa

SEQ ID NO: 144088 - RNA, 51 nt, Homo sapiens
aaucauuugguuguacuguccaugauguccaguaguagauuaaaaaaaaaa

SEQ ID NO: 144089 - RNA, 80 nt, Homo sapiens
aacaauccuuuucuuagccuuacuccucccccaccccugccccccuacuacuuuugcgaugguaaucgucauugccaacu

SEQ ID NO: 144090 - RNA, 49 nt, Homo sapiens
ggaugcuguuuuaagauuuaagugcuucuuaugcaauaggagcucaaag

SEQ ID NO: 144091 - RNA, 65 nt, Homo sapiens
gacaauuaggcaacaauguaaggcaguauauaauuaaaugcuaaauuauguagagcagauuaugu

SEQ ID NO: 144092 - RNA, 45 nt, Homo sapiens
ccuuagcaaagcugcugucaugaauauuuaauggaaaaagcaguu

SEQ ID NO: 144093 - RNA, 51 nt, Homo sapiens
cagagcaguguugaagcaggauuuaaagcaguaacaucugucagauguaac

SEQ ID NO: 144094 - RNA, 44 nt, Homo sapiens
gcucuuguagcaguaaggacuuaguauuuuugcuauagaagugu

SEQ ID NO: 144095 - RNA, 46 nt, Homo sapiens
aaaaucuggucaaaugccccuuguucuucuucaacagauacauagu

SEQ ID NO: 144096 - RNA, 79 nt, Homo sapiens
augugggcuaaauccggggcuauucaacuugacuagggucuuuggccuuccagaauguugagaaacuaauuagugggug

SEQ ID NO: 144097 - RNA, 46 nt, Homo sapiens
ucuugggcuauaaguacauacuccagggcguauccuggugacagag

SEQ ID NO: 144098 - RNA, 145 nt, Homo sapiens
gcuucuuacuauguccuggggacugugcugggcaguaagaacaccagaaaggguguggcgucuuaggagccuauuaaacuagauuaggaagagagguguugaggugucaccuagggcauaggcagagaaccugucugccuaauga

SEQ ID NO: 144099 - RNA, 38 nt, Homo sapiens
cacuccagugggauuacuaggucaaagauaaaucauua

SEQ ID NO: 144100 - RNA, 68 nt, Homo sapiens
ucuuggucuagguuauuauaaaaguccuaguugaggaucuugaaucucucccauucaguuugacugag

SEQ ID NO: 144101 - RNA, 32 nt, Homo sapiens
gucacuuuagcaaguccuauuuauucuagcuu

SEQ ID NO: 144102 - RNA, 54 nt, Homo sapiens
gaugaggaaagugagaccaagacuugaguucaaugacuugcccagagucgugca

SEQ ID NO: 144103 - RNA, 43 nt, Homo sapiens
guuccuuuaaaauagauuaucagaggauacacagugacacaaa

SEQ ID NO: 144104 - RNA, 54 nt, Homo sapiens
aaauaguuaucccauucugucuacuacaaaacuaauugcuuacaggaaguagaa

SEQ ID NO: 144105 - RNA, 46 nt, Homo sapiens
aaauaggcgucugguauuuguuuuguauaacacaauccccauaaaa

SEQ ID NO: 144106 - RNA, 35 nt, Homo sapiens
caugauuugaucaaaaguaaacaagaaaacaaaag

SEQ ID NO: 144107 - RNA, 44 nt, Homo sapiens
cggugcuuucaaacuguuuauuuucucucuuggcacuagugagu

SEQ ID NO: 144108 - RNA, 42 nt, Homo sapiens
augaucagucucguguaaaagaauaacacacguucuccuuga

SEQ ID NO: 144109 - RNA, 41 nt, Homo sapiens
cacgugcggagggacuuucgaaagucccccuagucccggua

SEQ ID NO: 144110 - RNA, 43 nt, Homo sapiens
cuccagccaaaauccucccuggucucuuacugagcagacaucc

SEQ ID NO: 144111 - RNA, 67 nt, Homo sapiens
uauuauaaguguuagccacuauugguaaacuuugauguagucagucuauucuagcacauauauauac

SEQ ID NO: 144112 - RNA, 78 nt, Homo sapiens
ccuggagaugucgcugcagguggauggggaucagagugacugcugccccagguagacacugugauccaauagaauaga

SEQ ID NO: 144113 - RNA, 69 nt, Homo sapiens
ucccugaguaaauguugggguguuauuugcuacuuucagggacauuuguauuauuacugaauucagccu

SEQ ID NO: 144114 - RNA, 57 nt, Homo sapiens
ccccacaguuguacaauagcacaaaagcauuucuaacauaaacccaauuagcacagu

SEQ ID NO: 144115 - RNA, 60 nt, Homo sapiens
uccugugggugcuuguaagaaaaaaaugcuuauagccuuucaggaauuucuuugucuggu

SEQ ID NO: 144116 - RNA, 86 nt, Homo sapiens
ggggaaccucucagcugaguacaagaggaacuggcagagguuggcagauuuugcaauugauucaugaaaugcagaauaggggaaau

SEQ ID NO: 144117 - RNA, 52 nt, Homo sapiens; identical to SEQ ID NO: 51689

SEQ ID NO: 144118 - RNA, 44 nt, Homo sapiens; identical to SEQ ID NO: 51690

SEQ ID NO: 144119 - RNA, 46 nt, Homo sapiens
ggaauggcuugcaccaccccaguccggaucauuucuggccccgcuu

SEQ ID NO: 144120 - RNA, 76 nt, Homo sapiens
cucuugucucgcccuuuuguuuuauuucggaggcuugcaguuuagggcaucgaggagccacagccggagagaagaa

SEQ ID NO: 144121 - RNA, 41 nt, Homo sapiens; identical to SEQ ID NO: 51693

SEQ ID NO: 144122 - RNA, 45 nt, Homo sapiens
gauauucagccccgcucucucccgugcauugugcaacccaaagau

SEQ ID NO: 144123 - RNA, 27 nt, Homo sapiens
ugcuuaagaagucuggggguacuugug

SEQ ID NO: 144124 - RNA, 44 nt, Homo sapiens
aagaagaggaaggaacaagggauaaacuucuaaugaguccaaag

SEQ ID NO: 144125 - RNA, 42 nt, Homo sapiens
gcuggguggguucuuuucuuuugaauuucuuccgacucuccc

SEQ ID NO: 144126 - RNA, 40 nt, Homo sapiens
uauauuguuuauuaaccuggaaauagacaauuuggcucuc

SEQ ID NO: 144127 - RNA, 46 nt, Homo sapiens
uccaaacacagugaccaccaucaccaccaucaccaugagcacaaga

SEQ ID NO: 144128 - RNA, 48 nt, Homo sapiens
agaguauuuuccuucauuacuuuauuauuuauuuuccuuuuccugagg

SEQ ID NO: 144129 - RNA, 46 nt, Homo sapiens
ccaauuauaaaaugcuacuggcaacuauaaaacugcacauaacgaa

SEQ ID NO: 144130 - RNA, 24 nt, Homo sapiens
guaucuuuagccuuuccaagaagu

SEQ ID NO: 144131 - RNA, 70 nt, Homo sapiens
uuuuuuuuaguaauuucauaaugaaggcagagaucagauuaacuagauugaacuagaaaggaggagugaa

SEQ ID NO: 144132 - RNA, 47 nt, Homo sapiens
gcuaugcuuauauuaaguuuucuauaaguggaauuuuuagaaagugg

SEQ ID NO: 144133 - RNA, 46 nt, Homo sapiens
agucacucuucacuaggauguuuuguuguaaaaguuguccaaacau

SEQ ID NO: 144134 - RNA, 43 nt, Homo sapiens
aaaauacagagaaggaaaaauaaacuuggagacagcucagaga

SEQ ID NO: 144135 - RNA, 48 nt, Homo sapiens
aaaacaucaguuguauuuuacuuagcacauuguggucauauacauaaa

SEQ ID NO: 144136 - RNA, 67 nt, Homo sapiens
accaauaggggcagccuguugaguuaauauaggcagacauaugguaaaagucuaaacuaggguaagu

SEQ ID NO: 144137 - RNA, 45 nt, Homo sapiens
uuuauagugaagaaaucaagcauaacaaaaaacgugauaauaaug

SEQ ID NO: 144138 - RNA, 69 nt, Homo sapiens
aaauuaaucaaggaaguaaaagaguccuuguuuuguuuauugguuuccguugugggugcuggggacggg

SEQ ID NO: 144139 - RNA, 51 nt, Homo sapiens
ugaaaaauauuuuuaaaaaaucauauagguagaaccugcacaauaucaaau

SEQ ID NO: 144140 - RNA, 44 nt, Homo sapiens
gucacuaggacaaucauguuugaaauuaagauacuuggagagca

SEQ ID NO: 144141 - RNA, 44 nt, Homo sapiens
cucuugcuguuuuaccuguccuaauuuacucaugagcagaaacu

SEQ ID NO: 144142 - RNA, 52 nt, Homo sapiens
cauguguuggauacagagacauugcuaccauacagcuaacaugguagaacua

SEQ ID NO: 144143 - RNA, 42 nt, Homo sapiens
uacuaagugguagagcuaggauuugaauacagggagucuacc

SEQ ID NO: 144144 - RNA, 41 nt, Homo sapiens
aucaggucgucugcaucaacaacauaaauuuccagagaaaa

SEQ ID NO: 144145 - RNA, 43 nt, Homo sapiens
uaauuauuuuaguccucugacucacuguuguuauugccuuuug

SEQ ID NO: 144146 - RNA, 45 nt, Homo sapiens
guagucuuuuuaauugcuguguaaagaugucaggggugggcugga

SEQ ID NO: 144147 - RNA, 22 nt, Homo sapiens
caacacaaaauuauacuucauu

SEQ ID NO: 144148 - RNA, 43 nt, Homo sapiens
aaggucaggaagguauaguccuucaauaggaaauuguaauuaa

SEQ ID NO: 144149 - RNA, 46 nt, Homo sapiens
uugaaacuuucuucugaugaguuucucuaaccuacaggauggagua

SEQ ID NO: 144150 - RNA, 44 nt, Homo sapiens
ucauuuuaaacuuuauuuucaaguuuugcaaaaugaugcaggag

SEQ ID NO: 144151 - RNA, 37 nt, Homo sapiens
auacuuagauuuuuuuucuuuuuucuuuaaaggaaaa

SEQ ID NO: 144152 - RNA, 75 nt, Homo sapiens
gagaggaccuugcuuaagauaugcuuuuguucuacccaacauagcuaagccaagaauauaauuuuccuuuggaau

SEQ ID NO: 144153 - RNA, 50 nt, Homo sapiens
uuauauuccugaccaagaggggugugguacucuuuuuuuuaaaauuagaa

SEQ ID NO: 144154 - RNA, 85 nt, Homo sapiens
uaggagaauuuuuuugcuauugcaaauucuauaccauuuuaacaugcuugcuaguguagaguuuuauuguaaauguacuuaaguu

SEQ ID NO: 144155 - RNA, 50 nt, Homo sapiens
agucaguacaauuuuuauuuuuauuuuuauuuuuuaaaugagaaaauaug

SEQ ID NO: 144156 - RNA, 57 nt, Homo sapiens
auuuggaacaacuguuuugcuuccuugagccagccuuugcccauuccuccccuuaaa

SEQ ID NO: 144157 - RNA, 41 nt, Homo sapiens
uuuggaucuauggagcuaagaggaagaguauuccaaaugau

SEQ ID NO: 144158 - RNA, 43 nt, Homo sapiens
acucuggcugcugggucgagaauagacuguucagaaauagggg

SEQ ID NO: 144159 - RNA, 39 nt, Homo sapiens
ccgacggaggacauaauuuccagccgaccuaaacgaagg

SEQ ID NO: 144160 - RNA, 27 nt, Homo sapiens
aauuaauccagaagauaguacuuuccc

SEQ ID NO: 144161 - RNA, 58 nt, Homo sapiens
ucuuuucuuuuauuccugcuucuuguccuuuacuggagaauguccuuuaaacguucug

SEQ ID NO: 144162 - RNA, 133 nt, Homo sapiens
ggcagccaggguggaggaaaguggauagaucugaaggaaauuauggggguagaauucaccuaccuuagcguugaauugguaugauguagaagaaggaaaggaugagaaaagaaucaaggaugacauuagguuu

SEQ ID NO: 144163 - RNA, 118 nt, Homo sapiens
cugguguggguaauggcaugaugguggcauuuagugagaaagaaccagauuuggagggaauaugacguguucaguuuggaaccuguuaauaguugccuguaagaugcaaaguaagaag

SEQ ID NO: 144164 - RNA, 52 nt, Homo sapiens
auguacagaugucaggugaaggcaugagaaaggaugggauugcuuacggaua

SEQ ID NO: 144165 - RNA, 66 nt, Homo sapiens
uuuagaagaacugaacaccaguuuuuaaaaagaauaaggagcagccagaaggaugggugccacaga

SEQ ID NO: 144166 - RNA, 43 nt, Homo sapiens
uaugcugagaggucaaauaacaacagaacuaaaaaccgcuaga

SEQ ID NO: 144167 - RNA, 45 nt, Homo sapiens
gagaaaaaucauguccuuuuuuauuaaacacuuagcauuuucuua

SEQ ID NO: 144168 - RNA, 40 nt, Homo sapiens
augaaaauguaccuuauaaagauauucuagaauagcacua

SEQ ID NO: 144169 - RNA, 55 nt, Homo sapiens
uuuuaugagaagacauucauauacuugcauucuuuuucucauuguagggcagggg

SEQ ID NO: 144170 - RNA, 38 nt, Homo sapiens
uuuuuguuugucugcauuuuagcuuuuauuuuguuuug

SEQ ID NO: 144171 - RNA, 42 nt, Homo sapiens
uuaguaacauacugauuccaccucccaaccaacucaguucaa

SEQ ID NO: 144172 - RNA, 46 nt, Homo sapiens
cauuaauauugguaacuugugaauaauaauaagacacagaucacau

SEQ ID NO: 144173 - RNA, 45 nt, Homo sapiens
aggaaauacauuuuugaagaugauuuaugaauauaaaguaauuag

SEQ ID NO: 144174 - RNA, 43 nt, Homo sapiens
uuucacauacuuaacaagauaauuguuuuuguuuaguuccaga

SEQ ID NO: 144175 - RNA, 74 nt, Homo sapiens
acaugcaaguuauaugaagcagauuuauuacuuacagauaggcagcaaggaacaaaagaagccuaggaucuguu

SEQ ID NO: 144176 - RNA, 156 nt, Homo sapiens
uuauguaauuucuaagaaauugauucaaauugugaguucuccuuaguuguauguagaaaaaaaguuauucgaauuauauauuacauauauuauaaaauaagaacuaucauucuuuucuuuaaaaacguauuuaaaaauugugaauucaguagccua

SEQ ID NO: 144177 - RNA, 138 nt, Homo sapiens
caauuguaaaaauccaggguaauuguuuagucuugagcuccucuaaccauugguguguuguuuuuuuuaaccacgaaaaugauguuugcucaaggaagguguaauuagaaaggcaaaucauuuuuaauaaaguguagu

SEQ ID NO: 144178 - RNA, 67 nt, Homo sapiens
ugauuaggagccaaggaaguugauguaggucuugaaugaugcauaagaucuggauagagggaagaua

SEQ ID NO: 144179 - RNA, 137 nt, Homo sapiens
augacuccuauguauauaccaaggaaauaauaaacauugacaaaacacauauuuaucaacauguuuauuuuagaaagaaaaacuugugagugaaauuaaacaaaaauagguaagguugcugagggcgauugauauga

SEQ ID NO: 144180 - RNA, 48 nt, Homo sapiens
cuccaucaagcagucagauguucaggaaaugauaacacuccuugggag

SEQ ID NO: 144181 - RNA, 48 nt, Homo sapiens
uuuauaguuuauuuguauuuguuuuaacacuaugacuuauuuugcaag

SEQ ID NO: 144182 - RNA, 46 nt, Homo sapiens
cuucuuucucagacaacugguaauaguaaucacuaucaucaucaug

SEQ ID NO: 144183 - RNA, 85 nt, Homo sapiens
caaaacuugcuacaaagaccaguucaggucaaaaaaguaugcaugaaucaaaaacaucaaggcaaauuaaggaaucaagaucaca

SEQ ID NO: 144184 - RNA, 27 nt, Homo sapiens
aaaagauauaucaagauagaaauuugu

SEQ ID NO: 144185 - RNA, 50 nt, Homo sapiens
aaacuucauaaaaacuauaauucucauagaaagaagauaaucgcauccau

SEQ ID NO: 144186 - RNA, 43 nt, Homo sapiens
ccuauuuacaaucaaaaauugugguacaacuguucuucaaagg

SEQ ID NO: 144187 - RNA, 24 nt, Homo sapiens
uguauauguguauguauuuugguu

SEQ ID NO: 144188 - RNA, 46 nt, Homo sapiens
uuaaaacuucaaggggucuauuugaagaaaugaagaaaacagcaaa

SEQ ID NO: 144189 - RNA, 47 nt, Homo sapiens
agauggagaagaagagaaucagaagcgauauuaucuuagacagagaa

SEQ ID NO: 144190 - RNA, 42 nt, Homo sapiens
uauucaaagaacugaugaagaaacaacugauaaucaagaagg

SEQ ID NO: 144191 - RNA, 25 nt, Homo sapiens
uguuuucaaucuacuugaggcucaa

SEQ ID NO: 144192 - RNA, 42 nt, Homo sapiens
agaagaauguggaaauaacggagcaacuugcuaauggcaggc

SEQ ID NO: 144193 - RNA, 42 nt, Homo sapiens
ccccgcgggacgccugcgucuacagcagcugcuacuggugag

SEQ ID NO: 144194 - RNA, 45 nt, Homo sapiens
caucacaauaaccguaagagguagguauuguuauccccaguugaa

SEQ ID NO: 144195 - RNA, 50 nt, Homo sapiens
uuagaggagauucagacauuagccaguuguuggaugacaugggguuuaag

SEQ ID NO: 144196 - RNA, 46 nt, Homo sapiens
uccuuuagaagaauguuaugcugucuucauaucuaaugagaggaag

SEQ ID NO: 144197 - RNA, 50 nt, Homo sapiens
auuaauaaauugaccuuuugagaauagauguuauuugaucuaagguagaa

SEQ ID NO: 144198 - RNA, 61 nt, Homo sapiens
cuauauaauaaaaucugcauuagagggaggugagcgcuagcagguuuuauuguaccacuug

SEQ ID NO: 144199 - RNA, 45 nt, Homo sapiens
ucaauccaguugauaauuuccugacauuuaagaagauaaaggguc

SEQ ID NO: 144200 - RNA, 49 nt, Homo sapiens
aaacugcugaacuuggucucaagauguggaacuguggagaaauucuagg

SEQ ID NO: 144201 - RNA, 33 nt, Homo sapiens
aaccagaacaucuguacccucaugaagcuuauu

SEQ ID NO: 144202 - RNA, 42 nt, Homo sapiens
aggggaagcaaaugauuauuuuagagucuuugaaauggggau

SEQ ID NO: 144203 - RNA, 46 nt, Homo sapiens
uaugugaggagaagccagauuuuaguuggcugagaagggaguauca

SEQ ID NO: 144204 - RNA, 46 nt, Homo sapiens
ggaagaagaacaagaacuagaaagagagagaggaguaauguccaga

SEQ ID NO: 144205 - RNA, 46 nt, Homo sapiens
uuaguauguagcuuuacaggacuguagccuugucuuugacucacag

SEQ ID NO: 144206 - RNA, 41 nt, Homo sapiens
aaauaacuugaacaaauagggacuaaauccuugaguguaga

SEQ ID NO: 144207 - RNA, 51 nt, Homo sapiens
auacugcaaauaaagauacgugaauaaagauauuucagugccuuuguugag

SEQ ID NO: 144208 - RNA, 47 nt, Homo sapiens
auugugugcuuuugacauuuuuuaccauuuaucuacgucuguauaca

SEQ ID NO: 144209 - RNA, 44 nt, Homo sapiens
uguuaaaauaggauauuucuaaaaggaguccagaaugggguagg

SEQ ID NO: 144210 - RNA, 44 nt, Homo sapiens
acauuacaacuccaaauauaaauucaauaauacugccuguugaa

SEQ ID NO: 144211 - RNA, 45 nt, Homo sapiens
ugcauguaggcacaucauaaaagcccgaauuuuacuucccgacuc

SEQ ID NO: 144212 - RNA, 40 nt, Homo sapiens
uggaguuucauuggguggaauaaauccauuguuguuagau

SEQ ID NO: 144213 - RNA, 49 nt, Homo sapiens
gggaguuaggccagagaaagacaaacaaacaccuuaagcaaaggcagac

SEQ ID NO: 144214 - RNA, 93 nt, Homo sapiens
ccaauucagacaauugggcauacuuauaacacauucacaaaaacuaauugguacugugucuucaugagggguaaaaaagaaaacaaaauaggu

SEQ ID NO: 144215 - RNA, 29 nt, Homo sapiens
auuuugagagugggagcauaugguugggg

SEQ ID NO: 144216 - RNA, 49 nt, Homo sapiens
ucuggguugguucaguuucuccagaaagggauccuguguucucugcugg

SEQ ID NO: 144217 - RNA, 81 nt, Homo sapiens
ucagugagugacugugucuagcaaaagaacuguaauccagguagauuaaaucacaguuacacuaugccugcuaaggaaaga

SEQ ID NO: 144218 - RNA, 70 nt, Homo sapiens
uccuuuggaaaccugccuuagaaaaaugcucagauauacauauauucauaugcaauuucaggagagugac

SEQ ID NO: 144219 - RNA, 42 nt, Homo sapiens
cauaaauacuaucugcuaaccacauaccuccgauaucuaugg

SEQ ID NO: 144220 - RNA, 42 nt, Homo sapiens
gacauaaugaaaagaaauagagaucgguguguagggggagug

SEQ ID NO: 144221 - RNA, 1213 nt, Homo sapiens
cccaaacauuugguaauacagacauagacgaccuauuuuaggaagacuauuucuauuuuuuuaauuuuuaauuuuuuuuuuuuuuuuugagacagaauguugcucucucacccaggcuggagugcagugguacaaucucagcucacugcaaccucugacccuggguucaagagauucucaugccugccgaauagcugggauuacaggcaugugccaacaugccggcuaauuuuuguauauuuaguagagacgagguuucaccaugcuggccaggcuggucuugaacuccugcccuugagugauccacccgccuuggccucccaaagugcuggcauuacaggugugagccaccacgcccggccugaagacugcuucuuaagaaguacauuucuauuucuaauuuuaaaauuuagcauuuucaagagagcaaaggggguaaaauaguccugcacaucaggaaauaugauauagaaaaauauagcaagagaggcuuaaguuaaacagagaaauuguuuccccaaauuaaagugcuuagaagagguaagcacauuuaagaaaauaauaagccaccuguuauccugauucaguugaaccuaccauuugugagaacaagggggagcacuguguugaagugaaaagacaaacagaaugaacauucguuguauccucugaauauugucauuauacuccgggaccagaaggaagcuucuugaaaacguaacagguuuuugucguuuaggcugggacuuggaauuagagcagugaaguucuguuccaaguuggccaugccagguauuguuaucuuggacaaaguacuacaccucucugacaccagcuuuuauacucagguuauuuugaggaucaaaugagacaaugguaucugguacuuggaaaaaccuucuuaucaaguacucuuuaagauauucagggcuaccacuuuaucauguaauuuucuuuuuuuaauagcauaauugaguuauuugcuguuuagcaaauacuuagauuucauuuuugagggaaaccuuguucauuuugcccaguggcaauaacuucuuuuauaacagcacauaaaaaacugguugcaaaauggaauagauuagcaugcaguaugaagcucuccugggcuucucgcuuggugaguugacucccacugauggugcucccaguggcaaggggccagugguguuacuuucugaaaauuaaagggcccaga

SEQ ID NO: 144222 - RNA, 57 nt, Homo sapiens
uauuuuuuaaagacuaagaaagagaagcaaagagugaaaacaaggaaaggccugauc

SEQ ID NO: 144223 - RNA, 46 nt, Homo sapiens
auuuugaccgacugcaguuuugucccaaagauacucaacucaagua

SEQ ID NO: 144224 - RNA, 45 nt, Homo sapiens
aguaauuuugaagaagucuuucugaaaacugcuucagguacaaua

SEQ ID NO: 144225 - RNA, 54 nt, Homo sapiens
ccuuuauuaaggcgaauaguuuccuaugaagacaaauuuucugccucaggagau

SEQ ID NO: 144226 - RNA, 43 nt, Homo sapiens
aggacauccagguagagauaucugggcaauugggaaugugguc

SEQ ID NO: 144227 - RNA, 61 nt, Homo sapiens
uugugggaaauagggagagguagggaagcauuucaagagcuuaaacuaggguaauggaaaa

SEQ ID NO: 144228 - RNA, 74 nt, Homo sapiens
uaccugaaggugggaaaugacagugaucacaccucugcuuuagcaagguaauccugauagcuauuauguagguu

SEQ ID NO: 144229 - RNA, 21 nt, Homo sapiens
aagaggugaaaaagauguaaa

SEQ ID NO: 144230 - RNA, 45 nt, Homo sapiens
caccgaccuuguguccagccccacugcuuggccugcgcacaccug

SEQ ID NO: 144231 - RNA, 41 nt, Homo sapiens
cccaccgcgacugcacuuccccaccgauaaaaggugguuuc

SEQ ID NO: 144232 - RNA, 42 nt, Homo sapiens
aaaagauggccucggacucaagagugcggcuccagggcaaug

SEQ ID NO: 144233 - RNA, 44 nt, Homo sapiens
ucgugcuauaauuucuuuucucaccaagagcaggugcccuuuca

SEQ ID NO: 144234 - RNA, 45 nt, Homo sapiens
aacuggucugaucggacuucucguccugggacacuguuuacugga

SEQ ID NO: 144235 - RNA, 33 nt, Homo sapiens
gcagauaaucuccgccuugaccggugccaccaa

SEQ ID NO: 144236 - RNA, 45 nt, Homo sapiens
cccagaaaaguccacaugguuccaaggcuucuuugguggcaccgg

SEQ ID NO: 144237 - RNA, 23 nt, Homo sapiens
uuuggcccagaagaagccaauga

SEQ ID NO: 144238 - RNA, 42 nt, Homo sapiens
ggcggccacugggagaagaugagggggaagaguuuaggccag

SEQ ID NO: 144239 - RNA, 45 nt, Homo sapiens
uggcgugcuuggcucugcuuuggcagcugugcuuuccagagaugg

SEQ ID NO: 144240 - RNA, 51 nt, Homo sapiens
auaaaauuuucuauacucauuuaccaacaaauuugcaugaaagugagagca

SEQ ID NO: 144241 - RNA, 47 nt, Homo sapiens
augcccagguuguaaaugguuacaugauucaugaucaggaaagcaaa

SEQ ID NO: 144242 - RNA, 46 nt, Homo sapiens
ugugaugggaguucaguacaaggauaaagagacuggagauaucaag

SEQ ID NO: 144243 - RNA, 37 nt, Homo sapiens
acgaauaacuucugggacagauaguuugucacugugg

SEQ ID NO: 144244 - RNA, 41 nt, Homo sapiens
guaucccugaccuuuaugaugaugcagcuauuuucgaggua

SEQ ID NO: 144245 - RNA, 72 nt, Homo sapiens
ggcaagaaaaacaucucauuccuuugucgugaauauccuugcucaggcucuuuaugaauuauuuucugccac

SEQ ID NO: 144246 - RNA, 30 nt, Homo sapiens
aguuugcuaacucccaaguugguaguuuuu

SEQ ID NO: 144247 - RNA, 68 nt, Homo sapiens
aaggaaguaccuuuuaaacaacucuuccaagaccuaaauauuaguaguuauuuacuaacagaaaaaag

SEQ ID NO: 144248 - RNA, 58 nt, Homo sapiens
uugaaauucuaggacuagauauuuaaaaauuaucugcaagauguagcguuuguuauuu

SEQ ID NO: 144249 - RNA, 45 nt, Homo sapiens
caucaacuaagaaaagccuguuuucuuuauuucaaacuugguggc

SEQ ID NO: 144250 - RNA, 41 nt, Homo sapiens
accuuggauuacaaaaccucgagcccuucucaguaguggug

SEQ ID NO: 144251 - RNA, 49 nt, Homo sapiens
aauauguaaauacaugcuuuaauuugcaauuuaaaaugaagggguuaaa

SEQ ID NO: 144252 - RNA, 59 nt, Homo sapiens
cugaggagaacuacaguuuuucuuuugaauuuaguauuugagaugaguuguugggacau

SEQ ID NO: 144253 - RNA, 38 nt, Homo sapiens
guuuauggcauucuguaggugaccgagaaaugaugaug

SEQ ID NO: 144254 - RNA, 56 nt, Homo sapiens
gaguuucauaauaggaguguguuguguacaugugcaugugauagggauaaugguag

SEQ ID NO: 144255 - RNA, 43 nt, Homo sapiens
ugaagggaaugauucaguagagagggaaaauuuaaugaugcag

SEQ ID NO: 144256 - RNA, 59 nt, Homo sapiens
ccugggaguuguucacuuuauagcugucaguauuuguugcucagcaucuuaggacucag

SEQ ID NO: 144257 - RNA, 44 nt, Homo sapiens
gguggaccagcuccauacaguuauucauuuacggcuaacagcag

SEQ ID NO: 144258 - RNA, 56 nt, Homo sapiens
aauuuagcuuugauagauaggccuggauaaaagucauaauaaaaucuuaaaccaua

SEQ ID NO: 144259 - RNA, 42 nt, Homo sapiens
uuauaggaugcaauuuugcuguaaugaaauucauuucagcag

SEQ ID NO: 144260 - RNA, 61 nt, Homo sapiens
uguuuaauguucuguugaucauauaacuuuaaugccuauucaauaccucaaaaagagagaa

SEQ ID NO: 144261 - RNA, 42 nt, Homo sapiens
ucuaacuuuaauaugcaucuauugccaaauucuuagaaucag

SEQ ID NO: 144262 - RNA, 193 nt, Homo sapiens
gucauauauauuuagcaauugaugauaaaauauauauccucucagcuaggugugguggcgcacgccuguaguuccagcuacuugggaggcugaagugggaggaucacuugagcccaggaguucaagaucagccuggacaacauaguaagacuccaucucuuuaaaaaaaaaaauguuuuuggugaccaguaua

SEQ ID NO: 144263 - RNA, 47 nt, Homo sapiens
agguuuaaccauaaauaguucauugugauccaauuucuauaaagcug

SEQ ID NO: 144264 - RNA, 46 nt, Homo sapiens
ggugagaagcccuuucagguccccaaucccuuuaauaagcacagug

SEQ ID NO: 144265 - RNA, 39 nt, Homo sapiens
ugauagaagacagugauaaggucuguauguggcauuaca

SEQ ID NO: 144266 - RNA, 42 nt, Homo sapiens
gucaguuugguuguucaaaggucuccuuaaucauacaguucg

SEQ ID NO: 144267 - RNA, 60 nt, Homo sapiens
cagaagacaacaaguuaguaggaucauugaagggccacuagcuuacggaagccaaaauag

SEQ ID NO: 144268 - RNA, 46 nt, Homo sapiens
guugaaaucauggcuauuacuucuuaaaucucucuaaaauggaguu

SEQ ID NO: 144269 - RNA, 111 nt, Homo sapiens
aguguauacaaacaugauauaauaugacaaccauuaauaacaaauaucaacucaaaagcaaagaaaacaucagaaacaaauguuauacaaugugggaccuaagugaggaga

SEQ ID NO: 144270 - RNA, 36 nt, Homo sapiens
gguucagccccaguaggaaagaaugugcuaaaagau

SEQ ID NO: 144271 - RNA, 47 nt, Homo sapiens
gaaauaauuaggucugccucagcuuacaucucagggucauuaccaag

SEQ ID NO: 144272 - RNA, 45 nt, Homo sapiens
auagcaaauacguucacaaggaaaggggaaguuuuaaaaugacag

SEQ ID NO: 144273 - RNA, 46 nt, Homo sapiens
acauuauaccuaagaaaauaauuaucuuguugaguuauaauuccug

SEQ ID NO: 144274 - RNA, 86 nt, Homo sapiens
agguuauuuuaaaaaauaaaauauaacuuguuagcuugaaaguaggagaaaaaaauuuaaaaaaauaaaauuucaguguuagauau

SEQ ID NO: 144275 - RNA, 37 nt, Homo sapiens
uaggucaaggcccuuuuugcgaagguuaccuuggcag

SEQ ID NO: 144276 - RNA, 46 nt, Homo sapiens
cuuuaggaaagcaagucugguugugguauauaggauaaguugguau

SEQ ID NO: 144277 - RNA, 44 nt, Homo sapiens
aguuuggguaacugggaaaauggugauaccaucaaaaaguugua

SEQ ID NO: 144278 - RNA, 41 nt, Homo sapiens
ggaaauagauauuuaaaauaguuauaauucaaagcaugaga

SEQ ID NO: 144279 - RNA, 47 nt, Homo sapiens
uuauaguguuaauaaauguuuucaaauauuauaauuguaucccaaua

SEQ ID NO: 144280 - RNA, 27 nt, Homo sapiens
guaaggucaagacaagucauaagucag

SEQ ID NO: 144281 - RNA, 27 nt, Homo sapiens
cuauauaaggacuccauuuggucucug

SEQ ID NO: 144282 - RNA, 46 nt, Homo sapiens
ugggcuaaauuuacucuggauugaauauuaacacagugccuggcag

SEQ ID NO: 144283 - RNA, 41 nt, Homo sapiens
uuuucacuucaagcaucauugcuuuuggcaauuguagacaa

SEQ ID NO: 144284 - RNA, 34 nt, Homo sapiens
uucuugcacuguaccccucauaucugcagccggg

SEQ ID NO: 144285 - RNA, 47 nt, Homo sapiens
ugagcugagccuugaagcauggauuuaauuucacuggggaaggcagu

SEQ ID NO: 144286 - RNA, 58 nt, Homo sapiens
gccugagugauucccucuaaguuacaaagcuuauaagagacagaaccaguccugaagu

SEQ ID NO: 144287 - RNA, 44 nt, Homo sapiens
gcugauggggaaacgagcagaguauaaagaaucuaacauauuug

SEQ ID NO: 144288 - RNA, 54 nt, Homo sapiens
cuuauuaagcucgauagcauaaacauaagugaguuacacagcaaugcaaggaaa

SEQ ID NO: 144289 - RNA, 34 nt, Homo sapiens
uuggugcccuucccauccuaccccaggguacugc

SEQ ID NO: 144290 - RNA, 42 nt, Homo sapiens
gauccauuccaggggauuuuguaguuucucagauguuauacu

SEQ ID NO: 144291 - RNA, 43 nt, Homo sapiens
cguccacuuccugucuccuuguaugcucacucuuggaacccag

SEQ ID NO: 144292 - RNA, 28 nt, Homo sapiens
cccccaccccacuuuccuggcuccccug

SEQ ID NO: 144293 - RNA, 38 nt, Homo sapiens
caacucuaaaacaggguagguaauguuaucucauucau

SEQ ID NO: 144294 - RNA, 82 nt, Homo sapiens
uucagauauacccuauggcacagauauuuuaaggcaaaacauagguauauuaugccauacauaaguguauuggaugaagcug

SEQ ID NO: 144295 - RNA, 50 nt, Homo sapiens
guaguaucuuaaaaauuaaaguuuauauacaguucaacagggccaggauu

SEQ ID NO: 144296 - RNA, 43 nt, Homo sapiens
aguggugugaugaguaauuaaaauauuccuuagguuguugggg

SEQ ID NO: 144297 - RNA, 769 nt, Homo sapiens
aagcaaguuaugaucagcaguguguuauauccuggguaggguaaaagauaggccuagcuggaugcaguggugcauaccuguagucccagcaacucaguagguugagaugggaggaucgcuugaggccggcaauucugggcuacaguacaguaugcugaucgaguguccacacuaaguucagcaucaauauggugaccccucaggagcagggaaccaccagguugccuaaggaggggugaacgggcccagguugaaaauggagcaggucaaaacuuccgugcugaugaguaaugagaucacacuugugaacagccacugcacgccaaccagggcaacauagugagacaccaucucuuagaaaaaagaaaaaaaagaauaaauguaagugggagggaaaaguggaggcagggaagucaguauaagacuacucuaggccaggagugguggcucaugccuauaaucccagcacuuugggaggccgaggcagguggaucacgaggucaggaguucaagaccagccugaacaacauagugagaccccguuucuacuaaaaaacacaaaauuuugccaggcaugguggugcgcaccuauaaucccagcuacucaggaggcuaaggcaggagaauugcuugaaccugggagguggagguugcagugagcagagauuaugccauugcacugcagacugggcgaccaagugagacuccaucucaaaaaaaaaaaaaaaguauuacucuagugaugagguaaguagugaggggggucuaa

SEQ ID NO: 144298 - RNA, 103 nt, Homo sapiens
guuaagauacuaucaaaguggacauaaaggggaggaauuaaauuugagagaaacaauuaaauuugaaagauauuuggaauguugugguaaucacuugaaugga

SEQ ID NO: 144299 - RNA, 48 nt, Homo sapiens
acugaugucagccuuugguuaucuuggacaugaaggauuacaauagcu

SEQ ID NO: 144300 - RNA, 42 nt, Homo sapiens
uccugaauucuacucauuuguauuuccucguuggcugcccag

SEQ ID NO: 144301 - RNA, 50 nt, Homo sapiens
ccuuccaggaagcccuuagccaaucaaacagaauggaaaccauagauuaa

SEQ ID NO: 144302 - RNA, 50 nt, Homo sapiens
uuuuccugcccuucuuuguuggucuuaccaugcauucuucccacccuaaa

SEQ ID NO: 144303 - RNA, 47 nt, Homo sapiens
accuccaugaaccuuugaauaaagaaggaaggagaaagggaaggaau

SEQ ID NO: 144304 - RNA, 114 nt, Homo sapiens
uauacagcgaacauguugaugauaugguagagguguuuccucagcaaugaguguugaauguuuaaagucaaguagauuuuugguaugcuuuugcuuuggucaagagggucuucu

SEQ ID NO: 144305 - RNA, 107 nt, Homo sapiens
uuuuucuuucuuuuugucuuuuggauauuguuuugguuuucauucuguaguauaaauugcagucccagaagcugaaauucacuuccaccuguucaaaaauugcugua

SEQ ID NO: 144306 - RNA, 89 nt, Homo sapiens
gaugggauuggaauuaaggcacauucagcuggagguuagagccauagucaaaugugaaaauauaaagcauauuaaauauuuuguguuug

SEQ ID NO: 144307 - RNA, 50 nt, Homo sapiens
ugugguuccgugcaccugggagcugagacguggcugagccuggagcaguu

SEQ ID NO: 144308 - RNA, 49 nt, Homo sapiens
gacuccacuugaaaauauuuuuaccgaaauuauggauggaaacuaugag

SEQ ID NO: 144309 - RNA, 322 nt, Homo sapiens
cacuuaggcuguaaucccaguacuuuggaaggaccagacagaaagaucaguuaaagccagcaguucgagaccagccuaggcaacaaagugagaccuugucucuagaaaaaaaaaaaaaaaauuaaagccaggcauaauagcgugcgccuguagucauagcuaguugggaggcugagguagaaggaucacuugagcccaggaguuugaggcuacagugagcuaugauugugccacugcacuccagcccaucaacagagugagacucugucucaaaaaaaaaauuauugauuacuuuuacaauaugcaaagcaauuaugaaaug

SEQ ID NO: 144310 - RNA, 30 nt, Homo sapiens
ucugaaaguaaaccuuugaaguauuuuuau

SEQ ID NO: 144311 - RNA, 35 nt, Homo sapiens
gcccuggugugggaguuggccuggcacacauucca

SEQ ID NO: 144312 - RNA, 54 nt, Homo sapiens
ugagaaguacuagaauagcagagaaguaaacaaagcgagauguuggguggaaug

SEQ ID NO: 144313 - RNA, 48 nt, Homo sapiens
uuuuuuuuuaacaaaauaaccagauucuuuuuauacacuuuucucuua

SEQ ID NO: 144314 - RNA, 47 nt, Homo sapiens
acccugcaaugugcuuggaaaucauccaguuugggaccucaagagag

SEQ ID NO: 144315 - RNA, 43 nt, Homo sapiens
uugacagaucauugacauggugacgugacccagugagauagag

SEQ ID NO: 144316 - RNA, 52 nt, Homo sapiens
cacucgugacauucuuccccagucucacuuuuguuaccuuuuuauuucguga

SEQ ID NO: 144317 - RNA, 46 nt, Homo sapiens
aaagacggcuccuagccuucuccuuggcuuuucuccuuaccugucc

SEQ ID NO: 144318 - RNA, 46 nt, Homo sapiens
cuaugaagaggacgccauuguucgcaugauugaguccaggcaaaag

SEQ ID NO: 144319 - RNA, 47 nt, Homo sapiens
gauacaagagugauuguggagguacaguuaacgacauuugacgacug

SEQ ID NO: 144320 - RNA, 45 nt, Homo sapiens
cuguagccacacggauauaagaaagucagaucuuauccaggauga

SEQ ID NO: 144321 - RNA, 42 nt, Homo sapiens
aggcgguaucucuggcaguggccagaaugacuuccaccagcc

SEQ ID NO: 144322 - RNA, 40 nt, Homo sapiens
uguguguguauacagcgugagucaccaggaggcggaggag

SEQ ID NO: 144323 - RNA, 33 nt, Homo sapiens
cauuucuagggguggggucggguguggggggau

SEQ ID NO: 144324 - RNA, 58 nt, Homo sapiens
cuggacaggccaggggcuuccuucuaucagccacucaacuaguguggccugcaaacag

SEQ ID NO: 144325 - RNA, 43 nt, Homo sapiens
ucugugugaaagcggguaacccuuuggguauuugcaagucuag

SEQ ID NO: 144326 - RNA, 42 nt, Homo sapiens
cucuugagacgggagcccuccgagagacucacugcccccgag

SEQ ID NO: 144327 - RNA, 58 nt, Homo sapiens
uucgauuuuguuuuguuuuguuuuguucuggcuuugaggcuuguuuuguugucugugu

SEQ ID NO: 144328 - RNA, 97 nt, Homo sapiens
cucgacuguuguaucugugauacauuauccgacuaaggacucugggcuggcagggccuucugccgggaaagcuagaaacacuagguucuuccuguac

SEQ ID NO: 144329 - RNA, 47 nt, Homo sapiens
gaaaugcaucgugauuccuguccguuggacugaaagguuuauguagg

SEQ ID NO: 144330 - RNA, 45 nt, Homo sapiens
auuaucguaggaguaguccuccaccucgucgcagaucuccaagaa

SEQ ID NO: 144331 - RNA, 53 nt, Homo sapiens
cuaggucaaaugaaaggaaauagaagacaguuugcaagagaagugguguacag

SEQ ID NO: 144332 - RNA, 46 nt, Homo sapiens
cauguaauaccaagaauuguuacuuuacaauguucccuuaagcaag

SEQ ID NO: 144333 - RNA, 48 nt, Homo sapiens
auuuacuuuuuuuccguagcugggauauaggaugcagcuauaguugaa

SEQ ID NO: 144334 - RNA, 25 nt, Homo sapiens
gccgaacuuugaguuacugugcaag

SEQ ID NO: 144335 - RNA, 36 nt, Homo sapiens
ggaggaggcgagggaggaagcuggccaggucauugc

SEQ ID NO: 144336 - RNA, 46 nt, Homo sapiens
ccuucuccucucccaucuugacaagucacuuuaccccgauccaguu

SEQ ID NO: 144337 - RNA, 27 nt, Homo sapiens
agagcuauccccuaaagcggcugggug

SEQ ID NO: 144338 - RNA, 42 nt, Homo sapiens
ugucuccucauggagcaccaggggcucggggcugcccugcgg

SEQ ID NO: 144339 - RNA, 15 nt, Homo sapiens
gggcagucuaagggg

SEQ ID NO: 144340 - RNA, 63 nt, Homo sapiens
ugguccucucauagcccaccagcaucccccaggaggacacuggcuuccucaaggucacagccu

SEQ ID NO: 144341 - RNA, 52 nt, Homo sapiens
ggcggccgggacgaggaggggcgacgacgagcugcgagcaaagaugugcccc

SEQ ID NO: 144342 - RNA, 44 nt, Homo sapiens
ugcuaggcgugcacuguccucaucaccagccucaagacuggugg

SEQ ID NO: 144343 - RNA, 47 nt, Homo sapiens
ggccuggucuccauuauuugagaugaguuacaucuuggaggugagga

SEQ ID NO: 144344 - RNA, 42 nt, Homo sapiens
ggucugaaaaccuggugaauucucacugcccacaucaaauca

SEQ ID NO: 144345 - RNA, 41 nt, Homo sapiens
uugccaugccugggccuucugccugcccaagauggacacgu

SEQ ID NO: 144346 - RNA, 79 nt, Homo sapiens
gccccuuugcuauuuguuuuauaucagguggcccuucuggauguguggccuuuuuauuuugcauuuccuuucauaguug

SEQ ID NO: 144347 - RNA, 545 nt, Homo sapiens
gcugcagacauaagauucuucuuuuucucuuguuuugcuuuuuuuuuuuuuuuuuugagacagaguuucacucuuguugcccaggcuggaguaaaauggcuggauuucagcucacugcaacuuccgccucccagguucaagcgauucuccugccucagccucccaaguagcuaggauuacaggcaugcaucaccacacccagcuaauuuuguauuuuuaguagagacggaguuucuccagauuggucaggcuggucuugaacucccagccucaggugauccgcccgccuuggccucccaaaaugcugggaggccucccaaguugcugggauuacaggcauggaccaccaugccuggcuaauuuuguauuuuuaguagagacggaguuucuccagauuggucaagcuggucucgaacaucugaccucaggugaucugcccuccucggccucccaaaguacugggauuacaggugccacaguacccggccuuguuuugcuuuuuauuguuuccugaugcagguuugugaucucuuugagggaucagg

SEQ ID NO: 144348 - RNA, 46 nt, Homo sapiens
acaacuccaugaggcauuuauaaugaaaugucuagcaaugguagac

SEQ ID NO: 144349 - RNA, 37 nt, Homo sapiens
caguuuccucaucuauaaaaugguuugcugugaugac

SEQ ID NO: 144350 - RNA, 54 nt, Homo sapiens
gggaagagcuaggacagagguggaggcagaagugagccugugggggugaggagc

SEQ ID NO: 144351 - RNA, 73 nt, Homo sapiens
cauguggguugaaucauauuuucgcuggauggaacaaugccuuggacgaggucagcauuuagugaaucaaaug

SEQ ID NO: 144352 - RNA, 41 nt, Homo sapiens
agacacugggguguugggucucagucugggucuuggugaca

SEQ ID NO: 144353 - RNA, 53 nt, Homo sapiens
caggauuugagugagacacgaagacucaguagaaguuaaccagaagaacaaag

SEQ ID NO: 144354 - RNA, 60 nt, Homo sapiens
gaugguggaucaacggaagcagguggcccauuuggggacugaauuacagcaauccaagag

SEQ ID NO: 144355 - RNA, 367 nt, Homo sapiens
auuuuacccugugggugauagggaacuauugaaaguuuucauuuuuuucuuuuuggagacagagucuugcucuguugcuucaggcaggagugcagugagccauaguggcucauugcagccuggacccccugugcucaagcaauccucccaccucagccuccagaguagcugggacuacaggugcauggcaccacccccagcuaauguuuuguuuuuaauuuuuuauaaagauagggucucacuuuguuguccaggcuuaaaacuccuggcuuuaagcgauccucccaucuugaccucccaaaguguuggaauuacaggaaugagccaucaugcucggcucuauggaagguuuugagguggggcaggg

SEQ ID NO: 144356 - RNA, 47 nt, Homo sapiens
accacuuaaaagcuuuuaauggcuucccauuauuagcuugagugccu

SEQ ID NO: 144357 - RNA, 49 nt, Homo sapiens
guagagcuuucccagagcuggcaugugguaggugcucaauaaacgcugg

SEQ ID NO: 144358 - RNA, 45 nt, Homo sapiens
gaaccugaggacacaaggauggaaagacucagucugucuguggca

SEQ ID NO: 144359 - RNA, 46 nt, Homo sapiens
uaauaauagucccuaauuccuaaggggauugggaagguugaacaaa

SEQ ID NO: 144360 - RNA, 63 nt, Homo sapiens
agggcuucuuacugagugucuaguuccuuguuguacaggugagggaaacugaggcccagagug

SEQ ID NO: 144361 - RNA, 51 nt, Homo sapiens
ccuguuuucacugacgcuuuagaaaacuugcaugaaaccucuucacggugg

SEQ ID NO: 144362 - RNA, 47 nt, Homo sapiens
aucuguaguuuaaagguuugucauuuggaggaauaucaaguaaaccc

SEQ ID NO: 144363 - RNA, 49 nt, Homo sapiens
guuuacuacuaugugccagacacuauucuaggugcuuuucaucaauuag

SEQ ID NO: 144364 - RNA, 396 nt, Homo sapiens
auugacuaacuuggcccaaggucacccauauaauaaaaggcgggcugggugcaguggcucgugccuguaauuccagcacuuugggaguccaaggggaauaggaucacuucaggagaggaguuugagaccagccugggcaacagagggagacccuaccucuaccaaaauuauaaaaaaauuagccgggcaugguggcauagacuuguggucccagcugcccagaaggcugaaguggaaggauggcuugagccugggaggucaagccugcagugagccgugauugugccacugcacuccagccugggugagagagugagauccuaucucaaaaauaaaaaauaaaaaaaaaaugaaaaaaaaaauaaaaaaaaauaaauaaaauaauuaaaaaaagag

SEQ ID NO: 144365 - RNA, 37 nt, Homo sapiens
ggaaaccaacacaagugguggccugugcgugguggga

SEQ ID NO: 144366 - RNA, 72 nt, Homo sapiens
caguugaggcagcagagccuuuccauagggguguggugugaccugaauguugggcacguggucguaacugag

SEQ ID NO: 144367 - RNA, 28 nt, Homo sapiens
ugagggauuucaucgcugagguggaugg

SEQ ID NO: 144368 - RNA, 41 nt, Homo sapiens
acaucuuaaauauuggccaaaaggccagaugucaaagugga

SEQ ID NO: 144369 - RNA, 59 nt, Homo sapiens
ugccucugggcagggccacuuccuagaaccauggggcugcucugugaagagaaccggcu

SEQ ID NO: 144370 - RNA, 21 nt, Homo sapiens
cuguauuuuauuccacccagc

SEQ ID NO: 144371 - RNA, 55 nt, Homo sapiens
cagcgaucaugucucuuuuaucauuugguauguguugcugcagcacuuagcacag

SEQ ID NO: 144372 - RNA, 40 nt, Homo sapiens
gaucugggacccggugucugggcccaccuucaagcuggau

SEQ ID NO: 144373 - RNA, 43 nt, Homo sapiens
gggaaagaagccucuuuccucacaagcugaagcuugaaaccaa

SEQ ID NO: 144374 - RNA, 68 nt, Homo sapiens
gguuugcaguggggguggggcaggaaagaaagguuacguggggugaaggggucaggucaauucagugu

SEQ ID NO: 144375 - RNA, 45 nt, Homo sapiens
cugugcagucucauuuuuuaugcagauauguugggggaugcagag

SEQ ID NO: 144376 - RNA, 42 nt, Homo sapiens
cuaagaucugagaugucauccuuuauggagcaucuccggaug

SEQ ID NO: 144377 - RNA, 51 nt, Homo sapiens
uaaaauaaucuuuuucuuauuaugaaauagauauuuauuuugcuuaacaaa

SEQ ID NO: 144378 - RNA, 31 nt, Homo sapiens
gacacucaagggaacaugcaaagcucagggc

SEQ ID NO: 144379 - RNA, 46 nt, Homo sapiens
cuucaguggucuggggaauaacgcugguggaaccaugcacuggaau

SEQ ID NO: 144380 - RNA, 41 nt, Homo sapiens
guaaauuaagacaggauuguuaaugaaugaagacaugggag

SEQ ID NO: 144381 - RNA, 48 nt, Homo sapiens
uguaguaauaaucuccauuuauuaagccaugcugucuacagggcacau

SEQ ID NO: 144382 - RNA, 42 nt, Homo sapiens
gagaauuaaauaagagaacauauuaaaagguuucauucagug

SEQ ID NO: 144383 - RNA, 55 nt, Homo sapiens
uaggcucugauauccauacaugguaaaacguaaaggcaugugcauuuuggcaggg

SEQ ID NO: 144384 - RNA, 41 nt, Homo sapiens
gaugcauaguaagcccugaaucucauuuaaauuuggaaguc

SEQ ID NO: 144385 - RNA, 46 nt, Homo sapiens
cgcuuguugagaugacagaugagucaccucugggaaacugccugag

SEQ ID NO: 144386 - RNA, 33 nt, Homo sapiens
gcuuguucauucauucccugggccacagagucu

SEQ ID NO: 144387 - RNA, 46 nt, Homo sapiens
agguccagagucuggguguggaaggagcaacauaaugggggccccu

SEQ ID NO: 144388 - RNA, 58 nt, Homo sapiens
cauggaggucccaggcaccauugcugugggcuuuuggggaguuggaugcacaguggag

SEQ ID NO: 144389 - RNA, 49 nt, Homo sapiens
uaaaggucaggagggggaaacuucuggaaggaaguugaauguuguggga

SEQ ID NO: 144390 - RNA, 35 nt, Homo sapiens
aucacagucugagucuuuuguggcaugugcaagag

SEQ ID NO: 144391 - RNA, 42 nt, Homo sapiens
cuuccugaggaugauaaauguuuagauagcaccgaagauaau

SEQ ID NO: 144392 - RNA, 49 nt, Homo sapiens
aggaggggaugguuggguuggggauugggaugggagggggguagcugaa

SEQ ID NO: 144393 - RNA, 43 nt, Homo sapiens
gaaccucaccacagguuuacggguggugcucguuucauaaugg

SEQ ID NO: 144394 - RNA, 75 nt, Homo sapiens
uccugcaguuugaacauccuggcauucagcucagcccacugugcagaaaucuauacuaaacauguagacaguuua

SEQ ID NO: 144395 - RNA, 28 nt, Homo sapiens
cuaccaacgacgauggcuuucacaacug

SEQ ID NO: 144396 - RNA, 45 nt, Homo sapiens
cauaaaaauaugcaugaauaaacucacugccaacauucagcccac

SEQ ID NO: 144397 - RNA, 46 nt, Homo sapiens
acgauaaacacucaauaaauguuagcuauugauauuggugugccca

SEQ ID NO: 144398 - RNA, 54 nt, Homo sapiens
aaaaguuaagagaggucuucgaaagguguuuugcaaaaugauuccuuggauuaa

SEQ ID NO: 144399 - RNA, 30 nt, Homo sapiens
gguuucuuuauguguccagcucacuguggg

SEQ ID NO: 144400 - RNA, 45 nt, Homo sapiens
cuccccaccuugcuguaucagcaaaacugcuaagcccugacccau

SEQ ID NO: 144401 - RNA, 46 nt, Homo sapiens
cagcugucacuucagcauuucccugcaucagccuucccaaguacag

SEQ ID NO: 144402 - RNA, 62 nt, Homo sapiens
uuuuauauauagcagcuuuauugagauauaauucacauauaauucaccugaaacucacccau

SEQ ID NO: 144403 - RNA, 32 nt, Homo sapiens
ccacuuccucgcuuggcgcugugugacugcau

SEQ ID NO: 144404 - RNA, 52 nt, Homo sapiens
aaucuuaauaagcaaaaggacacauuucucaagugaucuuagcaccauuuca

SEQ ID NO: 144405 - RNA, 82 nt, Homo sapiens
uguguuaugggcugaauugugucucugcaaauucacauguugaaguccuagugccaaggaccucagaauaugacuggauuug

SEQ ID NO: 144406 - RNA, 62 nt, Homo sapiens
cugauccccugcuccucugccuccauccccugcugggccucugcaggagacgguccaggccc

SEQ ID NO: 144407 - RNA, 52 nt, Homo sapiens
gugcauauaaccuuuuucuucuuggaaaaucuuuuggacagauucucagcag

SEQ ID NO: 144408 - RNA, 45 nt, Homo sapiens
aaugaucucuuguuagauuuauauauuuuuuuauccuuagugagg

SEQ ID NO: 144409 - RNA, 41 nt, Homo sapiens
aaguuuuaccaaacuccuuuuuuauauuaggugcuagguga

SEQ ID NO: 144410 - RNA, 47 nt, Homo sapiens
acagacgcuaagauguagauuagcaaguaggauguuuauuaugggau

SEQ ID NO: 144411 - RNA, 47 nt, Homo sapiens
guguggcuaaaaacauuaauuaaaaacauuaaucaguuuggcugccu

SEQ ID NO: 144412 - RNA, 46 nt, Homo sapiens
gagcucaaguuugaguacuuguucaggguccuaaaaagccucuuua

SEQ ID NO: 144413 - RNA, 34 nt, Homo sapiens
gauuuggcugccagugaggauggugggggggccu

SEQ ID NO: 144414 - RNA, 47 nt, Homo sapiens
uccucucuaccuaguauucuuggaagaaggugaaugaaaaugcucua

SEQ ID NO: 144415 - RNA, 43 nt, Homo sapiens
uacgugaccuaaagcuggaguauuuugagauuggagaauuaag

SEQ ID NO: 144416 - RNA, 29 nt, Homo sapiens
cuguggcccagucaaguugacacacaaaa

SEQ ID NO: 144417 - RNA, 52 nt, Homo sapiens
ugagccccagcugaccccuuugauccuucacagccccaucauuaaaacaagg

SEQ ID NO: 144418 - RNA, 46 nt, Homo sapiens
ugguauguuuccucuucucuugugagguguauuucuguauuuccua

SEQ ID NO: 144419 - RNA, 39 nt, Homo sapiens
gcaggguggaaacaaccuugucaaaauaaaccagggcag

SEQ ID NO: 144420 - RNA, 48 nt, Homo sapiens
auguucccacaggcucugguguguucacugaguuagcuccagaaagaa

SEQ ID NO: 144421 - RNA, 48 nt, Homo sapiens
ugacauaaucaagauaauuaugaaguauccaaauauuaauuuucauag

SEQ ID NO: 144422 - RNA, 44 nt, Homo sapiens
uuuauucccucccaggguuuaggucacugccugacacauggcag

SEQ ID NO: 144423 - RNA, 67 nt, Homo sapiens
guaacaagaaagcuuugagagugcuuagugaugucugcuaccacauucauuuccucuguuuccauug

SEQ ID NO: 144424 - RNA, 63 nt, Homo sapiens
ggcaugaugauauuauaaggaaagaaaaagauguuauaaaaggucacauaaagucacccacag

SEQ ID NO: 144425 - RNA, 76 nt, Homo sapiens
aauaacuauuacuauuacaauaguaauaacuauuggauucaaauccugccagggcauggguugguuagugcuacau

SEQ ID NO: 144426 - RNA, 43 nt, Homo sapiens
ugaucuacggaguaauuugggucccuggcuccaaggcaagccu

SEQ ID NO: 144427 - RNA, 27 nt, Homo sapiens
gcccugguguucuggcccccagcuagg

SEQ ID NO: 144428 - RNA, 45 nt, Homo sapiens
ggcuaagaaagaaagaaugucauuuccagcagugauaaguccuaa

SEQ ID NO: 144429 - RNA, 65 nt, Homo sapiens
ugaucccgauuguugauuauccugugcaacuacagaaugaaguuuccauuuauugauaugggcca

SEQ ID NO: 144430 - RNA, 39 nt, Homo sapiens
aguuuggacuugccagcccccauaaucacacgagccaac

SEQ ID NO: 144431 - RNA, 46 nt, Homo sapiens
acagcuugaagagaccaucaaaaacugccugucagcggcggaggac

SEQ ID NO: 144432 - RNA, 47 nt, Homo sapiens
ugagaguggagggcauuguccacccaaccacagccgaaauugaccuc

SEQ ID NO: 144433 - RNA, 47 nt, Homo sapiens
ucuugccugacguggccuuccugccucuuuucucuggggguggggag

SEQ ID NO: 144434 - RNA, 45 nt, Homo sapiens
guggaggcguccugcccagaauucaccccgaacugcuggccaaaa

SEQ ID NO: 144435 - RNA, 42 nt, Homo sapiens
agcaagcugagagggaaacugaagcaagaugucgggccggag

SEQ ID NO: 144436 - RNA, 36 nt, Homo sapiens
ucaaccuuaacaaugcugacuuuuuaaagaauagug

SEQ ID NO: 144437 - RNA, 48 nt, Homo sapiens
guuaccugaccagcuuuccuacucaacauggagcucugucugucucau

SEQ ID NO: 144438 - RNA, 63 nt, Homo sapiens
ccaguuccuagcuugugauggauccuuccuaaggauguauuggguaaauuaaugaauagugau

SEQ ID NO: 144439 - RNA, 53 nt, Homo sapiens
uccaaucccgcauaguguuggcaguuaucauaccauccccauuuuacacaugg

SEQ ID NO: 144440 - RNA, 49 nt, Homo sapiens
uucugaauguucuuuuuucuuuaaacagcuuuguuaagauauaauuuac

SEQ ID NO: 144441 - RNA, 62 nt, Homo sapiens
aguuagguaggaggaauaaguucaagaagucgauuuugacuauaguuaauaauguguuguau

SEQ ID NO: 144442 - RNA, 41 nt, Homo sapiens
gauauggacugugaugcgggugagucauagugcacacucac

SEQ ID NO: 144443 - RNA, 39 nt, Homo sapiens
augcuaaaaauaacuaggcacagcugauaaguagcaaag

SEQ ID NO: 144444 - RNA, 61 nt, Homo sapiens
caagaguuauggcucccugcuggguguuucacaugggucagcagacucaaugugguucuga

SEQ ID NO: 144445 - RNA, 32 nt, Homo sapiens
auucacagauacuugaucugaaaugcuuggug

SEQ ID NO: 144446 - RNA, 46 nt, Homo sapiens
gcagccaucugguaauuaugaggugacaagucaauagacugagaug

SEQ ID NO: 144447 - RNA, 45 nt, Homo sapiens
auagagcaugaaacucccccuaaaaucugucucaaagcagccaca

SEQ ID NO: 144448 - RNA, 46 nt, Homo sapiens
gcuugcaaaggagaggcugugacuaccaagucgugucaacaacuga

SEQ ID NO: 144449 - RNA, 77 nt, Homo sapiens
agagugagagugagaagggagggcuaaugccugagcuccugcccuuucuaugcagugagggucaagauccucagcua

SEQ ID NO: 144450 - RNA, 51 nt, Homo sapiens
uaagcaauauuuugaaauauaccuuguucaugaguuuaaaggaucaacugg

SEQ ID NO: 144451 - RNA, 59 nt, Homo sapiens
caacaaacccaaagcucacaccacaacagcugucuugucagcuuuaccuaaacagagaa

SEQ ID NO: 144452 - RNA, 43 nt, Homo sapiens
aagacccagcucaaauggaacagcuuaacuccuuguuccuaca

SEQ ID NO: 144453 - RNA, 42 nt, Homo sapiens
uuggcaauaguggagcaucuuugugcauuaucucagucuuca

SEQ ID NO: 144454 - RNA, 70 nt, Homo sapiens
caggcccugaccccaggaggcaggugcugugccaacuuguccuccauguggcccaaauaagaagaaaagg

SEQ ID NO: 144455 - RNA, 48 nt, Homo sapiens
aucuugagauuugcuggagggagggaaauuuacccauggaaaugagag

SEQ ID NO: 144456 - RNA, 73 nt, Homo sapiens
cugaccuuuauucagaaucauccuccagcgcccacaucacacagcacccuggcucacccgcuccucccccaac

SEQ ID NO: 144457 - RNA, 53 nt, Homo sapiens
cucucuggggaggugacagucaagcccagaccuaaaggaaccugcugcaggga

SEQ ID NO: 144458 - RNA, 56 nt, Homo sapiens
uacuccccuggaauauaaacuucaagaaggcagugauuuuugucuuaucucuuucc

SEQ ID NO: 144459 - RNA, 53 nt, Homo sapiens
caugguaggcacuccauaaguauuuguaaaacaaauaauuggacuuccuuaua

SEQ ID NO: 144460 - RNA, 45 nt, Homo sapiens
cgcccucugccuugcacauaccagaccauccugggaaguaggcgg

SEQ ID NO: 144461 - RNA, 58 nt, Homo sapiens
gcacucgcugugugccaggcaccgcguccacacuuugcagccccacuugaugcaagac

SEQ ID NO: 144462 - RNA, 31 nt, Homo sapiens
uccacuuuucuuuucccugugaagcaaaaau

SEQ ID NO: 144463 - RNA, 62 nt, Homo sapiens
uguuauugaaugaaugcaaugaugugcagaagcaagcagggaggaguaucacugugugucug

SEQ ID NO: 144464 - RNA, 45 nt, Homo sapiens
aaaagaugguuacaauguaauaguaaauguaaaaaccagguuaua

SEQ ID NO: 144465 - RNA, 44 nt, Homo sapiens
aaguaaggcauauaauagaguuugcuuuaguauuguugagagag

SEQ ID NO: 144466 - RNA, 42 nt, Homo sapiens
ggucugucugauuggaaugcaacccgaaaggaaagucccgga

SEQ ID NO: 144467 - RNA, 45 nt, Homo sapiens
ccucugagaugggggagcugcugguuacacaguuuuaagagagga

SEQ ID NO: 144468 - RNA, 46 nt, Homo sapiens
aacuuguuguggcaggauauggaccaccagguggguaaggacagcc

SEQ ID NO: 144469 - RNA, 106 nt, Homo sapiens
ggaaauggaucgugcccaggcagagcucaaugccuugaaacgaacagaagaagaccugaaaaagggucaccagaaacuggaagagaugguuacccguuuagaucaa

SEQ ID NO: 144470 - RNA, 46 nt, Homo sapiens
cuucuguucguuucaaggcauugagcucugccugggcacgauccau

SEQ ID NO: 144471 - RNA, 45 nt, Homo sapiens
gaaaacgcuauugaagacacuaucuuuuacuugggagaagccuug

SEQ ID NO: 144472 - RNA, 41 nt, Homo sapiens
uaaaguauucuucucuuccuuuuaucaguaggugcccagaa

SEQ ID NO: 144473 - RNA, 47 nt, Homo sapiens
aagcaagaaaaagaaggaagaggaggaagaugaggaagaugaagagg

SEQ ID NO: 144474 - RNA, 50 nt, Homo sapiens
aaguuguucaguaaauguaauacguugugugcauagagauuuuaaugugg

SEQ ID NO: 144475 - RNA, 50 nt, Homo sapiens
acaugaggugagagagugggaaggaaaggaggccacagaugccauggggc

SEQ ID NO: 144476 - RNA, 82 nt, Homo sapiens
auuucaucuauggcucuuauuguauuuuacuagauggugucggccuagaaagacacaagugugccuaaggcuaugauaacag

SEQ ID NO: 144477 - RNA, 56 nt, Homo sapiens
ugccccuucacccuuccaacugcccccaaagggaggugagugugauugugcccaua

SEQ ID NO: 144478 - RNA, 42 nt, Homo sapiens
aggcccucucuccagccccuacgaccauggacuuuaccccag

SEQ ID NO: 144479 - RNA, 75 nt, Homo sapiens
auggauggaaggaugaugaaugaauggguggauuaauagauggauggauaaauggauguaugaauagaugggugg

SEQ ID NO: 144480 - RNA, 47 nt, Homo sapiens
gaguaagacugaaggucuuaaugucaaucuaaugcauggggugaaga

SEQ ID NO: 144481 - RNA, 43 nt, Homo sapiens
cugucuuuccaucccuucccugucugccuguucccuccucucc

SEQ ID NO: 144482 - RNA, 50 nt, Homo sapiens
ugaaaccaugaugaaugacuggccauaggcaagacaaaaaugcaggacaa

SEQ ID NO: 144483 - RNA, 43 nt, Homo sapiens
acuuuuaauaucacuaauuucuucuuuagaugccaaaccacaa

SEQ ID NO: 144484 - RNA, 52 nt, Homo sapiens
guuguuguuaaugaauaucaggcuauuauuuauuguauuaggaaaauauaau

SEQ ID NO: 144485 - RNA, 63 nt, Homo sapiens
gaggugagaaaacucaaccagagucacccaguuggugacugggaaaguuaggauucagaucga

SEQ ID NO: 144486 - RNA, 56 nt, Homo sapiens
gaaacugaacuuagcuuucaaagaucauaggaagucugguuggagaaacuagggau

SEQ ID NO: 144487 - RNA, 36 nt, Homo sapiens
cccccaaaaaguuagagcucaaacagcagcuuauuc

SEQ ID NO: 144488 - RNA, 106 nt, Homo sapiens
aucuacaaggggcuucaaacagaccaaauagaucaucaccucuguggucccuuguuaacuauauguucugagacaaaggaaagcuacccuaaggguuaguuaaccu

SEQ ID NO: 144489 - RNA, 43 nt, Homo sapiens
gucuauaaucucgcuagccuuguacugugugugcauagcaauu

SEQ ID NO: 144490 - RNA, 51 nt, Homo sapiens
uuaauauuuaaauauuccuacugccauuuuugugacugaaaaacuacacau

SEQ ID NO: 144491 - RNA, 41 nt, Homo sapiens
caucaccuuggaggccuucccuggccuugaguagaaaaguc

SEQ ID NO: 144492 - RNA, 44 nt, Homo sapiens
cagccacugggacccgaggauuucugggaccccgcaguugggag

SEQ ID NO: 144493 - RNA, 53 nt, Homo sapiens
cagcugcccuggcugugaugaguguccuugcaggggccggaguaggagcacug

SEQ ID NO: 144494 - RNA, 52 nt, Homo sapiens
cauccucuuaaugugcagcaaaagcaggcgacaaaaucuccuggcuuuacag

SEQ ID NO: 144495 - RNA, 52 nt, Homo sapiens
uagugacaugcaggcaccucuuuuaaacaggcaaaacaggaagggggaaaag

SEQ ID NO: 144496 - RNA, 22 nt, Homo sapiens
gaacugagagaacugguagaac

SEQ ID NO: 144497 - RNA, 51 nt, Homo sapiens
gaaggucaggacuuuguccagcaaguucaucugagcacauggugagccagc

SEQ ID NO: 144498 - RNA, 62 nt, Homo sapiens
agaaauacuggaguuucuggugacgguggcagaguggcggagaagggggagauguuuuggcu

SEQ ID NO: 144499 - RNA, 45 nt, Homo sapiens
augacaugaaccccggcaaccugcaccuguucaucaaugccuaca

SEQ ID NO: 144500 - RNA, 47 nt, Homo sapiens
caggccacauccucacagauguccuggcaucuccaaggcaacccuga

SEQ ID NO: 144501 - RNA, 45 nt, Homo sapiens
uuuuucggguggcccaaagcugcaguucuuccuugggacccaacc

SEQ ID NO: 144502 - RNA, 47 nt, Homo sapiens
aaguguaaaucagguguucuugagagauuagcaaagccagccugaag

SEQ ID NO: 144503 - RNA, 51 nt, Homo sapiens
gcgaaaggaaauugcaucuucauugaauuucuggugaggaaacuuuugagg

SEQ ID NO: 144504 - RNA, 42 nt, Homo sapiens
gauuguuuaaaacucauuucagaguaccagguauuggaggga

SEQ ID NO: 144505 - RNA, 107 nt, Homo sapiens
caauucaccuuuuauggcaauuuaaguagucauuugucauagauuggaggauuuccuggaagggugaagaacuucuauauagguuacuuauucugacuaacauaaau

SEQ ID NO: 144506 - RNA, 81 nt, Homo sapiens
acaaagcuuuuucagaaacucccagcuuaugucucauuugccacaacugcguaacauggcuaucuuuuagcuguaagagau

SEQ ID NO: 144507 - RNA, 45 nt, Homo sapiens
cagaguaaugauugaacuagggcagcugguacaagaacccuggag

SEQ ID NO: 144508 - RNA, 39 nt, Homo sapiens
uuucuuugggccagauuucaucacugccacaaaggaaaa

SEQ ID NO: 144509 - RNA, 41 nt, Homo sapiens
uuuuacuccuucaauccuaaauaacugccuagccaaagggg

SEQ ID NO: 144510 - RNA, 42 nt, Homo sapiens
gacagaauggagacaggaggagggacagauaauggaaaaaga

SEQ ID NO: 144511 - RNA, 46 nt, Homo sapiens
caccagaacugcauuggccacaccacugcccucagcccaagugggg

SEQ ID NO: 144512 - RNA, 61 nt, Homo sapiens
agccaccauuuuccaccucugucaccagaaagugagcauccuucugcuucacuuggagaga

SEQ ID NO: 144513 - RNA, 42 nt, Homo sapiens
acauuaauuccagacuuaaucguuuucuucagcaucucuagc

SEQ ID NO: 144514 - RNA, 37 nt, Homo sapiens
cucuguggagauggcaccuucacaaauggccuuagaa

SEQ ID NO: 144515 - RNA, 38 nt, Homo sapiens
ccagcccccagcauagcugggcauuuuugugacugugc

SEQ ID NO: 144516 - RNA, 44 nt, Homo sapiens
gagauaucuagguauagcaugaaauggucucagaguggggaggg

SEQ ID NO: 144517 - RNA, 42 nt, Homo sapiens
cuucagaccccagaaaaucuguucuuuuuuguaguaaaauga

SEQ ID NO: 144518 - RNA, 42 nt, Homo sapiens
guuuggcauaguguuuuuucaccuccuuacauaaccccuaac

SEQ ID NO: 144519 - RNA, 48 nt, Homo sapiens
aaucucugagccucaguuuccuugucugcaaaaagggcccaggaaccg

SEQ ID NO: 144520 - RNA, 43 nt, Homo sapiens
gaauaccacucuguaauugcaaaaaaaaaaaguugcagcuguu

SEQ ID NO: 144521 - RNA, 75 nt, Homo sapiens
aggaugaggaggaggaggaagaugaagaagaugaagaagaagaugaugaugaugaauaaguugguuguagcgcag

SEQ ID NO: 144522 - RNA, 35 nt, Homo sapiens
cugccccuugccccacacagaccaggccuuaaaug

SEQ ID NO: 144523 - RNA, 41 nt, Homo sapiens
aggccccccgaccccgucagagccucccagcgagcccgaac

SEQ ID NO: 144524 - RNA, 42 nt, Homo sapiens
cagagcagaccugaugucccggugcuuccuggccccucaggu

SEQ ID NO: 144525 - RNA, 42 nt, Homo sapiens
ggcgucagcuggcucugcggaugccgggagagggcggcggcg

SEQ ID NO: 144526 - RNA, 43 nt, Homo sapiens
ggccuggguguuguagcagaaugaggaagcugggguguucugu

SEQ ID NO: 144527 - RNA, 45 nt, Homo sapiens
ccugccgcaaguacuccucuagguggcucaggaacucucgagggu

SEQ ID NO: 144528 - RNA, 73 nt, Homo sapiens
gacuugcguuaggaugugccucaggaaccaggacaggcucccacugggccgggugugugaggaguggcacaga

SEQ ID NO: 144529 - RNA, 37 nt, Homo sapiens
aggguggagaaugcugggccauggaaacagcagcaga

SEQ ID NO: 144530 - RNA, 44 nt, Homo sapiens
acgaggccagcagccagcugcuccgcauggagagugggcucagu

SEQ ID NO: 144531 - RNA, 60 nt, Homo sapiens
uagguaggggaggauggugccuggagcagagggacccacaagugccucccgagccuagau

SEQ ID NO: 144532 - RNA, 33 nt, Homo sapiens
gagggggugccccaucuagcugggugcaggggu

SEQ ID NO: 144533 - RNA, 70 nt, Homo sapiens
cugcuguucuugccuuacagccaccaugggaaagcugcaaccuuucuguuuuauuuaaagaaagcccaac

SEQ ID NO: 144534 - RNA, 43 nt, Homo sapiens
agccccaucccccuaggaggugggcagacaagcucagaggcag

SEQ ID NO: 144535 - RNA, 94 nt, Homo sapiens
gguaaaaucacccaggaaagcggggagcagaggagaggacccgggagcaggaacuggggaugggagagcagagggacuugguuuucccaggcaa

SEQ ID NO: 144536 - RNA, 53 nt, Homo sapiens
gugugugugugcacgugcacgaaggugcgugugugaggggugucgcgguggac

SEQ ID NO: 144537 - RNA, 75 nt, Homo sapiens
acuuggauguucucucuuagucaaguguucuagacaauuuuaucacagcugggaguguagaauguguacauggag

SEQ ID NO: 144538 - RNA, 46 nt, Homo sapiens
ccaagggucaagagcauuuauauguugguccaggagacugaaacac

SEQ ID NO: 144539 - RNA, 36 nt, Homo sapiens
cagccagugccaccaugcgcgcucaguguaaguauc

SEQ ID NO: 144540 - RNA, 42 nt, Homo sapiens
cgcccccggcauaucaccccggagcacuggaacccgcccccg

SEQ ID NO: 144541 - RNA, 55 nt, Homo sapiens
ggaugagccaugagccugcagccugggccccaggggcgccccccacggccugccg

SEQ ID NO: 144542 - RNA, 45 nt, Homo sapiens
cacccagaagggcagccagcagcacuggcaagaagaucuucauuc

SEQ ID NO: 144543 - RNA, 65 nt, Homo sapiens
ugaugugcuucuccugcuugaaccagaagagcaaucuguacugccugaagccgaccaucugcucc

SEQ ID NO: 144544 - RNA, 47 nt, Homo sapiens
gcagaggccauugcugucugucugcagccgucugucucuccccugac

SEQ ID NO: 144545 - RNA, 40 nt, Homo sapiens
gaagccacaccaacauugacgccuucugggauggggcagg

SEQ ID NO: 144546 - RNA, 43 nt, Homo sapiens
cgucaauguugguguggcuuccaugggcaucagcugcugccag

SEQ ID NO: 144547 - RNA, 19 nt, Homo sapiens
acgugccugaucugugccc

SEQ ID NO: 144548 - RNA, 55 nt, Homo sapiens
cuuggggcagaggcaggggcuggggcagguggaggugcagggggugggccugacc

SEQ ID NO: 144549 - RNA, 47 nt, Homo sapiens
gaagggacgaggguucccuggagucuuacgguccaacaucaggacca

SEQ ID NO: 144550 - RNA, 53 nt, Homo sapiens
ggguugggguuucugccacuuccgggucuaggcccugccccaaauccagccag

SEQ ID NO: 144551 - RNA, 28 nt, Homo sapiens
ugcguguguguggcgugcguguguggcg

SEQ ID NO: 144552 - RNA, 57 nt, Homo sapiens
auuuaacaggaaugugaauguuuucuuuccuguuauuuucuucguuuagggggagac

SEQ ID NO: 144553 - RNA, 46 nt, Homo sapiens
acuguauuuuagauggucaccaagaaaaaauaggcaacuucaagau

SEQ ID NO: 144554 - RNA, 45 nt, Homo sapiens
gagggaagucaucaagagccuggacaagugugacuucacggagau

SEQ ID NO: 144555 - RNA, 45 nt, Homo sapiens
auaucuccuuuuccuccaucucccgaguccgcgacggccggccag

SEQ ID NO: 144556 - RNA, 40 nt, Homo sapiens
gucuuacuccuuggaggccaugugggccaugagguccacc

SEQ ID NO: 144557 - RNA, 41 nt, Homo sapiens
ggcaagaacucccuccucccaggaacucuggggaaccuagg

SEQ ID NO: 144558 - RNA, 66 nt, Homo sapiens
cagcagggcccaguccuacagacucccugauucugaccucucucuggccagcugcugcccccaaac

SEQ ID NO: 144559 - RNA, 39 nt, Homo sapiens
cauauacuccuccaggcauuuagaagccucucugcagau

SEQ ID NO: 144560 - RNA, 38 nt, Homo sapiens
cggcgcggggcuaggccugcggucuggagugggagcag

SEQ ID NO: 144561 - RNA, 42 nt, Homo sapiens
ccuaaucugggcucguggacuuccucagacucgggagagggg

SEQ ID NO: 144562 - RNA, 46 nt, Homo sapiens
aauggcgaaugaggcucgagcuccuuaugaaggauuucccacauuc

SEQ ID NO: 144563 - RNA, 47 nt, Homo sapiens
aggcuuucccacagucuuuacauucgaagggccuguccccagagugg

SEQ ID NO: 144564 - RNA, 44 nt, Homo sapiens
cuuucccacaauaacugcacacauagggcuuuucuccaguguga

SEQ ID NO: 144565 - RNA, 50 nt, Homo sapiens
uuagacagcuuuugaaccuuugcugcuuucuugucuccuucagugcguac

SEQ ID NO: 144566 - RNA, 46 nt, Homo sapiens
aaagucucuuggggguacuggaauuuucuuuacuauguacucacaa

SEQ ID NO: 144567 - RNA, 42 nt, Homo sapiens
gcugcaccacacgcggcgccagcugcuggaacagcgcgagca

SEQ ID NO: 144568 - RNA, 140 nt, Homo sapiens
gggcaccaaggggcuguggcccagggagguuuuaucugagagggacagugacaagaaagaggucaaagguaggccaagggaaggagggggugcugggagacagggacggagucuagggaucaguguuccaggacugggcg

SEQ ID NO: 144569 - RNA, 69 nt, Homo sapiens
uccccuaaaagccacucuuggaagaagggcucuccucagagggggugucucucgguggcuacauagaag

SEQ ID NO: 144570 - RNA, 48 nt, Homo sapiens
ggguggggguggcagagccuccuuccccagcaggauggugggugggga

SEQ ID NO: 144571 - RNA, 24 nt, Homo sapiens
agcccaggcccccgcauccugugg

SEQ ID NO: 144572 - RNA, 60 nt, Homo sapiens
cuggccccucccccgagcccucccugcucucuucuccggcuguccugucugcucccaucu

SEQ ID NO: 144573 - RNA, 40 nt, Homo sapiens
gccggggacagugcugcagcguccuggggggcccagcgga

SEQ ID NO: 144574 - RNA, 23 nt, Homo sapiens
cuccagagcagaagcccagacgg

SEQ ID NO: 144575 - RNA, 45 nt, Homo sapiens
ugccgugcagaugcgaguguggcgggagcgcaugguggagccuga

SEQ ID NO: 144576 - RNA, 42 nt, Homo sapiens
agcauugcgggcggcaagggcuccacacccuauaagggggac

SEQ ID NO: 144577 - RNA, 86 nt, Homo sapiens
gcccagaaggaggaggaggaggaggaagaggguaguccucaggaggaggagguagaggaggaggaggaaaacagggcugaagagga

SEQ ID NO: 144578 - RNA, 46 nt, Homo sapiens
gccaggcgggaggcagcggcucauccgcaaggacacaccucacuac

SEQ ID NO: 144579 - RNA, 43 nt, Homo sapiens
agcuggggccacccucacccuuuuguccgcacagcccacggug

SEQ ID NO: 144580 - RNA, 46 nt, Homo sapiens
cugccucccuaggugggguuaaggucuccccugacggcugggcuca

SEQ ID NO: 144581 - RNA, 49 nt, Homo sapiens
aggcacagggugggagccagcaggaagccacgacugcuggcggggagga

SEQ ID NO: 144582 - RNA, 36 nt, Homo sapiens
ggugugccugggagcacagggaaugggguuugguug

SEQ ID NO: 144583 - RNA, 45 nt, Homo sapiens
cugggggcucugcccaaucuucgggagcuguggcuugaccggaac

SEQ ID NO: 144584 - RNA, 46 nt, Homo sapiens
gucccugccagcgugagugugacaggcauucuccuaacagccaggg

SEQ ID NO: 144585 - RNA, 27 nt, Homo sapiens
ucuggagauggggugcugggugaucag

SEQ ID NO: 144586 - RNA, 59 nt, Homo sapiens
uucauuugcccuguuugagaaggaccauccuccagguuuccugagagggugcauaggaa

SEQ ID NO: 144587 - RNA, 52 nt, Homo sapiens
uggagguucuaggggagacucugucuccugcuccuucaggcugcuggcagaa

SEQ ID NO: 144588 - RNA, 52 nt, Homo sapiens
ccucuugauucuuggcuugccucuccuccaauuccaaacuuagugaaauggc

SEQ ID NO: 144589 - RNA, 47 nt, Homo sapiens
cuuccagcaccagaagcagagugagcuggggaggcggcggggcgugg

SEQ ID NO: 144590 - RNA, 24 nt, Homo sapiens
ccugcugcucagugccaucccuca

SEQ ID NO: 144591 - RNA, 43 nt, Homo sapiens
uggucuggauuuccaguacagccaucuggggcacagagccagg

SEQ ID NO: 144592 - RNA, 43 nt, Homo sapiens
gagcugagcgggcggggaccucuccaggaccccguccccccaa

SEQ ID NO: 144593 - RNA, 46 nt, Homo sapiens
uuggggggcugcaggcgugcaggaagcugcagacguuggggagggg

SEQ ID NO: 144594 - RNA, 44 nt, Homo sapiens
aggaggggguagaggugguguggaacgagcuccacuucggagac

SEQ ID NO: 144595 - RNA, 24 nt, Homo sapiens
cgcuagcuuccuggggaucccccu

SEQ ID NO: 144596 - RNA, 23 nt, Homo sapiens
agaggcauggggaggugguccug

SEQ ID NO: 144597 - RNA, 41 nt, Homo sapiens
gaauaaacgugaacgugaacccaggcggaagggacccggga

SEQ ID NO: 144598 - RNA, 42 nt, Homo sapiens
gccaggcgcgccucccugucggugcaggaccgcuacucgccc

SEQ ID NO: 144599 - RNA, 52 nt, Homo sapiens
guccugggucgacugggggggcucaguggagagugggacuagugauguggag

SEQ ID NO: 144600 - RNA, 56 nt, Homo sapiens
acagcagcgcgcgggccaagccguggagggcgugcagcgccgggggcgggaagggc

SEQ ID NO: 144601 - RNA, 42 nt, Homo sapiens
ccaacacuaccccgcgaagcgaagccgcagcugccgccaucu

SEQ ID NO: 144602 - RNA, 60 nt, Homo sapiens
ugcccagcgcugacagcaucacuuuccggccucgggaaaggccagacuucgacgacaagg

SEQ ID NO: 144603 - RNA, 45 nt, Homo sapiens
cggccagggaagcuguucgacuauuucccaaaaccauaccccaac

SEQ ID NO: 144604 - RNA, 46 nt, Homo sapiens
gucacugcgggaaggucucuacuucaaccccuacuuuccuggccag

SEQ ID NO: 144605 - RNA, 46 nt, Homo sapiens
gccccaugcguuuucgauggucgugcucuggcucagaugcccagcg

SEQ ID NO: 144606 - RNA, 47 nt, Homo sapiens
uguugaugaugauggcucugcuggugccccuggucuacaccauaaag

SEQ ID NO: 144607 - RNA, 40 nt, Homo sapiens
ugucugcuugccauccugccagaacaggcccucaagccca

SEQ ID NO: 144608 - RNA, 46 nt, Homo sapiens
gggcaggagaccaggcucuagcucugggcccuccuucagcccccau

SEQ ID NO: 144609 - RNA, 49 nt, Homo sapiens
caauuacaauuuggaauagccuuggccccccaguccugguuggggaagu

SEQ ID NO: 144610 - RNA, 45 nt, Homo sapiens
gacuugggcuccgccgcagugcucuuggcugugcacgccgcggug

SEQ ID NO: 144611 - RNA, 47 nt, Homo sapiens
guuuccgaccggcggagggggcucagcggcccgaucccacggaagcg

SEQ ID NO: 144612 - RNA, 45 nt, Homo sapiens
ucagaggcgcggggccgggcccggcggacgcuuguuguuguccgg

SEQ ID NO: 144613 - RNA, 45 nt, Homo sapiens
cccucuucuaccugauugccacgcucaaugaguccuucaggccug

SEQ ID NO: 144614 - RNA, 44 nt, Homo sapiens
gaagucauagucaggccugaaggacucauugagcguggcaauca

SEQ ID NO: 144615 - RNA, 39 nt, Homo sapiens
aagcgggggcaguggggccgaggagaccagcaccaugga

SEQ ID NO: 144616 - RNA, 43 nt, Homo sapiens
agccucagaguuggccggagaggagggaggccaguggagggag

SEQ ID NO: 144617 - RNA, 53 nt, Homo sapiens
uggagccucgccuagcugcccagguccuggggcugcugcuggagaagaugagu

SEQ ID NO: 144618 - RNA, 47 nt, Homo sapiens
aaccgcccaacaguuagcagaagcccaauacaagagacgccccauuc

SEQ ID NO: 144619 - RNA, 43 nt, Homo sapiens
uggugcaccugugaguggaguggaggcuggccacgggccucau

SEQ ID NO: 144620 - RNA, 47 nt, Homo sapiens
ggaguccucagggcuugugugagugcucucaaagucacaggauggga

SEQ ID NO: 144621 - RNA, 44 nt, Homo sapiens
ccuccuugacacgcaccagggggcugcuggauaggggccugcac

SEQ ID NO: 144622 - RNA, 45 nt, Homo sapiens
gcggucggggacaagaggguguccacggaagaugggcgcccggga

SEQ ID NO: 144623 - RNA, 46 nt, Homo sapiens
ggaggaugcugugcagccaggcccauccccagcacucgaggccuag

SEQ ID NO: 144624 - RNA, 44 nt, Homo sapiens
agacccugacgggcccacagcccuccagcuuucuccuuagguag

SEQ ID NO: 144625 - RNA, 41 nt, Homo sapiens
agcccgggaagcugggcuggaagaauucggauuuggcagag

SEQ ID NO: 144626 - RNA, 47 nt, Homo sapiens
accgcuuccagcaaagccccaggccccgcgcccuggucucagaccag

SEQ ID NO: 144627 - RNA, 95 nt, Homo sapiens
ccaggccccauguuguggaaaggucagccauaagggucagggguccccacucuugugucuccagcaccccacccucagcaaagccagagccccug

SEQ ID NO: 144628 - RNA, 63 nt, Homo sapiens
gacagguaugggaugcaguuacugguggugauggagcacaguuggguuagaagaugaggacau

SEQ ID NO: 144629 - RNA, 46 nt, Homo sapiens
gagcagcugcuccagacaccacuggacuuccuccaggccccgguag

SEQ ID NO: 144630 - RNA, 49 nt, Homo sapiens
cugccgcugccuuccccggggucugaagcgggccuaccggggccuggag

SEQ ID NO: 144631 - RNA, 46 nt, Homo sapiens
ggauuuccaagggaaugcggucuccccagcccgcgucgggcccuuc

SEQ ID NO: 144632 - RNA, 45 nt, Homo sapiens
cuggccaccucgcuggccguguucugccacgaguugccacacgag

SEQ ID NO: 144633 - RNA, 45 nt, Homo sapiens
ggaggccagguacgucgcccgccucagugccgccgccguccugua

SEQ ID NO: 144634 - RNA, 27 nt, Homo sapiens
guccacacuccgcagauguggggggca

SEQ ID NO: 144635 - RNA, 38 nt, Homo sapiens
cccguggcguugccaacgugggccacacaugacaggac

SEQ ID NO: 144636 - RNA, 74 nt, Homo sapiens
ggugagagucugaggugugucccccaugcugcucucgggguccugcugcuggcccugcauucagggcucgcugc

SEQ ID NO: 144637 - RNA, 65 nt, Homo sapiens
acaggcugugggcugcccaagaggacugugcaggcagggcugccugcugauuggcagcuccggau

SEQ ID NO: 144638 - RNA, 41 nt, Homo sapiens
acacaggugguccccaaggcccagacagcagagacagccag

SEQ ID NO: 144639 - RNA, 45 nt, Homo sapiens
ggcugaaggaggagcaggccacgugccccaauugucguugugaga

SEQ ID NO: 144640 - RNA, 42 nt, Homo sapiens
auuaguacacugcgaagaaggaaagggagacgaagcucacag

SEQ ID NO: 144641 - RNA, 34 nt, Homo sapiens
cagccccccgccccccggagguaugccacuccac

SEQ ID NO: 144642 - RNA, 48 nt, Homo sapiens
aggccuguggccaggggccggcccaggagcugggguggcuuucggggg

SEQ ID NO: 144643 - RNA, 43 nt, Homo sapiens
gaacaaagucucaaagugggggcgcugccucugccgggcccaa

SEQ ID NO: 144644 - RNA, 46 nt, Homo sapiens
ccuucagacgaggcccagugugaugcugcguaagacagaccuggcc

SEQ ID NO: 144645 - RNA, 40 nt, Homo sapiens
ugggucagcuggcccugcaggcccaaaggcucagaccugg

SEQ ID NO: 144646 - RNA, 46 nt, Homo sapiens
gggcggccagaggcagggagcugaacagguguaauggagaccgaag

SEQ ID NO: 144647 - RNA, 54 nt, Homo sapiens
aggauucuuccacccaggaggguagaaaaggaggcguccauaggauguucagga

SEQ ID NO: 144648 - RNA, 63 nt, Homo sapiens
acagaaaaggggggucccgagcggaaaauaaagcccugagagaaagacaacgaggagcuucgg

SEQ ID NO: 144649 - RNA, 53 nt, Homo sapiens
gucucuccgcuugcuccuguggagaccuaaggggucccgcacccgacagagag

SEQ ID NO: 144650 - RNA, 54 nt, Homo sapiens
gaccagaaugaaagggacagggucccagacacguuuggggguccugauucuggg

SEQ ID NO: 144651 - RNA, 42 nt, Homo sapiens
gggcugcugcuggcuuccugcuccaggucuuggcugccacca

SEQ ID NO: 144652 - RNA, 49 nt, Homo sapiens
ccggguucccaggacaacgccucccggaacgcagggagcaggccgaggc

SEQ ID NO: 144653 - RNA, 32 nt, Homo sapiens
agcccuccgagcccaggugggcauggggccca

SEQ ID NO: 144654 - RNA, 45 nt, Homo sapiens
gcugcagggccuucaaggggcccuccagcagcuccagcaggagac

SEQ ID NO: 144655 - RNA, 31 nt, Homo sapiens
gacacuccgcucaccgggacccccugcaccc

SEQ ID NO: 144656 - RNA, 42 nt, Homo sapiens
aaguguguugugccugcugaagugaucaccccccgcccccag

SEQ ID NO: 144657 - RNA, 77 nt, Homo sapiens
uuugcuguuaucacggcacacagcagggaaucccaggcccccccgccaagugguuacccaagucaccacuccugacc

SEQ ID NO: 144658 - RNA, 46 nt, Homo sapiens
ggugcuaccuccuuuccagacagaugagagagggcaggacuucagg

SEQ ID NO: 144659 - RNA, 53 nt, Homo sapiens
ggcuccccccugcacagucucccccuccacucucguggggccaggaagggggc

SEQ ID NO: 144660 - RNA, 37 nt, Homo sapiens
uagccccggccagggugcccccuccccggacccuccu

SEQ ID NO: 144661 - RNA, 47 nt, Homo sapiens
guguucugcagccggagcgccucagcugggaucaggcucacgucgac

SEQ ID NO: 144662 - RNA, 44 nt, Homo sapiens
ggagggugcagggcgguggggcaguguagaaggcagggccggga

SEQ ID NO: 144663 - RNA, 26 nt, Homo sapiens
uccaaacuugaaauagcuuagacaag

SEQ ID NO: 144664 - RNA, 27 nt, Homo sapiens
ggggccuccagaaacuugcagccccag

SEQ ID NO: 144665 - RNA, 53 nt, Homo sapiens
cagccuuguuuccucaucacaauccaugcucuccauucagaacucagacccug

SEQ ID NO: 144666 - RNA, 42 nt, Homo sapiens
uucccacccuucuggucuugcuuugucuccuuugccucugca

SEQ ID NO: 144667 - RNA, 63 nt, Homo sapiens
cuauccugggagccuugagcccuggcccccgcauuuguagucuuaucauuucucugagcacag

SEQ ID NO: 144668 - RNA, 40 nt, Homo sapiens
guuuauuucagauucuacgauuaggacugaaaaugagcag

SEQ ID NO: 144669 - RNA, 49 nt, Homo sapiens
aggagcugggaagcagcggccuggauugucagccucuugaaagucaggg

SEQ ID NO: 144670 - RNA, 39 nt, Homo sapiens
ucaaaggaugcauacuggggagaaagcucaaauucuaaa

SEQ ID NO: 144671 - RNA, 29 nt, Homo sapiens
auaaauguguauauaugugaauaaaccua

SEQ ID NO: 144672 - RNA, 47 nt, Homo sapiens
ggcccuggaagcagguggcagagggguccaugucagucccaggagga

SEQ ID NO: 144673 - RNA, 50 nt, Homo sapiens
ugcaauucugcaaauguuacugcgcuagagguugcaagcagcggagaacu

SEQ ID NO: 144674 - RNA, 49 nt, Homo sapiens
uugugccccaguccacuucuuucucaaagaaaaaaaaauguuggcucaa

SEQ ID NO: 144675 - RNA, 46 nt, Homo sapiens
caccaucauccuucaacagccacagucugaauugagccaacauuuu

SEQ ID NO: 144676 - RNA, 46 nt, Homo sapiens
ucuagugaacaccuuuaucuccaugucccucuuagagcccagagag

SEQ ID NO: 144677 - RNA, 35 nt, Homo sapiens
aggagcccagcuuccaagaguacagaaaguccagg

SEQ ID NO: 144678 - RNA, 72 nt, Homo sapiens
cagcuagauauguaaaugugaauaugucaagaaacagccuaguuggugugcuucguagaugauagaggaaac

SEQ ID NO: 144679 - RNA, 66 nt, Homo sapiens
uagauaguacuagaaauuccuaagugaaugcuuuauaggauauuuuauuauugauuauugauaaca

SEQ ID NO: 144680 - RNA, 44 nt, Homo sapiens
ucauugauaauaugccccgaguaguggcaugauuugcgagagaa

SEQ ID NO: 144681 - RNA, 31 nt, Homo sapiens
ugucuauguuugugucagucccugugucuac

SEQ ID NO: 144682 - RNA, 50 nt, Homo sapiens
uuauagguauuucuaaaauaagggguaacaaauaaaagaagcaagcuagg

SEQ ID NO: 144683 - RNA, 41 nt, Homo sapiens
uaaguacauuugaaacuacccugacuucaagcagcauaaac

SEQ ID NO: 144684 - RNA, 25 nt, Homo sapiens
auuagggugugcuguggccaugcua

SEQ ID NO: 144685 - RNA, 52 nt, Homo sapiens
agguggaagacaucagguugaucauagcaauuuuuucccuuaaccccaauuu

SEQ ID NO: 144686 - RNA, 44 nt, Homo sapiens
uaaaaauacuccauauacaaaaaguuauuuccaagccagcagau

SEQ ID NO: 144687 - RNA, 50 nt, Homo sapiens
uguauuuuucagaauuccaugaauacucuuauagucaaaaaagaacccuu

SEQ ID NO: 144688 - RNA, 51 nt, Homo sapiens
caacuggagacuaugaaaaugaaugggacuuagcuaaaugaacaucagaga

SEQ ID NO: 144689 - RNA, 47 nt, Homo sapiens
caucagacaucugucuuugccccaguccuggcugcugcacccucacu

SEQ ID NO: 144690 - RNA, 43 nt, Homo sapiens
ccucugcucuuuuaauauauaaugauggcuuuaaauaaaauua

SEQ ID NO: 144691 - RNA, 46 nt, Homo sapiens
uuguccaaggucccaugauuagcgaaggguggagccaggauuagga

SEQ ID NO: 144692 - RNA, 32 nt, Homo sapiens
cccugggaaaagguguaucucaacuaguaaga

SEQ ID NO: 144693 - RNA, 46 nt, Homo sapiens
ggcaaggagcuguuuucggaaaugcuggauaaauuggcaaguagca

SEQ ID NO: 144694 - RNA, 40 nt, Homo sapiens
gcggggaaggaaugaaugggauugugugaacagguccaug

SEQ ID NO: 144695 - RNA, 57 nt, Homo sapiens
gccacugacccuugagaucagcccuccccuccccaccuucccgucccaggccagccc

SEQ ID NO: 144696 - RNA, 50 nt, Homo sapiens
ggacggccaucugccugcuugguuguuuccugccucuucccagucggacg

SEQ ID NO: 144697 - RNA, 45 nt, Homo sapiens
gaguucuacaacaucggcccgcugauccgcaucaucaaagaccgg

SEQ ID NO: 144698 - RNA, 51 nt, Homo sapiens
acacccaucccuuccucauaggcagaagggggucaguguggagguacaggg

SEQ ID NO: 144699 - RNA, 41 nt, Homo sapiens
caggcugggagcagugaaaugagagcauccccagggugcag

SEQ ID NO: 144700 - RNA, 45 nt, Homo sapiens
ggucugcccuggucccagccucccgugcccuccacccaggccccc

SEQ ID NO: 144701 - RNA, 43 nt, Homo sapiens
aagccaguggguggguugggggagugcggggcuauaaucaggg

SEQ ID NO: 144702 - RNA, 40 nt, Homo sapiens
cuggaacuccuuggaaaacucccaagaugagaauaucuua

SEQ ID NO: 144703 - RNA, 41 nt, Homo sapiens
acagcuuccaggcacucagcuuagcaagcagaacaugggcu

SEQ ID NO: 144704 - RNA, 34 nt, Homo sapiens
ggggcgggcccagccugccucuaggggcagcgag

SEQ ID NO: 144705 - RNA, 108 nt, Homo sapiens
ggacagacaucagugucugagggcagcuggaggcccuggggaaacggaaguucagaugacuuugguggaagggacugagcaaggcccuggcagagcccugggaggagg

SEQ ID NO: 144706 - RNA, 41 nt, Homo sapiens
guuugcuguaacgaugagcacugggcagguggaugaggaac

SEQ ID NO: 144707 - RNA, 48 nt, Homo sapiens
auauuuagguuagcaagcuucuuaaaauagguccaagagagaagagag

SEQ ID NO: 144708 - RNA, 46 nt, Homo sapiens
gaaggaucucacagugagcggcaggauccuggccguccgcuggaaa

SEQ ID NO: 144709 - RNA, 71 nt, Homo sapiens
ugucuguacuuuugggcuccuuccucguugccagggucccucuggguggggaggcaggacuugcaucuggg

SEQ ID NO: 144710 - RNA, 41 nt, Homo sapiens
cccuuaucucuuuugcgccccuccccugccacagagccgga

SEQ ID NO: 144711 - RNA, 44 nt, Homo sapiens
uuaauuuuucuaccaaggucacauugcuaauucauuggaagaga

SEQ ID NO: 144712 - RNA, 37 nt, Homo sapiens
uggcaaggcaaaguuggagugcucuguggcacgcagg

SEQ ID NO: 144713 - RNA, 35 nt, Homo sapiens
cagaccggggguugggcugacagauagucaggugg

SEQ ID NO: 144714 - RNA, 41 nt, Homo sapiens
ugcugcuucccauaugggaggagacaaggagcaauggaggg

SEQ ID NO: 144715 - RNA, 37 nt, Homo sapiens
acggcuugucccaccuuuggguugggugugaugcgau

SEQ ID NO: 144716 - RNA, 358 nt, Homo sapiens
uaugaggauuugauaaguuguuuuuuuuuuuuuuuuuuuugagauggagucucacccuuguugcccaggcuggagugcaguggugugaucucggcuccuugcagccucugccucccggguuccagcgauucuccugccucagcuucccggguagcugggauuacaggcucgugccaccacacccagcuaauuuuuguauuuuuaguagagaugggguuucaccauguugacccggcuggucucgaacuccugaccucaggugaucugcccgccucggccucccaaagugcugggauuacaggcgugagccaccguaccuggcccggugaguuuaagacacaguuucaaacauguacag

SEQ ID NO: 144717 - RNA, 41 nt, Homo sapiens
cuucgcagccgugaccugcagcuggcgguaggcccugggga

SEQ ID NO: 144718 - RNA, 42 nt, Homo sapiens
acccaauucuugaugacagaggugcgacggcugcgggaagcu

SEQ ID NO: 144719 - RNA, 55 nt, Homo sapiens
ucgccgucccaggggucauggcccagggauccgacaggugggcggcgcccgcucc

SEQ ID NO: 144720 - RNA, 28 nt, Homo sapiens
uucucccccugccucuggcugaaagcca

SEQ ID NO: 144721 - RNA, 42 nt, Homo sapiens
aucacugcccauucaaugacacccagccagaagacccuaaaa

SEQ ID NO: 144722 - RNA, 38 nt, Homo sapiens
ccagacagcuaccccuuuaacccccaauacugguuaaa

SEQ ID NO: 144723 - RNA, 44 nt, Homo sapiens
gguggcuccuuccaacugcagauacuuagcagggccugggggag

SEQ ID NO: 144724 - RNA, 42 nt, Homo sapiens
uuggccugcaggaucuccgcuggaacaggcaggaggggagag

SEQ ID NO: 144725 - RNA, 99 nt, Homo sapiens
aagagguuccuuuccucacgcauccaggcaaggggagagcagcucugugccugccacuggcccacucgagggacgccugcugggugacugugggcuagg

SEQ ID NO: 144726 - RNA, 48 nt, Homo sapiens
caggguggcugggucugguuggggguucuacaauccagggaccucugu

SEQ ID NO: 144727 - RNA, 45 nt, Homo sapiens
gcgacugcugcaggagggucuuccccaggaggucuaggucgucca

SEQ ID NO: 144728 - RNA, 44 nt, Homo sapiens
cggaugggcuggggggcggugcucagcauggaaaccaccaccac

SEQ ID NO: 144729 - RNA, 45 nt, Homo sapiens
cgaaggcacucuccagguuugagauucagguugcuggcgaccaga

SEQ ID NO: 144730 - RNA, 44 nt, Homo sapiens
aaccugaaucucaaaccuggagagugccuucgagugcgaggcga

SEQ ID NO: 144731 - RNA, 58 nt, Homo sapiens
acagcaacaaccugugccugcacuucaacccucgcuucaacgcccacggcgacgccaa

SEQ ID NO: 144732 - RNA, 46 nt, Homo sapiens
uugcuguugcacacgaugguguuggcgucgccgugggcguugaagc

SEQ ID NO: 144733 - RNA, 45 nt, Homo sapiens
gggggaccgagcagcgggaggcugucuuucccuuccagccuggaa

SEQ ID NO: 144734 - RNA, 45 nt, Homo sapiens
ugugcaucaccuucgaccaggccaaccugaccgucaagcugccag

SEQ ID NO: 144735 - RNA, 57 nt, Homo sapiens
ggcccccaauaaaggcagcugccucugcucccucugaaccagccucgugugugugcu

SEQ ID NO: 144736 - RNA, 39 nt, Homo sapiens
gagggaagaauacgagaccccucucauuugccuucauga

SEQ ID NO: 144737 - RNA, 42 nt, Homo sapiens
ggaguucugaagcucgaggggcuuuaggggcccagaggccag

SEQ ID NO: 144738 - RNA, 41 nt, Homo sapiens
ggggguuaugucccuuggguugugaccuguccucggaaagu

SEQ ID NO: 144739 - RNA, 58 nt, Homo sapiens
cccggcucgggugucgggagagcucgccgagccggcuuugcgaggcccagccccgccg

SEQ ID NO: 144740 - RNA, 47 nt, Homo sapiens
agccugccucgggaucugcuccugagccccugacuaccgggccaguc

SEQ ID NO: 144741 - RNA, 49 nt, Homo sapiens
uuuggaaggcgccuucaacagccggaccagacaggccaccaugaccgag

SEQ ID NO: 144742 - RNA, 42 nt, Homo sapiens
cuuggcccgcuugggcuuggccgcaggggcggacguggaauu

SEQ ID NO: 144743 - RNA, 79 nt, Homo sapiens
agcgggccaaggccuccaagaaguccacagaccaccccaaguauucagacaugaucguggcugccauccaggccgagaa

SEQ ID NO: 144744 - RNA, 43 nt, Homo sapiens
gagaacgcugacucgcagaucaaguuguccaucaagcgccugg

SEQ ID NO: 144745 - RNA, 46 nt, Homo sapiens
gcuugaggacaccgguggugaccaggcgcuugauggacaacuugau

SEQ ID NO: 144746 - RNA, 45 nt, Homo sapiens
aaagaaggcauccaagcccaagaaggcugccuccaaagccccaac

SEQ ID NO: 144747 - RNA, 46 nt, Homo sapiens
caagaagaagcuggcugccacgcccaagaaagccaaaaaacccaag

SEQ ID NO: 144748 - RNA, 42 nt, Homo sapiens
uacuuacgggguuagggauuugcggggggggcuuguguguuu

SEQ ID NO: 144749 - RNA, 57 nt, Homo sapiens
gcacuugcgcgucccccccccacccccuuuuuuaaacaaguguuacuugugccggga

SEQ ID NO: 144750 - RNA, 46 nt, Homo sapiens
gcacagucagcgcuggcccagcugcguggcauucuggagggggagc

SEQ ID NO: 144751 - RNA, 39 nt, Homo sapiens
uuucuugagcggcuccuuugugaaggucucuaccaauug

SEQ ID NO: 144752 - RNA, 49 nt, Homo sapiens
aacagcagagauuuguccaagaugugaacccagaucccucacacccaga

SEQ ID NO: 144753 - RNA, 46 nt, Homo sapiens
cucaugucuuuccugcagaagcaucggcugcgccugguggccacug

SEQ ID NO: 144754 - RNA, 45 nt, Homo sapiens
gguacagaucucagcagugcauagcgaggaagacauugaccgcug

SEQ ID NO: 144755 - RNA, 40 nt, Homo sapiens
cugcagagagaggaaaaggcagcagcaacgcagagaggca

SEQ ID NO: 144756 - RNA, 81 nt, Homo sapiens
uccaugugcauaauaggugcggaaugagugaaugcccuugaauuauuuauauuuugaaagaaagcaggcacaugcagauca

SEQ ID NO: 144757 - RNA, 93 nt, Homo sapiens
aguaauauaaaucgaaauauuuaguaauaaaauuaguaagcugguagcucucagacuagcugauuaucagaaucaucugggcaguuuugcaaa

SEQ ID NO: 144758 - RNA, 38 nt, Homo sapiens
cugucaaggacaacugacucccccaucagcucaaacau

SEQ ID NO: 144759 - RNA, 72 nt, Homo sapiens
caaugggcgcuuccuggacggugggcugcuggccaacaaccccacgcuggaugccaugaccgagauccauga

SEQ ID NO: 144760 - RNA, 92 nt, Homo sapiens
accucuuccggaacuacgaugcuccagaaacuguccgggagccucguuucaaccagaacguuaaccucaggccuccagcucagcccucaggu

SEQ ID NO: 144761 - RNA, 46 nt, Homo sapiens
uggggagcacaccaagaugacggacgucaggaaacccaaguaagcc

SEQ ID NO: 144762 - RNA, 50 nt, Homo sapiens
aaggguauucaugccuugggguuucaagaggaagagauugaggggaaccu

SEQ ID NO: 144763 - RNA, 43 nt, Homo sapiens
auccacgggguccccgcggagcagggcucugcagcgccacauc

SEQ ID NO: 144764 - RNA, 62 nt, Homo sapiens
cugugcaaugcucggugcaacaucaugggccccaacggcuaccccauccacucggccaugaa

SEQ ID NO: 144765 - RNA, 78 nt, Homo sapiens
caggugaauaaccaagggcugaccccgcugcaccuggccugccagcuggggaagcaggagaugguccgcgugcugcug

SEQ ID NO: 144766 - RNA, 59 nt, Homo sapiens
gcaagggugauggggagauccugguggagcuggugcaguacugccacacucagauggau

SEQ ID NO: 144767 - RNA, 58 nt, Homo sapiens
agcugugccaauugcgcggagaacgaggagggcugcacaccccugcaccuggccugcc

SEQ ID NO: 144768 - RNA, 34 nt, Homo sapiens
agggauccgcgagugcuuccaucacagccguauc

SEQ ID NO: 144769 - RNA, 45 nt, Homo sapiens
gaauuuccaucaguauucuucccagcugcuacccuucuaugagag

SEQ ID NO: 144770 - RNA, 67 nt, Homo sapiens
uccccugggccugaagagaaggcucaaaagccaggacaggccugagggaaccgggccaacggcagag

SEQ ID NO: 144771 - RNA, 79 nt, Homo sapiens
gggcggccuccgucugauuggcgccuggcuuuggugacaguaccuuaggaaggcaguguauuuucugggaaccuaggaa

SEQ ID NO: 144772 - RNA, 45 nt, Homo sapiens
cuccugcucccacagaugacuuggaagcuggugacagggagcaug

SEQ ID NO: 144773 - RNA, 42 nt, Homo sapiens
auuucucacucccugcuucuccugccuuuccucccugcuuuu

SEQ ID NO: 144774 - RNA, 45 nt, Homo sapiens
gcggagagcgguggucaggccaucacguggcccgaggcccguuug

SEQ ID NO: 144775 - RNA, 86 nt, Homo sapiens
guaggagucugccaaacaaaguagaggggagugaggggagagaaauaucauggggugggagguggcucagaggcaagaaagcgcgg

SEQ ID NO: 144776 - RNA, 52 nt, Homo sapiens
ggucuggaucugggaucgcccuuggcugaaaguuuagccuuuuuagauugag

SEQ ID NO: 144777 - RNA, 80 nt, Homo sapiens
gggccugggggugccuggccuuccgaaacuaaaagagugggugggaagacuagugaaacccaguucacggauggggaaac

SEQ ID NO: 144778 - RNA, 85 nt, Homo sapiens
aaaaccuggguguccucacugcugcccugaguccagccaugguuuucagggggacaguggacagggacucagaaaugugguggga

SEQ ID NO: 144779 - RNA, 165 nt, Homo sapiens
gggagaccgcucucugcaagggagggggagagaagcagagggagagagaaggugacacggauggaagagugggaaggagcuggccuggcucagcccuaggcugucccugcagccaggguguccgggggcuggccagucagagaaagggggccauggacugcugug

SEQ ID NO: 144780 - RNA, 48 nt, Homo sapiens
agccagagcccgagcuccugcucccugggaaaaguggcguauggcccu

SEQ ID NO: 144781 - RNA, 48 nt, Homo sapiens
uggcccaucucuucugugccuuagucacauaugaaagcgccccucccu

SEQ ID NO: 144782 - RNA, 34 nt, Homo sapiens
gaaggagggcugggagccccugagcccugaagca

SEQ ID NO: 144783 - RNA, 45 nt, Homo sapiens
ccuggugucuggcucugauccuugcagcaugccacagaggccugg

SEQ ID NO: 144784 - RNA, 48 nt, Homo sapiens
acuccugcccggggugaggugaaucuagcacuggacaaagguggacag

SEQ ID NO: 144785 - RNA, 49 nt, Homo sapiens
uccuccccgcgagacucucaggcugaggucggcaagccguggcuccccc

SEQ ID NO: 144786 - RNA, 43 nt, Homo sapiens
cagcaggggcauaagccuugcucccaguguccucugcccucgc

SEQ ID NO: 144787 - RNA, 38 nt, Homo sapiens
auaaaggcggcgugagcacugugccagcugccuccugg

SEQ ID NO: 144788 - RNA, 63 nt, Homo sapiens
caucuccagcagccucaaggagaccaugaacccgcacgacaucgugcaggacgccauccacaa

SEQ ID NO: 144789 - RNA, 46 nt, Homo sapiens
cugcacgaugucgugcggguucauggucuccuugaggcugcuggag

SEQ ID NO: 144790 - RNA, 36 nt, Homo sapiens
uguggauguggccccaggcuagccggggaagaagug

SEQ ID NO: 144791 - RNA, 63 nt, Homo sapiens
acacaggcuccguggugggugguguggacuguagaaaugucugccugcagcggggcuccgcgg

SEQ ID NO: 144792 - RNA, 45 nt, Homo sapiens
acuggggcuacuuaccacuguucuagcaaggaggaagauucgcag

SEQ ID NO: 144793 - RNA, 46 nt, Homo sapiens
uggcccugcggcacgccuucaccuacaaggucuaugcugacaagag

SEQ ID NO: 144794 - RNA, 41 nt, Homo sapiens
augaaguccugguagccggcagccacggugcccucgcccac

SEQ ID NO: 144795 - RNA, 46 nt, Homo sapiens
caugcuccuggccauccuggagaaguguggggccauccccaaaauc

SEQ ID NO: 144796 - RNA, 50 nt, Homo sapiens
uucgccacccgggagcugcucagccccuacagccccguccucaaguucuu

SEQ ID NO: 144797 - RNA, 45 nt, Homo sapiens
gacggggcuguaggggcugagcagcucccggguggcgaaguagaa

SEQ ID NO: 144798 - RNA, 52 nt, Homo sapiens
ucauggcggucagcacugugguccuccaggccuucggcaaguaccgggaugg

SEQ ID NO: 144799 - RNA, 42 nt, Homo sapiens
accugcugccucuggggaaagacuuauuccaucggauuucug

SEQ ID NO: 144800 - RNA, 45 nt, Homo sapiens
gugcuaugaguaccuaggaggagaaaguuccaucaugucggagau

SEQ ID NO: 144801 - RNA, 54 nt, Homo sapiens
uccccaggggagccugccaugacaacaggcucaggcagggcaggaggggacacc

SEQ ID NO: 144802 - RNA, 50 nt, Homo sapiens
gauagauccaagugcagaaagacauucagaagaagccaguagaagagagg

SEQ ID NO: 144803 - RNA, 50 nt, Homo sapiens
gacaggcgcauggcagaaggcggggcacacagccaggggagccuccgcuu

SEQ ID NO: 144804 - RNA, 42 nt, Homo sapiens
cagcgcuacaucgugcgcauccucuucaucgugcccaucuac

SEQ ID NO: 144805 - RNA, 41 nt, Homo sapiens
cgauguagcgcugcucguuggggcagcuguagcagcgcagg

SEQ ID NO: 144806 - RNA, 45 nt, Homo sapiens
cuggcuucuucguguggacggcccugcucaucacaugccaccagg

SEQ ID NO: 144807 - RNA, 42 nt, Homo sapiens
uggcaugugaugagcagggccguccacacgaagaagccagag

SEQ ID NO: 144808 - RNA, 42 nt, Homo sapiens
caggcugcuccauggcaguggggcugcccucggggaucacgg

SEQ ID NO: 144809 - RNA, 45 nt, Homo sapiens
cggauccagcgucgcccacgaccgcagcagccucgcccagcgucu

SEQ ID NO: 144810 - RNA, 36 nt, Homo sapiens
gaggaugcggaauggcuagaagucucagaacuggag

SEQ ID NO: 144811 - RNA, 43 nt, Homo sapiens
uauagucugcauacaccugugcauagucaugguuccuauaguu

SEQ ID NO: 144812 - RNA, 50 nt, Homo sapiens
ccaaaacaaucaccagccauacuaaaggaggacauuggagaaaacaggag

SEQ ID NO: 144813 - RNA, 49 nt, Homo sapiens
cucucuggcaauauuuuccaaaauuacagauguuucuauacuuucaccg

SEQ ID NO: 144814 - RNA, 375 nt, Homo sapiens
ccuuucucuaccguuucuucacuuggacaacuuuaaacuauguauuggcuggucgcgguggcucacgccuguaaucccagcacuuugggaggccgaggugggcagguaacuugaggucaggaggucgagaccagccuggccaacauggugaaaccucaucucuacuaaaaauacaaaaauuagcccagcguggugacacgcaccuguaaucccagcuacucgggaggcugaggcagaagaaucgcuugaacuugggaggcaaagauugcagugagcugagauugcaucaccgcacuucagccugggagacagagcgagacugcaucucaaaaaacaaacagaaaccuacauauuuucuauauuucccccaacauu

SEQ ID NO: 144815 - RNA, 25 nt, Homo sapiens
caugaagaugagcaggcaggccagg

SEQ ID NO: 144816 - RNA, 45 nt, Homo sapiens
ggaguggucuugcauggcugugguguccccugcagcuugugcagg

SEQ ID NO: 144817 - RNA, 39 nt, Homo sapiens
cgccuccaucuccucaacucccuggcuugaugcuuaggu

SEQ ID NO: 144818 - RNA, 45 nt, Homo sapiens
aggugaagugcaggaggucuuugcagggagugggaccaccuugag

SEQ ID NO: 144819 - RNA, 52 nt, Homo sapiens
guggaagcacgugugccuguugcuucuuuuccaacuuaaaaugcuuggugau

SEQ ID NO: 144820 - RNA, 53 nt, Homo sapiens
cgccuuuagcucccaagguugugguuuggagauagggcaggucacaugaccau

SEQ ID NO: 144821 - RNA, 30 nt, Homo sapiens
guuccagcucagagaagccaguucccagca

SEQ ID NO: 144822 - RNA, 44 nt, Homo sapiens
gacucccucauaaggagacgguugagcugaagccugaaggauga

SEQ ID NO: 144823 - RNA, 23 nt, Homo sapiens
aggugagcuuguuugccuggcug

SEQ ID NO: 144824 - RNA, 47 nt, Homo sapiens
cagagccagaugccuucuggaagcagucuccauggauucugcccuaa

SEQ ID NO: 144825 - RNA, 28 nt, Homo sapiens
cccacuccauggagaggcagaggaggag

SEQ ID NO: 144826 - RNA, 66 nt, Homo sapiens
cgggcaggcccuggcgucuggcuccuguagccugguguugucaggggagcaucuggcagccugaag

SEQ ID NO: 144827 - RNA, 41 nt, Homo sapiens
gucgacccgcgagaucgcucugggagaaguauugccuggag

SEQ ID NO: 144828 - RNA, 41 nt, Homo sapiens
uacgugggcccagcacagggacaggggcggggacagaaagg

SEQ ID NO: 144829 - RNA, 38 nt, Homo sapiens
aaagacguagucauaggagaagcccugccgguggaaga

SEQ ID NO: 144830 - RNA, 44 nt, Homo sapiens
agucgaugauguagaccagguugcccuucuuccccagccccaug

SEQ ID NO: 144831 - RNA, 16 nt, Homo sapiens
caagcccaaaguguac

SEQ ID NO: 144832 - RNA, 40 nt, Homo sapiens
gacagggacccaagcugcuaggcaaagccucugacccccg

SEQ ID NO: 144833 - RNA, 70 nt, Homo sapiens
uucuucagcacuuucaaggcaaccagcccugggagaggagguuauuuguuaucucauuuaauccucucaa

SEQ ID NO: 144834 - RNA, 77 nt, Homo sapiens
gcauguguggcaccgguggcugugauguggcaggagggcaccagccgggcucaggcggguauggagcugccucuaaa

SEQ ID NO: 144835 - RNA, 50 nt, Homo sapiens
agaagcuuggaggcuggacucgcggucgccaacagauccagagccacgaa

SEQ ID NO: 144836 - RNA, 82 nt, Homo sapiens
agcagcuccgugcuggucccggaggacgagcaggugucaauccaggaagugugugcuguggagggcuccggggaugaagagg

SEQ ID NO: 144837 - RNA, 86 nt, Homo sapiens
cauggaggucaccaagcaccgggcaucccccgggaagggugggcagccagauuugggguggucuggagggagaugaguccaggagg

SEQ ID NO: 144838 - RNA, 46 nt, Homo sapiens
ggcuaacuggaucaggcgguaccagacugagaauuucuaugaccaa

SEQ ID NO: 144839 - RNA, 68 nt, Homo sapiens
aaaaccucggccaccugcacaaagauggugccucacugcaacaagaaaccuuaaggugucuuaccgac

SEQ ID NO: 144840 - RNA, 46 nt, Homo sapiens
ccaugguaucuucagagcuaggauaaugcuccuuaugcaaucccac

SEQ ID NO: 144841 - RNA, 45 nt, Homo sapiens
gaugggggcacacaggagcaagcgcagaauuugguuuucuccagu

SEQ ID NO: 144842 - RNA, 57 nt, Homo sapiens
uaugacauggccugaaucgccaaucacuaauaaggagggacuaagucuagccaagag

SEQ ID NO: 144843 - RNA, 43 nt, Homo sapiens
uuugaagacaauggcauaaggucagugauccagcugcuuguac

SEQ ID NO: 144844 - RNA, 33 nt, Homo sapiens
aaugauaacuugggggacuauuacauuuaaaaa

SEQ ID NO: 144845 - RNA, 45 nt, Homo sapiens
cuaugaaccuggcagggcaaagccugaaguuugaaaauggccagu

SEQ ID NO: 144846 - RNA, 46 nt, Homo sapiens
cgguguggaccggagggagguucagcgccuucgcaggcggaaccag

SEQ ID NO: 144847 - RNA, 58 nt, Homo sapiens
gaguaucauauaaugagacccacaggcacuggcacccuuggguuggcaauagaaggug

SEQ ID NO: 144848 - RNA, 62 nt, Homo sapiens
gagucgggugaccagagcuggaauaaccaucugcauggcugcacucugguaucagaguggag

SEQ ID NO: 144849 - RNA, 41 nt, Homo sapiens
gguuacgaucucggcgggagacgggagggcgggaggcuggg

SEQ ID NO: 144850 - RNA, 44 nt, Homo sapiens
gauccuaauuuaugccuaugcaaaaaauaaaugacgcccaagag

SEQ ID NO: 144851 - RNA, 56 nt, Homo sapiens
ucuuguggggacguucaggguaucggggugcgaggucugucugcaccggcccccac

SEQ ID NO: 144852 - RNA, 93 nt, Homo sapiens
ccccucugcuggggacgguaguugcuuuucucucuccugaugcuagguuggggcccacccugcucccuguuccugcuagggccugccagugcc

SEQ ID NO: 144853 - RNA, 42 nt, Homo sapiens
caggaugggacuuccccaggcaggaagcacuugauggagagc

SEQ ID NO: 144854 - RNA, 46 nt, Homo sapiens
gcuacagugaggaccgcaucgggcuggcagacuacgcccuggaguc

SEQ ID NO: 144855 - RNA, 46 nt, Homo sapiens
cccgagguggagggggccgcguggggcuccuucagagagaggagau

SEQ ID NO: 144856 - RNA, 48 nt, Homo sapiens
acaaacuuguuacacaacaaauauuuguuagcaaacuaacaaaauagg

SEQ ID NO: 144857 - RNA, 44 nt, Homo sapiens
ggccagcaggcaucaacgcaggaaggccauucaucaaucuggug

SEQ ID NO: 144858 - RNA, 49 nt, Homo sapiens
gggcccuccaggagcugggaggaggaaggaaauccagcagaucgaugga

SEQ ID NO: 144859 - RNA, 44 nt, Homo sapiens
agaauaaaaaggaaucguuauagaugauguguuuccaaauacag

SEQ ID NO: 144860 - RNA, 49 nt, Homo sapiens
gcuguacuauaaugauacagcgucauaaaaaauucuccugccuuucugu

SEQ ID NO: 144861 - RNA, 50 nt, Homo sapiens
uagaauuuggcaaagaagggagaaauaaaucuggggaaaaagacuggggu

SEQ ID NO: 144862 - RNA, 26 nt, Homo sapiens
uggugaagagacaaaggaaagaaacu

SEQ ID NO: 144863 - RNA, 26 nt, Homo sapiens
ggccccggcuccggcccccgcaggag

SEQ ID NO: 144864 - RNA, 46 nt, Homo sapiens
auuacaguacuuuuaggugauaauauucgucaucccaucugaacua

SEQ ID NO: 144865 - RNA, 43 nt, Homo sapiens
ugaucccauggaaggcacaguccagugaacagacagccaugug

SEQ ID NO: 144866 - RNA, 54 nt, Homo sapiens
uggagggcgaauguagguguaggugggaggugauaggggugaagaugcuaaggg

SEQ ID NO: 144867 - RNA, 61 nt, Homo sapiens
gaaugccaaguucagggacuugagugcucccugggaugagguaagaauaggcacgguagcu

SEQ ID NO: 144868 - RNA, 77 nt, Homo sapiens
uaaaugccaggacagggcaggugaaugucacccuuaggcaaugggaagccauggaaggagagaagaaguuaucggac

SEQ ID NO: 144869 - RNA, 86 nt, Homo sapiens
ccguccgauaacuucuucucuccuuccauggcuucccauugccuaagggugacauucaccugcccuguccuggcauuuaagccucc

SEQ ID NO: 144870 - RNA, 50 nt, Homo sapiens
uaugaaaguaggggcuuuguguuguucaccaccucacccccaucuccuag

SEQ ID NO: 144871 - RNA, 31 nt, Homo sapiens
gccccauguuuccugugugaaucaaccacug

SEQ ID NO: 144872 - RNA, 42 nt, Homo sapiens
gcagggggugaggacagagugggcacggcccagaggaagcag

SEQ ID NO: 144873 - RNA, 97 nt, Homo sapiens
aagaagaggaacucugagcuguccuaccgcgagauugugaagaacagcuccaacgaugagaccaucgcugccaagcaggugaggccgguggcacugu

SEQ ID NO: 144874 - RNA, 58 nt, Homo sapiens
caaaaggccaucagugcuguggaagggcuuggagaugggguucccaagcccgggucca

SEQ ID NO: 144875 - RNA, 45 nt, Homo sapiens
ggcaggggagcaagagaccucccugggccaggcaagaccagcccc

SEQ ID NO: 144876 - RNA, 62 nt, Homo sapiens
agcucagugccacgucccugcaaugacaaccuucuucccccauccugcccuggcauggccca

SEQ ID NO: 144877 - RNA, 57 nt, Homo sapiens
cuccucgggggccuggagugggcuguggucaccaugguucucugggccuccuagggg

SEQ ID NO: 144878 - RNA, 41 nt, Homo sapiens
auccugcgcguggcacgccacuuccagugcacagaccccaa

SEQ ID NO: 144879 - RNA, 44 nt, Homo sapiens
agccaccggcgccgagccaaggcccugcuggacuuugagcggca

SEQ ID NO: 144880 - RNA, 46 nt, Homo sapiens
gggaugcucuaggccaaaccacaguuuguaccaaaaaccuugugag

SEQ ID NO: 144881 - RNA, 41 nt, Homo sapiens
caccgccucgcgcggcucccggccggguuccgcggcucgcc

SEQ ID NO: 144882 - RNA, 26 nt, Homo sapiens
gaaggcuuccgggauggggucaccag

SEQ ID NO: 144883 - RNA, 45 nt, Homo sapiens
ccuccgaauguuaaugugucuaggugaugucagugggagccauga

SEQ ID NO: 144884 - RNA, 75 nt, Homo sapiens
cugagccaaacugcuugggaaacuuuaucacaguucuuggggacaagaucuguggucugcuuugcucugaggggc

SEQ ID NO: 144885 - RNA, 23 nt, Homo sapiens
gccagcaggaugucaguucucag

SEQ ID NO: 144886 - RNA, 45 nt, Homo sapiens
ccaagauauaccucccucaucauuguccacgaaaguauauugaga

SEQ ID NO: 144887 - RNA, 44 nt, Homo sapiens
ggccuucaugccccaaugaacccugugauguauauccuguauca

SEQ ID NO: 144888 - RNA, 43 nt, Homo sapiens
cuugugcacaacagacucucccuccccgucccaggccccggag

SEQ ID NO: 144889 - RNA, 56 nt, Homo sapiens
uccaggcggcauggaggggugagucuuugggcccgauggugcaaggggggauucag

SEQ ID NO: 144890 - RNA, 46 nt, Homo sapiens; identical to SEQ ID NO: 52837

SEQ ID NO: 144891 - RNA, 43 nt, Homo sapiens
cguggggccucucucuucggcguccggagcuucuggggugucc

SEQ ID NO: 144892 - RNA, 44 nt, Homo sapiens
cuggcagggccccccuuccuuuuguguuguccuuggccccgcag

SEQ ID NO: 144893 - RNA, 105 nt, Homo sapiens
aaugagaacacaagaauucuggggucagugcagugggaguggagagaagacagcucaaggcuaccuggaaaaguuagagaaggcuucuucuaggaaguagaauuu

SEQ ID NO: 144894 - RNA, 49 nt, Homo sapiens
uuauucaauuagaaguuggaaaaauuaacugguacagaaaaaaagugua

SEQ ID NO: 144895 - RNA, 41 nt, Homo sapiens
ccccagagacugauggagaggcagaaacggaaggcggacau

SEQ ID NO: 144896 - RNA, 42 nt, Homo sapiens
gcuccccagcccuucuccccuccacgcccacgaugccccugu

SEQ ID NO: 144897 - RNA, 47 nt, Homo sapiens
ccaucauccagugcccacaauggccuccuuccuccugucacagccag

SEQ ID NO: 144898 - RNA, 54 nt, Homo sapiens
guacggggauaacugcaccuucgccuaccaucaggaggagaucgacguguggac

SEQ ID NO: 144899 - RNA, 45 nt, Homo sapiens
gucccaagcgccguguccacggccccacgucucaggccuccucca

SEQ ID NO: 144900 - RNA, 45 nt, Homo sapiens
gaucugcuuugacaguaaaccccggaucaucagcaaaggcaccaa

SEQ ID NO: 144901 - RNA, 45 nt, Homo sapiens
ugccuggugcacaucguccgcuccaccucccucaaguacuccaag

SEQ ID NO: 144902 - RNA, 40 nt, Homo sapiens
ugagcugccugguggacuucacauggagauguuggaagca

SEQ ID NO: 144903 - RNA, 45 nt, Homo sapiens
aucguucaggagucuaagaaguacuggcagcagauggaggcgcau

SEQ ID NO: 144904 - RNA, 42 nt, Homo sapiens
cagaugaaguuuguauguggccagugcuggagaaacgggcag

SEQ ID NO: 144905 - RNA, 23 nt, Homo sapiens
acugcuggcucugcggcaagaac

SEQ ID NO: 144906 - RNA, 82 nt, Homo sapiens
ucagggggugggguggggccagaaggccugauagaagggucagggcaggccagggggguggggggccgcccucaucaggcag

SEQ ID NO: 144907 - RNA, 40 nt, Homo sapiens
gugguccacccacggucccagcacaaggcagagcugggau

SEQ ID NO: 144908 - RNA, 60 nt, Homo sapiens
augagcucaggaucugugugaggugugggaggugggaagggugagggucugggggaaugc

SEQ ID NO: 144909 - RNA, 46 nt, Homo sapiens
ccccucuuucuuggggacccaguauguccucuccucuagacccaga

SEQ ID NO: 144910 - RNA, 88 nt, Homo sapiens
caugucugugugcaccccccuccucuccacccuaccuuccaucaaccagggcagauccaccgugcccugguuccccagacauuccaga

SEQ ID NO: 144911 - RNA, 42 nt, Homo sapiens
gcuuccuggccuggccagagcuggagcccccacaggguaagg

SEQ ID NO: 144912 - RNA, 46 nt, Homo sapiens
agauguuuuaauaacaauuuuuguccuucuuaaaauaaaaugaaag

SEQ ID NO: 144913 - RNA, 26 nt, Homo sapiens
ucaaggccugaggagcgcauugucca

SEQ ID NO: 144914 - RNA, 47 nt, Homo sapiens
ccggcucaacaagcaugaggagaacccgaagaccaagaagcagcagc

SEQ ID NO: 144915 - RNA, 44 nt, Homo sapiens
gccugucacuuuggcgacgcgcagcugggacagcuccaccuuca

SEQ ID NO: 144916 - RNA, 44 nt, Homo sapiens
gaucuucgcgggaagaaggaggagcugcugaaacagcuggacga

SEQ ID NO: 144917 - RNA, 55 nt, Homo sapiens
cauugcugcacaggccgccgacgccgccgcgccgcccgcuccgagggaaagagcg

SEQ ID NO: 144918 - RNA, 56 nt, Homo sapiens
cucccuuccuccuucacacuccuaguuuaggauugauguguccaagcucauaggga

SEQ ID NO: 144919 - RNA, 47 nt, Homo sapiens
ucuucucacucuuacuucuagaaaaaagauccagcccaggcacggaa

SEQ ID NO: 144920 - RNA, 41 nt, Homo sapiens
agcggaguggccuggcgguggaagaugugcgggccaaugug

SEQ ID NO: 144921 - RNA, 45 nt, Homo sapiens
aggaccucacagaucaucuuccugagacaugaggcuggcccaggc

SEQ ID NO: 144922 - RNA, 47 nt, Homo sapiens
gccacuuaagcgaaucccuuuacuuguucccuuuauugacagguagu

SEQ ID NO: 144923 - RNA, 92 nt, Homo sapiens
ccccaggagcacagauggcgugagaagaggagcuggggaaaguggggucuggagggaagcuggauggggaaagaaaaugcuggccaggcggg

SEQ ID NO: 144924 - RNA, 27 nt, Homo sapiens
gcucggagcuggagggaaggccccggg

SEQ ID NO: 144925 - RNA, 39 nt, Homo sapiens
gguggggaaggugccuauuuuagagaacuuugucacagu

SEQ ID NO: 144926 - RNA, 42 nt, Homo sapiens
agggugggaacgacuuugagaucuuugccgacccccggacug

SEQ ID NO: 144927 - RNA, 45 nt, Homo sapiens
ggaccaggacagcuucgacaccauccacuucuuugggaacgagac

SEQ ID NO: 144928 - RNA, 45 nt, Homo sapiens
ggacugugugcccagccagggccuggcacacagcagguccucuga

SEQ ID NO: 144929 - RNA, 49 nt, Homo sapiens
caggccaacaccugggaacaucauuuccaccuucccacccacaucgggu

SEQ ID NO: 144930 - RNA, 73 nt, Homo sapiens
guucuccgaacuggacaagguaccacuagcuaugcaaucuuaggccuguagggccucagucacucaauuuauc

SEQ ID NO: 144931 - RNA, 70 nt, Homo sapiens
ucgaguuccggaauggcaugcugaacaucucgcccaucggccggagcugcacccuggaggagaggaucga

SEQ ID NO: 144932 - RNA, 39 nt, Homo sapiens
ucugccucagcuacauggcccugcucaggcugcccaaga

SEQ ID NO: 144933 - RNA, 42 nt, Homo sapiens
ucauugagaaguuugauuauguguuugccgagaacgggacgg

SEQ ID NO: 144934 - RNA, 36 nt, Homo sapiens
ccuacgacacaccaguggucggagcuggcuucugaa

SEQ ID NO: 144935 - RNA, 46 nt, Homo sapiens
agcucugcagugggcccacucucgcauccuguaaucaggcagauag

SEQ ID NO: 144936 - RNA, 45 nt, Homo sapiens
aaagaccuucccaucauggaauccaacugcuucaaccccagcacg

SEQ ID NO: 144937 - RNA, 67 nt, Homo sapiens
ccuccuuccaccuagauggauugccaaucuucugccaucaauuuugggaaaccugccuuugugcccc

SEQ ID NO: 144938 - RNA, 35 nt, Homo sapiens
ucccuuaccccaagcaaggccagugcuggagcagc

SEQ ID NO: 144939 - RNA, 48 nt, Homo sapiens
ccugccucaccagggcuuuuccuuuuuaaacaaaacaaacccuaccag

SEQ ID NO: 144940 - RNA, 47 nt, Homo sapiens
uggaauaaaagccagaaaacucagcauggccucccaggaccuaccug

SEQ ID NO: 144941 - RNA, 46 nt, Homo sapiens
acauccauaguugugcacaaggaugaguucuucuucggcaguggug

SEQ ID NO: 144942 - RNA, 50 nt, Homo sapiens
uagcauuugcaaaguuuuauccuaucaguuucugaaggauuucaccucaa

SEQ ID NO: 144943 - RNA, 32 nt, Homo sapiens
cugcucuuuaaguuucuugaccucuuuuugug

SEQ ID NO: 144944 - RNA, 56 nt, Homo sapiens
uuaguuacaaauugcauaagugccuucugcacaggaagcacacugggugcugugau

SEQ ID NO: 144945 - RNA, 49 nt, Homo sapiens
uaagguaaaugagguugauauaaugaacaaagauguucuuugccaucau

SEQ ID NO: 144946 - RNA, 45 nt, Homo sapiens
ggcgaaugauuuaguucaucucugugagacgagggggcagagauc

SEQ ID NO: 144947 - RNA, 61 nt, Homo sapiens
uaaggauuaguaaagaaaguauuucgguugugcuccauuaaacuacuuaacuggcaggaga

SEQ ID NO: 144948 - RNA, 60 nt, Homo sapiens
gcaggcgggccucaaacgcgaggugccgccuccuucccgaggaaggagcguggucucgag

SEQ ID NO: 144949 - RNA, 42 nt, Homo sapiens
uuuugucuuucucgguaccauagaacaccacagccaagagau

SEQ ID NO: 144950 - RNA, 29 nt, Homo sapiens
uuguugagcuucagcuuuaaccugaggga

SEQ ID NO: 144951 - RNA, 42 nt, Homo sapiens
cucuucuuccuguggcaccaaagccacaaaauaaggagggau

SEQ ID NO: 144952 - RNA, 41 nt, Homo sapiens
guagaauuguugagaccuccuccuuccucugcaacaaggau

SEQ ID NO: 144953 - RNA, 42 nt, Homo sapiens
ggcugggugacccuuaugagccucauuuucugcucagacaac

SEQ ID NO: 144954 - RNA, 46 nt, Homo sapiens
cagacguaagagauacguaugagguaaaauggacaggacuggauga

SEQ ID NO: 144955 - RNA, 32 nt, Homo sapiens
auggcauguggacgagcacugccucuucugag

SEQ ID NO: 144956 - RNA, 55 nt, Homo sapiens
caucccccuaugucacuucuggucugggucaggcaagguuggggggaguacagaa

SEQ ID NO: 144957 - RNA, 20 nt, Homo sapiens
cuggggauagaaggcuuucu

SEQ ID NO: 144958 - RNA, 28 nt, Homo sapiens
ucugucagagagaccuggagaugcagga

SEQ ID NO: 144959 - RNA, 43 nt, Homo sapiens
ggacacagggugagaagaagagggcugcaauuaggggcaggaa

SEQ ID NO: 144960 - RNA, 45 nt, Homo sapiens
cuucucauggccuuccuuuucccaggaagccccagccuuaccccc

SEQ ID NO: 144961 - RNA, 37 nt, Homo sapiens
uacccagagacaucccugguuuggcucugccgggaaa

SEQ ID NO: 144962 - RNA, 42 nt, Homo sapiens
gaguguccuccuggagacggggcgaaggggcugaggccaauc

SEQ ID NO: 144963 - RNA, 58 nt, Homo sapiens
aaggcccucagccucccagucuggugaagcuuccuguaugguccaugaccguauucca

SEQ ID NO: 144964 - RNA, 43 nt, Homo sapiens
acuaagcacugcacaaacaagcaaucaaauuaugaauaaacau

SEQ ID NO: 144965 - RNA, 46 nt, Homo sapiens
uauagugaguuuauuugugcucuaaaauaguaucaacgugcaucuu

SEQ ID NO: 144966 - RNA, 44 nt, Homo sapiens
cacgggcagccggucucuguaguaccgcgugguacucacugcgg

SEQ ID NO: 144967 - RNA, 44 nt, Homo sapiens
uuguugaaauggaaacguauaaaaagcuugagcuugcugaaggg

SEQ ID NO: 144968 - RNA, 26 nt, Homo sapiens
ggaacuucuucuggcauuugcuguuc

SEQ ID NO: 144969 - RNA, 45 nt, Homo sapiens
ccugacauaaacaaacacuuccaaaaaugguuuccagguccaggg

SEQ ID NO: 144970 - RNA, 45 nt, Homo sapiens
guacuagaauacguccuccuucacgaaauucuuuacuggagagau

SEQ ID NO: 144971 - RNA, 46 nt, Homo sapiens
guaaugaacuuugucuugggcccgaggaaacugagcacuucuugca

SEQ ID NO: 144972 - RNA, 46 nt, Homo sapiens
gagguucuacuuguugacaacugcauuaaaacugcagcauuuaagc

SEQ ID NO: 144973 - RNA, 51 nt, Homo sapiens
agcucaggaaacccugaguuuacccuuaguuaccacuaaaaacuaacaaau

SEQ ID NO: 144974 - RNA, 47 nt, Homo sapiens
cugucauguacaggauauaucaacauuuacuacucaucugucauguu

SEQ ID NO: 144975 - RNA, 40 nt, Homo sapiens
gauucuccauucugggccacagcuucggugaguacagugg

SEQ ID NO: 144976 - RNA, 110 nt, Homo sapiens
agucagagguugaccacuguacccucugaccucaggcaacugccgcaagggacacagggaugagggaaauguggucuuuugaguggucaggucugaugaaggggacauca

SEQ ID NO: 144977 - RNA, 45 nt, Homo sapiens
gaggagugcggggagcuucuccugcaaagaggaaccacgaaggug

SEQ ID NO: 144978 - RNA, 28 nt, Homo sapiens
uaguucccugggcagcacuguucccagc

SEQ ID NO: 144979 - RNA, 45 nt, Homo sapiens
ucaccacccugcccccugaggccuucuaccccauccccuggcagg

SEQ ID NO: 144980 - RNA, 45 nt, Homo sapiens
aaccccaacuuccuguucaugugcucgguggagucggccgccaga

SEQ ID NO: 144981 - RNA, 46 nt, Homo sapiens
cgucuccaucaugaucuacuggcacguugugggagagcccaaggag

SEQ ID NO: 144982 - RNA, 32 nt, Homo sapiens
accacugucuccuccaucugaccugcucaucc

SEQ ID NO: 144983 - RNA, 31 nt, Homo sapiens
ggaauuucagggggcccagggaggaccuggu

SEQ ID NO: 144984 - RNA, 46 nt, Homo sapiens
ucaaggccauuucaucagauauguauuuuggaagacaaucccaggc

SEQ ID NO: 144985 - RNA, 47 nt, Homo sapiens
cugggaugacaguucagauuccuauuggaaaaaagagaccagcaaag

SEQ ID NO: 144986 - RNA, 49 nt, Homo sapiens
caguccuccuacugaguugcuccugcuuagcaugagcacagagagccuc

SEQ ID NO: 144987 - RNA, 49 nt, Homo sapiens
auuuuaaggaauguuuucaagauuggguaaagacagagugggaggggaa

SEQ ID NO: 144988 - RNA, 46 nt, Homo sapiens
gaugaagagcucuuauugcuuucaaauuauucauuagcccauuaga

SEQ ID NO: 144989 - RNA, 55 nt, Homo sapiens
cuucucuaguccuccuuggcauggugaccaccacuaguagaaugaggauacuauu

SEQ ID NO: 144990 - RNA, 35 nt, Homo sapiens
gguugguaagaaagcucuaagugagguugccuaau

SEQ ID NO: 144991 - RNA, 76 nt, Homo sapiens
cucaagguacuguauuacaaaucaucguugaagugucauuuugaaaagcagugacuaguauggauuuauuaguuua

SEQ ID NO: 144992 - RNA, 27 nt, Homo sapiens
cugguguggaagcugucugguguggga

SEQ ID NO: 144993 - RNA, 39 nt, Homo sapiens
cgaugggggcagcaacacucugcugaggcuguaagggca

SEQ ID NO: 144994 - RNA, 44 nt, Homo sapiens
aaguuugggagcucagaaacuggcaaacacaugcuuuaaugaaa

SEQ ID NO: 144995 - RNA, 46 nt, Homo sapiens
caccugugccccuccacaccugugcccccucuacaccugugccccc

SEQ ID NO: 144996 - RNA, 46 nt, Homo sapiens
cugugaaauuucauuuauauuuuucuauuuuuaguacuguauggau

SEQ ID NO: 144997 - RNA, 62 nt, Homo sapiens
ucagaauggacguccuucugccagagacuuccagcgggcggcuccaaaggcccaaugcagag

SEQ ID NO: 144998 - RNA, 54 nt, Homo sapiens
uuguaguuuuauuaucuaaggcacagccauucuguucucacuugguucugagau

SEQ ID NO: 144999 - RNA, 49 nt, Homo sapiens
cauuugaaucuuguccuaaugaaauauuuguccauguggguaccugugu

SEQ ID NO: 145000 - RNA, 46 nt, Homo sapiens
acaugaucauuugcacacccugggguuuagcaacaauaaaagucag

SEQ ID NO: 145001 - RNA, 31 nt, Homo sapiens
ccugugcaucccaagauuuauggcuggccag

SEQ ID NO: 145002 - RNA, 45 nt, Homo sapiens
uuccucccuuuccuucaacacuuggcucaugaccguccaguccaa

SEQ ID NO: 145003 - RNA, 36 nt, Homo sapiens
auggggaaacagaauuuuggaaaggagagccaagca

SEQ ID NO: 145004 - RNA, 48 nt, Homo sapiens
gcaccccagcggggccgguagaucuggaagauggugauccaggaggug

SEQ ID NO: 145005 - RNA, 45 nt, Homo sapiens
ucaauuucuccucauuggacacucgcuccagguucauagcugcgc

SEQ ID NO: 145006 - RNA, 56 nt, Homo sapiens
gauucguugguggacaacaccugugauguccagugggagguguccagguagcuggg

SEQ ID NO: 145007 - RNA, 52 nt, Homo sapiens
cucugucccgcccgggcagcucugcgaggcagcggcuggagagggaaccaug

SEQ ID NO: 145008 - RNA, 49 nt, Homo sapiens
guuuggagccucuuccaucaaguggaccugauuuuggaggauuaggaga

SEQ ID NO: 145009 - RNA, 46 nt, Homo sapiens
uuuugauggacuuggaaggacuaaagaugauaucaucauuugugaa

SEQ ID NO: 145010 - RNA, 46 nt, Homo sapiens
uuccaaauggguuagacguuaccuuugaaguaacugaauugaggag

SEQ ID NO: 145011 - RNA, 71 nt, Homo sapiens
uuucaguuuuccuauggaacaaaagaaacuucguauggccuguccuucuucaaaccacggcccggaaacuu

SEQ ID NO: 145012 - RNA, 45 nt, Homo sapiens
auauaaaguuacuggacaguucccuuggagcucacugcgggagac

SEQ ID NO: 145013 - RNA, 43 nt, Homo sapiens
gugggaaggcguauggcgagaacugggcugccucucaaggacg

SEQ ID NO: 145014 - RNA, 47 nt, Homo sapiens
agcacgccauggucaucgauucucggaauucuuccaucuuaccaagg

SEQ ID NO: 145015 - RNA, 45 nt, Homo sapiens
agagcauaguauuucaaauauuccuuuaguauuuauguuuaagcu

SEQ ID NO: 145016 - RNA, 45 nt, Homo sapiens
gcaccucuacaccccauuaccuuuccggccaggccaggguggcuu

SEQ ID NO: 145017 - RNA, 131 nt, Homo sapiens
ggagggacuuuugggagggaugguugggaugagugacguggccuguuccagaggagagggguuaggaaauguggggcccugggguuuggaggaagcagugcaggaagugucugagaaugagcuucacggug

SEQ ID NO: 145018 - RNA, 45 nt, Homo sapiens
ccugggucagaaaagggaacugugaccaacugugggcauucagaa

SEQ ID NO: 145019 - RNA, 39 nt, Homo sapiens
gcuucuguagaaaagguaaaggcacugcuuggccacaag

SEQ ID NO: 145020 - RNA, 23 nt, Homo sapiens
auuuaagcugcacccagccccag

SEQ ID NO: 145021 - RNA, 41 nt, Homo sapiens
ggggcuccugaaagggauguuggugcugcaugagaaggugg

SEQ ID NO: 145022 - RNA, 45 nt, Homo sapiens
cucugagcauugauuauacucauguauuauacuguuaagggguga

SEQ ID NO: 145023 - RNA, 79 nt, Homo sapiens
cgggccgugucuccuccugccuguugcaaucagcccucguccgacucuuuuuggaagugauuaaaacauaacugucaua

SEQ ID NO: 145024 - RNA, 109 nt, Homo sapiens
gcucugggggagacaggcugcagauccugauuauaauucagaaggaucuaaagaaaaaguaauuuuuuaaaaaaauucugguuaaagccaaagcucauaagacgugugu

SEQ ID NO: 145025 - RNA, 48 nt, Homo sapiens
caagggagggggagccagaggaguguugcauucaggaaggguaaagga

SEQ ID NO: 145026 - RNA, 54 nt, Homo sapiens
gaacaauggcauugauuugaugagaggcagaagcagaggcaugaggguguugag

SEQ ID NO: 145027 - RNA, 66 nt, Homo sapiens
cuuaucuaaccccagauggaaugguugguguaagggauguggcauuuccaggguggaaggaaggaa

SEQ ID NO: 145028 - RNA, 44 nt, Homo sapiens
caccauaauccaugaugaccucaucugagcuaguaucugcaaag

SEQ ID NO: 145029 - RNA, 23 nt, Homo sapiens
ccuuuggggaauccugaccuggg

SEQ ID NO: 145030 - RNA, 46 nt, Homo sapiens
ucucaucacuuuugugaacaagcaccugaacaagcugaauuuggag

SEQ ID NO: 145031 - RNA, 39 nt, Homo sapiens
cuccagccccugccuuuuuucccuuucuccucauggcag

SEQ ID NO: 145032 - RNA, 41 nt, Homo sapiens
cagugacauucaaaagccacacugacaaaaagccuggggcu

SEQ ID NO: 145033 - RNA, 50 nt, Homo sapiens
ccaucaguuugagucugaauucauagcauggccuggacagaugcagcaag

SEQ ID NO: 145034 - RNA, 43 nt, Homo sapiens
aaaagugguuguugagggcaaugacagccccagcauugaaggu

SEQ ID NO: 145035 - RNA, 37 nt, Homo sapiens
uuuuucaagcucauuuccugguaugacaaugaauuug

SEQ ID NO: 145036 - RNA, 37 nt, Homo sapiens
cgccaugcuauuagggaagucccagaaccagaccaca

SEQ ID NO: 145037 - RNA, 48 nt, Homo sapiens
uguguucaaucgcuucuugcuguucuuuuucucccuucuucagcaagc

SEQ ID NO: 145038 - RNA, 63 nt, Homo sapiens
ggagcagagaaaagagaccucaagaacagggugacagagcacaagagggaaaaaaaaaaaaaa

SEQ ID NO: 145039 - RNA, 30 nt, Homo sapiens
uggccuugggcugcucuucgugagcagcgg

SEQ ID NO: 145040 - RNA, 51 nt, Homo sapiens
cccaaccaugaacaugagaaggggguuccauacaagcagauaagaaaacag

SEQ ID NO: 145041 - RNA, 45 nt, Homo sapiens
ccugggcaccagagcugggcagggccggggaggaggccaagagcc

SEQ ID NO: 145042 - RNA, 35 nt, Homo sapiens
cacagggagucauguggcucaggagaugggcuugg

SEQ ID NO: 145043 - RNA, 78 nt, Homo sapiens
uuaacaauguacagagauacucaggcuuccauucagagcgagccuaggccccaucuuccccagugcuacacaugcccc

SEQ ID NO: 145044 - RNA, 40 nt, Homo sapiens
cccggggcagguuugucagggagaacaucccggugggauu

SEQ ID NO: 145045 - RNA, 45 nt, Homo sapiens
acugcuggggaugugcacgcacuggaugccccgcuccaaacaggc

SEQ ID NO: 145046 - RNA, 46 nt, Homo sapiens
aauugauuuguaggaguaggcauaaccuuugucuuggaauuuagac

SEQ ID NO: 145047 - RNA, 44 nt, Homo sapiens
gccccagaugcccccuccccugcugcccagugcccugaucaggg

SEQ ID NO: 145048 - RNA, 38 nt, Homo sapiens
cucuccucucuucuccggcgggugccgggugcugaauc

SEQ ID NO: 145049 - RNA, 46 nt, Homo sapiens
uggcguccugucggccugggagggggccugcagcugggccccgaca

SEQ ID NO: 145050 - RNA, 65 nt, Homo sapiens
ccaggccuggggaauuaauucuuguccucggugcucaaaccauucuucccuucaagccuggccua

SEQ ID NO: 145051 - RNA, 34 nt, Homo sapiens
ugucgcuccuggcucucccgacacaacagcggcg

SEQ ID NO: 145052 - RNA, 42 nt, Homo sapiens
ugaaacaggaaagaggacaccauugacaacggcugggcacau

SEQ ID NO: 145053 - RNA, 89 nt, Homo sapiens
ccaagcugagccgucagaagcuucuguugguguucucguguuggucgaaagggaaguuauuuauuuugaaguuaacucugaucagauua

SEQ ID NO: 145054 - RNA, 62 nt, Homo sapiens
cuuuuuacacagaaauguuuuuuauuuuuucuguguaugucauucauagugacaaaauugag

SEQ ID NO: 145055 - RNA, 51 nt, Homo sapiens
uuuuucuuugccuggcuuuagcuucuggucucauucucuuugguguggugg

SEQ ID NO: 145056 - RNA, 34 nt, Homo sapiens
ccccgcccuuccugccuugccaccuccacagaca

SEQ ID NO: 145057 - RNA, 68 nt, Homo sapiens
cuccaccuguuugcugcagggagcagggucgggagcaugugcauuucggagagcucugguugcuccgu

SEQ ID NO: 145058 - RNA, 50 nt, Homo sapiens
aagggucacguguaugcucucaagaugaucaggcagauccuguccucagg

SEQ ID NO: 145059 - RNA, 41 nt, Homo sapiens
uguccagaaaguggcgucuaagaucccgucccccgaucgaa

SEQ ID NO: 145060 - RNA, 46 nt, Homo sapiens
ccacuggacaacuccaaagcugucugcauucacugcaugaacgagu

SEQ ID NO: 145061 - RNA, 43 nt, Homo sapiens
gaacgggggcacgggcaucccgccacuguacuccaccccuccc

SEQ ID NO: 145062 - RNA, 42 nt, Homo sapiens
cucuaccggcgccauccagaaguugucgggagccagaagggc

SEQ ID NO: 145063 - RNA, 88 nt, Homo sapiens
cuucugagacauuuacagcgguuccauagcaacgugcugaaaacugaggucucggagacggcucggcccuccucuccggacacccggg

SEQ ID NO: 145064 - RNA, 46 nt, Homo sapiens
caacguuggcuuuaacaggcugcuugaauacuugaaaccucaguac

SEQ ID NO: 145065 - RNA, 45 nt, Homo sapiens
gcuggagugcuggugggaagcgugggugaccuccaccggccuuca

SEQ ID NO: 145066 - RNA, 42 nt, Homo sapiens
gagccagcggauggugcagaaccugcugagccucgcccggaa

SEQ ID NO: 145067 - RNA, 51 nt, Homo sapiens
cugccgcagaggagaaccuguggucacuuguggccaaggugaagaagaaag

SEQ ID NO: 145068 - RNA, 26 nt, Homo sapiens
ccacuaggccagaggcguggcugccc

SEQ ID NO: 145069 - RNA, 46 nt, Homo sapiens
uguaggcuuuuuacucaauuauguacaaaccacaaaucagguacug

SEQ ID NO: 145070 - RNA, 46 nt, Homo sapiens
gaccuuuuagaaaaguuguuuuguugaaauacuguacguacgcuua

SEQ ID NO: 145071 - RNA, 42 nt, Homo sapiens
cagcaggcggaugacgccgcgcgcgccgcccgccgcgcccac

SEQ ID NO: 145072 - RNA, 42 nt, Homo sapiens
gaccucuucgacuuuaucacggagcgcggcgcccuggacgag

SEQ ID NO: 145073 - RNA, 25 nt, Homo sapiens
gggaggagggaggggcgggcgggga

SEQ ID NO: 145074 - RNA, 36 nt, Homo sapiens
uccggaggagggucucuccaggugcgugguggcucg

SEQ ID NO: 145075 - RNA, 43 nt, Homo sapiens
gcacccucgacccugaugacguggccagcaccacguccagcag

SEQ ID NO: 145076 - RNA, 44 nt, Homo sapiens
ccggucgaggucccgccugcccuggguggauacuugaaccccag

SEQ ID NO: 145077 - RNA, 42 nt, Homo sapiens
gaagaugaacauguauaguggcuaacuuaaggggagugggug

SEQ ID NO: 145078 - RNA, 89 nt, Homo sapiens
aucgcagauggggguucuuucaguucaaaagugagaugucuggagaucauauuuuuuuauacagguauuucaauuaaaauguuuuugua

SEQ ID NO: 145079 - RNA, 45 nt, Homo sapiens
agugguauagcagccacuccagccucugcugcagcagccacccug

SEQ ID NO: 145080 - RNA, 42 nt, Homo sapiens
uauagacguaagcaucuuauuuacagaaauggagugauugac

SEQ ID NO: 145081 - RNA, 31 nt, Homo sapiens
aaacacgggcuacacaggugugugccaggcu

SEQ ID NO: 145082 - RNA, 40 nt, Homo sapiens
gggacaggcaguggcaggcaccacuagcgagggcguuugg

SEQ ID NO: 145083 - RNA, 42 nt, Homo sapiens
ggacaaggaaagaggacugacccacagaccagagcaccucag

SEQ ID NO: 145084 - RNA, 36 nt, Homo sapiens
ugaggacuuccugguaagugagcucuaggaggugaa

SEQ ID NO: 145085 - RNA, 41 nt, Homo sapiens
ggucagcuguacauccagggccagauauggagcccagucua

SEQ ID NO: 145086 - RNA, 38 nt, Homo sapiens
uccacaccacccucucccccagagagccugggggcuca

SEQ ID NO: 145087 - RNA, 55 nt, Homo sapiens
cgucuagacuguagcaucuuccucugagcaauaccgccgggcaccgcaccagcac

SEQ ID NO: 145088 - RNA, 51 nt, Homo sapiens
acaaggggauccggcagauggugcaggucagcgaccaggacaugaacacac

SEQ ID NO: 145089 - RNA, 41 nt, Homo sapiens
caagcugcuguacgccaaggagaucuccaccuacaagaaga

SEQ ID NO: 145090 - RNA, 46 nt, Homo sapiens
auguccacgaggugguggacgccucgcugucagucaucgcgcagac

SEQ ID NO: 145091 - RNA, 46 nt, Homo sapiens
caccugcagucaaguacuucuucgacuuccuggacgagcaggcaga

SEQ ID NO: 145092 - RNA, 45 nt, Homo sapiens
gaccgacgagguggacgagggcaaguccaagagaggcagcgugaa

SEQ ID NO: 145093 - RNA, 32 nt, Homo sapiens
gccaaguacacucucaacgacacggggcugcu

SEQ ID NO: 145094 - RNA, 57 nt, Homo sapiens
agcaggcccucuaccaguucuccaaccugcugaacagcaagucuuuccucaucaaug

SEQ ID NO: 145095 - RNA, 96 nt, Homo sapiens
ccgaccgcgucuucuuccugcccuccaaggacggcgacaaggacgugaugaucaccggcaagcuggacaucccugagccgcggcggccgguggugg

SEQ ID NO: 145096 - RNA, 74 nt, Homo sapiens
gaugaucgagauggaggaccagaccaacgacgugcacgaggccggcauccccgugcuggacuacaagaccuaca

SEQ ID NO: 145097 - RNA, 48 nt, Homo sapiens
cgaacgagaguaugagaagaucaagucccagcuggagggccuggagga

SEQ ID NO: 145098 - RNA, 45 nt, Homo sapiens
gcccaugguggucgucaucgcggugucugucuacugcuacuggug

SEQ ID NO: 145099 - RNA, 46 nt, Homo sapiens
ucgcgagugggugcugggccgcguggaguacgacacacgggugagc

SEQ ID NO: 145100 - RNA, 81 nt, Homo sapiens
gcugcaccaugaagacgcugacggagaccgaccuguacugugagcccccggaggugcagcccccgcccaagcggcggcaga

SEQ ID NO: 145101 - RNA, 62 nt, Homo sapiens
gggcaccaaucugaacaaggcgaugacgcugcaggaggccgaggccuucgugggugccgagc

SEQ ID NO: 145102 - RNA, 45 nt, Homo sapiens
guggcgucaagaagcaggucaacaagcucauccacgcccggguga

SEQ ID NO: 145103 - RNA, 29 nt, Homo sapiens
cgucuuccuguccccggcugugccugagg

SEQ ID NO: 145104 - RNA, 85 nt, Homo sapiens
ccgcagcaucaacgucacgggucagggcuucagccugauccagagguuugccaugguggucaucgcggagccccugcaguccugg

SEQ ID NO: 145105 - RNA, 71 nt, Homo sapiens
augcuucuggaggucuccuacggggggucccccgugcccaaccccggcaucuucuucaccuaccgcgaaaa

SEQ ID NO: 145106 - RNA, 57 nt, Homo sapiens
acgaaguuuggggcgcagcuccagugugucacuggcccccaggcgacacggggccag

SEQ ID NO: 145107 - RNA, 47 nt, Homo sapiens
ccacggcacccaccuggacacgggcucccaggaggacgugcggguga

SEQ ID NO: 145108 - RNA, 45 nt, Homo sapiens
cagcccaagccucucaguguggagccgcagcagggaccgcaggcg

SEQ ID NO: 145109 - RNA, 48 nt, Homo sapiens
cgagguggacgucuucgggaaacugggccguucgccucccaaugucca

SEQ ID NO: 145110 - RNA, 64 nt, Homo sapiens
ucucuguggccggccggaacugcuccuuucagccggaacguuacuccguguccacccggugagu

SEQ ID NO: 145111 - RNA, 51 nt, Homo sapiens
ucaccauccugggguccaauuugggcguccaagcaggggacauccagagga

SEQ ID NO: 145112 - RNA, 42 nt, Homo sapiens
uccccgcagugacccucuacaacugcuccuuuggccgcagcg

SEQ ID NO: 145113 - RNA, 44 nt, Homo sapiens
ugaccaugcaggaaucugggaccuucgccuuucggaccccaaag

SEQ ID NO: 145114 - RNA, 45 nt, Homo sapiens
ugaaccacgagacagaugugaacuuccagggcaagaaccuggaca

SEQ ID NO: 145115 - RNA, 47 nt, Homo sapiens
agugccugagcuacccgaccugcacccagugccgcgacucccaggac

SEQ ID NO: 145116 - RNA, 27 nt, Homo sapiens
ucagaguacgacucuauccuuguggag

SEQ ID NO: 145117 - RNA, 42 nt, Homo sapiens
caaccacacuguugcuuuucugggcaccucugauggccggau

SEQ ID NO: 145118 - RNA, 42 nt, Homo sapiens
auggaggccaaccgcaacgccuguuacacaggcacccgggag

SEQ ID NO: 145119 - RNA, 39 nt, Homo sapiens
ggagauggaccugcagugccgggaccccgacauccacgc

SEQ ID NO: 145120 - RNA, 100 nt, Homo sapiens
cgaggacggccccuacgucuucuuugucuucaaccagcaggacaagcacccggcccggaaccgcacgcugcuggcacgcaugugcagagaagaccccaac

SEQ ID NO: 145121 - RNA, 52 nt, Homo sapiens
gaccgcgugcuguuugugggcaaaggcaaugggccacacgacaacggcauca

SEQ ID NO: 145122 - RNA, 46 nt, Homo sapiens
ggacggcagcggggagaagucuuucguggccagcaaugaugagggc

SEQ ID NO: 145123 - RNA, 48 nt, Homo sapiens
cuggagcagcagguggccacgggcccggcccuggacaacaagaagugc

SEQ ID NO: 145124 - RNA, 93 nt, Homo sapiens
gggcgcaggugccagccugaggccccgcaagcuggacuucuuccgcagcgagaaagagcugaaccaccuggcuguggaugaggccucaggcgu

SEQ ID NO: 145125 - RNA, 49 nt, Homo sapiens
agagaaucucgaugcuggccuggagcagaaacugagcuggaccacugga

SEQ ID NO: 145126 - RNA, 64 nt, Homo sapiens
ccaccuucugucugagggcuggggaggaccauccuccagaugcgccagugggccguggccagag

SEQ ID NO: 145127 - RNA, 21 nt, Homo sapiens
ccauauggcacaguccuccuc

SEQ ID NO: 145128 - RNA, 68 nt, Homo sapiens
gagcccuuugcgggugggagagcgaggcugccgggaagugggggcucucagccugccccaugcccaga

SEQ ID NO: 145129 - RNA, 51 nt, Homo sapiens
cgcagcgccgagcgcggcccgggcgccaucgagccuuggcggcggacgugc

SEQ ID NO: 145130 - RNA, 26 nt, Homo sapiens
cgucgggggcggggccggcagcuccc

SEQ ID NO: 145131 - RNA, 45 nt, Homo sapiens
agaccccugggaaagggccaaagcccagcagcccccaccccugaa

SEQ ID NO: 145132 - RNA, 49 nt, Homo sapiens
ucuaccccuggccagagugccagcccccgcaggcaagagggcuugcugg

SEQ ID NO: 145133 - RNA, 24 nt, Homo sapiens
cacaggccucaaggccaucauguu

SEQ ID NO: 145134 - RNA, 51 nt, Homo sapiens
cccccuggugaggcccggggcugggggacaugggacuggggggcacggggc

SEQ ID NO: 145135 - RNA, 47 nt, Homo sapiens
aagggcauggggcugcaggcagaugagacccccacccuggcuccucu

SEQ ID NO: 145136 - RNA, 35 nt, Homo sapiens
gcgccaguguggagggcagaggagccccuggcaug

SEQ ID NO: 145137 - RNA, 42 nt, Homo sapiens
gcugaaaguaggggaagucugagaaguccgagggucacuagg

SEQ ID NO: 145138 - RNA, 51 nt, Homo sapiens
uggaacccagaggagaggccaagccgcagguauacaacugucaucaugggg

SEQ ID NO: 145139 - RNA, 45 nt, Homo sapiens
aguuaauggaugaagaugacaucuugcaggaguguaaggcucaga

SEQ ID NO: 145140 - RNA, 47 nt, Homo sapiens
agugcauggaggagcuggugagccucaucacacaggauccgccccug

SEQ ID NO: 145141 - RNA, 53 nt, Homo sapiens
caaacacagccugugagcuucugacuugugaugugccgcagaucagcgaccgc

SEQ ID NO: 145142 - RNA, 46 nt, Homo sapiens
ggucagugaggugcuagcccugcguccaggccugugccugccagga

SEQ ID NO: 145143 - RNA, 46 nt, Homo sapiens
gcccccgggaagaaggaagcgcccccuguggagggugacucagaag

SEQ ID NO: 145144 - RNA, 42 nt, Homo sapiens
ugguacuggggcuccgggcaucucccccagccaagcugcaag

SEQ ID NO: 145145 - RNA, 46 nt, Homo sapiens
uggcuggguugguguguaaggccugaggcaguguccugcgcguggu

SEQ ID NO: 145146 - RNA, 68 nt, Homo sapiens
cccuccccuuggguagagccaaguggacgggucuagguuugcuugucugacaguguggagcgcuggaa

SEQ ID NO: 145147 - RNA, 83 nt, Homo sapiens
uggaccccaggcaucucccagcccuuugggcugccaguccucccugugccuucaggccacgucgucuggaccguaaaccucag

SEQ ID NO: 145148 - RNA, 22 nt, Homo sapiens
uggcauuugcagguggggccgc

SEQ ID NO: 145149 - RNA, 46 nt, Homo sapiens
uccuuccccacccacuugggauuccccauaacugugguacccugag

SEQ ID NO: 145150 - RNA, 46 nt, Homo sapiens
cuacuucgggagcgugccgggcugggcgaccuggagagcgccagca

SEQ ID NO: 145151 - RNA, 54 nt, Homo sapiens
gcggcgcuuguggccaacucugagucgugagaagcagcaggagcuggugcagaa

SEQ ID NO: 145152 - RNA, 43 nt, Homo sapiens
uggagccaagggugucaggugcuggucuguggugguuaugggg

SEQ ID NO: 145153 - RNA, 41 nt, Homo sapiens
acuauuauguuucgucuguguccuuccccuuaaauugggua

SEQ ID NO: 145154 - RNA, 46 nt, Homo sapiens
ggacccggagcuggaguuggcugaccucgccuucccuccgcccacg

SEQ ID NO: 145155 - RNA, 46 nt, Homo sapiens
gugcacauuccacccuugccagagccacugcagagucagacgcaca

SEQ ID NO: 145156 - RNA, 47 nt, Homo sapiens
auuggggucaacgcggccuuccaggcagagacccaggagcugguaag

SEQ ID NO: 145157 - RNA, 69 nt, Homo sapiens
agcuucaccuaugugcccauccugccggcucagcugcuggagguccucagcacacccacgcccuucauc

SEQ ID NO: 145158 - RNA, 46 nt, Homo sapiens
gcacaagguucucuuccugucccggagcuaccagcggcucgccgau

SEQ ID NO: 145159 - RNA, 26 nt, Homo sapiens
agcugcuugggacaacagaggcaggg

SEQ ID NO: 145160 - RNA, 85 nt, Homo sapiens
aaaccccccacaucccccuggaggccaagauguggccuggccccggacagcacagagcugaggugcaggcugggaccucagaagg

SEQ ID NO: 145161 - RNA, 47 nt, Homo sapiens
cucucugcucaugucuauccaagugugugucuuauggcaccgucagu

SEQ ID NO: 145162 - RNA, 48 nt, Homo sapiens
ccgggguugcccugguguugcccccaucuguagagaaguuaggcgcgg

SEQ ID NO: 145163 - RNA, 44 nt, Homo sapiens
augacaucagcaacagccuggagacagcagcguuggcgagcgug

SEQ ID NO: 145164 - RNA, 40 nt, Homo sapiens
ugcuccgucugaagcccccggcggucuuggcggggugcaa

SEQ ID NO: 145165 - RNA, 30 nt, Homo sapiens
agggagcugcaggcagaggaggcugaugca

SEQ ID NO: 145166 - RNA, 39 nt, Homo sapiens
ccuggagggcccggugaagcuuccagaccacaggucggg

SEQ ID NO: 145167 - RNA, 45 nt, Homo sapiens
uucaggguguuuaggcuccuugacguaccagcacugcguguagac

SEQ ID NO: 145168 - RNA, 42 nt, Homo sapiens
uggaggauugaaccuauuucaccaucaugucagcuccacgag

SEQ ID NO: 145169 - RNA, 41 nt, Homo sapiens
agccccugguaguagggccgcagcuuguccacguccggcag

SEQ ID NO: 145170 - RNA, 42 nt, Homo sapiens
gccugcgccguccaugcagagcagcgccuccuccaccuccag

SEQ ID NO: 145171 - RNA, 40 nt, Homo sapiens
agcaacgccccucgccccggcccgcccccggccccgcccc

SEQ ID NO: 145172 - RNA, 60 nt, Homo sapiens
cucccaguaccggaggucugggggcgcacgagccgcuccuccucuggagaagcuccggac

SEQ ID NO: 145173 - RNA, 373 nt, Homo sapiens
ucagaugaguuuuuccccagcagcguaacccugcaacaggccagacuggaccccagacacacauuccacaccacaccacgccuccaccaccacacgcacacaacagacacacccuaaacaccagacacacacacacaccucaaccaccgcaaacacacauacgccacaccucuaacaccacacacacccaacaccacacacauacgugccucaaacacuacacacaccucaaccaccauacaccucaaccacacacaccccucaaacaccaaacacaccccucaaccacacacacacaccccucaaacaccacacacccaccucaaacaccacacacacauaucccucaaacacuacaaaaacacacacacac

SEQ ID NO: 145174 - RNA, 42 nt, Homo sapiens
cugcuggagaucgacaacucugagcugcugcacguguuagag

SEQ ID NO: 145175 - RNA, 45 nt, Homo sapiens
cugcccagaaggugggcgcuguugcugcugcuaccacucagacaa

SEQ ID NO: 145176 - RNA, 47 nt, Homo sapiens
uuauucuugccacccuucuuugcgggagccauucugccggguccaag

SEQ ID NO: 145177 - RNA, 46 nt, Homo sapiens
uucagucccagcaggaugcaauccuucaaguuggaauuccaguggg

SEQ ID NO: 145178 - RNA, 88 nt, Homo sapiens
ugucaucucaguauuuauauauucaguucaccuugaucauuuuccacugcggaugggcuuccuguacuaacucuuuucucagggugaa

SEQ ID NO: 145179 - RNA, 52 nt, Homo sapiens
ugaaacuuuaagaaaggauagaaaaauaaaugaaaaaagaaauguucaacga

SEQ ID NO: 145180 - RNA, 36 nt, Homo sapiens
caucaggauggauuuucacucguuccagccacggug

SEQ ID NO: 145181 - RNA, 86 nt, Homo sapiens
cuuucuuuuuuuucuuuuuuucuuucuucuuuggaggcucacguucuccgagcauauuuuucggacaggcauaacuuaagugucca

SEQ ID NO: 145182 - RNA, 40 nt, Homo sapiens
uaccauauuugauguuauuuauaaaaacuugccugguacc

SEQ ID NO: 145183 - RNA, 48 nt, Homo sapiens
auuuuaacauuuaggacuauuuaguaguuuuacuaagaguagugguag

SEQ ID NO: 145184 - RNA, 45 nt, Homo sapiens
ucauaacacuuagauuuaucaaaguaguuucgccuucggaugaac

SEQ ID NO: 145185 - RNA, 42 nt, Homo sapiens
uuaccuguuuguuguuuauugcccugguacaguuuugugcag

SEQ ID NO: 145186 - RNA, 72 nt, Homo sapiens
agucauuguuugucagggaaaaaggcaaguuggauacauacacugugcucuuacuuggagccaauccaccac

SEQ ID NO: 145187 - RNA, 75 nt, Homo sapiens
cucgcagcggccuuggcaucacgaguccugggaggggucaggcgcggagagcagauaauagcagccacggugcuu

SEQ ID NO: 145188 - RNA, 41 nt, Homo sapiens
uugugugacaauucugcccaugcgguugaggguggagagac

SEQ ID NO: 145189 - RNA, 46 nt, Homo sapiens
aauaguuguugaaagaauauaaaaagcgaaggaaugaguuuuggug

SEQ ID NO: 145190 - RNA, 38 nt, Homo sapiens
aagccacaaauauuuaugucuacguuaguuauuuuuua

SEQ ID NO: 145191 - RNA, 45 nt, Homo sapiens
guuugacaaagagauccaagcaguccucugcccaccucccgugaa

SEQ ID NO: 145192 - RNA, 45 nt, Homo sapiens
uuuuuguuacagauuaauuuuuccagaaaaccauuuugaaccaau

SEQ ID NO: 145193 - RNA, 50 nt, Homo sapiens
uguucuaaauguaagaguucagacucauauucuauuaaaauuuagcccua

SEQ ID NO: 145194 - RNA, 24 nt, Homo sapiens
ugugggugugcuggguggggugug

SEQ ID NO: 145195 - RNA, 49 nt, Homo sapiens
gugugugacaaugagaauagagagcuaguguaaguuacuggaguugaga

SEQ ID NO: 145196 - RNA, 58 nt, Homo sapiens
uucuguaugguauauucauucauuuauuaaauauuucuugugguaucuaauaugucaa

SEQ ID NO: 145197 - RNA, 54 nt, Homo sapiens
uuuuacugccuggcaucuaucuggcuucuguaagcuguucucuguaucaggugg

SEQ ID NO: 145198 - RNA, 42 nt, Homo sapiens
gccaugucaguauuuuuguuuuugucagugggguguacaaag

SEQ ID NO: 145199 - RNA, 29 nt, Homo sapiens
cuauaucuuaauuucuugcaaucugcuuu

SEQ ID NO: 145200 - RNA, 22 nt, Homo sapiens
ggugcaaacagaaguacaaaga

SEQ ID NO: 145201 - RNA, 51 nt, Homo sapiens
cauuauuuauuccccuucacuggugauugcucaggcagcccaacuugaaag

SEQ ID NO: 145202 - RNA, 33 nt, Homo sapiens
augauauguuuguaaaggaaacacuaagcaaaa

SEQ ID NO: 145203 - RNA, 43 nt, Homo sapiens
acagaaaucuuaguagguacauaucucuauucuauaguagagu

SEQ ID NO: 145204 - RNA, 40 nt, Homo sapiens
uaaacauaaagugagcaggcaaauaaucagauaggcccca

SEQ ID NO: 145205 - RNA, 25 nt, Homo sapiens
uaaaaaccaagaaucuuuugcuaag

SEQ ID NO: 145206 - RNA, 87 nt, Homo sapiens
uuuuuuuaaaccuucuuaaggacacagggcucuuaaauuaaaauaaguuuuuaaauaaccuucgaauauaccacuguuaugugucag

SEQ ID NO: 145207 - RNA, 76 nt, Homo sapiens
ucuacugcaacucaauucuggcacuaaccacucagaguuaguacagacccuacaaguuaaaaggcacugucuucaa

SEQ ID NO: 145208 - RNA, 36 nt, Homo sapiens
aaggguagaaugagagacugaagaggaaaaacagaa

SEQ ID NO: 145209 - RNA, 40 nt, Homo sapiens
auuagaaaagucuauacaguuugcauugaggcagaauuua

SEQ ID NO: 145210 - RNA, 100 nt, Homo sapiens
ugucuugccauauaaagccuugguuaucaacagguggaauguagauauuguaaagcuuuuugugaauuaaaagugcaaaauaaagcaaccacauuuaagu

SEQ ID NO: 145211 - RNA, 35 nt, Homo sapiens
ucuuucaaugucaucagaaauccugcaguauagaa

SEQ ID NO: 145212 - RNA, 46 nt, Homo sapiens
uucuaauuacauccauuuguaguugucuuucuacaauuucuagcag

SEQ ID NO: 145213 - RNA, 48 nt, Homo sapiens
uuuguucuguuggacagaaaaugcaacacaaacaucaugcacugaauu

SEQ ID NO: 145214 - RNA, 24 nt, Homo sapiens
gaaaacugaaaugaaguaacuuug

SEQ ID NO: 145215 - RNA, 67 nt, Homo sapiens
cccggcucgccccgcgagaccgacuuccggagcucccggcccgacuccagcccugccgguccugcag

SEQ ID NO: 145216 - RNA, 46 nt, Homo sapiens
caauccuuguugguuuccuucuuuagucuuuuagcaauauuuaaag

SEQ ID NO: 145217 - RNA, 47 nt, Homo sapiens
cagugguaggaaacacaaagagaaugugaaagacuacuaucagaaau

SEQ ID NO: 145218 - RNA, 65 nt, Homo sapiens
agaagaguuuacaucuaacucuaguggucuucggcuucuucucccucuuugacacagaggacuag

SEQ ID NO: 145219 - RNA, 60 nt, Homo sapiens
aacccgggagcccccaacuucgcgccaaguucggagccgccuucugagggagacaugaaa

SEQ ID NO: 145220 - RNA, 53 nt, Homo sapiens
auaauuuuaaccucugccuuuaauuuugcaaugcacgucuguauuuacgcuau

SEQ ID NO: 145221 - RNA, 46 nt, Homo sapiens
augcauuucacaacagaauuguaucacuuuaaauauauaauuuuag

SEQ ID NO: 145222 - RNA, 52 nt, Homo sapiens
aacagcagauuauauuuaaagaucgugaaaaaagagacugaaccaggauagc

SEQ ID NO: 145223 - RNA, 43 nt, Homo sapiens
gauuaucaacucuuuacaaaacaggucuaugagaaggcucaag

SEQ ID NO: 145224 - RNA, 47 nt, Homo sapiens
agucguacucagggaauucaccaugcagagguuuuguuuauaaugau

SEQ ID NO: 145225 - RNA, 45 nt, Homo sapiens
auuucugcuguaacccugugcacuuguuacuuuauuuucuauaag

SEQ ID NO: 145226 - RNA, 42 nt, Homo sapiens
gaugcugguugucccauuaccguuuuucuuacugcccaagca

SEQ ID NO: 145227 - RNA, 47 nt, Homo sapiens
guagcacagcugaauuuucuucugugugcauaaggacaacagaugag

SEQ ID NO: 145228 - RNA, 51 nt, Homo sapiens
uaacauaacacauaaggaugagagaauaguaauaauguugccucuauauga

SEQ ID NO: 145229 - RNA, 38 nt, Homo sapiens
ccacuccuccccuaagauuuugcuuaaaaaucacucau

SEQ ID NO: 145230 - RNA, 58 nt, Homo sapiens
caaguaucuucagaaaauggugggacaggaagaggggaguaauuugcccuucuugggg

SEQ ID NO: 145231 - RNA, 56 nt, Homo sapiens
caacuccucgaauccugcccaggcagauucaguguccuucuuugcccucugugcag

SEQ ID NO: 145232 - RNA, 45 nt, Homo sapiens
cagaguuucagaaacaauucagaguuaucaggcucugucauuuau

SEQ ID NO: 145233 - RNA, 47 nt, Homo sapiens
uccuucuuuuuccccuccgacugucaguuccgggagaacaggccugu

SEQ ID NO: 145234 - RNA, 43 nt, Homo sapiens
ccagaagagacauuauuaacuaugagcguuuaccaugcuggug

SEQ ID NO: 145235 - RNA, 55 nt, Homo sapiens
cuauggucuuguuuuuucuuuuuccuugcaugcucuuuuuuuuagcccugcauag

SEQ ID NO: 145236 - RNA, 55 nt, Homo sapiens
augaugcaggagcagcggggcggggauagacucagcugaagugauguggggagug

SEQ ID NO: 145237 - RNA, 45 nt, Homo sapiens
gauuugggaucacuggaaagucagcaugauuuucgaaccccggag

SEQ ID NO: 145238 - RNA, 58 nt, Homo sapiens
cagauguucuggaacuaugugaauggugacuaucauuuggggacauggaugaaaauag

SEQ ID NO: 145239 - RNA, 46 nt, Homo sapiens
ggaccagagacucagauaaccuuguagaguuccgucuuaaaaguag

SEQ ID NO: 145240 - RNA, 62 nt, Homo sapiens
cacuugugaagcuaacauuuugaugggggagacauaaaacacaaacgucagauaauccugua

SEQ ID NO: 145241 - RNA, 25 nt, Homo sapiens
aaguagggauuauuuguguguaugu

SEQ ID NO: 145242 - RNA, 47 nt, Homo sapiens
agauguuuaagcagaugguuugugaauauuagaaaaaaggucauuag

SEQ ID NO: 145243 - RNA, 37 nt, Homo sapiens
ccccacuuacaccuuacuuaucuucuucaucucagcu

SEQ ID NO: 145244 - RNA, 56 nt, Homo sapiens
acauuuuuggaucuucagaauuuuuuuguguugaguauauauuuuaucagaaaaaa

SEQ ID NO: 145245 - RNA, 63 nt, Homo sapiens
auuugcacaucaguuacaauucaaauuaugugaauguuuugauacuuacuuuucguaguguaa

SEQ ID NO: 145246 - RNA, 57 nt, Homo sapiens
gaaaaccugacucccucuuuuuuaaugauggccagcgaagaauugacuuuguucuag

SEQ ID NO: 145247 - RNA, 43 nt, Homo sapiens
auuguaacaugaaaaaacugcuauuuuguauaaguaauaaagu

SEQ ID NO: 145248 - RNA, 46 nt, Homo sapiens
caacuuuaaaucuauugauuuuugcccauucuuucaaaucaagcga

SEQ ID NO: 145249 - RNA, 58 nt, Homo sapiens
aagcaucaugccgagugcuuuaugcccaugaucaugcuuaauccuuaaaacaauccca

SEQ ID NO: 145250 - RNA, 48 nt, Homo sapiens
gaaucuagccacuaugcccaggaguaacaggaaaaccaaaacugcaag

SEQ ID NO: 145251 - RNA, 45 nt, Homo sapiens
uacgaaucuaaccuuaucugucauggccugcaguuagaagcaaca

SEQ ID NO: 145252 - RNA, 88 nt, Homo sapiens
uguaaaaguacacgcaccaugggagguguuauguacguaugcugagauaaugcacaucaaauugccucugaaacccaaugaucugaaa

SEQ ID NO: 145253 - RNA, 49 nt, Homo sapiens
uagacgaaagcaucaucaagccagagcaagaguuuuucacugccccauu

SEQ ID NO: 145254 - RNA, 47 nt, Homo sapiens
uuuuuacauaguugauagagaugcuuucuucaauccagccaccagaa

SEQ ID NO: 145255 - RNA, 55 nt, Homo sapiens
auguuagcaaguuugggaucaacagacuuguaaacucugggaucuacaaggcagc

SEQ ID NO: 145256 - RNA, 44 nt, Homo sapiens
aacuaggacacuaaacagcagcuugauacacauggaaaaguaga

SEQ ID NO: 145257 - RNA, 48 nt, Homo sapiens
uaaugaacgguaccuucuguacagagaaugggcucauccucgaagcau

SEQ ID NO: 145258 - RNA, 37 nt, Homo sapiens
gguuuuuacauuaaaaaauaguucauacaauguuuaa

SEQ ID NO: 145259 - RNA, 25 nt, Homo sapiens
acaaauugugaauaugguaguguag

SEQ ID NO: 145260 - RNA, 85 nt, Homo sapiens
guuugucauccugauauugguggcaagaucauaauguguccucagugugauaggcuuuguccauucuggaaacucaauauuacuu

SEQ ID NO: 145261 - RNA, 22 nt, Homo sapiens
aaccugaaaucuguacuucugu

SEQ ID NO: 145262 - RNA, 54 nt, Homo sapiens
aacagcccucacagugugauacaaccuaacuuuuauggggguggagaucaggag

SEQ ID NO: 145263 - RNA, 94 nt, Homo sapiens
uucuaaacuaggccuacuuauuuccagaaaaccaccagucaucuggcucacuaaggaucuggggaaccaggaagccuaacuagcugcacuuggg

SEQ ID NO: 145264 - RNA, 47 nt, Homo sapiens
aguucugccaauaauuuggcuauuaucagucuuuagauugaugacaa

SEQ ID NO: 145265 - RNA, 42 nt, Homo sapiens
guuaccuuguuuuuggaguuuuggaagcgacgccaggcagaa

SEQ ID NO: 145266 - RNA, 45 nt, Homo sapiens
gaagcacgauguacucacguagugauaaaugagauuacucaggua

SEQ ID NO: 145267 - RNA, 44 nt, Homo sapiens
aagaccaaauggaaggcauuaagaauucuaaaauuuuccaacag

SEQ ID NO: 145268 - RNA, 40 nt, Homo sapiens
cuauuguaauucugcacugcuccagcuucguagaaggcag

SEQ ID NO: 145269 - RNA, 47 nt, Homo sapiens
ucaaaaauauucauaugcuuuaauccacuaauuuagcucuuaggacu

SEQ ID NO: 145270 - RNA, 47 nt, Homo sapiens
cagaaauaccugacuccacagacagccacguccaucacggccuccau

SEQ ID NO: 145271 - RNA, 66 nt, Homo sapiens
acccagacugauuaugagaacagccucaccaugaagauguucuuauuccaguuugucaacuacuac

SEQ ID NO: 145272 - RNA, 60 nt, Homo sapiens
cauucuuuaagggcaaauuuguaggcuauccaggagacccaguuuauugguugggaaaau

SEQ ID NO: 145273 - RNA, 46 nt, Homo sapiens
uagugugacccagguggcugucuucuugaacugacaacucagcuga

SEQ ID NO: 145274 - RNA, 91 nt, Homo sapiens
ucucaccauguuuuguacaaaauaaggaccuaguaaagcauaacuuaugauguggcuaugacaauacacaugguaaauuccuauggaaauu

SEQ ID NO: 145275 - RNA, 29 nt, Homo sapiens
uucuaaaaguucugugggugauucucaug

SEQ ID NO: 145276 - RNA, 68 nt, Homo sapiens
aaguaguugccaggacagaaguuucauccugaaucugagcuuugaugugauuuagagcccagacagaa

SEQ ID NO: 145277 - RNA, 77 nt, Homo sapiens
uucagauucaggggugucugaacucauaucccauccacuuuccacagccuccugcugccucucuaacaucaucaaaa

SEQ ID NO: 145278 - RNA, 49 nt, Homo sapiens
gcuggaucaugaaucuaauugggcgauuucacagaguuucuggaucaga

SEQ ID NO: 145279 - RNA, 46 nt, Homo sapiens
ugucaauauuuauguuguaaaaagcuagaaauuuauuacugggcaa

SEQ ID NO: 145280 - RNA, 41 nt, Homo sapiens
uuacuuguuuaaaaaugcacuucaucuuuaaaaggguuuuu

SEQ ID NO: 145281 - RNA, 87 nt, Homo sapiens
gucauuuaaaucaagcugcuagagacauuuuuuccccauagcuuucucuugagugaaacucagaaaauguauauauauguauauuua

SEQ ID NO: 145282 - RNA, 42 nt, Homo sapiens
cccgauguaucaaaacgcacaaagagcaagauccagagagaa

SEQ ID NO: 145283 - RNA, 42 nt, Homo sapiens
ugagaaucaccucaaagauaugacgaaaaauaugggggugau

SEQ ID NO: 145284 - RNA, 50 nt, Homo sapiens
aaugagaauguguaaguuaaaucacuuuggcaaauaugagucucaacuau

SEQ ID NO: 145285 - RNA, 45 nt, Homo sapiens
gaucuguuccagggucaucuuuuccuuacaguaccaucauuauag

SEQ ID NO: 145286 - RNA, 46 nt, Homo sapiens
caauguugacugcuuugcagaucucaagggaauaaaaugacaaaag

SEQ ID NO: 145287 - RNA, 80 nt, Homo sapiens
gccaaagugaucaacacaccaaagucucugccauaaagaauguggcuuccuugcauccuccauccuguuacucugggccc

SEQ ID NO: 145288 - RNA, 50 nt, Homo sapiens
cauucgcagccaagacgggagugccacuguuccucucuucacuccugaga

SEQ ID NO: 145289 - RNA, 39 nt, Homo sapiens
uaaaagaaaugugcauuuguuuucauagccccagcagag

SEQ ID NO: 145290 - RNA, 45 nt, Homo sapiens
aaaaaaaacccucuacauauugaaaggcaccaaauguaauaucug

SEQ ID NO: 145291 - RNA, 40 nt, Homo sapiens
uuguaccauuuuauguucauauuauguuugagaggguaaa

SEQ ID NO: 145292 - RNA, 32 nt, Homo sapiens
cucccugcuucacugaggggugucccuuugag

SEQ ID NO: 145293 - RNA, 43 nt, Homo sapiens
ugaaccuuaaauagccagaggauuggaggagcuuccucacauu

SEQ ID NO: 145294 - RNA, 45 nt, Homo sapiens
uaacacagccagacggacaaugagaagaagaauaucaguucccaa

SEQ ID NO: 145295 - RNA, 37 nt, Homo sapiens
uacauagucugaaggugaugggagaggagacaggcaa

SEQ ID NO: 145296 - RNA, 44 nt, Homo sapiens
aaugcuggaaacuaaaaaauuuuaaaacaaguuuuuuuccagau

SEQ ID NO: 145297 - RNA, 96 nt, Homo sapiens
uauguuuagagaaauuuucuuuuccuuauucacguaaggggccacagguccuuaagaacugugucgauuuaccaaaaugauuuggagcuuauuagg

SEQ ID NO: 145298 - RNA, 103 nt, Homo sapiens
aacaaaauuuauaccuacccuggcuuuagccauaguuuuuuuaauaucuaccaucuguuacaauuuuguuuuaacuauucccacugacuuagaagacuucugg

SEQ ID NO: 145299 - RNA, 45 nt, Homo sapiens
ugcagcuaguagcgcugggcuccuuuuguccuuggcggugggugc

SEQ ID NO: 145300 - RNA, 74 nt, Homo sapiens
gcgcccuucccacagacgcccccccgcacgcguuaccucgguggucucuauucucacgcagacgucuucagugg

SEQ ID NO: 145301 - RNA, 27 nt, Homo sapiens
ccggggcggcgguggugggauaagaga

SEQ ID NO: 145302 - RNA, 45 nt, Homo sapiens
ucaucgauucucaguccuggccccgcuagugaugccuccgcugau

SEQ ID NO: 145303 - RNA, 46 nt, Homo sapiens
uagauguuucuuauaaccgaauuccuuccaugccaaugcaccacau

SEQ ID NO: 145304 - RNA, 46 nt, Homo sapiens
cgacuggagccucuucaacaguauccaccagguaugggaggcagag

SEQ ID NO: 145305 - RNA, 45 nt, Homo sapiens
gacuuaugaaauaguuggggcaagucuuauugucuccauuuuacc

SEQ ID NO: 145306 - RNA, 43 nt, Homo sapiens
uguuuccuucuucugucggggcgccuuggcauggaguggagga

SEQ ID NO: 145307 - RNA, 39 nt, Homo sapiens
guaucuuauuuucaggugaauuuuaccgggaaggccgag

SEQ ID NO: 145308 - RNA, 46 nt, Homo sapiens
agugaagauuucauacauuggccucaugacccagagcuccuuggag

SEQ ID NO: 145309 - RNA, 50 nt, Homo sapiens
acccccacgugguguaagcagaggaggaauugguucacuuaacucccagc

SEQ ID NO: 145310 - RNA, 63 nt, Homo sapiens
ugcagagccuugugcccucccucuccuccaccucccacccccauacacugagccccucugccc

SEQ ID NO: 145311 - RNA, 47 nt, Homo sapiens
uauccuuugcagaacacaagugcuaggaaaggaaaaagugugggaga

SEQ ID NO: 145312 - RNA, 46 nt, Homo sapiens
aaauauuuauugccauguauagcagaaaaugaaacaugcaacaaaa

SEQ ID NO: 145313 - RNA, 43 nt, Homo sapiens
aagaccaccuuuuguguguuuguuuuuucucucucuuucuuuc

SEQ ID NO: 145314 - RNA, 44 nt, Homo sapiens
aguuuuguaugaaaucuuuucuccucucccguuguaccgcauuc

SEQ ID NO: 145315 - RNA, 42 nt, Homo sapiens
cacacagagaucccagccccuaugaguaggguguuuguggac

SEQ ID NO: 145316 - RNA, 82 nt, Homo sapiens
aaccaccagcauauacauggacauacacacacacccacacacacaaacacacacacacacacaauuuucacgauguaugguc

SEQ ID NO: 145317 - RNA, 47 nt, Homo sapiens
acccaguguaacuucuaaggcuauaauggugaaaaauaacaauagaa

SEQ ID NO: 145318 - RNA, 42 nt, Homo sapiens
ggugucuagcugugaguaccccuuucauuuuugauaaaaugu

SEQ ID NO: 145319 - RNA, 87 nt, Homo sapiens
cuaauuaacuaguugacuuuggaggccauuuuccucucaguugagaaacuuugguugggugcagcaauggaagaggaauucucaaag

SEQ ID NO: 145320 - RNA, 69 nt, Homo sapiens
cauuuggaugguguaauagcuaaaaaaauugaggagaaagacuugaauccagauucugccuuggauguc

SEQ ID NO: 145321 - RNA, 44 nt, Homo sapiens
ccaucacugcuccucuuucaucuugaacacugugaucccuucuc

SEQ ID NO: 145322 - RNA, 24 nt, Homo sapiens
uuaggaauagguuuuccuuagaga

SEQ ID NO: 145323 - RNA, 43 nt, Homo sapiens
gaauacaguauuucuaacuucaccagcuagugaaaggccaaug

SEQ ID NO: 145324 - RNA, 45 nt, Homo sapiens
gaaauggagaaagaaauaaagaauguauuucguaaugggaaucag

SEQ ID NO: 145325 - RNA, 45 nt, Homo sapiens
agcuuccagagcgacccccaagagccggagacuccuucgccuggg

SEQ ID NO: 145326 - RNA, 53 nt, Homo sapiens
auuaaauguuaaagaaaauguuaugaaaauaucaaacagucaccugaauugaa

SEQ ID NO: 145327 - RNA, 48 nt, Homo sapiens
uuuaacagggccagaugcagauggcuggagaugggugcagaucccagg

SEQ ID NO: 145328 - RNA, 42 nt, Homo sapiens
aaacaugccaacuuuauuacuguuucccuugguauugcugau

SEQ ID NO: 145329 - RNA, 52 nt, Homo sapiens
caauuucuuuuccagaacuuuuccaucagcccaaacagaaacucuaccuguu

SEQ ID NO: 145330 - RNA, 46 nt, Homo sapiens
uucaucacuggggaacuuagguguugacuacagcuaacuaacccca

SEQ ID NO: 145331 - RNA, 43 nt, Homo sapiens
agaagcucugcuuugguucaggcccuugagacaaagccuuauu

SEQ ID NO: 145332 - RNA, 44 nt, Homo sapiens; identical to SEQ ID NO: 53588

SEQ ID NO: 145333 - RNA, 968 nt, Homo sapiens
gcccucacuucuguauuuuauuuuauuuuuuauuuuuuggagauggaguuuugcucuagucucccaggcuggagugcaauggcgugaucucggcucacugcaaccuccaccucacugcacccuccgccucccgaguucaagcgauucuccgaguagcugggauuauaggcacguaccacaauaccuggcuaauguuuguauuauuaguagagaugggguuucaccauguuggccaggcuggucucgagcuccugaccucaggugauccacccgccuuggcuucccagaaugcugggauuacaggaguaagccacugugcccggcuuuuauuuuuuuauuuguguuuuuugagacagggucucacacuguuauccaggcuggagugcaguggcucagucauagcucacugcagccuuaacuccugggucaagcaauucuccuaccucagccuucugaauagcugggacuauguaugugugccaccaugccuggcuaauuauuuauuuuauuuuauuauuaauuauauuuuuugaggcagagucucgcugugucgcccaggcuggagugcaguggugugaucucggcucacugcaacuuccaccuccuggguucaagcaauucuugugugucauccuccugaguagcugggauuacaggcacgugccaccacgccuggcuaauuuuuguauuuuuaguagagaugggguuucaccauguuggccagguuggucucaaauuccugaccucaagugaucugccugccucggccucccaaaguguugggauuacaggcaugagccacugcaccuggccuauuuuuuuuuuuuuuauuuuuuguagagucaauuuucaauauguugcccaggcuggucucaaacugcugggcuuaagcagucugccaguccuuuccuccccaaaugcugggcuuacagucaucagccacuguaccuggccuuuauaaacuuaaa

SEQ ID NO: 145334 - RNA, 74 nt, Homo sapiens
uuacuguggguuuuccaccccaguugaaaggaugauuuugcacugugaacuucuaguauuauccuuuugugugg

SEQ ID NO: 145335 - RNA, 46 nt, Homo sapiens
gcucaucacugccaccaagggcuccuccaacuccuuugccaucaag

SEQ ID NO: 145336 - RNA, 47 nt, Homo sapiens
cauggauucuagugugaguccccacugaccagcucugugucugcaca

SEQ ID NO: 145337 - RNA, 42 nt, Homo sapiens
aguagucuccugacuggcccagagggacuuuuggccaaagaa

SEQ ID NO: 145338 - RNA, 46 nt, Homo sapiens
ucugcucaaggagaagaagcgccgauacuuacauaaucgcaaagug

SEQ ID NO: 145339 - RNA, 72 nt, Homo sapiens
aacccaaaagugauuauaucuuaaucagguuuauaucuuaguaagcuucugcucuucacuuaacccaucauc

SEQ ID NO: 145340 - RNA, 22 nt, Homo sapiens
auuguaguugaauacuucugca

SEQ ID NO: 145341 - RNA, 46 nt, Homo sapiens
acagcuggagugauggggagcaggaacccauuacuguggaucagac

SEQ ID NO: 145342 - RNA, 23 nt, Homo sapiens
aaccugacuagauaauuuuuuac

SEQ ID NO: 145343 - RNA, 82 nt, Homo sapiens
aagaaugcacccuucaagcaguguaguuauauaucgacgaagaauggaaaaagaugucccaaugcugccccaaagccagaga

SEQ ID NO: 145344 - RNA, 41 nt, Homo sapiens
uccgaggccaggcccagucgugcgcucugaggcaggccggg

SEQ ID NO: 145345 - RNA, 36 nt, Homo sapiens
cucuuuguauugcucuuaagaguccuuucucagcau

SEQ ID NO: 145346 - RNA, 49 nt, Homo sapiens
caguugaagcugaggaacuaacugauuaguuguugaucauaauauaauu

SEQ ID NO: 145347 - RNA, 42 nt, Homo sapiens
uggagagggaugcuugacagcaugcuaauugaagccagagca

SEQ ID NO: 145348 - RNA, 72 nt, Homo sapiens
guuucuaaaguuuuucauaugaacuuggcauuggaaaagggagguaaagaaaaaggacguuuacuaaaagca

SEQ ID NO: 145349 - RNA, 50 nt, Homo sapiens
uuaugaguuauuuugauacuaagaaaagagagaaucuagaacaucuugca

SEQ ID NO: 145350 - RNA, 45 nt, Homo sapiens
auuuauuuagauuuuguuuguuggagucuguuuccaaaagggaau

SEQ ID NO: 145351 - RNA, 52 nt, Homo sapiens
guuccugccauugcuggguauaaaacgaggagcucucuguugaccuguaaau

SEQ ID NO: 145352 - RNA, 45 nt, Homo sapiens
aaaauuguggcuguuggaauugaugauguacuggccuaauauaga

SEQ ID NO: 145353 - RNA, 31 nt, Homo sapiens
uuuaaugagauauucuuugaucuucauugca

SEQ ID NO: 145354 - RNA, 40 nt, Homo sapiens
aacauuuuuaauaaaucuuucagaaaaucuuggcuagaaa

SEQ ID NO: 145355 - RNA, 33 nt, Homo sapiens
auguauauccugccugugaaagcccaaaccaua

SEQ ID NO: 145356 - RNA, 63 nt, Homo sapiens
uaguagcccucuaauuuguaguuugggcaaguacagccaacacccugacucuuaaccuuauua

SEQ ID NO: 145357 - RNA, 25 nt, Homo sapiens
caggccacuuuuuucagacuuuuaa

SEQ ID NO: 145358 - RNA, 49 nt, Homo sapiens
uaaagaaaguaaguuaucuguuuaguuuuuuuauauaauugggaagggg

SEQ ID NO: 145359 - RNA, 44 nt, Homo sapiens
uugauauugagacauaguuaggagggugguagaaggccuuggcu

SEQ ID NO: 145360 - RNA, 41 nt, Homo sapiens
ugaagagacuggaggggcuguguuugaucauccagccaaga

SEQ ID NO: 145361 - RNA, 57 nt, Homo sapiens
cauuuaaacaaguaccucagauauguggugugcagaauaaagcuugaguaccuagau

SEQ ID NO: 145362 - RNA, 64 nt, Homo sapiens
aguaucuacuugcuuggccauuucauccuuuugggagggagauagagguuaucuuuuccagaau

SEQ ID NO: 145363 - RNA, 41 nt, Homo sapiens
gggcugaaacucaguuagcgcuagggaagcgaggcagaguu

SEQ ID NO: 145364 - RNA, 42 nt, Homo sapiens
cuucgccgcugccuucugguugaagcacuauggagggagaga

SEQ ID NO: 145365 - RNA, 49 nt, Homo sapiens
gcggccgcccacgcgccgcuuggcgguucuuacgagaacuuuguuugug

SEQ ID NO: 145366 - RNA, 36 nt, Homo sapiens
aauguguagccaaaggcaugaaaacauucucacguu

SEQ ID NO: 145367 - RNA, 38 nt, Homo sapiens
cccucacccugagcuagagauggcuaccacagcucaga

SEQ ID NO: 145368 - RNA, 46 nt, Homo sapiens
cuucagacauauuuauagcaaaugcugcaucaggggauggaaucug

SEQ ID NO: 145369 - RNA, 46 nt, Homo sapiens
guuuuguuuugagggaaagaguuaugaacccauaagaccaaagaga

SEQ ID NO: 145370 - RNA, 44 nt, Homo sapiens
gcauccaugcugugucugaacaagccuagcccacugccccagaa

SEQ ID NO: 145371 - RNA, 42 nt, Homo sapiens
uguaacaaggagguuuuucucuucacuggggagacccuggag

SEQ ID NO: 145372 - RNA, 70 nt, Homo sapiens
cucaucucuuuucacuaccaccgcccaaacgcccuccccccaccuccucccuccuuugacagucagaaug

SEQ ID NO: 145373 - RNA, 64 nt, Homo sapiens
ccaaaaagaagcucaaggaagagaaacgaaacaagagcaaaaagaaauaauaaauaauaaauuu

SEQ ID NO: 145374 - RNA, 79 nt, Homo sapiens
guagggauggccauggugccagcccuccugggccucauuggguaucaccuauacagaaaggccaauagacccaaagucu

SEQ ID NO: 145375 - RNA, 47 nt, Homo sapiens
ugacuaggacucucucucaggccaucaaaauacccagucccuaagag

SEQ ID NO: 145376 - RNA, 45 nt, Homo sapiens
auccuugcucaaaaugugggauaacgcgaugacugugacccuggu

SEQ ID NO: 145377 - RNA, 72 nt, Homo sapiens
cccacagaugcuucccuccauacuuuuuauuugcucuguuuccucagauuuauuuugucuugccccauugcc

SEQ ID NO: 145378 - RNA, 52 nt, Homo sapiens
cucuggagcuugacugggggguggggauggcaaguccaugguguguguuagg

SEQ ID NO: 145379 - RNA, 57 nt, Homo sapiens
aaaguuguuacgguuucaugggguggccccucucucucucacccucuggguuucggg

SEQ ID NO: 145380 - RNA, 21 nt, Homo sapiens
guggccaacuguuacccugcu

SEQ ID NO: 145381 - RNA, 33 nt, Homo sapiens
ucugccucucaggccccacaucuuagcugaggc

SEQ ID NO: 145382 - RNA, 47 nt, Homo sapiens
agacauagucuuugcacauagggaauacacagcuuaacgugggaagc

SEQ ID NO: 145383 - RNA, 43 nt, Homo sapiens
guucguccuucaccuuggcuuuaucucccuuagcauccccuuc

SEQ ID NO: 145384 - RNA, 57 nt, Homo sapiens
uccauuaguuucaagguccugggcugugccagggagauacaugauagcuacuggaua

SEQ ID NO: 145385 - RNA, 42 nt, Homo sapiens
aauucuaauacauaaaauggacaaaaguggaguuacucucua

SEQ ID NO: 145386 - RNA, 47 nt, Homo sapiens
cauaauccuaauaauaugaacacucagggcugccuuagaggaaaaga

SEQ ID NO: 145387 - RNA, 40 nt, Homo sapiens
accccuggucuauggcaugaaaguuuuauugggaggagau

SEQ ID NO: 145388 - RNA, 23 nt, Homo sapiens
guuugagggaaggggcgggaguu

SEQ ID NO: 145389 - RNA, 44 nt, Homo sapiens
ggggccuuccuccccaggcggagcgggggcggucucacaggagg

SEQ ID NO: 145390 - RNA, 45 nt, Homo sapiens
ccgccucgcucaagggggcgaccugggcugcaguuagguugucgc

SEQ ID NO: 145391 - RNA, 58 nt, Homo sapiens
cagcuccagucgccgucgcggcuuccggugcuagguggagggaaggaaggagggagcc

SEQ ID NO: 145392 - RNA, 46 nt, Homo sapiens
ccuugccuuaucucaccgaccgucacuuccccagcccgagguuggc

SEQ ID NO: 145393 - RNA, 33 nt, Homo sapiens
ggaccucagcaaaggcccaggccuagcugagcc

SEQ ID NO: 145394 - RNA, 54 nt, Homo sapiens
ucgggugggcgaauaaccgggucuugagugcuagcgagucuguuugggggaggg

SEQ ID NO: 145395 - RNA, 43 nt, Homo sapiens
auguuaguggcagcacagcccacgccaacccuuccaugcagag

SEQ ID NO: 145396 - RNA, 360 nt, Homo sapiens
ggcacuaucuuuuuuuuuuuuuuuuuuuuuuuuuuugagauggaaucucacucuguugcccagguuggagugcaauggcgcaaucucagcucacugcaaccuccgucucccggguucaagugauucuccugccucagccuccugaguagcugggacuacaggcgcgcgccaccacgcccagcuaauuuuuguauuuuuuaguaaagacggaguuucacccauauuggccaggcuggucucgaacuccugaccuugugaucuaccugccucagccucccaaagugcugggauuacaggcaugagccaccgcacccggccagcacuaucuuuaaaccuacaaaucccuugccucuuccaagg

SEQ ID NO: 145397 - RNA, 43 nt, Homo sapiens
aagagauccccagaccucacuugccucugccuccaucuuggcc

SEQ ID NO: 145398 - RNA, 54 nt, Homo sapiens
ugugacucuguucccuguucaggguccccugcccuucuaucugggagcuaggga

SEQ ID NO: 145399 - RNA, 48 nt, Homo sapiens
gggcagaaggagagggagggaagauccaggcaagucaggguggcucug

SEQ ID NO: 145400 - RNA, 44 nt, Homo sapiens
accacuggcagggcugagacucgaugcuguacaaaaauccccag

SEQ ID NO: 145401 - RNA, 49 nt, Homo sapiens
aaggauaaagggauggcggguuucugggaaacacuuuuccaugguggua

SEQ ID NO: 145402 - RNA, 42 nt, Homo sapiens
uuuaaagcgcccucucucccuccacccucagcgccccugucc

SEQ ID NO: 145403 - RNA, 45 nt, Homo sapiens
ccuuuuuaaaaaauaaaucgcugacaagugugaaucccgugaaga

SEQ ID NO: 145404 - RNA, 30 nt, Homo sapiens
aaguacccugccuguauaauugcaucagaa

SEQ ID NO: 145405 - RNA, 68 nt, Homo sapiens
cugcugcccucaaagccacagcccuuggauguuccuuuuccgagagcagaaggucuaggcuacaggga

SEQ ID NO: 145406 - RNA, 50 nt, Homo sapiens
aauuaauauuuucaagaaucagaugucuggaguguaggggugggcuuggu

SEQ ID NO: 145407 - RNA, 56 nt, Homo sapiens
ggcucccuggggugacaauguauauaugcaaauaaauugagaaaucuuuuguuguu

SEQ ID NO: 145408 - RNA, 48 nt, Homo sapiens
uggccucuagcccucuguuuuuguuugaugaauucuguuauaaccuau

SEQ ID NO: 145409 - RNA, 44 nt, Homo sapiens
gcucuggggugaaagccccauucccgcaacauucccaccaccaa

SEQ ID NO: 145410 - RNA, 46 nt, Homo sapiens
ggcaguugaaggaaagaagcuggcagaguccuggggugcgacauuu

SEQ ID NO: 145411 - RNA, 29 nt, Homo sapiens
uccacugacucaaacaagucauuucaccu

SEQ ID NO: 145412 - RNA, 72 nt, Homo sapiens
aacccgguaaguggcccugggggauagggacauagugugggcaugagggggugggagagagcagaggggaga

SEQ ID NO: 145413 - RNA, 41 nt, Homo sapiens
uaaaguuauagcuccaauucuuguguuuaaagcuuccaagu

SEQ ID NO: 145414 - RNA, 45 nt, Homo sapiens
gcagagaggugacagaauacacaagcacauaaccauggaccccaa

SEQ ID NO: 145415 - RNA, 73 nt, Homo sapiens
guccaugguuaugugcuuguguauucugucaccucucugcauagguaagugaccaagguugugagugcgggac

SEQ ID NO: 145416 - RNA, 42 nt, Homo sapiens
guaugcagggcucauuggagcuguuccauaaauacauguuga

SEQ ID NO: 145417 - RNA, 45 nt, Homo sapiens
aauguggcaguucagcccucggagaugaagucugguagucuuugu

SEQ ID NO: 145418 - RNA, 55 nt, Homo sapiens
aacugucacacugcuccccacagggaagacaucuuuggcacaucaauuuguggaa

SEQ ID NO: 145419 - RNA, 49 nt, Homo sapiens
cuucggggugagcgacuuuccugcaccagcugccgcgccugcucacacc

SEQ ID NO: 145420 - RNA, 46 nt, Homo sapiens
aacgcaguagacaccuggaauccaggcaggcaggugccccugaguu

SEQ ID NO: 145421 - RNA, 54 nt, Homo sapiens
uggggggcacccagagcacgaagggguuaaugcuaagggcccaaaggaggagga

SEQ ID NO: 145422 - RNA, 42 nt, Homo sapiens
acuuuccauuacaccaccuaauuguguauggaguggggaggu

SEQ ID NO: 145423 - RNA, 46 nt, Homo sapiens
agcugaugguggcugaccggcgccagaagcgagagauucggcagcu

SEQ ID NO: 145424 - RNA, 33 nt, Homo sapiens
uaucaugaaaguuuuauuuauuccuucaagagu

SEQ ID NO: 145425 - RNA, 94 nt, Homo sapiens
cucuuuauuccugcggcuuccaaaauucugccucuuccucagacucagauaucacagaauucccacagagagaacagauacugacuggauaacu

SEQ ID NO: 145426 - RNA, 69 nt, Homo sapiens
gacuagcuugcuucuuccagcuccugggggaugcugaggugggagguagagaugguaaggcagagaggc

SEQ ID NO: 145427 - RNA, 70 nt, Homo sapiens
aaggcugagggcugggaagguggaggaucagggcacagcgagagcuggaccaccuagaaaaccacugaug

SEQ ID NO: 145428 - RNA, 54 nt, Homo sapiens
aaagcccccagcacuccugugccacccagcccagccccagccccuggacucacc

SEQ ID NO: 145429 - RNA, 61 nt, Homo sapiens
agggggccagugggguggaaccagggcgcuguucggggagugaacccuccuccagugagaa

SEQ ID NO: 145430 - RNA, 76 nt, Homo sapiens
uacagguucaucaagaggaagaaguucgaugaugagcugguggagagcagccuggcaaaaucuucuacccgggcaa

SEQ ID NO: 145431 - RNA, 66 nt, Homo sapiens
cccaaacagugguuuuugguuuccacgagaugguaucucauggaaauaccacuuacuaaaucuuca

SEQ ID NO: 145432 - RNA, 37 nt, Homo sapiens
cccagccaccagccugugggucucaaaccaaggcuac

SEQ ID NO: 145433 - RNA, 50 nt, Homo sapiens
uggugaagggugugggcuggcccacucugcggcaccccuuuuuuccaggu

SEQ ID NO: 145434 - RNA, 60 nt, Homo sapiens
ccacugaggugaugggagaggugaggggcccaggaggaagguggagcucaaaggugagac

SEQ ID NO: 145435 - RNA, 49 nt, Homo sapiens
cccacagaggacagacccacggacccugagaggagacagacaugcagac

SEQ ID NO: 145436 - RNA, 37 nt, Homo sapiens
gagggaagaacuugggaacagucggagagcagaggac

SEQ ID NO: 145437 - RNA, 45 nt, Homo sapiens
uguagaauguuugacuucguauugacccuuaucuguaaaacaccu

SEQ ID NO: 145438 - RNA, 60 nt, Homo sapiens
aaagcuacagucauuuuuucuuugcacuuuggaugcugaaauuuuucccauggaacauag

SEQ ID NO: 145439 - RNA, 116 nt, Homo sapiens
cuacuuuuagcauucuccaggcuuuuacucaaguuuaauugugcaugaggguuuuauuaaaacuauauauaucuccccuuccuucuccucaagucacauaauaucagcacuuugug

SEQ ID NO: 145440 - RNA, 31 nt, Homo sapiens
cuauaagaaaggacacaucuguacucugcuc

SEQ ID NO: 145441 - RNA, 45 nt, Homo sapiens
ucacagagaguccguuccacccucaccaagaacacuccuagguau

SEQ ID NO: 145442 - RNA, 31 nt, Homo sapiens
acgugucagcuauucauugaguucaaaagau

SEQ ID NO: 145443 - RNA, 47 nt, Homo sapiens
auugggacucuucuuuggugaagacuuucaaacugaagaagagagaa

SEQ ID NO: 145444 - RNA, 48 nt, Homo sapiens
uuauuuuuaaaucuuuccuaaggauguuguuucaccauggauacaauu

SEQ ID NO: 145445 - RNA, 45 nt, Homo sapiens
cuuuucucaacagaggccaaccauccagcagcaaugcugggaaca

SEQ ID NO: 145446 - RNA, 46 nt, Homo sapiens
uucuccccuggcuaguuaugauguuuuacuuugcuuuggucuguag

SEQ ID NO: 145447 - RNA, 45 nt, Homo sapiens
uggauguuaagcugaagcaugcacguaaucagguggauguagaga

SEQ ID NO: 145448 - RNA, 47 nt, Homo sapiens
cuaguuauuuucagcuggauuugcccauaguucagcugguuccuuaa

SEQ ID NO: 145449 - RNA, 75 nt, Homo sapiens
ugacuguaaaggaaacuguuuuuguuuuauagcuguaacuguccuggugcaugacagcugccccaaagguauccc

SEQ ID NO: 145450 - RNA, 78 nt, Homo sapiens
uaaucuacaucuacuggagcauauuacagcaguuacauuugaauuugcuguuuaacaucucucuggugcagcaaugcg

SEQ ID NO: 145451 - RNA, 46 nt, Homo sapiens
cggaaucuguuugagcagcuugugcgccggguggagauucucagug

SEQ ID NO: 145452 - RNA, 37 nt, Homo sapiens
guuguuagcuugagauucuuauaaugguaguuauaaa

SEQ ID NO: 145453 - RNA, 24 nt, Homo sapiens
auauaagugaaugccgagaugaua

SEQ ID NO: 145454 - RNA, 56 nt, Homo sapiens
aguaggguaugggauaggguaggucagugaguagcguaguugauggacaugaacag

SEQ ID NO: 145455 - RNA, 48 nt, Homo sapiens
aauagucuguuuuucugaaggaugauaucuaccucuuggcugggugau

SEQ ID NO: 145456 - RNA, 52 nt, Homo sapiens
aauaauguuguuugaaggaggaggaagaagaggauagagacuuuucccagga

SEQ ID NO: 145457 - RNA, 62 nt, Homo sapiens
guuccuaugaaaggaucuuaaaguacugagauuaucuuugagaaugguuuuccuugacagca

SEQ ID NO: 145458 - RNA, 46 nt, Homo sapiens
uuagcccuuaggaccacagccccguccagggaauacccgugaccag

SEQ ID NO: 145459 - RNA, 51 nt, Homo sapiens
cuugauacauaaucacauuaccucuguuuuacaaaugcacgaaacugagac

SEQ ID NO: 145460 - RNA, 32 nt, Homo sapiens
aggaggacagaguggaaaugcugggguggaca

SEQ ID NO: 145461 - RNA, 36 nt, Homo sapiens
auagggaauucaguaacuaagugccucugggggcca

SEQ ID NO: 145462 - RNA, 47 nt, Homo sapiens
aggacaugcaguuggguguguguguguguuggggugugugcguguug

SEQ ID NO: 145463 - RNA, 45 nt, Homo sapiens
uuggggcagagagagaugggggaaaagggaaaaagggagugggag

SEQ ID NO: 145464 - RNA, 60 nt, Homo sapiens
agcugguugacccuggaggguccugaggaagugagauauaagaguaagaaauauccaugg

SEQ ID NO: 145465 - RNA, 41 nt, Homo sapiens
acaagcugugccgacgaggaaaaugccagaaggaggccaaa

SEQ ID NO: 145466 - RNA, 45 nt, Homo sapiens
ggccacccugccgggaugacauacgcugccaacauccuaccucac

SEQ ID NO: 145467 - RNA, 52 nt, Homo sapiens
ccccacccaggggauggaggucuacccuggacacuaagccaagugugucaga

SEQ ID NO: 145468 - RNA, 40 nt, Homo sapiens
gucaaauccacguggcucuccccaccuggaaaggggaagc

SEQ ID NO: 145469 - RNA, 33 nt, Homo sapiens
ggggaguuucggagguauaaaggaaugccuggg

SEQ ID NO: 145470 - RNA, 42 nt, Homo sapiens
aaaacaggaugaguggauggaaaugggagagaaggguuguca

SEQ ID NO: 145471 - RNA, 93 nt, Homo sapiens
gggggagaaccagagguuucugaggacacagauguugcuaggagaagcuaaaagggguuuguuugagaucuuuguauuuuguuaacaaacacu

SEQ ID NO: 145472 - RNA, 41 nt, Homo sapiens
auuaaguuccugcuccccaaagagggugcuggcggggaggg

SEQ ID NO: 145473 - RNA, 51 nt, Homo sapiens
auaaagcguguuuuuuccagaaacaagaagaguugggagagggagcuucag

SEQ ID NO: 145474 - RNA, 38 nt, Homo sapiens
aaagaaaucccuccuccauaaucgcagcuacuccaggg

SEQ ID NO: 145475 - RNA, 32 nt, Homo sapiens
uugagaaagccaauucaagcacuaaacaaagc

SEQ ID NO: 145476 - RNA, 46 nt, Homo sapiens
ggaaaauugucuaggagaauccaggcaugaaguagaaaaaucagaa

SEQ ID NO: 145477 - RNA, 45 nt, Homo sapiens
ccuugauguggggauaucgacccugaacgagggcuucaggaggug

SEQ ID NO: 145478 - RNA, 68 nt, Homo sapiens
aagcccucguucagggucgauauccccacaucaaggacggugaggaucuuaaagaccacucaacagaa

SEQ ID NO: 145479 - RNA, 42 nt, Homo sapiens
cagcuuuggcuccagaagcagcguggcuugucacuucagcag

SEQ ID NO: 145480 - RNA, 64 nt, Homo sapiens
uucuuguucuucuagaacaccgaaaaucucucccagcacuuuagaaaggggacccugacugugu

SEQ ID NO: 145481 - RNA, 47 nt, Homo sapiens
uacagccuugccacauggagaaagcauccacccggcagagggagagg

SEQ ID NO: 145482 - RNA, 362 nt, Homo sapiens
uugauaacugagaauuuuuuuuuuuuuuuugguugggggauggcgucucacuuugucacccaggcuggaguguaguggcgcagucuuggcucacugcaaccuccacuucccagguucaagcgauucuccugccucagccuccagaguagcugggacuaugggugugcaccacugcacccaguuaauuuuuguauuuuuuuuagagacaggguuucuccauguuggucuggcuggucucaaacuccugaccuugugauccgccggccucggccucccaaagugcugggauuacaggcgugagccaccgugccuggcccugauaagugagaauuuauacacagauaaacuuguagagaagagca

SEQ ID NO: 145483 - RNA, 30 nt, Homo sapiens
caaccuaggaauuaaacaggauuagcagcu

SEQ ID NO: 145484 - RNA, 82 nt, Homo sapiens
uuaguguuucuacaucaggauccccuaacaacagugagagagcaaugccagcaguuggagaaauguguaaaggcccaggagu

SEQ ID NO: 145485 - RNA, 31 nt, Homo sapiens
guuuugaauauuauuuaguuuuaaguauaug

SEQ ID NO: 145486 - RNA, 43 nt, Homo sapiens
ucacuugucagauagcuacacagcacugauaauuccgcaguuu

SEQ ID NO: 145487 - RNA, 89 nt, Homo sapiens
ccguucaugagagaaauuuucuguaagcuugcuguuuuacaggggauuuaucaauaauugauuuagaggagucaguuuuuuucuauggc

SEQ ID NO: 145488 - RNA, 59 nt, Homo sapiens
gcaucucaguuuggguagaguuuuaagguuauaugaaacugauagaacuuuuguauuuu

SEQ ID NO: 145489 - RNA, 45 nt, Homo sapiens
uuugcucucauacccauccucacauuuacgagcuugcggccagua

SEQ ID NO: 145490 - RNA, 37 nt, Homo sapiens
uaccaagccuagcugagugcuggggggauauugagag

SEQ ID NO: 145491 - RNA, 55 nt, Homo sapiens
ugucuuccaagauguagagcaucuaacagggaugaaugacuuucugaauguucua

SEQ ID NO: 145492 - RNA, 50 nt, Homo sapiens
aaccuaaaguggucacgcuuugcccgagugguucugacucgcucuauugc

SEQ ID NO: 145493 - RNA, 46 nt, Homo sapiens
agauugacugcaaaaugcagaacucagggaaacgcugauaucaguc

SEQ ID NO: 145494 - RNA, 63 nt, Homo sapiens
cagaucaggaggccagguuugucccccaaaaggaaacacacugcuguaaacuucugguuagga

SEQ ID NO: 145495 - RNA, 46 nt, Homo sapiens
gagaaaagcuacuuaagugugaggacaaaacauauuuucugaggca

SEQ ID NO: 145496 - RNA, 54 nt, Homo sapiens
ucagcaguggucccuuggauuacucuacaaagcuaguaggcagcuuugguucag

SEQ ID NO: 145497 - RNA, 33 nt, Homo sapiens
agccuggcagcacuucuuguuaaggaaugggga

SEQ ID NO: 145498 - RNA, 40 nt, Homo sapiens
acagcggcuccaaucccaagggaucuggcacaagaaggag

SEQ ID NO: 145499 - RNA, 46 nt, Homo sapiens
acguugaaucuucuuguaguccuucccaggaggccggucauggggu

SEQ ID NO: 145500 - RNA, 23 nt, Homo sapiens
ccggaaacuccgccccugcuccg

SEQ ID NO: 145501 - RNA, 42 nt, Homo sapiens
accguccgcgacgccgagacaaaccggacccgcaaccaccau

SEQ ID NO: 145502 - RNA, 46 nt, Homo sapiens
uuauuacuaaaagcaaagaccaguaugguacaguauuacuccagag

SEQ ID NO: 145503 - RNA, 95 nt, Homo sapiens
ucugacuggcuuucuguccugcaccauugauucaauggagacuggcgggaggaaauggaagacuaggguuggagaugggauggguggggcaaggg

SEQ ID NO: 145504 - RNA, 46 nt, Homo sapiens
uugaaucaauggugcaggacagaaagccagucagacuaauuuccuu

SEQ ID NO: 145505 - RNA, 47 nt, Homo sapiens
aggauccuugugaaacacuaguuaaaagaugacgaguggggagaagu

SEQ ID NO: 145506 - RNA, 54 nt, Homo sapiens
gaugucgugcaaacuguacugugaacaacaguugguuuaaaauaugaggggcaa

SEQ ID NO: 145507 - RNA, 52 nt, Homo sapiens
ggguuuaagaauauuucagggauccuuaauguuuugauuuuuguuuucugaa

SEQ ID NO: 145508 - RNA, 46 nt, Homo sapiens
guggaauuuuuauacuaaaaauguagaauaaagacuauuuugaaga

SEQ ID NO: 145509 - RNA, 44 nt, Homo sapiens
aguacguggguagggacgaggauauaugugguugguugaguggg

SEQ ID NO: 145510 - RNA, 62 nt, Homo sapiens
ccccugggcccgcguggaaagacccuucaacacucuuggccccucuuagcauaggcccacca

SEQ ID NO: 145511 - RNA, 53 nt, Homo sapiens
ggccuuuccuaaucccagugagaaagaauuguucaacauccccuuccccagac

SEQ ID NO: 145512 - RNA, 34 nt, Homo sapiens
cuguggagagcuguugguaccuggagccugagga

SEQ ID NO: 145513 - RNA, 64 nt, Homo sapiens
cucagguuagguuggguccugacuaaggugcaagacucacgucaggaucacacaaccccugagg

SEQ ID NO: 145514 - RNA, 45 nt, Homo sapiens
cuuucccugccuucuguucuuauuuggacugcaguggcccuuugc

SEQ ID NO: 145515 - RNA, 46 nt, Homo sapiens
gccugcuggcacagcugccccagcucgcccccagagaagcccugcg

SEQ ID NO: 145516 - RNA, 45 nt, Homo sapiens
agaguacuucucugcauagcgcuuuaggagguuggaggcagugag

SEQ ID NO: 145517 - RNA, 51 nt, Homo sapiens
cccaugucuuuuucuuccuuugagggacucaucuaaccccaaacaacugga

SEQ ID NO: 145518 - RNA, 47 nt, Homo sapiens
uaguuuuguuuaaacagcuccuggaacagaugugauaaaacauauua

SEQ ID NO: 145519 - RNA, 45 nt, Homo sapiens
uagaguugccauacuuugguuuagcugugaaguuuccaucccagg

SEQ ID NO: 145520 - RNA, 56 nt, Homo sapiens
caaaauugccuucucucagaaagcuuaccuucugccaggugagguggacaauaaac

SEQ ID NO: 145521 - RNA, 85 nt, Homo sapiens
ucaguugaccuuuagccaucuaaaggagguuaucauggugggucugucuugauugaacuagcccuuucaaagcagagagauuucu

SEQ ID NO: 145522 - RNA, 101 nt, Homo sapiens
gucggugcugugccuggacuucugaccuguaggaacugugaaauaguaacuagguggugguuuaaaaaauguaugcauugggugggggugagucaaauggu

SEQ ID NO: 145523 - RNA, 33 nt, Homo sapiens
caucugacuauaacuuuuuucuagauauuugug

SEQ ID NO: 145524 - RNA, 48 nt, Homo sapiens
caugcaugcugcaggaagccgugggugugcuugguuccugcuggggga

SEQ ID NO: 145525 - RNA, 107 nt, Homo sapiens
aggcagcggugaggaguggaagaaccaggcagggauucccacgggaggaugugggacugauccagaaagagauggccccagagccgagcaaaggugacuccucaagg

SEQ ID NO: 145526 - RNA, 43 nt, Homo sapiens
cuaaagaaguugggcauuugagagcaucuaggcagcaagacua

SEQ ID NO: 145527 - RNA, 43 nt, Homo sapiens
ucaucaguuucccagcaggauagagugcuuguagagaaggcug

SEQ ID NO: 145528 - RNA, 46 nt, Homo sapiens
aauaagauaagauaauggguucacagaaaaucucucauuccguggg

SEQ ID NO: 145529 - RNA, 56 nt, Homo sapiens
aaagaacuuuuaugaugaggagaccagcaugaugugcuugugcuggggaagcaggg

SEQ ID NO: 145530 - RNA, 50 nt, Homo sapiens
ccagcgcacaguggcccgaaccaucguuuuacaagagauuauuggcaagg

SEQ ID NO: 145531 - RNA, 46 nt, Homo sapiens
aaauauucucuucucgugaagaacggucuugguucagggaagcaga

SEQ ID NO: 145532 - RNA, 49 nt, Homo sapiens
uuuuauuccaugaaaagguuauacaaaaauccagguuaucaagcaaaua

SEQ ID NO: 145533 - RNA, 63 nt, Homo sapiens
cugacuaucaugagcacgggucccuguuugauuaucugaaccgguacacagugacaauugagg

SEQ ID NO: 145534 - RNA, 58 nt, Homo sapiens
ggaugauuaagcuggccuugucugcugcuagugggcuggcacaccugcacauggagau

SEQ ID NO: 145535 - RNA, 57 nt, Homo sapiens
ucccacuucaugcagaagugagguaagaaguaaggagcugugauugcaaauugacuu

SEQ ID NO: 145536 - RNA, 46 nt, Homo sapiens
cuuuaaaugugcugauauuuaugcccucgggcuuguauauugggag

SEQ ID NO: 145537 - RNA, 119 nt, Homo sapiens
gcccaggcauguuauucucaagccaccagugggauggcccaggcauguucuuuucaagccauuagugguauagcccaggcauguucuucucaagccaccagugggcuaacccagguaua

SEQ ID NO: 145538 - RNA, 67 nt, Homo sapiens
uucuucucaagccaccagugggcuagcccaaguauguuuuucucaagccaccaggggccuagcccag

SEQ ID NO: 145539 - RNA, 80 nt, Homo sapiens
acccuuccauugaggaaaugcgaaagguuguaugugaucagaagcugcgucccaacauccccaacugguggcagaguuau

SEQ ID NO: 145540 - RNA, 45 nt, Homo sapiens
ggcccugcgcaucaagaagacccucucccagcucagcgugcagga

SEQ ID NO: 145541 - RNA, 51 nt, Homo sapiens
agggacagagcccgggagagacucgcucacucccauguuggguuugagaca

SEQ ID NO: 145542 - RNA, 48 nt, Homo sapiens
aaagaggcuuuugggccaaaaugugaggguggugggugggaugggcag

SEQ ID NO: 145543 - RNA, 41 nt, Homo sapiens
gggaaaugagccagcccaagggcaucauccucagcagcauc

SEQ ID NO: 145544 - RNA, 50 nt, Homo sapiens
uauauuuuugguggugguggguuugggguggggaagggaagggcgggcaa

SEQ ID NO: 145545 - RNA, 35 nt, Homo sapiens
agugguuugauuucuuuuuuuaauuuuauugggag

SEQ ID NO: 145546 - RNA, 47 nt, Homo sapiens
ugagaguuccucuuugcccugaggcucagucucucucguauuuuguc

SEQ ID NO: 145547 - RNA, 64 nt, Homo sapiens
cagagcacuaggggcuagugcuggccccucuggagucugaccuaagucucagagcucuaacaug

SEQ ID NO: 145548 - RNA, 41 nt, Homo sapiens
cggcuggcaucccccagccgccgccagccccgccgagggga

SEQ ID NO: 145549 - RNA, 47 nt, Homo sapiens
gggugggagugggcagaggaaacucugggcucccccagcaggcgagg

SEQ ID NO: 145550 - RNA, 61 nt, Homo sapiens
gggggugagcaaucucuccugaaaucaauuccucuuccuuuuccuucuuugagaaggccag

SEQ ID NO: 145551 - RNA, 46 nt, Homo sapiens
ccagcguggacuggacagaaauaaccaaaucugaggguagcccagg

SEQ ID NO: 145552 - RNA, 46 nt, Homo sapiens
cugcaguaccugaagguaggggaaccuagauaacguccagccucca

SEQ ID NO: 145553 - RNA, 35 nt, Homo sapiens
gagaaauggcccguggugggcugaccccccacccu

SEQ ID NO: 145554 - RNA, 90 nt, Homo sapiens
caagugcacaguauaaaaucaagauucuaauugaagguaacugggcagaaggaugggccgagauuaacggugugaaugugacugacgauu

SEQ ID NO: 145555 - RNA, 63 nt, Homo sapiens
acuaggagagguguacagagacagcuaaugcagucuagcuccuuucucagagcuuccccacag

SEQ ID NO: 145556 - RNA, 57 nt, Homo sapiens
uuuuauuuuggaauuugaaauuuugcccacguaggcuggguggagaccuugggcaga

SEQ ID NO: 145557 - RNA, 57 nt, Homo sapiens
gagcggugcaugaaggagauggguguacgcgcgggcagagaggauguuguagggccg

SEQ ID NO: 145558 - RNA, 44 nt, Homo sapiens
acuguccuggagccuccucugcauuauuuuuugaccauucugug

SEQ ID NO: 145559 - RNA, 49 nt, Homo sapiens
ccacucaugcugggccgcugcccaggggcuuuguggcaccuaggucgag

SEQ ID NO: 145560 - RNA, 44 nt, Homo sapiens
auugacaagaucuucauggacacgcugcccuucugaccccugcc

SEQ ID NO: 145561 - RNA, 47 nt, Homo sapiens
cacauagcgccgugcuguaaauaagcccagugcugcuguaaauacag

SEQ ID NO: 145562 - RNA, 126 nt, Homo sapiens
gagggacgagacuuuccagacccuacucuggugggcccugcuugcucacugcucacuguguggggcaggggacaacaagguuuucacagaccaaauguggcagcugugggaaggagaaugggguug

SEQ ID NO: 145563 - RNA, 88 nt, Homo sapiens
aaguguggacggucaaggugcaugugguagcccuggccacggagcaggagcggcagaucugccgggagaaggugggugagaaacucug

SEQ ID NO: 145564 - RNA, 42 nt, Homo sapiens
uguguguccccaggaagaaucugucauucugagaucccacag

SEQ ID NO: 145565 - RNA, 54 nt, Homo sapiens
guuuacaggggaguaucugugaauuuagggugugagagaguccaucuaaggaag

SEQ ID NO: 145566 - RNA, 41 nt, Homo sapiens
ggacacaugaagcagaugauguggcuauuccuggggguggg

SEQ ID NO: 145567 - RNA, 67 nt, Homo sapiens
uggaaaauguugucuagucuaagcgaucaacuaucuugaggagucugccuuauaauacccuccaggg

SEQ ID NO: 145568 - RNA, 73 nt, Homo sapiens
gugaguguguaugugaaagagagaggggggguugugaguaggaaggccagcaugugagugcauugugugugag

SEQ ID NO: 145569 - RNA, 42 nt, Homo sapiens
gaaaguuuaacauaaagcauuauuaaccauaacagagauugg

SEQ ID NO: 145570 - RNA, 30 nt, Homo sapiens
agccuuccugaaggaagggguacuggagga

SEQ ID NO: 145571 - RNA, 41 nt, Homo sapiens
ccagcugucugcugcagcuccucauacugaugcagccagga

SEQ ID NO: 145572 - RNA, 66 nt, Homo sapiens
gccagcuagccagccugcugaggcuucccaagaggggcagagugcugggaucugggaauccaggaa

SEQ ID NO: 145573 - RNA, 73 nt, Homo sapiens
ggagcugggggugauaaaggaaugacagcagauggaguuggcagcgcuuccuaaaagaugguagaaggagcag

SEQ ID NO: 145574 - RNA, 41 nt, Homo sapiens
ccuuggccgcgcucggcugcucgcucaccugaggccgccau

SEQ ID NO: 145575 - RNA, 47 nt, Homo sapiens
cgcgcagaaagggugaaaagagugugagggggaggggaagguguccu

SEQ ID NO: 145576 - RNA, 60 nt, Homo sapiens
aacucgcgcucgcguuccaacugcucccccccaccacacuuacuccccuaccccccacuc

SEQ ID NO: 145577 - RNA, 25 nt, Homo sapiens
gagaaaaaagccuagaaggaaaucu

SEQ ID NO: 145578 - RNA, 35 nt, Homo sapiens
cuugcaaggcacugauacuccccuccaagguuguc

SEQ ID NO: 145579 - RNA, 24 nt, Homo sapiens
gcuccggucgauauuggguucccg

SEQ ID NO: 145580 - RNA, 27 nt, Homo sapiens
aucuauuuaucaucuauuuaauguuca

SEQ ID NO: 145581 - RNA, 44 nt, Homo sapiens
cuagguggguagucaucaaagcugucuguagcaggacgagcccu

SEQ ID NO: 145582 - RNA, 41 nt, Homo sapiens
ucccgauacccaucccgauacccaucccgauaccggucuga

SEQ ID NO: 145583 - RNA, 46 nt, Homo sapiens
auagucucugcugccucggucaucauagcgaucccggccaccauau

SEQ ID NO: 145584 - RNA, 45 nt, Homo sapiens
ucugucauaucggucuucauagcgguccccgccuccucuguaguc

SEQ ID NO: 145585 - RNA, 45 nt, Homo sapiens
gagguacuagcagaggaaucaucuuccuuaggaguacuccgaggc

SEQ ID NO: 145586 - RNA, 45 nt, Homo sapiens
cuggcauuaccuuuaggggcugaucagguuugggagguuuagaag

SEQ ID NO: 145587 - RNA, 46 nt, Homo sapiens
cucaccuuuccuuccugguccuuccucagaugguugagcuggagcu

SEQ ID NO: 145588 - RNA, 45 nt, Homo sapiens
ccuggaccacggcuagaguucccaguuuggccuuuuggggcauuc

SEQ ID NO: 145589 - RNA, 40 nt, Homo sapiens
ucgcuucccacccuacgauguaugaaauguauguacagac

SEQ ID NO: 145590 - RNA, 43 nt, Homo sapiens
aggaagaggaggaagaggaagaggaagaggauggggaagagau

SEQ ID NO: 145591 - RNA, 38 nt, Homo sapiens
gauggugggagauguggaggcauagggacauccacuuu

SEQ ID NO: 145592 - RNA, 52 nt, Homo sapiens
caggcuucugugcuggugcaggugggcauaauuccuuuccuguucaggcagg

SEQ ID NO: 145593 - RNA, 43 nt, Homo sapiens
uuuggagaggagggaaggauggacuugagguggcggggcugag

SEQ ID NO: 145594 - RNA, 44 nt, Homo sapiens
agcaggagaguggaucaggagguuuaugauggcuuucacuguga

SEQ ID NO: 145595 - RNA, 72 nt, Homo sapiens
guaccaucacagaaugaccaggagcagcaagaugaggaugaggccucugcugucagugcuggggagaaguug

SEQ ID NO: 145596 - RNA, 45 nt, Homo sapiens
aaaccugucacccugucccuucugcucuccuaccccuuagcuagg

SEQ ID NO: 145597 - RNA, 44 nt, Homo sapiens
gggguaacugagucuucugccacugucucagggauuagaucuag

SEQ ID NO: 145598 - RNA, 47 nt, Homo sapiens
cuuuucaacucaaaugucaccuccucagagagaccgccucuguccac

SEQ ID NO: 145599 - RNA, 46 nt, Homo sapiens
agagaagaguacuucaccucuuucucacuuuuggcucccaggaaaa

SEQ ID NO: 145600 - RNA, 43 nt, Homo sapiens
gggcaaggggugcaggcggguuguccagggggcugcguggagg

SEQ ID NO: 145601 - RNA, 62 nt, Homo sapiens
ggagggaggggcaggagugcggggucuacaccccuaacugcgccccaggacugcagugccau

SEQ ID NO: 145602 - RNA, 31 nt, Homo sapiens
gaggccgcugccuuccggcccgcgcgccugc

SEQ ID NO: 145603 - RNA, 49 nt, Homo sapiens
acuugaguagggacugagggcaggcuagggcguagguuaggggagaggg

SEQ ID NO: 145604 - RNA, 26 nt, Homo sapiens
caucucaggccugggagggguggguu

SEQ ID NO: 145605 - RNA, 38 nt, Homo sapiens
caucacucaacaaaaaaccgaggcccucaauccaccuu

SEQ ID NO: 145606 - RNA, 38 nt, Homo sapiens
gguguuggcuggggugucaauaaagcugugcuuggggu

SEQ ID NO: 145607 - RNA, 48 nt, Homo sapiens
gggccucugagaugcacacgcaugacccugaagcaacucgagaggccu

SEQ ID NO: 145608 - RNA, 41 nt, Homo sapiens
cgacccagccaauccacaagggaggaggccacuaggccaaa

SEQ ID NO: 145609 - RNA, 46 nt, Homo sapiens
ccggucauaguucuccccccaguuucgaagggccaaggccccugcc

SEQ ID NO: 145610 - RNA, 46 nt, Homo sapiens
gcccaacagcagcacgcggcgguccgacaggaggcagcgcaggccu

SEQ ID NO: 145611 - RNA, 45 nt, Homo sapiens
cugucggaccgccgcgugcugcuguugggcaccauacaagcucua

SEQ ID NO: 145612 - RNA, 68 nt, Homo sapiens
gcuggcugccaugaagcuggagaagauaaugcccagaggggccccguguggguccagcacaggugucc

SEQ ID NO: 145613 - RNA, 63 nt, Homo sapiens
ucgccaccuccaagagguaccaccuucagcccaugcaccugcugucccuugcugugcucaucg

SEQ ID NO: 145614 - RNA, 46 nt, Homo sapiens
ccggacucuccuggccugggcugguagagaaagucaacaugaagag

SEQ ID NO: 145615 - RNA, 46 nt, Homo sapiens
ccuuucuacuuauugaguuggcuuguggauuauacuuucccagcau

SEQ ID NO: 145616 - RNA, 43 nt, Homo sapiens
ugcacucacuggcuugccuagggcuccuuguccuccaugacag

SEQ ID NO: 145617 - RNA, 52 nt, Homo sapiens
ggaggacaugaugggggugauggacuggaaagaaggugccaaaaguucccuc

SEQ ID NO: 145618 - RNA, 34 nt, Homo sapiens
ggauauuucacagucuuuaauggcuuauguuuuu

SEQ ID NO: 145619 - RNA, 75 nt, Homo sapiens
gggaguaaaucaguggcucucccaauacagugaacagcagucggcugccaucugggcuccagcagccagucuggg

SEQ ID NO: 145620 - RNA, 49 nt, Homo sapiens
ccucucacaaguccacaucugggccucccagacucugagccagagaaaa

SEQ ID NO: 145621 - RNA, 46 nt, Homo sapiens
aaggagugguagccaggauuuugcugccgucuggggaccagagcag

SEQ ID NO: 145622 - RNA, 56 nt, Homo sapiens
ggagaggacaggaaaaauagggcuaaaagaggcugagccaacaggugucgggggug

SEQ ID NO: 145623 - RNA, 53 nt, Homo sapiens
cagaacaacggccaaccagaauccgggauaugcuugggcaaaauccuaguggg

SEQ ID NO: 145624 - RNA, 42 nt, Homo sapiens
aaaccagucaaccggcaggcgggcucccugagacguagggau

SEQ ID NO: 145625 - RNA, 42 nt, Homo sapiens
cugcugccacucuguuccuuugagguagggguagccccagag

SEQ ID NO: 145626 - RNA, 46 nt, Homo sapiens
gauaaucuguugguuugcaccugguaugaucuguauuugaccagaa

SEQ ID NO: 145627 - RNA, 46 nt, Homo sapiens; identical to SEQ ID NO: 54040

SEQ ID NO: 145628 - RNA, 46 nt, Homo sapiens
ugagccuccagaugucugguuuugcuggauguucagagcaucagac

SEQ ID NO: 145629 - RNA, 45 nt, Homo sapiens
ggaugaugaugggaccagaguuuggaacagccugaagcuggaggu

SEQ ID NO: 145630 - RNA, 47 nt, Homo sapiens
ggguaggcugggguaagaaguguaagaagaaacuggggucaaacaaa

SEQ ID NO: 145631 - RNA, 46 nt, Homo sapiens
ugggcuaucauucccaugaucaugugcuucccuuucccuuaggaac

SEQ ID NO: 145632 - RNA, 45 nt, Homo sapiens
gaauguaggcuccaaacuuccuguggaagagacugaguggcucac

SEQ ID NO: 145633 - RNA, 43 nt, Homo sapiens
ucuguguagcacccacagagugccaguuggaaaucccugaagg

SEQ ID NO: 145634 - RNA, 44 nt, Homo sapiens
uccuugguaccugaucuccaaaacucuugaucugaucccaaggu

SEQ ID NO: 145635 - RNA, 41 nt, Homo sapiens
ccuuucccccacccccucccuaguggaagugcuugccuacu

SEQ ID NO: 145636 - RNA, 48 nt, Homo sapiens
accccugugaaaaaccuugaaauauaacacuccaugcaggcccagcug

SEQ ID NO: 145637 - RNA, 46 nt, Homo sapiens
ugcaccgccuagaagaggaacuggugaugaggaggagggaggagcu

SEQ ID NO: 145638 - RNA, 30 nt, Homo sapiens
gggguguguuuuagaaugaggcucucaccu

SEQ ID NO: 145639 - RNA, 83 nt, Homo sapiens
ucagggagcuaguuuuguguguguguuugcgcgcgcgcgcgcgcgcagagagagugugcggggcuuaaggcgauccuccgggg

SEQ ID NO: 145640 - RNA, 44 nt, Homo sapiens
guggggauggaggaacuggggaccuggacccgacgccugugggg

SEQ ID NO: 145641 - RNA, 41 nt, Homo sapiens
ugugacagcgccccggguccgguggagggcagcggggggag

SEQ ID NO: 145642 - RNA, 42 nt, Homo sapiens
gcuguaagaagguggguaggacgugggagaguuagaggagcg

SEQ ID NO: 145643 - RNA, 47 nt, Homo sapiens
cccugauucuuuggcucaauuuggaaguucucuuaggggauugggag

SEQ ID NO: 145644 - RNA, 36 nt, Homo sapiens
guccuaccaaacaucuugcaaugagauuggucccug

SEQ ID NO: 145645 - RNA, 42 nt, Homo sapiens
gucuucucacaagacuuucaggauuaagcgauuccuggccaa

SEQ ID NO: 145646 - RNA, 78 nt, Homo sapiens
gaaggucacgaucauguuaccauaucaagcugaaaaugucaccacuaucuggagauuucgacguguuuuccucucuga

SEQ ID NO: 145647 - RNA, 27 nt, Homo sapiens
guggggagaaagacgcugugggagagg

SEQ ID NO: 145648 - RNA, 50 nt, Homo sapiens
gagcugcggucagcccugcgugugcuccagaaggaaaaggagcaguuaca

SEQ ID NO: 145649 - RNA, 46 nt, Homo sapiens
cuggagcuagaggaugacauccagaccaucagugagaaagugcuga

SEQ ID NO: 145650 - RNA, 45 nt, Homo sapiens
ugaccugaugcagcugaagcuacagcuggagggacaggugacaga

SEQ ID NO: 145651 - RNA, 57 nt, Homo sapiens
uuaugauuaugauagaggggcaguggguuugggaaagaaaggaaggagagggacagg

SEQ ID NO: 145652 - RNA, 42 nt, Homo sapiens
ucuaguccccuguccuacccaaagaaggaaaaaugggggagu

SEQ ID NO: 145653 - RNA, 45 nt, Homo sapiens
cacagugguauuccaggaagaauucaugcaauuauucggauaauu

SEQ ID NO: 145654 - RNA, 45 nt, Homo sapiens
gcguuuuacccgggcagcuagcaaagaaagaugcugcagucggug

SEQ ID NO: 145655 - RNA, 45 nt, Homo sapiens
uggcgugcggagaaacaaauauauuggauauuugcuggucuaggg

SEQ ID NO: 145656 - RNA, 44 nt, Homo sapiens
ggauaacgcgucaucucgccuucccaaauuuuccccccucgcua

SEQ ID NO: 145657 - RNA, 46 nt, Homo sapiens
gccgaguagggauaggagaucugacgagagggggccuggggcagga

SEQ ID NO: 145658 - RNA, 46 nt, Homo sapiens
ccccaggcccccucucgucagaucuccuaucccuacucggcccaag

SEQ ID NO: 145659 - RNA, 24 nt, Homo sapiens
gagggagcgagagagggagggcga

SEQ ID NO: 145660 - RNA, 41 nt, Homo sapiens
ggagcauuuaaggaaguauggggagccgggcugccgaggag

SEQ ID NO: 145661 - RNA, 45 nt, Homo sapiens
auguguucgcggguccucgagcagaaacccaagcaacucuggggu

SEQ ID NO: 145662 - RNA, 45 nt, Homo sapiens
agaaaucuggggggaaagcugagaacaggcgcgaagcagugaaau

SEQ ID NO: 145663 - RNA, 43 nt, Homo sapiens
gcgugucgcccugagguuugaggccagacagcucgcagucggg

SEQ ID NO: 145664 - RNA, 42 nt, Homo sapiens
cacagcugcgagcuaaagcugggguuucccccuccccaacaa

SEQ ID NO: 145665 - RNA, 24 nt, Homo sapiens
uuugaagcggaccugcagauuucc

SEQ ID NO: 145666 - RNA, 43 nt, Homo sapiens
acuuaggcaggguagagugaauuuaaaggaggggugcaauuuc

SEQ ID NO: 145667 - RNA, 46 nt, Homo sapiens
ggcguccccaucccaucuuccugcgcacccuccuuugcccccaacu

SEQ ID NO: 145668 - RNA, 43 nt, Homo sapiens
aucgcaggucgcggggagcagcagagagaagggggugggagag

SEQ ID NO: 145669 - RNA, 41 nt, Homo sapiens
ggaaagaaggagaaacagcaggggagggggugcagaccccu

SEQ ID NO: 145670 - RNA, 71 nt, Homo sapiens
gcagaggguggugagggguuuagggauucucagggucaggaagcagaacugcuaaaauuucaggacuuggu

SEQ ID NO: 145671 - RNA, 46 nt, Homo sapiens
acaggcgggggagagacgaaaaagaaaaggaaagagcaagauagac

SEQ ID NO: 145672 - RNA, 34 nt, Homo sapiens
ccaggcccggggagggaugaccuggaccaaauac

SEQ ID NO: 145673 - RNA, 24 nt, Homo sapiens
ccugggcuguuagaggaaagagcu

SEQ ID NO: 145674 - RNA, 42 nt, Homo sapiens; identical to SEQ ID NO: 54097

SEQ ID NO: 145675 - RNA, 45 nt, Homo sapiens
uccagcagaucaauuauuuuucuuauuggaaaagcauuaggcaga

SEQ ID NO: 145676 - RNA, 80 nt, Homo sapiens
guggaaaaaggagaacaacaaggauaaacugccgggagcccgagaugaggagaagguggaggaagaaggaaaugaggaag

SEQ ID NO: 145677 - RNA, 50 nt, Homo sapiens
aggagaaagaagaggaggaaaaggaagaaaacaaggacuaagcaaaaaag

SEQ ID NO: 145678 - RNA, 46 nt, Homo sapiens; identical to SEQ ID NO: 54101

SEQ ID NO: 145679 - RNA, 45 nt, Homo sapiens
uauuuguuugggggcuggaggggggagacggagaaacagugaaaa

SEQ ID NO: 145680 - RNA, 47 nt, Homo sapiens
ucuugaaaaagaaaaagagaaaaauuuuaaaauccugcuauaggaga

SEQ ID NO: 145681 - RNA, 45 nt, Homo sapiens
ggccucacacacaauggacacauauuuuucuucagcgaugucaga

SEQ ID NO: 145682 - RNA, 50 nt, Homo sapiens
cauugacaaggaaggagaagaaaaaagaauuuaugcaaaggcugggucag

SEQ ID NO: 145683 - RNA, 149 nt, Homo sapiens
gagaggaagugaucugacaaaguucuaaagcuagaacuuggcagaguuggcaucugaacucugaucugcuugaugacaaacuuaaagcccuuccauugcugcaugcuuuuugaagggagggaugggacacaugugaacuugggccagga

SEQ ID NO: 145684 - RNA, 39 nt, Homo sapiens
ucagcaggaguugugggggaggguggguggggagcagag

SEQ ID NO: 145685 - RNA, 35 nt, Homo sapiens
aguaacaaaaauaaaauuacaagaguaauucgugu

SEQ ID NO: 145686 - RNA, 42 nt, Homo sapiens
gcuuuccuccccgaguuuagggacuaaggugguagcuggcag

SEQ ID NO: 145687 - RNA, 39 nt, Homo sapiens
ugguuccuaaagaugguucccaggucaugggaggaauag

SEQ ID NO: 145688 - RNA, 46 nt, Homo sapiens
ccuggcagccagggauaagugcacuugagcaaaagacagaaaggug

SEQ ID NO: 145689 - RNA, 42 nt, Homo sapiens
uggcuguuggggugggggggucccugcccauucagcugggag

SEQ ID NO: 145690 - RNA, 46 nt, Homo sapiens
aaaggucacagugagacuacuuuucuggauguucgaugguagaggu

SEQ ID NO: 145691 - RNA, 44 nt, Homo sapiens
uguccccaaaauggggugacgaugugcacaaggacaguggaggc

SEQ ID NO: 145692 - RNA, 40 nt, Homo sapiens
agggucccuccugaggcccagggauuugggguaggggaag

SEQ ID NO: 145693 - RNA, 56 nt, Homo sapiens
uccugcuggugguuggagggguugccaugagagugaacagaaagcuaacuugaagu

SEQ ID NO: 145694 - RNA, 52 nt, Homo sapiens
ugugcuaacaagcaggagaagccaggagcagcccucacagcaucacacggag

SEQ ID NO: 145695 - RNA, 50 nt, Homo sapiens
uugggaguaguauuaguuguggacauguuagcuuugagauaccuguuaag

SEQ ID NO: 145696 - RNA, 137 nt, Homo sapiens
uucaaacccuucccuucaagccgccuugccuucuccccaugacuuagagaccccaccacaccaggcuguccgcugaguccucagccuuucuccaccugugugcccguggggaaggccugcagacugggaacagcuag

SEQ ID NO: 145697 - RNA, 101 nt, Homo sapiens
ggauagggcaggggaggccgugugucggagaagagagaagcagggaguuggccaggacugaggcagagggcaggagcaagcagggcucagggcugguaaug

SEQ ID NO: 145698 - RNA, 48 nt, Homo sapiens
aaauaggggcuugggaagcaguggaagagaagagaggagguaucagaa

SEQ ID NO: 145699 - RNA, 46 nt, Homo sapiens
uaggccacacacuuauuccaaaggucagcagaacgcucagucccca

SEQ ID NO: 145700 - RNA, 39 nt, Homo sapiens
uggggcgaguuuggugguuugguaaauuaaaaucagggu

SEQ ID NO: 145701 - RNA, 51 nt, Homo sapiens
auuccacaaucaaugcaaacuuugaucaacaguucuucuugacccccugua

SEQ ID NO: 145702 - RNA, 46 nt, Homo sapiens
uggagaauggugaucugcagagauccucuucauucacaacucaaaa

SEQ ID NO: 145703 - RNA, 48 nt, Homo sapiens
uucucuccuucaaggcauggggcaagggagaaauacugacauggaaaa

SEQ ID NO: 145704 - RNA, 46 nt, Homo sapiens
agaucuauacugcuuuuguauaccacugucaggccuuccaagaggg

SEQ ID NO: 145705 - RNA, 45 nt, Homo sapiens
uccuuaugcuuggccuuucccuacuucuaaugucaagaaugaagc

SEQ ID NO: 145706 - RNA, 54 nt, Homo sapiens
ucuucuauuacccaucuacacggguaacagagaacagagggcuagugggaaggu

SEQ ID NO: 145707 - RNA, 35 nt, Homo sapiens
aggcccugaaaagaagcccaaagagggggcagggu

SEQ ID NO: 145708 - RNA, 45 nt, Homo sapiens
ccgguguaccaccugcuggggaucacucucuaggaucacccugca

SEQ ID NO: 145709 - RNA, 48 nt, Homo sapiens
caaggaagaugugucuugagucucuaguuucacucagauuugagaggu

SEQ ID NO: 145710 - RNA, 45 nt, Homo sapiens
ugugauccccgagaugacccugagagcaucgauuggggaacuaga

SEQ ID NO: 145711 - RNA, 46 nt, Homo sapiens
uuaaacucuguugcaagugcaauaaaucugacccagugcccccacu

SEQ ID NO: 145712 - RNA, 66 nt, Homo sapiens
acuugcaacagaguuuaaauaaguccugggugucuggugccaaggugagggaaggguugggcagag

SEQ ID NO: 145713 - RNA, 51 nt, Homo sapiens
cccauuugaguucugauuccccuuggagcugggcucugggcccugggccag

SEQ ID NO: 145714 - RNA, 47 nt, Homo sapiens
ucaggacagaugccacacaaggauagaugcuggcccagggcccagag

SEQ ID NO: 145715 - RNA, 46 nt, Homo sapiens
ggaucucuggcaaggcugaggacagaucuuugcagguuggagcugg

SEQ ID NO: 145716 - RNA, 61 nt, Homo sapiens
ggggaacucagauccagggacagaggccccagccucccugaagccuuugcauuuuggagag

SEQ ID NO: 145717 - RNA, 46 nt, Homo sapiens
cuucagggaggcuggggccucugucccuggaucugaguucccccau

SEQ ID NO: 145718 - RNA, 52 nt, Homo sapiens
ccccccaugcacugugaaggacccuuguuuacacauacccucuucauggaug

SEQ ID NO: 145719 - RNA, 52 nt, Homo sapiens
gccuccagccaccucugaugccugaguccucccaauuucagacucccauucc

SEQ ID NO: 145720 - RNA, 41 nt, Homo sapiens
aauugggaggacucaggcaucagagguggcuggaggcuuga

SEQ ID NO: 145721 - RNA, 41 nt, Homo sapiens
aagggggggaucuuauaggaaggguuaggaugggaugcaug

SEQ ID NO: 145722 - RNA, 69 nt, Homo sapiens
acuguggaucaucauccuagccauccuguuuggccuccugcuccuaggucuacucaucuacauccucua

SEQ ID NO: 145723 - RNA, 48 nt, Homo sapiens
ccugcagugugaggcuguguacaaagcccugaagaugcccuaccgaau

SEQ ID NO: 145724 - RNA, 45 nt, Homo sapiens
aaugcaacugcagacuuuggcucucuuguuggugcaggggcccga

SEQ ID NO: 145725 - RNA, 75 nt, Homo sapiens
uguuucaggcugcgcugugagcucgggccccugcaccaacaagagagccaaagucugcaguugcauuuccgaguc

SEQ ID NO: 145726 - RNA, 55 nt, Homo sapiens
cccugcaccaccagcaaaaacgggaagcuccaagccgcagcucugcuuccucggg

SEQ ID NO: 145727 - RNA, 41 nt, Homo sapiens
gaguuacgggacucaacugcaccaccaaucaccccauuaac

SEQ ID NO: 145728 - RNA, 51 nt, Homo sapiens
gcugaguuccagcacacccuggcuaauggagcuggggccuugguugaugag

SEQ ID NO: 145729 - RNA, 46 nt, Homo sapiens
cucaucuccgggacacuaagaaaaccauccaguuugacuuccagau

SEQ ID NO: 145730 - RNA, 45 nt, Homo sapiens
acaacaucugugugccugaccugcagcuggaaguguuuggguaag

SEQ ID NO: 145731 - RNA, 44 nt, Homo sapiens
cagaauuucgagacaaacucucgccgauucacaucgcucucaac

SEQ ID NO: 145732 - RNA, 29 nt, Homo sapiens
ggccucugaaacaaugaggauggucggaa

SEQ ID NO: 145733 - RNA, 27 nt, Homo sapiens
agcagaagggagggguacggcgggcac

SEQ ID NO: 145734 - RNA, 45 nt, Homo sapiens
cgcuagugccucccucaccaucuuccccgccauguucaacccaga

SEQ ID NO: 145735 - RNA, 49 nt, Homo sapiens
acaccccagacuucuuuggcucugcccuucgaggaggccgagaccugga

SEQ ID NO: 145736 - RNA, 46 nt, Homo sapiens
gggcccccaggaaauacaaacacuacucccugcugggucuccccac

SEQ ID NO: 145737 - RNA, 69 nt, Homo sapiens
gccaucggggcucccuuugguggggagacccagcagggaguaguguuuguauuuccugggggcccagga

SEQ ID NO: 145738 - RNA, 45 nt, Homo sapiens
cgauuuggcagcuccuugaccccccugggggaccuggaccaggau

SEQ ID NO: 145739 - RNA, 44 nt, Homo sapiens
gggggucaaggagcugccaaaucggccaaacucaucauggccag

SEQ ID NO: 145740 - RNA, 42 nt, Homo sapiens
ugggcagggucuacgucuaccugcagcacccagccggcauag

SEQ ID NO: 145741 - RNA, 46 nt, Homo sapiens
auccuuaauggcucagacauucgaucccucuacaacuucucagggg

SEQ ID NO: 145742 - RNA, 46 nt, Homo sapiens
auuaccccgaguaccugaucaaccugguucaggggcagcugcagac

SEQ ID NO: 145743 - RNA, 46 nt, Homo sapiens
ccuugccagaaauagcuuccugguccaccuaaaaccacacggccag

SEQ ID NO: 145744 - RNA, 64 nt, Homo sapiens
ugggcaccugcuaccucuccacagauaacuucacccgaauucuggaguaugcacccugccgcuc

SEQ ID NO: 145745 - RNA, 41 nt, Homo sapiens
uccuucucugugcgccagcuguacaguggagcgcaugccug

SEQ ID NO: 145746 - RNA, 45 nt, Homo sapiens
uacaaguccuugcagugguucggggcaacaguucgagcccauggc

SEQ ID NO: 145747 - RNA, 42 nt, Homo sapiens
cacaggcuccucucccucugagcuggacagugaggacuccag

SEQ ID NO: 145748 - RNA, 48 nt, Homo sapiens
ugugcgugcguguguauguauguguguguguguauguguaugugugua

SEQ ID NO: 145749 - RNA, 23 nt, Homo sapiens
uggaggucuuggaggcaagagac

SEQ ID NO: 145750 - RNA, 59 nt, Homo sapiens
aaccucuucuucacccagaggaagagggagaggguauugcccaaguccacaguuagugc

SEQ ID NO: 145751 - RNA, 39 nt, Homo sapiens
guauugaacugggacuugguuaaucaaaagcuggggaga

SEQ ID NO: 145752 - RNA, 38 nt, Homo sapiens
gggcuaggccauagaugccagauuccugguccuccaca

SEQ ID NO: 145753 - RNA, 43 nt, Homo sapiens
gggcgaacucagccaagggcgggugcugggaugugucgggagg

SEQ ID NO: 145754 - RNA, 42 nt, Homo sapiens
ggggucuggaggggaccagggcuuaaguuugaggguggaguu

SEQ ID NO: 145755 - RNA, 54 nt, Homo sapiens
agucaaaaaagagacacaguugauucacaggcuggagguuugaacuugaguaag

SEQ ID NO: 145756 - RNA, 73 nt, Homo sapiens
gggcaguguccuccccagcccaggugccacuaggcacagcacaagagacuaaaaacaacaggggaaggcugga

SEQ ID NO: 145757 - RNA, 82 nt, Homo sapiens
cacucaagguuugggaguauaagcaccccacuucuggcucagggauuuggggaguaggguaaacaaaaccuacuuggaaaag

SEQ ID NO: 145758 - RNA, 46 nt, Homo sapiens
acuggccuuaagaggagaaccagauggcugaugggagaauccacag

SEQ ID NO: 145759 - RNA, 69 nt, Homo sapiens
ggcagugaccucacaaggacagcacaguuuuugcagcuuagagaucacccaccugccccuaccuagcua

SEQ ID NO: 145760 - RNA, 46 nt, Homo sapiens
ugguguagggccacucuccggccccgagggaguggauggcucugua

SEQ ID NO: 145761 - RNA, 45 nt, Homo sapiens
gaauuucuucuucuucuugggggucuccuugggggggaccucccc

SEQ ID NO: 145762 - RNA, 76 nt, Homo sapiens
ggaagaaacaggagcuaggcagaagccuugagcagggaagaguucuucccuuagcccugacuuuacuugcuguggg

SEQ ID NO: 145763 - RNA, 47 nt, Homo sapiens
aucuccucugacagacaaaaagaaauggauagcugcagcaagaagga

SEQ ID NO: 145764 - RNA, 52 nt, Homo sapiens
uacugagugacaccaagcccucccaacuugaaccucagagccccacuguggc

SEQ ID NO: 145765 - RNA, 33 nt, Homo sapiens
uccagaugaugguugaacaucaccuggggcaac

SEQ ID NO: 145766 - RNA, 46 nt, Homo sapiens
ccuccuuguucagaucucaguggaugggaaagucaaacacccagca

SEQ ID NO: 145767 - RNA, 41 nt, Homo sapiens
ugcccuucacaguccacuuuggcaaugucuccacggcaacg

SEQ ID NO: 145768 - RNA, 56 nt, Homo sapiens
ccgcccaucucuaggaucuuuuugacucccgcuucccuguaccucuaccccccaaa

SEQ ID NO: 145769 - RNA, 50 nt, Homo sapiens
gaguccuugaacugacuucaacaacaaucaacuuuauuggcagcgugaca

SEQ ID NO: 145770 - RNA, 73 nt, Homo sapiens
cagcauggguuguguucccugggagucaggggaaaggcugcuaugccuggaggcagggcaucagccaggauaa

SEQ ID NO: 145771 - RNA, 71 nt, Homo sapiens
ccgccuucccucccgccgcagcgcgggcccaccggccgccgccccagccauggagcaagacaacagccccc

SEQ ID NO: 145772 - RNA, 65 nt, Homo sapiens
guuuacugcucuuucagggauuucuaagccaccagaaucucacacagacguguguaggugguugu

SEQ ID NO: 145773 - RNA, 46 nt, Homo sapiens
aaagccauggauucugauuaguuugcacaaaauuacauggguagaa

SEQ ID NO: 145774 - RNA, 46 nt, Homo sapiens
gucguacccuucaaaguaccaggaaaagauacaguuaccaaacaua

SEQ ID NO: 145775 - RNA, 46 nt, Homo sapiens
accaagccaugaccacagguguugguuugauugcuucuggccagug

SEQ ID NO: 145776 - RNA, 61 nt, Homo sapiens
uacacuuuuaaaaagugcacuucugaugcacuucucacugcaucagaauggucccucagau

SEQ ID NO: 145777 - RNA, 37 nt, Homo sapiens
guaaauggccaagaccuaaagaaccugcugcaccagg

SEQ ID NO: 145778 - RNA, 46 nt, Homo sapiens
gaauggaccuauaggacaucgaggugaaggggacccaagugguauu

SEQ ID NO: 145779 - RNA, 46 nt, Homo sapiens
ccacaguucucuuugcgcacaucgugcucacaguuccguccguaga

SEQ ID NO: 145780 - RNA, 45 nt, Homo sapiens
gggacccccaggcuguaaaggagaggggugaggcacaguuaucug

SEQ ID NO: 145781 - RNA, 45 nt, Homo sapiens
ggaaugaaagaccugcaguuggugguguggguucuccuggggcug

SEQ ID NO: 145782 - RNA, 50 nt, Homo sapiens
gcucccuggcuuucucuuuuuccuccugaagggaacauggaagacaagga

SEQ ID NO: 145783 - RNA, 41 nt, Homo sapiens
ccuuccuccccugaguguuggggguggggguucuccaugug

SEQ ID NO: 145784 - RNA, 42 nt, Homo sapiens
gccagagccuaaggcgagucugagccaugugcacuuccuagg

SEQ ID NO: 145785 - RNA, 50 nt, Homo sapiens
uagaaauggcacuuguggguuuuaaucucaugguccucuuagagcccugg

SEQ ID NO: 145786 - RNA, 46 nt, Homo sapiens
cggcagggcaugcaccucaccagacaucagagaacacacacaggag

SEQ ID NO: 145787 - RNA, 41 nt, Homo sapiens
ggaaaacuucucucauagauccaauuuaaucaggcaccaga

SEQ ID NO: 145788 - RNA, 52 nt, Homo sapiens
cccucuuggucuuuuuaaagccaaggugcgauuugggcaccugacuguccag

SEQ ID NO: 145789 - RNA, 48 nt, Homo sapiens
caaaaaggaaccagaggcccaagggcaauaauaagguggaauuugcag

SEQ ID NO: 145790 - RNA, 45 nt, Homo sapiens
uuuggggaacaguuccuacucaguggaggaccucugucccauagg

SEQ ID NO: 145791 - RNA, 45 nt, Homo sapiens
ucagcauuugggggacugaacuaguagcgaaagcaagguccaagg

SEQ ID NO: 145792 - RNA, 49 nt, Homo sapiens
uaagggcagccgggcccgcggcuuggcgcccaccccacccccuugcccu

SEQ ID NO: 145793 - RNA, 65 nt, Homo sapiens
ucuuacuugaaaguuuaaaggaucacauaucaaccaccgcccaggaccacugcaaagccauuuac

SEQ ID NO: 145794 - RNA, 56 nt, Homo sapiens
cugcauguccucaccaccaacaacacagcaauaaacuucuaugaaaacagagacuu

SEQ ID NO: 145795 - RNA, 46 nt, Homo sapiens
ggcucugcacuagccagccugagccccugcuccauuccgcacagag

SEQ ID NO: 145796 - RNA, 45 nt, Homo sapiens
cccgcagagcccgccuuccuguccaucugaccccuucuguuuucu

SEQ ID NO: 145797 - RNA, 48 nt, Homo sapiens
cucaugcuccuggagcacccaggcccagcuguguggcccauaggcagg

SEQ ID NO: 145798 - RNA, 65 nt, Homo sapiens
cuguucuugcagcuccuuccuggaaagcuggaggggacuuucuccugcaagggaggaacgcaagu

SEQ ID NO: 145799 - RNA, 45 nt, Homo sapiens
aagggaauggcccguccccuuccagaaccagcccaaagaagccug

SEQ ID NO: 145800 - RNA, 46 nt, Homo sapiens
cccaguccuggcacucgggaucccuauggccucuccagggccccag

SEQ ID NO: 145801 - RNA, 41 nt, Homo sapiens
gaaggaaaugacauugagcuuguuucaaauucagcggcuuu

SEQ ID NO: 145802 - RNA, 24 nt, Homo sapiens
gagaagacugaggaagaauuacaa

SEQ ID NO: 145803 - RNA, 39 nt, Homo sapiens
gucccauccucauguggcugugcaagggaggacacauac

SEQ ID NO: 145804 - RNA, 31 nt, Homo sapiens
aggacugacaccacagaugacagccccaccu

SEQ ID NO: 145805 - RNA, 48 nt, Homo sapiens
ccaggaggagcgcgcacagcuccugcagcccacgcuggagaucaaccc

SEQ ID NO: 145806 - RNA, 35 nt, Homo sapiens
ugggugaccuucaccccugguaagauccugccagc

SEQ ID NO: 145807 - RNA, 54 nt, Homo sapiens
uaugggccucaggcaaccugaagcauccuuugagguuuuacuuuuagaugaaaa

SEQ ID NO: 145808 - RNA, 40 nt, Homo sapiens
agccacccccgagaagagccuugugggagcacccugguga

SEQ ID NO: 145809 - RNA, 47 nt, Homo sapiens
cugaucucuguggagacggacauagucguggaucacuacaaggagga

SEQ ID NO: 145810 - RNA, 46 nt, Homo sapiens
gacguuuuacagcagaggcugaucaaauucuucauugaccagagua

SEQ ID NO: 145811 - RNA, 48 nt, Homo sapiens
agacggacgcaccgcucaacauccgcagcaucuucuacgugcccgaca

SEQ ID NO: 145812 - RNA, 67 nt, Homo sapiens
cugugcagccaccccgcaucaauuccagaacaucccaucaccccaaaaagcagcccuuuccccacug

SEQ ID NO: 145813 - RNA, 46 nt, Homo sapiens
ccuuccuggaugcucugcagaaccaggcugaggccagcagcaagau

SEQ ID NO: 145814 - RNA, 45 nt, Homo sapiens
ugacacaggaagagcugguguccaaccuggggacgauugccagau

SEQ ID NO: 145815 - RNA, 40 nt, Homo sapiens
auugagguuugugguuuuuccuuuaggguguaggagaaac

SEQ ID NO: 145816 - RNA, 707 nt, Homo sapiens
cauauagcagcaguuucaaaugagcagcacaggcugggcgugguggcucagaccuguaaucccagcagcuuugggaggcuaagguaggaagauugcuugagaccaggagcuuaagaccagccuggucaacauggaaacacccuaucucuaggaaaaaaaaaaaaaaaagaauuuaguccugugugauggugcuuaccugcagucccagcuguucaggagaguaaagcaggaaggucccuugagcccaggaguucaagacugcagugagccaugacuguaccacugcacuccagccugggugacagagcaaucucuuuucuaagaaagaaagaaauaguaaauacaugaauaaaucuuuuuuuuuuuuuuuuuuuuuugagacggaguuucacucuugucacccaggcugcuggagugcaauggcacaaucucggcucaccgcaaccucugccucguggguucaagugauucuccugccucagccucccgaguagcggggauuacaggcacccagugcuaauuuuguauuuuuaguagagaugggguuucacccuguuggucacgcuggucuugaacuccugaccucaggugauccacccgccucggccucccaaagugcugggauuauggugugagccacugcgccuggccaguauaaaauuuuuuuaaaugggcagcauaaaaaguuaagugcagugaacucauag

SEQ ID NO: 145817 - RNA, 69 nt, Homo sapiens
agcagguggacucgaugucguugacgcagcuguguccucggggccuggaauugauggaugcgccaauaa

SEQ ID NO: 145818 - RNA, 34 nt, Homo sapiens
cgccaggaaagacugaggccgcggccugccccgc

SEQ ID NO: 145819 - RNA, 45 nt, Homo sapiens
gugggggauggggagcaguccccugaguuuacucucuucucccag

SEQ ID NO: 145820 - RNA, 99 nt, Homo sapiens
cccccagcacgugccccuaagagcuggccugcacaccuggccuugcagggcugaggacuccacaugcaucccccacugcagcccugaagugucccagau

SEQ ID NO: 145821 - RNA, 46 nt, Homo sapiens
accuuccguggccugcggcgccucgagcgccucuaccugggcaaga

SEQ ID NO: 145822 - RNA, 52 nt, Homo sapiens
gccuucgacacgcucgaccgccuccuggagcucaagcugcaggacaacgagc

SEQ ID NO: 145823 - RNA, 46 nt, Homo sapiens
cuccacgaccuggauguguccgacaaccagcuggagcgagugccac

SEQ ID NO: 145824 - RNA, 48 nt, Homo sapiens
ccaggcggacccugggggccagugaaggaagcucccggaaagagcaga

SEQ ID NO: 145825 - RNA, 56 nt, Homo sapiens
uuggggacagugauggacacacagcaccuuuuccuguuacccucagugggauggag

SEQ ID NO: 145826 - RNA, 45 nt, Homo sapiens
ccaacuggcuccacucaccguccugucagccgagccuguggccag

SEQ ID NO: 145827 - RNA, 38 nt, Homo sapiens
gcccagccaggggcaggggcgacccggggcggcaggga

SEQ ID NO: 145828 - RNA, 42 nt, Homo sapiens
agcgguucauggcgacgggcacggcggcggacgcgucuucga

SEQ ID NO: 145829 - RNA, 41 nt, Homo sapiens
ccuccugccugucugugucuccggcaauugugcauccgcgu

SEQ ID NO: 145830 - RNA, 52 nt, Homo sapiens
gcuaacugccauucggagaggccuagguacuuuguuacaacaacccugcaag

SEQ ID NO: 145831 - RNA, 46 nt, Homo sapiens
agaagauuauuaucagauauuaggagugccucgaaaugccagccag

SEQ ID NO: 145832 - RNA, 46 nt, Homo sapiens
auccucuucauuuggagauuuccagaccguguuugaucagccucag

SEQ ID NO: 145833 - RNA, 98 nt, Homo sapiens
ucaccgugaacaucauggacacgugugagcgcugcaacggcaaggggaacgagcccggcaccaaggugcagcauugccacuacuguggcggcuccggc

SEQ ID NO: 145834 - RNA, 101 nt, Homo sapiens
gcccuuuugugaugcguuccacguguaggagaugugguggccgcggcuccaucaucauaucgcccuguguggucugcaggggagcaggacaagccaagcag

SEQ ID NO: 145835 - RNA, 45 nt, Homo sapiens
uuguaggagucgaggauggccagaccgugaggaugccugugggaa

SEQ ID NO: 145836 - RNA, 42 nt, Homo sapiens
gcucaggcucuucuuggggguacagccagagcccagggccug

SEQ ID NO: 145837 - RNA, 45 nt, Homo sapiens
ggcaucccccggauuaacagcuacggcuacggagaccacuacauc

SEQ ID NO: 145838 - RNA, 44 nt, Homo sapiens
aggaggcuaacgagccggcagcagagccugauccugagcuacgc

SEQ ID NO: 145839 - RNA, 43 nt, Homo sapiens
uguuuaaauuauucagugcuaaucauuguuuuuuccuuuguaa

SEQ ID NO: 145840 - RNA, 36 nt, Homo sapiens
aaagagggaggaggauugaaagggaggaaauugaag

SEQ ID NO: 145841 - RNA, 40 nt, Homo sapiens
gaucccugggguggugcuggggaguugaggggcugguggg

SEQ ID NO: 145842 - RNA, 33 nt, Homo sapiens
ggacaggcagugaggggcacuagggagaggggg

SEQ ID NO: 145843 - RNA, 62 nt, Homo sapiens
cagccagguaugagagccacagaacuagcacagaggcacuccacugggaccaugguggccug

SEQ ID NO: 145844 - RNA, 34 nt, Homo sapiens
augccuugaauagugagggugugguucacuacag

SEQ ID NO: 145845 - RNA, 35 nt, Homo sapiens
gcuucucuccuugcccagcccugugguccuuaccc

SEQ ID NO: 145846 - RNA, 34 nt, Homo sapiens
gaagcugggccuggggccgagggagaaguggagu

SEQ ID NO: 145847 - RNA, 44 nt, Homo sapiens
aaaaacaaaacaugauuuugugcaauuaacaaagcuacugcaag

SEQ ID NO: 145848 - RNA, 60 nt, Homo sapiens
cuugugaaaaagcuuguaagaaagccccucccuuuuuucuuuaaaccuuuaaaugacaaa

SEQ ID NO: 145849 - RNA, 60 nt, Homo sapiens
ggcggaacacacugggggugggggcgggggaagaugcgguaaugaaaccgguuagucaau

SEQ ID NO: 145850 - RNA, 47 nt, Homo sapiens
guuuuuagcacaguucauuucacugggauuuugaagcauuucugucu

SEQ ID NO: 145851 - RNA, 46 nt, Homo sapiens
ggagacaguauuucuuucugucugucccuuuggcccagacccagcc

SEQ ID NO: 145852 - RNA, 72 nt, Homo sapiens
ugcauuccaucccuugggagggaguccucagggccacuagugaugagccaagaggaguggggguugggggcg

SEQ ID NO: 145853 - RNA, 58 nt, Homo sapiens
uguucacacacacacacacacacacacacacacacacacacaggcucucgccccagga

SEQ ID NO: 145854 - RNA, 27 nt, Homo sapiens
gugaugagcagccguggccacucagca

SEQ ID NO: 145855 - RNA, 39 nt, Homo sapiens
cccaggcuuacaagagugggcaguuaaguuacucuagag

SEQ ID NO: 145856 - RNA, 42 nt, Homo sapiens
aagggauccgcccugggaagugcuacguggacaugucaacag

SEQ ID NO: 145857 - RNA, 45 nt, Homo sapiens
gcagcugacagcacagccgugaauggcagcaucacacccacagac

SEQ ID NO: 145858 - RNA, 75 nt, Homo sapiens
cuguaaagccccauucauugucaguggauuagagaagagaggggucaagaagggcucuaaagauaucggccuagu

SEQ ID NO: 145859 - RNA, 57 nt, Homo sapiens
gugcuaacgagcuagagagcagugacgggggaagaaauaggacuugagguuggagau

SEQ ID NO: 145860 - RNA, 31 nt, Homo sapiens
gccccgugaggauuaauggaaaaagcugacc

SEQ ID NO: 145861 - RNA, 43 nt, Homo sapiens
aggugagagacacggccuggaugcagguguaaaguaggagcgc

SEQ ID NO: 145862 - RNA, 50 nt, Homo sapiens
caaacuuagccugucugaagggaaggugaagaagaacaugggagaaggaa

SEQ ID NO: 145863 - RNA, 37 nt, Homo sapiens
ucuagggucauugugaggagaccacacagagugccug

SEQ ID NO: 145864 - RNA, 110 nt, Homo sapiens
ucaaaguggaacagcugaagccauaucaugcucauaaagaggaaaugauaaaaauuaacaaggguaaacgauuccagcaagcgguagaugcugucgaagaguuccucagg

SEQ ID NO: 145865 - RNA, 51 nt, Homo sapiens
cuggguguuauggaaaggaagaggcucccugccugagguaacuugugcuua

SEQ ID NO: 145866 - RNA, 46 nt, Homo sapiens
agccugugguggcaguauuucaaggagaucgcuggccuggagcugu

SEQ ID NO: 145867 - RNA, 46 nt, Homo sapiens
ucgcggaaagaaaugcuucuuugugaaauuuuuuggaacagaagau

SEQ ID NO: 145868 - RNA, 46 nt, Homo sapiens
cugggcgcgggguucgcugccggcccuggagcugccuuuuuaugcg

SEQ ID NO: 145869 - RNA, 46 nt, Homo sapiens
cuggugaagaauauccgagggaagguaaaaggccuucagccuggag

SEQ ID NO: 145870 - RNA, 45 nt, Homo sapiens
ucagugccaagugaucagucggucuuauucacaggugugcuguuc

SEQ ID NO: 145871 - RNA, 373 nt, Homo sapiens
acaggagucuuauuaaaauuaggauuccuggcuccuggcugggugugguggcucucgccuguaaucccagcacuuugggaggcugagaugggcagaucauuugagcccaggagcuugagaccagccugggcaacaugaugaaacccuaucuauacaaaaaacuuaaaaaaaaaaaauuuagcuaggcauaguguuguaugccuauagucccagcuauucaggaggcugaggcaggaggaucacccgagccuggggagguugaggcuacagugagucaugauugugccacugcacugcagccugagugacagagugagacucuuaucucaaaaaaaaaaaaaaaaaauuuuuuuuuuuggauuccuugcucaca

SEQ ID NO: 145872 - RNA, 46 nt, Homo sapiens
gucagauccuuucaaugacgaagaaaaggaaaggcauaaaguagag

SEQ ID NO: 145873 - RNA, 50 nt, Homo sapiens
uuuuauacagguacaaauauguucuauguuaaaagguuuucaggaaagga

SEQ ID NO: 145874 - RNA, 45 nt, Homo sapiens
aaggagaagaaaucgaaaaaguccaaguuuuccaaagccggguga

SEQ ID NO: 145875 - RNA, 87 nt, Homo sapiens
aagaagaagaagaaauauucuggggcuuuaagcguuaaagagaugcuaaagaaauuucagaaagagaaagaggcucagaaaaaaagg

SEQ ID NO: 145876 - RNA, 54 nt, Homo sapiens
gcccagagaaacucuuagugaguuggcaguuaaggugucagcuuuuuccaaacc

SEQ ID NO: 145877 - RNA, 140 nt, Homo sapiens
ccgcagucgacucuucaguauaaagccagacccucagagauauugucuaugcaauucaaaagguuuacagaaaaguacuuucuaaaauuacauaauauuauuuaaaauauuuuuaaagauugcguaaagauuacauagaa

SEQ ID NO: 145878 - RNA, 265 nt, Homo sapiens
auccauccacagaagugcaguugacccuugaacaacacaggguuuaacugcguggauccacuuacacgcagauguuuucuaaccaaauguggguugauuugagggaugcuaaaucuguguauagagggcuaacuuuuuguauaggcagguuccucagggcugacugugcaguuggauuuugguauauacggggguccuguaaccaauccccugccuauaccaggcguugacuguaauugggaaauuucucagagauaacuggaaa

SEQ ID NO: 145879 - RNA, 46 nt, Homo sapiens
ugaguugcuccaagcugcccagggaauuccaauaugcaaccaagug

SEQ ID NO: 145880 - RNA, 22 nt, Homo sapiens
cugagcuugccauccagggugu

SEQ ID NO: 145881 - RNA, 48 nt, Homo sapiens
auugacaggugcucuuuauggagcgaugacuccugugccuguggguga

SEQ ID NO: 145882 - RNA, 83 nt, Homo sapiens
uuugggguccuggcggaggggugacugagucuuaagcaaugaugcgucugcugccccacugccuccuugugaucaccccauca

SEQ ID NO: 145883 - RNA, 50 nt, Homo sapiens
uggccaaguaccaggacgaaugccaggcacacacgcaggcaaagguugcc

SEQ ID NO: 145884 - RNA, 64 nt, Homo sapiens
accuuggggccccauguaauucuauucaccccguaggaugcuggaagaggagaaagacaaggag

SEQ ID NO: 145885 - RNA, 57 nt, Homo sapiens
cagagggaccggauuuguucggaugaggaagaagaugaagaaaaagggggcaggagg

SEQ ID NO: 145886 - RNA, 45 nt, Homo sapiens
cggaagucaagccccucuggcccaaaggcuggaugcaggccaggu

SEQ ID NO: 145887 - RNA, 49 nt, Homo sapiens
gaguggcaaaguugcugaccucgccgucccuaaagcccucugcaguuag

SEQ ID NO: 145888 - RNA, 42 nt, Homo sapiens
ccucugccaaagcaggggucuccaaggaugccaucgucacag

SEQ ID NO: 145889 - RNA, 40 nt, Homo sapiens
acuguggggaacaucuccgggaacugugccaagcccccac

SEQ ID NO: 145890 - RNA, 29 nt, Homo sapiens
gcaccauggcgcauuauaguaaacaccag

SEQ ID NO: 145891 - RNA, 46 nt, Homo sapiens
gugagucugaacugacugcuccagcuaagugaucaggcacguugag

SEQ ID NO: 145892 - RNA, 46 nt, Homo sapiens
ucuagugaugccucuugccucagggaaacguuucuuugauggggag

SEQ ID NO: 145893 - RNA, 34 nt, Homo sapiens
uuccuuuuaaagugauuguauuuaagccaacaag

SEQ ID NO: 145894 - RNA, 62 nt, Homo sapiens
ugggucccgggccugcucuauggccucucacaggcuuuuuuucugcuccuucagcucagaac

SEQ ID NO: 145895 - RNA, 23 nt, Homo sapiens
cucugugaaggcaaagggccucu

SEQ ID NO: 145896 - RNA, 43 nt, Homo sapiens
cuguguggcugcuuggccagcuuaagccacuuguguuuggggc

SEQ ID NO: 145897 - RNA, 54 nt, Homo sapiens
gcagaggcugcugcaugugcaucugugcacauggcugccaggaggggcugugcu

SEQ ID NO: 145898 - RNA, 32 nt, Homo sapiens
uuugaaugacacaaagccugacccugccauga

SEQ ID NO: 145899 - RNA, 32 nt, Homo sapiens
cucggcaacugcucucuuggaguguguguccc

SEQ ID NO: 145900 - RNA, 44 nt, Homo sapiens
agcucagaaucugaugagucucuuaacuuugcuucuaagcucug

SEQ ID NO: 145901 - RNA, 47 nt, Homo sapiens
uuauacacauugguguucauuuguucaaggcggcaucugggccucgg

SEQ ID NO: 145902 - RNA, 32 nt, Homo sapiens
ugugggacaggcuuggccuggcugggcuggca

SEQ ID NO: 145903 - RNA, 48 nt, Homo sapiens
uggcagagggagagggauguaaaugaaaaugaauggggcguggaccag

SEQ ID NO: 145904 - RNA, 32 nt, Homo sapiens
aaguuuaucuuuuuuuccugaugauguuuaga

SEQ ID NO: 145905 - RNA, 46 nt, Homo sapiens
uccgaaacccgagcgucgggccugcccgccccagcccugaccccga

SEQ ID NO: 145906 - RNA, 45 nt, Homo sapiens
ggcuaauuuuagguugauuuuaaugaggcaaagggagggagaaaa

SEQ ID NO: 145907 - RNA, 63 nt, Homo sapiens
auucugaguaaaggaccugguuuagaaauuacaaagguagagacacaaggaugaggacaggcg

SEQ ID NO: 145908 - RNA, 45 nt, Homo sapiens
uuggcacuuguccaguggacucaaaaucccuaagcccuucucuga

SEQ ID NO: 145909 - RNA, 29 nt, Homo sapiens
gcauuaggauaaugacgguuauucugucc

SEQ ID NO: 145910 - RNA, 52 nt, Homo sapiens
gcgcauuuuaugacauuuuuauaaaguacuguaauucuuucauugaggggcu

SEQ ID NO: 145911 - RNA, 42 nt, Homo sapiens
caccuuagaaccagagaucgacccccucaagcaauacaucaa

SEQ ID NO: 145912 - RNA, 47 nt, Homo sapiens
agacaggacaaaugucaccuccugccuccaugagauacucucacuag

SEQ ID NO: 145913 - RNA, 35 nt, Homo sapiens
gucuuuaggcaaaaccuacagcgcccccccccuca

SEQ ID NO: 145914 - RNA, 104 nt, Homo sapiens
ugguggguggaagagggugaggugggguauaggagaagaaugacagcuuccugagagguuucacccaaguuccaagugagaagcagguguagucccuggcauuc

SEQ ID NO: 145915 - RNA, 71 nt, Homo sapiens
aaaaaagaaaaaagaaaaaaaaaauccaaaagagagaagaguuuuugcauucuugagaucagagaauagac

SEQ ID NO: 145916 - RNA, 46 nt, Homo sapiens
gcaugauguaccugauacugaggaagcgcaaauagaguuccggagc

SEQ ID NO: 145917 - RNA, 46 nt, Homo sapiens
uuauacagacaggcgugaagacauucacgacaaaaacgcgaaauuc

SEQ ID NO: 145918 - RNA, 47 nt, Homo sapiens
caggugaccucugcccccaaccccugacaccuccuuaucaaccaggg

SEQ ID NO: 145919 - RNA, 46 nt, Homo sapiens
acggcaucccaguuaaugcugcgugcacggcgggcgcugccgguca

SEQ ID NO: 145920 - RNA, 45 nt, Homo sapiens
cucucccaugcggcccaccauccugcacugccgcugccccaagaa

SEQ ID NO: 145921 - RNA, 45 nt, Homo sapiens
uuggagcaaugcgggaaagaacggaacuuccuugccuacuccagg

SEQ ID NO: 145922 - RNA, 64 nt, Homo sapiens
guaagcagggcagcccuccuggcgucugucaaggagccucaggagguggcggcugcaaggcggg

SEQ ID NO: 145923 - RNA, 47 nt, Homo sapiens
cccggcaaugcucaugaugugcccgguugaguuaggaggaggcagcg

SEQ ID NO: 145924 - RNA, 38 nt, Homo sapiens
gagcaaaugaaguagggcaaggcuguagugguggggug

SEQ ID NO: 145925 - RNA, 40 nt, Homo sapiens
uggcaggcccacccaugggugaacuccguggcucggccag

SEQ ID NO: 145926 - RNA, 77 nt, Homo sapiens
uucaacauguggagcacaggcuuggccuggccugggaggggccucauccccgcucccacccaaaucagcuggugccc

SEQ ID NO: 145927 - RNA, 50 nt, Homo sapiens
guguggcaaguucagaagaggugguggugggguaggcgugaugucagcag

SEQ ID NO: 145928 - RNA, 45 nt, Homo sapiens
gcuacuuuuuuuagcagacaccagagccacacucaaauggcuaag

SEQ ID NO: 145929 - RNA, 46 nt, Homo sapiens
caauaaaugcugaaugacauucaagcugauuuucuagaccacugag

SEQ ID NO: 145930 - RNA, 65 nt, Homo sapiens
cacuggugucugaaaggaauaaggagaacaggacagacuaacuuuuuaaaugauaugaagaaauc

SEQ ID NO: 145931 - RNA, 42 nt, Homo sapiens
agucuuuuauucaaaacuucagcguucucuauagucccuuga

SEQ ID NO: 145932 - RNA, 51 nt, Homo sapiens
uuaaagaaccuuaauaaaggaaacaaaaaacuguagcuccuuguccucaaa

SEQ ID NO: 145933 - RNA, 85 nt, Homo sapiens
uuucaaguuuuaaaguaugaacucaacaguagacucagagcuucuacauaugagucuuuuuagccauccucuuucaaaucuaggu

SEQ ID NO: 145934 - RNA, 47 nt, Homo sapiens
cagccucauuggaaacgggagggagggucaguguaugccgaauggag

SEQ ID NO: 145935 - RNA, 62 nt, Homo sapiens
aaagaagaaucucauuacaucuuggauccaaagcaagcacugaugaagcucacccuagguac

SEQ ID NO: 145936 - RNA, 42 nt, Homo sapiens
ccagggucaggaggaaccagaggagggagggugccaucucag

SEQ ID NO: 145937 - RNA, 50 nt, Homo sapiens
gagguuuuuauuuuuucacucccucaaggaucccuuaauuggccaaaacc

SEQ ID NO: 145938 - RNA, 42 nt, Homo sapiens
cugaacuacacagcugagaacaucuguaagugggccuuagaa

SEQ ID NO: 145939 - RNA, 75 nt, Homo sapiens
gaaauuaaaaguagauggggaaagaaagguaggacuaugagauggaaaaauauaucagguuucugcuucgauuug

SEQ ID NO: 145940 - RNA, 50 nt, Homo sapiens
cagaguuacucucuugaagaauuguuacucugagcccguguuuucagaag

SEQ ID NO: 145941 - RNA, 52 nt, Homo sapiens
auguacuuaccacaaagaaguaaauaaguucauaguuucagaauugcuaacu

SEQ ID NO: 145942 - RNA, 46 nt, Homo sapiens
cugagggaaaggagaguugccacuguggaaugcuggguuuuggcgg

SEQ ID NO: 145943 - RNA, 51 nt, Homo sapiens
uuccuaacagcuugguaacaaaauuguuuuaaauuuagaugggauggggaa

SEQ ID NO: 145944 - RNA, 43 nt, Homo sapiens
uuucaguggacauuaaguugauuggaaagggaauaggacugag

SEQ ID NO: 145945 - RNA, 47 nt, Homo sapiens
gcuaaaaacugaaaugaacuugccaggagaucccauaaagggagauu

SEQ ID NO: 145946 - RNA, 45 nt, Homo sapiens
gcuccuuccaaauugagagcuuacuauuccauguacucaguaggg

SEQ ID NO: 145947 - RNA, 37 nt, Homo sapiens
gaaaguucaugugugucuuuucaggaauguacacaca

SEQ ID NO: 145948 - RNA, 43 nt, Homo sapiens
aacaaguaaauauaauuuuuuaaagcuucagugcuaugcaggg

SEQ ID NO: 145949 - RNA, 26 nt, Homo sapiens
cuuuuuuuuguuuuguuuucacgcuu

SEQ ID NO: 145950 - RNA, 80 nt, Homo sapiens
ucucucuacagggucaggucguuuuucuucauguucggacgggagaaggaauuccuuucuccuuuucuaaggcaagcugc

SEQ ID NO: 145951 - RNA, 69 nt, Homo sapiens
uaccuuauucucucuccaccuucuuucuccucacccccagccagauuuugcccuucauuucaaagccgg

SEQ ID NO: 145952 - RNA, 47 nt, Homo sapiens
ggcuuucccggaacucaggcguuccgguauuccuccagcccuuccua

SEQ ID NO: 145953 - RNA, 42 nt, Homo sapiens
gauggggccgcuaccugugugccugccaaucaugcugcuccu

SEQ ID NO: 145954 - RNA, 29 nt, Homo sapiens
aggccccagccacaguggggcuggccuuc

SEQ ID NO: 145955 - RNA, 44 nt, Homo sapiens
gaaaugggggcuauaaagacaagaggguggggggggguccccau

SEQ ID NO: 145956 - RNA, 44 nt, Homo sapiens
aagccagugacucccaguucucaacacauggccccagucaagac

SEQ ID NO: 145957 - RNA, 58 nt, Homo sapiens
gauggggggcgggaagaggggugucucucugcuucuguuuucccaucuuuuuuguggu

SEQ ID NO: 145958 - RNA, 39 nt, Homo sapiens
cuuuuuauuuuuuccuucguuaaggacuuucugccacag

SEQ ID NO: 145959 - RNA, 37 nt, Homo sapiens
uccccguguuugaccuugcguauuucugcugucugga

SEQ ID NO: 145960 - RNA, 46 nt, Homo sapiens
uugggacaaagcuggccuauguccaguucucugcauacuugguagg

SEQ ID NO: 145961 - RNA, 82 nt, Homo sapiens
cucugggccuguuuccccuucuacuuccucuaucucucccgacaugaccgaggcuacauucagaugacaccucucaacaaaa

SEQ ID NO: 145962 - RNA, 69 nt, Homo sapiens
ggaucgucugcugggcagaccucuucuacucuuucugggaaagaagucggggcauauuccuggccccag

SEQ ID NO: 145963 - RNA, 357 nt, Homo sapiens
uaaaaagaggagggaggcugggcaucguggcucaugccuguaaucccagcacuuugggaggcugaggcgggagaaucacuugaggucgggaauuugagaccaguauagccaacauggcaaaaccccgucucuacuaaaaauaaaaaaauuagccggcgugguggcacacgccuguaguccuagcuacucaagaggcugaggcaggagaauugcuugaacccgggaaguggaggcugcaguaagccgagaucgcaccacugugcuccagucugggggacagagcgagaccucaucucaaaaaagaaaaagaaaaaaaaaaggagagaacaaguuuaaggcaggacauucugagcaggg

SEQ ID NO: 145964 - RNA, 42 nt, Homo sapiens
aauucagcuggagaggaggaagggaguucagucuucagggau

SEQ ID NO: 145965 - RNA, 46 nt, Homo sapiens
guccuguuucucagaucgcucaccccuguucucggaaaccauccac

SEQ ID NO: 145966 - RNA, 42 nt, Homo sapiens
uggucaauaaauauucagugacugaaugaguaaaguggggac

SEQ ID NO: 145967 - RNA, 24 nt, Homo sapiens
gugcagaaugguguggagcugacg

SEQ ID NO: 145968 - RNA, 47 nt, Homo sapiens
aggacacgucggaacaagucgugccuguuuugguaaagaacuggaag

SEQ ID NO: 145969 - RNA, 29 nt, Homo sapiens
ggcauccugcauguucuugcuguuugaau

SEQ ID NO: 145970 - RNA, 45 nt, Homo sapiens
uucuucuucaaggccauccacgaccugaugauguuuuccgggccg

SEQ ID NO: 145971 - RNA, 46 nt, Homo sapiens
gcugcuguuugucacugccugccugcagacccucgugcugcaccag

SEQ ID NO: 145972 - RNA, 46 nt, Homo sapiens
uuuaugccugggagcuggcauucaaggacaaggugcuggccaucag

SEQ ID NO: 145973 - RNA, 44 nt, Homo sapiens
uucucucccaugaggagcuggaaccugacagcaucgagcgacgg

SEQ ID NO: 145974 - RNA, 46 nt, Homo sapiens
uaagugagagacaugaaguaaaaggaaaauaacaggaagaagagua

SEQ ID NO: 145975 - RNA, 53 nt, Homo sapiens
cagccuuggacagcuagacuuagacaauacaggagauucuuggcuugcguaac

SEQ ID NO: 145976 - RNA, 55 nt, Homo sapiens
ggugggcugcggaaagucgucccugcucucagcccucuuggcugagauggacaaa

SEQ ID NO: 145977 - RNA, 35 nt, Homo sapiens
uccuccuguaucuuuccacugucucuuucucucuc

SEQ ID NO: 145978 - RNA, 46 nt, Homo sapiens
uccaacgcugacauuuaccucuucgaugauccccucucagcagugg

SEQ ID NO: 145979 - RNA, 42 nt, Homo sapiens
caugagcuacuugccgcagguggacgucaucaucgucaugag

SEQ ID NO: 145980 - RNA, 44 nt, Homo sapiens
aaaaagggugguguggccagaccauggugugccaggacgugggg

SEQ ID NO: 145981 - RNA, 47 nt, Homo sapiens
gguugggaaguucuaccuugagucuagccuguuucuucuugcugcag

SEQ ID NO: 145982 - RNA, 51 nt, Homo sapiens
agcugaggccaagaaggaggagaccuggaagcugauggaggcugacaaggc

SEQ ID NO: 145983 - RNA, 71 nt, Homo sapiens
ugucuauguuaacucaccuguccaucacaacacaccugugaagauacuauuugcagcaccagaaacugagg

SEQ ID NO: 145984 - RNA, 44 nt, Homo sapiens
agccuaucucaccacgcgacuggaagcuccaugcaugagggcag

SEQ ID NO: 145985 - RNA, 60 nt, Homo sapiens
ucaagcuuuccguguacugggacuacaugaaggccaucggacucuucaucuccuuccuca

SEQ ID NO: 145986 - RNA, 59 nt, Homo sapiens
gcaucuuccuuuucauguguaaccauguguccgcgcuggcuuccaacuauuggcucagc

SEQ ID NO: 145987 - RNA, 48 nt, Homo sapiens
ugucugcacguggaccugcugcacagcauccugcggucacccaugagc

SEQ ID NO: 145988 - RNA, 46 nt, Homo sapiens
uucuccaaggagcuggacacaguggacuccaugaucccggagguca

SEQ ID NO: 145989 - RNA, 52 nt, Homo sapiens
uccuggagguaucgguuacgucuagauguucuccagcacagcccugcccugg

SEQ ID NO: 145990 - RNA, 55 nt, Homo sapiens
aaggacucucucuggaauuacugcggaguuacuugaguuagcaaagaauccccuu

SEQ ID NO: 145991 - RNA, 16 nt, Homo sapiens
ugguguauguauauuu

SEQ ID NO: 145992 - RNA, 46 nt, Homo sapiens
uuuguuuucggguucccuccgaaugaaccuggacccauucagccag

SEQ ID NO: 145993 - RNA, 46 nt, Homo sapiens
gcuuggugugagccccagagcuggcauaucuggucagaacugcagg

SEQ ID NO: 145994 - RNA, 49 nt, Homo sapiens
ggaacuggcugugaagacccaggagagacagagaugcgaaccacccaaa

SEQ ID NO: 145995 - RNA, 47 nt, Homo sapiens
caaaacuugaacuucuugggaauagaaguguugggcugagaaguaac

SEQ ID NO: 145996 - RNA, 46 nt, Homo sapiens
caagacucagacuugcuaagaauuacgccgccgacuucaaacccag

SEQ ID NO: 145997 - RNA, 40 nt, Homo sapiens
uuuuuguaaguuauaccauucuuucacauuagauaaacua

SEQ ID NO: 145998 - RNA, 41 nt, Homo sapiens
cugcacugcgaugcccagucuagaaaaucuuucagcuguaa

SEQ ID NO: 145999 - RNA, 53 nt, Homo sapiens
uuuaagaagugaaaguccaagaacuacguaaauuauuucuguaugauuggcag

SEQ ID NO: 146000 - RNA, 50 nt, Homo sapiens
uaauccuuuccaugugaaguuuaaaauuacuauauauuugcugauggcua

SEQ ID NO: 146001 - RNA, 43 nt, Homo sapiens
gaacaguauugcuuuguaauagagucuguaauaggauuuccca

SEQ ID NO: 146002 - RNA, 95 nt, Homo sapiens
uaaaagggaggaaaaaaauaacaagaacaaaacacaggagaauguauuaaaaguauuuuuguuuuguuuuguuuuugccaauuaacaguaugugc

SEQ ID NO: 146003 - RNA, 47 nt, Homo sapiens
gaagacuugugaaaucaauguuucuuuuuuaaaaaacaauuuucaag

SEQ ID NO: 146004 - RNA, 33 nt, Homo sapiens
accuacaaacgacguacuaaagacugcuugagc

SEQ ID NO: 146005 - RNA, 46 nt, Homo sapiens
cgaguccaccuggcgaguagcgcucccaaaccgcgagacccagagu

SEQ ID NO: 146006 - RNA, 50 nt, Homo sapiens
ugaucuauaauggggugcaccacacccucucagccuggucagggaugggg

SEQ ID NO: 146007 - RNA, 48 nt, Homo sapiens
cccagacugauccugacauuuauuuuuacaaaacaaaccaucucaaaa

SEQ ID NO: 146008 - RNA, 43 nt, Homo sapiens
ugcagccaccaucuuucugccuuaggugugggauggcccccaa

SEQ ID NO: 146009 - RNA, 26 nt, Homo sapiens
uuaauacagucccauguuaagaacug

SEQ ID NO: 146010 - RNA, 179 nt, Homo sapiens
gucauaggucuguuccucuuguacuugcugaaagaaggaaaauagauucacuguugcacugugugaaguagucuaaaacuuggagagcaagauauagucuguuuuucccagaaaaacuagaacuguuuaauuguggaaagauaaucuaacuuuaucuccuccaaacacagcuguuuugc

SEQ ID NO: 146011 - RNA, 41 nt, Homo sapiens
caagaaaaggguggggacacacauccacaccaagaggaagc

SEQ ID NO: 146012 - RNA, 40 nt, Homo sapiens
ucaacacggugggcgccgacaucauccagcugccucaaau

SEQ ID NO: 146013 - RNA, 42 nt, Homo sapiens
cuacgacgauuugaggcagcuggaugaugucggcgcccaccg

SEQ ID NO: 146014 - RNA, 45 nt, Homo sapiens
ccuccaugacucugaaaacacggggccccagugcccgccggccac

SEQ ID NO: 146015 - RNA, 55 nt, Homo sapiens
uuccuccucuccuccgcccucuccucggaagccggcacccauuggaccgggcccg

SEQ ID NO: 146016 - RNA, 46 nt, Homo sapiens
cgggcccgguccaaugggugccggcuuccgaggagagggcggagga

SEQ ID NO: 146017 - RNA, 41 nt, Homo sapiens
gacagacugcugacgccagaugcagucuucaggaggggagg

SEQ ID NO: 146018 - RNA, 26 nt, Homo sapiens
ucucuuuaggagucagcauugguaau

SEQ ID NO: 146019 - RNA, 30 nt, Homo sapiens
cauggcacuggccaggguccaguugaagcc

SEQ ID NO: 146020 - RNA, 46 nt, Homo sapiens
gggaauggagaaugggggcagcucauggggcuuucucccuucagaa

SEQ ID NO: 146021 - RNA, 65 nt, Homo sapiens
guuucuagaugggaguaaaggaagccauguggugggguguuguggagugcucagggcuucuggaa

SEQ ID NO: 146022 - RNA, 37 nt, Homo sapiens
cauaccuaccacuggccaggcacuggggauaggcagg

SEQ ID NO: 146023 - RNA, 55 nt, Homo sapiens
gaccgggagaucgcacagauguuuuuaaacaugacaaagcuggagaaggaagccc

SEQ ID NO: 146024 - RNA, 49 nt, Homo sapiens
uccuuagccgccuucuccuuguccuucucuggccuuccuugagugcccu

SEQ ID NO: 146025 - RNA, 80 nt, Homo sapiens
cagcacgccaugcagacggcugagcggcucuacacgcaaggcuacaucagcuacccacggacagagaccacccacuaccc

SEQ ID NO: 146026 - RNA, 45 nt, Homo sapiens
cugaagggcucucugcggcagcaggccaaccaccccuacugggcc

SEQ ID NO: 146027 - RNA, 45 nt, Homo sapiens
gggaccaggacaggagugaagagguagcagcaggugcuguugcag

SEQ ID NO: 146028 - RNA, 43 nt, Homo sapiens
ugacagugaagagggcucugguguuaccuucugaacaggagag

SEQ ID NO: 146029 - RNA, 47 nt, Homo sapiens
cagaggccaguuucuucccaugugagauucucuccgagcuacuuugg

SEQ ID NO: 146030 - RNA, 67 nt, Homo sapiens
uuccucugggugggagaguggaauccuggggacugggagccuccccuggggaucgugacgggccuug

SEQ ID NO: 146031 - RNA, 64 nt, Homo sapiens
gccucugacgcacagggcugcugcccugccgugcugccaggacaguagaaaccaccgccuauag

SEQ ID NO: 146032 - RNA, 47 nt, Homo sapiens
gggagaugacuccugcacucugcuugcccgcaggcauggaugaguug

SEQ ID NO: 146033 - RNA, 27 nt, Homo sapiens
ccgugugcucugcagaaagcucccuca

SEQ ID NO: 146034 - RNA, 41 nt, Homo sapiens
cccuggaagcuggacaacacacauucaccccugugugccug

SEQ ID NO: 146035 - RNA, 32 nt, Homo sapiens
cucucuucugcccugccuaccugcuaaaagac

SEQ ID NO: 146036 - RNA, 41 nt, Homo sapiens
gagauggagcugcggaaugaaugaggauagggggcugaguc

SEQ ID NO: 146037 - RNA, 57 nt, Homo sapiens
uugaauuguguccccccuaaauucauacacugaggcccuaacccccaguaccucaga

SEQ ID NO: 146038 - RNA, 48 nt, Homo sapiens
gaccuuuccgaauucaggaaguugcccagggaggaagaagaagaggag

SEQ ID NO: 146039 - RNA, 48 nt, Homo sapiens
aggaauucaggaaagaggcagagcagguggccuggacccgaagaacac

SEQ ID NO: 146040 - RNA, 43 nt, Homo sapiens
acauguuuauuuaagccaguagauuccuuaucuagaaagcagg

SEQ ID NO: 146041 - RNA, 45 nt, Homo sapiens
aagaagccaagacagaagaaaccagaacccaaccucuugugggac

SEQ ID NO: 146042 - RNA, 26 nt, Homo sapiens
cccgucgcuggcggagagggugguac

SEQ ID NO: 146043 - RNA, 35 nt, Homo sapiens
ggcgcccgucggaggggacuaggggccugccgaga

SEQ ID NO: 146044 - RNA, 38 nt, Homo sapiens
aaggucuuuccacauugggucccugggguaagacugga

SEQ ID NO: 146045 - RNA, 26 nt, Homo sapiens
ggucagaggucccgagggucugcagg

SEQ ID NO: 146046 - RNA, 45 nt, Homo sapiens
agccaggugaacagccagugcggagggacagaggcagcuauggua

SEQ ID NO: 146047 - RNA, 64 nt, Homo sapiens
auucccacaggguugcagggucuccucacgccuaucccguagaauggcuuacaucuaaacagau

SEQ ID NO: 146048 - RNA, 51 nt, Homo sapiens
cuccaaaagagguacauagaaguguuccugccucccuagagggaaggagau

SEQ ID NO: 146049 - RNA, 45 nt, Homo sapiens
uucaaucuacuucaaaagaaugguguuucuuuucuuguccaauuu

SEQ ID NO: 146050 - RNA, 45 nt, Homo sapiens
gccacgauugguuccagcaagugugagcagagaccccgugcagug

SEQ ID NO: 146051 - RNA, 68 nt, Homo sapiens
cccccagccugagcacccgcuucgggcugaccuagcugaagaauacucuaaggaccguaaaaaauucu

SEQ ID NO: 146052 - RNA, 46 nt, Homo sapiens
cccuggaagggaugaaggacuguggggcugccuacaaggggaaggg

SEQ ID NO: 146053 - RNA, 24 nt, Homo sapiens
ucuuugggggugcugcucuggggu

SEQ ID NO: 146054 - RNA, 46 nt, Homo sapiens
ucgaaaucaacuuuccagcagaguacccauucaaaccaccgaagau

SEQ ID NO: 146055 - RNA, 45 nt, Homo sapiens; identical to SEQ ID NO: 54706

SEQ ID NO: 146056 - RNA, 117 nt, Homo sapiens
aggaagcagccuggcgaaggaggcagggcucagcuggauggugcucgggcugcagaagagaaggugccugacagguguggaggcggcuuuugugccacuggaugggaggccgggcug

SEQ ID NO: 146057 - RNA, 45 nt, Homo sapiens
ggucgaacuuggccuggcccuuuaagcacgaguaggguuucagca

SEQ ID NO: 146058 - RNA, 31 nt, Homo sapiens
guaugucacauguuucaggaggugaggggag

SEQ ID NO: 146059 - RNA, 46 nt, Homo sapiens
ugcaagcagcuaauuuagcauuguuggcuacaaccagauuguaacc

SEQ ID NO: 146060 - RNA, 66 nt, Homo sapiens
uguucacgccccgccaggcugucugcucuauccucacacacaccgggcuccagacagccuggccau

SEQ ID NO: 146061 - RNA, 52 nt, Homo sapiens
auugccucccagacugcccuuuuccucacacucccacgacacagcccucaaa

SEQ ID NO: 146062 - RNA, 46 nt, Homo sapiens
gcuccaucccuuugggcagacagcccauggcacagguauuuacggg

SEQ ID NO: 146063 - RNA, 47 nt, Homo sapiens
cauugcugauucacagcuacuguacugaagccuuggccacccuggag

SEQ ID NO: 146064 - RNA, 54 nt, Homo sapiens
uauucuuuuaguaugugaaaaccaaacucuaauuuacaagucacaaagaauuau

SEQ ID NO: 146065 - RNA, 41 nt, Homo sapiens
cugggacugaguauucuagaaaaauugcucagccuugugcu

SEQ ID NO: 146066 - RNA, 57 nt, Homo sapiens
ugguaacuguagaacccagaaaguggagaggaacagaaguaagagaaccauuccaug

SEQ ID NO: 146067 - RNA, 46 nt, Homo sapiens
uggaagcugcuaccuuugccucuuuggaccaucgauccucuguuca

SEQ ID NO: 146068 - RNA, 48 nt, Homo sapiens
accacagccccagcagccuccaguugcucagaaccaaccaucacaacu

SEQ ID NO: 146069 - RNA, 46 nt, Homo sapiens
cagcagcagcagcaucuaauuaaauugcaucaucaaaaucagcaac

SEQ ID NO: 146070 - RNA, 44 nt, Homo sapiens
gucuaggcuucuuauuuauccaaaagacuuaguugucccuuuuc

SEQ ID NO: 146071 - RNA, 351 nt, Homo sapiens
aauuuuuuacacuuggccaggcacagugacccacgccuauaaucucaacacuuugugaggucgaggcaggaggaucacuugaacccaggaguuugagaucagccugggcaacaaagugagacugucucuauaaaaauuuuacaaauuaguugggugugguggcaugcaccuguaguuccagcuacucgggaggcugaggcaggagggucacuuaagcccaggaggucaagggugcagugagccacgaugguaccacuucaguccagacugggcaacagagugagaccccaccucaaaaaaaaaaaaucuuacacccaucagaauugcuaaaaugaauagugacagccucaa

SEQ ID NO: 146072 - RNA, 27 nt, Homo sapiens
gcacacaggggcccaggcugaguugga

SEQ ID NO: 146073 - RNA, 45 nt, Homo sapiens
aauuacugauuuucaccguauagcccguuguaaugggagcaacca

SEQ ID NO: 146074 - RNA, 1442 nt, Homo sapiens
uugaccuggaagaaaagcaggaaaacaaauacagcuuagaagacauggagauaagcaugaauauuuauaaaacaauuaucuauucaauugaucaagucccuaguauguauagacuuauuuugggugccaguaauacuuguaugaauaggccaaaaucugaacauucauggugugaaaagaccauaaauaaguaaaacuugaauacccugauauccuggaaagugcuaucaagacaaagcggguguuaauggggggugggggcaggaacuucauuaggaaggccucucugaggcaaaucugagccgaagccuaaggucaggagaaggcaguuggcagagcaugcagaauggcuccaagaugggaucaucuugguguguuugaggagcaggaggaguggcuggauuuuagugacugaaaaagacaguaauauaauaagaggggucggggauaggcaagaaaccaagucguauaaggcaguauggggcaaggugaggcauuugaaagugagaaagaagggcaauguacaggucuuuuaaacaaugaucaauacuagggaucuuuugguacucuaccuaugggacuagcggaugcagaagggugcaguaagacagcgaauccaacuauauuugaguaucaccuguaagcuguuaaguaauuauguauuauaaaaacagauggcagaaugucaugucuauauaccuaacgcauuaaacuucauuuauucacauuaggcagaaaacagggacuaucugauuuaguaaaaauuacaaagaguaguuuuuaaaagacaguuuccuuauuuuuauagcugcuucuaacuccaaggaggcuaagugcuuaagaccuccuuuuauguauacgaguauuaugcacaaugcuaacacuagcauuaauuuaagcacuuuacauaaugguauugcacuucaguguaucauuucaacuuugugaaauaaauuauuacuaucgcauaaaugcagaaacugaggcacagagugauuaagcugccaaaggucacaaacaauaagcuguaaaccuggcauaaaacucaagucucacucuuaacuaccuucaaacguuuacuuccucccugauuuuaauggaauauucuuacaauagccuauucuacaaaaggaguuggcaaauguucucugucgagggccgcauaguaaauauuuuagguuucauuuagggccauauggucugcuguagccacuuaacucugccauuguagcacaaaagcauccacaaacaacacaugaacaaauaagccuggcuaugucccaauaaaacauucacaaaacaggcgguggucccuguuacagaggacaaauucauuccaguucaucucaguucuaaaucagccagguucaauuugguaagguuucacaauauuacaaucaaaaaaagcacacucacuuuuuuugaacugccuuccacagaga

SEQ ID NO: 146075 - RNA, 28 nt, Homo sapiens
gcuaucugucaaauuuauauaugcagcu

SEQ ID NO: 146076 - RNA, 39 nt, Homo sapiens
acuuuagcaccugucucguccccaguggcuuuuccagaa

SEQ ID NO: 146077 - RNA, 50 nt, Homo sapiens
uuuggugauuccaugugugaaugcucguauuccgugugcaugcguauaug

SEQ ID NO: 146078 - RNA, 37 nt, Homo sapiens
gguaaauauaugcacuuaauucucugggcugugcacc

SEQ ID NO: 146079 - RNA, 70 nt, Homo sapiens
cacuucaggguuccugcaagaaaaguccccagggcaaggguucuucucugggaaagcccagaauuaagaa

SEQ ID NO: 146080 - RNA, 27 nt, Homo sapiens
guguuuggcauguggcauucuuuggag

SEQ ID NO: 146081 - RNA, 46 nt, Homo sapiens
guaagaugagauugggaagguaguuguuuggggugugggcgguggg

SEQ ID NO: 146082 - RNA, 50 nt, Homo sapiens
caagcaggaauggaauccuccagcaaacgacaaccaacugcacgaugguc

SEQ ID NO: 146083 - RNA, 32 nt, Homo sapiens
uccagcuucugaccucccugacugaaccacac

SEQ ID NO: 146084 - RNA, 45 nt, Homo sapiens
uaguucucaggugguggauccaaaacuaaaccacaucuucaggcc

SEQ ID NO: 146085 - RNA, 47 nt, Homo sapiens
agaugucuuucuguuuuaccguacuuguuuuugcaguauggguuuag

SEQ ID NO: 146086 - RNA, 42 nt, Homo sapiens
ugacagguaucccuuuuggacuaaggacugcugauggggcug

SEQ ID NO: 146087 - RNA, 74 nt, Homo sapiens
cccuggaggaguggaggguggcugucugagauggaggagaggugaaggaaucagaacuaguagguucauagggc

SEQ ID NO: 146088 - RNA, 119 nt, Homo sapiens
agcuuugauaguaaaauuagacaaguuggagggcuacuagcuagauuaggcacugagcuguaggugaaacugggaaugugaaccacugggaaagaaggaugggcucgagcagggugugu

SEQ ID NO: 146089 - RNA, 56 nt, Homo sapiens
guggccaucucuggggccuuggugagaaagaugagccagcccaggagggggaaagg

SEQ ID NO: 146090 - RNA, 41 nt, Homo sapiens
gaaugugaggagaccaagcagugacgaaggccaugaagugg

SEQ ID NO: 146091 - RNA, 65 nt, Homo sapiens
uagguccuuuccaaaccacagauauaugacacagugaccauuugugcugcuuccugcuuuucugg

SEQ ID NO: 146092 - RNA, 49 nt, Homo sapiens
aggacuuaaaccuagucugcaguaagccccagucuccagugugucagaa

SEQ ID NO: 146093 - RNA, 46 nt, Homo sapiens
gccaaggaggagaaggccauuucucagcgaccucucuacugcuggc

SEQ ID NO: 146094 - RNA, 55 nt, Homo sapiens
cuuccacuuucugucuccucccccuguccuacugccuguguugagugcugcagaa

SEQ ID NO: 146095 - RNA, 45 nt, Homo sapiens
aaccgcggcagccgcacaggcuacgugcacauuuacgauguggag

SEQ ID NO: 146096 - RNA, 41 nt, Homo sapiens
aguuugacaacuccagugaggacuaggcucccugugccugg

SEQ ID NO: 146097 - RNA, 28 nt, Homo sapiens
cugccuagaucaguccuucuccaaaagg

SEQ ID NO: 146098 - RNA, 42 nt, Homo sapiens
aaggggaacgaugacucucuccacagggcugaugaaagcucc

SEQ ID NO: 146099 - RNA, 24 nt, Homo sapiens
uuacuguuggccuggagacucggg

SEQ ID NO: 146100 - RNA, 55 nt, Homo sapiens
cucaguccugagccacaggcacucagggcuccagagguguccaccccggucgcac

SEQ ID NO: 146101 - RNA, 47 nt, Homo sapiens
ccucacucguguagcggcucaggaagacaucuaggcugggcagcggc

SEQ ID NO: 146102 - RNA, 50 nt, Homo sapiens
cuaugcaggccccugccgccgcuaccgaugacccugaccagucacccccu

SEQ ID NO: 146103 - RNA, 66 nt, Homo sapiens
aucucaucccucugcccccaaguucugcucaaaucccugccguggccgguggcucacuagcuccaa

SEQ ID NO: 146104 - RNA, 83 nt, Homo sapiens
cucugccaaaucacauccauccaccacccaacgcccacuuaauucuccauugaccaggccugaccugggagccaugaccuggg

SEQ ID NO: 146105 - RNA, 71 nt, Homo sapiens
agccucccuucugcucagguugggccggacccugaccccugacccuccccaacauggcccuuauuacacug

SEQ ID NO: 146106 - RNA, 51 nt, Homo sapiens
auaccggaacacgugggacugcggcuugcagauccugaagaaggaggggcu

SEQ ID NO: 146107 - RNA, 43 nt, Homo sapiens
gaaacacuccucuggaugugauuaagacccggaugcagguggu

SEQ ID NO: 146108 - RNA, 46 nt, Homo sapiens
gccucacagccacuguccugaagcagggcucgaaccaggccauccg

SEQ ID NO: 146109 - RNA, 46 nt, Homo sapiens
aguacagaggauucuuccacgggguuagggagauugugcgggaaca

SEQ ID NO: 146110 - RNA, 45 nt, Homo sapiens
uggcaucgagaucugcaucaccuuccccaccgaguacgugaagac

SEQ ID NO: 146111 - RNA, 42 nt, Homo sapiens
ugcccgcgccccgcgccccgcgcgcucuggcggccgccgcgc

SEQ ID NO: 146112 - RNA, 46 nt, Homo sapiens
acgauuucgaacacggugccgucgagaagcgccagggccaggucgc

SEQ ID NO: 146113 - RNA, 42 nt, Homo sapiens
gaaccacaggcagguuguggggccggcaggccugcugggcuu

SEQ ID NO: 146114 - RNA, 44 nt, Homo sapiens
ucgcccgcugcuccucacggauccgguguuccacggccugccau

SEQ ID NO: 146115 - RNA, 37 nt, Homo sapiens
gccuuucuggucacacugggcagcaggcgacugccag

SEQ ID NO: 146116 - RNA, 111 nt, Homo sapiens
augaagggugacaggcagcugggguccaccuggucucuccucagcagggggaacccccugcgggcagcugggaaggcaguggccaaaggucaagaagaugaacucugccca

SEQ ID NO: 146117 - RNA, 43 nt, Homo sapiens
gccaagggagcggcugagaccagaacaagcgcucgggugggcc

SEQ ID NO: 146118 - RNA, 34 nt, Homo sapiens
cgacuguguaugucuguguguguguguacuacag

SEQ ID NO: 146119 - RNA, 58 nt, Homo sapiens
ucucuccccuuugcucuguggugccggcaggaggaagaggagcagaaaaacuguugcu

SEQ ID NO: 146120 - RNA, 41 nt, Homo sapiens
ugacccugaugaggagaggaaggagggugugggaugcaggg

SEQ ID NO: 146121 - RNA, 27 nt, Homo sapiens
cgagacaaggagaccuggaggcagggc

SEQ ID NO: 146122 - RNA, 50 nt, Homo sapiens
ccugggccccacccucagaacgagcugcagcagauccgccugugcuuuga

SEQ ID NO: 146123 - RNA, 45 nt, Homo sapiens
cggggccccggggcguugcugcuggccugaucagccugcagggag

SEQ ID NO: 146124 - RNA, 41 nt, Homo sapiens
cugcagggcaggguugcgggcgccaccgaagccgggcccag

SEQ ID NO: 146125 - RNA, 26 nt, Homo sapiens
guugucguagcgcacaggcgagggcu

SEQ ID NO: 146126 - RNA, 48 nt, Homo sapiens
ggcgggucgcccguugccccaggaugcagguagggugagugguauccg

SEQ ID NO: 146127 - RNA, 46 nt, Homo sapiens
ggcugucauaggacaggcugccguugcgguugggcagugcaugggg

SEQ ID NO: 146128 - RNA, 45 nt, Homo sapiens
ccucagagcgcaggggcugcagggccacaugauccccgccccgcc

SEQ ID NO: 146129 - RNA, 42 nt, Homo sapiens
ucacuguuugcucacugcugcaggaaggcuguggggaccugg

SEQ ID NO: 146130 - RNA, 58 nt, Homo sapiens
ggcuguggggacccagcugguguuugccuccucagauuccaaggugauccuggccauc

SEQ ID NO: 146131 - RNA, 52 nt, Homo sapiens
accagcgugagcauagaggcuaagggaccaugggagcuccaagcgcgcucac

SEQ ID NO: 146132 - RNA, 49 nt, Homo sapiens
agacucucagagcuggagaguugcaggaggccugggggagggucugugg

SEQ ID NO: 146133 - RNA, 83 nt, Homo sapiens
uggaccggggugggguccccagacuccuuguggaaagcugagguugaagaucugugcugugaugaggggcuccagauagcggu

SEQ ID NO: 146134 - RNA, 67 nt, Homo sapiens
gacguugggugggagucuccggacuugggguggggaaucuggaugggaacuggggaauucggaccuu

SEQ ID NO: 146135 - RNA, 46 nt, Homo sapiens
uucuuauuuauguaacuggcuuucauuuagauuguaaguuauggac

SEQ ID NO: 146136 - RNA, 45 nt, Homo sapiens
cuguccucccucaacggaggcuucuacuuggguuucagaccgaag

SEQ ID NO: 146137 - RNA, 42 nt, Homo sapiens
gacucgggcugggaacugcuugguuucccugaggguggagag

SEQ ID NO: 146138 - RNA, 45 nt, Homo sapiens
acauuaccuaucccaugcuguucaaacugaccaauaagaauucgg

SEQ ID NO: 146139 - RNA, 46 nt, Homo sapiens
gagcgucaaccuucaaguggccaccuacuccaaauuccaaccucag

SEQ ID NO: 146140 - RNA, 47 nt, Homo sapiens
uuggucugugucaccuggcacaaagccaggaugcacaguauguccag

SEQ ID NO: 146141 - RNA, 37 nt, Homo sapiens
cagucaaacaacacagacagauaggaaguuaagaaaa

SEQ ID NO: 146142 - RNA, 35 nt, Homo sapiens
ucuggcugaggucuggaugaaagcagucuuggcac

SEQ ID NO: 146143 - RNA, 45 nt, Homo sapiens
uuccugucuaggcuuucucuggaucuggcaauagacuggauggaa

SEQ ID NO: 146144 - RNA, 21 nt, Homo sapiens
agccuagaagcaguucugugu

SEQ ID NO: 146145 - RNA, 46 nt, Homo sapiens
guuccagcaaaaugaaugaaaauagccccacuuugaggcaaagaaa

SEQ ID NO: 146146 - RNA, 65 nt, Homo sapiens
cacagguuugucaaaacagaugaacuccaugcaaugcaggcugugauugaauagaggaagaagcc

SEQ ID NO: 146147 - RNA, 55 nt, Homo sapiens
acaaucccucuuucugcugauggaaggauagcuuaguggaauguuucugagggcu

SEQ ID NO: 146148 - RNA, 45 nt, Homo sapiens
aggcagauucgucgcuuucucuggagaaggacagucauugcguaa

SEQ ID NO: 146149 - RNA, 125 nt, Homo sapiens
cucaccucuucacgcuuucagcuugaggggagcucccacugccucagcaggagcaauucugcaucccuaauucugucaaaaccuaugaaggugacuaaauugucuaacaugaaguguucuuucuu

SEQ ID NO: 146150 - RNA, 55 nt, Homo sapiens
gcugucccacuacuguggcugcaauuuaaguauuugacaaagaauguuucuauuu

SEQ ID NO: 146151 - RNA, 108 nt, Homo sapiens
uucauauggacauaacuggcuccuuagugaaccuguucauagugaaacaacuccauggagaagcaaacaugugaauguuagaaugaacaaaugcuaaagagauguucc

SEQ ID NO: 146152 - RNA, 46 nt, Homo sapiens
ugcuucugaagaagugguccuuguacaagcagcaagagcguaagau

SEQ ID NO: 146153 - RNA, 42 nt, Homo sapiens
cucuccucucagucuccucaaaggugagcuccaccugaggcc

SEQ ID NO: 146154 - RNA, 41 nt, Homo sapiens
gucucucuaagcugcgucugccaaguucccagaagccugaa

SEQ ID NO: 146155 - RNA, 26 nt, Homo sapiens
uugaaauucucuacuguuuacuucuu

SEQ ID NO: 146156 - RNA, 46 nt, Homo sapiens
ggcagggacuucacagaagaagugaucaauugcccuagagccacag

SEQ ID NO: 146157 - RNA, 45 nt, Homo sapiens
auaccuggaacccacaaccugcaaaugaaauaguucugcugccug

SEQ ID NO: 146158 - RNA, 50 nt, Homo sapiens
cauagaagugugugaccuagaaucccucaaacaaggaaaacaacucaucc

SEQ ID NO: 146159 - RNA, 45 nt, Homo sapiens
gcaacuaagcgaaaaguuuuugaaauggaccccaaaucucugaca

SEQ ID NO: 146160 - RNA, 46 nt, Homo sapiens
agcuauggaauguuuuuugcaguauguuuauacuggaaaggugaag

SEQ ID NO: 146161 - RNA, 42 nt, Homo sapiens
aguaugcagucugugcucuaaggaaugacauucuuguuucag

SEQ ID NO: 146162 - RNA, 45 nt, Homo sapiens
acaguuaaauauuuggaucagaguugccucucucaauaaaggcag

SEQ ID NO: 146163 - RNA, 75 nt, Homo sapiens
uuguugaaauauuaagaggaacugauaaaguauuuuaggaagaauaaucugugguuuagagagaacaagagugga

SEQ ID NO: 146164 - RNA, 54 nt, Homo sapiens
agauuguuucuuagaagaugaaaaaaaauguacccuuucuuguguaaagaacag

SEQ ID NO: 146165 - RNA, 41 nt, Homo sapiens
uagguauauguugucgguggcuaugaugggcaaaacagacu

SEQ ID NO: 146166 - RNA, 47 nt, Homo sapiens
guugaagauuacuggaugcacguacagaauacauucagccgucaggu

SEQ ID NO: 146167 - RNA, 53 nt, Homo sapiens
cuuggccuuugaagaguguaccuuuguaaguauuuguaagaagucuaugugaa

SEQ ID NO: 146168 - RNA, 83 nt, Homo sapiens
caguggguccauuuuucuuuuaaaauuaguuaucugaaaaaacuuagcaguaguucccaucuuuaagguaagucuuucauuug

SEQ ID NO: 146169 - RNA, 66 nt, Homo sapiens
aggaaauaaaaagguuacugaagauccaauacacuaguauuucauaccugugcaguaaagucagug

SEQ ID NO: 146170 - RNA, 28 nt, Homo sapiens
uuuuuuaaauugcugugagaacccauau

SEQ ID NO: 146171 - RNA, 67 nt, Homo sapiens
gugcuuuuuaaaauauucagacaaauaucuaucuuacauugauuaaacccguguaaauucauuugca

SEQ ID NO: 146172 - RNA, 45 nt, Homo sapiens
aaagguucagggaaccguuauuauaauuguaucagaggccuauaa

SEQ ID NO: 146173 - RNA, 49 nt, Homo sapiens
gcgggccccucaucgcguccuccuaccgaaaccuugccuuucucgauuu

SEQ ID NO: 146174 - RNA, 51 nt, Homo sapiens
uuuagaugaagccacagcugccauggacacagagacagacuuauugauuca

SEQ ID NO: 146175 - RNA, 67 nt, Homo sapiens
ugcucagcuaccucugaaacuugaaucugaagugauggagaauggggauaacuucucagugggggaa

SEQ ID NO: 146176 - RNA, 44 nt, Homo sapiens
guuuuaaugguauaaagcuaacagaauagucuauuggaaucagg

SEQ ID NO: 146177 - RNA, 76 nt, Homo sapiens
ccuagaucaaauuuggaccccuucaaccaguacacugaagaccagauuugggaugcccuggagaggacacacauga

SEQ ID NO: 146178 - RNA, 49 nt, Homo sapiens
aagagaaagagggugcauuucuaaguuuguacguauggagagauuuauu

SEQ ID NO: 146179 - RNA, 46 nt, Homo sapiens
uugacugaagggugcagggaggccugcaacacagugcugaagaggc

SEQ ID NO: 146180 - RNA, 46 nt, Homo sapiens
ucuaucauuccucaagagccggugcuguucaguggcacugucaggu

SEQ ID NO: 146181 - RNA, 47 nt, Homo sapiens
uaaauuuaauugauaccagaguauccagcucuucccaccuuucccca

SEQ ID NO: 146182 - RNA, 89 nt, Homo sapiens
cgccaucucuuaugcuguccaggucagucucugggauaggagcgucaucuuugcuuguuugagcccuuccucugcugacguaaaagagg

SEQ ID NO: 146183 - RNA, 42 nt, Homo sapiens
ccugauucgggagcugaagcgucuggacaauaucacgcaguc

SEQ ID NO: 146184 - RNA, 46 nt, Homo sapiens
cccuaugaaguuuuuugacacgacccccacagggaggauucucaac

SEQ ID NO: 146185 - RNA, 45 nt, Homo sapiens
accgccuucagcaccuggugguugaguuacuggaucaagcaagga

SEQ ID NO: 146186 - RNA, 49 nt, Homo sapiens
aagacaaggguccuaaaacaggaucaguaaagaaggaaaaagcaguaaa

SEQ ID NO: 146187 - RNA, 54 nt, Homo sapiens
caugaagaauggaagacuugaaucuaucugaauggggacaacugugacugcgau

SEQ ID NO: 146188 - RNA, 42 nt, Homo sapiens
accauuuuuaauaaccuguugcugggagagacaccgccaguu

SEQ ID NO: 146189 - RNA, 52 nt, Homo sapiens
cuguucuggacuugcgcuggaggcuucaccacacuucugggcucuuguagau

SEQ ID NO: 146190 - RNA, 53 nt, Homo sapiens
aaacaaauaggcacaaaauaaucugaugaaaagagccccaucucuuuggggua

SEQ ID NO: 146191 - RNA, 41 nt, Homo sapiens
ccugaggccugaccuggccauucuucccagcagcgaccuga

SEQ ID NO: 146192 - RNA, 56 nt, Homo sapiens
uggacuuauguaugaagaggaucauucugguugcugcaggggagacaaggaagcaa

SEQ ID NO: 146193 - RNA, 52 nt, Homo sapiens
agaacauuccgggccaaaggaacagaaacacagaggccgcaaguggugagug

SEQ ID NO: 146194 - RNA, 45 nt, Homo sapiens
ggccaccuccuccuggacagugacgagcggcccagucccgaagag

SEQ ID NO: 146195 - RNA, 42 nt, Homo sapiens
caugggacuccucccacuccaguauccagaacucgcccaagc

SEQ ID NO: 146196 - RNA, 46 nt, Homo sapiens
uuucuaauggaagagguucacaugauaaagaacaaaccagccaguc

SEQ ID NO: 146197 - RNA, 63 nt, Homo sapiens
aaaauuuuuuuaaauuaagauaaauauauuuuaaaucauacugugaauccaacugguauagca

SEQ ID NO: 146198 - RNA, 105 nt, Homo sapiens
ucaaguauggggaggcccuucucugccucuuagcacgucagggcagagugaucugaagccgaaacucuccugguagaagggaggguaaggcugcggggaguagga

SEQ ID NO: 146199 - RNA, 46 nt, Homo sapiens
ugcggggggccauccuaaccauggcauuuaagaagauccuuaaguu

SEQ ID NO: 146200 - RNA, 33 nt, Homo sapiens
uuaauucucuuuccuuagcagcaaggucuuuuu

SEQ ID NO: 146201 - RNA, 48 nt, Homo sapiens
augccaccaguuuuuccuugaggccuaggauuuuuuauucugucccga

SEQ ID NO: 146202 - RNA, 44 nt, Homo sapiens
uaguggacaucugguauuaauuuaaucucaggaaaaacaagaaa

SEQ ID NO: 146203 - RNA, 55 nt, Homo sapiens
cuccuauuugaucagguuauuuccugggacuuggcaaaaaucugauuggugggga

SEQ ID NO: 146204 - RNA, 59 nt, Homo sapiens
auacuggaaaagaagccaaucuucuugcuaguaaaccagcaacccggcuguauacagug

SEQ ID NO: 146205 - RNA, 71 nt, Homo sapiens
aaaaauggcacucuaaagguaugggaaggaaggagcccaaggcaaccaccugcuguccuuucagccuuccu

SEQ ID NO: 146206 - RNA, 45 nt, Homo sapiens
uuggugcugucaggaucuggauuuggggggagucucucuguagug

SEQ ID NO: 146207 - RNA, 45 nt, Homo sapiens
uuggaacuccaauucuaauauguuucuuuuucauuggaaauugaa

SEQ ID NO: 146208 - RNA, 74 nt, Homo sapiens
uucuucucucugccguuucagggaagagcaccuuaaggccaguguuauuucaugggauucugcccuagagcuga

SEQ ID NO: 146209 - RNA, 63 nt, Homo sapiens
guauauuccuuauucucucauuuauggugcagaacacugggguacuaaccucuaggaaacugu

SEQ ID NO: 146210 - RNA, 66 nt, Homo sapiens
ggauugcugggauuuuuauuuuuuauuuuuugaaaaaaaugguaccuauccguauucagcuuggug

SEQ ID NO: 146211 - RNA, 44 nt, Homo sapiens
aacgaggacgugugcccuuguuaagacuagagagacuguggcaa

SEQ ID NO: 146212 - RNA, 45 nt, Homo sapiens
ccucucucuugaugccuccaugcauucucagcucagaauccugga

SEQ ID NO: 146213 - RNA, 49 nt, Homo sapiens
gaagucuaauugcuaggagcuacauuuuuuuaauccuguaaccccaggg

SEQ ID NO: 146214 - RNA, 74 nt, Homo sapiens
uaucugucccagaggccuccgugcaggggaaaagcccuugguugcccugucagcaggcauuugcucuggcagcc

SEQ ID NO: 146215 - RNA, 50 nt, Homo sapiens
aggagguaucauuuggcuggaaacuugaggaauggauagaauuuggagaa

SEQ ID NO: 146216 - RNA, 48 nt, Homo sapiens
ucagagaggccaggguucuguuguaaagcacagaagugaggauggagg

SEQ ID NO: 146217 - RNA, 58 nt, Homo sapiens
auaggucgggugaaauucugcaugccaugcuaagaaauauuucacugugggcauuagg

SEQ ID NO: 146218 - RNA, 48 nt, Homo sapiens
guacaaguacagacccaaagguauggaaagagcgugugacauauuggg

SEQ ID NO: 146219 - RNA, 46 nt, Homo sapiens
cauuuaguguaacaguuaagucuggaaaaagucagaagguaacauu

SEQ ID NO: 146220 - RNA, 46 nt, Homo sapiens
gggacgcacagagaccgugaagauuccaaguucaggagaacucgac

SEQ ID NO: 146221 - RNA, 49 nt, Homo sapiens
gaaccuccacucagagaagaugaaggauaucgacauaggaaaagaguau

SEQ ID NO: 146222 - RNA, 13 nt, Homo sapiens
ggccuggggaucc

SEQ ID NO: 146223 - RNA, 45 nt, Homo sapiens
gcuuugugcagcgcgcuugcgcgguguggcggccgaugccgcuau

SEQ ID NO: 146224 - RNA, 50 nt, Homo sapiens
gcggcgcggggccgggaggcagcgguggcgggggagccagaggggcggag

SEQ ID NO: 146225 - RNA, 42 nt, Homo sapiens
ggcgcagccucuucuaggggcacugaauccccgcgugaaggc

SEQ ID NO: 146226 - RNA, 46 nt, Homo sapiens
agguguacaggaaacauuugucuuuuguugcuggaaagcugcucaa

SEQ ID NO: 146227 - RNA, 45 nt, Homo sapiens
gacaacuuugacuaccaaacucgagaugacuuugugcgaggucuc

SEQ ID NO: 146228 - RNA, 66 nt, Homo sapiens
augagugcagcucuggguggugcugucagugaaguucgccucuggggugagaggguagacccaucg

SEQ ID NO: 146229 - RNA, 45 nt, Homo sapiens
uacccucucaccccagaggcgaacuucacugacagcaccacccag

SEQ ID NO: 146230 - RNA, 62 nt, Homo sapiens
uccucuaggaugcugccauggcccaggcugaccucaggcccucgguagauguugugccggga

SEQ ID NO: 146231 - RNA, 97 nt, Homo sapiens
ggcucggugaucucuuugcacccuccagaugcagaggaagaugaagaugauggcgaguucagugaugauucuggggcugaccaagaaaaggacaaag

SEQ ID NO: 146232 - RNA, 53 nt, Homo sapiens
uaggagcugcuggcaagggcuaccucuggaaagcugcaggcaugaacauggag

SEQ ID NO: 146233 - RNA, 42 nt, Homo sapiens
cucugcuucuuuacagcugcagagguucauccaguggcuaaa

SEQ ID NO: 146234 - RNA, 47 nt, Homo sapiens
ggugauuagggaaggcuuuacagaaauuugaugcuggaguggccuaa

SEQ ID NO: 146235 - RNA, 49 nt, Homo sapiens
aggaaacagauucaacacagagacagguaaagggaauuuugaggaugca

SEQ ID NO: 146236 - RNA, 44 nt, Homo sapiens
ucuugggauccggagaguggccgggccggcagagcagggggccg

SEQ ID NO: 146237 - RNA, 43 nt, Homo sapiens
cuguucucagagcgaugggccgcggagacugaucugccgccau

SEQ ID NO: 146238 - RNA, 78 nt, Homo sapiens
ccgucaccaacauugcucgcaccagcuucuuccacguuaagcgguccaacauuuggcuggcagcagucaccaagcaga

SEQ ID NO: 146239 - RNA, 48 nt, Homo sapiens
agaugugugacgugauggcugccuacuuuggcaagaucagcgaggaaa

SEQ ID NO: 146240 - RNA, 72 nt, Homo sapiens
uucuagacuuuggcuacccacagaauuccgagacaggcgcgcugaaaaccuucaucacgcagcagggcauca

SEQ ID NO: 146241 - RNA, 55 nt, Homo sapiens
agaagagcagucacagaucaccagccagguaacugggcagauuggcuggcggcga

SEQ ID NO: 146242 - RNA, 64 nt, Homo sapiens
caaguuugggaugaaugacaagauuguuauugaaaagcagggcaaaggcacagcugaugaaaca

SEQ ID NO: 146243 - RNA, 46 nt, Homo sapiens
cugcaccuuccaccagugugugcgacucagcaaguuugacucugaa

SEQ ID NO: 146244 - RNA, 45 nt, Homo sapiens
aagguggucaucaaguccaacuuuaaacccucacugcuggcucag

SEQ ID NO: 146245 - RNA, 79 nt, Homo sapiens
aacacaagcggggugcaggugaucugcaugaaggggaaggccaaguacaaggccagcgagaaugccaucguguggaagu

SEQ ID NO: 146246 - RNA, 46 nt, Homo sapiens
aucaagcgcauggcaggcaugaaggaaucgcagaucagcgcagaga

SEQ ID NO: 146247 - RNA, 43 nt, Homo sapiens
cuccucccuccugcuuugcugccuucccuuugcaccagcccga

SEQ ID NO: 146248 - RNA, 47 nt, Homo sapiens
guugccccucaccucagagcucccccaaaggccaguaauggaucccc

SEQ ID NO: 146249 - RNA, 48 nt, Homo sapiens
uuguacacgugugacuucguccaguuacaaacccaauaaacucuguag

SEQ ID NO: 146250 - RNA, 44 nt, Homo sapiens
gguuggacucugcccuuccaaauaaaccuugcuaaguccaacuc

SEQ ID NO: 146251 - RNA, 45 nt, Homo sapiens
ggugaagaggguagaaacgaucuguaugcgguggucaaggccaag

SEQ ID NO: 146252 - RNA, 46 nt, Homo sapiens
aaacuauugccccucuguuuugggauagucccccccacacacacuc

SEQ ID NO: 146253 - RNA, 61 nt, Homo sapiens
ugucgcugcugagggaucccuccaaaaggaagguuccaccccagccccuuacacccaacca

SEQ ID NO: 146254 - RNA, 46 nt, Homo sapiens
cuguugacugcccaccucacccugcuccugcuguuugcccucugca

SEQ ID NO: 146255 - RNA, 41 nt, Homo sapiens
aaacagcaggagcagggugaggugggcagucaacagggcca

SEQ ID NO: 146256 - RNA, 41 nt, Homo sapiens
uuccugcuggagaaccccagcggcuaccugucccgcuccuu

SEQ ID NO: 146257 - RNA, 45 nt, Homo sapiens
cccacggaagccaaacugugugaggagaagaaacaguaacccagg

SEQ ID NO: 146258 - RNA, 45 nt, Homo sapiens
acaaccccauaaagauguacacgaaaccagcuggguaccuggaag

SEQ ID NO: 146259 - RNA, 45 nt, Homo sapiens
ugacuauacccaacugcagggugacaccggaccacuugugugagu

SEQ ID NO: 146260 - RNA, 40 nt, Homo sapiens
uuucucuguggcuuuggacaccucaggucuccuccuggau

SEQ ID NO: 146261 - RNA, 51 nt, Homo sapiens
ccgccaucgggaggggagggggucuaggcuuggcggcggguugggucucca

SEQ ID NO: 146262 - RNA, 69 nt, Homo sapiens
agggggaucuguugaagugcggguugaagagggggauuccgugagcaagagguuucugaucaacucaga

SEQ ID NO: 146263 - RNA, 78 nt, Homo sapiens
gacaauacgaagaaccuucgggucgagagggacgucuaacaagagagggcaggaggccggggguccgcuugucuuggu

SEQ ID NO: 146264 - RNA, 72 nt, Homo sapiens
ucgcaggcgggcucuggaggaggaggggcgccgcgaccgacgcgcgcgaguuggucugggaaaaagggcggu

SEQ ID NO: 146265 - RNA, 74 nt, Homo sapiens
cccagcagucuccagcggcggcccccggcggcacggacgagaagccgagcggcaaggagcggcgggaugccggg

SEQ ID NO: 146266 - RNA, 51 nt, Homo sapiens
aggauaaacagcuucaagaugaacuggagaugcucguggaacgacuagggg

SEQ ID NO: 146267 - RNA, 46 nt, Homo sapiens
cacacuauggcaaacugaaggaaaucuaugagaacauggccccugg

SEQ ID NO: 146268 - RNA, 46 nt, Homo sapiens
ucuugggaugauucugcugugggauguggaugguggccucacccag

SEQ ID NO: 146269 - RNA, 33 nt, Homo sapiens
cucuucuugccuguggcauagugaacucugggg

SEQ ID NO: 146270 - RNA, 99 nt, Homo sapiens
ugcugaaggugcagcagcugcuccacauuuguagcgaacacuuugacuccaaagagaaggaggaagacaaagacaagaaggaaaagaaagacaaggaca

SEQ ID NO: 146271 - RNA, 62 nt, Homo sapiens
agggaguggcuguucuggggauugcccuuauugcuaugggggaggagauuggugcagagaug

SEQ ID NO: 146272 - RNA, 42 nt, Homo sapiens
aucagcugagauauggggagccuacacuccggagggcuguac

SEQ ID NO: 146273 - RNA, 46 nt, Homo sapiens
uaucaugccaaggacccaaacaaccucuucauggugcgcuuggcac

SEQ ID NO: 146274 - RNA, 65 nt, Homo sapiens
aacgggcagaauuggccacugaggaguuucuuccuguuacccccauucuggaagguuuuguuauc

SEQ ID NO: 146275 - RNA, 43 nt, Homo sapiens
uguuaucagcaggccaugcauccugcugccaaggguggacacg

SEQ ID NO: 146276 - RNA, 45 nt, Homo sapiens
cggaaucagcaaagcucacccacugcaccaccugggcugcugccu

SEQ ID NO: 146277 - RNA, 44 nt, Homo sapiens
ccagaaaaguccucgucuucaaguaagcauccagcagccccaga

SEQ ID NO: 146278 - RNA, 68 nt, Homo sapiens
uugguauugcgaaaggcccggcggaaagaaggcucuagaaccugcuuauagagccacaacagggugca

SEQ ID NO: 146279 - RNA, 42 nt, Homo sapiens
aacccuucucuuuccgugguguguccuuuuuaggcugggucu

SEQ ID NO: 146280 - RNA, 44 nt, Homo sapiens
cugcucacauucauccaucuccuccucaggagcaggggcagccg

SEQ ID NO: 146281 - RNA, 46 nt, Homo sapiens
gcgcuuaaauucauccaacacaaagguacucuugggcaggugagcg

SEQ ID NO: 146282 - RNA, 43 nt, Homo sapiens
ggaaaaggaaaauuacucuggcuuagauauuaagaaccaggcu

SEQ ID NO: 146283 - RNA, 66 nt, Homo sapiens
cagaaaaaauaucaugaguucgucagaaaagaagaguaaagagcuguggaccagcugaggcuggcg

SEQ ID NO: 146284 - RNA, 53 nt, Homo sapiens
aggcugucggcugaaagcauuauuugcaggugacacuugagaugggccuuaag

SEQ ID NO: 146285 - RNA, 35 nt, Homo sapiens
gcccuaacuauccaggagaucgcugcgcuggccag

SEQ ID NO: 146286 - RNA, 64 nt, Homo sapiens
aggggcauuugggaggcagaggcggggcucagggggcgggagcagugcccgggaagggggggcc

SEQ ID NO: 146287 - RNA, 41 nt, Homo sapiens
guccgcgccgagggcagguggagcagaaccccgccccagag

SEQ ID NO: 146288 - RNA, 26 nt, Homo sapiens
augggaaaggcaccacccaccucaug

SEQ ID NO: 146289 - RNA, 47 nt, Homo sapiens
ggcugaccaguuugaguauguaauguauggaaaaguguacaggauug

SEQ ID NO: 146290 - RNA, 40 nt, Homo sapiens
ugugaaagacacagugggagagcugaaaaugaaucagaag

SEQ ID NO: 146291 - RNA, 49 nt, Homo sapiens
ccgggcccuggcggguggggagcgccgggucgcgcgggcgucggagugg

SEQ ID NO: 146292 - RNA, 42 nt, Homo sapiens
gcccaaccccggccugugggcagccgcgccagcugccgggac

SEQ ID NO: 146293 - RNA, 46 nt, Homo sapiens
cucccgaccagugcugcccuguuugcccuggugaguuccccgcagg

SEQ ID NO: 146294 - RNA, 51 nt, Homo sapiens
gugucccagugccucugggggacacucagugucugcucugucuuguaccag

SEQ ID NO: 146295 - RNA, 44 nt, Homo sapiens
cucuacucacucuacuauauggugcuggugucucuggcccugcu

SEQ ID NO: 146296 - RNA, 41 nt, Homo sapiens
ucaaaauguuuuuucacuucuucucuccauucagccugggu

SEQ ID NO: 146297 - RNA, 375 nt, Homo sapiens
gcugcgggguagacgggaagagcaagggccucgagacgggcacagcaggagccucuugggcgcucacugccagugucuggauggagagagaugccacgagucggcugcucgcugugcauggcagccuccuggccccaguccuggagcuguucuccugggccuccccacccuacauguauuccugauaaaggaacaccccacuuucuccggauggccagcacuguggacacgggcuggggagucagagagaagaggcagccgucaaaugugcucugagagcuggggcugugccaggagagggcccagccaugcccagcccagcgugcucaccugcagugaacguguauuguccaaccuuagccacuccuucaagga

SEQ ID NO: 146298 - RNA, 46 nt, Homo sapiens
caccugcaucagcgcccauguccgcgagaagcccgacgacccccug

SEQ ID NO: 146299 - RNA, 45 nt, Homo sapiens
cauccacucggaucucuccugaacucccacgacgcuaucccuuuu

SEQ ID NO: 146300 - RNA, 52 nt, Homo sapiens
gaauguagcccuuccaacaccugacagaaugagaccaaacgcagccagccag

SEQ ID NO: 146301 - RNA, 51 nt, Homo sapiens
ugaaauguccagaauaggccagucccuagagacagaaaguagauuggcagu

SEQ ID NO: 146302 - RNA, 46 nt, Homo sapiens
acaacauguggaauauccauuuaacagaauguuauucagccacaga

SEQ ID NO: 146303 - RNA, 38 nt, Homo sapiens
aguccuuuuuguuuuaucauuguuguccucaagaagau

SEQ ID NO: 146304 - RNA, 44 nt, Homo sapiens
cuggaaaagcuacagaagggccugagugauucauacaucuucac

SEQ ID NO: 146305 - RNA, 48 nt, Homo sapiens
gcagcccacgucacaugacaauuaugaggugugaugagaagagcuaga

SEQ ID NO: 146306 - RNA, 46 nt, Homo sapiens
cacugugaagggcacaguugaggccugugccagugcugagauagag

SEQ ID NO: 146307 - RNA, 42 nt, Homo sapiens
cagaaauuugaagaaaauugaacaugaaacagggaccaagau

SEQ ID NO: 146308 - RNA, 35 nt, Homo sapiens
agccauuagucuuaauggcaggcugccaauggaaa

SEQ ID NO: 146309 - RNA, 45 nt, Homo sapiens; identical to SEQ ID NO: 55101

SEQ ID NO: 146310 - RNA, 46 nt, Homo sapiens
gucaacacagacacagaaaccgccguugucaacgucacauaugcaa

SEQ ID NO: 146311 - RNA, 46 nt, Homo sapiens
aauugauuacaaauuacugugaacucagaugaauaaacguagagau

SEQ ID NO: 146312 - RNA, 49 nt, Homo sapiens
uauuaccuuguaaaaugaagagauccuuguaaaagaauuguuaaauauu

SEQ ID NO: 146313 - RNA, 90 nt, Homo sapiens
aauaaauugagaaacggggaaaagauaguguucagcgaagcccuuggagaaguucuaguaaaacuugagcuaaaacuacguuucuuucuc

SEQ ID NO: 146314 - RNA, 60 nt, Homo sapiens
ucugagcucaaaugaugauguguaaauauuuguuuuuacccucguuagucuuaauuacag

SEQ ID NO: 146315 - RNA, 40 nt, Homo sapiens
uuugucacaccaaauauuuuaaaagaucugcauuccaggg

SEQ ID NO: 146316 - RNA, 43 nt, Homo sapiens
uaaauaaaaguauuccaaaauucuaguucuuaagaggucaaau

SEQ ID NO: 146317 - RNA, 47 nt, Homo sapiens
caccugcaugguguccccugcugggaauuucagguugugagcaagau

SEQ ID NO: 146318 - RNA, 47 nt, Homo sapiens
cauuuucauggugacacuuguuagcuuguaaauuagagucccaagac

SEQ ID NO: 146319 - RNA, 46 nt, Homo sapiens
gaaucauggugaagaugaucucuagaaaagcucucugcgguccugu

SEQ ID NO: 146320 - RNA, 227 nt, Homo sapiens
auuuccauucuuggcaguuucucaagaaaugucuuuuucgagacaggcucuugugccauauuuuacaggcugggcgcaagcuccugggcuuaagcaguccucgugccucagccucccaaguagcugggauuacagcuagaacuuaugugaaacucaagaauuuaugucgaacucuucgucagagcuggaaguaggacauacaguuggauuuauuuauugaucuuuuu

SEQ ID NO: 146321 - RNA, 47 nt, Homo sapiens
ugggauauggcauuuuccguggaauucugacucaggagaugggggag

SEQ ID NO: 146322 - RNA, 59 nt, Homo sapiens
uccuuuaacucuuauggacuguuuauggugcuggugggagggagagaggaauuaucaag

SEQ ID NO: 146323 - RNA, 40 nt, Homo sapiens
aaaaauaugcuaaauaaugaagcaugugaaguacaguuca

SEQ ID NO: 146324 - RNA, 34 nt, Homo sapiens
ucaacaucugagccacacagauuagacagcgaac

SEQ ID NO: 146325 - RNA, 47 nt, Homo sapiens
gcuuaauaauuuguuuaggccacaugacuguuaauuaaguaguaggg

SEQ ID NO: 146326 - RNA, 46 nt, Homo sapiens
cccagaauuuauuaguaaaguuuuauccuucuuauauucaaauuca

SEQ ID NO: 146327 - RNA, 52 nt, Homo sapiens
ugcauaacacaagugcucucagugaguaaacuucauuagaagaagcguuaua

SEQ ID NO: 146328 - RNA, 27 nt, Homo sapiens
uuaauuaaauauuagaaaccaaugaga

SEQ ID NO: 146329 - RNA, 42 nt, Homo sapiens
ucucuuccagugccucgugcccagaaccucucgcccucuggc

SEQ ID NO: 146330 - RNA, 87 nt, Homo sapiens
ccugaccccacagcauauaugcuuauuaugauuaaacccucuacuccugauucucuagaguauaucaccugucagcaaaaugaacag

SEQ ID NO: 146331 - RNA, 79 nt, Homo sapiens
cuaugcaaaggaaguuuaaacuuaguuuuccuuaagguucagcccuacaaugacuuucagucagaaauggguuaaacug

SEQ ID NO: 146332 - RNA, 42 nt, Homo sapiens
cuccugcaaagcaccgauagcugcgcucuggaagcgcagauc

SEQ ID NO: 146333 - RNA, 45 nt, Homo sapiens
agggccgggccaguucguggguuggugggucgugggucagcgggg

SEQ ID NO: 146334 - RNA, 74 nt, Homo sapiens
aucaagagguauaguucuaugaagaagcuuuuugagcaugaacucuguguggugaggugcaccuggcauaggag

SEQ ID NO: 146335 - RNA, 98 nt, Homo sapiens
uccagcagcccacaucugaaagguggcagggcaagaggagaagaugggcuuauuuugugauuggcaaacauucuuugcuaaaaugauguuuugagagu

SEQ ID NO: 146336 - RNA, 40 nt, Homo sapiens
cugcaccgcuucccugggcagcagcacuucaugcucccag

SEQ ID NO: 146337 - RNA, 46 nt, Homo sapiens
ccuuuuuaauauccuuuauagaggcacuucgaggcacccccaagau

SEQ ID NO: 146338 - RNA, 46 nt, Homo sapiens
gaacacuaauuuaccuaagacuaaaggcaaucaagcuugaaugaua

SEQ ID NO: 146339 - RNA, 46 nt, Homo sapiens
uaaaccucuuauuuuuagucaaaagugcaaguucugggagucaaua

SEQ ID NO: 146340 - RNA, 45 nt, Homo sapiens
uuaucuuuuaggaaauccgagcuguguaaagcauaaccccugagg

SEQ ID NO: 146341 - RNA, 39 nt, Homo sapiens
cuuaaaugacucaaauucuaaagcuggagaaguagagac

SEQ ID NO: 146342 - RNA, 48 nt, Homo sapiens
guguacaaaucaucuccucuccuuucaaauauugggugccuaaaaaca

SEQ ID NO: 146343 - RNA, 45 nt, Homo sapiens
ucuuucuuucuuccuuuucauuauuugcuuuccuuccuuccuccg

SEQ ID NO: 146344 - RNA, 22 nt, Homo sapiens
ugcccuuccccuucgcaccccg

SEQ ID NO: 146345 - RNA, 51 nt, Homo sapiens
ucuggauauugauuaaguuguuccaguuucuagaauuguugcacaguucuc

SEQ ID NO: 146346 - RNA, 51 nt, Homo sapiens
cugagcugccgacuagggccauaggcuagcuaugugggcccauauugaggu

SEQ ID NO: 146347 - RNA, 48 nt, Homo sapiens
uacaaguaguucgagagaaagugaaaaauuuugcucaauuaacugugu

SEQ ID NO: 146348 - RNA, 67 nt, Homo sapiens
uuaauuuuuguggguauaacagauucgagcaaugcagaaaggaaguaaaacauuauuucacucuuuc

SEQ ID NO: 146349 - RNA, 76 nt, Homo sapiens
ucuuuguuaaaauaauucauaaauuaucucucuaaccaguacugaucacuuuuuuuuuuuuuuaacuuauggagga

SEQ ID NO: 146350 - RNA, 46 nt, Homo sapiens
cuugcagagucuggguuuacggaucgacaaauugaggcccgcggca

SEQ ID NO: 146351 - RNA, 35 nt, Homo sapiens
cuggcacuuaagugguagggagggaggagagagaa

SEQ ID NO: 146352 - RNA, 44 nt, Homo sapiens
gcugccacgccggcaggcccugccaugucugguagacgccagug

SEQ ID NO: 146353 - RNA, 84 nt, Homo sapiens
cagcuuuauucuccagaaguaccgaugaggacaaagcaaggcccugaccucaaagaaauugggcuucugacaacacuuaucaaa

SEQ ID NO: 146354 - RNA, 45 nt, Homo sapiens
uuuuuccuaccugccaauucuagccuuggaaauaaaagccaagca

SEQ ID NO: 146355 - RNA, 32 nt, Homo sapiens
cagcauuggauccacucauaagggagggcaga

SEQ ID NO: 146356 - RNA, 55 nt, Homo sapiens
gugaaucauuuggaugagauaaaaacaggauuuuauuugcugcaugcauguugug

SEQ ID NO: 146357 - RNA, 47 nt, Homo sapiens
ccuaucuugacugaucagcaacuuuugauacaauugaccauuccauc

SEQ ID NO: 146358 - RNA, 62 nt, Homo sapiens
acuguggagugccucugggaguggcccuuggacuuggccucuucucugucuccucaugcccu

SEQ ID NO: 146359 - RNA, 43 nt, Homo sapiens
gacaacccucaauuuauauuuccaacccacaccuuuccccuga

SEQ ID NO: 146360 - RNA, 63 nt, Homo sapiens
ucuuucucucaugcugcacccacucuguuagcaaaccaugucagcugugcuuucacaauaaau

SEQ ID NO: 146361 - RNA, 49 nt, Homo sapiens
ccuacuccucagauauaaagcacacuuuggucucagagccuuuccacug

SEQ ID NO: 146362 - RNA, 54 nt, Homo sapiens
augcuucugggucuaagggcagaggagaaaggggauuggcugagcugcugccag

SEQ ID NO: 146363 - RNA, 54 nt, Homo sapiens
agcgggugggacauccguuaagcaccaguuuauccuuguagaauuguagguuca

SEQ ID NO: 146364 - RNA, 34 nt, Homo sapiens
agcuuuggcucagcagggcacucagaacaugaau

SEQ ID NO: 146365 - RNA, 46 nt, Homo sapiens
uuuguuguggaacaugacuucaucauggccaccuaucuagcggauc

SEQ ID NO: 146366 - RNA, 47 nt, Homo sapiens
aacgacauuuaucagaaugcuugcuggaagacuugaaccugaugaag

SEQ ID NO: 146367 - RNA, 46 nt, Homo sapiens
ucagcagcuugaauuaacccaccuaacagaacgaaauguugaagau

SEQ ID NO: 146368 - RNA, 53 nt, Homo sapiens
uucauucuugaccucuccucaguauccaguuggcaucacuaugugggccuccc

SEQ ID NO: 146369 - RNA, 44 nt, Homo sapiens
cccucgcugagcagcuauggcugcggcgauagccagcuccuuga

SEQ ID NO: 146370 - RNA, 42 nt, Homo sapiens
aauaaaacguuccuuuagaaaacaagccaccaaccgcacgag

SEQ ID NO: 146371 - RNA, 47 nt, Homo sapiens
gggacggugaccccugucuggucugacccccaucuuggggaugagau

SEQ ID NO: 146372 - RNA, 44 nt, Homo sapiens
aagagcugcuuuuaugacagguuuuggaaauuaaaauggcagag

SEQ ID NO: 146373 - RNA, 42 nt, Homo sapiens
ugucguguugacacuggcugggguagcagccaccggggacga

SEQ ID NO: 146374 - RNA, 42 nt, Homo sapiens
cggaagucuggaagaaaucaccgcgaggcgagcgggacgccc

SEQ ID NO: 146375 - RNA, 39 nt, Homo sapiens
cuggugugcccgaggccguauaauuaggccaggccugag

SEQ ID NO: 146376 - RNA, 43 nt, Homo sapiens
ggagccggggaggaagcuaggagcggguuguuaccggccaacg

SEQ ID NO: 146377 - RNA, 79 nt, Homo sapiens
aagaaggacgcuggaaagucagccaagaaaaacaaagacccagugaacaaauccgggggcaaggccaaaaagaagaagu

SEQ ID NO: 146378 - RNA, 45 nt, Homo sapiens
cucuguaaggaaguucccaacuauaaacuuauaaccccagcugug

SEQ ID NO: 146379 - RNA, 48 nt, Homo sapiens
aggagcuccuuaguaaaggacuuaucaaacugguuucaaagcacagag

SEQ ID NO: 146380 - RNA, 43 nt, Homo sapiens
ggacuggaguuggugacuaguccacuagagacuagaauauggc

SEQ ID NO: 146381 - RNA, 46 nt, Homo sapiens
ggcccugugguccuaggcugccagggcagguagugagaucccaggu

SEQ ID NO: 146382 - RNA, 25 nt, Homo sapiens
auacccacauacuuacacacaccca

SEQ ID NO: 146383 - RNA, 33 nt, Homo sapiens
acaucagcaucugaaagguuguggaaauugugu

SEQ ID NO: 146384 - RNA, 42 nt, Homo sapiens
cccagcccugcuccagccugccucuuuaacacucauugggug

SEQ ID NO: 146385 - RNA, 46 nt, Homo sapiens
ucaugccccaaacgcugcggucaucagugaccugaaugguagucag

SEQ ID NO: 146386 - RNA, 45 nt, Homo sapiens
gaagagacggauguggugucaggguaacugggugugucuggguac

SEQ ID NO: 146387 - RNA, 45 nt, Homo sapiens
ugaggcgguuguucugcagggagauguucugcagguuggccaaca

SEQ ID NO: 146388 - RNA, 46 nt, Homo sapiens
gaaucaggaccugcaacuggcggagguugcugaagacauugucggg

SEQ ID NO: 146389 - RNA, 43 nt, Homo sapiens
agggcgaugagggcugagauauugaggaacggggacucauuga

SEQ ID NO: 146390 - RNA, 41 nt, Homo sapiens
agcucggcgcccgcccgccguggacaagagggagccugaga

SEQ ID NO: 146391 - RNA, 24 nt, Homo sapiens
ggaaaagugugugugugcauguaa

SEQ ID NO: 146392 - RNA, 76 nt, Homo sapiens
gacguagagauucccaggaccucuguuggauccaaucugcaaccugccuuggagacgucaucugugggucuuggag

SEQ ID NO: 146393 - RNA, 42 nt, Homo sapiens
aacacaaugccuggcauauagcauaaaauauaaauucaauau

SEQ ID NO: 146394 - RNA, 33 nt, Homo sapiens
aaaaauacagaaucccuguccucccacagaagc

SEQ ID NO: 146395 - RNA, 46 nt, Homo sapiens
acaguggacucucuaaaaaauauccugacuucuaauaacauugaug

SEQ ID NO: 146396 - RNA, 42 nt, Homo sapiens
acuggauccuggccaccgacuaugagaacuaugcccucgugu

SEQ ID NO: 146397 - RNA, 328 nt, Homo sapiens
agaagugaaucugccaggcacggcggcucacgccuguaaucccagcacuuugggaggcugaggcagguagauugccugaggucaggaguuugagaccagccuggcuaacauggugaaaccccgucucuacuaaagauacaaaaaauuagccaggcgugguggugcaugccuguaaucucagcuccuggggaggcugagggaggagaauugcuugaaccggggaggcagagguugcaguaagccgagaucgcaccacugcacuccagccugggggacagagcaagacuccaucuccaaaaaaaaaaaaaagugaaucuucuuugugugu

SEQ ID NO: 146398 - RNA, 216 nt, Homo sapiens
acugacuuucuuuuuuuuuuuuaauuguauuuuaguagagacgggguuucacuguguuggccaggcuggucuugaucuccugaccuugugauccgcccccccuuggccucccaaagugcugggauuacaggcgugagccaccacgcccggccaaccuacugacuuucuaacacauacgacugcucuaauuucaguuggccucccugcucugccuug

SEQ ID NO: 146399 - RNA, 62 nt, Homo sapiens
ccugggucagggaggaugggaaccuugcuggaucgggacugccugcuccuagcaggaauuga

SEQ ID NO: 146400 - RNA, 48 nt, Homo sapiens
caccaccaucgauuuagaacauuucacuguuccgaaaaggaaccucau

SEQ ID NO: 146401 - RNA, 48 nt, Homo sapiens
caucaucauuacagggagaaaugcagagagcuggaaauagcucgugug

SEQ ID NO: 146402 - RNA, 43 nt, Homo sapiens
aaaccucuugcugaaaacuuaggaaacucuccaaggucacuca

SEQ ID NO: 146403 - RNA, 32 nt, Homo sapiens
guucuuucacagacauuuccauauaccucaug

SEQ ID NO: 146404 - RNA, 46 nt, Homo sapiens
cucaaagaagucagauggacacauuaaagaccaaaggcugggggga

SEQ ID NO: 146405 - RNA, 47 nt, Homo sapiens
agccucuuccucaccggaguuuuccucacuucaaggagcggcgccuu

SEQ ID NO: 146406 - RNA, 61 nt, Homo sapiens
uccaccccuggucccaccuuguuugaguuugucuaggucuuucuuggagugugcugugauc

SEQ ID NO: 146407 - RNA, 79 nt, Homo sapiens
ccggggguggggcgugcggcagcaacugggcgagcgggccggggggccgcggcgagcgaggaggcggcgcggccgagaa

SEQ ID NO: 146408 - RNA, 47 nt, Homo sapiens
guucaaaacuaagccaaacugaagacagacagcucagaaguuccaua

SEQ ID NO: 146409 - RNA, 25 nt, Homo sapiens
aauuggauuccucuggaaaaacagc

SEQ ID NO: 146410 - RNA, 47 nt, Homo sapiens
uuguaaaggcaucuaaauauuucuucuaagccauuuccucucugcag

SEQ ID NO: 146411 - RNA, 47 nt, Homo sapiens
uggacaaaaaauucuuuaagacucaacaauaagaagacaauccaaua

SEQ ID NO: 146412 - RNA, 52 nt, Homo sapiens
ugucagagauuaaauaaauaggaggaaacagaagcuccuguacaguuaguaa

SEQ ID NO: 146413 - RNA, 40 nt, Homo sapiens
uaucguuugauccagcauaugcuccagauucaccacagau

SEQ ID NO: 146414 - RNA, 68 nt, Homo sapiens
uaguguagaauuuaacacaaauugaauaaucauucccugaguacagccuuaaaaccuguaaguauuag

SEQ ID NO: 146415 - RNA, 73 nt, Homo sapiens
auuuuguucuauuagacaugugccaaauaaugugcuugcuuauauaguuuuaggggagcagacaugucugcac

SEQ ID NO: 146416 - RNA, 29 nt, Homo sapiens
ccugauuucugcaaucaaaaacaacauau

SEQ ID NO: 146417 - RNA, 46 nt, Homo sapiens
uauuuuacuuuugauggauauggauuuauuuucagguuauuacuag

SEQ ID NO: 146418 - RNA, 53 nt, Homo sapiens
ggacaguaggaguauuauugaguguaugggaggaugcagugaucauugaagaa

SEQ ID NO: 146419 - RNA, 41 nt, Homo sapiens
ggucauguaacaggacauuuucauaaagaagucuuucccaa

SEQ ID NO: 146420 - RNA, 49 nt, Homo sapiens
aaauauuuuuccuuaugcucuuauguaauaccaaacaaaauagccucag

SEQ ID NO: 146421 - RNA, 50 nt, Homo sapiens
aauuuuuuuauaacuuacuggaguugauuugacaaguuaaaauauaaugg

SEQ ID NO: 146422 - RNA, 30 nt, Homo sapiens
agucuuugaacucucuuuuuauacucacau

SEQ ID NO: 146423 - RNA, 57 nt, Homo sapiens
agccaugaaaagacauggaggaaccuuaaaugaauauuaccaggugaaagaagccaa

SEQ ID NO: 146424 - RNA, 47 nt, Homo sapiens
uuugguguuuuuccugauuuuuugucauugaugauuuuuagccaaca

SEQ ID NO: 146425 - RNA, 46 nt, Homo sapiens
gauagcuuggaaacaccaacuuacguaaguuccauuuccuccccac

SEQ ID NO: 146426 - RNA, 37 nt, Homo sapiens
ucugagaaaaauaaaucugagagagucucuuacaugu

SEQ ID NO: 146427 - RNA, 44 nt, Homo sapiens
gaugacucaaguauuuucauuaccaaaauuaucacagggggagc

SEQ ID NO: 146428 - RNA, 47 nt, Homo sapiens
ucauaagggacuuguaggagcuuuauuauuuugccuuucacauuuag

SEQ ID NO: 146429 - RNA, 59 nt, Homo sapiens
acauuugauuuuuuuuuuuuuuuuuuuuuguggugauugucaagcauugauggagggga

SEQ ID NO: 146430 - RNA, 33 nt, Homo sapiens
cuguuggauacugcaaaccuguaauaucaauag

SEQ ID NO: 146431 - RNA, 24 nt, Homo sapiens
uuauuucauauaaaaagccugaag

SEQ ID NO: 146432 - RNA, 46 nt, Homo sapiens
ccaccuucuuucccuuggccuucuuuccuuucggcaucuugggcag

SEQ ID NO: 146433 - RNA, 46 nt, Homo sapiens
gaagaaaauaucagagacuauguucacaggccuagaguagguaaca

SEQ ID NO: 146434 - RNA, 53 nt, Homo sapiens
uauguaaaaguuggggaaaacuaauuucauauuaaaaugagcaguaggaaaag

SEQ ID NO: 146435 - RNA, 60 nt, Homo sapiens
aggguaaugccuugguuucaggagucagagccugagggcuggugaggaaagcacauaugg

SEQ ID NO: 146436 - RNA, 41 nt, Homo sapiens
acagucguuuugaagcuaaaauacaugauuuacgggagcag

SEQ ID NO: 146437 - RNA, 46 nt, Homo sapiens
ugguggcaagccaggcagguuacaccagauggugagagcgaugagg

SEQ ID NO: 146438 - RNA, 48 nt, Homo sapiens
gaacgagcccgauuaaaaacagugaaauucaauucuaaaacgagagau

SEQ ID NO: 146439 - RNA, 46 nt, Homo sapiens
uaaaaagaaccucuuuucccgaaaauuccccuucuacaagaacaag

SEQ ID NO: 146440 - RNA, 28 nt, Homo sapiens
agcugcagcagguugcuaauugucuuca

SEQ ID NO: 146441 - RNA, 35 nt, Homo sapiens
auguacccucauuauuagaauguagaaauaugcuu

SEQ ID NO: 146442 - RNA, 33 nt, Homo sapiens
cuaucacuagugacacccuuacauuuggggaaa

SEQ ID NO: 146443 - RNA, 50 nt, Homo sapiens
agauugagacuuuggaagagaaauaauaugaaaaaugguaacugauuauc

SEQ ID NO: 146444 - RNA, 47 nt, Homo sapiens
aagauuuuauucacaaaauguuggagaagacagaaaaauaucaguaa

SEQ ID NO: 146445 - RNA, 50 nt, Homo sapiens
uuauauuacauucuugguuuuauuaagugaacugcacaagcaugugaugu

SEQ ID NO: 146446 - RNA, 29 nt, Homo sapiens
cuggccaguauaacaaucaucuauaugga

SEQ ID NO: 146447 - RNA, 54 nt, Homo sapiens
gccauacagugagccauuguugcaaaccccacugccacuguuacaagccccucc

SEQ ID NO: 146448 - RNA, 35 nt, Homo sapiens
agaccaggacauucaaaaguauaugaggggagguu

SEQ ID NO: 146449 - RNA, 40 nt, Homo sapiens
uggagguaaaaauaacugaaauggaaaauucacuacaggg

SEQ ID NO: 146450 - RNA, 57 nt, Homo sapiens
ccaucaagcagucaacguacacauuguggagguccuugaaggagaauagagagaagg

SEQ ID NO: 146451 - RNA, 108 nt, Homo sapiens
aagaaauaauggccaaaaacaucccaaaugugaugaaagacgugaauauaauccaagaaagucaaugaacucaaagcaggauaaacuuagauacccacacugcggcac

SEQ ID NO: 146452 - RNA, 52 nt, Homo sapiens
aaacacugaaggaaaaaaaaaaaauuuaacugucaacaaagaauccuauauc

SEQ ID NO: 146453 - RNA, 36 nt, Homo sapiens
gcuuccuaccuacauacaacgucuuucuucuaugca

SEQ ID NO: 146454 - RNA, 40 nt, Homo sapiens
uuuguuuguuuguuugcuuuauuaacuaaucccucacaga

SEQ ID NO: 146455 - RNA, 92 nt, Homo sapiens
ucguguguauuauuuaaugucacuauugguuaguggccauuuuucagaacugaagauggaauggccugaccagcuauuaagaacguggggag

SEQ ID NO: 146456 - RNA, 51 nt, Homo sapiens
cacacaaacauauauauauauuuaaaauauauuuuguuucuuuugccaccu

SEQ ID NO: 146457 - RNA, 46 nt, Homo sapiens
gugccgcaaggagccuugcguccugggcgucgaugaggcgggcagg

SEQ ID NO: 146458 - RNA, 168 nt, Homo sapiens
aaaguggcaggugagcccgaggugugcgucuggggaagggauuccuggguaugugcaggggcaggugagaacugaaaggggagggcaggaacugggagaaccagcuguuccccuucucuuccaaaccuccucccagacucaaagacccuauuggagagcgagcgggaa

SEQ ID NO: 146459 - RNA, 135 nt, Homo sapiens
gaugugcugucuccaaaccucaucucuaccagcaugcuugggcggugagggguccccgggaggggcagccagcaugggcugaccaagcuuuguuccuagaaugagauuaacugggcucuguuccccaccacaggg

SEQ ID NO: 146460 - RNA, 2614 nt, Homo sapiens
ugaacgucacccaggugaguuaacuguaaguuguccccauuuggucaucucaggauaaaauggggacaaaacaggaguucgagacugcagugagccaugaucaugccacagcacuccauccugggugacaaaggaagccccccaacucaaaaauggaggcagggcgcaguggcucacgccuauaaucgcagcacuuugggaagccgcggcggguagaucaccggaggucaagaguucgagaccagccugaccaacauggugaaaccccgucucuacuaaaaauacaaaaauuagcuggacgugguggcaggcgccuguaauccuagcuacucaggaggcugagacaggagaaucgcuugaacccaggaggcagaaguugcagugagccaagauugugccauugcacuccaacccgggcaacagagcaagacccugucucaaaaaaauaaaaaauaaaaaauaaacuaaaaaugggagaccaggcgcaguggcucacggcuguaaucccagcguuucaggaggcugaggcaggcagaucaccugaggucaggaguugaagaccauccuggccaacauggugaaaccucaucucuacugaaaauacaaaaaauuagcccagcaugguggcgggugccuguaaucccaccuauuggugaggccgaggcagaagaauugcucgaacccgggaggcggagguugcagugaggugagaucgcgccauugcacuccagccugggggacagagcgaaaaauaaaaauaaaaauaaaauaaaaaauaaaugugggcaaaaaugugcagugugcagauucagcaucagauacgucuggagugccucgggcauauucauugcuacuguugauuucgugcuccuguuucugcccuaaaugugugccacacugacgaccacaguguagccccuagucccgucuccaucuaaucucucccucauccuaaaggcucagucuccagaacaaauccuacauugucuaccugucaccucuguccuagcccaggacaccccccacucccuggacaccugcugagugucgucucucgucccucacccuccuauccccuccaaucuguuccccaagcagcaacagaagguagucuuuuugaaaugcacaucucgacauuuaguuuuccgaucacaguggaaauuaaaucaggaaaauucacagucgaguggggcagaauuacauuaaauuaccagagaaaaacauaaaucagcauugccucgaaugcucucaaugaaagaauggaccguucugagagaauaacaaggcaaaauaaccuugacguaggaauuguaugcuggguaugguggcucacgccuguaaucccagcacuuugggaagcugaggugagcaaauugguugaggcuaggaguuccagaccagccugggcaacauagcgagacuccaucuccacaaaaagaagaagaaagaaaggaauuauagcaagguagacccugcugaggagggaccugaggaccaggcccaaaugcagagcuggcgauacaguaacugguguagacagacaagggcccuacccguaggcguucagggccuagccugggcagaaagauggucagcuggagguugggcgcaguagcucacgccuguaaucccagcacuuugggaggccgaggcgggcggaucaucaggucaggaguucgagaccagccugaccaacauggugaaaccccaucucuacuaaaaauaaaaaauaaaaaaauaaaacaugaaagauggucagcugguaaacaaaaaauaaagguuguuucugaaaacaguagugcuguggagauaccacuuucucccagcagcucuuggacccucucuucggugcugcagccaaaggcccccaugcaugggcccagcaucaugaaccuggucccagcucagggccuuuguacuggcuguucucacaccuagagcccucuuccccagaucucugcacaguucacuuccucaccuccuucaagccuuuauucaccacuacaccuagcuaacuuuuuauuuuuuguagaaacagggucuccauauguugcccagguuggucucaaccaccugcccucaagcgauccucccacuucggcuuccuaaaguguugggauuacaggcuugugcuaacgcacucuaccaauuuuuuucuaguguuuucugccaccucaguuccuagaacaguauguggcaugcaguaggugcuaaauaaguuagaguaaaagcagcgugauagagaaagccucuucaggaggugaguuuuuucuuuauuuuauuguauuuauuuuauguuuuuauaaagauggggucucacuguguugccaagccuggccucaaacucccaggaucaagcgauccucccgccucagccucccaaagugcugggaucacaggccugaacaacuuugccuggucuaggaggagauguucgaguugaaaucccugauugauccauccuggggacgugcuggagaagaggauucuggguagcaggaagaacgugccagggcugugaggcuagagcauugguacaguuguuuguucaauuaauaugugucuguugcuguggcagguauucguggacaccguagggaugccagagacauac

SEQ ID NO: 146461 - RNA, 2722 nt, Homo sapiens
cuugggaucugggguagggugggcaauggugacaguccaaguugcaccauaacauucaagcucccugccacucuuuuuuuuuucuuugagauggagucccacucuguagccaggcuggagugcaguggcgcgaucucagcucacugcaaccuccaccucccggauucaagcgauucuccugccucagccucccaaguagcugggacuacaggcgcaugccaccaugcccagcuaaauuuuguguuuuuaguagugacgagguuucaccauguuggccaggauggucucaauugcuugaccucgugaucuaccccccucggccucccaaagugcugggauuacaggcaugagccaccacgcccggccuccuugccgcucuucuaaggcuuccuccugaguaccuggggcaccuccuauggucugaagcaccuucuugccacaggaccuuuaccuggccaagagcugcuaaaagggcagugcagggagacugccucugagacaucuccuugaccuccaagaacaagucauuaaacauuuuuauuuuauuuacuuauuuuuugaaauggagucuugcucugucacccaggcuguagugcaauggugcgaucucggcucacugcaaccuccgccucccagguucaagcgauucuccugccucagccucccaaguagcugggacuacagccacccaccaccauaccuggcuaauuuuuguauuuuuaguagagacgggguuucaccauauuggacaggcaggcuggucucaaacuccugaccucaggugauccacccaccucagccucccaaagugcugggauuacagguguaaacaccacacccagccuuuuuauuuuuuugagauagggucucgcucuauuacccaggcuggagugcagugacauuaucacagcucaaugcaaccucugccucccaggcucaagccauccucucaccucagccucccaaguagcugggacuacaggugcgcaccaccacaccuaauuuuuguauuuuuuguagagauggggucuugucauauugcccaggcugguugugaauuccugaguucacaugaucuaccugccucugucucuuaaaaugcuaggauuacgggcaugagccaccuggcccagccugucauuaaauauuauuauuauuauuauuauuauuauuuugagauggaauuuugcucauuucccaggcuggagugcaauuaugcgaucucggcucacugcaaccuccaccucccagguuuaaguaauucuccugccucagccucccgaguugcugggauuacgggcgugugccaccacguccagcuaauuuuguauuuuuaguagagaugggguuucaccacguuggucaggcuggucuagaacuccugaccucaaaggauccaccugccucagccucccaaaguccugggauuacaggugugagccaccacgccuggcuaacauuauuuuuuuuuuugacacaagaucucaucuugucaccaaggcuggagugcaguggcauaaucauagcucacugcagccuccaacuccugggcucaagcaacccacccaccuuagccuccuccuccagaguagcugggacuacaggugggcaccacuauaaccggcuaauuuuuuaaauuuuuuauagagaugggggucucgcuauguugcccaggcuggucuugaacucgaggacucaagcgguucuccuaccucagcuucccaaagugcugggauuacaggcaugagccaccacgccugguccccuuccccuuaacaaagggacaaaugcccaccuugggucucaguccaucacuggggcuccagaaagacagcaaagugggaagcggggaagacagcagcaauccuauggccuggaauucagcucuaucacucacuggcuguguggccauaaacaaauggcaccacugucuaacacuuggccucuuucacuguggaguagggugaccagagcaauuuagaaaaccuccagccaggcacaguaguucacaccuguaauccuagcuauuugggaguccaaggcaggaggaucacuuaagcccaggaauucaagaccaggcugggcaacauagggagaccccaucucuuuaaaaaaagaagaaaaaaagggccaggggugguggcucauggcuguaaucccagcacuuugaaagaccaaggugggaggacugcuugacuccaggaauuugagaccagccugggcaacaugacaagaccccaucucuauaaaaacaaaaaauaggcugggcacgguggcucaugccuguaaucccagcacuuugggaggcugagccaggcagaucaccugaggucaggaguucaagaccagccugaccaacauggagaaaacuagucucuacuaaaaacacaaaauuagcugggugugguggcacaugccuguaaucccagcuacucgcgaggcugaggcaggagaaucgcuugaagccaggagguggagguugcggugagccgagaucgcaccauuacacuccagccugggcaaaaagagcgaaacuccgucucaaaaaauaaacaaaaauaacaaauaaaaacaaaaaauaagcaaaauaaaaugauaaaugacagaaaggaaaaaaagaaaaccucagaagugugcucagcccuggccauuucaacauuaguaccauggucacgugucugcucaccauugggguagccugagccauaaucaguauccaagu

SEQ ID NO: 146462 - RNA, 2724 nt, Homo sapiens
acuuggauacugauuauggcucaggcuaccccaauggugagcagacacgugaccaugguacuaauguugaaauggccagggcugagcacacuucugagguuuucuuuuuuuccuuucugucauuuaucauuuuauuuugcuuauuuuuuguuuuuauuuguuauuuuuguuuauuuuuugagacggaguuucgcucuuuuugcccaggcuggaguguaauggugcgaucucggcucaccgcaaccuccaccuccuggcuucaagcgauucuccugccucagccucgcgaguagcugggauuacaggcaugugccaccacacccagcuaauuuuguguuuuuaguagagacuaguuuucuccauguuggucaggcuggucuugaacuccugaccucaggugaucugccuggcucagccucccaaagugcugggauuacaggcaugagccaccgugcccagccuauuuuuuguuuuuauagagauggggucuugucauguugcccaggcuggucucaaauuccuggagucaagcaguccucccaccuuggucuuucaaagugcugggauuacagccaugagccaccaccccuggcccuuuuuuucuucuuuuuuuaaagagauggggucucccuauguugcccagccuggucuugaauuccugggcuuaagugauccuccugccuuggacucccaaauagcuaggauuacaggugugaacuacugugccuggcuggagguuuucuaaauugcucuggucacccuacuccacagugaaagaggccaaguguuagacaguggugccauuuguuuauggccacacagccagugagugauagagcugaauuccaggccauaggauugcugcugucuuccccgcuucccacuuugcugucuuucuggagccccagugauggacugagacccaaggugggcauuugucccuuuguuaaggggaaggggaccaggcgugguggcucaugccuguaaucccagcacuuugggaagcugagguaggagaaccgcuugaguccucgaguucaagaccagccugggcaacauagcgagacccccaucucuauaaaaaauuuaaaaaauuagccgguuauaguggugcccaccuguagucccagcuacucuggaggaggaggcuaagguggguggguugcuugagcccaggaguuggaggcugcagugagcuaugauuaugccacugcacuccagccuuggugacaagaugagaucuugugucaaaaaaaaaaauaauguuagccaggcgugguggcucacaccuguaaucccaggacuuugggaggcugaggcagguggauccuuugaggucaggaguucuagaccagccugaccaacguggugaaaccccaucucuacuaaaaauacaaaauuagcuggacgugguggcacacgcccguaaucccagcaacucgggaggcugaggcaggagaauuacuuaaaccugggagguggagguugcagugagccgagaucgcauaauugcacuccagccugggaaaugagcaaaauuccaucucaaaauaauaauaauaauaauaauaauaauauuuaaugacaggcugggccagguggcucaugcccguaauccuagcauuuuaagagacagaggcagguagaucaugugaacucaggaauucacaaccagccugggcaauaugacaagaccccaucucuacaaaaaauacaaaaauuaggugugguggugcgcaccuguagucccagcuacuugggaggcugaggugagaggauggcuugagccugggaggcagagguugcauugagcugugauaaugucacugcacuccagccuggguaauagagcgagacccuaucucaaaaaaauaaaaaggcugggugugguguuuacaccuguaaucccagcacuuugggaggcugagguggguggaucaccugaggucaggaguuugagaccagccugccuguccaauauggugaaaccccgucucuacuaaaaauacaaaaauuagccagguauggugguggguggcuguagucccagcuacuugggaggcugaggcaggagaaucgcuugaaccugggaggcggagguugcagugagccgagaucgcaccauugcacuacagccugggugacagagcaagacuccauuucaaaaaauaaguaaauaaaauaaaaauguuuaaugacuuguucuuggaggucaaggagaugucucagaggcagucucccugcacugcccuuuuagcagcucuuggccagguaaagguccuguggcaagaaggugcuucagaccauaggaggugccccagguacucaggaggaagccuuagaagagcggcaaggaggccgggcgugguggcucaugccuguaaucccagcacuuugggaggccgagggggguagaucacgaggucaagcaauugagaccauccuggccaacauggugaaaccucgucacuacuaaaaacacaaaauuuagcugggcaugguggcaugcgccuguagucccagcuacuugggaggcugaggcaggagaaucgcuugaauccgggagguggagguugcagugagcugagaucgcgccacugcacuccagccuggcuacagagugggacuccaucucaaagaaaaaaaaaagaguggcagggagcuugaauguuauggugcaacuuggacugucaccauugcccacccuaccccagaucccaagac

SEQ ID NO: 146463 - RNA, 42 nt, Homo sapiens
cugggccgugcgccagcugaaccggacaaacugggggaagcc

SEQ ID NO: 146464 - RNA, 33 nt, Homo sapiens
uucuccuuaaacaauuuuaaugucuggguuggg

SEQ ID NO: 146465 - RNA, 54 nt, Homo sapiens
ggagcuacgccgcggccuccgaggccgcucggggccaccaccagguagccagag

SEQ ID NO: 146466 - RNA, 47 nt, Homo sapiens
uuucuuguagcuagaaaauuaucauauagugagacacacaggccaaa

SEQ ID NO: 146467 - RNA, 45 nt, Homo sapiens
gucaaaaccugugaaaagcuaauuagcaguauuaagcaacacaaa

SEQ ID NO: 146468 - RNA, 49 nt, Homo sapiens
gaaacaauuuuuuuuuugaggaaccauaagcaaauuauaguuugacaag

SEQ ID NO: 146469 - RNA, 32 nt, Homo sapiens
uuguagagcuacuacuggguuuuagugacaaa

SEQ ID NO: 146470 - RNA, 41 nt, Homo sapiens
ccaauaacagcaggacaaagcaguauguuagguggugcccg

SEQ ID NO: 146471 - RNA, 28 nt, Homo sapiens
guuaauguuccuagaguuuaacgugcaa

SEQ ID NO: 146472 - RNA, 22 nt, Homo sapiens
aacaucaggucaaaguaaagua

SEQ ID NO: 146473 - RNA, 42 nt, Homo sapiens
uagagaagaaguucgugccccaauuccucaaaagcaggaaau

SEQ ID NO: 146474 - RNA, 44 nt, Homo sapiens
aacagauauguggacauguaaaacagugccacucuucucacuac

SEQ ID NO: 146475 - RNA, 42 nt, Homo sapiens
auaagaaauuaacuacccuugcagaucuauuccggccaccca

SEQ ID NO: 146476 - RNA, 42 nt, Homo sapiens
gacuuugcaugucagugccucaaccgcgauguguggagcaac

SEQ ID NO: 146477 - RNA, 25 nt, Homo sapiens
uucuuggugaaaucaugauacucau

SEQ ID NO: 146478 - RNA, 46 nt, Homo sapiens
ugccaucagagccuccuuacaagaaacacauuuugauucaacacag

SEQ ID NO: 146479 - RNA, 54 nt, Homo sapiens
ccaaguccagaaagucuccccacaaagauuuggggcauagaaaagaggagaaua

SEQ ID NO: 146480 - RNA, 44 nt, Homo sapiens
cagcuguggauucagagauacuggagaugccaccugaaaaagca

SEQ ID NO: 146481 - RNA, 46 nt, Homo sapiens
acccuuccuuuaggaccaaaagcacagcugauguugcgguauccag

SEQ ID NO: 146482 - RNA, 47 nt, Homo sapiens
gaaagaaauuaacaccauggcuugaccucucucagcuuaccccuuuu

SEQ ID NO: 146483 - RNA, 41 nt, Homo sapiens
cuguauugauccugcuaguccaagaauggacaugaagugaa

SEQ ID NO: 146484 - RNA, 49 nt, Homo sapiens
uuagguuuucaucuacuuuaagauugcucucuuggcaauuaggggauuu

SEQ ID NO: 146485 - RNA, 55 nt, Homo sapiens
uuuauuuuauuuugaggcaggaguguaauuaucuuaggguugauauaaaggccca

SEQ ID NO: 146486 - RNA, 70 nt, Homo sapiens
uacuuuuuugaaauugguaucggaaggaacuggagaagagaaaacaacagugccaaaugagaaaagaaca

SEQ ID NO: 146487 - RNA, 16 nt, Homo sapiens
uucuucccauguuaag

SEQ ID NO: 146488 - RNA, 57 nt, Homo sapiens
ucuccaaagaggagaguauaguaguuauaggucuaguaauaauaaucuuguaaacaa

SEQ ID NO: 146489 - RNA, 39 nt, Homo sapiens
gaaauugauuuguauaagauucacaccugguuuuggcag

SEQ ID NO: 146490 - RNA, 46 nt, Homo sapiens
uuuuucucucuaucuagguagcugguuccauagugcccgucacgag

SEQ ID NO: 146491 - RNA, 53 nt, Homo sapiens
uaaaaugcacaucgaauucuguuuucugggccuuuucuccaauggugcuagga

SEQ ID NO: 146492 - RNA, 69 nt, Homo sapiens
ccuccuggaaagaguccuggaaagacaaccuucagguccagcccuggagcuggaggaguggagccccac

SEQ ID NO: 146493 - RNA, 45 nt, Homo sapiens
aacugggcucuggggaggaggccucaugguaaguguccgggguuc

SEQ ID NO: 146494 - RNA, 42 nt, Homo sapiens
gagcaaaguugugaauggaccugaaccacucaacagccgaag

SEQ ID NO: 146495 - RNA, 46 nt, Homo sapiens
gauguagaacagaaaaugagcaucugauuucuucacuaaaggacag

SEQ ID NO: 146496 - RNA, 66 nt, Homo sapiens
ggucuauaaacagggcguuacagaaugguacacccagucuauuucuucucaguauccauucgccag

SEQ ID NO: 146497 - RNA, 71 nt, Homo sapiens
cugaaugccacacauccauccagucugagaaaguaagauagggaauccugccgaggaacaagccagcaaag

SEQ ID NO: 146498 - RNA, 37 nt, Homo sapiens
uuuuuauauguccuuugcuucccacuucuguguacau

SEQ ID NO: 146499 - RNA, 44 nt, Homo sapiens
ggcccucugggauguugccucuccaggagcuuuuugguaaccaa

SEQ ID NO: 146500 - RNA, 39 nt, Homo sapiens
ggcgccggccagaaauccgaccggaccgggcucggggga

SEQ ID NO: 146501 - RNA, 35 nt, Homo sapiens
uguaaugauucuaugaauagggaacucuuuggaag

SEQ ID NO: 146502 - RNA, 44 nt, Homo sapiens
cuccagagccuauuuaucuugauauuuagugauuuggcaaguac

SEQ ID NO: 146503 - RNA, 55 nt, Homo sapiens
uuacaaggacucuugugauuacguucgguauacccagauaaaccagaauaaucuu

SEQ ID NO: 146504 - RNA, 46 nt, Homo sapiens
ugaugagcucacacacaacuucaaaggcuucacggugaugaacgag

SEQ ID NO: 146505 - RNA, 42 nt, Homo sapiens
caucaucacccgaauugugcgggauuaugauguguaugcgag

SEQ ID NO: 146506 - RNA, 43 nt, Homo sapiens
cggaggguuuauaccauuuuccuuaucuuuagcaaaguuggua

SEQ ID NO: 146507 - RNA, 79 nt, Homo sapiens
accacuugcaggagaggguugacaaaguaaagaagaaagugaaagauguggaggaaaagucaaaagaauuuguucagaa

SEQ ID NO: 146508 - RNA, 102 nt, Homo sapiens
agaagugggaggagaagucccgagaauucauuggaaguuuucuggaaauguuugguccggaaggagcacugguauguucuuucccacuggacaauguaggga

SEQ ID NO: 146509 - RNA, 55 nt, Homo sapiens
cugaaagaggggaagggccggaugcugcaggccaucagcccgaagcagagcccca

SEQ ID NO: 146510 - RNA, 62 nt, Homo sapiens
gcagcagcccuacucgcgagcgcucccccucccccucuuuccgauggcccuucuccggcaag

SEQ ID NO: 146511 - RNA, 47 nt, Homo sapiens
agaagcucucuguugaauuccaaauugugaccccaacacuaaaccua

SEQ ID NO: 146512 - RNA, 49 nt, Homo sapiens
gaaagaagaccuaggacugggggaacccaaacagccuguccugcaagug

SEQ ID NO: 146513 - RNA, 40 nt, Homo sapiens
uuucaaauguagaacuaauuuuuugccccugaggaguggg

SEQ ID NO: 146514 - RNA, 45 nt, Homo sapiens
ucgugccaucuaccuucgaaggaaggaacacuuuuagaguuacaa

SEQ ID NO: 146515 - RNA, 57 nt, Homo sapiens
gcucuugcagcuauugcugauagcuagagccaaagaccauuauauugcugaggcuug

SEQ ID NO: 146516 - RNA, 47 nt, Homo sapiens
ggcuguggggaaggaagcugucagcagggacagaugaccagagaaac

SEQ ID NO: 146517 - RNA, 46 nt, Homo sapiens
ugugugugguucagaugaagcuaguccuugcugggaaggggccugg

SEQ ID NO: 146518 - RNA, 44 nt, Homo sapiens
agacauaguuccuuuuagaagucccguucccagcaggccuuaaa

SEQ ID NO: 146519 - RNA, 29 nt, Homo sapiens
ucaaaaacccaaaaccuaccagugucaua

SEQ ID NO: 146520 - RNA, 52 nt, Homo sapiens
uaauuuucuacaaacaucccuuuuuaaaauuuuccaaaccugcuuccuugac

SEQ ID NO: 146521 - RNA, 387 nt, Homo sapiens
aaagguaauacuugcaaguuuuuuuuuuuucuuuuugagacggaguuucccucuuguugcccaggcuggcgugcaguggcgcgaucucaggucaccgcaaccuccgucucccagguucaagcgauccuccugucucagccuccggaguagcugggauuacaggcgcccgccaccacgcccggcuaauuuuuauuuauuuauuuauuuauuuauuuuguauuuuuaguagagacgggguuucaccauuuuggccagccuggucugcaacuccugaccuugugauccgcucaccucggccuaccaaagugcugggauuacaggcgugagccacugcgccuggccuuugcaagguuuugaggaaagugaagcguucuguugaagcagggc

SEQ ID NO: 146522 - RNA, 51 nt, Homo sapiens
cucugccuugccaguuauuauugggucuguuuucucccggaaagaucagag

SEQ ID NO: 146523 - RNA, 42 nt, Homo sapiens
cgcgccgaacugcagccauggagcaggcaccuccggaccccg

SEQ ID NO: 146524 - RNA, 42 nt, Homo sapiens
uccuugccgaccgcagcccccagcccagcgucuggggagccc

SEQ ID NO: 146525 - RNA, 74 nt, Homo sapiens
gcugggcugggcugggccgggccgggccagugggcucggccgaggaggcccagcagugagggggagcgaggugg

SEQ ID NO: 146526 - RNA, 67 nt, Homo sapiens
ggccccggaugggcgaggcuggaggaggggguuuucaguggucgcguagcugggagaucuggaccgu

SEQ ID NO: 146527 - RNA, 73 nt, Homo sapiens
uuuaaucauuuuaggaccagauaggguagcucucucucucucucucucucucucucucucucugugugugugu

SEQ ID NO: 146528 - RNA, 49 nt, Homo sapiens
uuuguuuacacauuggggaaaacaauucaguuuauuaaacguuucaugu

SEQ ID NO: 146529 - RNA, 50 nt, Homo sapiens
acaucuuugcuuuacacagucaccuugcccuuccuuccaccaccgaagaa

SEQ ID NO: 146530 - RNA, 54 nt, Homo sapiens
acaaacgacuacagcagugauuacgguucucagcugggugggguggguggggag

SEQ ID NO: 146531 - RNA, 72 nt, Homo sapiens
ugugugugggacugagaaccccugccccaggcacacaucugcuuggaagguccuaggaugcuuugcauaaga

SEQ ID NO: 146532 - RNA, 67 nt, Homo sapiens
caucugugcuguggacacagguaauaugaagcacauguacuuuucucaaaaaaaaaaaaaaaaaucu

SEQ ID NO: 146533 - RNA, 45 nt, Homo sapiens
ccuaaauuugucuugccuggcguguagcucagaagcaaaggagga

SEQ ID NO: 146534 - RNA, 22 nt, Homo sapiens
cuuuacaggggaaaauagaaug

SEQ ID NO: 146535 - RNA, 58 nt, Homo sapiens
guauauuauuuaacuuucaaauuugcaauuuggggcaucaucuccugccagccucagg

SEQ ID NO: 146536 - RNA, 61 nt, Homo sapiens
cucacggagacggggaucugcagccaauccgaaacugccugacccaggggguccgcggaaa

SEQ ID NO: 146537 - RNA, 45 nt, Homo sapiens
uguggcucuucagggcccaccaucugcucccaaggggugcucgug

SEQ ID NO: 146538 - RNA, 43 nt, Homo sapiens
ggagagacugggagaguugaguaggggauacaagaauggacau

SEQ ID NO: 146539 - RNA, 44 nt, Homo sapiens
cacuggaaagaaagagggaggucugaucacuggcauaagcauuu

SEQ ID NO: 146540 - RNA, 32 nt, Homo sapiens
aagacacauaacuugugaggagacccagggga

SEQ ID NO: 146541 - RNA, 40 nt, Homo sapiens
auugacaucacaccuacaguuucgauggauggcaccaggu

SEQ ID NO: 146542 - RNA, 183 nt, Homo sapiens
ccaaaaaagggguaccauuguuuuguuucuuuuuuuacuuuuaaauauauauaaaaauauggaacacuucacgaauuugcaugucauccuugcacaugggccaugcuaaucucuguauuguuuuaauuuuaguguauguacugcugaagugagcaguuuuuuuucucuuucuuauauuaaaaa

SEQ ID NO: 146543 - RNA, 43 nt, Homo sapiens
gacaggcaaaagaggucugguccauuggguuucuauuacacac

SEQ ID NO: 146544 - RNA, 46 nt, Homo sapiens
aguccucccaugcaggaagccagggacgagauguauaagcccaaaa

SEQ ID NO: 146545 - RNA, 46 nt, Homo sapiens
ucagagaucucgacagggaaagaaggaggggauuugagguccaaga

SEQ ID NO: 146546 - RNA, 41 nt, Homo sapiens
cacuguccccaacccagucaugucaacuaccucugacucag

SEQ ID NO: 146547 - RNA, 31 nt, Homo sapiens
guguauuauuuauuuuugaauaaauaauaca

SEQ ID NO: 146548 - RNA, 42 nt, Homo sapiens
agggguugggcuccucgagagucgucuguucuuucacccaca

SEQ ID NO: 146549 - RNA, 23 nt, Homo sapiens
aacagugguauaugaauuuaaaa

SEQ ID NO: 146550 - RNA, 46 nt, Homo sapiens
uagaaaacagaucuaauucuagaccuuuagaaagcaaaagauacgg

SEQ ID NO: 146551 - RNA, 110 nt, Homo sapiens
auuuaaagauaauccuuaauuguggguauuuugaucaauuaucaggauuauacaguugauuuucauuuuaauaaucaguauuaguuagguuuaugugugcuuaugccuuu

SEQ ID NO: 146552 - RNA, 49 nt, Homo sapiens
uuauuagcuguuuuugugcugcagugucagaguugaguaguuuugacag

SEQ ID NO: 146553 - RNA, 38 nt, Homo sapiens
ccauugugcuauucuuccuuauccaggagucguuacag

SEQ ID NO: 146554 - RNA, 37 nt, Homo sapiens
ccuggcuccccaugcagcaaaauagucagaucuguca

SEQ ID NO: 146555 - RNA, 57 nt, Homo sapiens
acuucucacauccucaaagagccugauauugugauugguuacuucacaauggaagga

SEQ ID NO: 146556 - RNA, 679 nt, Homo sapiens
ucuccugcaaaagaauuacaagguugaacaacagaaagucaaauaccaaagauuccacaaucugagugguauacacaggcaagggaucuaauauauaaauacauuagugagaggagaaaaaaccaaaauuuuucauugcucauccuuaauugauauuuuucaguuugagguuucagaauguagaacaguuuagggaacugaagaaugaagauuuccuguaacccagcuaaauuaguucagggaaacauccugcuucagaauccacuaugcuagccccugauuuuguagcgugcuacucccauacucauuuguccaguaauauuaaauauauuuccaaaauacauuucuuugcacugguagcuuugguagcuuuucaaugucauuagcauugaacuguagagucaauaauaaugacauuuacuuaaucagucucuuuuugggugcaagcuccaugaaggaagguagaguugcacauuuuauucaaaaugucaucauugguaccuagaacagcaccuggcacucaguaaagaauggaguaaucaccgugauucucaucauccuucuaaucucuuuaacucugccacccuccagcuuucaggugaucacagagcuaucucuuacccgguguuccucagcugccucuucgaugggauaguguuugugagccccgugcuccuga

SEQ ID NO: 146557 - RNA, 81 nt, Homo sapiens
aucuucuuuguuugccuaugggucccacauauuuguuucucagagcucaggaauugccagagacuggcuuuucuggcaaug

SEQ ID NO: 146558 - RNA, 51 nt, Homo sapiens
gguaggugugacaaauauccauauauuuuucuaaauuuauuuuguauacug

SEQ ID NO: 146559 - RNA, 56 nt, Homo sapiens
uucucuuuccuauugcauuuucccuugagaacaugaacugacaaggaacaagguga

SEQ ID NO: 146560 - RNA, 52 nt, Homo sapiens
uuuugacuggggaaacuuaaacacuaauuacuuucagaaagaauuugagaug

SEQ ID NO: 146561 - RNA, 65 nt, Homo sapiens
accuaaugaagcuucugcuagaagugaaagagacacaucagaccuagagcaaaacuggucauugc

SEQ ID NO: 146562 - RNA, 393 nt, Homo sapiens
uugcuauaaaaguuuuacauguuuauggccgagcgccguggcuaaacgccuguaaucccggcacuuugggaggccgagguggguggaucacgaggucuggaguucaagaccagccuggccaacauggugaaaccccaccucuacgaaaaauacagaaauuagcugggcaugguggcacaugccuguaaucccagcuacucgggaggcugaggcaggagaauuacuugaaccgggacccaggaggcagagguagcagugagugagaucgcgccacugcacuccagccugggcuacagagugagacucuaucucaaaaaaaaaaaaaaagaaaagaaagaaaaguuuuaccuauuuauuaaugacaauaaugaaggagaaagaggggaagagauc

SEQ ID NO: 146563 - RNA, 48 nt, Homo sapiens
agaaauguuucagcagugaaaaacuggcuguuacuuaaaugucuaacu

SEQ ID NO: 146564 - RNA, 37 nt, Homo sapiens
aacaagacagcugaaaaaguuagaauuauaaaauauu

SEQ ID NO: 146565 - RNA, 37 nt, Homo sapiens
cacaugaacuggcaaagagggagaaacugcagauaca

SEQ ID NO: 146566 - RNA, 25 nt, Homo sapiens
uuugcacauguaaaacuguuucuga

SEQ ID NO: 146567 - RNA, 87 nt, Homo sapiens
gccuuccuuacugauuuguaggaguucuuuaaauguuauggaccccuugucuauaacauaugugcagguauuuucuuucaggcuuuu

SEQ ID NO: 146568 - RNA, 44 nt, Homo sapiens
augguuuuguuuuuguuuuguuuauuuaguuuuugucuuuuggg

SEQ ID NO: 146569 - RNA, 46 nt, Homo sapiens
uucucuucagucauugaauaugucacugcaaaaucaauuggaggag

SEQ ID NO: 146570 - RNA, 46 nt, Homo sapiens
gggauaacauuacgucagcgugaugcugaggugacucgacuaagag

SEQ ID NO: 146571 - RNA, 56 nt, Homo sapiens
ggguaagucagccucuuucagcauuauuucaucaguuaaaugagugaguuggcagu

SEQ ID NO: 146572 - RNA, 46 nt, Homo sapiens
ggagugaaacuauggcuuuaauagaagaugagcauaauuuggauaa

SEQ ID NO: 146573 - RNA, 45 nt, Homo sapiens
gaugccaacauagcuagacuccagaagucuuuaaggacuggucuu

SEQ ID NO: 146574 - RNA, 61 nt, Homo sapiens
acaagaagaaaguuguggauaacuaggaaauuauuguaaguaauguuuuauuucaguacuu

SEQ ID NO: 146575 - RNA, 46 nt, Homo sapiens
aagcugaacuccugccaccucccauacgggcaaaggagccccagau

SEQ ID NO: 146576 - RNA, 69 nt, Homo sapiens
ggcuaucacugggccccagcacuuucacuggccuuccuuuccccacaaggagcacucuuuggggacggc

SEQ ID NO: 146577 - RNA, 44 nt, Homo sapiens
agagcacugggauggggugagaaaaggccacuggcucuguuauu

SEQ ID NO: 146578 - RNA, 48 nt, Homo sapiens
acuggggagaaauuaggaggagcucuccuagagucuuggugggaagug

SEQ ID NO: 146579 - RNA, 34 nt, Homo sapiens
gggaacugcucuuuaauuauuagugauguuugcg

SEQ ID NO: 146580 - RNA, 71 nt, Homo sapiens
gcugucaacagucuuggagaagccaccugcacagcagagcucauuguggaaacgauggaggaaggugaagg

SEQ ID NO: 146581 - RNA, 46 nt, Homo sapiens
aguuggcaccuuaagauacuagugcagcuagauuucauuuagggaa

SEQ ID NO: 146582 - RNA, 47 nt, Homo sapiens
uauuuaucugggcaaagucauaaauucuccacuugaaugcgcucaug

SEQ ID NO: 146583 - RNA, 46 nt, Homo sapiens
ggcacucagagaugcuaagauguaucagaaacaaucucuacucuga

SEQ ID NO: 146584 - RNA, 70 nt, Homo sapiens
gauugaacaccugcauuuucuccuguuucucccaaaaccuaaauaaaggaacaaaaggcauaaauccaua

SEQ ID NO: 146585 - RNA, 40 nt, Homo sapiens
augggggcggcgguggcagggccggggccggggacgccag

SEQ ID NO: 146586 - RNA, 73 nt, Homo sapiens
ugaaucaauguucauuuccugguuugaugauuauacuaugauuacauaagaggauaacggggaacagggugaa

SEQ ID NO: 146587 - RNA, 373 nt, Homo sapiens
acucuucaagacugucaaggacaugaauuuuuuuuuuuuuuuuuuuuuuuuugagauggagucuugcucuguugcccaggcuggagugcaguggugugaucucggcucacugcaaccuccgccucccagguucaugccauucuccugccucagcuucccgaguagcugggacuacaggcgcccgccaccacacccgacuaauuuuuuguauuuuuaguagagacaggguuucacuguguuagccaggauggucucaaucuccugaccucgugauccgccugccugggccucccaaagugcugggauuacaggugugagccaccaugccuggccaaaaauuuuuuuaaaaaaagauggaggagcuguuacagau

SEQ ID NO: 146588 - RNA, 50 nt, Homo sapiens
auuguauaaccucauuucaaucuugacaaaacaucagacacacccaaguu

SEQ ID NO: 146589 - RNA, 42 nt, Homo sapiens
uaugguaauggcagugaggauagaaaaaaauagacauugaga

SEQ ID NO: 146590 - RNA, 63 nt, Homo sapiens
caagguuacauguacaaauguaugcccucucagaacaauggccauuuugagaaagccagugag

SEQ ID NO: 146591 - RNA, 42 nt, Homo sapiens
uguuuauuuacaaggguuuuauuuuaggagcucugugucagg

SEQ ID NO: 146592 - RNA, 54 nt, Homo sapiens
ugccaaauacacagaguugggaagggggagaggucaguauaaucaggauuggag

SEQ ID NO: 146593 - RNA, 46 nt, Homo sapiens
auacuuucaccuaccugcaaauaguagacauauuuaugcaguaagg

SEQ ID NO: 146594 - RNA, 46 nt, Homo sapiens
uguagacccuguuguuaauucuauuaagcguaagaugaugaugaag

SEQ ID NO: 146595 - RNA, 33 nt, Homo sapiens
gccauaucuuucuucuugauggucucuccuucc

SEQ ID NO: 146596 - RNA, 72 nt, Homo sapiens
ucuagaggguaaaacugaugauuccaugauacauuaaucauuaaacacaaguaauauuggacuauuucauga

SEQ ID NO: 146597 - RNA, 42 nt, Homo sapiens
gcauugcaaguggggaagacaaaaucaugaaguuucucaguu

SEQ ID NO: 146598 - RNA, 25 nt, Homo sapiens
cauuuuauguauauaucuugguuug

SEQ ID NO: 146599 - RNA, 53 nt, Homo sapiens
ucacauguccuuaccccuuugagcuuuaccaaagccauacagaauggcgcuga

SEQ ID NO: 146600 - RNA, 73 nt, Homo sapiens
gucucaagaacaagacauugucuuugcuuguauaauugaccauuucuagacugauuaaucauuguagucagag

SEQ ID NO: 146601 - RNA, 44 nt, Homo sapiens
aguuggcuuuagagauuuaaaaaucauaguuguacauuuugaaa

SEQ ID NO: 146602 - RNA, 28 nt, Homo sapiens
gugaggcagaagagaaagauaaugaagc

SEQ ID NO: 146603 - RNA, 42 nt, Homo sapiens
aaugagcuagagccuggggccuuguagguaaaaucaguuggg

SEQ ID NO: 146604 - RNA, 46 nt, Homo sapiens
gucuucugccuguauaugguggcaugagauguaauguccagagcca

SEQ ID NO: 146605 - RNA, 45 nt, Homo sapiens
uuaucacauuaauuuaauuacuacuagguaauaauaaugggagac

SEQ ID NO: 146606 - RNA, 50 nt, Homo sapiens
acugcacacugcacauuugcucagaauugcacaucuaacaggaaaagagg

SEQ ID NO: 146607 - RNA, 45 nt, Homo sapiens
ucagggaauccuaugacagacucuaucuugaugugguugucuccg

SEQ ID NO: 146608 - RNA, 45 nt, Homo sapiens
ucuugacacauuaaaucaaacaacaacagaauugcccauucagau

SEQ ID NO: 146609 - RNA, 51 nt, Homo sapiens
uguguguugguagcaaauggcugaggauugucuuguuggagaauccugaau

SEQ ID NO: 146610 - RNA, 49 nt, Homo sapiens
uacuuauaagugguagaaaccgaaagcgugacuccacuguagggaaaga

SEQ ID NO: 146611 - RNA, 50 nt, Homo sapiens
gacuagugagaaguaauuuuauaucuaagaagcagaauaauggaauguga

SEQ ID NO: 146612 - RNA, 51 nt, Homo sapiens
ucauuauucaguuauuuugaaacuugaaaacucacccagaaguuaauuaua

SEQ ID NO: 146613 - RNA, 45 nt, Homo sapiens
uguggaguugucacuuuuuuaaguaauauguuuaugggaguacuu

SEQ ID NO: 146614 - RNA, 46 nt, Homo sapiens
cuccuguauucuccugggaguguucuugaauagcagcgugccuaua

SEQ ID NO: 146615 - RNA, 47 nt, Homo sapiens
acuagaaugcuaugacagugauaucagaaacaugcuggaugggggag

SEQ ID NO: 146616 - RNA, 47 nt, Homo sapiens
uauuuaaauugaaguacuuagaauagggcgaauaaauaaccucauga

SEQ ID NO: 146617 - RNA, 42 nt, Homo sapiens
cauauuuuauauuauuugcaaguaauauucagccaccuuuug

SEQ ID NO: 146618 - RNA, 44 nt, Homo sapiens
ugagaaacagaaacauggccauccaacuggagaacaguagaaga

SEQ ID NO: 146619 - RNA, 51 nt, Homo sapiens
acagucacauaauuacaauagaaauguaaaucaacuuuagaaaauuaaaag

SEQ ID NO: 146620 - RNA, 46 nt, Homo sapiens
cacaaacaugauuaaccauaucaugucaaauaaguacaaaacagaa

SEQ ID NO: 146621 - RNA, 28 nt, Homo sapiens
aacagucuuuuggauuuucuugaggaau

SEQ ID NO: 146622 - RNA, 46 nt, Homo sapiens
cuuccucccaguguugcugcagcuagccagcggcugaguuaucgga

SEQ ID NO: 146623 - RNA, 46 nt, Homo sapiens
uucagaauuuggaguugucugcuuaauauuuucugcaacacuagcu

SEQ ID NO: 146624 - RNA, 64 nt, Homo sapiens
aaacuuuucuaacuggcuuaagauggcaguuuaaaaaaaaaaagaggauuugagacucacauag

SEQ ID NO: 146625 - RNA, 40 nt, Homo sapiens
gcaccccugcaggcauuguccucugugggcaggggcacua

SEQ ID NO: 146626 - RNA, 53 nt, Homo sapiens
ugugaacuguagaucuucaauuugaacuucagcuauuggcauuugucugaaaa

SEQ ID NO: 146627 - RNA, 60 nt, Homo sapiens
gugauuuuacauguguuauuaacuuucuggaagggguuggguuaucuaggugaggucuga

SEQ ID NO: 146628 - RNA, 50 nt, Homo sapiens
gccauuagcuaguuguaugacuggagcucccuccaauacuuuuuaaagaa

SEQ ID NO: 146629 - RNA, 55 nt, Homo sapiens
cauaauuaggaauugggagaaaguuucugaacuauugaccuaaugaguuuuggag

SEQ ID NO: 146630 - RNA, 44 nt, Homo sapiens
guucauguuugaaaagggagauaagacaaucaucuagguuccua

SEQ ID NO: 146631 - RNA, 49 nt, Homo sapiens
auuccaugcugugggaaguugggggaauggaaaggauggcacagacaug

SEQ ID NO: 146632 - RNA, 24 nt, Homo sapiens
uccagacagcaaacaagaaaagca

SEQ ID NO: 146633 - RNA, 41 nt, Homo sapiens
uggguuuguaccuucccacccuuuuucauuuaccagcaagg

SEQ ID NO: 146634 - RNA, 72 nt, Homo sapiens
ggaggaagaacuagacugagucaaguuacaaagaaauguaacucaaagcaauacaaggaagaaccuucuaac

SEQ ID NO: 146635 - RNA, 38 nt, Homo sapiens
cucaagaggcuguugugcaagauuuuauauuuauuaau

SEQ ID NO: 146636 - RNA, 51 nt, Homo sapiens
uggacaucucacuuuaccacuugccagugugauucucugagaagaaaaagc

SEQ ID NO: 146637 - RNA, 47 nt, Homo sapiens
acugccaaacuaaccugcagugacagaaaguagaucaguggugucug

SEQ ID NO: 146638 - RNA, 44 nt, Homo sapiens
cuaauaugauuggaaaauauccuguagccuugagauggccuaaa

SEQ ID NO: 146639 - RNA, 24 nt, Homo sapiens
gccuuuucuguuuauguaccuaag

SEQ ID NO: 146640 - RNA, 43 nt, Homo sapiens
cugcuccuuguaaacugccauauugggugcacuugcccugcca

SEQ ID NO: 146641 - RNA, 45 nt, Homo sapiens
gucaaugacuuugacugguuugccaaaucaccuugcaaaggcgaa

SEQ ID NO: 146642 - RNA, 76 nt, Homo sapiens
uacaucaauuuuugagugagcaguuccuggaaagugagcagaaacaacaauuuuccccuucaaugacagagaggaa

SEQ ID NO: 146643 - RNA, 47 nt, Homo sapiens
ugcgccaggugaaagaugauaauggcaugcacuuugguggccuugau

SEQ ID NO: 146644 - RNA, 32 nt, Homo sapiens
uuaccuguauaaugaguauugaaaugggagac

SEQ ID NO: 146645 - RNA, 68 nt, Homo sapiens
aacacaaaauggaacauccuuuuguucauggauggaacaauggaaccauuauuuaaaacauaaaagug

SEQ ID NO: 146646 - RNA, 54 nt, Homo sapiens
gcgccuuaguguggaugcuuuccauauccucauucuaacuuaauuucucagcug

SEQ ID NO: 146647 - RNA, 43 nt, Homo sapiens
gccccgggcaccuuccggguggaguucagugaaagggcaggug

SEQ ID NO: 146648 - RNA, 46 nt, Homo sapiens
cccuuucacugaacuccacccggaaggugcccggggcuucguguuc

SEQ ID NO: 146649 - RNA, 38 nt, Homo sapiens
cucugcgcgucgggagggcgcgggggcuccgggaggca

SEQ ID NO: 146650 - RNA, 46 nt, Homo sapiens
gggaagcggcucugccgggaacagggagggaccuccagggaagcga

SEQ ID NO: 146651 - RNA, 46 nt, Homo sapiens
uuuaaauguuuauucccuuuugcgcuucaaagcauagacuguaguu

SEQ ID NO: 146652 - RNA, 46 nt, Homo sapiens
aaggaauuuaacaaugaauccuacccuuucuucccuuuucaggcag

SEQ ID NO: 146653 - RNA, 46 nt, Homo sapiens
auauauauaccauguacuguggcauucagaauuuccuaaaccucag

SEQ ID NO: 146654 - RNA, 53 nt, Homo sapiens
guaggaaugggacugacagaguggaugaagucaagugcugugugugcagagag

SEQ ID NO: 146655 - RNA, 42 nt, Homo sapiens
gaagagauguaugaggcccacgcauggauccaaagaauccug

SEQ ID NO: 146656 - RNA, 48 nt, Homo sapiens
ugaagauaugcuuuguaaaguacaggaggaaauggcaaggaaaaagga

SEQ ID NO: 146657 - RNA, 43 nt, Homo sapiens
ucucacuaaacuaugagcuuaagagggcagagacuaugucuag

SEQ ID NO: 146658 - RNA, 52 nt, Homo sapiens
uggggcuacucuguggaauuuggugagcugacaucaguagauucuuccacug

SEQ ID NO: 146659 - RNA, 50 nt, Homo sapiens
cuucaccugccaaaugauaccuaauucauucacuagcaggcuauaggaaa

SEQ ID NO: 146660 - RNA, 71 nt, Homo sapiens
cggcgagggagaagugauucccgaagaaucaaggcugggccggacccgguggccuggcaacaggguaguag

SEQ ID NO: 146661 - RNA, 46 nt, Homo sapiens
ccaaauaggaucugcagucaugaugaugcuacagaauauacuacag

SEQ ID NO: 146662 - RNA, 43 nt, Homo sapiens
agacacaaaaggcaaucauacuaauccaagugaaguaaugaua

SEQ ID NO: 146663 - RNA, 36 nt, Homo sapiens
uuguuggccuuuuaagcccaauggucuaucaggaag

SEQ ID NO: 146664 - RNA, 78 nt, Homo sapiens
accaaaaagacaauaaauuuaaaaauacaagcagaaaccaugaaaauaaguccaguaaggcaggagaauggguugggg

SEQ ID NO: 146665 - RNA, 50 nt, Homo sapiens
augaaaggucaggcggacuaugaaaucuuugaaaaggaaauggaagugag

SEQ ID NO: 146666 - RNA, 45 nt, Homo sapiens
uuucccgagaauugcagcugaguaugcucgaaauaguucauccag

SEQ ID NO: 146667 - RNA, 41 nt, Homo sapiens
uaucgggaaauggaagagaaaucagcacugauuauccagaa

SEQ ID NO: 146668 - RNA, 50 nt, Homo sapiens
acauugaacauuaauuuaacuaaaauuaugauguaauaauauaggaugga

SEQ ID NO: 146669 - RNA, 106 nt, Homo sapiens
gauauuuagggaguccuaucauucacccuuucauuccuccagagcauccaaaaugaaaggacuuuuuguaacaaacaaacaaaaacuacuguacaaauggaaauga

SEQ ID NO: 146670 - RNA, 78 nt, Homo sapiens
ucucacaaucauguccuuacagacauugcugauccucuuucauacugacaccggguucuaguccgaguuccaucacua

SEQ ID NO: 146671 - RNA, 141 nt, Homo sapiens
aaugcaaacggaggccuguccaauaauccugcuaaugcuaauggguuacuggaaagaugagaagagaggaaagaucccaacgaucccgucaacacgaaaaucccaggaaucagaggugggcaggcuguuagagaaaaagga

SEQ ID NO: 146672 - RNA, 42 nt, Homo sapiens
gguuugaugguguggaguauguuuaaucugcacaaccggaau

SEQ ID NO: 146673 - RNA, 45 nt, Homo sapiens
gggccagaggccuuuccaaaagcgugaauugauaagauuuagaug

SEQ ID NO: 146674 - RNA, 50 nt, Homo sapiens
acucaggaaauauccuauuggaaaaauggcaggauuugguuuuggaauag

SEQ ID NO: 146675 - RNA, 51 nt, Homo sapiens
guguuucugugggaaaaugugauuuaaauuccaaaguagauggcauauaug

SEQ ID NO: 146676 - RNA, 42 nt, Homo sapiens
aauaguuauauauggcccuauguacucauguaugacacugug

SEQ ID NO: 146677 - RNA, 62 nt, Homo sapiens
agguaucucucaucacuucuuucuuaagaaccauggcugcccuaaacacuauuauuaucccc

SEQ ID NO: 146678 - RNA, 45 nt, Homo sapiens
cgauuaucaggauuagcaaauguuguuuugcaugaauuaucagga

SEQ ID NO: 146679 - RNA, 46 nt, Homo sapiens
gucuaaaauguuuucuucucagaaauugagggugcugcaaaggaag

SEQ ID NO: 146680 - RNA, 49 nt, Homo sapiens
gagucucgguauagugcuuuggagcagaagcacaaagcagaaauggaag

SEQ ID NO: 146681 - RNA, 46 nt, Homo sapiens
aaugagcaagcaguucagucagcccagaccauucagcaacuggaag

SEQ ID NO: 146682 - RNA, 59 nt, Homo sapiens
cuuagaucagcuccagcaaaaauccaaagaaauuagccaauuucuaaauagacugcccu

SEQ ID NO: 146683 - RNA, 59 nt, Homo sapiens
ugcaacaacaugaaacagcaucucagacuucuuucccagauguuuauaaugagggcaca

SEQ ID NO: 146684 - RNA, 44 nt, Homo sapiens
uuuguuuguuuuacuaagauuuccuuucuucucauucauuauga

SEQ ID NO: 146685 - RNA, 46 nt, Homo sapiens
caagaggagcucuucugcugaggaaaguggacaagauguucuagaa

SEQ ID NO: 146686 - RNA, 38 nt, Homo sapiens
aauuaucaguuuuauuguuggaaaugaaagaagcucaa

SEQ ID NO: 146687 - RNA, 86 nt, Homo sapiens
auaaaucccuuucugcuguaccagauauuggucagugucaucaggaugaguuggaaagguuaaaaagucaaauuuuggagcucgag

SEQ ID NO: 146688 - RNA, 95 nt, Homo sapiens
cuaaacuuucauaaagcacaagaaaucuaugagaaaaauuuagaugagaaagcuaaggaaauuagcaaccuaaaccaguugauugaggaguuuaa

SEQ ID NO: 146689 - RNA, 59 nt, Homo sapiens
aacuuagcaugguaacagaauugagggcucagguaaagcaacuggaaaugaaccuugca

SEQ ID NO: 146690 - RNA, 69 nt, Homo sapiens
uuucugagcagaguacccugauaagaagccugcaaagccagcugcaaaauaaggaaagugaagugcuug

SEQ ID NO: 146691 - RNA, 49 nt, Homo sapiens
gaaauaacaaaaauggaucagcucuuacuagagaaaaagagagaugugg

SEQ ID NO: 146692 - RNA, 44 nt, Homo sapiens
gcuaaauuuauuauccagagcugaggaagcaaaaaaagagcagg

SEQ ID NO: 146693 - RNA, 46 nt, Homo sapiens
agaacuucagcaugaauuugaccuucugaagaaagaaaaugagcag

SEQ ID NO: 146694 - RNA, 79 nt, Homo sapiens
gaaagaugaaucuaagaaagaaaucccacucagugagacugagaggggagaaguggaagaagauaaagaaaacaaagaa

SEQ ID NO: 146695 - RNA, 79 nt, Homo sapiens
uacucagaaaaaugugugacuucuaagugccaagaaauagaaauuuauuuaaaacagacaauaucugagaaagaagugg

SEQ ID NO: 146696 - RNA, 46 nt, Homo sapiens
cucuggucaaacagaugaaucagaccuugcaagauaaaacaaacca

SEQ ID NO: 146697 - RNA, 53 nt, Homo sapiens
gaaacaguggugauaaguccaccuuguacagguaguagugaacacuggaaacc

SEQ ID NO: 146698 - RNA, 44 nt, Homo sapiens
gcaaggcaauucuuaaaaaggcacaggagaaagaaagacaucuc

SEQ ID NO: 146699 - RNA, 46 nt, Homo sapiens
uucuguugcccagauuaaggcccagcugaaggaaauagaggcugag

SEQ ID NO: 146700 - RNA, 46 nt, Homo sapiens
ugagcuuacuaaaaaaucagaagagguauuucaguuacaagagcag

SEQ ID NO: 146701 - RNA, 46 nt, Homo sapiens
agaauugcaaccuaaacuggaugaacugcaaaaacucauaagcaaa

SEQ ID NO: 146702 - RNA, 45 nt, Homo sapiens
agagcaugaugagaggauaaagcagcuacagguggaacuuuguga

SEQ ID NO: 146703 - RNA, 46 nt, Homo sapiens
ucagcagcuccugugaaagucuaaaacuagcucuagagggucuuac

SEQ ID NO: 146704 - RNA, 49 nt, Homo sapiens
aguccuaugagaauguuaguaaugaagcagaaaggauucagcauguggu

SEQ ID NO: 146705 - RNA, 74 nt, Homo sapiens
gaacuguauggcaaguuaagaagcacagaggcaaacaagaaggagacagaaaagcaguugcaggaagcugagca

SEQ ID NO: 146706 - RNA, 46 nt, Homo sapiens
aacagcagaaaauccuagagcuggaagaagagaaugaccggcuuag

SEQ ID NO: 146707 - RNA, 45 nt, Homo sapiens
aaacccuuucuaagaaguuucagucuuuaaugucugagaaagacu

SEQ ID NO: 146708 - RNA, 46 nt, Homo sapiens
aaugucacugaagagggaacacagucuauaccaggugagacugaag

SEQ ID NO: 146709 - RNA, 46 nt, Homo sapiens
agaaagaauugcuggauuagaggaggagaagcagaaaaacaaggaa

SEQ ID NO: 146710 - RNA, 59 nt, Homo sapiens
cugucaggauguuacagaugcccaaauaaaaaaugagcuauuggaaucugaaaugaaga

SEQ ID NO: 146711 - RNA, 45 nt, Homo sapiens
ugaaucucaaaaagauuuggaaauaaccaaagaaaaucuggcuca

SEQ ID NO: 146712 - RNA, 100 nt, Homo sapiens
aagcagcaaggguccuagcagacaaucucaaguugaaaaaggaacuucagucaaauaaagaaucaguuaaaagccagaugaaacaaaaggaugaagaucu

SEQ ID NO: 146713 - RNA, 101 nt, Homo sapiens
ugagcgaagacuggaacaggcagaagagaagcaccugaaagagaagaagaauaugcaagagaaacuggaugcuuugcgcagagaaaaaguccacuuggaag

SEQ ID NO: 146714 - RNA, 48 nt, Homo sapiens
uucccuccaggaugaucgugacagggugauagaugaagcuaagaaaug

SEQ ID NO: 146715 - RNA, 38 nt, Homo sapiens
gauuuuuaccacaguacucucaaauuaauugucuaguc

SEQ ID NO: 146716 - RNA, 89 nt, Homo sapiens
gcaaggaagaggcaauccaaguagcuauugcugaacugcgucagcaacaugauaaagaaauuaaagagcuggaaaaccugcugucccag

SEQ ID NO: 146717 - RNA, 46 nt, Homo sapiens
ucuauaaucuuggaaaaagaccaacucauccaagaggcugcugcag

SEQ ID NO: 146718 - RNA, 46 nt, Homo sapiens
aagaagaagguacuuuaggacucuaucaugcccaguuaaaaguaaa

SEQ ID NO: 146719 - RNA, 87 nt, Homo sapiens
aagagaauugcagaacuggaagaagaauugguuuguguucaaaaggaagcugccaagaagguaggugaaauugaagauaaacugaag

SEQ ID NO: 146720 - RNA, 46 nt, Homo sapiens
gggauaaugagaaaugaaacugaaacagcagaagagagaguggcag

SEQ ID NO: 146721 - RNA, 75 nt, Homo sapiens
cagagagagagaugcucuucuuucugaaaccgccuuuucaaugaacuccacugaggagaauagcuugucucaccu

SEQ ID NO: 146722 - RNA, 74 nt, Homo sapiens
gaaugagagagaucaccuguggaaugagcuggagaaauuucgaaagucagaggaagggaagcagaggucugcag

SEQ ID NO: 146723 - RNA, 45 nt, Homo sapiens
guacagaguuuaaaaaaagcuaugucuucacuccaaaaugacaga

SEQ ID NO: 146724 - RNA, 47 nt, Homo sapiens
auuaccuucucuaguugguuuucuucccuuccuuaauguuagccauu

SEQ ID NO: 146725 - RNA, 45 nt, Homo sapiens
uugaggucuucuuccucccagacucagccucucaaagugcaauac

SEQ ID NO: 146726 - RNA, 42 nt, Homo sapiens
ucaagagcugcaggcggugaguaaagagaaggugagagacug

SEQ ID NO: 146727 - RNA, 46 nt, Homo sapiens
aagucuuuccuuucaccaaagggcagggagaagugucuauggacag

SEQ ID NO: 146728 - RNA, 42 nt, Homo sapiens
ccauggaguaagauuccaggagaaaaguggaaauauuuggag

SEQ ID NO: 146729 - RNA, 56 nt, Homo sapiens
cauguaaaucacuuugacuguuguuauaauaaagugaacaguucuuuucuauagaa

SEQ ID NO: 146730 - RNA, 40 nt, Homo sapiens
gagguuuaacucaauuuuucacgaaguuuagacguuaaau

SEQ ID NO: 146731 - RNA, 370 nt, Homo sapiens
ucugcauuuuaaaaguuacaaacaaugggccaggcgcgguggcuuacgccuguaaucccagcacuuugggaggccaaggcaggcggaucacaaggucaggaguuugagaccagccuggccaauauggugaaaccccauuucuacuaaaaaauacaaaaauuagccagacguggugacaugugccuguaaucccagccacuugggaggcugaggcaggagaaucgcugaacccagggaggcggagguugcagugagcugaaaucaugccacugcacuccagccugggugacagagugagacuccaucucaaaaaaaaaaaaaaaaaaaaguuacagacaaugaaugaacucuucaaaugaaacaaaaccuu

SEQ ID NO: 146732 - RNA, 57 nt, Homo sapiens
agauguuaagauuaauuaacuauaagguccucuggaguaaaaauuauuaaaguauua

SEQ ID NO: 146733 - RNA, 53 nt, Homo sapiens
uuuguaaaauguuugauuugcaaagauuuuucuuucaguguauagauuaucuu

SEQ ID NO: 146734 - RNA, 48 nt, Homo sapiens
agacuuaaugcaauuaucuuucuugccuacagauuccaggcuuuccug

SEQ ID NO: 146735 - RNA, 45 nt, Homo sapiens
uagccagaguuaaauauaaauacaaauuaauaauacauagagaac

SEQ ID NO: 146736 - RNA, 53 nt, Homo sapiens
uuuucuguuuggaaauagguaggguaaaaucuaagaccugcacaagggcagug

SEQ ID NO: 146737 - RNA, 72 nt, Homo sapiens
gaauaagaucuaagaguuaccuggcuacagaaagaagaugccagaugacacuuaagaccuacuugugauauu

SEQ ID NO: 146738 - RNA, 47 nt, Homo sapiens
uggauaacaacguugauggggaagugagcauacacagaccucaucuu

SEQ ID NO: 146739 - RNA, 37 nt, Homo sapiens
uccccaggcucauagaagcaaguuggagaggaaccau

SEQ ID NO: 146740 - RNA, 46 nt, Homo sapiens
cuuggccauuaggggucagauguaaggcuuuagcagaaauuccccu

SEQ ID NO: 146741 - RNA, 54 nt, Homo sapiens
auggugugaaguuugccuguuaaugaauuuaauaagugcaugucauucauucac

SEQ ID NO: 146742 - RNA, 65 nt, Homo sapiens
uaaucccacagccaacauauccuauuagcuucuguaaggguugggcuaauuacauguauuuuuag

SEQ ID NO: 146743 - RNA, 40 nt, Homo sapiens
gggaaucaugugcaaauugggguaauggaaagcagccaca

SEQ ID NO: 146744 - RNA, 67 nt, Homo sapiens
aucaggaaccacccagggacuacuuaaauucaguggcacccaaggcaaaaauggguggaguggagaa

SEQ ID NO: 146745 - RNA, 346 nt, Homo sapiens
ugucauccccgacuagauuacagucuuaaaccuggccgguuuuccugcuugcagccucucuccauccaggcugccuugcacuuugaaucagaauuucagaaaggacccaacacaaauuaacauuccaaagcaccauauccaucauguuaccuacccaaucccaaaccuuccaagguucucacuucucauagucgcuguggagagccccucaggucagccaucgagcgccaccccucuccccaucaucaccugccacccugcuucaucucccucuuccucaccacgagaaggguugaacccaugagcauguucaaccccucucaagguguucuuuucccccacucag

SEQ ID NO: 146746 - RNA, 41 nt, Homo sapiens
uuuuaggaagagcuaaggagcaaauccaagaucugugccaa

SEQ ID NO: 146747 - RNA, 42 nt, Homo sapiens; identical to SEQ ID NO: 55835

SEQ ID NO: 146748 - RNA, 46 nt, Homo sapiens
cucacuggauccaaaauccagguugauuacgauggacacugcaaag

SEQ ID NO: 146749 - RNA, 46 nt, Homo sapiens
agaucauuccagauggcugguucucuaaaggcagcaacuacaguga

SEQ ID NO: 146750 - RNA, 76 nt, Homo sapiens
cagugaauuccugaaguuuguggaacagaaugaaacugccaucaauauuacaacguauccagaccaggagaacaac

SEQ ID NO: 146751 - RNA, 100 nt, Homo sapiens
uggaaacucagcuuccaagaguuucucaagugccucaacccaucuuucaacccuccugagaagaguaugccuaaccuaagaaauagagagcuguagugaa

SEQ ID NO: 146752 - RNA, 46 nt, Homo sapiens
agugugcccuggaggaugaaacguaugcagauggagcugagaccga

SEQ ID NO: 146753 - RNA, 46 nt, Homo sapiens
ugcaggaaagaaucagaagggggcccagacccagacagaggaggag

SEQ ID NO: 146754 - RNA, 48 nt, Homo sapiens
ggaaacagcugaaaagaccaagagagugagcaccaaagagaucuaaug

SEQ ID NO: 146755 - RNA, 90 nt, Homo sapiens
gaucccagcaucuucuccacuucagcgcugaguucaguauacacaagugucugcuacagucgccaaaucaccaguauuugcuuauauagc

SEQ ID NO: 146756 - RNA, 69 nt, Homo sapiens
uggugcucuggggcuggaggcuaguaaggaaacugcaucacgauugaaagaggaacagacccaaaucug

SEQ ID NO: 146757 - RNA, 84 nt, Homo sapiens
aaccucuuuugaguuuacugcaucugucagcaggcugcagggagugcacacgaugccagagagaacuuagcaggguguccccgg

SEQ ID NO: 146758 - RNA, 48 nt, Homo sapiens
gucagcaugacagaccuccagcauccacgcaucucuuggucccaauaa

SEQ ID NO: 146759 - RNA, 46 nt, Homo sapiens
guacacccaaaugaugcagauacuuguauacuuugagccccuuagc

SEQ ID NO: 146760 - RNA, 49 nt, Homo sapiens
uuguaauuauuuuucaguagucccaccacuucauagguggaaggaguuu

SEQ ID NO: 146761 - RNA, 78 nt, Homo sapiens
ccacauacuagaugcagcccauaguuggccccccuagcuuccagcaguccacuaucugccagaggagcaagggugccu

SEQ ID NO: 146762 - RNA, 48 nt, Homo sapiens
aaaacaagaugaccagauuugaucucagccugaugacccuacaggucg

SEQ ID NO: 146763 - RNA, 87 nt, Homo sapiens
agaaagcauucccuuagagaugaggauaaaagaaaguuucagauucaacagggggaagaaaauggagauuuaauccuaaaacuguga

SEQ ID NO: 146764 - RNA, 43 nt, Homo sapiens
uuuagguuguaaugcacaggcaacugugagaaacuguugugcc

SEQ ID NO: 146765 - RNA, 49 nt, Homo sapiens
uguauccaucccaucuaaaaacucuucaaacuccacuuguucagucuga

SEQ ID NO: 146766 - RNA, 77 nt, Homo sapiens
aaagguuuuaccagcccuuggacacuaugggaggagggcaagaguacaccaauuuguuaaaagcaagaaaccacagu

SEQ ID NO: 146767 - RNA, 34 nt, Homo sapiens
gcagcuucuguguaaauagggcagcugucgucua

SEQ ID NO: 146768 - RNA, 53 nt, Homo sapiens
gcugcuaaauagccuagucuggggagucuuccauaaaguuuugcauggagcaa

SEQ ID NO: 146769 - RNA, 47 nt, Homo sapiens
uguaguuuuguaaacacuauagcaucuguuaagauccaguguccaug

SEQ ID NO: 146770 - RNA, 76 nt, Homo sapiens
auucccacaugccgugacucuggacuauaucaguuuuuggaaagcaggguuccucugccugcuaacaagcccacgu

SEQ ID NO: 146771 - RNA, 69 nt, Homo sapiens
uggcauagauuuggcugucuccgcucauagcugcuuuuggcgcgaaagaugccgggucugguugacuca

SEQ ID NO: 146772 - RNA, 67 nt, Homo sapiens
aacccugccccgccugagucucaggagaagaagccgcugaagcccugcugcgcuugcccggagacca

SEQ ID NO: 146773 - RNA, 40 nt, Homo sapiens
gcaaaaucagaaaguuaauuucucugugauaauaagcaaa

SEQ ID NO: 146774 - RNA, 33 nt, Homo sapiens
ucacuuaucuguggaaugucuucauaggcaugg

SEQ ID NO: 146775 - RNA, 46 nt, Homo sapiens
aagaacacuguggacaucuaauugaggcccacaaggaaugcaugag

SEQ ID NO: 146776 - RNA, 74 nt, Homo sapiens
auuauacauuuuuuauaccuuaccugaaaguaggcuacauucacccagugguucuuacccagaggugcaccuca

SEQ ID NO: 146777 - RNA, 55 nt, Homo sapiens
ccccaauuuaauuaccuuccuagcauuguucucaaucuucugggauaggcacugg

SEQ ID NO: 146778 - RNA, 93 nt, Homo sapiens
ugcaggucuuguuucuugaauaucuguaaaaauaacugcuuuagccuuuuuuggaggauauuuuugagaaauauguauuucucaaacacacac

SEQ ID NO: 146779 - RNA, 67 nt, Homo sapiens
agguggucugcugugugaauaaauaauuccugaagaaugaagaagauuaauuuugggaguucuuuga

SEQ ID NO: 146780 - RNA, 46 nt, Homo sapiens
cgaacuuugauauguggaaaaaguauuuauaauuuauuguaagaag

SEQ ID NO: 146781 - RNA, 56 nt, Homo sapiens
ggugggaugaugaucugggcaauguauuauuauuuguuuacuauuaccagauccag

SEQ ID NO: 146782 - RNA, 71 nt, Homo sapiens
ccaucagcuggauagggugcaugggaucucauugucuaaagaaacaagcuguuauugucaccuacgguuag

SEQ ID NO: 146783 - RNA, 54 nt, Homo sapiens
uugagaggaggaaaugaauaaaggacgugggggagggguauagcagaaaggaaa

SEQ ID NO: 146784 - RNA, 46 nt, Homo sapiens
cucaauugauagggucagcgucucgcaagcaaaaaaucucaugacc

SEQ ID NO: 146785 - RNA, 49 nt, Homo sapiens
agacgcugacccuaucaauugagcuaaaggacucuucaguguaagaaaa

SEQ ID NO: 146786 - RNA, 108 nt, Homo sapiens
uguguauuuccuuuucugcuauuucuuuucaguuuuuccaaagucaagagucuuaaccuuguacucagggaauuuugagauaacaagucccuugggcaccuuaagcuc

SEQ ID NO: 146787 - RNA, 42 nt, Homo sapiens
ugagaaacuagaauacagaaaccggcuggaagagacagcuag

SEQ ID NO: 146788 - RNA, 49 nt, Homo sapiens
cugagcuacucuggcugggguggcagcagugggcacgaugcccccauga

SEQ ID NO: 146789 - RNA, 42 nt, Homo sapiens
uaggcaaucaugggggcaucgugcccacugcugccaccccag

SEQ ID NO: 146790 - RNA, 48 nt, Homo sapiens
agcugcccuauucauugagguauccacuuggcuacuuuguagaaucau

SEQ ID NO: 146791 - RNA, 25 nt, Homo sapiens
gugaauagcagaccacccuugcagu

SEQ ID NO: 146792 - RNA, 42 nt, Homo sapiens
uggacacacugauccaagugagcaucgagaguggucggauga

SEQ ID NO: 146793 - RNA, 42 nt, Homo sapiens
cggugcacaacgccaugcagcugaagccgggcaagcccaaug

SEQ ID NO: 146794 - RNA, 95 nt, Homo sapiens
aaucugccugguguccuuacaugaagaggaaugcaaacacacagaaacaccagggauacaugcacacagaggaaagaccaugugaggacacagcg

SEQ ID NO: 146795 - RNA, 45 nt, Homo sapiens
auacaccggcaguuggcccagcugggcggcuuggaugcccuagac

SEQ ID NO: 146796 - RNA, 42 nt, Homo sapiens
cucagcaccauagcagccacauacuucuccaucagucccuca

SEQ ID NO: 146797 - RNA, 52 nt, Homo sapiens
cugaggcugaguggugugauaccaagcauccuggcuuggcuggaaucagauu

SEQ ID NO: 146798 - RNA, 48 nt, Homo sapiens
uggaagccuccugacuugaacuagaccuuggguaaauaggguuuagau

SEQ ID NO: 146799 - RNA, 47 nt, Homo sapiens
aagggcaucuuugucuuuaaauacagcaaauguuauucagauuuugu

SEQ ID NO: 146800 - RNA, 48 nt, Homo sapiens
gguuuuccuuaucaugcugcacccagagcaacucuugagaaagauuua

SEQ ID NO: 146801 - RNA, 56 nt, Homo sapiens
auacucuaaauuccugucuuauaauguaacgagaaggaaagguuaugaucaaauua

SEQ ID NO: 146802 - RNA, 44 nt, Homo sapiens
uauaguccugaccuuaguucauggcccacucaguuagcugccca

SEQ ID NO: 146803 - RNA, 78 nt, Homo sapiens
uauuggccuuccagucccaccuaucacagccuuaaucaccccagguccuguucgucauugccaaauuccugacuugcc

SEQ ID NO: 146804 - RNA, 42 nt, Homo sapiens
gcugucuucacuuagccauauauauuuaggguuuccccaugu

SEQ ID NO: 146805 - RNA, 42 nt, Homo sapiens
ugugugggcagaaauugguagucgugcuuuugaaugucagcu

SEQ ID NO: 146806 - RNA, 64 nt, Homo sapiens
uuugauauaacaaauuucuuucuauacagguuuuacauaagagagacaguaauaaugucaagga

SEQ ID NO: 146807 - RNA, 29 nt, Homo sapiens
gccuggggauguuagcagacucugggguu

SEQ ID NO: 146808 - RNA, 47 nt, Homo sapiens
auauuuguugagaggaaauauugcuacuuccugcacuuccacccucu

SEQ ID NO: 146809 - RNA, 55 nt, Homo sapiens
uguuaguuuugaacauguacuguugugcaaucccaaagauaauucaugacuccuu

SEQ ID NO: 146810 - RNA, 61 nt, Homo sapiens
uucuuuaaucauaucuuaaaaccgaaaauguauaaaagauuaaauauuuauguacaauggg

SEQ ID NO: 146811 - RNA, 45 nt, Homo sapiens
cugcguuggagaaucaaaucaucaagcauuuauacuugcccuuuu

SEQ ID NO: 146812 - RNA, 42 nt, Homo sapiens
agauaauguugcagcuucacuaaauacaucuaaacuaaaggg

SEQ ID NO: 146813 - RNA, 45 nt, Homo sapiens
guucccuggggcagacaugucgggcagucucaacaaucgcacaac

SEQ ID NO: 146814 - RNA, 46 nt, Homo sapiens
uaccugcggguuauuucugauacucuuagccuugcacagagccaag

SEQ ID NO: 146815 - RNA, 45 nt, Homo sapiens
agacccuguuuuuccugagccuuggacuguucucucugggcuaca

SEQ ID NO: 146816 - RNA, 69 nt, Homo sapiens
auugggaaugagguuucaacauaaugaacuuuggagggacacagauacuuccuggcucccuaaaauuua

SEQ ID NO: 146817 - RNA, 47 nt, Homo sapiens
ucuuacuugacaguguacuguguagucuuuuuuauggaugucuuuga

SEQ ID NO: 146818 - RNA, 88 nt, Homo sapiens
gcugugcagaaccuucuggaggaagaagaaauuggaauaaagagcacggggaugaguauuaagagcuagugacucaacuagauuuggg

SEQ ID NO: 146819 - RNA, 86 nt, Homo sapiens
uugggucacagcgaguggaggagggggagagagcgcgaucacuguagacuuggggugccaacauauuuaaggaaguauagggugga

SEQ ID NO: 146820 - RNA, 76 nt, Homo sapiens
ucaguagguggagcuguugcuucaguaguucacuauugccccugagugcugaggcgguccuggguaguucuaccac

SEQ ID NO: 146821 - RNA, 46 nt, Homo sapiens
augccacagauaaccaugacugagguggcaauguaauuaggcagug

SEQ ID NO: 146822 - RNA, 39 nt, Homo sapiens
aaugucuuuaacaaaaugugaauacgugacuaagauggg

SEQ ID NO: 146823 - RNA, 42 nt, Homo sapiens
uaagauucugcagucagaaacaaaacuuuaaaaacuccgaac

SEQ ID NO: 146824 - RNA, 48 nt, Homo sapiens
uugacaccuuuuauaaaccuacaguuuauacuucuuccuucugugaaa

SEQ ID NO: 146825 - RNA, 25 nt, Homo sapiens
cuuuccaagggcuaacgaaagggaa

SEQ ID NO: 146826 - RNA, 67 nt, Homo sapiens
caguggguaaaaucuagggaugcugcugaguauucugcaguguaccagaaaggcccuuuacaacaaa

SEQ ID NO: 146827 - RNA, 48 nt, Homo sapiens
guaauuuacuacaggguaagaguuuagaaacauuacugcuagcaaaga

SEQ ID NO: 146828 - RNA, 53 nt, Homo sapiens
auaggcuugauucuggcuuuauccauaacugucuguauaacuauagguacauu

SEQ ID NO: 146829 - RNA, 46 nt, Homo sapiens
ccuauuucaaugauauugcuguaggugcaguaugcuguagggugga

SEQ ID NO: 146830 - RNA, 51 nt, Homo sapiens
uggaaaauaaggauaucuaguguauaccucauaaauucuuuuaggacucaa

SEQ ID NO: 146831 - RNA, 51 nt, Homo sapiens
acaggaacuaaaauguuaaaucaugucuuaaacaucugugaaaaagauggu

SEQ ID NO: 146832 - RNA, 49 nt, Homo sapiens
gcugcagaaaaaccucaaaguuccuucuggucagaaugcagaugugcaa

SEQ ID NO: 146833 - RNA, 51 nt, Homo sapiens
uguuuaguuuugcaguugaaguuagaugguccuaaacauuuaauugucaaa

SEQ ID NO: 146834 - RNA, 44 nt, Homo sapiens
auuuuuaaguaauuauaucuucucuucuugcugguggguggggc

SEQ ID NO: 146835 - RNA, 48 nt, Homo sapiens
guguugugauuuaauuuuuucccguuccuuuuucuucaguaaacccaa

SEQ ID NO: 146836 - RNA, 45 nt, Homo sapiens
accccuaaauaaaccugaagcagguguuuucucuuggacauacua

SEQ ID NO: 146837 - RNA, 23 nt, Homo sapiens
uuuaaggauuugaggcaggggua

SEQ ID NO: 146838 - RNA, 49 nt, Homo sapiens
caaucuugagugccaagaauaauacagaaaaagaagacaguugaugaau

SEQ ID NO: 146839 - RNA, 50 nt, Homo sapiens
cuggaaaaucacaggauauauccaucauauuuuucaggacagauaguuuu

SEQ ID NO: 146840 - RNA, 48 nt, Homo sapiens
aaagcaguuuacucaucaauugaaaaguccuccaaaaagagaacuauu

SEQ ID NO: 146841 - RNA, 44 nt, Homo sapiens
cauugcuguuacaucugaaauaaacuuaugugauguucugguag

SEQ ID NO: 146842 - RNA, 57 nt, Homo sapiens
agcuuucguaggacaucugauuauaaugcuuuucuuuguuucuuuguccauacugaa

SEQ ID NO: 146843 - RNA, 331 nt, Homo sapiens
uuguagguuguaauaaacaacuuuuuuuuuuuuuuuugagacaaggucuugcuuugucguccaggcuggagugaagugguaugacuguggcucacuacagcuuugcccuccuuggcucaagcgauccucgcaccucagcuuccugaguagcuggaacuacaggcguguucccacgcccagcuaauuuuuuaauuuuucguagagacgggguuucgccaucuugcccaugcuugucucaaacuccugagcuuaagcaauccuucugcuucugucuccaaaagugcugggauuccacuacuaaagauuuguaaacaaaugaauagagaugaaa

SEQ ID NO: 146844 - RNA, 69 nt, Homo sapiens
uggugccucgcuuuuagauggugcuucaaaauauuaguuacauuaauagauggaugaugaagucaguga

SEQ ID NO: 146845 - RNA, 45 nt, Homo sapiens
ugaugaucaugaaaugagugugucuuugccaaagaugacucggug

SEQ ID NO: 146846 - RNA, 42 nt, Homo sapiens
auccauuaagugagucccaaccugugguuugaaaaacacuag

SEQ ID NO: 146847 - RNA, 25 nt, Homo sapiens
aguagguguuuaaagaaggguggug

SEQ ID NO: 146848 - RNA, 53 nt, Homo sapiens
uggauguccucaaacacaugauacaugaaguggaacaugaaauggaagaauau

SEQ ID NO: 146849 - RNA, 55 nt, Homo sapiens
aaauaccucaguuuuagauuaucugcaguaaaggcuuauccuuuaagucuuuucu

SEQ ID NO: 146850 - RNA, 46 nt, Homo sapiens
cugacagcugaaauucuucgucuuagagaagaaaacgcugcuacac

SEQ ID NO: 146851 - RNA, 25 nt, Homo sapiens
gaggaguuauuggaauaguucaggu

SEQ ID NO: 146852 - RNA, 42 nt, Homo sapiens
acucacacaugcuauuaagaacuguccugugauaaauaacag

SEQ ID NO: 146853 - RNA, 41 nt, Homo sapiens
uauaguauugagaaggacuguucaaacucguccugcuccac

SEQ ID NO: 146854 - RNA, 46 nt, Homo sapiens
gagaacaaaugagucauuaauacaaagaaaggacauaaugacacga

SEQ ID NO: 146855 - RNA, 41 nt, Homo sapiens
gcgggauaaauacaagaagguaaguugcagugugaauauuu

SEQ ID NO: 146856 - RNA, 33 nt, Homo sapiens
cucaccucuggccgcggaagguccggggcgugg

SEQ ID NO: 146857 - RNA, 46 nt, Homo sapiens
uuucaaagagucuucccgcucccagccgcagcccgggcgccgccau

SEQ ID NO: 146858 - RNA, 51 nt, Homo sapiens
uggaaggauguuuaacgguuugcagaggugaaagaccuaucuggccaugug

SEQ ID NO: 146859 - RNA, 45 nt, Homo sapiens
ucuucuuucucuugccuggauucagucccagaaauguuaggacua

SEQ ID NO: 146860 - RNA, 45 nt, Homo sapiens
cugggacugaauccaggcaagagaaagaagaaaaagaagaagaaa

SEQ ID NO: 146861 - RNA, 50 nt, Homo sapiens
acgcccggaaacaaagagacuaagccagacuaugggggaaagggagauaa

SEQ ID NO: 146862 - RNA, 127 nt, Homo sapiens
gaaggauccuggaacuuuaaagagggaaagagugagauucagaaaucgccaggacuggacuuuaagggacguccugugucagcacaagggacuggcacacacagacacacgagaccgaggagaaacu

SEQ ID NO: 146863 - RNA, 47 nt, Homo sapiens
ccuuucaccucauccuacuuguccagaagguaaaaagacacagccag

SEQ ID NO: 146864 - RNA, 45 nt, Homo sapiens
agagauccacucuggaggaaccaaaccuucagccucuccagagaa

SEQ ID NO: 146865 - RNA, 42 nt, Homo sapiens
ugacccauacucuguucuucccugcaaagcuggcaaggaugu

SEQ ID NO: 146866 - RNA, 45 nt, Homo sapiens
gagaagggcaaguuuggcauggugcugcugaagaagacgcugcag

SEQ ID NO: 146867 - RNA, 42 nt, Homo sapiens
gggagcaggaaggccaagccugggcagcgagaagaagaaaga

SEQ ID NO: 146868 - RNA, 42 nt, Homo sapiens
cuggggcaggaggaagggugguggcucuggggguugagggag

SEQ ID NO: 146869 - RNA, 46 nt, Homo sapiens
ccacgucccgggcgguaacaguugcugcaagaccuaugaccaccac

SEQ ID NO: 146870 - RNA, 27 nt, Homo sapiens
cuugagaaaccagagaaggagaagaaa

SEQ ID NO: 146871 - RNA, 38 nt, Homo sapiens
cuaaaauugucuuuuguuuuuggugaagacacauggua

SEQ ID NO: 146872 - RNA, 53 nt, Homo sapiens
uuugguuuuauuuccucugugaagaugacuaauuguugaauauauaguugcag

SEQ ID NO: 146873 - RNA, 40 nt, Homo sapiens
uaugacuuguuuaaguagaauacuauuaauugagguuagc

SEQ ID NO: 146874 - RNA, 48 nt, Homo sapiens
uuucuugccuccuaguguucuuguuuuuaaauagaagauacuauaggg

SEQ ID NO: 146875 - RNA, 47 nt, Homo sapiens
uggaagcuaucauugaagaagaugauggugauggcggauggguagau

SEQ ID NO: 146876 - RNA, 85 nt, Homo sapiens
aggacaauauaaggcuucaagauugcucagcacuaugugaagaggaagaagaugaagaugaaggagaagcugcagauauggaagg

SEQ ID NO: 146877 - RNA, 46 nt, Homo sapiens
agcaaaauauauacaguauuaguuauaaguguuaaggaaaaaauaa

SEQ ID NO: 146878 - RNA, 67 nt, Homo sapiens
uaaaauauuguaagguaugcuuauguccagauaggagagaagggagaguaguaaaggguggagucag

SEQ ID NO: 146879 - RNA, 48 nt, Homo sapiens
uuuuaaaguagaggugaugaagaggaaccagcauagaagauacugaaa

SEQ ID NO: 146880 - RNA, 46 nt, Homo sapiens
acaaggaaaauaguagaagcuuguaaagccaaaacugaugcuggcg

SEQ ID NO: 146881 - RNA, 48 nt, Homo sapiens
uagaauacuagaauuuaaagggauaauaaguuuauucugucaugucag

SEQ ID NO: 146882 - RNA, 46 nt, Homo sapiens
gaauaugcugugaaggcuguggaaaauaguacagccacuggacuca

SEQ ID NO: 146883 - RNA, 45 nt, Homo sapiens
gacucccuuuucuaccccaaagccaccaccaucuuuacaucugag

SEQ ID NO: 146884 - RNA, 45 nt, Homo sapiens
ggguagaaaagggagucuuccuaaacuuuaugaagaaggcuccaa

SEQ ID NO: 146885 - RNA, 42 nt, Homo sapiens
cuuugcagcgugccuggcuuugccaaggguacagccccaaua

SEQ ID NO: 146886 - RNA, 46 nt, Homo sapiens
uggggcuguacccuuggcaaagccaggcacgcugcaaagauagaaa

SEQ ID NO: 146887 - RNA, 52 nt, Homo sapiens
uuggugaauuaacuaaaggaagaagacaugaaauuauuccaaaagauauaag

SEQ ID NO: 146888 - RNA, 31 nt, Homo sapiens
auguugaggggaaaaugaucaucucugagag

SEQ ID NO: 146889 - RNA, 37 nt, Homo sapiens
ccuacucuuugcuggaauucuggaaaacaccugggcu

SEQ ID NO: 146890 - RNA, 55 nt, Homo sapiens
uaugugcaaagccccaggaccaagcacugcugucuccacaacugaguuccccaaa

SEQ ID NO: 146891 - RNA, 46 nt, Homo sapiens
auggcuuuaggcagcguugcagucaccaaggaugauggcugcuauc

SEQ ID NO: 146892 - RNA, 42 nt, Homo sapiens
agccaguuguuuauugucuccauuuagcuguuuucaagcggc

SEQ ID NO: 146893 - RNA, 89 nt, Homo sapiens
cccugauauuucucccuugacuguugcaauauuuuggucuaccuucaguggagaauuggaagcuaggccaaaguuauuauucagggaaa

SEQ ID NO: 146894 - RNA, 41 nt, Homo sapiens
agcagaguuucugagguaauaugucugaggugaggccaaga

SEQ ID NO: 146895 - RNA, 55 nt, Homo sapiens
uguaccacuauccuuaauccccccaggugaaauacuucagauagacugcagggua

SEQ ID NO: 146896 - RNA, 40 nt, Homo sapiens
agcuacugcuuauugauguuuuccuaugcacaaggcauug

SEQ ID NO: 146897 - RNA, 41 nt, Homo sapiens
ccucuucuaauggaacacacacccugaggacacagagggga

SEQ ID NO: 146898 - RNA, 44 nt, Homo sapiens
auacccaagaucucagagucaaagauggcuuuuaagcagaugga

SEQ ID NO: 146899 - RNA, 44 nt, Homo sapiens
uagcaucaaauauccaaacugacaggaaguuucuuuugcauagc

SEQ ID NO: 146900 - RNA, 42 nt, Homo sapiens
agagcucaaagaaaucugccaacauguauguggacucuugag

SEQ ID NO: 146901 - RNA, 40 nt, Homo sapiens
ggauuggagagagaggucgagauggacuuaauggaaggga

SEQ ID NO: 146902 - RNA, 88 nt, Homo sapiens
augaacgaagauaaaaugggucgugaagaacuauuaguucauaaguagacccuccagaagaguguugaaaagaaaggcucuagaaaga

SEQ ID NO: 146903 - RNA, 41 nt, Homo sapiens
cauucuauaacuccuugaaaacaagacuaccucggggauau

SEQ ID NO: 146904 - RNA, 38 nt, Homo sapiens
uccuguuaggauggccccuggggcagugaugaugaagu

SEQ ID NO: 146905 - RNA, 57 nt, Homo sapiens
cuaauccagucuagcugguauccuuaaaagaaaaggaaauuuagacacacaaagaga

SEQ ID NO: 146906 - RNA, 42 nt, Homo sapiens
cguagaaggaagccacaagaaauauagccauuugacucaauu

SEQ ID NO: 146907 - RNA, 47 nt, Homo sapiens
uguuauaaauacauuuggauaacagggaaucccuugcaauccaagcu

SEQ ID NO: 146908 - RNA, 44 nt, Homo sapiens
uuuaacuguauuauccaacuacaaauacuucuaaaguuaugaag

SEQ ID NO: 146909 - RNA, 46 nt, Homo sapiens
ccaggagauuaucuuccuggauuucaaccacuucuaugccauggau

SEQ ID NO: 146910 - RNA, 42 nt, Homo sapiens
auuucuguauacuugcugucuuguucagaauaagcaccuuau

SEQ ID NO: 146911 - RNA, 47 nt, Homo sapiens
gggguuacuucacaaaaagaugacgccaucuauuuggagacagagca

SEQ ID NO: 146912 - RNA, 138 nt, Homo sapiens
gaugcucuagagggggaaauaaaaugagugaggaucuugaagagagggaauggcccauuuaacaaaccaaaauaguuuauuaugguuguacuguggguugcaaggaggagacugucagggaguaaaguggcaacauac

SEQ ID NO: 146913 - RNA, 36 nt, Homo sapiens
acccugcaaaggaggcuuuaaaguuaagggaaggau

SEQ ID NO: 146914 - RNA, 54 nt, Homo sapiens
ucaucuacuucaaacaaaugagcaauuuacagcuccacaaaaagcuagaugcaa

SEQ ID NO: 146915 - RNA, 49 nt, Homo sapiens
ggacacuuugcgggacuggugucaacaacucgguuugaguacuaauggc

SEQ ID NO: 146916 - RNA, 47 nt, Homo sapiens
auaugccugaaaugucacaagagaccagauuacagcgauguucgagg

SEQ ID NO: 146917 - RNA, 45 nt, Homo sapiens
aguugaagugauaacuucagcaccgggagccauguuggcaucaug

SEQ ID NO: 146918 - RNA, 25 nt, Homo sapiens
agagcaaauucaagagugacuugcu

SEQ ID NO: 146919 - RNA, 42 nt, Homo sapiens
cucucuucuuguuaccugccugcauuuucccauccccaggca

SEQ ID NO: 146920 - RNA, 58 nt, Homo sapiens
agauuaaugacaguagagaaguagcagcaaccuguuugaauacaauguaagagaugag

SEQ ID NO: 146921 - RNA, 28 nt, Homo sapiens
ccuugaguugcgcgggucguguucgagg

SEQ ID NO: 146922 - RNA, 40 nt, Homo sapiens
cuuuuuuuaaaacgaugaaagcauaauaaagauauauucu

SEQ ID NO: 146923 - RNA, 33 nt, Homo sapiens
ugauucuaccaauccugccuaaccuuagucugc

SEQ ID NO: 146924 - RNA, 28 nt, Homo sapiens
aagauauuaaaagaauauuguagagaga

SEQ ID NO: 146925 - RNA, 40 nt, Homo sapiens
aauaauuguaaaaaaauacaaaaauaauaucugugaauuu

SEQ ID NO: 146926 - RNA, 43 nt, Homo sapiens
gagagcaagaagguagggcgcuguugugauccagaaaggagau

SEQ ID NO: 146927 - RNA, 68 nt, Homo sapiens
gucaguuccacaacugaggaaaggaugcaucaguaugcucaaauauugauuugcugauagaagcugaa

SEQ ID NO: 146928 - RNA, 47 nt, Homo sapiens
cuucggauaauuuugauuuuuccaggucauuuugauuaaaaguauuc

SEQ ID NO: 146929 - RNA, 46 nt, Homo sapiens
uaguggguccaugagaauuggaaaagacuuuauucuuuuuacgaag

SEQ ID NO: 146930 - RNA, 34 nt, Homo sapiens
accuaugcuuuguucucuuugaguuuauggauau

SEQ ID NO: 146931 - RNA, 46 nt, Homo sapiens
cuaaaacaauggaccuugaaaacagguuucucuaucaguaaagcag

SEQ ID NO: 146932 - RNA, 46 nt, Homo sapiens
uuuugggacuaggagaaguaguuuauccagugucgaucauaaucug

SEQ ID NO: 146933 - RNA, 46 nt, Homo sapiens
acaucuucuuuuaaaggagcauuuaaagaugaaguuaaaaaggcag

SEQ ID NO: 146934 - RNA, 46 nt, Homo sapiens
ucuccuugaaaauaucuauucaaauuagagcucccuguggaccuaa

SEQ ID NO: 146935 - RNA, 52 nt, Homo sapiens
gcaggaauccucuguacucuguuaaaacaaauucugguuucuaaguaggcag

SEQ ID NO: 146936 - RNA, 51 nt, Homo sapiens
auuuaauugggcuagaugaaaaugucuggaugaggaagugaaagugaacug

SEQ ID NO: 146937 - RNA, 46 nt, Homo sapiens
aguacuuuuguugaauauccuuuugggaucucauuacugaguagug

SEQ ID NO: 146938 - RNA, 51 nt, Homo sapiens
aggagugagaagggagcccauuucagaaucuuucccagacugucgugaaaa

SEQ ID NO: 146939 - RNA, 46 nt, Homo sapiens
caugagacucauuacauuguuuggcaagguuugcuuaaagcuguag

SEQ ID NO: 146940 - RNA, 58 nt, Homo sapiens
uuuaaucuugacuaacacuuccaaguucaagaauaguaauuauucuucauuugacaug

SEQ ID NO: 146941 - RNA, 48 nt, Homo sapiens
ggaaacaaaaugugccagaugaaaccugaacagccuugacugaaaugg

SEQ ID NO: 146942 - RNA, 35 nt, Homo sapiens
ucuuuuguauccauucaggaaaaugugcaucgcaa

SEQ ID NO: 146943 - RNA, 46 nt, Homo sapiens
agacuaaagcagaaaauaguuuucacucaucauaucacuauucaga

SEQ ID NO: 146944 - RNA, 47 nt, Homo sapiens
uaacauuguuuugcaaugaauuuggauaccagaaugacaucgaugug

SEQ ID NO: 146945 - RNA, 44 nt, Homo sapiens
aagguaagugauauacuagagacaaauaauuauuugaggguuca

SEQ ID NO: 146946 - RNA, 51 nt, Homo sapiens
gggcagggaguuaaagacagucucuaauaucuguaacuaacagcucaguag

SEQ ID NO: 146947 - RNA, 46 nt, Homo sapiens
gucggucauaaaguaucaaaauagacuggcagaacagcagccacag

SEQ ID NO: 146948 - RNA, 38 nt, Homo sapiens
caauagguaguugaaucaauaaguaaaacaugccguca

SEQ ID NO: 146949 - RNA, 60 nt, Homo sapiens
ucuccaaauuauuuucuuacucauccuuuuuggagaagcugacaucauacuuccugaugg

SEQ ID NO: 146950 - RNA, 49 nt, Homo sapiens
ggcaucagaacagccuggcauuguggcauagcauggugcagggaacuca

SEQ ID NO: 146951 - RNA, 91 nt, Homo sapiens
auaaucaguugcagauuaaauucuaagauuuguucuuuuaguccaggucccaagugaaguaaauuuaaucagaaaauccuaacuguacaga

SEQ ID NO: 146952 - RNA, 33 nt, Homo sapiens
agucccacaaagaauugauagaaaauuagaaag

SEQ ID NO: 146953 - RNA, 55 nt, Homo sapiens
auaaaaaaagaugcuaucauugguaaacagcuacucauuaaguaacucagauuuu

SEQ ID NO: 146954 - RNA, 32 nt, Homo sapiens
ucuuccaauugugagugaauuuuugccuucac

SEQ ID NO: 146955 - RNA, 46 nt, Homo sapiens
gcucaaagcaaucaagaugaugcaggagcuccacaggaagaauaga

SEQ ID NO: 146956 - RNA, 64 nt, Homo sapiens
augauggugauggaggagguaacucugcccuuuccuggaggcagucuuuauuggauauagagga

SEQ ID NO: 146957 - RNA, 46 nt, Homo sapiens
ccauuaauugaaauugggaauuguagaaggugacugggcuugugga

SEQ ID NO: 146958 - RNA, 38 nt, Homo sapiens
uguuaaaaaggugcagacauaauuugugaaugggaaca

SEQ ID NO: 146959 - RNA, 31 nt, Homo sapiens
auuuucuggagauuaaaaaacugccaggaaa

SEQ ID NO: 146960 - RNA, 45 nt, Homo sapiens
cacucugaucagguguuacuauacaaugcuucauaaaaacgauaa

SEQ ID NO: 146961 - RNA, 28 nt, Homo sapiens
uauggaaaggauacaggcuguacacucu

SEQ ID NO: 146962 - RNA, 46 nt, Homo sapiens
guaauucugaagaagacaaauucagccuuuauugggugagcuagga

SEQ ID NO: 146963 - RNA, 60 nt, Homo sapiens
ugaugacaguaguaagaguaaauaaacuguaugcaacuuacuguuaauaguuauucagag

SEQ ID NO: 146964 - RNA, 23 nt, Homo sapiens
uugaaaagagcuuugaaagacag

SEQ ID NO: 146965 - RNA, 23 nt, Homo sapiens
gaucaguuggaaauaacuggagc

SEQ ID NO: 146966 - RNA, 27 nt, Homo sapiens
gcagagcuuccauucuaguugggggau

SEQ ID NO: 146967 - RNA, 50 nt, Homo sapiens
guagguguggagagguaaaggaguagaaguaaagaaaucagauaaaguga

SEQ ID NO: 146968 - RNA, 42 nt, Homo sapiens
cauugaaacaagaaaaaaaggaaauuccucuuuuaaaccaag

SEQ ID NO: 146969 - RNA, 41 nt, Homo sapiens
gcuuuacaauuuaagaaucauccaaaaacuaaaacacauuu

SEQ ID NO: 146970 - RNA, 42 nt, Homo sapiens
aauaaauuaucaccaauuccauuuaauugucacuaccuaaaa

SEQ ID NO: 146971 - RNA, 44 nt, Homo sapiens
aacaugauuucuacuuugaaaugacaaaccucagcuugcucaau

SEQ ID NO: 146972 - RNA, 45 nt, Homo sapiens
uguaaaguugcuucuucgccagcgucuucucaaagcacaccuguc

SEQ ID NO: 146973 - RNA, 49 nt, Homo sapiens
augaucuuccugaagaugagaguucucaaacaguagaagcagguaggaa

SEQ ID NO: 146974 - RNA, 46 nt, Homo sapiens
ucucaggaacaguaccagaugugauuggaaagaaaacuuugaacag

SEQ ID NO: 146975 - RNA, 45 nt, Homo sapiens
gaugcuuuuuauacucaaugcuugugugauauaacucugcuguag

SEQ ID NO: 146976 - RNA, 46 nt, Homo sapiens
gugcccagagcagaugaacaaaaagcugaaaauguguuucaaccag

SEQ ID NO: 146977 - RNA, 96 nt, Homo sapiens
uacaagaggaauacauaaugaaaucucucuggggcaaugugaaaauaaaagaaaaaucucugaggauaagcugaagaaucuucguauaaaacuggc

SEQ ID NO: 146978 - RNA, 48 nt, Homo sapiens
gugagugaaaaaguuguauuugagcaguaggaguagacucuauggaac

SEQ ID NO: 146979 - RNA, 42 nt, Homo sapiens
acuuuuauuuuaaugcauaaauaaaaauccucuuaaucuuag

SEQ ID NO: 146980 - RNA, 62 nt, Homo sapiens
aaguuucuaaccgcuuguuagcauaaaaugacauuaaaugagaaaaccuuuugaaagguuaa

SEQ ID NO: 146981 - RNA, 46 nt, Homo sapiens
gaccuggagcagacugacacuuauuuagaagcuuugcuuaaagaag

SEQ ID NO: 146982 - RNA, 37 nt, Homo sapiens
auaugcacaacauuugaauauccuuauaaauuuguuc

SEQ ID NO: 146983 - RNA, 41 nt, Homo sapiens
cccucucagggaguuacucaccagcagggcaggaggacggu

SEQ ID NO: 146984 - RNA, 54 nt, Homo sapiens
aaggaugaguaagauccugguagcagagaaaaaugggaaggaccauucugggca

SEQ ID NO: 146985 - RNA, 50 nt, Homo sapiens
gcuuauugauaaagaugaauccggaacuuuugguuuugcucuaaucgaug

SEQ ID NO: 146986 - RNA, 61 nt, Homo sapiens
aagaacuaaaauuccagauggcaaacucaaugaauggcagaaacccugguggucgaggagg

SEQ ID NO: 146987 - RNA, 44 nt, Homo sapiens
acauuguuuauugugaaaggaaaauuuauguuggggguggugag

SEQ ID NO: 146988 - RNA, 44 nt, Homo sapiens
uuggaguccagugagauggaggacauguuagguugaaggaauga

SEQ ID NO: 146989 - RNA, 44 nt, Homo sapiens
guaaagcuugaauuaagagaaaaaaacugaaagcaagaguaaug

SEQ ID NO: 146990 - RNA, 47 nt, Homo sapiens
uuggagguaaaaucuacaggucuuggugaccccuuagaauuagagga

SEQ ID NO: 146991 - RNA, 70 nt, Homo sapiens
cagagaaggaaagagaauccuacauagauuagugaugagaaagguagaauuaaaccauaaugacauccua

SEQ ID NO: 146992 - RNA, 47 nt, Homo sapiens
agggaauauacagagaaguuuugagggaauuuguaaauuuuauauug

SEQ ID NO: 146993 - RNA, 46 nt, Homo sapiens
guaagacugugccaaaaucccaaacuucaguugaaaaauagcccac

SEQ ID NO: 146994 - RNA, 1571 nt, Homo sapiens
uuuguauauagucaugugguacuuaacgauggggauacuuuacaagaaaugcauuuuuagacaauuucauuguuguguggacaugauagaguguacuuacacagagcuagaugguauuaccuaccgcacaccuaggcuguaugauguagccuauugcuccuaggcugcaaaucuauacaguauguuacuguacugaauacugugggcaguuguaacacaaugguaaguauguguguaucuaaauauaccuaaacauagaaaagguaugguaaaaauacuguauaaaaggccgggcguggugggucaugccuguaaucccagcacuuugagaggcugaggugggcggaucacuugaggucgggaguucgagaccagccugaccaacauggagaaacccugucucuacuaaaaauacaaaauuagcccggcgugguggcacacgccuguaaucccagcuacucgggaggcugaggcaggagaaucgcuugaacccaggagguggagguuguggugagcugagauugugccauugcacuccagccuggacaaaaaaaaaaauacuguauaaaagauaaaaauggauaaccuguaauaaccuguauaacaugcauggagcuugccagacuggaagugagugagugaacggugagugaaugugaaggccuaggacuguuacuguacacuacugcagacuucagaaacauuguacacuuaggcuacacuaaauuuauaaaaaaaauuucuuuuccaauaugaacagccuacugucacauuuaaacuugauaaacuuuuaauuuuuuuuaacuuuuugacucugguauuaacaauuagcuuaacaaaaauauuuucuuucuauauuacccuauaagcuuuaaaaaauguuaaaaaauuaaguuuuaaaaaaaauuuuauaaacuuuuuaaaaacuaagacacaaacacacacauuagccuaggccugcacagugucaggaucaucaauauuauugucuuccaccuccacaucuuauuccacuggaaggucacacaauauguaacuuuuucagauuggcuucuuucaccuaacaauuugcauuuuagcauggagcaauaacaugcauggagcuaucaucugugauaauagugccuucaggaauaccuccugaagggccugccugaggcccuuuuacuguuagcuguuuuuuaauaaguagaaggaauacccuauaaaauaauguuaaaaaguuuauaguauaguaaauacaucaacuaguaauauagucacuuauuauaauaucauuaucaaguauguguuaugcauaauuguaugugcuaugcuuuuaugugacugguggcacaguagauuuguuuacaccagcaucaccacaaacauguaauauguugcacuaugaccuugugaugacuaugacaucacuaggugauaggaauuuuucaguuccauuauaaucuuaugaaagcacuaacauaaaugcagucugucauuaacugaaauguccuugacugaaaugucauuacgggguucaugacuguauuugcuuuuaacauuaauagcuuuaugugaauuuacuuaug

SEQ ID NO: 146995 - RNA, 40 nt, Homo sapiens
gucucccaugguauccagaacagugcuuuauacuuggcaa

SEQ ID NO: 146996 - RNA, 48 nt, Homo sapiens
uacucaaagcaaugagcauauugcauagcuuucuuauugacuuauuag

SEQ ID NO: 146997 - RNA, 75 nt, Homo sapiens
uucaguuuauauuuuauguauaaucaucucucuuacaaauauaugacucaaggaaagauaguauuuugcccuagg

SEQ ID NO: 146998 - RNA, 56 nt, Homo sapiens
gcuuaaguuugggauucccacuacucaggaggacugaugauggggaccaaaguuag

SEQ ID NO: 146999 - RNA, 89 nt, Homo sapiens
gagggagaaaugucagaguuuauuuggauucuuuuaaagaauaaaauagaacacaguggggagauucagagucagcuugguaggguuga

SEQ ID NO: 147000 - RNA, 88 nt, Homo sapiens
cagcuguuucagugaaguucaagcuugccaucuauuuucaguagaagcaggaagaaugucagagacaauguuugcauuuuagggccuu

SEQ ID NO: 147001 - RNA, 45 nt, Homo sapiens
uuuaacuuaucaaauucaagcagagccuuuuaauuucaacacacu

SEQ ID NO: 147002 - RNA, 93 nt, Homo sapiens
ggaugaauagggcauugaacggauucuauaaacaaguacuuuucugagcgauaaacaggaacaaaagcagcacaaagauagcaugucaacaag

SEQ ID NO: 147003 - RNA, 50 nt, Homo sapiens
gcuauucuggggaagcaacuauguuuguuuguuugauuuaaggagcagug

SEQ ID NO: 147004 - RNA, 48 nt, Homo sapiens
ugaaacaaaauggauagaguuguuuggguacuaagaguaguagaguag

SEQ ID NO: 147005 - RNA, 31 nt, Homo sapiens
augggcuccuaccuauuuuaggacuagaaag

SEQ ID NO: 147006 - RNA, 34 nt, Homo sapiens
uuuuuaccaggacauuuuuuuaaaaagauuuugg

SEQ ID NO: 147007 - RNA, 50 nt, Homo sapiens
auuguuauuauagguauuauuaaacaguguacaugaccuuucccccaucu

SEQ ID NO: 147008 - RNA, 42 nt, Homo sapiens
ugcuuuauguguguauuugucugcuucuaucuguuucuccgu

SEQ ID NO: 147009 - RNA, 45 nt, Homo sapiens
aguuuggaggaguauugugugcaguuugggggaguaccaagcacc

SEQ ID NO: 147010 - RNA, 47 nt, Homo sapiens
aguuugggggaguaccaugugcaguuuugggggguaccaugcacagu

SEQ ID NO: 147011 - RNA, 53 nt, Homo sapiens
aguuuuggggaguacugugugcaguuugggggaguauuggaguaccaugcgua

SEQ ID NO: 147012 - RNA, 45 nt, Homo sapiens
aguuugggggaguaccaugugcaguuugggggaguacuuugugca

SEQ ID NO: 147013 - RNA, 362 nt, Homo sapiens
gcaguuuggaggaguacggugugcaguuugcaggaguaccgugugcgguuugggggaauaccgagugcaguuuggggaaguaccaugggcaguuugggggaguacugugugcuguuguuugggggaguacugugugcaguuuggggcaguacugugugcaguuugggggaguacugugugcaguuugggggaguaccaugugcaguuuggggaaguaccaugggcaguuugggggauuacugcaugcgguuguuugggagaguacugugugcaguuuggggcaguacugugugcaguuugggggaguacugugcacaguuuggaggaguaccaugugcaguuugggguaguaccauaugcag

SEQ ID NO: 147014 - RNA, 44 nt, Homo sapiens
auuagugagacuaagaagcaaacugggaacuguuccagcuggag

SEQ ID NO: 147015 - RNA, 50 nt, Homo sapiens
ggcuagcuuagaauuguaacuugcccaugccaaagcaacaacaacagauu

SEQ ID NO: 147016 - RNA, 18 nt, Homo sapiens
ugaggaaagucuguaagu

SEQ ID NO: 147017 - RNA, 43 nt, Homo sapiens
gcccucuuuuucugguuccaucucagcuuuauucccacugcau

SEQ ID NO: 147018 - RNA, 45 nt, Homo sapiens
auaucagugccuagacuaagccuggcguauaauaggcacucagag

SEQ ID NO: 147019 - RNA, 60 nt, Homo sapiens
gaucuuaauaaugugagaauaugauucucuuaccuuaguaagagagccaucaguuuauug

SEQ ID NO: 147020 - RNA, 50 nt, Homo sapiens
guuaaguaaccuuuucuuuaucuuuaaacaggcuaaggauauuaagccag

SEQ ID NO: 147021 - RNA, 51 nt, Homo sapiens
ccuuauuuugagggauagcuucuugcuguuaauaaaacuucguagauaaca

SEQ ID NO: 147022 - RNA, 42 nt, Homo sapiens
cagaaaucaaagcaaucuuucccaauggucaauuccagggag

SEQ ID NO: 147023 - RNA, 23 nt, Homo sapiens
uuaacucaucugcaaagaaacaa

SEQ ID NO: 147024 - RNA, 57 nt, Homo sapiens
uuaagucaagcuacugugaaaaguuuuauaucauaaaaugaaaaucuuaccugggcu

SEQ ID NO: 147025 - RNA, 67 nt, Homo sapiens
acuuaguaauaaaauauaaugauuuucccauuuucauagucauaaaagggccugcuucuucuuuugu

SEQ ID NO: 147026 - RNA, 52 nt, Homo sapiens
auuuauauuuucaaaguccuuucugaaugcccagagaucuuugcuaccucag

SEQ ID NO: 147027 - RNA, 50 nt, Homo sapiens
cuuuugaauauaaauguacacauuuuaauuuuuccuaauuguguauaaag

SEQ ID NO: 147028 - RNA, 47 nt, Homo sapiens
caauagaaccuaaaagucuauaauacauacuuuuugauucccucucu

SEQ ID NO: 147029 - RNA, 62 nt, Homo sapiens
uugguccauaaaacucugccucuuuaagauuaaaugaguucauauauauaaaaagccauuag

SEQ ID NO: 147030 - RNA, 33 nt, Homo sapiens
cuucauauaagcuuuuguuuauuaucuguggag

SEQ ID NO: 147031 - RNA, 44 nt, Homo sapiens
aaacagcauaaguguucauugcacaggaaugguuuuguaaaucc

SEQ ID NO: 147032 - RNA, 47 nt, Homo sapiens
uccucuccccuugcccagagaagaaagccacagccugacccacucca

SEQ ID NO: 147033 - RNA, 30 nt, Homo sapiens
aaaagguugggaaguguuuuuuuuugccua

SEQ ID NO: 147034 - RNA, 397 nt, Homo sapiens
cuucuauuaacaacuuaguggugguauaaucagccugcauuuuuuuuuuuuuuugagacgaagccucgcucuugccccccaggcuggagugcaguggcgugaucucggcucacugcaaccucugccucccagguucaagcgauucuccugccucagccuccugaguagcugggauugcaggcaccugccaccacgccuagcuaauuuuuguauuuuuaguagagaugggguuucaccauguuggccaggcuggucuugaacucuugagcucaggggauccacccgccucagccucccaaagugcugggauuacaggcaugagccacugugcccagccagcacgguauuuuuaacaaacuccuuuaguuccauccaauuuuuacaaguuguguuacua

SEQ ID NO: 147035 - RNA, 73 nt, Homo sapiens
ccuaaaauugagagauucucacccuuguugacuucucacuugaaggauguuacuacuaucauuuauaugucca

SEQ ID NO: 147036 - RNA, 53 nt, Homo sapiens
gcugauggaggccuuggcucuucugaagacuauaauauuaaagugaucucauc

SEQ ID NO: 147037 - RNA, 46 nt, Homo sapiens
cugaucccgugccauuaccaccugccaggccuccaacucgggacaa

SEQ ID NO: 147038 - RNA, 49 nt, Homo sapiens
gucagauguuuaagggcugaaaaaagauuugaauaaauaugauaaugua

SEQ ID NO: 147039 - RNA, 48 nt, Homo sapiens
aauuuaaacaaacucugugagcauuuuaccguuguuuucguuguucag

SEQ ID NO: 147040 - RNA, 49 nt, Homo sapiens
guagagcccagaggaacaucauucacauauaugauuucaagcaguauga

SEQ ID NO: 147041 - RNA, 42 nt, Homo sapiens
cagccagacccccuaaaccacgaccgcgcaggacugcaccag

SEQ ID NO: 147042 - RNA, 238 nt, Homo sapiens
ccuugggcaggaaaaugccaggauacagauguaaucccuucaacuugcccaucacuggauucccuaacaauuucuugacaaaucccuggguucuguuuuguuugggguuuugcugcucuuuucucuguguggguagaaugaguaggugagggaaaaggggaugauccauuccucaugucaaacucuuccuuaccuguaccaccugucggaacccagugcgcaggauuggcaagaaaau

SEQ ID NO: 147043 - RNA, 1181 nt, Homo sapiens
aggagccccggccuguuguguacuggccuggaagagaagaaauaaggaaccaugagagagaaagaacaagaaagagaacaagcaaaagacaacaaacgggccagggaggcgaggccugcgcugggaucauuccacucccuccaccaggccuucuugagaugcccgaggaucuguggggcacuggcaaugucccccuuccccucccacugguucucuucagaacacaacuguggcucacugaaaccuuggcuccugggcucaagccauccuccggccucagccucccaaguaacugagacuauaggcacucacuaccacacccaaccaauuuuuaaaacuuuuuaguagaggccgggcgcaguggcuaacuccucuaaucccagcacuuucggaggccgauaacaaggcgggcagaucacgaggucaggaguucgagaccagccugcccaacacaguaaacccugucucuacuaaaaauacaaaaaguggccaagugugguggcacgcgccuguagucccagcuacucgggaggccgaagcaggagaauugcuugaaccugggaggcagagguugcagugagccaagaccaugccauugcacuccagucugggugacugagacuccgucucaaaaaaaacaaaaaacaaaacaauacccaaacaacaaaaaaaacuuuuuaggccgggugcgguggcucacgccuguaaucccagcacuuugggaggccgaggcgggcggaucacgaggucaggauaucgagaccaucuggcuaacacggugaaaccccgucucuauuaaaaauacaaagaauuagccaggcgugguggcgggcgccuguagucccagcuacucgggaggcugaggcaggagaauggcgugaccccaggagguggagcuugcagugaaccgagauagcgccacugcacuccggccugggcgaaagagcaagccucuaucucaaaaaaaacaaaaacaaaaacaaaacuuuuuaguagacauggaagcggucucaaaauccucgccucaaaugauucuccugccucagccucucagagcauugggauuacaggcgugagcaaacaugcaccccuacuuuuugaauaaacacugugguccugucugucacuauauucaccucccgcaaagcccaacuacuuacugcgaggcgccagucgaucaa

SEQ ID NO: 147044 - RNA, 45 nt, Homo sapiens
ugcugcugugauguagucagccagagacucuggcaccaugggcug

SEQ ID NO: 147045 - RNA, 832 nt, Homo sapiens
ccaccacauccaccauucucagacgugccuaaggggaagguaggggggaaagaugggaacgggaggagggcaguggaacgaggucaggggacacccuuguucuggcuuuaaggcugggcagcccaugggucgccuacucacaaaacaggaguggaauccccccuccccccagcauccgcaguguugggccggcacugucagaccgagacaagugcaaugcccagggcagcguccagcaauugcccaagucuccgccucucaacacuggccagucccggaguucagcuguccugugagggagaccagacccuuuugaacgccacugggcuccccagcaugacagauggagcuuggggagcucagccaagaagacaauuggcagagagaacgugucccgggggcucgggaagugcuagcucagcaguagguuggguaaucacacuaccugcacgaacagcacuuuggagcccccaggacugagguccaagacgggaggacagaaaggaaggucuguagcacaggaucuaggacacauggagugaaacagaccccaaccacccucucagugaagguuaagaaguggggaaaaggccuuucccuccacggacgcugugcgugcccugcuggagcagcaaguacccacagugcgguagcacggagaggaccacuaucugcacugucagcacuuuagccccggcagggcuggagcgggagguggggaggcggcaaugagagcacgguaaggagcuaccccuuuaagggucaaaacagauggcccuccagcaauuugggcacuuaccagagcaguggaaaggcgcaggauagccagcag

SEQ ID NO: 147046 - RNA, 42 nt, Homo sapiens
ugguaguuuuccacuuauccaacucuagcucuucagaagggg

SEQ ID NO: 147047 - RNA, 39 nt, Homo sapiens
uaaguuauuucucuuccuaugaaggguaaauggcaccaa

SEQ ID NO: 147048 - RNA, 27 nt, Homo sapiens
cuuucaaaauguuaucuaaucuagauc

SEQ ID NO: 147049 - RNA, 27 nt, Homo sapiens
gugguuaggaucuagauuagauaacau

SEQ ID NO: 147050 - RNA, 38 nt, Homo sapiens
ucaucuccuguuuuaaaaauucauuuaaaauacaagcu

SEQ ID NO: 147051 - RNA, 46 nt, Homo sapiens
caauuauccugcacaaacuuacacugcccaaacuucucagccuacu

SEQ ID NO: 147052 - RNA, 84 nt, Homo sapiens
ugaagaccccuugaagaaugaagugacaauuuugguuccugugcagaauacauugcuuggaguagggggauauuggcauugcag

SEQ ID NO: 147053 - RNA, 49 nt, Homo sapiens
acaaacauggaaugaauauuaacuguaauaaauuacauauaagggagga

SEQ ID NO: 147054 - RNA, 45 nt, Homo sapiens
cuucugaguaaugaugaaguaacaauaaaguauaaagaugaaggu

SEQ ID NO: 147055 - RNA, 59 nt, Homo sapiens
ugguguucugagacuagauuaaaagugggcaaagguaaaaagcaggcagacugguuagg

SEQ ID NO: 147056 - RNA, 48 nt, Homo sapiens
auaaaauguuauaaauuuuuaaugucugguaguguuaagugcuuugaa

SEQ ID NO: 147057 - RNA, 49 nt, Homo sapiens
gaaagcugcuaguaguaaggcgggaaguugaaacuagaauguggccagu

SEQ ID NO: 147058 - RNA, 73 nt, Homo sapiens
gggaguaggugagugcuuucacauaccccgaaagaauaaagaauaauugcagagaagugugguguuaaugaaa

SEQ ID NO: 147059 - RNA, 49 nt, Homo sapiens
uugaaaggucuuuauuacucuuaggcugccagagcaagcaagauggaau

SEQ ID NO: 147060 - RNA, 43 nt, Homo sapiens
gguuuggggcggccggcgcccaauacccgaaggagcucggaag

SEQ ID NO: 147061 - RNA, 55 nt, Homo sapiens
auguggucugugauauuuugguccagacgaggagaaaugugccaguaucugggaa

SEQ ID NO: 147062 - RNA, 34 nt, Homo sapiens
gcuugguucuaggcuggucuaugugggauccuua

SEQ ID NO: 147063 - RNA, 44 nt, Homo sapiens
cauuuucuguuuggaaacagcuuacugcagagugggucugggca

SEQ ID NO: 147064 - RNA, 48 nt, Homo sapiens
uaaauuaucucuguccucagguccuguguuaauuuaucccugucagug

SEQ ID NO: 147065 - RNA, 36 nt, Homo sapiens
guaccucccaucuagauaauaagcauucaauuagaa

SEQ ID NO: 147066 - RNA, 44 nt, Homo sapiens
gaugcugggaaauuauauaacaccugugcuguguuugggccuga

SEQ ID NO: 147067 - RNA, 42 nt, Homo sapiens
aucagauaacgucacucgcgcuuguagcuucauccgggaggc

SEQ ID NO: 147068 - RNA, 46 nt, Homo sapiens
guucuuaaagacacugucucucucuuucuuuucccuauuugcaaau

SEQ ID NO: 147069 - RNA, 43 nt, Homo sapiens
auuuuauucuaauaucuaauaaaaacaguuugagugguugaag

SEQ ID NO: 147070 - RNA, 45 nt, Homo sapiens
guugaugggagaaauauuuagauguacccuguuaacagccaguca

SEQ ID NO: 147071 - RNA, 47 nt, Homo sapiens
uuaauauaaaagaaaauuauauaaaaagaaauuaagacaaccaagag

SEQ ID NO: 147072 - RNA, 46 nt, Homo sapiens
ugauuccaaaugcaggggaugcaacuaaagccauaaaacagcagau

SEQ ID NO: 147073 - RNA, 46 nt, Homo sapiens
ugucagaugaugauagaaaagagguuguaaacauucagacuuggau

SEQ ID NO: 147074 - RNA, 61 nt, Homo sapiens
aucaguguaaagucaaccgaguuucuugaauuucaccuaccaucauuuuuccugaaaggua

SEQ ID NO: 147075 - RNA, 41 nt, Homo sapiens
auuuuuguuugcccagcuuucccaggcagagacgauguuag

SEQ ID NO: 147076 - RNA, 109 nt, Homo sapiens
uuuuaagagaaggcaaacuaucucagguuuuaguagcugaaaaaaagguuuuugaaaaaagcucuggcuucacuauucaucgcuuuuuaaaguuuacuaauucacagcu

SEQ ID NO: 147077 - RNA, 53 nt, Homo sapiens
ucucccuuccuggaagagaaugaugcugugaauguccaauauccaaugaaaug

SEQ ID NO: 147078 - RNA, 53 nt, Homo sapiens
ucugaugccccagagggguuuccaacccaggaagaugcacuugauaagaguuu

SEQ ID NO: 147079 - RNA, 45 nt, Homo sapiens
auuuuaucuucccugcuaguggccuauucuuuaccaaugcuucuc

SEQ ID NO: 147080 - RNA, 48 nt, Homo sapiens
uauaauuaaaagaguauuaaaagggaauggugauuagugagugcagug

SEQ ID NO: 147081 - RNA, 47 nt, Homo sapiens
ccuucuuuuugagauucuaaucugcucuuuucuguaauuuucuguaa

SEQ ID NO: 147082 - RNA, 42 nt, Homo sapiens
cauccaccaccaucaaagcaaaagacuucagcuuggucagcu

SEQ ID NO: 147083 - RNA, 45 nt, Homo sapiens
ggacauggaguagacuggcugcauuugaaggacagcacagauccc

SEQ ID NO: 147084 - RNA, 44 nt, Homo sapiens
uacauggucuggaguaaccuuuauaugaaguggcugcccaggug

SEQ ID NO: 147085 - RNA, 46 nt, Homo sapiens
uuggcgugccacaguucgguaucacugcaguacucguguaagagug

SEQ ID NO: 147086 - RNA, 42 nt, Homo sapiens
ccggucuggggagacucugaauaucgcaugcuuggcacugau

SEQ ID NO: 147087 - RNA, 40 nt, Homo sapiens
uaauuuaaauguucccugaaagcuguuguucucugcucag

SEQ ID NO: 147088 - RNA, 40 nt, Homo sapiens
uggccgaggauuggccgcggugccuagggggcguggccgg

SEQ ID NO: 147089 - RNA, 35 nt, Homo sapiens
agucuuggauucagaacauguucuuuacaauccau

SEQ ID NO: 147090 - RNA, 48 nt, Homo sapiens
acacguuucuauauagaguaacucaaaauuuagaugcuuagcauuuag

SEQ ID NO: 147091 - RNA, 55 nt, Homo sapiens
agaggauuuauauauagcucacauuccuucauguuauucaguuuuguagauuauc

SEQ ID NO: 147092 - RNA, 47 nt, Homo sapiens
guuuugggggagguagagaugagcagguggaacaugggauuuuuagg

SEQ ID NO: 147093 - RNA, 45 nt, Homo sapiens
uaaacaaaaaacacacuugauuuggaguuuaauuagaguagccua

SEQ ID NO: 147094 - RNA, 56 nt, Homo sapiens
caauaauucauuaucauuuaaauacguuuaauuuucuuucucuuuuuucuagggau

SEQ ID NO: 147095 - RNA, 36 nt, Homo sapiens
ugugaauagauauacuaagaacaaugucaggucuug

SEQ ID NO: 147096 - RNA, 49 nt, Homo sapiens
agaccuaucccaacagcacuguuugugaaugggagauccguguaaagau

SEQ ID NO: 147097 - RNA, 45 nt, Homo sapiens
ucacuuuaauuacuugagaauuuauaauggaauuggagucagcag

SEQ ID NO: 147098 - RNA, 62 nt, Homo sapiens
caaacgaccuaguuucuucaacauauacauagcauuuuaaaaaaauaggaggagggggaagg

SEQ ID NO: 147099 - RNA, 63 nt, Homo sapiens
guggucugggguugcaaaugaaccauucaauugaaucaaaaggcaaugaaaucacauugcugu

SEQ ID NO: 147100 - RNA, 57 nt, Homo sapiens
ucaugaguggaauccauguuucuggacgcggauuuuuggccucauacucuguuauag

SEQ ID NO: 147101 - RNA, 45 nt, Homo sapiens
uaacagcuccuaaaaucuuauuauuuuuugccugucuuuauccca

SEQ ID NO: 147102 - RNA, 41 nt, Homo sapiens
aagugaaaguuucaucucacucuaccaacuauccuuaucuc

SEQ ID NO: 147103 - RNA, 55 nt, Homo sapiens
aacacauuacguuugacaacacagaauagucaucuguuuauuaaaacaaacaaaa

SEQ ID NO: 147104 - RNA, 22 nt, Homo sapiens
guaguagugggaaagccuuaca

SEQ ID NO: 147105 - RNA, 32 nt, Homo sapiens
cuaccacuggaauauaaacucagugaggacag

SEQ ID NO: 147106 - RNA, 46 nt, Homo sapiens
cacguugggcggccaaaucaguguuguaauuaguaaagguaucccc

SEQ ID NO: 147107 - RNA, 42 nt, Homo sapiens
acagcaucaucugugcuggaguggacugaccacacagggcaa

SEQ ID NO: 147108 - RNA, 45 nt, Homo sapiens
cacugaugaauaccagugguuacaaauagauuugaauaaggaaaa

SEQ ID NO: 147109 - RNA, 74 nt, Homo sapiens
cugagacaauacuguucuaaguacucacugcagcaucccauguauuaugagguuucucuguucuaccucuuggc

SEQ ID NO: 147110 - RNA, 47 nt, Homo sapiens
ucacgggcauuuuuaaaccuucaguuuauuuucuuccaacuauaguu

SEQ ID NO: 147111 - RNA, 50 nt, Homo sapiens
agaauugcucuuuaaauauuuagagaaggccacuguguugcaggccuccu

SEQ ID NO: 147112 - RNA, 47 nt, Homo sapiens
aaacuuguuucccuugauaauauauuaauuugauggauagggaacuu

SEQ ID NO: 147113 - RNA, 77 nt, Homo sapiens
aacuaauaucccaagugaccuuaggcagaucauuuucuauaucugggcccagaauuccuuaucucuggagugaaauu

SEQ ID NO: 147114 - RNA, 53 nt, Homo sapiens
auuacuaguuaaucucugcugauuuuucucuuaaauguuuggauuuggcuugu

SEQ ID NO: 147115 - RNA, 45 nt, Homo sapiens
ccucacuacucucauucucauauuagugugugcuuggcacuggag

SEQ ID NO: 147116 - RNA, 46 nt, Homo sapiens
auagaaaagggcagcuagugccccaggguagaucuuggaaaauauu

SEQ ID NO: 147117 - RNA, 46 nt, Homo sapiens
aggaaugaagcaguuucuuccugcaaaagcaguggaccaugaggaa

SEQ ID NO: 147118 - RNA, 50 nt, Homo sapiens
aagcaucguuuuaaagcacauggccuuuuuuuuuuaauuauuagugguag

SEQ ID NO: 147119 - RNA, 42 nt, Homo sapiens
ugcuuuaagguguuaugguggcacaguuacugcucgccuguu

SEQ ID NO: 147120 - RNA, 50 nt, Homo sapiens
uuggugucuugccccauucuuguguuuauaaaauguuugaguauuucuga

SEQ ID NO: 147121 - RNA, 44 nt, Homo sapiens
uugaguaguccuauaugucaccuagggaacagacauuauagcuu

SEQ ID NO: 147122 - RNA, 177 nt, Homo sapiens
uuccaugucaccacuuguucauaccugcccagagcuaguuuuagacauggcaaaauagaaaucaucuguaauuuauuagcuaacaauguaaaaccaucuuuuaaagccuucagacugucaagacgacaugagcagcucaccauaugauaaaaauacauaaauuugacauucccucuu

SEQ ID NO: 147123 - RNA, 46 nt, Homo sapiens
aauuugaauaaagaugaacaguauuuguuuucuuguuuccaugaau

SEQ ID NO: 147124 - RNA, 51 nt, Homo sapiens
ugaaacaaaagacauagaugguagacuuuuauuaaaacauauauggaugug

SEQ ID NO: 147125 - RNA, 53 nt, Homo sapiens
uuuuuauaaaauaucuaguuuuuacuacuuuuauauaaacuuuacuuuccaga

SEQ ID NO: 147126 - RNA, 44 nt, Homo sapiens
uauuuuuuuuuuuuuuuuuuuuacuacauuuauaugucugauac

SEQ ID NO: 147127 - RNA, 47 nt, Homo sapiens
auuggauuaaguuuuuuccuguuaaugcaauuauagaaauacaucgg

SEQ ID NO: 147128 - RNA, 51 nt, Homo sapiens
aauuacacugacuuggcuguuacuugaucuuaggaaacagcacaguuuaag

SEQ ID NO: 147129 - RNA, 86 nt, Homo sapiens
uugguucugaacuugaagucccuaaacugcaaaaucuaagaguugggugguuauuaaaaugcuuuuaaagucaacuguggcaccaa

SEQ ID NO: 147130 - RNA, 48 nt, Homo sapiens
gcacugggaaaaguggaaacaaacauguauugaaauacauauuggaaa

SEQ ID NO: 147131 - RNA, 42 nt, Homo sapiens
ccuuugcagaugcaugcacuucauccucuguaacuucuaaga

SEQ ID NO: 147132 - RNA, 42 nt, Homo sapiens
cuggaagcaaaaaaguaaaacugggugaugcacucagcuagg

SEQ ID NO: 147133 - RNA, 45 nt, Homo sapiens
cucccagaauuccuugaaaaaagucucugucuugaugggcgagau

SEQ ID NO: 147134 - RNA, 43 nt, Homo sapiens
uuuauuuaaaaccuucuucuucccauugacacaccggcagaca

SEQ ID NO: 147135 - RNA, 49 nt, Homo sapiens
cuccaucucuuaccucgacaucaucauaauggggcggcaggcccugaga

SEQ ID NO: 147136 - RNA, 39 nt, Homo sapiens
uauaugcaaaugugucagguugguagaaucuuuggaaug

SEQ ID NO: 147137 - RNA, 51 nt, Homo sapiens
aggaaugaggucuguggcuguccaagcaagaacaguaaggcccgaaguagg

SEQ ID NO: 147138 - RNA, 78 nt, Homo sapiens
auauaaaauaguaggcauuugauucugcaaaggcacuagacuacuugaauuaaacauucuguccagagggauaauacc

SEQ ID NO: 147139 - RNA, 40 nt, Homo sapiens
aaauuuuucuagagccaaagaagcucuuuaaagaaguugu

SEQ ID NO: 147140 - RNA, 45 nt, Homo sapiens
uuucuggagaaacgaggucuuuucuggccacagaccaacuugcag

SEQ ID NO: 147141 - RNA, 45 nt, Homo sapiens
uaugaauucuuagaaauuccaacgcucuccuggucaucaggguaa

SEQ ID NO: 147142 - RNA, 111 nt, Homo sapiens
acugcagggcagagggaagucagcuccacagcccccugcaugcccgccugccgugugccagccugacccccacgcuuaccuggaugagggcacgguugcgaaucugggugu

SEQ ID NO: 147143 - RNA, 33 nt, Homo sapiens
auuacuacuuaacacaugagagaaauguauaau

SEQ ID NO: 147144 - RNA, 32 nt, Homo sapiens
gguucuaguuugguuuagcuuuauuguagcau

SEQ ID NO: 147145 - RNA, 44 nt, Homo sapiens
cuuaagcuagauucagcucccaguuacaaauuagauucuucaag

SEQ ID NO: 147146 - RNA, 45 nt, Homo sapiens
cccugaaaucaaaaggacuguuaaauacuguauucuauuucucag

SEQ ID NO: 147147 - RNA, 43 nt, Homo sapiens
cuagaaaggggcuguaaauugaaguuauaauuaaaucuuggug

SEQ ID NO: 147148 - RNA, 56 nt, Homo sapiens
caaacaauuuauuuauuuauccauuacauuuaaaccucugcuuuggcaagucagag

SEQ ID NO: 147149 - RNA, 31 nt, Homo sapiens
cgauuuggaaauaaguacucuggguuucauu

SEQ ID NO: 147150 - RNA, 46 nt, Homo sapiens
aaaugaaugcaaagaucccucaaauauaaauggagguugcagucaa

SEQ ID NO: 147151 - RNA, 42 nt, Homo sapiens
aacaucccaggagauuuugaaugugaaugccccgaaggcuac

SEQ ID NO: 147152 - RNA, 53 nt, Homo sapiens
cccuggagguuacacuugcuauugugaugggaagaaaggauucaaacuugccc

SEQ ID NO: 147153 - RNA, 46 nt, Homo sapiens
acauacauccaaaaucacaacuggaggugauguuauuaauaauggu

SEQ ID NO: 147154 - RNA, 46 nt, Homo sapiens
aaagucagugcucuuauggagcuugcguucuaauggugagacgcaa

SEQ ID NO: 147155 - RNA, 46 nt, Homo sapiens
gaauuagaacauaguauuagcauuaaaauagcuaaagaagcuguga

SEQ ID NO: 147156 - RNA, 45 nt, Homo sapiens
auggauugcuggaaaccaaaguauacuuugcaggauucccucgga

SEQ ID NO: 147157 - RNA, 43 nt, Homo sapiens
guauacgaagcuggaauuugaugaagcaaggagcuucuggaau

SEQ ID NO: 147158 - RNA, 42 nt, Homo sapiens
uuugcuguguccuugguggacuccaccucugaaaaaucacag

SEQ ID NO: 147159 - RNA, 44 nt, Homo sapiens
ggaauuuagagucaacagaaacaaucuggaguugucgacaccac

SEQ ID NO: 147160 - RNA, 46 nt, Homo sapiens
gaaggcagaagagaugguggucuauuaaauaugaauugaauggagg

SEQ ID NO: 147161 - RNA, 48 nt, Homo sapiens
cacauuuaaaccaguaucuuuauugaauuagaaaacaagugggacaua

SEQ ID NO: 147162 - RNA, 57 nt, Homo sapiens
gaauccaacuuuuaauuaccagaguaaguugccaaaaugugauuguugaaguacaaa

SEQ ID NO: 147163 - RNA, 47 nt, Homo sapiens
guuuguaauguagauauauuuauauagugccucugguauuggagaug

SEQ ID NO: 147164 - RNA, 87 nt, Homo sapiens
aguaugcgauaaauacugugacuacacuauauuuccucauauguaguaggguuuugaggaauacuuuuugacugauuaucuucaaug

SEQ ID NO: 147165 - RNA, 44 nt, Homo sapiens
uuguacauguuacuuuuuccuuugcuauaaucaucuagggagac

SEQ ID NO: 147166 - RNA, 38 nt, Homo sapiens
gcuuaaugcaaauaaaucccacuuuagaucuuacagcu

SEQ ID NO: 147167 - RNA, 42 nt, Homo sapiens
cuggaacauuaccgaaaccaucuguuaaauuugaacaaagug

SEQ ID NO: 147168 - RNA, 45 nt, Homo sapiens
uucuuuggacuucuuaauucucagaauccuuuucuaggaccaccu

SEQ ID NO: 147169 - RNA, 44 nt, Homo sapiens
aaagcaacauuuaggauaguagcuacucugagguggaugcgaau

SEQ ID NO: 147170 - RNA, 66 nt, Homo sapiens
gcacggcuuccagguuuuauccauugaauauuaugggcagcgcuuguugauucaaggauucggaau

SEQ ID NO: 147171 - RNA, 42 nt, Homo sapiens
gggcugccguaaccuacuuggccuacuggacaacgacgagau

SEQ ID NO: 147172 - RNA, 49 nt, Homo sapiens
uucauguuugguuuaauacuguuguauggaugaaaaaccuaaaagggau

SEQ ID NO: 147173 - RNA, 46 nt, Homo sapiens
caauggacacagugaaauagagcaaacaccuuuaguuucaucagau

SEQ ID NO: 147174 - RNA, 46 nt, Homo sapiens
ugacacuguuucaaauauaagcuugauagaccaaaagaugccugac

SEQ ID NO: 147175 - RNA, 46 nt, Homo sapiens
cauccaaccgauuuaaaugugcgacaaacaguaaugaaguggagca

SEQ ID NO: 147176 - RNA, 36 nt, Homo sapiens
uguauuugaauaaacuguauuuuugauaauucucuu

SEQ ID NO: 147177 - RNA, 47 nt, Homo sapiens
cugauauuucuuccucucccaacuuguuuuagucucauauagguaga

SEQ ID NO: 147178 - RNA, 114 nt, Homo sapiens
guguggaucuuggaaagggaguuaaaaaaaaaacuaaaagggagagaguuguugcugaggaggaagaguuggauuacugaagaaguaugaagagucaaauauagggaaggcaag

SEQ ID NO: 147179 - RNA, 80 nt, Homo sapiens
ugugaaaaagacauuucauaccacaaauuuuguugagcagguuauuucuguuagucacaggcuaagggguuagggugggu

SEQ ID NO: 147180 - RNA, 46 nt, Homo sapiens
caguguugcaagcuguccuuaaagcucagccagcaucucaggagau

SEQ ID NO: 147181 - RNA, 41 nt, Homo sapiens
uauuguucuuucuuccuuugucuuuuuaaauagaccaaaau

SEQ ID NO: 147182 - RNA, 30 nt, Homo sapiens
ggauuuagauacguucauggaaguuguagg

SEQ ID NO: 147183 - RNA, 43 nt, Homo sapiens
gggauggcaaacagaauguuuaaggcaccuggauauuaacaga

SEQ ID NO: 147184 - RNA, 64 nt, Homo sapiens
ggaaaacuuuuugcauuauuuguauuuacuuuacagagaaguuaauuauauuuuccauaccaga

SEQ ID NO: 147185 - RNA, 45 nt, Homo sapiens
auaucuauuuuuuaaucaguugaauugggauagaagagcuaagac

SEQ ID NO: 147186 - RNA, 42 nt, Homo sapiens
aggaaacuggguccuacggcuuggacuuuccaacccugacag

SEQ ID NO: 147187 - RNA, 123 nt, Homo sapiens
gaguugaagguggucucguggaugccgcaagauuccauaccuaggggacagagcccucccuuagugaugcugugucaccgaggauguaagaguagaaaccuuuagcucacaacaccuacccag

SEQ ID NO: 147188 - RNA, 46 nt, Homo sapiens
ucagugaggaucuucaugagguagucggucaggucccggccagcca

SEQ ID NO: 147189 - RNA, 46 nt, Homo sapiens
gugaccccgucuccagaguccaugacaaugccaguggugcgcccag

SEQ ID NO: 147190 - RNA, 64 nt, Homo sapiens
uccuccggggccacgcgcagcucguuguagaagguguggugccagaucuucuccaugucguccc

SEQ ID NO: 147191 - RNA, 63 nt, Homo sapiens
aaacaaaaagucuaaagggcaauagagacaagaaugaggaaggcacauagugaggacagugga

SEQ ID NO: 147192 - RNA, 52 nt, Homo sapiens
ccauccacgguuuucuucuugaagagggacgccaugguuaaagacugcgccc

SEQ ID NO: 147193 - RNA, 44 nt, Homo sapiens
cgccaggcaggacccgcggaaggcuuguauccgcagcuaccgca

SEQ ID NO: 147194 - RNA, 41 nt, Homo sapiens
cccacgcucuccuauccccgccagcuccagacucgccccgc

SEQ ID NO: 147195 - RNA, 65 nt, Homo sapiens
caaauguuugagauguucaagacagucucuuaauccguuaaugcuuuuggaaacaauugacaaaa

SEQ ID NO: 147196 - RNA, 76 nt, Homo sapiens
ccauugcugaauucgauaggauguugaaaugcuggucaccaaaaaaggaaacugagcaaauucauuucaacaacau

SEQ ID NO: 147197 - RNA, 54 nt, Homo sapiens
cauauucuuguaaucugcauucuccaggaguuuuauguguuuaauagaugaauu

SEQ ID NO: 147198 - RNA, 46 nt, Homo sapiens
gaaaauuuuacauaguguuuugucuuaggauuagacgugaccagau

SEQ ID NO: 147199 - RNA, 46 nt, Homo sapiens
ccugaccuagcaguaguaacgggaguggcuauccaagcagggauug

SEQ ID NO: 147200 - RNA, 83 nt, Homo sapiens
gaaauggucaaauuaaaucugacucuucaucaaucugcucaguugucaguauuacuaacgguggaggagcaggacaggaagga

SEQ ID NO: 147201 - RNA, 41 nt, Homo sapiens
uacugaauaaacaaggagggauguuucuaacccgagcaaug

SEQ ID NO: 147202 - RNA, 58 nt, Homo sapiens
cuugaucgcauccucucaugaauuuuucuucccuuaaccaaucuuacaggacugaaga

SEQ ID NO: 147203 - RNA, 74 nt, Homo sapiens
uaucccccacccacacacacacccaccccgcgucuccaaggugaugaaaugcuucugaaauguugccuguagcu

SEQ ID NO: 147204 - RNA, 22 nt, Homo sapiens
ggacgccucuaggagggccccg

SEQ ID NO: 147205 - RNA, 42 nt, Homo sapiens
guaccuccaaaagaggcaauuuagaaaguauuaaguagugac

SEQ ID NO: 147206 - RNA, 60 nt, Homo sapiens
auucaguaagauuguuaccagccaguguguuugcacacauuuggguuuguguuuagauga

SEQ ID NO: 147207 - RNA, 72 nt, Homo sapiens
uugccuuaguuuugaugagcuuuaaauuaaaugugugcaauaucaaaauauucaaacuuacaagcuggguaa

SEQ ID NO: 147208 - RNA, 53 nt, Homo sapiens
guugauuuuguuuuucuuugaaguauaacauuacuuuuuggagggaauuuuug

SEQ ID NO: 147209 - RNA, 43 nt, Homo sapiens
cauguuuagaauguacuuaugagguagauccuugcuugaaagu

SEQ ID NO: 147210 - RNA, 82 nt, Homo sapiens
aaagcauugugagguauuuuucuaaacuuuagacucuauagagaaauauaggauuguucuacagaagaaaagcaaaacuccu

SEQ ID NO: 147211 - RNA, 41 nt, Homo sapiens
ccaaauuguauuaucaccaucauugaacuuagugcucaaag

SEQ ID NO: 147212 - RNA, 35 nt, Homo sapiens
aacagauuaacuccuuaguguaaacuacuagagau

SEQ ID NO: 147213 - RNA, 42 nt, Homo sapiens
aacauaaggcaguauuuaacaucuuugucaaauaaagcagau

SEQ ID NO: 147214 - RNA, 46 nt, Homo sapiens
ucuuggugagguagagcaacugaaugcaaagcuccuacagcaaauc

SEQ ID NO: 147215 - RNA, 74 nt, Homo sapiens
accaaacauuugcuugagcuuaaaaagcucccucuccagcucuugcugauacucugaacuagcaucaacagguc

SEQ ID NO: 147216 - RNA, 39 nt, Homo sapiens
gaugauccacaguuguccaugagauucucaagagggaug

SEQ ID NO: 147217 - RNA, 49 nt, Homo sapiens
ccgcaaauggacugagacggcugaccgaaugacagaggagaaccugaag

SEQ ID NO: 147218 - RNA, 41 nt, Homo sapiens
agucugcgaccggacgggucuaggugagacagaagccaaac

SEQ ID NO: 147219 - RNA, 27 nt, Homo sapiens
cuccagccaugacuaaaagagaagcag

SEQ ID NO: 147220 - RNA, 47 nt, Homo sapiens
guagaacaaaccuacgcgccagcugaauguguaagccaggccauaga

SEQ ID NO: 147221 - RNA, 41 nt, Homo sapiens
ggaagcccauugacuuuugaagcugaaguguauuucuagcc

SEQ ID NO: 147222 - RNA, 85 nt, Homo sapiens
uggauccagaacgaaguuuauuugaccaaggaguaaaaacagauggaacuguacagcuuaguguacagguaauuucuuaccaagg

SEQ ID NO: 147223 - RNA, 46 nt, Homo sapiens
aauugaaccaaaguuaaacauccuugaaauuguuaaaccugcggac

SEQ ID NO: 147224 - RNA, 57 nt, Homo sapiens
gucuaaaaaauuucugcucuuaggguguugagaguguaguugaagagagagaagaua

SEQ ID NO: 147225 - RNA, 44 nt, Homo sapiens
caguaacucuuguagaaguaugcuauuggaaucucaaagagauc

SEQ ID NO: 147226 - RNA, 46 nt, Homo sapiens
ccagaauaaucucauauuuuauucuuucauuuggcccacuggagag

SEQ ID NO: 147227 - RNA, 51 nt, Homo sapiens
uucggggagagaauuauguagucucaaccaagaagauuuuuuucagcgggu

SEQ ID NO: 147228 - RNA, 46 nt, Homo sapiens
acggaauuucuuggugauccagccaugguucuucacucugccgggg

SEQ ID NO: 147229 - RNA, 50 nt, Homo sapiens
uguaaggguauuucuaacagacuuucuagaauucacaagucuuacuucuc

SEQ ID NO: 147230 - RNA, 38 nt, Homo sapiens
uugccucucaagacugcuuacuuuguguguagcaagga

SEQ ID NO: 147231 - RNA, 45 nt, Homo sapiens
agucucaaauaguuccucuuugaggaacuuuuauaaaauucugag

SEQ ID NO: 147232 - RNA, 42 nt, Homo sapiens
agcuaaaucagccugaacugguugcacagaaauggggacagc

SEQ ID NO: 147233 - RNA, 42 nt, Homo sapiens
ugucugugacuugaagacucuuauuggauacagugcagcgga

SEQ ID NO: 147234 - RNA, 41 nt, Homo sapiens
cagucacagcaguagcucuggcuacugcuucucugcaaacg

SEQ ID NO: 147235 - RNA, 44 nt, Homo sapiens
acuggucaguauuaauguguagcccuaccaaaaauagccaguag

SEQ ID NO: 147236 - RNA, 55 nt, Homo sapiens
uuacuaaacuaagaguaucagguuauuuauauauuugcaagcaaaggacaguaag

SEQ ID NO: 147237 - RNA, 48 nt, Homo sapiens
cauauuuaaaaugcuuuuggggagacauauauuaaaauuuuagccaag

SEQ ID NO: 147238 - RNA, 41 nt, Homo sapiens
cucaaauuauauguaaaauauuuguuuuacuuagguuacag

SEQ ID NO: 147239 - RNA, 38 nt, Homo sapiens
gcuaugugugguugaucuucagauaaauugacugauca

SEQ ID NO: 147240 - RNA, 46 nt, Homo sapiens
uucuacacuguauuacauaaauaaauuaaauaaaauaaccccgggc

SEQ ID NO: 147241 - RNA, 34 nt, Homo sapiens
agaaaagaaucccuguucauuguaagcacuuuua

SEQ ID NO: 147242 - RNA, 44 nt, Homo sapiens
gaauagauucucuccugauuauuuaucacauagccccuuagcca

SEQ ID NO: 147243 - RNA, 85 nt, Homo sapiens
aauaaugugggaagaaacaaacccguuuuaugauuuacucauuaucgccuuuugacagcugugcuguaacacaaguagaugccug

SEQ ID NO: 147244 - RNA, 42 nt, Homo sapiens
uccaaccuacaaguucuuugagcagaugcagaacuagacccc

SEQ ID NO: 147245 - RNA, 49 nt, Homo sapiens
cgucguccuugcucuuccuuuuuucuugugccaaauaauagcccccuuu

SEQ ID NO: 147246 - RNA, 45 nt, Homo sapiens
gagcagugugaggaaggaaaccaagagaacagcaggcagcagggu

SEQ ID NO: 147247 - RNA, 47 nt, Homo sapiens
aggugcaaucauuggacucauggugggcgguguugucauagcgacag

SEQ ID NO: 147248 - RNA, 45 nt, Homo sapiens
ugcagaauuccgacaugacucaggauaugaaguucaucaucaaaa

SEQ ID NO: 147249 - RNA, 20 nt, Homo sapiens
aguuaaagaaugagaaaggg

SEQ ID NO: 147250 - RNA, 48 nt, Homo sapiens
ccaaauaacacauacuuuuccauauuuauuuucuucuuuauccucaua

SEQ ID NO: 147251 - RNA, 41 nt, Homo sapiens
caaaagugaaguuuuuaggauuaauaauggucauaggguaa

SEQ ID NO: 147252 - RNA, 44 nt, Homo sapiens
caaaaggaaauccuuugagaauuuuagauauuuucaguaguugg

SEQ ID NO: 147253 - RNA, 45 nt, Homo sapiens
gaucuccagccguggcauucuuuuggggcugacucugugccagcc

SEQ ID NO: 147254 - RNA, 45 nt, Homo sapiens
cacagagucagccccaaaagaaugccacggcuggagaucguccag

SEQ ID NO: 147255 - RNA, 46 nt, Homo sapiens
acuauucagaugacgucuuggccaacaugauuagugaaccaaggau

SEQ ID NO: 147256 - RNA, 69 nt, Homo sapiens
cuuucugguucagaaaugugacccugaugauaagaaacuucaaggcaugacucugguguuuuggcaaua

SEQ ID NO: 147257 - RNA, 45 nt, Homo sapiens
accacacuguuuugauuauuguagcuuuguaguaaauuuugaaau

SEQ ID NO: 147258 - RNA, 41 nt, Homo sapiens
uauuuggcacuauacuacugaaaacauuagccacuaauuag

SEQ ID NO: 147259 - RNA, 45 nt, Homo sapiens
gcucuacaacgugccugcaguggccgaggagauucaggaugaagu

SEQ ID NO: 147260 - RNA, 50 nt, Homo sapiens
uucaauaugcuaaagaaguauguccgcgcagaacagaaggacagacagca

SEQ ID NO: 147261 - RNA, 15 nt, Homo sapiens
auaugccugcagguu

SEQ ID NO: 147262 - RNA, 43 nt, Homo sapiens
gccaacgagagacagcagcugguggagacacacauggccagag

SEQ ID NO: 147263 - RNA, 31 nt, Homo sapiens
auaggucaugagagaaugggaagaggcagaa

SEQ ID NO: 147264 - RNA, 103 nt, Homo sapiens
accccugaugccguugacaaguaucucgagacaccuggggaugagaaugaacaugcccauuuccagaaagccaaagagaggcuugaggccaagcaccgagaga

SEQ ID NO: 147265 - RNA, 66 nt, Homo sapiens
gaugugacugaagggaagugugccccauucuuuuacggcggauguggcggcaaccggaacaacuuu

SEQ ID NO: 147266 - RNA, 59 nt, Homo sapiens
ugugcucugaacaagccgagacggggccgugccgagcaaugaucucccgcugguacuuu

SEQ ID NO: 147267 - RNA, 23 nt, Homo sapiens
uagguaccagacauggcauuggu

SEQ ID NO: 147268 - RNA, 107 nt, Homo sapiens
cuucacagugaagacaaaguaguagaaguagcagaggaggaagaaguggcugagguggaagaagaagaagccgaugaugacgaggacgaugaggauggugaugaggu

SEQ ID NO: 147269 - RNA, 41 nt, Homo sapiens
uuagacuucauaaggcuagauuuuguuucuacuuaaauaau

SEQ ID NO: 147270 - RNA, 42 nt, Homo sapiens
ggcuuuuaguccauuauccucuuuuucccugccugccuuucu

SEQ ID NO: 147271 - RNA, 71 nt, Homo sapiens
auucugcugaugcggaggaggaugacucggaugucugguggggcggagcagacacagacuaugcagauggg

SEQ ID NO: 147272 - RNA, 45 nt, Homo sapiens
aaacauccauccucuccugguguaagaauuugcacuugucaggaa

SEQ ID NO: 147273 - RNA, 47 nt, Homo sapiens
agaauacaaugagguuucuauuuugccauuaguccugagagcuuauu

SEQ ID NO: 147274 - RNA, 45 nt, Homo sapiens
uugcuagcuaauuuaagucuaguuuuauugucaaauugaccacau

SEQ ID NO: 147275 - RNA, 23 nt, Homo sapiens
uuccuguacuuagcaugcuucuu

SEQ ID NO: 147276 - RNA, 44 nt, Homo sapiens
ggucacuugugacauguuaagcaaauuucucaguucugguugug

SEQ ID NO: 147277 - RNA, 47 nt, Homo sapiens
auugauucuuuuugugugcucucccaggucuacccugaacugcagau

SEQ ID NO: 147278 - RNA, 36 nt, Homo sapiens
ugaggguucacucuuggcgguauacauuuuuugggu

SEQ ID NO: 147279 - RNA, 45 nt, Homo sapiens
ucauuauuaaaagaauuuuuguugagaauaguuuaagaugugaua

SEQ ID NO: 147280 - RNA, 24 nt, Homo sapiens
aauaaacuauuauaguaccaaaau

SEQ ID NO: 147281 - RNA, 57 nt, Homo sapiens
uuacaguggauuuuauccaacacuuagcucugaccuagagcacgcuagucgucguua

SEQ ID NO: 147282 - RNA, 54 nt, Homo sapiens
agugcaucaugcauuaggauuuuaaguggcuuuuuggggaguauugagcaggug

SEQ ID NO: 147283 - RNA, 34 nt, Homo sapiens
uuucuccugcuaagauggguguccucaaggagac

SEQ ID NO: 147284 - RNA, 45 nt, Homo sapiens
cugaacaugcacaugaauguccagaaugggaagugggauucagau

SEQ ID NO: 147285 - RNA, 50 nt, Homo sapiens
aaacuaugccuuuguacaaauuguuuaucauuugcagaggucuaaaaaau

SEQ ID NO: 147286 - RNA, 41 nt, Homo sapiens
ugguuucucagcggagaaugacauucuaguuucuacagauc

SEQ ID NO: 147287 - RNA, 43 nt, Homo sapiens
accauauaugaaaccagguacuaacuugguauucugcauagcu

SEQ ID NO: 147288 - RNA, 35 nt, Homo sapiens
agggugcagauaaaaggaucgaauugagugaagau

SEQ ID NO: 147289 - RNA, 41 nt, Homo sapiens
ccuggcagcucuggggacucugguuuaguuccccugggggc

SEQ ID NO: 147290 - RNA, 21 nt, Homo sapiens
gagagugggaugugcgucugg

SEQ ID NO: 147291 - RNA, 45 nt, Homo sapiens
auguccgcgucucccuuuuguguaacuugcgagaaaugggagggg

SEQ ID NO: 147292 - RNA, 48 nt, Homo sapiens
gucucaugaaaaucaguacaaucacacaaggaggaugaaacgccggaa

SEQ ID NO: 147293 - RNA, 46 nt, Homo sapiens
gugaagcauuagaugcugguaaaagcuagaggagacacaaugagcu

SEQ ID NO: 147294 - RNA, 39 nt, Homo sapiens
aaaguaggagaaaagugagauuuuacuaagaccuguuuu

SEQ ID NO: 147295 - RNA, 111 nt, Homo sapiens
guuacaucuauuacaaguuuagaaaaaacaaagcaauugucaaaaaaaguuagaacuauuacaaccccuguuuccugguacuuaucaaauacuuaguaucauggggguugg

SEQ ID NO: 147296 - RNA, 53 nt, Homo sapiens
ggagggauccagcguaucuugccaguaaccagugagguguaucaguaaggugg

SEQ ID NO: 147297 - RNA, 64 nt, Homo sapiens
agacuuuugcacaauggcagaaugcaguuaagugguuuaagugguguuagcuuugagggcaagg

SEQ ID NO: 147298 - RNA, 53 nt, Homo sapiens
gcccccaguggcagcugggggaguggucaucauguucuaagaccugugggaag

SEQ ID NO: 147299 - RNA, 57 nt, Homo sapiens
guggggcgaauguucuaagucaugugaauuggguuggcagagaagacugguagaaug

SEQ ID NO: 147300 - RNA, 45 nt, Homo sapiens
aauuccaacuggagccaccaacaucgaagugaaacagcggaacca

SEQ ID NO: 147301 - RNA, 45 nt, Homo sapiens
gauaauguuaucauauuauucucuuuccaggaaaaaccuuuagag

SEQ ID NO: 147302 - RNA, 54 nt, Homo sapiens
aggaguccaguacacgaugagggaaugugacaacccagucccaaagaauggagg

SEQ ID NO: 147303 - RNA, 42 nt, Homo sapiens
ccuuuucauggaagcuggggaaugugggggccuuggggagac

SEQ ID NO: 147304 - RNA, 63 nt, Homo sapiens
acgacgagccccggccgacugggaaagcggagaccgaagacgaggacgaagggacugagggcg

SEQ ID NO: 147305 - RNA, 45 nt, Homo sapiens
agccucugcgagggcgugcgcggcgccuucuaccugcugggggag

SEQ ID NO: 147306 - RNA, 42 nt, Homo sapiens
ccccuccgaggaggacgaggagcuaguggugccggagcugga

SEQ ID NO: 147307 - RNA, 45 nt, Homo sapiens
aggugaaggcuguauuuguaguaguacucaagaaucaccugaugu

SEQ ID NO: 147308 - RNA, 58 nt, Homo sapiens
gcaaaaccagcuggugggcccaagccuccaagugggaagaaagacugggaugaugacc

SEQ ID NO: 147309 - RNA, 42 nt, Homo sapiens
ucaaaccuuuuagccuuagaacccauuuguacaaauaauuua

SEQ ID NO: 147310 - RNA, 48 nt, Homo sapiens
uacuuaccugggaaaauauugggcuaucaaacucgcuacuaaugcugc

SEQ ID NO: 147311 - RNA, 48 nt, Homo sapiens
aaggccaaugaaguaaucucuaaacuuuaugcaguacaucaagaagga

SEQ ID NO: 147312 - RNA, 52 nt, Homo sapiens
auuaagaaguuugcugaggcauuugaagcuauuccccgcgcacuggcagaaa

SEQ ID NO: 147313 - RNA, 46 nt, Homo sapiens
cggagguggagcaacagaaauugaauuagccaaacagaucacauca

SEQ ID NO: 147314 - RNA, 46 nt, Homo sapiens
agggcaguagacgaugguguuaauacuuucaaaguucuuacaaggg

SEQ ID NO: 147315 - RNA, 45 nt, Homo sapiens
ucagauugucuguagagccucgaaguacuaugguagaaauggcgc

SEQ ID NO: 147316 - RNA, 47 nt, Homo sapiens
ugaagaaaugggacacugugacaguguuuaccucucagaaguuggag

SEQ ID NO: 147317 - RNA, 44 nt, Homo sapiens
gguaaacacugucacagugucccauuucuucaaggacaggaggu

SEQ ID NO: 147318 - RNA, 123 nt, Homo sapiens
cuaaacgaaauagaccaugaagacuguuaauaaagggaaaguaaagguacuaggucaaauagcagaaggauuuaguuuggggaggggucaggaaacaccucugagaaaacauaaauuuaagcu

SEQ ID NO: 147319 - RNA, 45 nt, Homo sapiens
gucaaagcuauugcugauacuggugcaaaugucguaguaacaggu

SEQ ID NO: 147320 - RNA, 46 nt, Homo sapiens
aguguugauaaagacugcugaagaauugaugaauuuuaguaaggga

SEQ ID NO: 147321 - RNA, 39 nt, Homo sapiens
agucaauaguggcugacuucaucucuagaauucuugaaa

SEQ ID NO: 147322 - RNA, 92 nt, Homo sapiens
uagggcucugguaucaguuccucuucaguauugcauggcaugguuuuuaagaaggaaaccgaaggugauguaacaucugucaaagaugcaaa

SEQ ID NO: 147323 - RNA, 45 nt, Homo sapiens
gcugaagaacuucugaggauuggccugucaguuucagaggcaagu

SEQ ID NO: 147324 - RNA, 45 nt, Homo sapiens
cauccugcugcaaaaaugauuguaauggcuucucauaugcaagag

SEQ ID NO: 147325 - RNA, 46 nt, Homo sapiens
uaucaaccacuuggagaaguuguuugugacaaacgaugcagcaacu

SEQ ID NO: 147326 - RNA, 64 nt, Homo sapiens
cauaguuuuaaaaaauaucuuacugcacuauugauaaauuugucucuugugcuauucaaauugc

SEQ ID NO: 147327 - RNA, 38 nt, Homo sapiens
aggauaagugauagaggggugcagauaacacuuuuguu

SEQ ID NO: 147328 - RNA, 55 nt, Homo sapiens
gaaacaaaacccaagaaaguuacauuuuagauuaagccagcuaacauaaguuggg

SEQ ID NO: 147329 - RNA, 66 nt, Homo sapiens
cccggccgcugagccagggcagcacgcucagcccguuaguaggcccuccuacuucgccgcggccgc

SEQ ID NO: 147330 - RNA, 152 nt, Homo sapiens
ccgggcgggccgcgggcgaggggccgggcuggcgcccgagggcagggagggggguggggcagggaccccgcggcccccagcccccgcccgccccggguaaaguacggcgcgcgcggguaaacaacagcuccggcagugcaggggguucggcc

SEQ ID NO: 147331 - RNA, 97 nt, Homo sapiens
ggaguccugggcucuccgguccccaaaaccagucuucgcuaaauccagcucagcacgguggccuucucuccccagccacaaacucggcuuuucuuac

SEQ ID NO: 147332 - RNA, 46 nt, Homo sapiens
auuccgcacaauucuacucaaugacaugaaacugccguguaagaau

SEQ ID NO: 147333 - RNA, 52 nt, Homo sapiens
caagaaaaagaaauagaaaaaaaguguuuagagcuggaguugcagaggugau

SEQ ID NO: 147334 - RNA, 46 nt, Homo sapiens
uuggucauauguguguaaaagagacaaagaauaaaguccaugaggg

SEQ ID NO: 147335 - RNA, 46 nt, Homo sapiens
cugcaaaugucacuccagaagccuuuugcuagguguucugccacuu

SEQ ID NO: 147336 - RNA, 55 nt, Homo sapiens
aggcaaaaucauuucuuugucucuuguagaaaucaaggagaaaucaugguugacu

SEQ ID NO: 147337 - RNA, 75 nt, Homo sapiens
aacuaaaauauuagaaaaaagucaaauuauuaaacuucugcaggccacuucuuuuaguaggaacuaucuguagau

SEQ ID NO: 147338 - RNA, 66 nt, Homo sapiens
uuuuuuucacaaugcagcucuacaaaaauauucccaguagcugacacccugcuucuaagaauagaa

SEQ ID NO: 147339 - RNA, 42 nt, Homo sapiens
agcagacccccuccaaugaagaggacagcagcgcuugcccag

SEQ ID NO: 147340 - RNA, 44 nt, Homo sapiens
aagaugcucaagauguagaacguggaagccuuuugagucuagag

SEQ ID NO: 147341 - RNA, 45 nt, Homo sapiens
cugccguagugacucauggugucaggaguggugaguugguuuguu

SEQ ID NO: 147342 - RNA, 46 nt, Homo sapiens
ccugggaaguagcuuccacagcagaaguaacgagucaugguggcag

SEQ ID NO: 147343 - RNA, 45 nt, Homo sapiens
agggcagugaguuugcagacagugggauugaaggggccacuaccg

SEQ ID NO: 147344 - RNA, 57 nt, Homo sapiens
auguuugaccagucacagauucaggaguucaaagaggccuucaacaugauugaucag

SEQ ID NO: 147345 - RNA, 48 nt, Homo sapiens
uuucaauuacaucgaguucacacgcauccugaaacauggagccaaaga

SEQ ID NO: 147346 - RNA, 44 nt, Homo sapiens
uugaaaaagaucgcgaauaaaaaucaacaaaugugaaagcccag

SEQ ID NO: 147347 - RNA, 46 nt, Homo sapiens
ugccuucgcuggauggaaaugacagcguccggacgucggcauucgg

SEQ ID NO: 147348 - RNA, 41 nt, Homo sapiens
aaaagagagccugucuacuugguguuuugcaagaaccagau

SEQ ID NO: 147349 - RNA, 37 nt, Homo sapiens
cuuuuuaaaaugaggagguacuuuaugaaucaaaaug

SEQ ID NO: 147350 - RNA, 42 nt, Homo sapiens
gaaggacuuacagccuguauuuccaauuuaaaguauugggac

SEQ ID NO: 147351 - RNA, 76 nt, Homo sapiens
ucugguuuuuaaauaauacucagcagcaagaccuuugguuugauggggagaauauaucuagggcaauguccuuaua

SEQ ID NO: 147352 - RNA, 45 nt, Homo sapiens
gaaguuagaugguugugaacccuugccaggcgaggggcagguaag

SEQ ID NO: 147353 - RNA, 44 nt, Homo sapiens
gcuaaaaucuagggcauugcuaguugaaggcauuugguaugggg

SEQ ID NO: 147354 - RNA, 39 nt, Homo sapiens
agagagagagagagaguguguguguguguguguguguac

SEQ ID NO: 147355 - RNA, 17 nt, Homo sapiens
ccgcgaugccucucugg

SEQ ID NO: 147356 - RNA, 48 nt, Homo sapiens
uaugguucauuggcaguucucuuggagagagaaagagggaggcuacgu

SEQ ID NO: 147357 - RNA, 48 nt, Homo sapiens
gauuaaugucaggccagcucugcuuggaaugaguuugagaaguuugag

SEQ ID NO: 147358 - RNA, 72 nt, Homo sapiens
uagaaccaggucuuaguuacugaaacacacacacacacacacacacacacacacacaaacucuacugugcuc

SEQ ID NO: 147359 - RNA, 45 nt, Homo sapiens
cuucucauuuuggagauuggauacaucaauacuugauguguuuca

SEQ ID NO: 147360 - RNA, 60 nt, Homo sapiens
acuuguaccucuguguauggcauauugcauauaaugcauauugagugcguugugaaacag

SEQ ID NO: 147361 - RNA, 67 nt, Homo sapiens
uccuucuguucuucccucccucccaccguaccucuuaugacaaguugauuguaggggcaauggccca

SEQ ID NO: 147362 - RNA, 31 nt, Homo sapiens
auagaacuuagacuuccaagguggagagagc

SEQ ID NO: 147363 - RNA, 38 nt, Homo sapiens
ggaggcaucaguuacagcaaaaguuuuguguuuaauug

SEQ ID NO: 147364 - RNA, 56 nt, Homo sapiens
ucuguggaggcccaggggagagacugccuucucccaucugccuucucccaucccac

SEQ ID NO: 147365 - RNA, 45 nt, Homo sapiens
uaagaugugauuuaaucaggagguuuuuuuucccuuucaaaaaaa

SEQ ID NO: 147366 - RNA, 41 nt, Homo sapiens
ggcccccaggacccuccgcuagugaagccauaauuaacaau

SEQ ID NO: 147367 - RNA, 53 nt, Homo sapiens
aacauagaguaaaggaaggaaggaaaggaaaagaaacaaccauuuugaaaucc

SEQ ID NO: 147368 - RNA, 46 nt, Homo sapiens
ucguagagcaguggucugcacauuugaguauuauacacuguguuuu

SEQ ID NO: 147369 - RNA, 41 nt, Homo sapiens
cuucuuaccgaucuccaagaauuuuucgaagcaagaguguu

SEQ ID NO: 147370 - RNA, 46 nt, Homo sapiens
cucaucaggaaaucucaucaaaaugauauuagauuuacacaucagg

SEQ ID NO: 147371 - RNA, 41 nt, Homo sapiens
auuuuucuuuugagaaaguuaggaaaauaaaggucucguau

SEQ ID NO: 147372 - RNA, 38 nt, Homo sapiens
ucaggugaugaauacuguucaaaacuuaguuauucaaa

SEQ ID NO: 147373 - RNA, 41 nt, Homo sapiens
uccugaggauguuagaaagaacagcuucgugaagugccaaa

SEQ ID NO: 147374 - RNA, 97 nt, Homo sapiens
aggggaagggaagucagugagcaucugccucuccgucagugacacugcagugaagggagagaacaugaccucgauagaaggaugcucaaggccaggc

SEQ ID NO: 147375 - RNA, 52 nt, Homo sapiens
cccuuccucaagacaggcuguggggcucggggaagaugaggauggagacaag

SEQ ID NO: 147376 - RNA, 45 nt, Homo sapiens
uggcuuucaggcuuaaagccagagagccaggugguggggacccag

SEQ ID NO: 147377 - RNA, 47 nt, Homo sapiens
agugggcccugaucagagucucagaaaauggauaggucugggauaag

SEQ ID NO: 147378 - RNA, 59 nt, Homo sapiens
uuuuauuaaagucuuuugaaaaauaauguuaauuuauaggaaaaugucaaauccagcua

SEQ ID NO: 147379 - RNA, 27 nt, Homo sapiens
aaaaaauauaguucagaaucagaucca

SEQ ID NO: 147380 - RNA, 35 nt, Homo sapiens
guuggcuccaggggcagccaauuccuaucauucag

SEQ ID NO: 147381 - RNA, 356 nt, Homo sapiens
gacuggguuccagaacuuaccauugaaaacagagcuuuuaggccaggugugguggcucacaccuguaaucccagcacuuugggaggccgaggcagguggaucgcuugagcucaggaguucgagagcagccugggcaacauggugaaagcccgucucuaccgaaaaauacaaaaaaaaauagcuggguguggugguacgugccuguagucccagcuacuucggggacugaggugggaggaucacuugaaccuaggaggucgaggcugcagugagccaagaucaugcuacugcacuccagcuuagguggcaaagugagacccugucuccaaaaaaagaaaauagagcuuuauaagcag

SEQ ID NO: 147382 - RNA, 46 nt, Homo sapiens
cgcaaaacaaucauccuuugaauacguggcugcucacccugcccca

SEQ ID NO: 147383 - RNA, 43 nt, Homo sapiens
uaaagaagugauuguuucucaaaaucgcauuuuaaagacguuu

SEQ ID NO: 147384 - RNA, 46 nt, Homo sapiens
uuaaucuugaaagcagaguugaaauagaaaagucucuaacacaggu

SEQ ID NO: 147385 - RNA, 78 nt, Homo sapiens
uaacaagccaguaauuuuuuuuuuuuuugcuuugaccuccuucuuuauuugguauuggaaaagucagacacucuaaau

SEQ ID NO: 147386 - RNA, 45 nt, Homo sapiens
gagcaaacugagugggaagcgcugcccuauauaauuguugcugca

SEQ ID NO: 147387 - RNA, 46 nt, Homo sapiens
gaaaggaauauguuaguucuugagugguuguggucaccuuuagaua

SEQ ID NO: 147388 - RNA, 119 nt, Homo sapiens
gggcgagcauguggagcuccaugagcgaagacgcgucgguggccgacauggagagggcgcagcuggaggaggaggcggcggcugcggaggagaggccgcugguguuccugugcuccggc

SEQ ID NO: 147389 - RNA, 41 nt, Homo sapiens
gggcaaaugcagcgacuccucgcuguugggcaagagacucu

SEQ ID NO: 147390 - RNA, 56 nt, Homo sapiens
aaguuaaccaggaccacugacuccaaagcuuuugcuuuuugcuaguggcuguaagc

SEQ ID NO: 147391 - RNA, 24 nt, Homo sapiens
agcugaugcuguacuaucacagaa

SEQ ID NO: 147392 - RNA, 42 nt, Homo sapiens
cuacguggggaagaaugaaaaaaccaaaauuaucgccaagau

SEQ ID NO: 147393 - RNA, 46 nt, Homo sapiens
gcagggcucaacgucauuaaagaggcagaggcgcagcugugguggg

SEQ ID NO: 147394 - RNA, 46 nt, Homo sapiens
agauggugaaagaugccuuggaccagcuucgaggcgcggugaugau

SEQ ID NO: 147395 - RNA, 56 nt, Homo sapiens
gcucucacaguuuauuauauacagcgaaaaaacacauaacacaccuuugcccacau

SEQ ID NO: 147396 - RNA, 68 nt, Homo sapiens
cucgcgcgcagccuuggggaggaggggggccgucguggaggaggaggaaguggaggagguggaggagg

SEQ ID NO: 147397 - RNA, 58 nt, Homo sapiens
cccagacgcagggagcaggggcgcggagaagcugagcgaagggaggccgggccgaggu

SEQ ID NO: 147398 - RNA, 44 nt, Homo sapiens
ugucucauaaaucacaugccccuguuuucaaaaauacguaauca

SEQ ID NO: 147399 - RNA, 42 nt, Homo sapiens
aaguacgccuucuccccuaggaauucucuuccacagcaccug

SEQ ID NO: 147400 - RNA, 44 nt, Homo sapiens
uuuuccagccaggaguucugugaaaaaaucuuuguaaacccaga

SEQ ID NO: 147401 - RNA, 57 nt, Homo sapiens
uugucggaugagaaugauguuuuugacaagcuaagugucauugcagaagacucugag

SEQ ID NO: 147402 - RNA, 85 nt, Homo sapiens
gcucugagaaggaaacacacucggcugggcacagugacguacuccaucucacaucugccucagugagggaucagggcagcaaaca

SEQ ID NO: 147403 - RNA, 40 nt, Homo sapiens
cuagaacucccagacccuggacuuagccaccagagagcua

SEQ ID NO: 147404 - RNA, 42 nt, Homo sapiens
cuacacagagcacggacuuuuggauucuuugcaguacuuuga

SEQ ID NO: 147405 - RNA, 55 nt, Homo sapiens
auaaauucuaacaaauggaugagaaccaaguuaagaauucuagagugggauaagg

SEQ ID NO: 147406 - RNA, 56 nt, Homo sapiens
acauuuggacaccagguggcaaugggaagaaagcugaauaaguagaaugggacaag

SEQ ID NO: 147407 - RNA, 46 nt, Homo sapiens
ccauuuguauaaauggaaacaaauaccugacugugaaaaugucaaa

SEQ ID NO: 147408 - RNA, 37 nt, Homo sapiens
aguuauaauuaugauuuggguaaauaaagcuugaaug

SEQ ID NO: 147409 - RNA, 46 nt, Homo sapiens
cauugaagaaucuucugcuuucaacuucugaggaacaaaucgaaaa

SEQ ID NO: 147410 - RNA, 45 nt, Homo sapiens
augcuucccuaggaaaaaggucgcuggcuuuggugcaagaggaag

SEQ ID NO: 147411 - RNA, 26 nt, Homo sapiens
gggaauucugguggccucuagggcag

SEQ ID NO: 147412 - RNA, 44 nt, Homo sapiens
cagucucaucacaagaggaugcagaaguuugacuuucauccuga

SEQ ID NO: 147413 - RNA, 47 nt, Homo sapiens
cucuagagaggggaugaucaucgcgauucgaaaucccggcgauacuc

SEQ ID NO: 147414 - RNA, 30 nt, Homo sapiens
cggcugcgaaggugguuaucauggcaaggg

SEQ ID NO: 147415 - RNA, 46 nt, Homo sapiens
cgaaaucucacuuugacucacaggaggcucaggcugcgauacagac

SEQ ID NO: 147416 - RNA, 42 nt, Homo sapiens
cagcuauggcuguccuggagucuucggcugugaccguccugg

SEQ ID NO: 147417 - RNA, 53 nt, Homo sapiens
aagugaacagaacccaaaucagaaacuuuuugauagcaguacuuuucucccca

SEQ ID NO: 147418 - RNA, 42 nt, Homo sapiens
gauucaacaagugaagcaaguuaugccaucaccaguuaagag

SEQ ID NO: 147419 - RNA, 63 nt, Homo sapiens
cacuuuuuugagagagagagagugugugugugcgucuauuuauuugaaauuuaguacucagcc

SEQ ID NO: 147420 - RNA, 54 nt, Homo sapiens
ccuuuugcuuucauaucugcacuuuuaccuggcaauaauguuaaaauguguaga

SEQ ID NO: 147421 - RNA, 62 nt, Homo sapiens
uuucauuuuaagaaggcauuguaucagaauccauacuuaaagaaaaaccuugaguuagcuaa

SEQ ID NO: 147422 - RNA, 85 nt, Homo sapiens
uccaugucagauaagcauuuuacaaaaaugaauuuucuugugugagauaacuaggaaauaauaauaauguuaaaagaaggacaaa

SEQ ID NO: 147423 - RNA, 42 nt, Homo sapiens
cauccaggcgccaaaccccgggcugaucacaucccugcugcg

SEQ ID NO: 147424 - RNA, 46 nt, Homo sapiens
uagcuuuccugaaugaugaaguuuggaauuugucaaauguacaaca

SEQ ID NO: 147425 - RNA, 49 nt, Homo sapiens
agaaaagacacacacacaccccuaccacuucaccaccaggauucuagau

SEQ ID NO: 147426 - RNA, 46 nt, Homo sapiens
aucagaaaccauaaagcguuaccauuacaccaaagggguguaauua

SEQ ID NO: 147427 - RNA, 45 nt, Homo sapiens
ucauagaggagccaaagugauuucaacagcaugcagccuugaaga

SEQ ID NO: 147428 - RNA, 46 nt, Homo sapiens
aaaggucacauggacggaagcagcaggaagcauucgggauggagug

SEQ ID NO: 147429 - RNA, 94 nt, Homo sapiens
ugacagagccagucaaaggggccauuuccagauucagguuuccagcuuacuucaccgcuucaugucagcuuccuugucuguuaaauagaaauaa

SEQ ID NO: 147430 - RNA, 30 nt, Homo sapiens
aaaaaaaauuauccuucgaauauugcagaa

SEQ ID NO: 147431 - RNA, 52 nt, Homo sapiens
ucaaaaaggcaauucuaguaacuccagacugaguaggaacagaguuguuuuu

SEQ ID NO: 147432 - RNA, 33 nt, Homo sapiens
acuuuuuugguauaguaaaauuuauaguagaac

SEQ ID NO: 147433 - RNA, 30 nt, Homo sapiens
caaaguucucguucugcuuuugcuaaaaau

SEQ ID NO: 147434 - RNA, 57 nt, Homo sapiens
guagguggaaaagaaagucaguuaaauggauuggaggggagcgaguaacuguugugu

SEQ ID NO: 147435 - RNA, 48 nt, Homo sapiens
uuccgagaccgguugccauggcguucuggacagccucgcgaguccgac

SEQ ID NO: 147436 - RNA, 46 nt, Homo sapiens
cuggagaaggaucagauggaacaaauagagggaagaaagaauaauu

SEQ ID NO: 147437 - RNA, 45 nt, Homo sapiens
cuccugccuggguugaugaaggaagcuucauugcagaaguggcac

SEQ ID NO: 147438 - RNA, 45 nt, Homo sapiens
cuagucuaaagcgaguagccucuccagcagccaagccggucguuu

SEQ ID NO: 147439 - RNA, 67 nt, Homo sapiens
ugagcuccacagagaggugggcuguguccugacaaggcgauugagagacuggugggaaguggauggg

SEQ ID NO: 147440 - RNA, 48 nt, Homo sapiens
acccuagugggaggcuucaguguucacuuuguuuuacaggcaguggag

SEQ ID NO: 147441 - RNA, 46 nt, Homo sapiens
ggcagagaauuaauguuuuugcugccaagauauacagcagcagggg

SEQ ID NO: 147442 - RNA, 26 nt, Homo sapiens
ucuccgccuccgcucccccugggcac

SEQ ID NO: 147443 - RNA, 43 nt, Homo sapiens
aaguacugcuugguuaguuggaagaaaaauaauuucauuggaa

SEQ ID NO: 147444 - RNA, 47 nt, Homo sapiens
uugaacuuugaagagcuguuaauuuugugaaagaauuaguuuuauuu

SEQ ID NO: 147445 - RNA, 345 nt, Homo sapiens
gugcuuauuagggagguuagguuaacauuuugccaggcgugguggcucacaucuguaaucccagcacuuugggaggcugaggcaggcagaucacuugagcucaugaguuugagaccagccuggccaacaugacaacauccugucucuacuaaaaguacaaaaguuagccaggcgcgguggugugcccuguagucccagcuacucuagaggcuuaggcaggaggauugcuugagcccgggaggcugaggcugcagagagccaugaucaugccccugcacuccagcuugggcgauagagugagaccuugucucaaaaaacuaacaaaaaacaaaaaccacuuucuuc

SEQ ID NO: 147446 - RNA, 57 nt, Homo sapiens
gggcucucagggcgcgccccuagccccuacuaagcggggacaggccgugcagacggc

SEQ ID NO: 147447 - RNA, 129 nt, Homo sapiens
cgaagcauuuuagguggagcuagcaagguguuauugucagauggcaacguuaacauccuuucccaaugcagugugcauuuuaaauggcuccuggccccuauucagcgcucaauaacccuuugcugcugu

SEQ ID NO: 147448 - RNA, 31 nt, Homo sapiens
ggacagggaugccucuguggaauugugaagg

SEQ ID NO: 147449 - RNA, 354 nt, Homo sapiens
acugccauaaaaucucacgcugccauuucccugaacagauacauacauagagagagacaguuuuccaaacugugucacgcaggcugagugcacuggcaggaucacagcucacggcagccucaaccucccuggcucaagcgaucccuccccucagccuccugaguagcugagacuacaggugagugccaccacacucagcuaauuuucaaauuuuuuguagacagggucucccuauguugcccaggcuggucuugaacuccuagacucaagugauccuccugucuuggccucccaaagugcugagauuacaggugugagccacugugcccagcaguuucccagaauauauuuaaa

SEQ ID NO: 147450 - RNA, 41 nt, Homo sapiens
gacagucugcuguuguugucucaggagcaguggaguccacg

SEQ ID NO: 147451 - RNA, 60 nt, Homo sapiens
uuucucuauucuuguaguugccuuuuccugaaggacauauuaacgcuuuaaguuuugcag

SEQ ID NO: 147452 - RNA, 48 nt, Homo sapiens
cauauugaauuguagccuccuuuuuaaaaauguagacauuucccacua

SEQ ID NO: 147453 - RNA, 33 nt, Homo sapiens
uaaaggcgagauaauuuuucuagacuauaagac

SEQ ID NO: 147454 - RNA, 115 nt, Homo sapiens
acuccucuagccaagcacaacaaugaacaccacuucaccaucacaacuaaugagacgacugacauucgguaccccuuggcaugaugcacagagaaggccacaacucaccuaugua

SEQ ID NO: 147455 - RNA, 66 nt, Homo sapiens
ggaugcuaaaacuuuugggcaaaagacaacuagggaagccugcucuuauuuacacaagcucaaaug

SEQ ID NO: 147456 - RNA, 43 nt, Homo sapiens
gcggcccuggggguccgcgcuggagcgaggggcacucacuggc

SEQ ID NO: 147457 - RNA, 44 nt, Homo sapiens
gagucagugacucugguuacuugccugugccuuucgcccaaccc

SEQ ID NO: 147458 - RNA, 45 nt, Homo sapiens
guuuaaugacucaggguucuaaccuagagauguguccccguaagg

SEQ ID NO: 147459 - RNA, 47 nt, Homo sapiens
aacaugguauacagugaccuuuggcaugcauuuuguuuuguaacuac

SEQ ID NO: 147460 - RNA, 68 nt, Homo sapiens
gugaguauucucugguggccagagguugguaguguuagcuugcuucgauggcuuccuaucacugagag

SEQ ID NO: 147461 - RNA, 37 nt, Homo sapiens
acacacaguuuugcaacuuaagcuuuuuauuuauuua

SEQ ID NO: 147462 - RNA, 46 nt, Homo sapiens
uauugucuuccagaaaaguagcaguaguuuaugcuuucaccagcag

SEQ ID NO: 147463 - RNA, 76 nt, Homo sapiens
ugacagagucauaucccuggagcaucagaugagggagagagggagggagagugaguuugguaugcucagggaguga

SEQ ID NO: 147464 - RNA, 167 nt, Homo sapiens
aggggacacuuguggacaugagagugggguugagucuuaauauuauaaagauaugaauuuggggcgauugaggguuuuucagcagggauuaggacagaucuguggguuggagggaggugacacuguaagaaggaggguuuggaaggcaggaccauucuagauguaau

SEQ ID NO: 147465 - RNA, 50 nt, Homo sapiens
ccaaagugaguauuucuggauucaaacagcaacauggccaaguuuuugga

SEQ ID NO: 147466 - RNA, 43 nt, Homo sapiens
gaauagauacaaauuaaauuuuccuuaaagcgaacauagaguc

SEQ ID NO: 147467 - RNA, 38 nt, Homo sapiens
gcaaagggagaagccaggcguuuuaagauucacgggag

SEQ ID NO: 147468 - RNA, 44 nt, Homo sapiens
cuggaucaggauauucuucacucuucuagccgacacagugaagu

SEQ ID NO: 147469 - RNA, 256 nt, Homo sapiens
ucauucagcaguuauaucuggaauguagcucuggcauuuguaguagcuuucaggugcauaucgaauauaagugcuauagccagguguggugguccgcaguccagcuacucgggagccugaggcaggaggaucgcuugauucugggagguugagggugcagugagcuguguuugugccaguguacuccagccugagugaguacacuuugagugauacccugacucaaaaacaaaaacaacaacaaaaaucccuguag

SEQ ID NO: 147470 - RNA, 46 nt, Homo sapiens
cucuuugugccuggcuccaugcuaagcucuugggacauaauaguga

SEQ ID NO: 147471 - RNA, 67 nt, Homo sapiens
cuugaacuuaguuuugguagcaccguuuuaaacuacuuuaaacuacuuguugcuuuauuucugguaa

SEQ ID NO: 147472 - RNA, 61 nt, Homo sapiens
gacguacucaucucagaugucaucuccuguagucuuuccugacuuuccuagaaggaggcag

SEQ ID NO: 147473 - RNA, 48 nt, Homo sapiens
agauucugaugguuguguuucugaaucugaauuuuuuaacaagccccu

SEQ ID NO: 147474 - RNA, 52 nt, Homo sapiens
gcuaggcacucccuacaaagucacuuuaaucauucccaacagucuugugagu

SEQ ID NO: 147475 - RNA, 48 nt, Homo sapiens
uuuuauaagacccauaagacucuuccuccuuuuucagcacauuugguu

SEQ ID NO: 147476 - RNA, 49 nt, Homo sapiens
ggauagagaucuguggauucauugucaagguggaggaugcaggcaggga

SEQ ID NO: 147477 - RNA, 117 nt, Homo sapiens
uuuacaggaaauguaaagguuaauuuauuuggcaaagauuguaccagauguuugggguaaaguagugaaaaaaagacaaauacaguuuguacuuucauguuguugacaguuuuggug

SEQ ID NO: 147478 - RNA, 20 nt, Homo sapiens
cuuuaggaggcuguaggaga

SEQ ID NO: 147479 - RNA, 45 nt, Homo sapiens
auucauguguguucaguuauguaaacuuguuucucaguuguauca

SEQ ID NO: 147480 - RNA, 54 nt, Homo sapiens
caucucuuagauaucaugaagaauguguuguuuauaauaugaaaaaguaugaag

SEQ ID NO: 147481 - RNA, 45 nt, Homo sapiens
guggcauuuacgggcagagguggauaaagaagacccauggaguag

SEQ ID NO: 147482 - RNA, 42 nt, Homo sapiens
aaaugucauauguauuaggauugugacagugugacuacugac

SEQ ID NO: 147483 - RNA, 50 nt, Homo sapiens
ggcucuugguguuuucuucauaccacuuugcucuuaguuccuguuagcag

SEQ ID NO: 147484 - RNA, 54 nt, Homo sapiens
uguaaaacaacuuagggaaaaggauuauuaagcaggaugauugggaugacauca

SEQ ID NO: 147485 - RNA, 56 nt, Homo sapiens
ggaagcaauaaguaggaaguacuguaaaagaauuacaauaaaauaagagaaaccac

SEQ ID NO: 147486 - RNA, 50 nt, Homo sapiens
uuucugauaaauagcaguuaguggggggaauuguagaucaguaaaugcaa

SEQ ID NO: 147487 - RNA, 57 nt, Homo sapiens
uagugcagcuaauguauaaaguguuaauaacuuuugaacuuaaauguucuuaaauua

SEQ ID NO: 147488 - RNA, 49 nt, Homo sapiens
aauauauacacaauuuuuauuuuccaguuauaacucaauaaagcuggug

SEQ ID NO: 147489 - RNA, 50 nt, Homo sapiens
ugacaacagaacauaguuuuaaaauuuucccauuuuccucuagaagagac

SEQ ID NO: 147490 - RNA, 44 nt, Homo sapiens
auguugauagcaagaccugugugguaucagcauuugugcagaag

SEQ ID NO: 147491 - RNA, 56 nt, Homo sapiens
augagggcaaaggaaaaaaugucagaugaaagugggagaagauaaaagcacaggag

SEQ ID NO: 147492 - RNA, 64 nt, Homo sapiens
agauuugaaaugagagcuuuagagcccuuuauauuucuuuuuaccucacagcuguuacccacca

SEQ ID NO: 147493 - RNA, 31 nt, Homo sapiens
ccaggaaacagucccuugacauggaaaaugc

SEQ ID NO: 147494 - RNA, 44 nt, Homo sapiens
ugaugugugacuaaaauauugauuauucauggauucugcgagag

SEQ ID NO: 147495 - RNA, 57 nt, Homo sapiens
cauguuucaaagcauuucucugaauaugugagauuaaagaaacucucaaccacucag

SEQ ID NO: 147496 - RNA, 238 nt, Homo sapiens
uuuauuguguuauaauuggccuacaguaaacuucacauaauugaaaguauacaauuugauggauuuugacaaguauuacuugugaaacuuuuaccacaagucagauaaugaagauuuauuacuucacuuguuccagaauuuuauauaaacaggauuauauguguucuuuuugccugguuuuaguucuuuugagagucauauguguugugauaccuaucaguaguucacuguuuuuauu

SEQ ID NO: 147497 - RNA, 48 nt, Homo sapiens
uaaagaugcuaugaauauuguuguacaacuuuuuguauggacauaugu

SEQ ID NO: 147498 - RNA, 34 nt, Homo sapiens
uugaauauauagauaauuucagaagaauugauac

SEQ ID NO: 147499 - RNA, 46 nt, Homo sapiens
uugggcagaaaacaaauguaauggaaggcuauauguuaacccauag

SEQ ID NO: 147500 - RNA, 72 nt, Homo sapiens
uugcugaagagaagagcgaagagcugcugaagagcaccauugaagaauggugagaaggucggugcaguuaag

SEQ ID NO: 147501 - RNA, 47 nt, Homo sapiens
ugacagagcauggaaauaagcagcuggauucaugagacauuccagag

SEQ ID NO: 147502 - RNA, 49 nt, Homo sapiens
cugucacccucuuaggcuguuuuagaaaaucccauguuuuagcuugcca

SEQ ID NO: 147503 - RNA, 47 nt, Homo sapiens
uguagaaugcuuucuaguugucuuccacaggacauuuuugggagcua

SEQ ID NO: 147504 - RNA, 25 nt, Homo sapiens
acacaucugcauauuagucuuaaag

SEQ ID NO: 147505 - RNA, 56 nt, Homo sapiens
auggauuuuuuccucccgaauacagaccacauuuucuugcuucuugcugugccuag

SEQ ID NO: 147506 - RNA, 48 nt, Homo sapiens
gauagaaacuuaagaguaaaaacauggguaauuugcuuaauuaugaaa

SEQ ID NO: 147507 - RNA, 41 nt, Homo sapiens
ucgccagccaaacauaagugaccaacagguuucugccuuau

SEQ ID NO: 147508 - RNA, 48 nt, Homo sapiens
guucauggaguaucagaaaugacuauuggaauggcaguuuauuccuua

SEQ ID NO: 147509 - RNA, 48 nt, Homo sapiens
uguaguugugugaaaguuucuugccccacggauauuugaugugugaug

SEQ ID NO: 147510 - RNA, 32 nt, Homo sapiens
uaguaguugucauauugaugauuauuaugaag

SEQ ID NO: 147511 - RNA, 50 nt, Homo sapiens
auaaaccagguccuuuuacuuuucuugaauggcauacuuuggacaaguca

SEQ ID NO: 147512 - RNA, 46 nt, Homo sapiens
ugaugauaacuaugauuauauuguaaaaaacggagaaaaguggaug

SEQ ID NO: 147513 - RNA, 73 nt, Homo sapiens
uaugaucguguggagcaagaauggguugccauuaaaauaauaaagaacaagaaggcuuuucugaaucaagcac

SEQ ID NO: 147514 - RNA, 47 nt, Homo sapiens
ucagcugcuauaguaaauuacuggauauucucaauacuugaauaugg

SEQ ID NO: 147515 - RNA, 46 nt, Homo sapiens
uuuccgaggggucucuuugaaccuaacacgaaaguuugcgcaacag

SEQ ID NO: 147516 - RNA, 61 nt, Homo sapiens
accuccaccacacacagaccuuccgcuuccaccuuacaugaccacaccaucuccaccacag

SEQ ID NO: 147517 - RNA, 61 nt, Homo sapiens
aacuccaccacacaugaccccaccaucuccaccacacacagacccuccaccuacaccacac

SEQ ID NO: 147518 - RNA, 43 nt, Homo sapiens
aguucuccagugauguguauguuacagugcugaauauuauccc

SEQ ID NO: 147519 - RNA, 45 nt, Homo sapiens
acccguaaacuucauaacauucuuggaguggaaacaggaggaccu

SEQ ID NO: 147520 - RNA, 24 nt, Homo sapiens
gaugauuucagccacaccugccag

SEQ ID NO: 147521 - RNA, 42 nt, Homo sapiens
cauccuguucaagaaacaaccuuucauguagccccucaacag

SEQ ID NO: 147522 - RNA, 37 nt, Homo sapiens
cuugaaucaggaggagauuaacacacugaaccgcuac

SEQ ID NO: 147523 - RNA, 49 nt, Homo sapiens
ugcaaagggacauugaaguguuuaaaagagccauguccaaacccaucuu

SEQ ID NO: 147524 - RNA, 42 nt, Homo sapiens
ugagaagcaaucaacgggucggucguggccaguccuggggag

SEQ ID NO: 147525 - RNA, 47 nt, Homo sapiens
ucccuuccugcuuuuuacuuuuucuuuugcuuuuucucggcacgugg

SEQ ID NO: 147526 - RNA, 45 nt, Homo sapiens
uacauugacauaggcaucagcaaucucugaaaguaaaaauuggag

SEQ ID NO: 147527 - RNA, 41 nt, Homo sapiens
aguuauagcccagagcccaagaucucugucugccagcuguc

SEQ ID NO: 147528 - RNA, 40 nt, Homo sapiens
aaaugaggcgcuuccuguagaaaccgggcccuggcugugu

SEQ ID NO: 147529 - RNA, 74 nt, Homo sapiens
ggaggauuguguacagcuuuuuucuggacauguguuguuuaacuucagggaucaagauuuuuuuccccccuuca

SEQ ID NO: 147530 - RNA, 52 nt, Homo sapiens
aauguaaauguaaaacaaaaaaaccauaaaacuucuagaagauaacaaaggg

SEQ ID NO: 147531 - RNA, 41 nt, Homo sapiens
uccgggaugagcucagccgcggccgaccacugggcgugguu

SEQ ID NO: 147532 - RNA, 38 nt, Homo sapiens
cagaaggacgcggagcaggagucacagaugagagcgga

SEQ ID NO: 147533 - RNA, 46 nt, Homo sapiens
caacaugauggacgaguuugccagauaugccaggcuggaaagaaag

SEQ ID NO: 147534 - RNA, 66 nt, Homo sapiens
uuacacuguuuuguuuuuuaagaaacaaaagugcauaguuuagauuuuuuuuuuguugaauauguu

SEQ ID NO: 147535 - RNA, 45 nt, Homo sapiens
ucuguguguaauagcugcugauaagaaacccagaggaagcucagg

SEQ ID NO: 147536 - RNA, 51 nt, Homo sapiens
uugcuggaacauacaaguauaaaaauaagauuauuuuagaaaacuccaguu

SEQ ID NO: 147537 - RNA, 51 nt, Homo sapiens
gcagaaaaucguugugaaaguauugaaggcauaagcacagagucggaaagc

SEQ ID NO: 147538 - RNA, 41 nt, Homo sapiens
cuuuauaccaagaagguugggaaagcaccaaaaucugcaug

SEQ ID NO: 147539 - RNA, 43 nt, Homo sapiens
ccaggaugaaagcaaggagcuggaguccugcugaggccaugau

SEQ ID NO: 147540 - RNA, 46 nt, Homo sapiens
gaacacacgccaggaccaugguggcucucgcagccugcacguggau

SEQ ID NO: 147541 - RNA, 57 nt, Homo sapiens
aagccaagaucuuugagaagagcaauccaaagggaagaagaguugaggacaagggcu

SEQ ID NO: 147542 - RNA, 50 nt, Homo sapiens
uaaauuaauguuuaacauauuaucuaucucacaugucucaucccauuuac

SEQ ID NO: 147543 - RNA, 32 nt, Homo sapiens
aaauugugucuuauuuuuuaaagggagggcag

SEQ ID NO: 147544 - RNA, 24 nt, Homo sapiens
ucgagaaggcaagaguuuaaaaca

SEQ ID NO: 147545 - RNA, 23 nt, Homo sapiens
acagaagcugggaggaagugacc

SEQ ID NO: 147546 - RNA, 33 nt, Homo sapiens
gagucaguauuuuuguaaccaucgcugacugga

SEQ ID NO: 147547 - RNA, 50 nt, Homo sapiens
ugcagaugcugccaccacccauagcccccugcaccagccgugggcagccc

SEQ ID NO: 147548 - RNA, 56 nt, Homo sapiens
gucagagugguuacuucacacaccaucaaauuuccaagaaaauuuacugguaucaa

SEQ ID NO: 147549 - RNA, 93 nt, Homo sapiens
ccaaggcugagugguugaauggcagaguggcaugcauguggucuuuggcaaggugaagagaauaucguggaaaccauggagcacuuugggucc

SEQ ID NO: 147550 - RNA, 103 nt, Homo sapiens
aagaaugccaaggccagcaagaagcucaucauugcugacuguggacgacucuuaauaaauuugacucauguucuaucuuaaccaccagacauuccuuccuuag

SEQ ID NO: 147551 - RNA, 62 nt, Homo sapiens
aagcccgaauucagacaacccauacagccauucccaucucagccaggugggacugagaauca

SEQ ID NO: 147552 - RNA, 26 nt, Homo sapiens
gaugaaaaaucccaaauaucccuggu

SEQ ID NO: 147553 - RNA, 64 nt, Homo sapiens
uuucagacuguagcugccuaugcuuggaauuuguccuagauaaggauaaaguagcuaauccauu

SEQ ID NO: 147554 - RNA, 71 nt, Homo sapiens
ccauucauuucaccaggagaaaggaaguuuauaauagaaacucugaaguaacuuagcaauaaccugcaggu

SEQ ID NO: 147555 - RNA, 42 nt, Homo sapiens
ugcuuggaguggcauagccuugcccuaauucugucaccaaga

SEQ ID NO: 147556 - RNA, 54 nt, Homo sapiens
uuugucuacauaaugaguuuuguccuaauuucauuauaugcuaucuacauaaaa

SEQ ID NO: 147557 - RNA, 35 nt, Homo sapiens
aaguuacaaauagagaauuaacgauuucaggaauu

SEQ ID NO: 147558 - RNA, 39 nt, Homo sapiens
ugcccuauggaaagguaacagaggcgacuuuagaccagg

SEQ ID NO: 147559 - RNA, 59 nt, Homo sapiens
cucuugaaaccuucauuggccuuaugcuauaaauacugguaccacuucgagaccagaga

SEQ ID NO: 147560 - RNA, 120 nt, Homo sapiens
aaguagaagaaugauuugcacuuucugguggcacugaaguacagagaugaugauagaccuaggguauacagagauagaacugugaugauuauuauuagugucucugaauucucagaucca

SEQ ID NO: 147561 - RNA, 52 nt, Homo sapiens
guaauaguucacuuuuguuguaauauaauacaaaaauaacauaacaauacuu

SEQ ID NO: 147562 - RNA, 43 nt, Homo sapiens
uuuauugauuuguagaauauucucaaauggaagucuuuagagg

SEQ ID NO: 147563 - RNA, 32 nt, Homo sapiens
guggaugguauugugccacaggucucagagga

SEQ ID NO: 147564 - RNA, 47 nt, Homo sapiens
uugguauuaacaaaagaaaaugcuuuuucaauagauuaccaguauag

SEQ ID NO: 147565 - RNA, 53 nt, Homo sapiens
auauauuuuuuugaaaaauuggggaagcuugaauauggaauuagacugaauuu

SEQ ID NO: 147566 - RNA, 44 nt, Homo sapiens
cgugaaaauaaaaggugggaagacuuucuauaauugaaagagac

SEQ ID NO: 147567 - RNA, 39 nt, Homo sapiens
caguguuauuuuguauuuucuuugugaaaaaauauggag

SEQ ID NO: 147568 - RNA, 69 nt, Homo sapiens
uuuuguaguuaguguuuuuguuuuuacuuuucccugacuuggagagcaaucuuauuuuggaauugagag

SEQ ID NO: 147569 - RNA, 49 nt, Homo sapiens
cucggaaacauauguagcacaaauaguuauuaaaguauagaagaaggaa

SEQ ID NO: 147570 - RNA, 35 nt, Homo sapiens
aguuguucaaggaaaaacaacaacuugacuagcac

SEQ ID NO: 147571 - RNA, 46 nt, Homo sapiens
ucuaaaaugaagccaugucuauaaauuguuaacacuugaggcagag

SEQ ID NO: 147572 - RNA, 46 nt, Homo sapiens
ccaugaagcaguuucugcuguacuuggaugaguccaaugcccuggg

SEQ ID NO: 147573 - RNA, 123 nt, Homo sapiens
gcuuuuucccuuacccagaaaugaaaauacucaauauggaccauuuaggaauuauaagcagcaacugugaaagacuugccacucaauaucuuaggugacugauuagacauagaggguuguuuu

SEQ ID NO: 147574 - RNA, 69 nt, Homo sapiens
uuuguucagaaaaaaagccccugaacugauuuuguuaccauagaauuuaaaaaaaaaaaaagcuuuaac

SEQ ID NO: 147575 - RNA, 86 nt, Homo sapiens
accuuuuauauuaacaugaaacuuagaaaauuuuugauagaaucccagaguucaaaagguauuaggauuuuugccacugaaguaaa

SEQ ID NO: 147576 - RNA, 39 nt, Homo sapiens
cucuuuuuccuccccgaccacgaccccgguugccaccag

SEQ ID NO: 147577 - RNA, 66 nt, Homo sapiens
uaacaaugaaauuacacguugaagggguuuguuacuguugaucuuuauuccacagccuggcuucuu

SEQ ID NO: 147578 - RNA, 46 nt, Homo sapiens
gggcucugcugccugcccuuugccucggaggguguggaagacccuc

SEQ ID NO: 147579 - RNA, 45 nt, Homo sapiens
agggcccagcagcccacacggcccagaugccaagccuggaggcuc

SEQ ID NO: 147580 - RNA, 63 nt, Homo sapiens
uauaauucccaauaagcucuucuuuuuaaaggugauuaacaguucuaguguucaauuucaaaa

SEQ ID NO: 147581 - RNA, 48 nt, Homo sapiens
gguugaaugccuauguaugucaggcccugugcugagccaugaggauua

SEQ ID NO: 147582 - RNA, 44 nt, Homo sapiens
cugguaagagauuuuuuuuuuuuucuuaauaaaagcccuugugu

SEQ ID NO: 147583 - RNA, 54 nt, Homo sapiens
auugugugcugucgcagaaguuggacguuuaaaauugaauuguauuucauaagg

SEQ ID NO: 147584 - RNA, 54 nt, Homo sapiens
cuuuggagaugcaaagguaauaucacuuaucuugagcccacugucuagagggga

SEQ ID NO: 147585 - RNA, 57 nt, Homo sapiens
uccuggagacuaaauuucaaaccuagccggaaggugagaggaucaucagagaagagg

SEQ ID NO: 147586 - RNA, 57 nt, Homo sapiens
gccucauuaguuuauugcccauuuucccccaucugaauguaaguacgcuaggugcug

SEQ ID NO: 147587 - RNA, 142 nt, Homo sapiens
gaguccuacuaaccccugcugacaauuugcgagaugucuuaguccauucagccugcuguaauaaaauaccuuagacuuugugauuuauaaacaacagaaauuuauuucuuacggguuuugaggccggaagucagagaucaag

SEQ ID NO: 147588 - RNA, 44 nt, Homo sapiens
ccugaucaucuccugaagggccaucuuccaguaccaucaccaug

SEQ ID NO: 147589 - RNA, 39 nt, Homo sapiens
uucacuucaaagaucaccgcguggaagaugguaauaaga

SEQ ID NO: 147590 - RNA, 46 nt, Homo sapiens
uuggcuguaaagcaggguggacagguggaucucagcucugugggaa

SEQ ID NO: 147591 - RNA, 55 nt, Homo sapiens
cgggucggagagcggcagccggaauuuuggcgaugguguaauuucgagcaggaag

SEQ ID NO: 147592 - RNA, 116 nt, Homo sapiens
gcccugggcugggucacugaguggaguggaggggaaaggccaguggagaucaggggaugcugcacagaaaggccaggcugcccacgcacacguggaacccgugccgcaugcugcaa

SEQ ID NO: 147593 - RNA, 44 nt, Homo sapiens
gaaggagaaaguguggaccccagcagcggguguggggagcgggc

SEQ ID NO: 147594 - RNA, 74 nt, Homo sapiens
cuguugcaucugcccccuguguuuuuuuaaucuuuguauauuuuauaauauaucuuauaugucauuuuauccau

SEQ ID NO: 147595 - RNA, 47 nt, Homo sapiens
aggauguuuauguaguucuguacauacugugaauucagccacaggau

SEQ ID NO: 147596 - RNA, 60 nt, Homo sapiens
cggagcccaggcuuggagcugcugcacucuaggcuuuguucuuguggagcuuacauuuua

SEQ ID NO: 147597 - RNA, 47 nt, Homo sapiens
acauuuuuaaaacuuuuauugaaguauucuuugcacuguuauuuuac

SEQ ID NO: 147598 - RNA, 36 nt, Homo sapiens
uggggcauacagaucucagugggauuuuacaugucg

SEQ ID NO: 147599 - RNA, 46 nt, Homo sapiens
uagugaaguguuaaaauugccugagacgugacgagcauuuuguuug

SEQ ID NO: 147600 - RNA, 66 nt, Homo sapiens
cugugcucguagaguuacauagugauauguucugcuuuuuucuaaugugagaaagagaaauaauaa

SEQ ID NO: 147601 - RNA, 48 nt, Homo sapiens
ucagucugcccaggugguggagagagacaccugaguucagacaagggu

SEQ ID NO: 147602 - RNA, 42 nt, Homo sapiens
ucuccagcuccuggcccuccgccacgcucaagaggccgccgg

SEQ ID NO: 147603 - RNA, 70 nt, Homo sapiens
ugucagaaaucuugaaaggucauacaaaaaggcauacggaaagaagcccagcgagaagaguuuuccugcu

SEQ ID NO: 147604 - RNA, 44 nt, Homo sapiens
guauuugauguccucgguucauuggacaacagagccauuguugg

SEQ ID NO: 147605 - RNA, 35 nt, Homo sapiens
ugagaacaccagcaaaaauggcaaaucaacguuuu

SEQ ID NO: 147606 - RNA, 25 nt, Homo sapiens
uuuugaggaggggcagaugccaacc

SEQ ID NO: 147607 - RNA, 42 nt, Homo sapiens
agaaacauacaaaaccaaacccuuugcugcgaccaccuucca

SEQ ID NO: 147608 - RNA, 49 nt, Homo sapiens
uccucucguuucuguguuucugcugcacuaauugccaggggguggggga

SEQ ID NO: 147609 - RNA, 62 nt, Homo sapiens
uaaauuaaccuguaauuaugaauuauuuaguuuaacucaaggugcauuuuuauuucacagau

SEQ ID NO: 147610 - RNA, 46 nt, Homo sapiens
aagacuuuuuuucugacaguauuauguaauuuuuuagcguggguag

SEQ ID NO: 147611 - RNA, 46 nt, Homo sapiens
guaugaaauaauaaaugugugacauuuauagggaauguuggcucug

SEQ ID NO: 147612 - RNA, 36 nt, Homo sapiens
cacuugaggugauaguuguuaaaaacaauaccagua

SEQ ID NO: 147613 - RNA, 47 nt, Homo sapiens
gccuuuuuuauauugccugccaaaauuugaaguauuagaagaaagug

SEQ ID NO: 147614 - RNA, 46 nt, Homo sapiens; identical to SEQ ID NO: 57214

SEQ ID NO: 147615 - RNA, 39 nt, Homo sapiens
accaguuuuuuuuuuuuuuuugugggagugggcucuucu

SEQ ID NO: 147616 - RNA, 42 nt, Homo sapiens
auaaacauuuauugaacaaaagaaaccuuguuuggcccagag

SEQ ID NO: 147617 - RNA, 41 nt, Homo sapiens
guacuuagagcuuuuugaguguagaauuuuaaauggcagga

SEQ ID NO: 147618 - RNA, 46 nt, Homo sapiens; identical to SEQ ID NO: 57218

SEQ ID NO: 147619 - RNA, 45 nt, Homo sapiens
auuaguauaagcauucauuuaaugcaaaaaaacucagcccuugga

SEQ ID NO: 147620 - RNA, 26 nt, Homo sapiens
ucuguaugagcacgucucauagggau

SEQ ID NO: 147621 - RNA, 46 nt, Homo sapiens
gcacuucagugaauaugugacuaguaaagcuuaaauauguuuggau

SEQ ID NO: 147622 - RNA, 82 nt, Homo sapiens
aaaggcuaagaauucaagaacggucuuaacugaacccucaucagaucugaauuuaacaaaugcuuagucucagcagccuccg

SEQ ID NO: 147623 - RNA, 28 nt, Homo sapiens
uuaaucuauacacccuaugaguaccccu

SEQ ID NO: 147624 - RNA, 46 nt, Homo sapiens
cguacuccuacgccagcuggcccuaccauaaugccuuugaucagac

SEQ ID NO: 147625 - RNA, 49 nt, Homo sapiens
uaauggugucauucauuuuuuuacaauggcuuuuuaauuuuugcacauu

SEQ ID NO: 147626 - RNA, 30 nt, Homo sapiens
auuggagaacagacaccauuagcaacaugu

SEQ ID NO: 147627 - RNA, 54 nt, Homo sapiens
uggagagcaaucugguuugacuuaagauguuacuuacauacguguguaaaguag

SEQ ID NO: 147628 - RNA, 45 nt, Homo sapiens
aucauauuuguguguguuugaguguuuuaagcuuuucugguuaaa

SEQ ID NO: 147629 - RNA, 53 nt, Homo sapiens
guuuagacaucuuguaauucuaaauuuuaggcguugcaaauguaaaaaaaagg

SEQ ID NO: 147630 - RNA, 33 nt, Homo sapiens
gacaucuagagguaauguacuggcuccuugaua

SEQ ID NO: 147631 - RNA, 31 nt, Homo sapiens
guaauacagaaauuaagugauuucaggcaac

SEQ ID NO: 147632 - RNA, 21 nt, Homo sapiens
aagauugagaaaguagagaug

SEQ ID NO: 147633 - RNA, 90 nt, Homo sapiens
uagcaauuagagacauguauguguguagggaguugggcaagaguugaaggaaggggauucauuaguuggcuguugcaguuguugaggcaa

SEQ ID NO: 147634 - RNA, 44 nt, Homo sapiens
ugggacuguccaaggaauagcaaagucagcaaggguggaaagug

SEQ ID NO: 147635 - RNA, 48 nt, Homo sapiens
auuaaacgaacaaagguaauuucagauagggauaagugccaugaaaau

SEQ ID NO: 147636 - RNA, 85 nt, Homo sapiens
aaaggaagcuggagaagauugaaguaggaguuuaccaggcaaauaaguaaaaugguauucuagacaucagaaauagaaucaacca

SEQ ID NO: 147637 - RNA, 53 nt, Homo sapiens
uauuuauccucaaauauguugucaguguuaauaguuucucuggugucucauua

SEQ ID NO: 147638 - RNA, 48 nt, Homo sapiens
ggauguaaaaucaugguccgaggcaaaggcucaaugagggauaaaaaa

SEQ ID NO: 147639 - RNA, 83 nt, Homo sapiens
uaacacauuuaaaauuuuuacuuuuaacagaaauuagcagaguacggaaagacauguacaaugacacauuaaauggcaguaca

SEQ ID NO: 147640 - RNA, 57 nt, Homo sapiens
aauaugaagugugagaauggacuugacauugugucauugcccgagaucaggaggaac

SEQ ID NO: 147641 - RNA, 376 nt, Homo sapiens
guugaaugcauauacgaaaaaaaucauuauauuguaucauugguaagacaguuuuuuuuuuuuaaaacagguuauacuuuauucaggucaguucaauuuuguaaaguuuuuacuuuuaggaaauuaaaaagcuuuuauuuuauuauguucugaauauauuuuuacuaaauauacuuugaguacaggguuaauuaggacugugcaggcuaugaauauaggguuuaugauaaagcucaguaggaguggaugauugcaguccuuuugugcaauccuggcaggagcagccuuuuccuuauuggcucgguuuuuuucuuaaagccaagacuaagcacauauuuagaugccuguauauuuuauuuucucaucugauguaaga

SEQ ID NO: 147642 - RNA, 686 nt, Homo sapiens
uucaagcgaaagaauuuauucuaucaaacucagaauuuucgcucuagaauaauccuucgugguuuuuuuuuguuuuuuuuuuuuuucgggggggugggggacggagucucacucuguugcccaggcuggauugcaguggcacgaucucggcucaaugcacccuccgccuccugguuucaagugauucuccugccucagucucccgaguagcugggauuacaggugcccgccaccacacauggcuaauuuuuuuuuuuguauucuuaguagagaugggguuucaccguguuggccaggcuguucucaaacugcugaccucaggugauccacuuaucucggccucccaaaguguugagauuacaggcaugagccaccgcguccugaauccuuuuuuuuuuuuuuuuugaaacagagucucacucuguugcccaggcuggaguacaguggcuuggcucacugcaaccuccaucuccagggugugagcaauucucaugucucagccucccgaguagcagguaauacaagugugugccaccacgcccagcuaauuuguguauuuuuaguaaagauugaguuuugccauguugaccaggcugaucucgaacuccugaucucaagugaucugccugccuuggccucccaaagugcuggaauuacagacgugagcuacugugccuggccuagaa

SEQ ID NO: 147643 - RNA, 76 nt, Homo sapiens
gugucugauaccacagaaagauaggaacuacugcauuaauaauagcagauucuugagcauguauuacaugacagac

SEQ ID NO: 147644 - RNA, 95 nt, Homo sapiens
ugaaggaagcuguggcaaguugagaauucagagguaaagccuuugugagagagaugauguaguuuaauuauuuuaacucuaguucuccugaucca

SEQ ID NO: 147645 - RNA, 50 nt, Homo sapiens
gagauacauuugaauguuuagccaucucucaauuuccauggagaggagag

SEQ ID NO: 147646 - RNA, 50 nt, Homo sapiens
auuguauauuuuucauugaaaguaguuccaucuaaauuaagagccugacu

SEQ ID NO: 147647 - RNA, 58 nt, Homo sapiens
aaggaaauagaaacauaccaagaagacuaaagacuggugcuaaagaggguguuuuugg

SEQ ID NO: 147648 - RNA, 24 nt, Homo sapiens
uguguguaaugauagcauuaagug

SEQ ID NO: 147649 - RNA, 67 nt, Homo sapiens
gucuuuuuaagagacuauauguugguauguugaccauauuaaauguaacuaguuuaguacaucagau

SEQ ID NO: 147650 - RNA, 104 nt, Homo sapiens
cuuuuguuguacuuacugcuucuauuagcuuuuaccuuaugcucagcagacauggaaaauacacauauauuuuaaugucaggugcgugcgugugugugccugca

SEQ ID NO: 147651 - RNA, 85 nt, Homo sapiens
cuuauuauuacuugguucucaaaguaaaguguugguuugcuaguugcuucaaauggagaccaaugaauuuuuucucucuuuucua

SEQ ID NO: 147652 - RNA, 46 nt, Homo sapiens
uuggguucuaaugcuccugcucucuucucuuuccccuccaaccagu

SEQ ID NO: 147653 - RNA, 46 nt, Homo sapiens
agggaaaaaccuggaauauuuccauaugcuaaaaaucugcugcugu

SEQ ID NO: 147654 - RNA, 45 nt, Homo sapiens
cuucaaugucauaguuuuacagggucucaaacuuacuuugcagau

SEQ ID NO: 147655 - RNA, 41 nt, Homo sapiens
auaucacauuauuuauuauaagcagaaugugucauauucug

SEQ ID NO: 147656 - RNA, 39 nt, Homo sapiens
uugcugccaaggugcuuaauuuuacuuuacugucauugu

SEQ ID NO: 147657 - RNA, 53 nt, Homo sapiens
cuaacaauaaacuuuuauggugaauauaguuuguuaucuuagugggacuguua

SEQ ID NO: 147658 - RNA, 40 nt, Homo sapiens
uguauccgacuguaacacaguugaguugauagaaauaggu

SEQ ID NO: 147659 - RNA, 51 nt, Homo sapiens
aaugaaacaacaguaguugaaugcaaauuguuauaauaaaguuuuguaauu

SEQ ID NO: 147660 - RNA, 44 nt, Homo sapiens
uaggcauuacuuuuuuuuuuuugccuauaaugcuuggcugaaaa

SEQ ID NO: 147661 - RNA, 42 nt, Homo sapiens
aaauauugguuucugaaguccaucacauuuuuuuuucuggau

SEQ ID NO: 147662 - RNA, 24 nt, Homo sapiens
guuauagauuauuugauuugucau

SEQ ID NO: 147663 - RNA, 45 nt, Homo sapiens
ccgcuguuggaacagcaaaucuguuaauuucaaguugcuccagag

SEQ ID NO: 147664 - RNA, 67 nt, Homo sapiens
agauuuuucgcaagaauuucgagauuuuaaaaauagagucggggaacaggaguuugaagcuugggga

SEQ ID NO: 147665 - RNA, 53 nt, Homo sapiens
gaguuuguaggacaggguuucgagacguuuggaaagggcgaaauaaaauugag

SEQ ID NO: 147666 - RNA, 43 nt, Homo sapiens
ggagugcgaaauaacgcgaugacagaucggagcgcagccugag

SEQ ID NO: 147667 - RNA, 38 nt, Homo sapiens; identical to SEQ ID NO: 57312

SEQ ID NO: 147668 - RNA, 50 nt, Homo sapiens
cggccaaggaaagcccaccagcccuccgcaccgugggcgacgggccaaga

SEQ ID NO: 147669 - RNA, 60 nt, Homo sapiens
cagaagucaacauuuuuacagaugaagaaagaauacggaggcaagaggucuuucucugca

SEQ ID NO: 147670 - RNA, 41 nt, Homo sapiens
gguuagacuguuauccccauuuuacaaauaaggggaaaccc

SEQ ID NO: 147671 - RNA, 45 nt, Homo sapiens
acucugguguucuauugcugagaagcaaaccgcccugcagcaucc

SEQ ID NO: 147672 - RNA, 78 nt, Homo sapiens
gugugacuuacagaaacugcaugaaaaaucaugggccagagccucggcccuagcauugcacuuggccucaugcuggag

SEQ ID NO: 147673 - RNA, 133 nt, Homo sapiens
gaacuggucauuaauguguccccugaguuggagcucauucugucucuuuucucuuuugcuuucuguuucuuaagggcacacacacgugcgugcgagcacacacacacauacgugcacaggguccccgagugcc

SEQ ID NO: 147674 - RNA, 89 nt, Homo sapiens
ccgcgggacagccaagcaccuccaaccaaauaagacuuccacucgaugaugcuucuauaauuuugccuuuaacagaaacuuucaaaagg

SEQ ID NO: 147675 - RNA, 43 nt, Homo sapiens
gggcagagagcucccacccagugagaaacgcacagagcaaugc

SEQ ID NO: 147676 - RNA, 79 nt, Homo sapiens
ggugaauaaggaagaagagacagaugagaaugaaacagaguggcugauggaagagauccagcugccuccuccacggcag

SEQ ID NO: 147677 - RNA, 31 nt, Homo sapiens
ugcuggcccuguugcucuacaagaaggagag

SEQ ID NO: 147678 - RNA, 140 nt, Homo sapiens
ucucgaugucguguuugccucuuccucuaagugcggaaaggauaagaccaagucuguuucuuccaccaucuucuuccacugugacccucugguggaggacgggauccccgaguucagucacgagacugccgacugccagu

SEQ ID NO: 147679 - RNA, 48 nt, Homo sapiens
aaacccggcgugcucuggagccaacauaugccaggugaagcccaacga

SEQ ID NO: 147680 - RNA, 45 nt, Homo sapiens
gcagauggugaaugggaccaucaccaacccuauaaauggcaagag

SEQ ID NO: 147681 - RNA, 25 nt, Homo sapiens
agccuggcugggacccucgagcagc

SEQ ID NO: 147682 - RNA, 51 nt, Homo sapiens
cgugugguggaaauaagaccgcauccuccgugauagaauugaccuguacaa

SEQ ID NO: 147683 - RNA, 51 nt, Homo sapiens
ggugacguccagguccugggacucguucacacgcagaagcugggugucaua

SEQ ID NO: 147684 - RNA, 67 nt, Homo sapiens
ggaaaacaaaaguugucugcccuccaaagaaguuggagugcaaauucguccagaaacacaaaaccua

SEQ ID NO: 147685 - RNA, 94 nt, Homo sapiens
acauccagcaucauauuuaagugugaugaagaugaggacauugggaggccacaagucuucagugaagugcgugggugugaugugacauuugagu

SEQ ID NO: 147686 - RNA, 46 nt, Homo sapiens
accgaugacggcguccccugugucuuccccuucauauucaauggga

SEQ ID NO: 147687 - RNA, 81 nt, Homo sapiens
uuuacuugaauuuugaaagcaguacuccuugcuuagcggacaagcauuucaacuacaccucgcucaucgcguuucacugua

SEQ ID NO: 147688 - RNA, 45 nt, Homo sapiens
ugccggagccgcugugugcaaaguuccuauugaugguccccccau

SEQ ID NO: 147689 - RNA, 52 nt, Homo sapiens
augagagugaggaugaugccuccgauaccaacccugauuucuacaucaauau

SEQ ID NO: 147690 - RNA, 50 nt, Homo sapiens
auguuccgugaggaauggaagcucuauuguugacuugucuccccuuauuc

SEQ ID NO: 147691 - RNA, 45 nt, Homo sapiens
uguacaaggauggguccccuugucccuccaaauccggccugagcu

SEQ ID NO: 147692 - RNA, 60 nt, Homo sapiens
uuacagcgagaagggguugguuuacaugagcaucuguggggagaaugaaaacugcccucc

SEQ ID NO: 147693 - RNA, 46 nt, Homo sapiens
ccguggaggacugugaguacaccuuugccuggcccacagccacagc

SEQ ID NO: 147694 - RNA, 52 nt, Homo sapiens
cauaauuguccugaaauacguugauggcgacuuauguccagaugggauucgg

SEQ ID NO: 147695 - RNA, 83 nt, Homo sapiens
auggggcuggcaacuccuucgaccucucgucccugucaagguacagugacaacugggaagccaucacugggacgggggacccg

SEQ ID NO: 147696 - RNA, 45 nt, Homo sapiens
uacaggucuccugacucagaagcuaacuuaugaaaauggcuuguu

SEQ ID NO: 147697 - RNA, 46 nt, Homo sapiens
ucugccccacaagugacaaguccaagguggucuccucaugucagga

SEQ ID NO: 147698 - RNA, 46 nt, Homo sapiens
caccaucgugagcgcuggcgaauacacuuauuacuuccgggucugu

SEQ ID NO: 147699 - RNA, 46 nt, Homo sapiens
guguuuaucuggagaacuguggaagccugucccguugucagagugg

SEQ ID NO: 147700 - RNA, 71 nt, Homo sapiens
cgaauggaucuuugagcaucauguaugucaacggugacaagugugggaaccagcgcuucuccaccaggauc

SEQ ID NO: 147701 - RNA, 45 nt, Homo sapiens
ccugacuggccuaagcacagucaggaaaccuuggacggcuguuga

SEQ ID NO: 147702 - RNA, 46 nt, Homo sapiens
agucaccgguaaggccgugcggccuaagaacugagaggccggucaa

SEQ ID NO: 147703 - RNA, 61 nt, Homo sapiens
uaccgcugaugcuuuuaucguccgcuuuguuugcaaugaugauguuuacucagggccccuc

SEQ ID NO: 147704 - RNA, 46 nt, Homo sapiens
aaacugaagagcucaagaauuggaagccagcaaggccagucggaau

SEQ ID NO: 147705 - RNA, 54 nt, Homo sapiens
gauggcagacagaccacauauaccacgaggauccaucucgucugcuccaggggc

SEQ ID NO: 147706 - RNA, 102 nt, Homo sapiens
guuuccaucaguaacuugggaauggcaaagaccggcccggugguugaggacagcggcagccuccuucuggaauacgugaaugggucggccugcaccaccagc

SEQ ID NO: 147707 - RNA, 92 nt, Homo sapiens
ugguaugccauggacaacucaggggaacaugucacguggaggaaauacuacauuaacgugugucggccucugaauccagugccgggcugcaa

SEQ ID NO: 147708 - RNA, 42 nt, Homo sapiens
uuaggaagaggauaacuccaccuacaacuuccggugguacac

SEQ ID NO: 147709 - RNA, 46 nt, Homo sapiens
caucaccuuucucugugaucgagacgcgggagugggcuucccugaa

SEQ ID NO: 147710 - RNA, 45 nt, Homo sapiens
ugagaagacuuggaacuugggucugaguaaugcgaagcuuucaua

SEQ ID NO: 147711 - RNA, 82 nt, Homo sapiens
acuuaucaccucucacaaagaaaaauggugccuauaaaguugagacaaagaaguaugacuuuuauauaaauguguguggccc

SEQ ID NO: 147712 - RNA, 56 nt, Homo sapiens
aggugaucuggaaagugcaccaguguugagaacuucuggggaaggcgguugcuuuu

SEQ ID NO: 147713 - RNA, 32 nt, Homo sapiens
cucuuauucagauggugaugauuguggucaug

SEQ ID NO: 147714 - RNA, 46 nt, Homo sapiens
aaggcacgagggugucccgaggacgcggcagugugugcagugggug

SEQ ID NO: 147715 - RNA, 48 nt, Homo sapiens
gcagucagacggaaacagagaagaagcauuuuuucauuaauauuuguc

SEQ ID NO: 147716 - RNA, 96 nt, Homo sapiens
ggagguugacugcaccuacuucuucacaugggacacggaauacgccuguguuaaggagaaggaagaccuccucugcggugccaccgacgggaagaa

SEQ ID NO: 147717 - RNA, 46 nt, Homo sapiens
cagcggaugagcgucauaaacuuugagugcaauaaaaccgcaggua

SEQ ID NO: 147718 - RNA, 49 nt, Homo sapiens
uuagaguaagaaugcuucuguuagaacuguucacuuuauaaacuugcug

SEQ ID NO: 147719 - RNA, 63 nt, Homo sapiens
auaaaaaacaagcugcaguuugccaagugaaaaagagcgauaccucucaagucaaagcagcag

SEQ ID NO: 147720 - RNA, 53 nt, Homo sapiens
cucugagcggcgagcagcaggaugucuccauagaccucacaccacuugcccag

SEQ ID NO: 147721 - RNA, 50 nt, Homo sapiens
uggucacagcccugcggugacuauuacauuuguuugcccgucggagcgga

SEQ ID NO: 147722 - RNA, 44 nt, Homo sapiens
aauggcuugcccaagguuucagaauaguuacuuagggagacuuu

SEQ ID NO: 147723 - RNA, 45 nt, Homo sapiens
ccuguuuuccuggaacuuuaguuagauaggagaaaagauagauag

SEQ ID NO: 147724 - RNA, 49 nt, Homo sapiens
gcaaggagccuauggcacagcagauacuauagguggaacaaagcagucc

SEQ ID NO: 147725 - RNA, 49 nt, Homo sapiens
gauccggacacuucucuauucaucaauguuuguagagacauagguauga

SEQ ID NO: 147726 - RNA, 85 nt, Homo sapiens
ggaccaggaaggacguuugugaggugguagaucucauggcaugcugacggaaacgauccaguggagagggaaaaccuggugaugu

SEQ ID NO: 147727 - RNA, 51 nt, Homo sapiens
ggacacgagcacuggaugugucagcagagauguugugggugagcugguaag

SEQ ID NO: 147728 - RNA, 45 nt, Homo sapiens
aaugugugcacuacuuugaguggaggaccacugcagccugcaaga

SEQ ID NO: 147729 - RNA, 46 nt, Homo sapiens
auacaugggaagcuguugauaccaaaaauaauguacuuuauaaaau

SEQ ID NO: 147730 - RNA, 82 nt, Homo sapiens
ccccauuuuacaaaauggacaaaacauucuccccagggaagggaagaguagacauuugagaauaauuguuuucacagaaccg

SEQ ID NO: 147731 - RNA, 95 nt, Homo sapiens
cagguuuucuagaaaggcccaccuucccuuguaguuugcacacuccaggaagggcccugggucugggaggguuuucugggaccuuggugacaggg

SEQ ID NO: 147732 - RNA, 40 nt, Homo sapiens
caccugauuggccuuugugaggaaccaccaccuggcggug

SEQ ID NO: 147733 - RNA, 44 nt, Homo sapiens
cccagcuggguguuaggcuuugcggagccucugcugucugaugu

SEQ ID NO: 147734 - RNA, 31 nt, Homo sapiens
uaguagaaaacuuguuucugaggcuagugug

SEQ ID NO: 147735 - RNA, 48 nt, Homo sapiens
ggcuugaagcagcgcuuuaaauaagugcaugguuuuuuuuggagagac

SEQ ID NO: 147736 - RNA, 69 nt, Homo sapiens
uggcuuuaacagaauccuagccguaaauucucauugucucuaaaagauggaguuggauuuccaggaaaa

SEQ ID NO: 147737 - RNA, 40 nt, Homo sapiens
auuucauacguggaauguguuuuuccauugauaguauucu

SEQ ID NO: 147738 - RNA, 45 nt, Homo sapiens
cagagaaaugguggcagcuuaaacgaggucaggcugagaacaaca

SEQ ID NO: 147739 - RNA, 82 nt, Homo sapiens
cagagauaguuuuauuagcaccccuguguucagaacaugcagaaauuagucuaaggagggugaggcugaucucacgauagaa

SEQ ID NO: 147740 - RNA, 81 nt, Homo sapiens
aaacaaaguugagccuacuuugggcugaacuuggaguuugugguaggguuuaugggggggguucuuauuuuucccaugcau

SEQ ID NO: 147741 - RNA, 45 nt, Homo sapiens
aggaauuuucugaccauccuuuucuggacuguuuaggaugaugga

SEQ ID NO: 147742 - RNA, 45 nt, Homo sapiens
uuggcgaugacccuggcugcuuccacgcccacuguguugccuucc

SEQ ID NO: 147743 - RNA, 51 nt, Homo sapiens
gauguuuggguaagaaagagcacaggauuauaaucuagguaaggaauuaga

SEQ ID NO: 147744 - RNA, 45 nt, Homo sapiens
aagaugaaaauacagaagagcagugagaugucugcgauagacagg

SEQ ID NO: 147745 - RNA, 44 nt, Homo sapiens
cguguucuuccggaucuucacgaccaagauggugcuggacacca

SEQ ID NO: 147746 - RNA, 45 nt, Homo sapiens
cccugucaaccagcuccgagccggcagcgaaaccugaaguggacc

SEQ ID NO: 147747 - RNA, 56 nt, Homo sapiens
gaagugaggcuccggggaaggggcggggucggcauuuuuguccaauuagauagccg

SEQ ID NO: 147748 - RNA, 47 nt, Homo sapiens
cacccgcuucccggcugccccggcccggccgcggggcacggcgggaa

SEQ ID NO: 147749 - RNA, 43 nt, Homo sapiens
caacuggaccaagagaacuuuuuacaauauuggcaaucgaagc

SEQ ID NO: 147750 - RNA, 65 nt, Homo sapiens
caucuccaacuucuuugucuugcagaucagccagcucacaaagaacuuuagcugcaggauguucu

SEQ ID NO: 147751 - RNA, 96 nt, Homo sapiens
aaucuuacuugcaagcaagucgauagccacuaauaacugaugugggaugaauuuucuguuugacuaauucaucugcauuuuuuaggaguucugcug

SEQ ID NO: 147752 - RNA, 44 nt, Homo sapiens
ccaaugauuuuggaagacauggaugucuuagcagcauuaaucag

SEQ ID NO: 147753 - RNA, 47 nt, Homo sapiens
gggcuuucaaaauauuaacagaguugacuggauagcguggcuggccu

SEQ ID NO: 147754 - RNA, 380 nt, Homo sapiens
aaaaaacauuuuuuauuuuuuuuuuuuuuugagacggagucucacucuguagcccaggcuggagugcaguggugugaucuuggcucacugcaaucuccgccucccagguuccagugauucuccuuccucagccucccaaguagcugggacuacaggcaggugccaccaugcccagcuaauuuuuguauuuuuuaguagagaugagguuucaccauauuggacaggcugcucucaaacuccugcccucgugauccaccugacucagccucccaaagugcugggauuacaggcaugagccaccgcgcccagccaaaagaaaagcuaguuuuaaucuguagcaaucucauucuauaaaccaaaucccaaaccuuacccuggga

SEQ ID NO: 147755 - RNA, 49 nt, Homo sapiens
aagucaaggcaagcaauuuuugcauuuacgauucucuugggcaugccua

SEQ ID NO: 147756 - RNA, 49 nt, Homo sapiens
ucugucuaauuugguccaguuuuucagggucuguaaugaccaccuguac

SEQ ID NO: 147757 - RNA, 55 nt, Homo sapiens
uaucaucaauuccaccagugguuagaauaacauuggcaccaguugccaggaucuu

SEQ ID NO: 147758 - RNA, 67 nt, Homo sapiens
uuaaggucccuuuuuaaaacucuucuaacugccauagcaccagccuccacaaaauacuucagacaca

SEQ ID NO: 147759 - RNA, 49 nt, Homo sapiens
uugcagcuucaaaaguuucuucaccuuccaaauuggccaggguugacag

SEQ ID NO: 147760 - RNA, 52 nt, Homo sapiens
acacaugaaaucauuugccccacguaagauaaucgaugcagacguacgagcc

SEQ ID NO: 147761 - RNA, 68 nt, Homo sapiens
auauggaaagggcugcuucuacagcacccccaccgggaaccacagauuuugacuccaaaacucucuuc

SEQ ID NO: 147762 - RNA, 47 nt, Homo sapiens
caagaagugaucuugcaaacucugcaaucgcaagcuguucccgagac

SEQ ID NO: 147763 - RNA, 54 nt, Homo sapiens
ggguuaaccugggccucauuaugaaaagcucuuaauuuugcaaccagaucugug

SEQ ID NO: 147764 - RNA, 45 nt, Homo sapiens
cugcuuguuuguugucucgagguuuaccauugcucaaaucaagac

SEQ ID NO: 147765 - RNA, 69 nt, Homo sapiens
cagauggaaaccauuuccuacaucacaaaaacccaaguuuacagcuuguacuuuacuuuaauguguaau

SEQ ID NO: 147766 - RNA, 44 nt, Homo sapiens
ucuugugacccuguuacacacacuggagagaaugggcagaaguc

SEQ ID NO: 147767 - RNA, 46 nt, Homo sapiens
agccauguccaagcuaaagccuuacuuucuuacugauggaacggga

SEQ ID NO: 147768 - RNA, 45 nt, Homo sapiens
ggagaauugaaaauggguagguaggagaguaaucguucccaacaa

SEQ ID NO: 147769 - RNA, 46 nt, Homo sapiens
gacuccagcauugugguugcaggaggcauggaaaauaugagcaagg

SEQ ID NO: 147770 - RNA, 32 nt, Homo sapiens
cagggguguuugaaccaaccauaguuaaaguu

SEQ ID NO: 147771 - RNA, 46 nt, Homo sapiens
gauaaacauggaaguuaugaagaugcuguucacucuggagcccuua

SEQ ID NO: 147772 - RNA, 43 nt, Homo sapiens
uuguaccuugaguugaguauuacacauuaaaguaaaguacaag

SEQ ID NO: 147773 - RNA, 46 nt, Homo sapiens
gaggguggcccaaggcuauagccccuccuucaauauugaccuaacg

SEQ ID NO: 147774 - RNA, 43 nt, Homo sapiens
auggucuuuuuaaccuuuuuaaagcuaauacaguuucagccau

SEQ ID NO: 147775 - RNA, 337 nt, Homo sapiens
uucauucacaaaaagcauauuaaugaagcuaagucuuuuuguuuguuuagagaaggggucucacucugucacccaugacggagugcagugacacaaucacugcagucucaaacuccugggcucaagugauccucccaccucagccucuccaguagcugggaggcacaggccaucauaccuggcuauuuuauuuuuuguagagacggggucuugcuuuguugcccaggcuagucucaaacuucuggacucaagugauccuuccuccuccgccucccaaagugcugggauuacaggcgggagccacccugccuggccaagaagcugagucucaagcugg

SEQ ID NO: 147776 - RNA, 38 nt, Homo sapiens
cuuugccuagcuugcaggcagcgcagggcagacggcgg

SEQ ID NO: 147777 - RNA, 51 nt, Homo sapiens
uuuucauugagucauugaauuucuacucauuauccuucaaguaccacaaca

SEQ ID NO: 147778 - RNA, 35 nt, Homo sapiens
auuacuuugaauguugcuaaaaggacauuuugugu

SEQ ID NO: 147779 - RNA, 48 nt, Homo sapiens
guucagaauggcuuggacucaaguguaaauguacaggguucaguuuug

SEQ ID NO: 147780 - RNA, 46 nt, Homo sapiens
acacaccaaucaaaugacacagacuccagucaugacccucaagagg

SEQ ID NO: 147781 - RNA, 45 nt, Homo sapiens
uccagggaaugguaauaaguccuccaacagcucagaggagagaac

SEQ ID NO: 147782 - RNA, 46 nt, Homo sapiens
cucugccccaaguaccagcaggacuacagcuucugaaccuguagaa

SEQ ID NO: 147783 - RNA, 51 nt, Homo sapiens
uuaauauaauagauaauauucuugagaguuauggaagauggauguaccaga

SEQ ID NO: 147784 - RNA, 53 nt, Homo sapiens
agcauuuggaaacuauaaucuguggaaagugugacacuccuagauuggcagau

SEQ ID NO: 147785 - RNA, 49 nt, Homo sapiens
uguuugugcuuuagggaacugauuguggggcagaggguggguugaagaa

SEQ ID NO: 147786 - RNA, 61 nt, Homo sapiens
uuguacucuuuaacauuuuaauuuggggcggggagggccuguugagagcagauucauuuug

SEQ ID NO: 147787 - RNA, 46 nt, Homo sapiens
uugcacucuugauauuaaauuaaaugugccuugaaauaguugguuu

SEQ ID NO: 147788 - RNA, 43 nt, Homo sapiens
aaggguuuauuugcugagaaccaacuuucaauagucaugagag

SEQ ID NO: 147789 - RNA, 46 nt, Homo sapiens; identical to SEQ ID NO: 57471

SEQ ID NO: 147790 - RNA, 46 nt, Homo sapiens
ccaguaccucaagcaaguccagcagccgagcguugcccaacugaga

SEQ ID NO: 147791 - RNA, 63 nt, Homo sapiens
cuuuagaaauucaaauguguauuuuaaguuauaaucuugcaccugauguauuuuuaggggacu

SEQ ID NO: 147792 - RNA, 83 nt, Homo sapiens
ggaaucacagcuucagguuugucuuguuugacugaguaacgaugcuacuaggauagauccuacaaagaucaaauuuuaaaaga

SEQ ID NO: 147793 - RNA, 77 nt, Homo sapiens
gaaaaacuaaagcaacaacagcaggagucugcacgcagggaaaacauccuuguaaugcgacuagcaaccaaggaaca

SEQ ID NO: 147794 - RNA, 50 nt, Homo sapiens
aauucgccuguuauaaaaguaguuaggauggaaacuaaagacuugauuaa

SEQ ID NO: 147795 - RNA, 46 nt, Homo sapiens
acaauaugaagcauauguacaagcuuuggagggcaaguacacagau

SEQ ID NO: 147796 - RNA, 50 nt, Homo sapiens
gagugaaacagacuucaaaguuauggcaagagaugaguuaauucuaaggu

SEQ ID NO: 147797 - RNA, 43 nt, Homo sapiens
uuucuuuuuauugcuuaaaguguuccaugguguggcuguauga

SEQ ID NO: 147798 - RNA, 109 nt, Homo sapiens
gaggucauuauauuucucuucacccuuuauggcgacaucaaaugauuugaauggcugaucagcuuuuuuacgagggaauuuguaaaaacuacccaauaacucuaaugau

SEQ ID NO: 147799 - RNA, 50 nt, Homo sapiens
gaaagcauuaauauuugcagcacuuugugagacaggcaaaauuaucuuuu

SEQ ID NO: 147800 - RNA, 42 nt, Homo sapiens
guuaauuccauugcuucggaagauaaguggacgucauagauc

SEQ ID NO: 147801 - RNA, 85 nt, Homo sapiens
ugaucccaaaggauuagcuuaacauuaucaaggacuagcauaacugugauuauguaaaaaaaacaaaacaaaacaaaaaaacuau

SEQ ID NO: 147802 - RNA, 42 nt, Homo sapiens
guucucuuguagacuuccauuuuuaaaugaguauaagcauuc

SEQ ID NO: 147803 - RNA, 38 nt, Homo sapiens
cgguuucuaaguucucaaaacuuacaggugagcuucug

SEQ ID NO: 147804 - RNA, 46 nt, Homo sapiens
gcugaaauacugcauuuuuccacuagaugccuccagucaacaagau

SEQ ID NO: 147805 - RNA, 60 nt, Homo sapiens
cacuuacaaauaucagccuuucuggucaugcagcucuacaaauaaccugacucuacagau

SEQ ID NO: 147806 - RNA, 46 nt, Homo sapiens
uuuauacugaagguaguaagcgugcucccacacaucaauccccagc

SEQ ID NO: 147807 - RNA, 48 nt, Homo sapiens
acacaaagcauuuacacuaaugucagguauauaucacauguguucacu

SEQ ID NO: 147808 - RNA, 45 nt, Homo sapiens
ugucauugguaugucugucucccucuuauuacacgaaggcaagag

SEQ ID NO: 147809 - RNA, 46 nt, Homo sapiens
ccugccagugaaaaauaauuuuauuuuacauaauuugcagaccuga

SEQ ID NO: 147810 - RNA, 44 nt, Homo sapiens
cugauaguauauaggauauacccauucaccuuguagauacuuaa

SEQ ID NO: 147811 - RNA, 52 nt, Homo sapiens
accauaagaacauaaaauucacuaaucauuuugacauaugugauugaccaaa

SEQ ID NO: 147812 - RNA, 53 nt, Homo sapiens
uuguauuuucccuuggcuuauuuccugagaaacagacacacaaacacagacag

SEQ ID NO: 147813 - RNA, 46 nt, Homo sapiens
cuucgagagguuaucuuuauuaccaacaguuccucaacaucuacug

SEQ ID NO: 147814 - RNA, 43 nt, Homo sapiens
agacacaguggccuguuguaccuucuuacauccuacagcccau

SEQ ID NO: 147815 - RNA, 79 nt, Homo sapiens
aaggccugaacuaagguaacagggaaggagaaaaugaaacugaaggagguaaacuggaauuuggagacugacgaggaga

SEQ ID NO: 147816 - RNA, 45 nt, Homo sapiens
gugauggugucauuaaccagaaucaaaaaugucagugguagauua

SEQ ID NO: 147817 - RNA, 49 nt, Homo sapiens
cacuuaggaagagagccaggggauucagggugauuguguagguagcagg

SEQ ID NO: 147818 - RNA, 47 nt, Homo sapiens
uuauuaagauuuauguggauaaaauuuaguucguguuuuuugaauug

SEQ ID NO: 147819 - RNA, 29 nt, Homo sapiens
cauguaauguaacuuguggggggggagag

SEQ ID NO: 147820 - RNA, 47 nt, Homo sapiens
cauaaaauuaaaugagaaucuacuucacugauugguucuuuucacca

SEQ ID NO: 147821 - RNA, 43 nt, Homo sapiens
cauuugguaaugcaaagagugaaacuggaaggguaggcaggag

SEQ ID NO: 147822 - RNA, 42 nt, Homo sapiens
cuaguacugccaccacucaagauguaaucgaaacgcucgcgg

SEQ ID NO: 147823 - RNA, 46 nt, Homo sapiens
gauauagaugagaaaccucuaguuguacaacugaauuggaacaaag

SEQ ID NO: 147824 - RNA, 46 nt, Homo sapiens
gaacuucaagagaacucucucaaagaaagaaaagaaggaaaaaaag

SEQ ID NO: 147825 - RNA, 46 nt, Homo sapiens
aaauuuaguuaaguaugucaguuaccuaguauuguuuucagcucau

SEQ ID NO: 147826 - RNA, 46 nt, Homo sapiens
ucuaauccugaggugguuaugaaacgacggaggcagcaaaaauugg

SEQ ID NO: 147827 - RNA, 42 nt, Homo sapiens
aaaaaaaacuagaaaauuucaaguauauacaaaaaaagagaa

SEQ ID NO: 147828 - RNA, 36 nt, Homo sapiens
auggacuguagaaugaaagaauguuuggggguggaa

SEQ ID NO: 147829 - RNA, 45 nt, Homo sapiens
aaauguuugauaaagauugagacuaaagagaugagugaaggucag

SEQ ID NO: 147830 - RNA, 46 nt, Homo sapiens
uugaugaugaugaguguccuuuacaaaucuucagggaauggccaag

SEQ ID NO: 147831 - RNA, 48 nt, Homo sapiens
ugaagaggaggccaccagaccacaucccaaagaaaaccaagaaacacu

SEQ ID NO: 147832 - RNA, 51 nt, Homo sapiens
uuuaguaaaauaguuacucuaccaacaaugacaaauugguauuuaccuagg

SEQ ID NO: 147833 - RNA, 66 nt, Homo sapiens
uuggggauuucucuucuagugagaauuguuauuucgacugcuucuuucauacuuauagucucucag

SEQ ID NO: 147834 - RNA, 48 nt, Homo sapiens
acucugcugccuucagucagcauucacugacccuucuacuuuaggcaa

SEQ ID NO: 147835 - RNA, 47 nt, Homo sapiens
aaugucugaaguucaggucuggugccacuauuuuaagggugaccuaa

SEQ ID NO: 147836 - RNA, 57 nt, Homo sapiens
gaugguucugacucuagagauaagccaaagcuuuaccgccuucaguuaaguguuacu

SEQ ID NO: 147837 - RNA, 56 nt, Homo sapiens
uuugacaguuuaauuauuuuuauacgauugagggaaauccacuuuaaaaggcacua

SEQ ID NO: 147838 - RNA, 51 nt, Homo sapiens
accuuaccaacauggauggaguggucacugugacgcccagaaguauggacg

SEQ ID NO: 147839 - RNA, 80 nt, Homo sapiens
aguuuguggaccccagucaggaucaugcucuugcaaaaagaucuguggauggaggccugaugguuaagggcccaagacau

SEQ ID NO: 147840 - RNA, 70 nt, Homo sapiens
gaauuguucaggagacaacuuuugauuugggaggagauauucauagugggacagcauuaccgacaagcaa

SEQ ID NO: 147841 - RNA, 54 nt, Homo sapiens
cguuuccuccaccuuucauugguugaagcaaauacaggcccaguccagauucag

SEQ ID NO: 147842 - RNA, 78 nt, Homo sapiens
agcgacagagugucgucugccucuagcacagccgagcggggaauggugaagccgaugaucagaguagaacagcagcca

SEQ ID NO: 147843 - RNA, 46 nt, Homo sapiens
ucucuuuauucauuuuuuggugcauggagaaggugaggauggaggg

SEQ ID NO: 147844 - RNA, 47 nt, Homo sapiens
gaacacaggaugcuucugggccugagcugauacuaccugcaagcauu

SEQ ID NO: 147845 - RNA, 46 nt, Homo sapiens
auauguauuauauauggcaugccgguauguauuguccaaccaguac

SEQ ID NO: 147846 - RNA, 66 nt, Homo sapiens
uccauuccuauuaauuaaucuagagggauggacuuucaccuuauuagguaccuuuuaaguaaguag

SEQ ID NO: 147847 - RNA, 45 nt, Homo sapiens
ugaggaaagaaccugaaauaaucacugugacccuaaaaaagcaga

SEQ ID NO: 147848 - RNA, 182 nt, Homo sapiens
caaagguaggccaauuagucacgugcgaguuguucucuccagucuuucggcauugaaucagugguugucagaguggaucgugugggaguacuuuaccaccuguguauaacgugccuguucaguucuguuucugcguaggagaggaaugguguuacaugaaugaagccagugugcucacuggg

SEQ ID NO: 147849 - RNA, 42 nt, Homo sapiens
aaaacuugauucgcacagugaggagagaaagcauugcuacag

SEQ ID NO: 147850 - RNA, 52 nt, Homo sapiens
uuauuauaggugaaauaaggacccuugagguuuaaaugaggcaugauaugau

SEQ ID NO: 147851 - RNA, 54 nt, Homo sapiens
uguacuaguuuuccagaugagaggucguggaggcuuacaauagggucguggcag

SEQ ID NO: 147852 - RNA, 51 nt, Homo sapiens
ucaguucaugaaguuguuguggucccggaaaugaaaaugugguucucuguu

SEQ ID NO: 147853 - RNA, 40 nt, Homo sapiens
agagggaagagauagauguggucuguuggguuuguauuuu

SEQ ID NO: 147854 - RNA, 67 nt, Homo sapiens
ucugauacgcugaaauugcauugaagggcacaaaggcuggacauagcagugugggcgcuguacugca

SEQ ID NO: 147855 - RNA, 86 nt, Homo sapiens
ccuuucuggaguuaucuauaauauuguguucucaauuuuaauggcucuuuugcuuuucuuuuuuuuuucuuuugguuggaaaucag

SEQ ID NO: 147856 - RNA, 41 nt, Homo sapiens
uugcuaguaccuaucauuacucauaacaaacauacuaugaa

SEQ ID NO: 147857 - RNA, 35 nt, Homo sapiens
uuuaugauuuuaaaaagggaguuuuguuauuacag

SEQ ID NO: 147858 - RNA, 48 nt, Homo sapiens
auuacuaauauuauugcuaaacauuuuucuugucagagaugauaauaa

SEQ ID NO: 147859 - RNA, 42 nt, Homo sapiens
uaugugaagucgguugugaaaggaggugcugcagaugugguc

SEQ ID NO: 147860 - RNA, 94 nt, Homo sapiens
aguccuggagggaaaagugcauaugccucuggaacaacagcgaagauaacaucugucucuacuggaaaccucugcacugaggucugauugauug

SEQ ID NO: 147861 - RNA, 45 nt, Homo sapiens
uagaccugaagccuaccccauccccacucagacguacaccagaga

SEQ ID NO: 147862 - RNA, 44 nt, Homo sapiens
agaaccaguggccaaauuaugaggaaaagccacauaugcacaca

SEQ ID NO: 147863 - RNA, 50 nt, Homo sapiens
agaagauaaagcuuaccaacuugagcggcaucgaauagaggcagcuaugg

SEQ ID NO: 147864 - RNA, 27 nt, Homo sapiens
ggucaccccugcuuccacacugaccaa

SEQ ID NO: 147865 - RNA, 46 nt, Homo sapiens
gagagaagaacaucagcguugguaugagaaggagaaggcccgccug

SEQ ID NO: 147866 - RNA, 64 nt, Homo sapiens
ucaugcuggaguggcaguuccagaagagacuccaggagucgaagcagaaggacgaagaugacga

SEQ ID NO: 147867 - RNA, 50 nt, Homo sapiens
accaggagcuauuaggucagacauuuuaaucuuucuaccucacaaugaaa

SEQ ID NO: 147868 - RNA, 71 nt, Homo sapiens
acgaggagcggaggcggcagcagcaguuagaagagaugcgcaagcgggaagcggaagaccgagcgaggcaa

SEQ ID NO: 147869 - RNA, 52 nt, Homo sapiens
gaggaagagcgccggcggcaggaggaggagcgaacaaaacgagacgcugaag

SEQ ID NO: 147870 - RNA, 53 nt, Homo sapiens
cucauggggaccuucuuccugccccucuuaaaccacggccaccccccugccag

SEQ ID NO: 147871 - RNA, 52 nt, Homo sapiens
uugaagguuuaauauauaauaauauuuagguugagucacuuuggaagccagg

SEQ ID NO: 147872 - RNA, 29 nt, Homo sapiens
cuggggccccugaaaacuugacauucaag

SEQ ID NO: 147873 - RNA, 70 nt, Homo sapiens
aaaugaggagaacacuuuguauuuaccccaaaaucuuuucaguuguggguuuguaggugcgaguuugaag

SEQ ID NO: 147874 - RNA, 48 nt, Homo sapiens
aguuuuuuguugguuucuuuuuuggaguccugaguucaaaggggacag

SEQ ID NO: 147875 - RNA, 51 nt, Homo sapiens
ugaggacacuggcagccuuauggugacuaaauccacacuuucuuuaaagag

SEQ ID NO: 147876 - RNA, 53 nt, Homo sapiens
ugugaaacccauacacaaguggauuuggccaucuuugggcagugaggucaaau

SEQ ID NO: 147877 - RNA, 46 nt, Homo sapiens
aaacugcuguaguuuuccauuucuacuguauuucaguugcaaccua

SEQ ID NO: 147878 - RNA, 41 nt, Homo sapiens
aucguauagguugaugaaacgucauguguuuugccaaagac

SEQ ID NO: 147879 - RNA, 39 nt, Homo sapiens
uuuugauaaaauuaauuuuguuguuuccuuugagguuga

SEQ ID NO: 147880 - RNA, 55 nt, Homo sapiens
cugucugaugauggauagggggcaaaucuuuuuccccuuucuguuaauagucauc

SEQ ID NO: 147881 - RNA, 106 nt, Homo sapiens
uuuguuuuuguuuuuguuuuuuuuguugguugguuuguuuuuuugcuuuaaguugcaugaucuuucugcaggaaauagucacucaucccacuccacauaagggguu

SEQ ID NO: 147882 - RNA, 46 nt, Homo sapiens
acgcugaaaagaaucagcauuuagucuugccaggcacacccaauaa

SEQ ID NO: 147883 - RNA, 76 nt, Homo sapiens
agguuccaucauaaacuccucauuauucucuauguauucuguuacagcuucuagcaugcuucaucgugacaaccua

SEQ ID NO: 147884 - RNA, 43 nt, Homo sapiens
acacauauguaguauaauuucuagaaacaaacaucuaauaagu

SEQ ID NO: 147885 - RNA, 45 nt, Homo sapiens
guugcuuuuaccugauuugaugauacauuucauuaagguuccagu

SEQ ID NO: 147886 - RNA, 63 nt, Homo sapiens
acgaacucuccucuuguccuacaaugaaagcccucaugugcaguagagaugcaguuucaucaa

SEQ ID NO: 147887 - RNA, 72 nt, Homo sapiens
guugcucuacaaugacacacaaaucccauuaaauaaauuauaaacaagggucaauucaaauuugaaguaaug

SEQ ID NO: 147888 - RNA, 52 nt, Homo sapiens
uuuacauauaaaauguaauuacuuauuguauuuauguguauauggaguugaa

SEQ ID NO: 147889 - RNA, 42 nt, Homo sapiens
gaggaaaccaguuuggugauauaugagacuuuauguggagug

SEQ ID NO: 147890 - RNA, 47 nt, Homo sapiens
uauccucugaaggcacuuggguuugggguugcuggcaggaggugaag

SEQ ID NO: 147891 - RNA, 112 nt, Homo sapiens
uggucccuagacaccucaguucauugugguccuuguggcuucucucucuagcagcaccuccugucccuugaccuuaacucugaugguucuucaccuccugccagcaacccca

SEQ ID NO: 147892 - RNA, 34 nt, Homo sapiens
gcaggcaggcaggaaggaaagaaggaaggaagga

SEQ ID NO: 147893 - RNA, 102 nt, Homo sapiens
cuuagugcaugaaggaaaacaggucauggcagacucaggaccuaucuaugaccaaaccuacgcuggcgggcggcugggucuauuugucuucucucaagaaau

SEQ ID NO: 147894 - RNA, 36 nt, Homo sapiens
cucuaaagcccuugccugggugacuguaagugaacu

SEQ ID NO: 147895 - RNA, 45 nt, Homo sapiens
ggccuauagguggcaccugacucacaggcccaagacuggcuacau

SEQ ID NO: 147896 - RNA, 44 nt, Homo sapiens
ggcgugucccucaagguggugaacuccaccacggggacgggcga

SEQ ID NO: 147897 - RNA, 46 nt, Homo sapiens
uguggacuucaguggcacauucuacguaaacacugaccgggacgac

SEQ ID NO: 147898 - RNA, 42 nt, Homo sapiens
cccggucaguguuuacguagaaugugccacugaaguccacag

SEQ ID NO: 147899 - RNA, 72 nt, Homo sapiens
ggaucccaaagggaccacccaaauugaucccaacugggucauucgccaucaaggcaaggagcugguucagac

SEQ ID NO: 147900 - RNA, 50 nt, Homo sapiens
ugauuuugacaaugacaacaucccagauauugaugauguguguccugaaa

SEQ ID NO: 147901 - RNA, 72 nt, Homo sapiens
gauggcguccccgaugacagggacaacugccggcuuguguucaacccagaccaggaggacuuggacgguggg

SEQ ID NO: 147902 - RNA, 53 nt, Homo sapiens
guugucccugucaucggggacgccaucguugucaucaucagggucacaggcgu

SEQ ID NO: 147903 - RNA, 92 nt, Homo sapiens
cagugugacaacaacgaggacauagaugacgacggccaccagaacaaccaggacaacugccccuacaucuccaacgccaaccaggcugacca

SEQ ID NO: 147904 - RNA, 51 nt, Homo sapiens
aucuauguccucguuguugucacacugguccccaacaaggucauuguccac

SEQ ID NO: 147905 - RNA, 47 nt, Homo sapiens
ucaggguugugcaccagggggcaguugucacagugaucccccacacc

SEQ ID NO: 147906 - RNA, 46 nt, Homo sapiens
cgagacaauugucccuacgucuacaacacugaccagagggacacgg

SEQ ID NO: 147907 - RNA, 46 nt, Homo sapiens
aacaauggagagggugacgccugcuccguggacauugauggggacg

SEQ ID NO: 147908 - RNA, 68 nt, Homo sapiens
cauuguugucugugucgaucugggcaggguugugcacguaagggcaguugucacagcgguccccaacc

SEQ ID NO: 147909 - RNA, 71 nt, Homo sapiens
ccucuucaauccccgccaggcugacuaugacaaggaugagguuggggaccgcugugacaacugcccuuacg

SEQ ID NO: 147910 - RNA, 83 nt, Homo sapiens
ccccaucugccaaauucugggcaggaagacuuugacaaggacgggauuggcgaugccugugaugaugacgaugacaaugacgg

SEQ ID NO: 147911 - RNA, 46 nt, Homo sapiens
ccguccuugucaaagucuuccugcccagaauuuggcagaugggggc

SEQ ID NO: 147912 - RNA, 46 nt, Homo sapiens
caaagcuuauaaacguuuaacccucaccagucaaaaaaucucaaag

SEQ ID NO: 147913 - RNA, 53 nt, Homo sapiens
acuggacugaaaugaaaggaguuuuugcccaauuacaugcauuacccacucac

SEQ ID NO: 147914 - RNA, 49 nt, Homo sapiens
cuggcccaaccucaaucuggucugcgccaccaacgccaccuaccacugc

SEQ ID NO: 147915 - RNA, 53 nt, Homo sapiens
gguagguggcguugguggcgcagaccagauugagguugggccagccguccagg

SEQ ID NO: 147916 - RNA, 69 nt, Homo sapiens
accugggccacuucagcgaccccauguacaagugcgagugccagacaggcuacgcgggcgacgggcuca

SEQ ID NO: 147917 - RNA, 43 nt, Homo sapiens
acgaggugggugaccccgcccugggcugugggcgcccugaggu

SEQ ID NO: 147918 - RNA, 41 nt, Homo sapiens
cagauggcuguuuauccaaccccugcuucccgggagcccag

SEQ ID NO: 147919 - RNA, 42 nt, Homo sapiens
cgggagcgcacccgggucugcaacagcccugagccucaguac

SEQ ID NO: 147920 - RNA, 67 nt, Homo sapiens
ccagauggggggcaagaauugcaaagggaguggccgggagaccaaagccugccagggcgccccaugc

SEQ ID NO: 147921 - RNA, 64 nt, Homo sapiens
caugcucugugaccuguggaguuggcaauaucacacgcauccgucucugcaacuccccagugcc

SEQ ID NO: 147922 - RNA, 42 nt, Homo sapiens
caggucacagagcaugaagaccaaggugaccaguggcuccag

SEQ ID NO: 147923 - RNA, 71 nt, Homo sapiens
guccugugacgucaccagcaacaccugcuuggggcccuccauccagacacgggcuugcagucugagcaagu

SEQ ID NO: 147924 - RNA, 42 nt, Homo sapiens
ggauggagggccccaagcagguguugcuggugacgucacagg

SEQ ID NO: 147925 - RNA, 74 nt, Homo sapiens
gagggcuggucuccgugggcagaguggacccagugcuccgugacguguggcucugggacccagcagagaggccg

SEQ ID NO: 147926 - RNA, 51 nt, Homo sapiens
aaaaccauuugccaccaaaucaccugcccgccugcaaccugcgccagucca

SEQ ID NO: 147927 - RNA, 78 nt, Homo sapiens
cagcuugcuggcaggauggccgguucuuugcggaaaaugaaacgugggugguggacagcugcaccacguguaccugca

SEQ ID NO: 147928 - RNA, 49 nt, Homo sapiens
acguggugcagcuguccaccacccacguuucauuuuccgcaaagaaccg

SEQ ID NO: 147929 - RNA, 59 nt, Homo sapiens
gaaugauaaccaguuucucugggagcucauugguggcccuccuaagacaaggaacaugu

SEQ ID NO: 147930 - RNA, 73 nt, Homo sapiens
aggagcugggaaacaugguccaggagcucucggggcuccacguccucgugaaccagcucagcgagaaccucaa

SEQ ID NO: 147931 - RNA, 75 nt, Homo sapiens
uggguccgcaugucaccaccgaguacgugggccccagcucggagaggaggcccgaggugugcgaacgcucgugcg

SEQ ID NO: 147932 - RNA, 46 nt, Homo sapiens
uuugcuucagaacguccaccuaguguuugaaaacucuguggaagau

SEQ ID NO: 147933 - RNA, 47 nt, Homo sapiens
gugcgugucuguguguguguguugcgugguguguguacaugugugau

SEQ ID NO: 147934 - RNA, 45 nt, Homo sapiens
cgcucuggacgagcccuucuacgagcaccugcaggcggaaaagag

SEQ ID NO: 147935 - RNA, 45 nt, Homo sapiens
ggccccgcggacacgcuggaucucaccuacuggauugacggcacc

SEQ ID NO: 147936 - RNA, 64 nt, Homo sapiens
cgcuuugacuacaucccaccggugaacgcagaugaccucagcaagaucaccaagaucaugcggc

SEQ ID NO: 147937 - RNA, 45 nt, Homo sapiens
gacaaagacacgaccuucgaccuuuucaguaucagcaacaucaac

SEQ ID NO: 147938 - RNA, 50 nt, Homo sapiens
caucacuaacaaggguuuccuguauucccaggagcucagcugcaggaggc

SEQ ID NO: 147939 - RNA, 43 nt, Homo sapiens
uuucaguguuccggaccgagucagaaaggcgcaggcucugcug

SEQ ID NO: 147940 - RNA, 51 nt, Homo sapiens
ccggagcauccugcacugcagggccggucucucgcuccagcagagccugcg

SEQ ID NO: 147941 - RNA, 33 nt, Homo sapiens
cuaucccgagugugaauaacucuggggcaccac

SEQ ID NO: 147942 - RNA, 37 nt, Homo sapiens
cuauauuaaaaucucauaaagggcacaugaucaagag

SEQ ID NO: 147943 - RNA, 46 nt, Homo sapiens
aacccagaagagccuuguguggaagcugugcuugccaagccagggu

SEQ ID NO: 147944 - RNA, 63 nt, Homo sapiens
cugcuuaauacagugauauguuucugcuuaucauaucauugucuuuuuacauuuuauuuagau

SEQ ID NO: 147945 - RNA, 54 nt, Homo sapiens
gauuuugaagcuaaaauugaauauuacuaguguagucaccagagugaugacugg

SEQ ID NO: 147946 - RNA, 37 nt, Homo sapiens
uugugcucaguugguccauccugaacuguugccuaag

SEQ ID NO: 147947 - RNA, 46 nt, Homo sapiens
auuggcaucacucccccagcauguuuccaucuuuuuucaguugauc

SEQ ID NO: 147948 - RNA, 21 nt, Homo sapiens
gucuuagaaugagugaaacau

SEQ ID NO: 147949 - RNA, 31 nt, Homo sapiens
gcagcaguuuucugaccucuuuucccuaaaa

SEQ ID NO: 147950 - RNA, 89 nt, Homo sapiens
cucagauucguugaugacugucugcuaucaguuuuuaagguaauuuauagggaagaaaaucauuaauuagauuaacucauucagcuaug

SEQ ID NO: 147951 - RNA, 45 nt, Homo sapiens
uugugcuaccacgaaggugccaaaugccacgucaugcuuucagaa

SEQ ID NO: 147952 - RNA, 23 nt, Homo sapiens
gauggaggaaugggguggaugga

SEQ ID NO: 147953 - RNA, 54 nt, Homo sapiens
uucucuuaaaauaaguaaaauuccaaggauauaugccccaacgaaugcugcuga

SEQ ID NO: 147954 - RNA, 65 nt, Homo sapiens
cggacucgggcuguucaacuucaaaagacaccaaguaccagucgguguacgucauauccgaggag

SEQ ID NO: 147955 - RNA, 48 nt, Homo sapiens
caaggcccgcuacccagcgguggacuauaaccucgugcaggaccucaa

SEQ ID NO: 147956 - RNA, 45 nt, Homo sapiens
gggggagacggagaccaugaacaaccuggccaacugccagcguga

SEQ ID NO: 147957 - RNA, 45 nt, Homo sapiens
ccguccgcacaggucauggcacucaauucacagauuuugccguag

SEQ ID NO: 147958 - RNA, 46 nt, Homo sapiens
ucacacucgucaauccccagcucgcagguggcaccuguguacccag

SEQ ID NO: 147959 - RNA, 23 nt, Homo sapiens
cagccuuccuggcaguugcacug

SEQ ID NO: 147960 - RNA, 45 nt, Homo sapiens
guacuuggcguggggcuugacccuguuuuuccuuugcuuguagcg

SEQ ID NO: 147961 - RNA, 31 nt, Homo sapiens
ugggagagaggggagaagacguuagacaacc

SEQ ID NO: 147962 - RNA, 59 nt, Homo sapiens
uacaggauauuacguuguuuuuuuaauuagagagagagagagaaugcaggcaggauggg

SEQ ID NO: 147963 - RNA, 43 nt, Homo sapiens
ccggccucugugccaggucuccagucagaggcgccccuucacg

SEQ ID NO: 147964 - RNA, 66 nt, Homo sapiens
gggcagaaaagcgcccuugccucgccccagaccgcaggacccaggacuucuuucuuuaaaagccgg

SEQ ID NO: 147965 - RNA, 41 nt, Homo sapiens
gagugcguuuuguguggugagggaggaagggggggcugggg

SEQ ID NO: 147966 - RNA, 54 nt, Homo sapiens
ggaagcagccuggccacaguguccucacuguagguguguuagagcugccuuauu

SEQ ID NO: 147967 - RNA, 43 nt, Homo sapiens
uggcuagggggcugauggcgucuaaaggcgugucguccccucc

SEQ ID NO: 147968 - RNA, 35 nt, Homo sapiens
aauaaagaagaagaagaaggggacguagaccaugc

SEQ ID NO: 147969 - RNA, 62 nt, Homo sapiens
uacaggaaaacaaucaaaaccaugggaguagguaaggacccacaagagaguaggcagaacac

SEQ ID NO: 147970 - RNA, 47 nt, Homo sapiens
gaauucuaccuucuucaucaaguccaccgaugauguuguaaacauag

SEQ ID NO: 147971 - RNA, 59 nt, Homo sapiens
aucucucuugauucucaccaaaaacuaugaagcuacuaaggaagauaaggaaauuuagg

SEQ ID NO: 147972 - RNA, 47 nt, Homo sapiens
uuagaagcagauucacccagaucugugcccgccuguuuugcugccaa

SEQ ID NO: 147973 - RNA, 45 nt, Homo sapiens
gcgcuuaagauauaauacacaccacuuuauuugcagggucucccg

SEQ ID NO: 147974 - RNA, 71 nt, Homo sapiens
aguccaaugaugccuuauggcacuggacugaccccacagccuauucagaacaccaauagucugucuauuuu

SEQ ID NO: 147975 - RNA, 46 nt, Homo sapiens
uguuguuuuucuaauuuauaacuccuagggguuauuucugugccag

SEQ ID NO: 147976 - RNA, 49 nt, Homo sapiens
gguccuuccuuccuuucucuucugccucuuuccccaagauaacgaccag

SEQ ID NO: 147977 - RNA, 60 nt, Homo sapiens
ccaaugacagcuugccuggguaugccaaaauaccugcaagaauguccacaucaucuggug

SEQ ID NO: 147978 - RNA, 46 nt, Homo sapiens
ucccuauaaucucugaguaaucuuccuuuuccacaaccucaggcau

SEQ ID NO: 147979 - RNA, 410 nt, Homo sapiens
gcagugacauacugcggcugaucaagguagcggagagccagagcuccucccggggcgugggguggagguggcuccguuucccagaguggggugauucacgucuugaggucucggccggugugagagcccagccuguuccccuuucugcgcccauccccggcucggccgccaccccgcccgcccgccccauuccguuccccugagcuggccgggccggagccucauuuuguuuucuacuuuuuucucuccuaugugcauccccccaggagcuggcuaaauaugaauacauggaagaacaaguaaucuuaacugaaaaagguaauucaacaguggcgggacgggggacaagcguucggugccugucaccuucgccaaggccauuaccgccccugcucccccuucuugcagau

SEQ ID NO: 147980 - RNA, 46 nt, Homo sapiens
acuccuccgauguccugguuuauguuaccagcaaugacacuaaggu

SEQ ID NO: 147981 - RNA, 46 nt, Homo sapiens
ucucuguucccucucuuuugaaaguguaaaauaaaaccaaaaauag

SEQ ID NO: 147982 - RNA, 45 nt, Homo sapiens
uguuccaguuccuuucgaaugcaugaaaggacucacacuggggag

SEQ ID NO: 147983 - RNA, 46 nt, Homo sapiens
aggagcagcugcgagccgaccaugucuucauuugcuuccacaagaa

SEQ ID NO: 147984 - RNA, 30 nt, Homo sapiens
ucccgggcggcgcgcugcccgaggggagca

SEQ ID NO: 147985 - RNA, 44 nt, Homo sapiens
ugcgaacggcgagcagcggcggcggcgcggagagacgcagcgga

SEQ ID NO: 147986 - RNA, 125 nt, Homo sapiens
gagugaaccccaugauaaggacuaccuauauuguguaauuauguaauaggauaugcgaugugagucacacugguucuugcauuauguuaaggcuucaaguuuuggauuuuuaaaauuaaucuuaa

SEQ ID NO: 147987 - RNA, 82 nt, Homo sapiens
agcacacucauuccuuagugucucugacagaaguaggggucaaaaguaagaguguuagaggacgggggaggcagagacaaag

SEQ ID NO: 147988 - RNA, 62 nt, Homo sapiens
uuuguaaaguucaccaagaaaugacuuagucauuaaauaugacauuccggucucaguugaau

SEQ ID NO: 147989 - RNA, 62 nt, Homo sapiens
aaucauuguuugacuagcugcccuuagcuuucaauaugaacuugccccagaauucugcuccc

SEQ ID NO: 147990 - RNA, 42 nt, Homo sapiens
aaacacuuucuucuaggcaaguaguugagucuguuggaaacc

SEQ ID NO: 147991 - RNA, 92 nt, Homo sapiens
aaccucguuucgaaauuugaaaaacaaacgcgauuaucauaaacauaggcacaaugugucauggcuauauuuaucucgucucucugccauga

SEQ ID NO: 147992 - RNA, 38 nt, Homo sapiens
agucaugcauuuuuuagccaaauaauacaugugucuca

SEQ ID NO: 147993 - RNA, 48 nt, Homo sapiens
gaaauuuccaguuccaaagccaauugauuacaaucgucaugcaguggu

SEQ ID NO: 147994 - RNA, 39 nt, Homo sapiens
gcuguaaagaucaaagaaagguaguaguagaaaagagau

SEQ ID NO: 147995 - RNA, 60 nt, Homo sapiens
gauacaccauguugaagauccugcaucaguauaugaugaagcuauggaacuaauugucaa

SEQ ID NO: 147996 - RNA, 65 nt, Homo sapiens
acuugcaaaucaugggcugauucauggagauuuuaaugaauuuaaucucauuuuggaugaaagug

SEQ ID NO: 147997 - RNA, 56 nt, Homo sapiens
gagauguuaaaugcauuaaagauuucuuuaugaaacguuucagcuacgaaagugag

SEQ ID NO: 147998 - RNA, 116 nt, Homo sapiens
aggagagaagacacucuugauguggagguuucugccaguggcuacacaaaggaaaugcaggcagaugaugaacugcuucauccauuagguccagaugauaaaaauauugaaacaaa

SEQ ID NO: 147999 - RNA, 48 nt, Homo sapiens
auuuucagauggagaaguggcagaaaaagcagagguuuacgggucaga

SEQ ID NO: 148000 - RNA, 34 nt, Homo sapiens
aucaucuggagacccugaacaaauaaaggaagac

SEQ ID NO: 148001 - RNA, 46 nt, Homo sapiens
ucuaauugccuugucgucauuaaauagagaauucaggccuuucagg

SEQ ID NO: 148002 - RNA, 60 nt, Homo sapiens
agcaacguagggaaaacaugcaaaauaucaaaucaaguuuggaagcagccagcuuuuggg

SEQ ID NO: 148003 - RNA, 49 nt, Homo sapiens
ggauauguuuaauauauuuuuuaaaguuacuguaauuccuuuuugagcc

SEQ ID NO: 148004 - RNA, 44 nt, Homo sapiens
auaugcuacaaugcacauaaagcaauuagaacaauguuuagcac

SEQ ID NO: 148005 - RNA, 48 nt, Homo sapiens
agccauggucccuuccucaaggacuuuauaauucagugagauguaaag

SEQ ID NO: 148006 - RNA, 54 nt, Homo sapiens
acagaauguuuauuuuggagucauuuucuuauauucagagcuaugaaagcaaau

SEQ ID NO: 148007 - RNA, 73 nt, Homo sapiens
agguuugggugaauaggugaacuaaaaaagaaaacuuucaaagaggaaaucaugcagaaaauucagaagacag

SEQ ID NO: 148008 - RNA, 23 nt, Homo sapiens
ucaauuuguggacaaauaggucc

SEQ ID NO: 148009 - RNA, 59 nt, Homo sapiens
aucuacccccgacugugagucaccaaagucaugcacgcaccaugcucuuuagagccaaa

SEQ ID NO: 148010 - RNA, 27 nt, Homo sapiens
uccagaauccugcccaggccccaggga

SEQ ID NO: 148011 - RNA, 33 nt, Homo sapiens
ugaggccuagagagguuaagaaacucgccccca

SEQ ID NO: 148012 - RNA, 80 nt, Homo sapiens
caggcaaguuggagugcguaugagguugaggacaggauucgggcuggagaugggauuggagauagugcugagauugagau

SEQ ID NO: 148013 - RNA, 45 nt, Homo sapiens
cugaguuugguguggggagugagguuggaaaaaggauauggauga

SEQ ID NO: 148014 - RNA, 49 nt, Homo sapiens
ucagcgguccucuagguaagcaggggcagagauugggagggcuguggau

SEQ ID NO: 148015 - RNA, 151 nt, Homo sapiens
guacuccucaggcucuagaaagucaucugcugggaggugggagagugaacagcacgcaggcagcuagucggcaggugccaagccccaccccacccccuggcaggcacccaccugcugcccccaggucuuccagggaauccuccaggugguc

SEQ ID NO: 148016 - RNA, 42 nt, Homo sapiens
acugggcgucugaucauucuugagauccacguuaguccggga

SEQ ID NO: 148017 - RNA, 53 nt, Homo sapiens
uuugacuuuuaaagaauuaauuauauugacugagagagaggcccaggagagaa

SEQ ID NO: 148018 - RNA, 43 nt, Homo sapiens
uggagcaagggaaggagccuuucacuuuggagagccaaguaca

SEQ ID NO: 148019 - RNA, 46 nt, Homo sapiens
ggaaagccaagacauugaaggauguuccuucagggaaguccagaaa

SEQ ID NO: 148020 - RNA, 46 nt, Homo sapiens
uggcaaagccuuuagaacacguucaaaccuaacuacccaucaggug

SEQ ID NO: 148021 - RNA, 46 nt, Homo sapiens
agagcucguucaagcuuagcuauccaucaggcaacccacaguggag

SEQ ID NO: 148022 - RNA, 70 nt, Homo sapiens
aagauaaagcuuaccaacuugagcggcaucgaauagaggcagcuauggaccgaaagucugauagugauau

SEQ ID NO: 148023 - RNA, 45 nt, Homo sapiens
guggcugcugcugaacggagaaagagagaagaacaucagcguugg

SEQ ID NO: 148024 - RNA, 47 nt, Homo sapiens
uuccagaagagacuccaggagucgaagcagaaggacgaagaugacga

SEQ ID NO: 148025 - RNA, 41 nt, Homo sapiens
cccagguaggugaaagcgaaugaagaagaggaugacauaga

SEQ ID NO: 148026 - RNA, 46 nt, Homo sapiens
auguggcaaagcuuuuagccaguccucaacccuuagaaaacaugag

SEQ ID NO: 148027 - RNA, 46 nt, Homo sapiens
acccuuaaaaaacauaagauaauucauacuggaaagaaacccuaca

SEQ ID NO: 148028 - RNA, 46 nt, Homo sapiens
aaacauaagauaauucauacuggggagaaaccauacaaaugugaag

SEQ ID NO: 148029 - RNA, 45 nt, Homo sapiens
guccucaacccuuagaaaccaucagauaauucauacuggagagaa

SEQ ID NO: 148030 - RNA, 46 nt, Homo sapiens
gcaauccucacaccuuacuagacauaaagcaauucauacuggagag

SEQ ID NO: 148031 - RNA, 45 nt, Homo sapiens
aauuuauuugaccaaaauguagaaaaagugauacuauuacauaug

SEQ ID NO: 148032 - RNA, 94 nt, Homo sapiens
cugccuccuccagcuucugcggggccguggccagucuuuccugagcccuguccaacuucuccucaacgagcuggaugcgucgguugagggcggc

SEQ ID NO: 148033 - RNA, 45 nt, Homo sapiens
gguaaagucuucgcucaaacaucacaacuugcaaggcauuggaga

SEQ ID NO: 148034 - RNA, 42 nt, Homo sapiens
caacccuuaguuaucauaagaaaauucauacuguagagaaac

SEQ ID NO: 148035 - RNA, 42 nt, Homo sapiens
acauucucaauccuuacuaaacauaagguaauucauacugga

SEQ ID NO: 148036 - RNA, 38 nt, Homo sapiens
ucaaaccuuauggaacauaagagaauucauacuggaga

SEQ ID NO: 148037 - RNA, 46 nt, Homo sapiens
caacugguccucaaaccuuauggaacauaagaaaauucacacugga

SEQ ID NO: 148038 - RNA, 49 nt, Homo sapiens; identical to SEQ ID NO: 57980

SEQ ID NO: 148039 - RNA, 41 nt, Homo sapiens
aaucaauucauacuggagagaaacccuacaaaugugaagaa

SEQ ID NO: 148040 - RNA, 53 nt, Homo sapiens
gaagaauguggcaaagcuuuuaagcauuucucagcccuuagaaaacaugagau

SEQ ID NO: 148041 - RNA, 46 nt, Homo sapiens
guggcaaagcuuuuagccaguccucaacucuuagaaaacaugagau

SEQ ID NO: 148042 - RNA, 46 nt, Homo sapiens
gcauuucucagcccuuagaaaacauaagauaauucauacuggaaag

SEQ ID NO: 148043 - RNA, 45 nt, Homo sapiens
guacauaagguaauucauauggaagagaaaccuugcaaaugugaa

SEQ ID NO: 148044 - RNA, 46 nt, Homo sapiens
gguccucaaaacuuacuguacauaagguaauucauacugcagagaa

SEQ ID NO: 148045 - RNA, 48 nt, Homo sapiens
gccgucuggagcaaagacaggagcccuggaaugugaagagacaugaga

SEQ ID NO: 148046 - RNA, 45 nt, Homo sapiens
gggcugcucagccucagccucaaccagcagccugccgcgccugag

SEQ ID NO: 148047 - RNA, 45 nt, Homo sapiens
ugucagcuggccagggccgcugcgucaaccaguggcagcugagcg

SEQ ID NO: 148048 - RNA, 44 nt, Homo sapiens
aggucuguggagggggcccagcccucacccucuggcaccuccga

SEQ ID NO: 148049 - RNA, 48 nt, Homo sapiens
ugcgcacagccaaggagguccagacgaucgaggucuauaagcacgagg

SEQ ID NO: 148050 - RNA, 42 nt, Homo sapiens
ccugcuuaccccaaagucgaacagcuccauccucgccaccug

SEQ ID NO: 148051 - RNA, 46 nt, Homo sapiens
agaggugcugucagguggcgaggauggagcuguucgacuuuggggu

SEQ ID NO: 148052 - RNA, 42 nt, Homo sapiens
gcaguggauguagucuguguggccccggaggacccucugcau

SEQ ID NO: 148053 - RNA, 44 nt, Homo sapiens
ucccaguuucaagguccauagugugcaacugacagucuccccca

SEQ ID NO: 148054 - RNA, 42 nt, Homo sapiens
caccgcagcccccuuaagccggauacccucccccaccccgag

SEQ ID NO: 148055 - RNA, 39 nt, Homo sapiens
gcucccuggggagagauggcagagaggcaggcugggaua

SEQ ID NO: 148056 - RNA, 46 nt, Homo sapiens
ugagugggggcagggcuggggagaaggucaugggggggcugcagua

SEQ ID NO: 148057 - RNA, 73 nt, Homo sapiens
agcugagcaccucccaccagguccagguccccaggggcuccuggguucccagcacuuuccaaagagccaagau

SEQ ID NO: 148058 - RNA, 44 nt, Homo sapiens
uguuguggggaagaaggaaggugggaggggcacuguccaccagc

SEQ ID NO: 148059 - RNA, 49 nt, Homo sapiens
acuccccaaagcggggaggagauauuuauuuuggggagaguuuggaggg

SEQ ID NO: 148060 - RNA, 51 nt, Homo sapiens
ccucacgcuggcucacacaaaacagcugacacugacuaaggaacugcagca

SEQ ID NO: 148061 - RNA, 54 nt, Homo sapiens
gagcggggccgagagcuuugcaucugggaaaucauucgggaggaggugggagcu

SEQ ID NO: 148062 - RNA, 42 nt, Homo sapiens
cacguuauucgagccggccgacccugaccucagaccccagaa

SEQ ID NO: 148063 - RNA, 49 nt, Homo sapiens
ccacaaguccgaaguacuucgaauggagagagaaagugagugagggcgg

SEQ ID NO: 148064 - RNA, 48 nt, Homo sapiens
gccggggcgcccucggacagagucuuuuucaugcagugcaugaaaaag

SEQ ID NO: 148065 - RNA, 45 nt, Homo sapiens
cagugcagcuccuucaaccucgccauggccucugccggaaugcag

SEQ ID NO: 148066 - RNA, 41 nt, Homo sapiens
gcagcuuggggucuggcuccagcaucaugacaaggacagaa

SEQ ID NO: 148067 - RNA, 44 nt, Homo sapiens
ggcccaggggcuguagccagcuggcagggugagccagcccaugc

SEQ ID NO: 148068 - RNA, 80 nt, Homo sapiens
uucaaauacuuuuuauuagacacggccaggcagagaagaccaugggaguucccgaggggccccagcuuucaagggcgacg

SEQ ID NO: 148069 - RNA, 57 nt, Homo sapiens
cucuggggucacgucuugcucugagaguucaaguccugccaggccgccagcccagag

SEQ ID NO: 148070 - RNA, 42 nt, Homo sapiens
gcgccugcuggacugggccagcucgccgccgcaccugcaguu

SEQ ID NO: 148071 - RNA, 46 nt, Homo sapiens
cuucccgcgcugcggccccacugaggaggaggcucggggacagcag

SEQ ID NO: 148072 - RNA, 47 nt, Homo sapiens
agaggggguuuaauuuaacuuggaaggagcacagaaaggaaagugug

SEQ ID NO: 148073 - RNA, 55 nt, Homo sapiens
gcagcugacuuuuaacaagcugaacuaaaaggucacaugauguugggguggccag

SEQ ID NO: 148074 - RNA, 39 nt, Homo sapiens
aggcugggcaguuucucccucuggcgccgggccuccagg

SEQ ID NO: 148075 - RNA, 69 nt, Homo sapiens
gcagugcacuuccuggggcuuggaucccaccccauccucaucuuggucggaggcugugagcagcaccag

SEQ ID NO: 148076 - RNA, 46 nt, Homo sapiens
gaggcggcggccccaggcccgagggacucgggagcucgagcagcgg

SEQ ID NO: 148077 - RNA, 44 nt, Homo sapiens
uucgugggccggauuuaaaugguuuaggauucccggcuaucagc

SEQ ID NO: 148078 - RNA, 39 nt, Homo sapiens
aucuuaaaaacugugaagaaagugaacguguucaguuua

SEQ ID NO: 148079 - RNA, 78 nt, Homo sapiens
agggcucuucuaaagcuacuauuuuagcuuucuggguucuuuguguccacucagccgcucuggagcgccccggugcug

SEQ ID NO: 148080 - RNA, 77 nt, Homo sapiens
agcuggcugugcuugcugauguccauuuuuuucgacaacccuugucuccccuuuuucuccccuuuugguaccguuuu

SEQ ID NO: 148081 - RNA, 48 nt, Homo sapiens
guguugaucuuccuacuuucugugucuuaacacaccccuuagaugccg

SEQ ID NO: 148082 - RNA, 102 nt, Homo sapiens
aguggggggauuuuugugugaggugguauggaagugugggugaaugguuaagcugaagaauuaagugcaggucaaaaacaugcugcaggggaagcagaaauu

SEQ ID NO: 148083 - RNA, 32 nt, Homo sapiens
caaaaaaucaauuucucuacaccccaauccuc

SEQ ID NO: 148084 - RNA, 55 nt, Homo sapiens
gauuucugcuugccuuauccagguuuagccucuucugucaccuucugcuuucaau

SEQ ID NO: 148085 - RNA, 50 nt, Homo sapiens
aaucuaaccaggaaagcugggacuugagaauuuuucagaaucacguuagg

SEQ ID NO: 148086 - RNA, 60 nt, Homo sapiens
gaggguuucuacauagauuuagggcaagguauauggagaagguaugggaacgguuggaac

SEQ ID NO: 148087 - RNA, 34 nt, Homo sapiens
aaucgucauauacuucaccucccagguaagggcc

SEQ ID NO: 148088 - RNA, 49 nt, Homo sapiens
cugguaaccaaccaaagccuccuggucacaacaaacaccagacacagau

SEQ ID NO: 148089 - RNA, 49 nt, Homo sapiens
ugugucugguguuuguugugaccaggaggcuuugguugguuaccagagg

SEQ ID NO: 148090 - RNA, 51 nt, Homo sapiens
uuccucuaaaaucucuccacacugucccuuuuuguucuccuuuggccccaa

SEQ ID NO: 148091 - RNA, 55 nt, Homo sapiens
auuuagaauucugugcaagggcauugagagaaaggcuguaagaacugggcuguga

SEQ ID NO: 148092 - RNA, 67 nt, Homo sapiens
uguugaauuagggaugaaggagagcagggacuuggguguggggcgguaagugguuaguuuggggcca

SEQ ID NO: 148093 - RNA, 45 nt, Homo sapiens
cccuggugcggggccgccggggugagcggccugacuacaagggag

SEQ ID NO: 148094 - RNA, 48 nt, Homo sapiens
cacgagcgcaagcggcgcgucgagcugcgaugccucgagcuggaggag

SEQ ID NO: 148095 - RNA, 76 nt, Homo sapiens
cugggggagagucaagcacugaaugagugcagagcuggggguguuaggugggauguauagggagcuuagggugguu

SEQ ID NO: 148096 - RNA, 49 nt, Homo sapiens
ucuaugccccagacacacagccuucucauuucccacucugcacuguccc

SEQ ID NO: 148097 - RNA, 60 nt, Homo sapiens
gccauugaggaacaaaaauguguuuuaaggaagagaugggaaagcagagaccagguagag

SEQ ID NO: 148098 - RNA, 48 nt, Homo sapiens
uaaauggauguaaggauugaggccuuggaaaguagcauaggcaggaaa

SEQ ID NO: 148099 - RNA, 50 nt, Homo sapiens
ggaucaccauugcugaaguuuaaaaccacugcucuaaaagaguuuucugc

SEQ ID NO: 148100 - RNA, 57 nt, Homo sapiens
aguggauuuuaaauaugcuacaccucagggaccaaaagaaaaaaguuaagcaagcag

SEQ ID NO: 148101 - RNA, 67 nt, Homo sapiens
guguagcauauuuaaaauccacuguucuagagggaguaguaaguagagggaagaaagaugaugggaa

SEQ ID NO: 148102 - RNA, 52 nt, Homo sapiens
aagaucagacagaagggacuuuugggugagcgaaaaguucugugugcgcaug

SEQ ID NO: 148103 - RNA, 58 nt, Homo sapiens
acagcaaauucaggaaaaaguggcgaccuuucgacucauguugcuggagaaggaugug

SEQ ID NO: 148104 - RNA, 42 nt, Homo sapiens
uacguagauggcagcucuuuugauccucagcgucgugcccga

SEQ ID NO: 148105 - RNA, 57 nt, Homo sapiens
gagucuagcaguucucgcucaccaaccccaaagcagaagaagaagaaaaagaagaaa

SEQ ID NO: 148106 - RNA, 42 nt, Homo sapiens
caggucucccacuccaaagagcaaacguaaaucuaaggacaa

SEQ ID NO: 148107 - RNA, 46 nt, Homo sapiens
aucauucccucucccucccuuccuccuggacuaccccuuaccgacu

SEQ ID NO: 148108 - RNA, 46 nt, Homo sapiens; identical to SEQ ID NO: 58099

SEQ ID NO: 148109 - RNA, 50 nt, Homo sapiens
uuuuuuuguuuuuguuuauuuguuauuuuuguuucguucugauguauaug

SEQ ID NO: 148110 - RNA, 42 nt, Homo sapiens
cuucgcccagccaaggcaguuguaugaguuuuagcugcagca

SEQ ID NO: 148111 - RNA, 54 nt, Homo sapiens
acacaacggccuaguagcccggagacugcuacgaaacagccuagcagcccuuau

SEQ ID NO: 148112 - RNA, 44 nt, Homo sapiens
gugguucugggccugugcugcuccuuuccggagaggggcuaggu

SEQ ID NO: 148113 - RNA, 57 nt, Homo sapiens
aggccucagaugggggguucacuggcuccuggcuuaagggggugguugcaagggguu

SEQ ID NO: 148114 - RNA, 45 nt, Homo sapiens
cccgagaaacuuccccagucuucuuccucagagagcagcccacca

SEQ ID NO: 148115 - RNA, 50 nt, Homo sapiens
agaagaaaucucucggugggacccuggagcuggagcagguuuaggacuuu

SEQ ID NO: 148116 - RNA, 52 nt, Homo sapiens
cgcucacauggccgagcaaaacgggauaaaucacauucucauacccccuccc

SEQ ID NO: 148117 - RNA, 54 nt, Homo sapiens
cuggggagaucgggaucgagaaugaccucucuugguagggguucgagaccgaga

SEQ ID NO: 148118 - RNA, 69 nt, Homo sapiens
ccuagagcggccacgucgcugggggcuucuagaucuuccccaccucugugcagaccuggaccuacgcca

SEQ ID NO: 148119 - RNA, 98 nt, Homo sapiens
uccaggucugcacagagguggggaagaucuagaagcccccagcgacguggccgcucuaggucuccucagcgaccaggcuggucuaggagcagaaauac

SEQ ID NO: 148120 - RNA, 73 nt, Homo sapiens
ccagagaagaggcaggucuaggucagcaaggcgagggaggucccacucuagauccccagccacuagggguaga

SEQ ID NO: 148121 - RNA, 45 nt, Homo sapiens
gguguucuagagcgggaccugccccggcgggcugguguucuagaa

SEQ ID NO: 148122 - RNA, 52 nt, Homo sapiens
acguggccgcucacgcuccagaaccccagccagacguggccgcucacgcucu

SEQ ID NO: 148123 - RNA, 72 nt, Homo sapiens
cgagaccucccucuccuggcugguguucuggagcgugagcgaccacugcgucuagcugggguucuagagcgu

SEQ ID NO: 148124 - RNA, 46 nt, Homo sapiens
ucuagagugagaucuuccacgucuaacuaagcuucuacugcgggau

SEQ ID NO: 148125 - RNA, 65 nt, Homo sapiens
gcuuaguuagacguggaagaucucacucuagaacaccucaaagaagaggcagaucuggcucaucu

SEQ ID NO: 148126 - RNA, 49 nt, Homo sapiens
cagguccaauucaagcccagaaaugaagaaaucucgcauuucuucaagg

SEQ ID NO: 148127 - RNA, 55 nt, Homo sapiens
uuguuuagggcauggggaagacccugaaaggcugcgccucaaagacaagcgagau

SEQ ID NO: 148128 - RNA, 107 nt, Homo sapiens
cgcucuggauccucccaaccuaaagcuaaaucuagaacgccacccagacgcagucgcuccaguucuucuccgccaccuaaacagaaaucuaagacaccaucaagaca

SEQ ID NO: 148129 - RNA, 46 nt, Homo sapiens
caaaacagcuccgucucuguggcguuacagauugcucauuggccug

SEQ ID NO: 148130 - RNA, 49 nt, Homo sapiens
cucuccuccuagagugaaaucuagcacaccucccagacagagcccaucu

SEQ ID NO: 148131 - RNA, 46 nt, Homo sapiens
ugauauuauugccuucacuuuggguuguggagaugaugaccuagau

SEQ ID NO: 148132 - RNA, 46 nt, Homo sapiens
ggagcagggagauacugaucugcuucgccguggaguuguucucgac

SEQ ID NO: 148133 - RNA, 62 nt, Homo sapiens
cuaguagggugacgucgagaacaacuccacggcgaagcagaucaguaucucccugcuccaau

SEQ ID NO: 148134 - RNA, 46 nt, Homo sapiens
ccccgguggaguuugggccuuuacuuugggguauggugaaauagac

SEQ ID NO: 148135 - RNA, 45 nt, Homo sapiens
gggucuauuucaccauaccccaaaguaaaggcccaaacuccaccg

SEQ ID NO: 148136 - RNA, 43 nt, Homo sapiens
ugcuagauuuuacuccugcacagagagagagggauccagggca

SEQ ID NO: 148137 - RNA, 42 nt, Homo sapiens
ccuggaucccucucucucugugcaggaguaaaaucuagcaca

SEQ ID NO: 148138 - RNA, 74 nt, Homo sapiens
aaaucucaaacaucaccuaagggaggucgguccaggucuucaucuccagucacugagcuggcauccagaucucc

SEQ ID NO: 148139 - RNA, 45 nt, Homo sapiens
ucuuauuggagaucuggaugccagcucagugacuggagaugaaga

SEQ ID NO: 148140 - RNA, 45 nt, Homo sapiens
guucuaagugugucuuugaauaccagugaagacucaggccuaucc

SEQ ID NO: 148141 - RNA, 49 nt, Homo sapiens
ccaaagaagccugugacuggcucugaucaagagucaaagacacagcagg

SEQ ID NO: 148142 - RNA, 65 nt, Homo sapiens
acugcaucuggggauaacucagaacugcuguguccagaggaucuugucgauuguucuuucauguc

SEQ ID NO: 148143 - RNA, 46 nt, Homo sapiens
gagggagucccagacccaucucuaaguccuggagaagacccagacc

SEQ ID NO: 148144 - RNA, 49 nt, Homo sapiens
ucuagauggcguucuagguauaucuuucauuccaggagaggacccagac

SEQ ID NO: 148145 - RNA, 69 nt, Homo sapiens
cccagaaccgaaagcuuugccucagacuccuaggccgaggagucguucuccaucauccccagagcucaa

SEQ ID NO: 148146 - RNA, 46 nt, Homo sapiens
aucuccagagguugacagcaaaucucgacuauccccucggcgcagu

SEQ ID NO: 148147 - RNA, 47 nt, Homo sapiens
uccugaaggaagcagcaguaccgaguccucuccugaacauccgccca

SEQ ID NO: 148148 - RNA, 56 nt, Homo sapiens
aggccagacugucccguagaagccgcucugccucauccucaccagaaacucgcucu

SEQ ID NO: 148149 - RNA, 65 nt, Homo sapiens
ucguggacuccagaggucccguucccgcucaaggagagagaaaacaagaacaacccgacgucgag

SEQ ID NO: 148150 - RNA, 52 nt, Homo sapiens
gagugauaaccagagccuccccuccgccgccgaguaacccgcgaccuugacc

SEQ ID NO: 148151 - RNA, 46 nt, Homo sapiens
ucggcggcggaggggaggcucugguuaucacucaaggucaccugcc

SEQ ID NO: 148152 - RNA, 88 nt, Homo sapiens
gguucuggaccuggaucgccggugaguggcuggagaggcucgagaucuagagcguuuccacggggcuggugaugugcgugagcgagaa

SEQ ID NO: 148153 - RNA, 56 nt, Homo sapiens
ugaaguccuggaccuugaccgucuccggcugacuggugaaguucgagaucuggacc

SEQ ID NO: 148154 - RNA, 47 nt, Homo sapiens
gagcauccccagugagcagaaggcgauccagauccagaacgccacca

SEQ ID NO: 148155 - RNA, 77 nt, Homo sapiens
gaccuugaacgacggcggguuacugguggcguucuggaucuggaucgccuucugcucacuggggaugcucuugaccg

SEQ ID NO: 148156 - RNA, 26 nt, Homo sapiens
agaacuucgccuaucacucgcagaag

SEQ ID NO: 148157 - RNA, 46 nt, Homo sapiens
caguggcguucgagaucuagagcggcgccgaauagcuggagguguc

SEQ ID NO: 148158 - RNA, 46 nt, Homo sapiens
gcuucagucguccuagcauguccccaacaccucuugaucgcugcag

SEQ ID NO: 148159 - RNA, 46 nt, Homo sapiens
auguucucugguggucagguauucggggaccuggaccauccaucau

SEQ ID NO: 148160 - RNA, 46 nt, Homo sapiens
auugcacuugcccugacagcuaucagucuuggcaccgcucggccuc

SEQ ID NO: 148161 - RNA, 44 nt, Homo sapiens
cuggugcgguucugagacucaugagaggcaccggggcuggaacc

SEQ ID NO: 148162 - RNA, 45 nt, Homo sapiens
ccagccccagaacagcgguggcaccuucggcugugaaccuggcug

SEQ ID NO: 148163 - RNA, 46 nt, Homo sapiens
ccaccaacugcugcaaacuaucccuccagcuccagaacaccacagg

SEQ ID NO: 148164 - RNA, 42 nt, Homo sapiens
gccugugguguucuggagcuggagggauaguuugcagcaguu

SEQ ID NO: 148165 - RNA, 45 nt, Homo sapiens
accgcuccuugaccgagcuagguccagaacaccaccgucugcccc

SEQ ID NO: 148166 - RNA, 42 nt, Homo sapiens
ugugaaggagccuggcccauucuagaggaaggggagggagcc

SEQ ID NO: 148167 - RNA, 41 nt, Homo sapiens
gcugcagggcggcuaaugcagaaggcugcugggccccagua

SEQ ID NO: 148168 - RNA, 76 nt, Homo sapiens
ccucuucuucaucaucgucgucgucguccuccuccuccucuggcuccaguucuagugacucagagggcucuagccu

SEQ ID NO: 148169 - RNA, 49 nt, Homo sapiens
gcacaggaaggcuagagcccucugagucacuagaacuggagccagagga

SEQ ID NO: 148170 - RNA, 45 nt, Homo sapiens
gcuggggguagaagagaaugcuggggcagggggcggagggaggag

SEQ ID NO: 148171 - RNA, 50 nt, Homo sapiens; identical to SEQ ID NO: 58163

SEQ ID NO: 148172 - RNA, 97 nt, Homo sapiens
gccccaccccagccccaaaggaggcuguucgagagggacguccuccggagccaaccccagccaaacggaagaggcgcucuagcaguuccaguuccag

SEQ ID NO: 148173 - RNA, 60 nt, Homo sapiens
gaagaagaagaggaagaggaggaggaagaagaggaggaggaggaggaggaggaagaugaa

SEQ ID NO: 148174 - RNA, 57 nt, Homo sapiens
uccuccucaucuuccuccuccucgucgucuuccuccccuuccccugcuaagccuggc

SEQ ID NO: 148175 - RNA, 48 nt, Homo sapiens
gggcaaggccugagggccaggcuuagcaggggaaggggaggaagacga

SEQ ID NO: 148176 - RNA, 54 nt, Homo sapiens
ccucaggccuugcccaaaccugcaagccccaagaagccacccccuggcgagcgg

SEQ ID NO: 148177 - RNA, 48 nt, Homo sapiens
gcccaaggccacgugagacacccagcggggagcucacaccccagggcc

SEQ ID NO: 148178 - RNA, 45 nt, Homo sapiens
ggaaguagccagaugugcguuuuagaaaggucccucuggcuacau

SEQ ID NO: 148179 - RNA, 46 nt, Homo sapiens
aauagacucccucagggacucucggucccucagcuacucgccugug

SEQ ID NO: 148180 - RNA, 49 nt, Homo sapiens
cagccgcucccccagccacaagcgcaggagggagacaccuagcccucgg

SEQ ID NO: 148181 - RNA, 26 nt, Homo sapiens
ugcucuccuuugaaccuuggcagccc

SEQ ID NO: 148182 - RNA, 15 nt, Homo sapiens
gggagggaaagggag

SEQ ID NO: 148183 - RNA, 44 nt, Homo sapiens
gaguugggggaggggaggauacaguucaggauaccccagccugg

SEQ ID NO: 148184 - RNA, 54 nt, Homo sapiens
uguauaagguguucuuggaaggaaggggcaggaguuggaauuaguuggucccua

SEQ ID NO: 148185 - RNA, 45 nt, Homo sapiens
acagcaagagcaacuuuuucugucaaauaaaaaugagaaaugcag

SEQ ID NO: 148186 - RNA, 534 nt, Homo sapiens
agucugccugguugcugccucuuuuucccgccccucccugggaugggucccacucccugugggcuccuuuuggggcuugugcuuggcaguuccugugcuguccugucucccagauccugagacccuggcugagaacuuggcccagccugcugcuuaaaggcaccauggggaccuggguugcccugagacccaagccauuguuagcagcuagccagccacaccaaccacgccagggggaggaaagggaaggacugggagagacacaaagaccagagccagccucagggacaagagauuccaguuuuaggccuuucuccuucuaagugccccccacccccauagccugcauguccacucccagacgauggccaagagcagaaacacaagcuggagccaguguccugguuugacagcauguucaacgagggaaccccaagacggacccacacagguccacccacgcugggggcuguaaucacggagggaaguggcugcccccuuaacacaccuuuaauaaacagucuacagacccag

SEQ ID NO: 148187 - RNA, 35 nt, Homo sapiens
augaacaagccgugcagugaggacccccaagaggc

SEQ ID NO: 148188 - RNA, 33 nt, Homo sapiens
acaccuuugaggcccugugcaucgagccguuuu

SEQ ID NO: 148189 - RNA, 29 nt, Homo sapiens
aggccccagccacaguggggcuggccuuc

SEQ ID NO: 148190 - RNA, 47 nt, Homo sapiens
uccggcgccacaagaccaccaucuucacggacgccaaggaguccagc

SEQ ID NO: 148191 - RNA, 45 nt, Homo sapiens
cagguggacccuuggccuguaacaagaauggacugugguaucaga

SEQ ID NO: 148192 - RNA, 44 nt, Homo sapiens
gaaccggacagacugcugggugacuggcuggggguacaucaaag

SEQ ID NO: 148193 - RNA, 40 nt, Homo sapiens
gggaggcgggggagcgguggggaggacgggagguggaggc

SEQ ID NO: 148194 - RNA, 56 nt, Homo sapiens
cggagcggcccuugucucccagcuaucuauaaccuuagcuagagugucgccuugug

SEQ ID NO: 148195 - RNA, 46 nt, Homo sapiens
caguguccuagugcccaucgucuguuuccccggccuugcccccgcc

SEQ ID NO: 148196 - RNA, 92 nt, Homo sapiens
cugauucucaucuucgccgaggugcucggccucuacggucucaucgucgcccucauccucuccacaaaguagacccucuccgagcccaccag

SEQ ID NO: 148197 - RNA, 46 nt, Homo sapiens
aucaucgccaucuacggccuggugguggcaguccucaucgccaacu

SEQ ID NO: 148198 - RNA, 48 nt, Homo sapiens
ccuugaagcccugaguuuguccaccaagcccuuuuucugcacccagcu

SEQ ID NO: 148199 - RNA, 58 nt, Homo sapiens
agcuuguggcugucacucauucauccaaacaaucuugauugagcgcuuacuaugugcc

SEQ ID NO: 148200 - RNA, 55 nt, Homo sapiens
agcagcaucggcgcuggcggggcuguguagcuugcagagggucugugcucugagg

SEQ ID NO: 148201 - RNA, 45 nt, Homo sapiens
ggggguggggcggcggcgccgcugccauauuagccccgggagcgg

SEQ ID NO: 148202 - RNA, 42 nt, Homo sapiens
cccacccgcagacauguccgaguccaagagcggccccgagua

SEQ ID NO: 148203 - RNA, 44 nt, Homo sapiens
ugcaggagccacugacucauuugaaacccccaaccacgcugcga

SEQ ID NO: 148204 - RNA, 39 nt, Homo sapiens
augguccucguugcauugagggggcgccuccagggacag

SEQ ID NO: 148205 - RNA, 73 nt, Homo sapiens
agaugaccggccucuucaccaaggugcccccccuggacagggcagcaggacaggagguggaugacaccuggag

SEQ ID NO: 148206 - RNA, 87 nt, Homo sapiens
cuaagaucccugcccacacgcgcuacgcccugcagugucgcuucagccccgacuccacgugcgugcagggccugcuggcccgggagg

SEQ ID NO: 148207 - RNA, 43 nt, Homo sapiens
auugcaucagagcgcgaguccugccuugagcccggagccagcu

SEQ ID NO: 148208 - RNA, 41 nt, Homo sapiens
uuuagguuggguucucuucaagcagaggcugagacagggag

SEQ ID NO: 148209 - RNA, 49 nt, Homo sapiens
aaagguuucuucccgaaucucaggcccucagcuaccugcagguaagacu

SEQ ID NO: 148210 - RNA, 41 nt, Homo sapiens
uugccugucagugaaauaaauaaaguccugaccccagugca

SEQ ID NO: 148211 - RNA, 65 nt, Homo sapiens
ccccgggugugcuuugaguguggagcucccugauuuugccggccaggcacacacggggcugaggg

SEQ ID NO: 148212 - RNA, 35 nt, Homo sapiens
caccagcagcgggggccgggcgcacccugcccagc

SEQ ID NO: 148213 - RNA, 46 nt, Homo sapiens
cccgcucagcccuuucuccucggacaucaacaacaugccccugcag

SEQ ID NO: 148214 - RNA, 46 nt, Homo sapiens
gugccccugcugacccagggcugggcggagauccugguccggaggc

SEQ ID NO: 148215 - RNA, 45 nt, Homo sapiens
aaaccugagaaggccucagcuggcacccggguuccugugcaggag

SEQ ID NO: 148216 - RNA, 36 nt, Homo sapiens
ggcaccggggcucccucaguugcugcuggucccagu

SEQ ID NO: 148217 - RNA, 46 nt, Homo sapiens
gccccggggugcaugugagacagaccaaggaggcgccggccaagcu

SEQ ID NO: 148218 - RNA, 45 nt, Homo sapiens
ggacccggucguuacuaggccuggacucgggggagcugcaguccg

SEQ ID NO: 148219 - RNA, 44 nt, Homo sapiens
ggcgaguuccuccuagcggguggcaggaccaaaaccuggcuggu

SEQ ID NO: 148220 - RNA, 60 nt, Homo sapiens
ggagcucacggaaaccugucuggacaugauggcucgauacgucuucuccaacuucacggc

SEQ ID NO: 148221 - RNA, 56 nt, Homo sapiens
agguggcucggcccgcccuaccuggcacccugacccuggucacggccucucccucc

SEQ ID NO: 148222 - RNA, 45 nt, Homo sapiens
gguguagaggcuggagagaagaucgugugugcuuugugggccaca

SEQ ID NO: 148223 - RNA, 49 nt, Homo sapiens
gcugacagcauuaaucucuuaccauaacuaccuggacaaaaccaaacag

SEQ ID NO: 148224 - RNA, 41 nt, Homo sapiens
cgugcgguucagccccuacugcgucugcgacuacauguacg

SEQ ID NO: 148225 - RNA, 116 nt, Homo sapiens
uucagguaggggguccucuguagccuugccuggcaccuggagccuggcccugucucugucuggggcccacccgggcugggucucaggaugcccgaugagcagggcccuccccucug

SEQ ID NO: 148226 - RNA, 45 nt, Homo sapiens
guccuaugagaucguccuguccaucaccaggcucaucaagaagua

SEQ ID NO: 148227 - RNA, 45 nt, Homo sapiens
cauggaauguggccucaacaaucgcauccggaugauagggcagau

SEQ ID NO: 148228 - RNA, 50 nt, Homo sapiens
gcaggaguccggcaugaccgccuugagcgcgaggaugcugacccggagcc

SEQ ID NO: 148229 - RNA, 43 nt, Homo sapiens
gcggaaagcacagagacugcguguggccuaugagggcucggac

SEQ ID NO: 148230 - RNA, 27 nt, Homo sapiens
cagaccagcgccauccugcagcagcac

SEQ ID NO: 148231 - RNA, 60 nt, Homo sapiens
caggaaguucuggaaugagaugagggcagaguggggagguaaggacugaggagggaggag

SEQ ID NO: 148232 - RNA, 27 nt, Homo sapiens
ccuggugaggcugaacagccacagcag

SEQ ID NO: 148233 - RNA, 53 nt, Homo sapiens
agcugaggggagcaggagccagaacccagguggacagcagcugcggccggcca

SEQ ID NO: 148234 - RNA, 44 nt, Homo sapiens
agguggaccaagaaggcaaccaaguccccagaggagacccgcgc

SEQ ID NO: 148235 - RNA, 73 nt, Homo sapiens
aucuugcugccacaggcccccaguaccuggugggcaggggcaggaugggggcucaccggggcuggggcugauu

SEQ ID NO: 148236 - RNA, 86 nt, Homo sapiens
ucugggcaauggcaggaccacccuccaguccacugaggcugggggagcucggggcaggcugaggcccaagguccgugcgggagggg

SEQ ID NO: 148237 - RNA, 46 nt, Homo sapiens
cucgagccuucuccuuggccucggccgccguggggcucagguggag

SEQ ID NO: 148238 - RNA, 52 nt, Homo sapiens
gcccacccucugaacccucucugcauggccaccacccagcccgucacaccag

SEQ ID NO: 148239 - RNA, 46 nt, Homo sapiens
cccaguggccaacaagauggucccuggggcagaaaaggagccccaa

SEQ ID NO: 148240 - RNA, 62 nt, Homo sapiens
ggccugggggaggguggacaaggcuccccaccagcugccgggcucagcagggguggugaaca

SEQ ID NO: 148241 - RNA, 18 nt, Homo sapiens
uccgcugaaguccaggga

SEQ ID NO: 148242 - RNA, 50 nt, Homo sapiens
agcacgcagcucccgccuucccgcucaggagcugccgccgccuccgccuc

SEQ ID NO: 148243 - RNA, 47 nt, Homo sapiens
uuggcagccuuggggccucccucacaggcugcucgccuggccaccuc

SEQ ID NO: 148244 - RNA, 49 nt, Homo sapiens
cccgacauucucuuuggcuaaggggcuaagguaaacuuaacaugaccuu

SEQ ID NO: 148245 - RNA, 54 nt, Homo sapiens
ggcgagugaccagugccaggcuugggacagugauggagccagaagggggcuuga

SEQ ID NO: 148246 - RNA, 41 nt, Homo sapiens
agcaguucacccacgccuuccgcaccgagaucgaccucaag

SEQ ID NO: 148247 - RNA, 45 nt, Homo sapiens
ccacaucgaccugcaguucagcuacgcgccacggcacucgcgccg

SEQ ID NO: 148248 - RNA, 52 nt, Homo sapiens
guggccuugacggcaggccuguuccuccuauugucgucccggggucccggga

SEQ ID NO: 148249 - RNA, 49 nt, Homo sapiens
accccugcggccagcagacagcccgucacuucccgggaccccgggacga

SEQ ID NO: 148250 - RNA, 45 nt, Homo sapiens
ccugcugcugugcggccacggaggcccggacagcagcugcuacuu

SEQ ID NO: 148251 - RNA, 45 nt, Homo sapiens
guagcagcugcuguccgggccuccguggccgcacagcagcaggag

SEQ ID NO: 148252 - RNA, 48 nt, Homo sapiens
ggacagguagcgggcgggggcuguggcaauguggugccuggcuucucc

SEQ ID NO: 148253 - RNA, 40 nt, Homo sapiens
cgcuguggugcuccugaagggcacgccucccccacccccg

SEQ ID NO: 148254 - RNA, 42 nt, Homo sapiens
cagagaagccagggggcggcuugcugauugggggcaccaggc

SEQ ID NO: 148255 - RNA, 33 nt, Homo sapiens
ugcaaccgcgagaagccucugagcaccaagucc

SEQ ID NO: 148256 - RNA, 44 nt, Homo sapiens
ccagucccugccucuccaccugcacccugcuuccuggcccaguc

SEQ ID NO: 148257 - RNA, 44 nt, Homo sapiens
cagcgguuccgccugggcaccgacaugucacucuucgccaccga

SEQ ID NO: 148258 - RNA, 38 nt, Homo sapiens
cgccgcgccgcacgcagguguucuccaucgccgucuuc

SEQ ID NO: 148259 - RNA, 370 nt, Homo sapiens
acaauccuuuaauuagaaaccauuuauuggccggacgcgguggcucacgccuguaaucgcagcacuuugggaggccgaggcgggcggcucacgacgucaggagauccagaccaucuuggcuaacagggugaaaccccgucucuacuaaaaauacaaaaaauuagccgggcgugguggcgggcgccuguagucccagcuacucuggaggcugaggcaggagaaucaauugaacccgggaggcggagcuuacagugagcugagauugcgccacuguacuccugggcaacagcgagacuccgucucaaaaaaaaaaaaaaaaaaagaaaccauuuauuuuaaaaaugauuagauugcuaugccucaacucaua

SEQ ID NO: 148260 - RNA, 58 nt, Homo sapiens
caguaugacauuuaaaguggaaaagccagaauauugaguuauuucuuaacaaguuucg

SEQ ID NO: 148261 - RNA, 42 nt, Homo sapiens
agcauccaggccauugucccgcuucugggaguggggaaagaa

SEQ ID NO: 148262 - RNA, 43 nt, Homo sapiens
gagcccuggcgguagcgagcggaggggaaggcgagcugcgcgg

SEQ ID NO: 148263 - RNA, 46 nt, Homo sapiens
cuuaaauaagucaucagccacccugcugagcugugacaaccguaag

SEQ ID NO: 148264 - RNA, 45 nt, Homo sapiens
uggcgugcaccuggacaccuggcacggcacacucaccuuuuucaa

SEQ ID NO: 148265 - RNA, 46 nt, Homo sapiens
gccguacccgccucuccuccgggccaugauuaucgcagaacgacag

SEQ ID NO: 148266 - RNA, 41 nt, Homo sapiens
ggauacgcauggaacccugggauuacccugcaaaacaggaa

SEQ ID NO: 148267 - RNA, 45 nt, Homo sapiens
ucgucguagcaguggaugaggcgcucgaacucgcgguagauggag

SEQ ID NO: 148268 - RNA, 58 nt, Homo sapiens
uuguuugugaguuagauccagaaguucuauaaagcuuuguagaggguggccuccacag

SEQ ID NO: 148269 - RNA, 41 nt, Homo sapiens
auacuguuaguguuucugcuuacgccuccuccaucccacag

SEQ ID NO: 148270 - RNA, 31 nt, Homo sapiens
auccaaggaccaugcccugccccaccucccc

SEQ ID NO: 148271 - RNA, 97 nt, Homo sapiens
guggcagugaccggagacccaaaaaugucgcuggucuucccuccagguggguucaggugcugucgagucugcacggggguugauucgucaaagauac

SEQ ID NO: 148272 - RNA, 45 nt, Homo sapiens
uauuaggccugcuggaaggaguagcuucuucuggacuuccaaaaa

SEQ ID NO: 148273 - RNA, 45 nt, Homo sapiens
cggccgcccucgcuauccgggaccuggaacaugucgaccgccgcc

SEQ ID NO: 148274 - RNA, 49 nt, Homo sapiens
ccccggacgcccccuggccgaggcucgcguccagacgcccgggccggcg

SEQ ID NO: 148275 - RNA, 42 nt, Homo sapiens
gcugagcgggucccccccgcagacugagaagccgacccacua

SEQ ID NO: 148276 - RNA, 59 nt, Homo sapiens
gccugggcuacgaggucgggugagggucgcgucuggagucgggaugggggugggcgcag

SEQ ID NO: 148277 - RNA, 42 nt, Homo sapiens
gcgcugucuguguuuguagguaccugaaggaguucaggacgg

SEQ ID NO: 148278 - RNA, 47 nt, Homo sapiens
aacauaagccuuuucuacuuuagaagauacaucuuccucaucaucag

SEQ ID NO: 148279 - RNA, 42 nt, Homo sapiens
gcccguguggccgauagcgaccggcagcuggcgcugcagaag

SEQ ID NO: 148280 - RNA, 44 nt, Homo sapiens
uaacaaaaaacgcagcagaggggauccgacgucagagcuuuuag

SEQ ID NO: 148281 - RNA, 44 nt, Homo sapiens
guuuuaaaggaaguggguccgugacauucugcagcuaguccacu

SEQ ID NO: 148282 - RNA, 41 nt, Homo sapiens
ccgaggaggucggcgccgcgcugcagggugagcgaggcgug

SEQ ID NO: 148283 - RNA, 52 nt, Homo sapiens
ccuuccugcugccugggggugguguuguaaacaacaccccgauggucuucug

SEQ ID NO: 148284 - RNA, 45 nt, Homo sapiens
gugaugcgucugaggacccagggccuggcgccgagcgcggaggag

SEQ ID NO: 148285 - RNA, 46 nt, Homo sapiens
gaugcugaccuggggucugaggcucaaaagcagcacagcccagguu

SEQ ID NO: 148286 - RNA, 46 nt, Homo sapiens
ggauaaucaucuuugaaaagcauccguaguuuaaacaagccuccuu

SEQ ID NO: 148287 - RNA, 42 nt, Homo sapiens
cagagagcaaaugcgugcuguuggcgccccccacccccacac

SEQ ID NO: 148288 - RNA, 48 nt, Homo sapiens
ccccaccugccagagaagcaaacugcagcagaacauuccuguccagga

SEQ ID NO: 148289 - RNA, 41 nt, Homo sapiens
cuuggggaucccguccucgauccacuucagcagccugcggg

SEQ ID NO: 148290 - RNA, 42 nt, Homo sapiens
uuggacguguggucgucaggagcacagcagucccgagugcag

SEQ ID NO: 148291 - RNA, 46 nt, Homo sapiens
cugguaggugaggggcuugcgggcaggcagcucagggaagcggcag

SEQ ID NO: 148292 - RNA, 41 nt, Homo sapiens
ccugcuggcugcuggggaaggugauccuggguguguggcug

SEQ ID NO: 148293 - RNA, 46 nt, Homo sapiens
ggaugucauugucaguuuucucacagagggcggccagcaccccugg

SEQ ID NO: 148294 - RNA, 42 nt, Homo sapiens
acuucccgccgacucugcccucgaggcuggugcagcggcucc

SEQ ID NO: 148295 - RNA, 41 nt, Homo sapiens
gcacacgugauugcgcgucacgcgggguacucuguggugga

SEQ ID NO: 148296 - RNA, 68 nt, Homo sapiens
acugggccucggagacggagugggcucugguuugcccuuuugaguuguagguggugaacugagcacag

SEQ ID NO: 148297 - RNA, 65 nt, Homo sapiens
cccagcccccaggaucaaacggccuaggcugcagguggucaagaggcugaacuucagaucggagg

SEQ ID NO: 148298 - RNA, 51 nt, Homo sapiens
ggccuccucagccucgcgcccacuccggaggcccuggggcaaugccgccaa

SEQ ID NO: 148299 - RNA, 44 nt, Homo sapiens
cccgccccagccgcaucugugggcagcagccagggcggcgccag

SEQ ID NO: 148300 - RNA, 46 nt, Homo sapiens
aggggucaggcgugcagaccuccacacacucgguguccguggggau

SEQ ID NO: 148301 - RNA, 74 nt, Homo sapiens
ccucuagaggguagguugggggcaguagcucaccaggcccaggagcagcccauccuggaggcaaagccuauccc

SEQ ID NO: 148302 - RNA, 43 nt, Homo sapiens
ggccagagguggacacagggcuggaccuggagccgccuggagg

SEQ ID NO: 148303 - RNA, 72 nt, Homo sapiens
cuugcuaugagccacgcacugagcucguucacuuugcaaugccccaagggagcagguaccgucaccucccca

SEQ ID NO: 148304 - RNA, 37 nt, Homo sapiens
gcuaucacagcaucguucucauugggcagaagauuaa

SEQ ID NO: 148305 - RNA, 41 nt, Homo sapiens
ugcucaccaccaccgggcugucgggccuggugcagcugcag

SEQ ID NO: 148306 - RNA, 46 nt, Homo sapiens
ugcacgccgcccuccgccacgccacagccacagccgccgccaucac

SEQ ID NO: 148307 - RNA, 41 nt, Homo sapiens
cugugcccuuaccgccuuccccgccacacccgcucugucuu

SEQ ID NO: 148308 - RNA, 97 nt, Homo sapiens
uggagcccuccgaggggugucaggggaaacaggccaccgccaaagccauggcccgccgccgagagcccaggccccacccgcaccuccucacccaucc

SEQ ID NO: 148309 - RNA, 46 nt, Homo sapiens
caggccugggaagaggccugggccgaccucacaccucagcccuugc

SEQ ID NO: 148310 - RNA, 47 nt, Homo sapiens
gaguaaccaguuuccagagagccagagagugagagagagaaagagag

SEQ ID NO: 148311 - RNA, 39 nt, Homo sapiens
accuuccucggcuagccaaaacagcuggcaggacugccg

SEQ ID NO: 148312 - RNA, 46 nt, Homo sapiens
agguagggcagggaaccucaguaguccuccacccagccauucucag

SEQ ID NO: 148313 - RNA, 84 nt, Homo sapiens
augcacggcucccgcaucagcucaaagcugaucuugccacacagguagucggggaugucucgcuucuguggcacaggggcacac

SEQ ID NO: 148314 - RNA, 54 nt, Homo sapiens
ccucccuccuccauggggcacagacccaacacaaggcggggaugcucccacgcc

SEQ ID NO: 148315 - RNA, 46 nt, Homo sapiens
caggcuaauaaaguggagaaacugucuuuuuggagugucuuugacu

SEQ ID NO: 148316 - RNA, 45 nt, Homo sapiens
ggaugguggcccagccggugagggcgggccaaggccugugcagua

SEQ ID NO: 148317 - RNA, 40 nt, Homo sapiens
gggucguggcucaggucagaaucugggcugcugaugggau

SEQ ID NO: 148318 - RNA, 41 nt, Homo sapiens
gggagggcagggguaaggcuguggcacaguuaggaggaguu

SEQ ID NO: 148319 - RNA, 42 nt, Homo sapiens
aagaucuccccccagagcaacguggacuuugaccugaugcuc

SEQ ID NO: 148320 - RNA, 46 nt, Homo sapiens
uccuggaggaccugggaaaggccaguggccugcuccuggagaggau

SEQ ID NO: 148321 - RNA, 39 nt, Homo sapiens
cuccuccggcugaccucgggggcuggcuugcugccaggg

SEQ ID NO: 148322 - RNA, 47 nt, Homo sapiens
cucagcuucccaugggccccccgccccccuccuuccccucccugaac

SEQ ID NO: 148323 - RNA, 73 nt, Homo sapiens
cgaaccagagccgcccagggucccgcccuucagccccuucucguccacccugcagaacaaccccgugccgcgc

SEQ ID NO: 148324 - RNA, 36 nt, Homo sapiens
agugcgaggacaaggacgaggaggagaaggaggagc

SEQ ID NO: 148325 - RNA, 60 nt, Homo sapiens
auggcucugugaaagauugacggagauguagggcccaggagcaggugcugugugaguggg

SEQ ID NO: 148326 - RNA, 46 nt, Homo sapiens
gacccuuccaaggccguaggauugcaccuccaggcccaguggagcc

SEQ ID NO: 148327 - RNA, 46 nt, Homo sapiens
auauauauauauauauguauaauauauaaagacuggcacccugccu

SEQ ID NO: 148328 - RNA, 65 nt, Homo sapiens
auuguacauuuggggaaagccuuggguguaaaucaguguaaacuuggaggagagauuuuucuauc

SEQ ID NO: 148329 - RNA, 45 nt, Homo sapiens
agcucuggggccuccaggccauguggcuguucccacggcccaguc

SEQ ID NO: 148330 - RNA, 32 nt, Homo sapiens
ggucccucuucccacgugcagcccuguuggga

SEQ ID NO: 148331 - RNA, 45 nt, Homo sapiens
aggagaucaacuuccgccugcaggacuacaucgacaggaucaucg

SEQ ID NO: 148332 - RNA, 45 nt, Homo sapiens
gcuuccuacgugacgggggccgugcugguggccgauggcggggca

SEQ ID NO: 148333 - RNA, 45 nt, Homo sapiens
aggucacugccagcccgcugcagaggcuggggaacaagaccgaga

SEQ ID NO: 148334 - RNA, 32 nt, Homo sapiens
gggagaauucgggggaggggcggggccuccgg

SEQ ID NO: 148335 - RNA, 68 nt, Homo sapiens
ggauuugaucccuuuaugaaccuugugauagaugaauguguggaaauggcgacuaguggacaacagaa

SEQ ID NO: 148336 - RNA, 26 nt, Homo sapiens
cacagguagagaugaaaggcaguuuu

SEQ ID NO: 148337 - RNA, 48 nt, Homo sapiens
augugcccuccgcccugaccuacccaggagaaggcugggacccaggga

SEQ ID NO: 148338 - RNA, 34 nt, Homo sapiens
ggcugagaggaggugggaggaccgugccuugaua

SEQ ID NO: 148339 - RNA, 46 nt, Homo sapiens
acaccgagaagcaaugccuccgucaacguuucccacccggcccccg

SEQ ID NO: 148340 - RNA, 42 nt, Homo sapiens
gagaaggacucccuaugguccuguucccuggcgaggcugugg

SEQ ID NO: 148341 - RNA, 45 nt, Homo sapiens
ggauguaaaagucgagcccauaagccucaucgaugagguccaggg

SEQ ID NO: 148342 - RNA, 61 nt, Homo sapiens
aucccucgcuucagguccaucccaaacuuggagcacagguccuccuucggggucuggcaga

SEQ ID NO: 148343 - RNA, 45 nt, Homo sapiens
accuuaccccaggcggccuugacguuggucuugucggcaggagac

SEQ ID NO: 148344 - RNA, 46 nt, Homo sapiens
acgcuaagucaucaccauaacugcuuagaaacccagaggaacucgg

SEQ ID NO: 148345 - RNA, 40 nt, Homo sapiens
ucucgagccccucccagaguuauugcauuucuccucucaa

SEQ ID NO: 148346 - RNA, 45 nt, Homo sapiens
gugcugaagcgcacguugacagagccggcgauguggccggcguug

SEQ ID NO: 148347 - RNA, 45 nt, Homo sapiens
gccauaucuauguguucaucacuggauccuggugcugagccagca

SEQ ID NO: 148348 - RNA, 52 nt, Homo sapiens
ccuauccugaugggaggccaccacgugccagcuccccuugcuugaagccaug

SEQ ID NO: 148349 - RNA, 72 nt, Homo sapiens
ugggugaaccagccaaaaggagaccgccaaagcaucaggugcauugccaggggcauugccaugauuugauug

SEQ ID NO: 148350 - RNA, 46 nt, Homo sapiens
gccuuugggaaauaguagagaccagugauuaagagcuugaucucca

SEQ ID NO: 148351 - RNA, 44 nt, Homo sapiens
ucagggugcuuccuggaggagggacacuugagagaugaguugga

SEQ ID NO: 148352 - RNA, 44 nt, Homo sapiens
uauuccucuucugucugcacuuuccauuuugacccaucuccauc

SEQ ID NO: 148353 - RNA, 59 nt, Homo sapiens
uugaggaucagaugagacaauaugaguuacuacuuggguucaugggaggugcucaguaa

SEQ ID NO: 148354 - RNA, 46 nt, Homo sapiens
uuuaccccaggccucaccagaacucagccuugacuuauuucucaag

SEQ ID NO: 148355 - RNA, 47 nt, Homo sapiens
gaugaguacagagagccaaggcucccagggcccaguggggagcuuug

SEQ ID NO: 148356 - RNA, 58 nt, Homo sapiens
ggaggaucaguguucagucuccaggaugaggcuggccaggguuccaguccugacucug

SEQ ID NO: 148357 - RNA, 83 nt, Homo sapiens
gcauuuguugaaggaaccucaggaguaguagggaagauucuguggacagaguaggccaagugucuaagcagugcuuggcccau

SEQ ID NO: 148358 - RNA, 66 nt, Homo sapiens
cagcucucuggugacauauucugauggagucaggcagugagcagauacacauaacucaacaucagg

SEQ ID NO: 148359 - RNA, 43 nt, Homo sapiens
acccuuuccuccacauucucuugacggagagcuggucacaacu

SEQ ID NO: 148360 - RNA, 65 nt, Homo sapiens
cagaggccaaagcccuggugggagcugggggaugacccaagucagaggggccgagggugcuggga

SEQ ID NO: 148361 - RNA, 106 nt, Homo sapiens
agguggacuggaugaaaucacaagaguuccuguaagagagagguggaggccaggcacaguggcucacgccuguaaucccagcacuuugggaggcugaggcgggggc

SEQ ID NO: 148362 - RNA, 45 nt, Homo sapiens
ucccgcugaacaauggggcaggcugccgcuucgaggggcaguuca

SEQ ID NO: 148363 - RNA, 46 nt, Homo sapiens
uucuucagcccagcaugugcuggcaugagucagccaccugugaugg

SEQ ID NO: 148364 - RNA, 66 nt, Homo sapiens
gguccccggcaacuuccacguguccacacacagugccacagcccagccacagaacccagacaugac

SEQ ID NO: 148365 - RNA, 24 nt, Homo sapiens
ugggagccggcagguggggugugu

SEQ ID NO: 148366 - RNA, 41 nt, Homo sapiens
agguccagaacauccacggagcuuucaaugcucucggggga

SEQ ID NO: 148367 - RNA, 38 nt, Homo sapiens
ccaaaaauugcacuuuuccuuuuacagcucugcuuucu

SEQ ID NO: 148368 - RNA, 54 nt, Homo sapiens
caucaucccugcaaucugguuccgcuacgaccucagccccaucacggucaagua

SEQ ID NO: 148369 - RNA, 65 nt, Homo sapiens
acuagaucuucaagaagguguuccagagacagauugcuccaaacugggucuguacagagaggggc

SEQ ID NO: 148370 - RNA, 60 nt, Homo sapiens
cuccuggcgcgugcguucccagagcagguucggaggcggaagaggaacgugagaccgagu

SEQ ID NO: 148371 - RNA, 58 nt, Homo sapiens
gucaggauauuugcuacguaaaccuuaacagaauugagaagacagauucccugcaugg

SEQ ID NO: 148372 - RNA, 46 nt, Homo sapiens
uucaccgucgccggcauccuggacucaugcaucuucacagccucug

SEQ ID NO: 148373 - RNA, 51 nt, Homo sapiens
agcuaccucuuuuccccguguuucuuuuuagacaaauuacacugccugaag

SEQ ID NO: 148374 - RNA, 45 nt, Homo sapiens
aucgaucagcucucagccaggcuucgacaaucucgcagcccccac

SEQ ID NO: 148375 - RNA, 62 nt, Homo sapiens
ugugcaugugaguugacugauguugugaguguaaaugcauuugguuauuucugguaucggug

SEQ ID NO: 148376 - RNA, 46 nt, Homo sapiens
caccucugacccguuauucuuauaaucaaaaucugaagggaaaaaa

SEQ ID NO: 148377 - RNA, 37 nt, Homo sapiens
cuggcagcggcccuucgcccagcgcuucgcccagcgc

SEQ ID NO: 148378 - RNA, 45 nt, Homo sapiens
cuauaucauuucucuucuugccccaguuucauuucagggagagag

SEQ ID NO: 148379 - RNA, 46 nt, Homo sapiens
agggcccugggggaggggucucacguccccuggggaagcgccggag

SEQ ID NO: 148380 - RNA, 42 nt, Homo sapiens
agaguuaccagggcagcagcggcuacaacuuccggcccacag

SEQ ID NO: 148381 - RNA, 45 nt, Homo sapiens
gcuuuuuaaauauuuuuuaaaauuauuuaaccccugggggcagag

SEQ ID NO: 148382 - RNA, 48 nt, Homo sapiens
gaucccggacucuguaugauugaaauaaagagaaauaaacaaaucuag

SEQ ID NO: 148383 - RNA, 63 nt, Homo sapiens
uggagcccauaggccacccccuauccucugaguguuuggaaauaaacugugcaauccccucac

SEQ ID NO: 148384 - RNA, 69 nt, Homo sapiens
ccuucucuauugggcacagccuagggucuugggggucaggggggagaaguucuugauucagccaaaugc

SEQ ID NO: 148385 - RNA, 53 nt, Homo sapiens
caggagcaggaccuacuaggagaggggggccaagguccugcucaacucuaccc

SEQ ID NO: 148386 - RNA, 57 nt, Homo sapiens
gggccagucaggcugcagaggcaccucaacauugcauggugcuagugggcccucucu

SEQ ID NO: 148387 - RNA, 43 nt, Homo sapiens
cccugccuggacuuaagcgaagucuuugccuucucuguucccu

SEQ ID NO: 148388 - RNA, 45 nt, Homo sapiens
ggugugguucuguugggccaguuugugguacgaagauucuucaaa

SEQ ID NO: 148389 - RNA, 63 nt, Homo sapiens
uaggccaggugacccgcuucguggucgacuucaugcugcaucacugcauugcccgguggauug

SEQ ID NO: 148390 - RNA, 55 nt, Homo sapiens
ggcuucggcuaccgucuggcccuacacgucuaccagcauggccugacuggcuucc

SEQ ID NO: 148391 - RNA, 46 nt, Homo sapiens
accugcagcccacggcagagaaugccuaugaguacuucaccaagau

SEQ ID NO: 148392 - RNA, 46 nt, Homo sapiens
cagcaccauggggcaggugggacggcagcucgccaucaucggggac

SEQ ID NO: 148393 - RNA, 59 nt, Homo sapiens
gaagggguggcugccccugccgacccagagauggucaccuuaccucugcaaccuagcag

SEQ ID NO: 148394 - RNA, 50 nt, Homo sapiens
aggcccagguccucccaggcaggagugcggagagccugcccugcccucug

SEQ ID NO: 148395 - RNA, 41 nt, Homo sapiens
guuuugaggauuugggcuucuagaaaacucucuucugagau

SEQ ID NO: 148396 - RNA, 45 nt, Homo sapiens
aguggccugucguuggaagaguacaagcugauccuguccacaggu

SEQ ID NO: 148397 - RNA, 45 nt, Homo sapiens
cgagagcuuagcgcgacuccauucaaacuacuacaaacacaaggu

SEQ ID NO: 148398 - RNA, 46 nt, Homo sapiens
cgcgcuaagcucucguacaucugaucacaggccucaggcucugcaa

SEQ ID NO: 148399 - RNA, 47 nt, Homo sapiens
aaaaacugcauuucagagcucaggaauguuagugcuggagucuguga

SEQ ID NO: 148400 - RNA, 24 nt, Homo sapiens
ugaccggcggggaggcggcuggga

SEQ ID NO: 148401 - RNA, 46 nt, Homo sapiens
ucguccacuggccauuccucacagagcuuaagaaaacgccgguacc

SEQ ID NO: 148402 - RNA, 54 nt, Homo sapiens
guucgccgaccccuuggucccagagggagaggaggugggcugugccucagcagg

SEQ ID NO: 148403 - RNA, 46 nt, Homo sapiens
agaugcagaccuccauggcgguucaggccagcucagggaggcugag

SEQ ID NO: 148404 - RNA, 68 nt, Homo sapiens
auggaguacuaugcaauguuggucaaaacugguguccaucacuacaguggcaauaauauugaacuggg

SEQ ID NO: 148405 - RNA, 46 nt, Homo sapiens
auuugcaguuacuugaauaaaaaaaauauccuuuucuggacuggag

SEQ ID NO: 148406 - RNA, 128 nt, Homo sapiens
aaauggagacccagcacccagcagggggagccaggugacagcaggggaagcagauggcagggccccaggcaguccaggaccccaggcucugaaggguggggcaagggggucaggucacgucuugacau

SEQ ID NO: 148407 - RNA, 56 nt, Homo sapiens
cgguccacccuggggagcaggggaggggacucagcuaggagguccccccaacccuc

SEQ ID NO: 148408 - RNA, 26 nt, Homo sapiens
cuguacauacauuaccugcaacagag

SEQ ID NO: 148409 - RNA, 79 nt, Homo sapiens
cuggucccaggucaaauccugggaggagggauccuccagguagauguacugggugugacccuccagugagucuuggcaa

SEQ ID NO: 148410 - RNA, 44 nt, Homo sapiens
acccaaacauaugagggaagccguuagaagguuaaagucaaaag

SEQ ID NO: 148411 - RNA, 46 nt, Homo sapiens
uuguuauugcuaugucugguauuuccaagguuuucgucggggaggu

SEQ ID NO: 148412 - RNA, 49 nt, Homo sapiens
ggaaaauacaaaccaccaaacuugaagcacaguuagaaaacuuguauaa

SEQ ID NO: 148413 - RNA, 50 nt, Homo sapiens
aguccauucuuucagcacgcauaaauuaaauauguaauaggugcggggac

SEQ ID NO: 148414 - RNA, 49 nt, Homo sapiens
gcagucuugagcgccggagcgcgucccugcccuuagcggggcuugcccc

SEQ ID NO: 148415 - RNA, 42 nt, Homo sapiens
cgcuggaaaaugucucaggagaggcccacguucuaccggcag

SEQ ID NO: 148416 - RNA, 44 nt, Homo sapiens
cacucuacucucucaaagacaggcacuguuaagugucuuguguc

SEQ ID NO: 148417 - RNA, 42 nt, Homo sapiens
aggggagaaucuuuguggugaguuuaaggaaauacaaacagg

SEQ ID NO: 148418 - RNA, 356 nt, Homo sapiens
aucaaaucccauuuuuccacuuuuuuuuuuuuuugagacggagucuugcuguguugcccaggcuggggcgcaguggugcaaucucggcucacggcagccucugccucccgaguucaagcaauucuccugccucagccuccugaauagcugagauuacaagugcgugccaccaugccuggcugauuuuuguauuuuuaguagagacgggguuuuaccauguuggucaggccagucucgaacuccugaccuugugaucugcccaccuuggccucccaaagugcugggauuacaggaaugagccaccacacccagccuccacugguucuucuuuaaaauaagcuuauccuggaucucca

SEQ ID NO: 148419 - RNA, 50 nt, Homo sapiens
ugccuuuguacagacugugacuuuuccuuuaagugagaggggaagccuug

SEQ ID NO: 148420 - RNA, 45 nt, Homo sapiens
gguggaguuagaugaauuggugcaagcccugacccaugcucacaa

SEQ ID NO: 148421 - RNA, 22 nt, Homo sapiens
cuuuuucagguuuuuguugcca

SEQ ID NO: 148422 - RNA, 52 nt, Homo sapiens
cauaccaguuuuguucuuuguuuucguaaguucauuaauuuaauauuuccag

SEQ ID NO: 148423 - RNA, 33 nt, Homo sapiens
ccaaguacuuuguaggugcucaagaaauauuug

SEQ ID NO: 148424 - RNA, 68 nt, Homo sapiens
ggguuacguguggcagugaagaagcucuccagaccauuucaguccaucauucaugcgaaaagaaccua

SEQ ID NO: 148425 - RNA, 46 nt, Homo sapiens
cguuuuuacaccugcaaggucucuggaggaauucaaugauguguga

SEQ ID NO: 148426 - RNA, 55 nt, Homo sapiens
ccuaucaugcaccucuuuuuggguguagggauggauaccagaagauguauguuau

SEQ ID NO: 148427 - RNA, 49 nt, Homo sapiens
uguaccccauugaagagucagucuugaauucuuacaaaaguuccaugga

SEQ ID NO: 148428 - RNA, 50 nt, Homo sapiens
ccuuggcuacauuaaccuugauccugcuaaugaaaguuuaagaaacaaag

SEQ ID NO: 148429 - RNA, 46 nt, Homo sapiens
uuugccuuuugauaauugcuuugaauaggacugauaguaguaagag

SEQ ID NO: 148430 - RNA, 46 nt, Homo sapiens
uucugccauaaauaaugccuuucaguuuauuucauuguagcuuagu

SEQ ID NO: 148431 - RNA, 49 nt, Homo sapiens
gugaaaugucagaagcuuacagaugaccauguucaguuccuuaucuacc

SEQ ID NO: 148432 - RNA, 42 nt, Homo sapiens
cuuuugcaguauauacauucagcugacauaauucacagggua

SEQ ID NO: 148433 - RNA, 44 nt, Homo sapiens
gaauuucuauuucacaaggguaacuguuuuauccacacuggcag

SEQ ID NO: 148434 - RNA, 57 nt, Homo sapiens
ucggcacacagaugaugaaaugacaggcuacguggccacuaggugguacagggcucc

SEQ ID NO: 148435 - RNA, 45 nt, Homo sapiens
ccaguugauauuuggucagugggaugcauaauggccgagcuguug

SEQ ID NO: 148436 - RNA, 49 nt, Homo sapiens
ucauggcagaguucuuguuugaauaggacuucaaaguguaaauaggaau

SEQ ID NO: 148437 - RNA, 46 nt, Homo sapiens; identical to SEQ ID NO: 58565

SEQ ID NO: 148438 - RNA, 49 nt, Homo sapiens
guaucccaguaaagcaaugagauuugagauucuaauucauuccaagaga

SEQ ID NO: 148439 - RNA, 44 nt, Homo sapiens
gacagaagccaugggaaugugagucuggcuuacuuuugcuauga

SEQ ID NO: 148440 - RNA, 42 nt, Homo sapiens
uuguuuuuucaggcaagaaacuauauucagucuuugacucag

SEQ ID NO: 148441 - RNA, 49 nt, Homo sapiens
acuccuuuugcugucuuucucuaaauaugauuacuuuaaaauaaaaaag

SEQ ID NO: 148442 - RNA, 48 nt, Homo sapiens
uucaggcauuuuguucuacaugaggacucauauauuuaagccuuuugu

SEQ ID NO: 148443 - RNA, 41 nt, Homo sapiens
ugucuuggguagguaauuccaggcauaucauugccucaggu

SEQ ID NO: 148444 - RNA, 43 nt, Homo sapiens
uccucucacaccaccucccuuaccaaaacgucucucugcccug

SEQ ID NO: 148445 - RNA, 31 nt, Homo sapiens
ggaggucaccuguggggacgucggggucagg

SEQ ID NO: 148446 - RNA, 48 nt, Homo sapiens
auuuuaacuuuuaaacuucugaauaaacuguguaaaaacaguagugga

SEQ ID NO: 148447 - RNA, 92 nt, Homo sapiens
cuccuguguguuuugcaagaaugugugguaagccuggguaaagagaaggaacugcgguguugggagagucuuuguguuggggaguggcaggg

SEQ ID NO: 148448 - RNA, 41 nt, Homo sapiens
auaucagccaguuccuguaauuuugugacacgcucucugcc

SEQ ID NO: 148449 - RNA, 49 nt, Homo sapiens
uuccauaaugcaucugaaaaacuguaaacaaagacaaccauuucuacua

SEQ ID NO: 148450 - RNA, 45 nt, Homo sapiens
aacuucgaugaguuuccagaaucugauauucuuaagccaacaggu

SEQ ID NO: 148451 - RNA, 71 nt, Homo sapiens
ugugaaugggaacauagaauuggagcuccuggaguugaggaaauaaaaaguaacucuuuuuuugaaggcgu

SEQ ID NO: 148452 - RNA, 46 nt, Homo sapiens
agaaggugaugaacuggaaagaaacuuugacuuuuccuccagaagu

SEQ ID NO: 148453 - RNA, 49 nt, Homo sapiens
cagaagaggagacucaguuuuauauagcagaaacaguauuagccauaga

SEQ ID NO: 148454 - RNA, 46 nt, Homo sapiens
uaggaccugaaucuuuuucugccauuuuauguugcugguauuagaa

SEQ ID NO: 148455 - RNA, 46 nt, Homo sapiens; identical to SEQ ID NO: 58597

SEQ ID NO: 148456 - RNA, 51 nt, Homo sapiens; identical to SEQ ID NO: 58598

SEQ ID NO: 148457 - RNA, 56 nt, Homo sapiens
cuuuucauagguguucuuguauuucaauucaguaaggauugauugagcacauagca

SEQ ID NO: 148458 - RNA, 66 nt, Homo sapiens
auuguauauauaucucauaacuaaggacuaggaauuagaauuuggaauuuauaaucuaaaaugugu

SEQ ID NO: 148459 - RNA, 357 nt, Homo sapiens
uuaaaaccugguaccccggggccaggcacgguggcucacuccuguaaucucagcacuuugggaggccaaggcgggcggaucacaaggucaggaguucgagaccagccugacaacauggugaaaccuugucucuacuaaaaauagaaaaauuagccgggugugguggcacgugccuguaaucccagcuacucaggaggcugaggcaggagaauugcuugaacccaggaggcagagguugcagugagccgagauugcaccauugcacuccagccugggugacagagcaagacuccaucucaaaaaaaaaaaaaaacaaaaaaccugguaccccggggaaaugugaauaguauucagagg

SEQ ID NO: 148460 - RNA, 44 nt, Homo sapiens
acaaaagaaguuagaaaaggugauggaagaagaaggccuaaaag

SEQ ID NO: 148461 - RNA, 42 nt, Homo sapiens
aagggcuuacugcaaggccauacguguccaaagcccagagau

SEQ ID NO: 148462 - RNA, 51 nt, Homo sapiens
uaagaagagaguggaaaagcaacagccagaggaaaaagucgguaagggcuu

SEQ ID NO: 148463 - RNA, 42 nt, Homo sapiens
gccaacggcuccuauuaguguuugagcgugacggcgacggug

SEQ ID NO: 148464 - RNA, 32 nt, Homo sapiens
caguuggguuuccgguuaauuccucccuguuc

SEQ ID NO: 148465 - RNA, 43 nt, Homo sapiens
aagggagcgaauuaguaaagggaauucuugaaaacaacaguug

SEQ ID NO: 148466 - RNA, 48 nt, Homo sapiens
guuugguagugaauaauugggaacuguuucaggauagguuccccagaa

SEQ ID NO: 148467 - RNA, 48 nt, Homo sapiens
aggacaugucccauccuucucaacacccucuaccucuucuaucauguu

SEQ ID NO: 148468 - RNA, 31 nt, Homo sapiens
cauguccuuggcaggaguggaggagacccug

SEQ ID NO: 148469 - RNA, 339 nt, Homo sapiens
uuucauuuuuauuauuacucuuucuuuuuuuuuuuuuuuugaugcagagucuugcucugucgcccagacuggaguguaguggcacgaucccagcucacugcaaccucugccuccggaguccaagcgauuguccugucucagccucccgaguagcugggauuacaggugcccaccacuacgcccagcuaguuuuuguauuuuuaguagagacaggguuucgccuuguuggccaggcuggucuuggacuccugaccucaagugauccgccugccucggccucccaaaguggugggauuacaggcgugagccaccacgcccagccuauuacucuugguggag

SEQ ID NO: 148470 - RNA, 31 nt, Homo sapiens
uaaaacuugaaggaccagaauaacccgagcu

SEQ ID NO: 148471 - RNA, 43 nt, Homo sapiens
aucugugggaaggggacacaagccaccagccacagccucuggg

SEQ ID NO: 148472 - RNA, 44 nt, Homo sapiens
acuggaagaaaacagcuaauuauaucaccaagagacccagggca

SEQ ID NO: 148473 - RNA, 44 nt, Homo sapiens
gcccgggcaaggccagcgggagcucugccggccagaguugcuga

SEQ ID NO: 148474 - RNA, 94 nt, Homo sapiens
cuuccccgacugacaggcugguuagagcccgcccagagcagggccgugacuccccgaccccuacagcgcgccgcggagcggggacccgacgcgg

SEQ ID NO: 148475 - RNA, 42 nt, Homo sapiens
acaucaggugaucugaagucuagacaccuggcagccccugcc

SEQ ID NO: 148476 - RNA, 35 nt, Homo sapiens
guggccuagggguaaggaggggccgggcggggcag

SEQ ID NO: 148477 - RNA, 53 nt, Homo sapiens
ggaguggggagcguccugggagcggggagugucccgggagaggggaguguccc

SEQ ID NO: 148478 - RNA, 44 nt, Homo sapiens
aaauaauaauuaagacacacaaacugagacuaaggcagaagaug

SEQ ID NO: 148479 - RNA, 36 nt, Homo sapiens
ccuaguuuuuguuuaaauaauucuaaugccagaggc

SEQ ID NO: 148480 - RNA, 59 nt, Homo sapiens
acaacuacucccagccccauaugagcccacguggcaugcccuguccauagccucuacug

SEQ ID NO: 148481 - RNA, 41 nt, Homo sapiens
ucuucuagccacuguagucugcagaucaaagcucuggcgaa

SEQ ID NO: 148482 - RNA, 42 nt, Homo sapiens
agugagccucgacaggcagagauacggaaggagugccuccga

SEQ ID NO: 148483 - RNA, 47 nt, Homo sapiens
augggauggccgccagucagaccgcuggaucaagcuagaccugaaga

SEQ ID NO: 148484 - RNA, 45 nt, Homo sapiens
ggacacucugcuaucuguggaaauugugcaugagcugaaagggga

SEQ ID NO: 148485 - RNA, 35 nt, Homo sapiens
uugccacagcugcucagguugagguauuuauguua

SEQ ID NO: 148486 - RNA, 45 nt, Homo sapiens
uugccgagaaauuugugaaagccguuuccaagccuagucggcccg

SEQ ID NO: 148487 - RNA, 57 nt, Homo sapiens
gccaggguuguaauguuagauagugggaaaguuccaggacccugagagagaaaggag

SEQ ID NO: 148488 - RNA, 42 nt, Homo sapiens
ugcagggugaaggagguguacagacuggaagagauggagaag

SEQ ID NO: 148489 - RNA, 55 nt, Homo sapiens
acuaugggauucagcaaaagcuucaagaagaaguucuucuacaacaagaaaacca

SEQ ID NO: 148490 - RNA, 72 nt, Homo sapiens
aaccucaacuaaagucauugacagaccccuccgccccacacccuuaagaacacaugacccugugccaucugg

SEQ ID NO: 148491 - RNA, 45 nt, Homo sapiens
auucgugugcaugacucccagaagccccaggaccaggacaagcug

SEQ ID NO: 148492 - RNA, 112 nt, Homo sapiens
ugaacuuacucuguuuugaugccaaauuggagaccauuuucuugucuccuucccccacucauccuggccuucccuggaguucuuccuagcccagagcucugacaguccagca

SEQ ID NO: 148493 - RNA, 51 nt, Homo sapiens
cuguguggcucuguguuggggcugcugcuguuuguccucagugcuuuguga

SEQ ID NO: 148494 - RNA, 45 nt, Homo sapiens
agacgcacccuuccagccaccuccuuacccauaaaaaugacucug

SEQ ID NO: 148495 - RNA, 43 nt, Homo sapiens
gugggagaggacccagaaagugggucuuaaaggaagucccgac

SEQ ID NO: 148496 - RNA, 44 nt, Homo sapiens
agauguggggauuaggaccagauaaggagacaaaugucaagaag

SEQ ID NO: 148497 - RNA, 48 nt, Homo sapiens
ugugguaugacugggcaacucccuuaguucugugcucaguugacucac

SEQ ID NO: 148498 - RNA, 44 nt, Homo sapiens
agcaucagugcacauucaauacucagacccgcugggggcaacug

SEQ ID NO: 148499 - RNA, 45 nt, Homo sapiens
agugaacgaaugcccaagaacgaguuugacuuagccaugguggaa

SEQ ID NO: 148500 - RNA, 51 nt, Homo sapiens
uaucuaucugguagaucacauguagauguacaguguguauauuaagcugaa

SEQ ID NO: 148501 - RNA, 96 nt, Homo sapiens
cgccagcauuacaguaacuaacucuuucuaaccaaccgugaugccacguaacuuacccuauggacaaaagcaggaaugacuaacacauccuaggag

SEQ ID NO: 148502 - RNA, 48 nt, Homo sapiens
gcucccaggugugcaucuuacuggaugagguugcugugauugagauag

SEQ ID NO: 148503 - RNA, 48 nt, Homo sapiens
ugcagauguuuuacauuugauuucuaccaagaguugaaauguugagag

SEQ ID NO: 148504 - RNA, 65 nt, Homo sapiens
uugaugaguuuuuaaaaaucaaagugauuuugaaaaucucuaauggcucagaaaauaaaaacauc

SEQ ID NO: 148505 - RNA, 76 nt, Homo sapiens
aaaguucaaggacuaaccuuauuuauuugggaaaggggaggaggaaggaaaugauaugguacccagacacugggcu

SEQ ID NO: 148506 - RNA, 44 nt, Homo sapiens
gguacucuugagagcaauucaaaucaugcugacaaggauacuga

SEQ ID NO: 148507 - RNA, 47 nt, Homo sapiens
uucagucauucugguuuucaagcagugcuuuaucucauguccuugaa

SEQ ID NO: 148508 - RNA, 79 nt, Homo sapiens
gaauccuaacaaaauggcaaccuuaauguagugcugugagaauucuccuuugagauuucagaagaaaggaaacaaugug

SEQ ID NO: 148509 - RNA, 54 nt, Homo sapiens
auuggaauugcuguuccugauguauacagugcuuguaaaagguuugaagaacug

SEQ ID NO: 148510 - RNA, 40 nt, Homo sapiens
uaugucagucucucaggaucacaccaauuugugaaggagu

SEQ ID NO: 148511 - RNA, 47 nt, Homo sapiens
aucuacagccucugcccugguagcauaaauuugucuauguacucaag

SEQ ID NO: 148512 - RNA, 34 nt, Homo sapiens
ucagcuguggggaucagggcacacaucaaaaaga

SEQ ID NO: 148513 - RNA, 48 nt, Homo sapiens
caaauaaggacacucaggcacauagagguguugagugauuugcccagg

SEQ ID NO: 148514 - RNA, 42 nt, Homo sapiens
gauugaauaugugcuucgugcagaccuuuaaaagggguagau

SEQ ID NO: 148515 - RNA, 48 nt, Homo sapiens
uauuuuuuaaacuaggugcugcaaaauuagucauaaaggcugucaguu

SEQ ID NO: 148516 - RNA, 68 nt, Homo sapiens
gaagacaacucuacuuacaguuuaaacuaaaugauuugagcuucccaggugccuaacuaagcaacuuc

SEQ ID NO: 148517 - RNA, 41 nt, Homo sapiens
ucccagaccuguuggagccauauuuagcuuaggaaagcuug

SEQ ID NO: 148518 - RNA, 96 nt, Homo sapiens
caaacuuguuaguggcuugcauuuugucaauuuuucuuugccauuucagucuuucaagcagcugaaucgcagaacugaaacaaaacacuuauauug

SEQ ID NO: 148519 - RNA, 31 nt, Homo sapiens
ggggcauccccgggcugugggguggaggggg

SEQ ID NO: 148520 - RNA, 48 nt, Homo sapiens
ugauguugggugugaacaacauggugaauaucguuuaacagauauggu

SEQ ID NO: 148521 - RNA, 109 nt, Homo sapiens
auguaaugagaacaugaugucugcagauuguuuacacuuacugaggaacagaaucauaacaaaagcccaguuaccaacucugccaggcagguccaaucuuucuauggcu

SEQ ID NO: 148522 - RNA, 42 nt, Homo sapiens
cguauacuacuacaucaauaaugacaccuacacuggagagug

SEQ ID NO: 148523 - RNA, 45 nt, Homo sapiens
aaggcacggacgugggagggcacggcuacccaacggggacaccua

SEQ ID NO: 148524 - RNA, 43 nt, Homo sapiens
gacacaccugcgugcguccuggaaguugauggugaaaagugaa

SEQ ID NO: 148525 - RNA, 58 nt, Homo sapiens
uuuugaaagguaacacagacauuuucagggauuuggagaggaaacuaaugccauccug

SEQ ID NO: 148526 - RNA, 40 nt, Homo sapiens
uaaaugugcuacugcagaaaggugugaauugacagcagag

SEQ ID NO: 148527 - RNA, 36 nt, Homo sapiens
caaagagggagugcuuccuguguuaauuuguuauug

SEQ ID NO: 148528 - RNA, 44 nt, Homo sapiens
uugaguaaaagaacaauaaggggcauuucugcuaaaggugccag

SEQ ID NO: 148529 - RNA, 51 nt, Homo sapiens
auggcaacaaccuucccucucccguccaucggccuugggucccagagccac

SEQ ID NO: 148530 - RNA, 37 nt, Homo sapiens
aggcuuuauaagcaaagccacagucauccuuacuugc

SEQ ID NO: 148531 - RNA, 48 nt, Homo sapiens
gucaccccaaggaugaugacaccccagggaaggugguggaagcaggaa

SEQ ID NO: 148532 - RNA, 32 nt, Homo sapiens
gugugugugugaguguggggugugggugugag

SEQ ID NO: 148533 - RNA, 51 nt, Homo sapiens
aagacugacagcuugacgucuggggccaccgagaaguccagagagagaagc

SEQ ID NO: 148534 - RNA, 62 nt, Homo sapiens
acugugccugaggaaagcggggggcguggcugcaguucuggacgggcuggccgagcugcgcg

SEQ ID NO: 148535 - RNA, 37 nt, Homo sapiens
cagggaagagcugcccugggcaccuggcaccacaaga

SEQ ID NO: 148536 - RNA, 87 nt, Homo sapiens
ugucagacuaugcuccaggaagcccagguguuucgaggacuugcuucuacgguuucuuugucugcggaaucagggaagagugaaaag

SEQ ID NO: 148537 - RNA, 46 nt, Homo sapiens
aaguccaccaaaaaguaagauuuugaugguagucauaagggaaaga

SEQ ID NO: 148538 - RNA, 91 nt, Homo sapiens
gaagaaaggguccccugcuaagccaucagaaggcagggaaaaugcgagaccaaaaaccacaaugcccagaucucaaguagaugaagaguuu

SEQ ID NO: 148539 - RNA, 46 nt, Homo sapiens
uuaaaggaaaaacaauugcagaaaacauuuagauuaaaugaaauag

SEQ ID NO: 148540 - RNA, 45 nt, Homo sapiens
accgaagggcagcccagcgccugcuguguuggcagaagaggccag

SEQ ID NO: 148541 - RNA, 44 nt, Homo sapiens
gagccguuugacaacacuaccuacaagaaccugcagcaucauga

SEQ ID NO: 148542 - RNA, 49 nt, Homo sapiens
cuguuuaacacugcaggguuuaagaagccgaaguagcugaaggcaccug

SEQ ID NO: 148543 - RNA, 53 nt, Homo sapiens
agacguccgagguaaucaucucaaccacgacgaacccagagagaggggccgag

SEQ ID NO: 148544 - RNA, 42 nt, Homo sapiens
cugcgccgcugaggccaccggggacgcgccggucugcaggag

SEQ ID NO: 148545 - RNA, 36 nt, Homo sapiens
guggugcuguaacuggagcagccugugggaacagag

SEQ ID NO: 148546 - RNA, 48 nt, Homo sapiens
ccgguccacgcccagggucugcaugauacccagcgccugcucaucgua

SEQ ID NO: 148547 - RNA, 45 nt, Homo sapiens
gggcaggcgggucccggcaagcagggcucagcccgcauccaccgg

SEQ ID NO: 148548 - RNA, 42 nt, Homo sapiens
ccuccagcacccgcugucucagcgucggcagguuaggcccau

SEQ ID NO: 148549 - RNA, 42 nt, Homo sapiens
ucuccugacuuguagaaauucccaaauccaaaaucugagcgg

SEQ ID NO: 148550 - RNA, 38 nt, Homo sapiens
uguuucuuuaacggagcuaauuccacacaaugggcaaa

SEQ ID NO: 148551 - RNA, 44 nt, Homo sapiens
caccacgacaaucaagccuggagcagugaaucugcauggggucc

SEQ ID NO: 148552 - RNA, 45 nt, Homo sapiens
caacccucccaccccagacuauucccugcaccacaucagccaguu

SEQ ID NO: 148553 - RNA, 46 nt, Homo sapiens
cuuuuuuuuuuuuuuuuuuuuaauuuuuauaauuggagccccuggu

SEQ ID NO: 148554 - RNA, 46 nt, Homo sapiens
agugugugaccguggcuguacuguauagugaacauaguuggcauau

SEQ ID NO: 148555 - RNA, 36 nt, Homo sapiens
gcaaaacauugacuuuccauaguguuaggggcggug

SEQ ID NO: 148556 - RNA, 73 nt, Homo sapiens
gaaggaggagaagauccacucacccaucauccgcagcgagcccuucagccccucgcugcggccggagcccccc

SEQ ID NO: 148557 - RNA, 46 nt, Homo sapiens
ccuccccgcuuaugauacauuccccccagaugucacaguuccagag

SEQ ID NO: 148558 - RNA, 32 nt, Homo sapiens
uagcagagugaagaaugaaguucagggagagc

SEQ ID NO: 148559 - RNA, 42 nt, Homo sapiens
gcaguuuuccacccacauccaacagcccccgccaccccaggg

SEQ ID NO: 148560 - RNA, 46 nt, Homo sapiens
gcagccaucacggcccagcaaccgagccgcugcccugccucccaag

SEQ ID NO: 148561 - RNA, 48 nt, Homo sapiens
ucaugagaugggauuccucccauggaaccuggacagcacucaccuggg

SEQ ID NO: 148562 - RNA, 46 nt, Homo sapiens
caugccgcagcaggcagccccggcgaugaaguccucgcccccaccc

SEQ ID NO: 148563 - RNA, 42 nt, Homo sapiens
cagcaggccccggcuccugugccccagcagccgcccccgccu

SEQ ID NO: 148564 - RNA, 29 nt, Homo sapiens
uacaugggcucaggggcauccuucauuag

SEQ ID NO: 148565 - RNA, 23 nt, Homo sapiens
agcccuggccuuuucuucccagu

SEQ ID NO: 148566 - RNA, 51 nt, Homo sapiens
cuuuuacaaccaaaaaaacaagguuucuuccaaggccacgagacaacaggc

SEQ ID NO: 148567 - RNA, 44 nt, Homo sapiens
cagugucgggccugcaugcugcccccgacacacgcacgcacgcg

SEQ ID NO: 148568 - RNA, 41 nt, Homo sapiens
uucugggcauccagcuuccaguuaagcucuguuugccaaac

SEQ ID NO: 148569 - RNA, 46 nt, Homo sapiens
uguggguguuucuuaauagcuccaggggaaaaaggaaugcuugaug

SEQ ID NO: 148570 - RNA, 41 nt, Homo sapiens
uuaggaauacccguuuaaccucagcuaccugggcugggaca

SEQ ID NO: 148571 - RNA, 68 nt, Homo sapiens
gcuguggccaucacauccugauuuccagugugugaucauggccuuugcccuuggccucugcgucccuc

SEQ ID NO: 148572 - RNA, 43 nt, Homo sapiens
gccaagccuccagcuugccuuccucuggguuuuugcaccuccu

SEQ ID NO: 148573 - RNA, 100 nt, Homo sapiens
ugaugcugggugccaggugggaguggagaggggacugcucuccuccaagugugcacuuuccucauuauucucaggggcgcagaugcucaggcuggcgcag

SEQ ID NO: 148574 - RNA, 83 nt, Homo sapiens
gcguggggguccaggcugugcuguugaccuugaugugaccacacccagcuuucugcaccaguggagacuucguguccccaggg

SEQ ID NO: 148575 - RNA, 61 nt, Homo sapiens
uuugagacccugaagccguccacacugcgugagcuggagcgcuaugucaccuccuguuugc

SEQ ID NO: 148576 - RNA, 45 nt, Homo sapiens
ccacguaugagucggaggaagaggacaagugcaagccuauguccu

SEQ ID NO: 148577 - RNA, 73 nt, Homo sapiens
agaauaaaaaaagcaaagccaaggaaccuccuccuaaaaagacgaagaaaaauaauagcagcaacagcaaugu

SEQ ID NO: 148578 - RNA, 95 nt, Homo sapiens
ccucucucagccccagcagaacaaaccaaagaaaaaggagaaagacaagaaggaaaagaaaaaagaaaagcacaaaaggaaagaggaaguggaag

SEQ ID NO: 148579 - RNA, 35 nt, Homo sapiens
guuggcagggccagucccagcccugaggcugagaa

SEQ ID NO: 148580 - RNA, 46 nt, Homo sapiens
cagcccguacagagccacccacccaucaucgcggccaccccacagc

SEQ ID NO: 148581 - RNA, 46 nt, Homo sapiens
cagccacugcagacgcccccgccagugcccccccagccacaacccc

SEQ ID NO: 148582 - RNA, 41 nt, Homo sapiens
accaaacacaacucaagcaucgacuccuccgcagacccaga

SEQ ID NO: 148583 - RNA, 43 nt, Homo sapiens
augaagggcagcaguccagcugcccccugugguuccaggaggu

SEQ ID NO: 148584 - RNA, 46 nt, Homo sapiens
ugggugugccacgugaccauuguguguucggacugccugcacagcu

SEQ ID NO: 148585 - RNA, 26 nt, Homo sapiens
cucagcagaaucucacccuugcuccu

SEQ ID NO: 148586 - RNA, 44 nt, Homo sapiens
aaugagcuacccacagaagaaaccgagaucaugauaguccaggc

SEQ ID NO: 148587 - RNA, 46 nt, Homo sapiens
aucaacccuuucaaauagaacgacucuggagggagacacuauacag

SEQ ID NO: 148588 - RNA, 45 nt, Homo sapiens
gguuguuccugugacugggugugggcuuuuuugcugggaggaggg

SEQ ID NO: 148589 - RNA, 41 nt, Homo sapiens
cggcagugggcaugucaggagcccgugggcagggguguugg

SEQ ID NO: 148590 - RNA, 70 nt, Homo sapiens
ccagccagccaacgcagccagcaccaaccccccgcccccagagaccuccaacccuaacaagcccaagagg

SEQ ID NO: 148591 - RNA, 44 nt, Homo sapiens
cugcggagagcggcccugggacgagauugagaaaucugccagua

SEQ ID NO: 148592 - RNA, 43 nt, Homo sapiens
uuucuguuggaaguagauacaaaaguaggacaucaaguucgau

SEQ ID NO: 148593 - RNA, 47 nt, Homo sapiens
aacuugugauuucaugaggggcuguagucaguuggcauuggcuggca

SEQ ID NO: 148594 - RNA, 40 nt, Homo sapiens
ucagggucccucauccucuuguuuuugucccugggcagaa

SEQ ID NO: 148595 - RNA, 105 nt, Homo sapiens
cguuaauuuagugucacauucugcguucccuuuucuucaagaaaagugaugccguuccuccuccugauccccauagauuggauucuguaccuaaugaguggugag

SEQ ID NO: 148596 - RNA, 44 nt, Homo sapiens
uggaacacacuggaaacaugaaaacugcaggcuuagaugagaag

SEQ ID NO: 148597 - RNA, 28 nt, Homo sapiens
uccagaccuuuaucaguuacagcugcag

SEQ ID NO: 148598 - RNA, 43 nt, Homo sapiens
agguggcaagauaaccaagcuucgcuugaguucagugcuugcu

SEQ ID NO: 148599 - RNA, 45 nt, Homo sapiens
gccacaugagcuagcaacagcaagugcauccgugagagagaugcg

SEQ ID NO: 148600 - RNA, 58 nt, Homo sapiens
ggaucacaaaaucgaaaauugugucgaccagcuucuuagcugggcuuggccauggcgg

SEQ ID NO: 148601 - RNA, 49 nt, Homo sapiens
acgucauaccaaggaauccacucaugcugggccacugaaggaaccaugg

SEQ ID NO: 148602 - RNA, 44 nt, Homo sapiens
cuacuuuucuccucugaaucuaaagguguucgcugucagagcua

SEQ ID NO: 148603 - RNA, 42 nt, Homo sapiens
agaguggguugggauuaugugguaaguguaaaaaaguuagcg

SEQ ID NO: 148604 - RNA, 25 nt, Homo sapiens
ggaaaauguauagcaggcaggugcu

SEQ ID NO: 148605 - RNA, 61 nt, Homo sapiens
guacauugucugccagcuuacuacaagcaucauggccaggcuggguuuggcugcucagcac

SEQ ID NO: 148606 - RNA, 39 nt, Homo sapiens
uaacauuucucuaugcauugccucagaauguaaccacaa

SEQ ID NO: 148607 - RNA, 128 nt, Homo sapiens
uuccaacugggagcauaggaagggggcuagcauugagucugguucuucaaugaggacagcagagguuuggaaagagaccuggacaggucugaaagcaaguaccugucccuuggaggugcucaccagug

SEQ ID NO: 148608 - RNA, 87 nt, Homo sapiens
aucuuuuucaaaauaauagcucagcuaucuguaaucccaggaaugcaguuuuaaauuaccaguguuagagcggucucucuauugggc

SEQ ID NO: 148609 - RNA, 59 nt, Homo sapiens
uaccauaaacuugaauaauucauacuucuguaauuggggcagaguugagucagaggaug

SEQ ID NO: 148610 - RNA, 51 nt, Homo sapiens
gugcugcgggacauuugcuuacgcaugcacuggaaccugcagauugaggaa

SEQ ID NO: 148611 - RNA, 36 nt, Homo sapiens
acccugcuucucucuagaucaucacuccuuaagagg

SEQ ID NO: 148612 - RNA, 48 nt, Homo sapiens
uucuagguuggaucauugcccaucucugaccaugugcagaaugggaau

SEQ ID NO: 148613 - RNA, 22 nt, Homo sapiens
aggucaagagugagucuuccca

SEQ ID NO: 148614 - RNA, 50 nt, Homo sapiens
ccucaguuuuucauauauaaaguagggcgcauagguuuugauuccagaga

SEQ ID NO: 148615 - RNA, 52 nt, Homo sapiens
gcugugguucaacccugaccugccaaaaguauuuucaagagggauaugaagu

SEQ ID NO: 148616 - RNA, 41 nt, Homo sapiens
guaaaauguuuugguuucugauuuugaauaaacuuguagag

SEQ ID NO: 148617 - RNA, 347 nt, Homo sapiens
caauauauacauauacuuuuagauggagucucgcucugucgcccaggcuguagugcaguggcgcgaucucggcucacugcaaccucugccuccuggguucaagcgauucuccugucucagccucucgaguagcugggacuacaggcgcccgccaccacaucuagcuaauuuuugcauuuuuaggagagacgcggguuucaccauguuggccaggcuggucucgaacuccugaccucagguguuccauccuccucggcuucccaaaguguugggauuacaggcaugagccaccguucccggccgccaauaauuucauaaagcauuuauuucgguuuaauuuggguggg

SEQ ID NO: 148618 - RNA, 38 nt, Homo sapiens
gucgggaguuuuuugugaauggagcugucaaguucccu

SEQ ID NO: 148619 - RNA, 61 nt, Homo sapiens
cggccuauuuuauuugcaguguuguguggugguggugauuguggugauuugggguggggau

SEQ ID NO: 148620 - RNA, 42 nt, Homo sapiens
ccucugcugccauugucucggcgccauuuccagccucugcag

SEQ ID NO: 148621 - RNA, 44 nt, Homo sapiens
uucucuccuguaacagacaagucccuucgagacgcucugagugg

SEQ ID NO: 148622 - RNA, 49 nt, Homo sapiens
ugucagagacuccugguggacacgggccuggagugagagcccggaguag

SEQ ID NO: 148623 - RNA, 58 nt, Homo sapiens
acauaccauuuucggagaaaucuccuucacugucaacccgggccaguuuggugucugg

SEQ ID NO: 148624 - RNA, 43 nt, Homo sapiens
cgcuguagcuccgccccccuagcgccgccauuuuguggcgucu

SEQ ID NO: 148625 - RNA, 51 nt, Homo sapiens
cgaccacagcacgcaugcguucagcgcaccuccgccaucgacuacuggaag

SEQ ID NO: 148626 - RNA, 43 nt, Homo sapiens
ccaccccgccccgcccgcgcggcacaguaacagagaaacccgg

SEQ ID NO: 148627 - RNA, 57 nt, Homo sapiens
cgugucgccgccaccgccgccgcccccagaggaggaggaggagggcgccgugcccuu

SEQ ID NO: 148628 - RNA, 41 nt, Homo sapiens
auucucaacaacaagcucaucagcaagaagcuggagcgcua

SEQ ID NO: 148629 - RNA, 45 nt, Homo sapiens
cugggucagauccuggucucuguagauuugguggaugaggccauc

SEQ ID NO: 148630 - RNA, 45 nt, Homo sapiens
guccgguauuugcacagagaacacacaaacuggauccugccacag

SEQ ID NO: 148631 - RNA, 42 nt, Homo sapiens
ggacaggcugggaccaguggggucgggaguagaaagggccag

SEQ ID NO: 148632 - RNA, 38 nt, Homo sapiens
gaagcccggggucuggggccugggccggagcaggccgc

SEQ ID NO: 148633 - RNA, 42 nt, Homo sapiens
ccgagcagguggcggcucccaagggaggccagagggcggcga

SEQ ID NO: 148634 - RNA, 46 nt, Homo sapiens
caguccgugcggguggcuuugcuaucuggcucaucaggacugccgc

SEQ ID NO: 148635 - RNA, 46 nt, Homo sapiens
gccaaacccgaaaccaaagcgggagccgcccgggaaggcgccccca

SEQ ID NO: 148636 - RNA, 56 nt, Homo sapiens
uguucugggagaagagggagggcagccgagaggcaccagacaugcacuggccccgg

SEQ ID NO: 148637 - RNA, 41 nt, Homo sapiens
agagacgggaagugcaacggacccugcugggagccacagca

SEQ ID NO: 148638 - RNA, 96 nt, Homo sapiens
cccggggagcuucggggacauuggacaggggcagggaugggaggugcuggaggcagggagagcucagagaugagaaaacaagggcugaaagcagag

SEQ ID NO: 148639 - RNA, 42 nt, Homo sapiens
gcaauggggcccauugacauaucuuagggguggagggaaaua

SEQ ID NO: 148640 - RNA, 362 nt, Homo sapiens
caacaggguguaagaugagaagcagugggccaggugcaguggcucaugccagcacuuugggaggucaaggugggcagaccacuugaggucaagaguuugagaccacccuggacaacaugaugaaaccucaucucuacuaaaaauauaaaaauuagccaggcgugauggugggcgccuauaaucccagcuacuugggaggcugaggcaagagaaucacgugaaccugggaggcggagauugcagugagcugagaucacgccacugcacuccagccuuggugugcacgagugagaacgagacgacaucucaaaaaaaaaaaaaaaaaaaaaaaagguugagagauagugaacagaaaaagcuag

SEQ ID NO: 148641 - RNA, 56 nt, Homo sapiens
gauagauaauaagauagaugguuggauggacccguagauaggauggguggaugcau

SEQ ID NO: 148642 - RNA, 42 nt, Homo sapiens
caagccaccagaguuggacaucacggaaguaguggcccagau

SEQ ID NO: 148643 - RNA, 42 nt, Homo sapiens
aggucacuucuccuuuuccaagggcccagcugggauccgagu

SEQ ID NO: 148644 - RNA, 40 nt, Homo sapiens
uccauggccaagaucccagguccuggggaagaacucacuc

SEQ ID NO: 148645 - RNA, 46 nt, Homo sapiens
aggcucuccuucaggcacauggucaggaagggcaacugggccaggu

SEQ ID NO: 148646 - RNA, 45 nt, Homo sapiens
cggcaggacgcggaagcgcagcagcgugagcgccaggaccaccuu

SEQ ID NO: 148647 - RNA, 44 nt, Homo sapiens
uccgcauccugcccgaccacagggagccacgcaggacgccggag

SEQ ID NO: 148648 - RNA, 48 nt, Homo sapiens
augaauccaauagguaguguggguuuuuuugucaguuaauacaaaauu

SEQ ID NO: 148649 - RNA, 45 nt, Homo sapiens
aggacucaugcuggacagaaacccuaugaauguaagcaaugugga

SEQ ID NO: 148650 - RNA, 49 nt, Homo sapiens
aggaauaugaaaagcaaccauguaaauguaaagcaguugggaaaaccuu

SEQ ID NO: 148651 - RNA, 44 nt, Homo sapiens
ccuauggcuuuuauuccuuucucggcggggcccaggugaggcca

SEQ ID NO: 148652 - RNA, 34 nt, Homo sapiens
ugccccucccuguuucuccaucccccgggccugg

SEQ ID NO: 148653 - RNA, 46 nt, Homo sapiens
agaggugauugcauagaaagcuuccugggaagaacaaacaggaggu

SEQ ID NO: 148654 - RNA, 41 nt, Homo sapiens
acgggggcucaugagcacauuguaacgcaguggguggcaga

SEQ ID NO: 148655 - RNA, 42 nt, Homo sapiens
augaaagaacucacacuggagagaaaccccaugaauguaaac

SEQ ID NO: 148656 - RNA, 68 nt, Homo sapiens
uuuccuaguuccuuuagaaaacaugaaagaauucauacaggagagaaacccuaugauuguaaggaaug

SEQ ID NO: 148657 - RNA, 43 nt, Homo sapiens
caaauauggagagaaaucauaugaauguaaggaaugugggaaa

SEQ ID NO: 148658 - RNA, 47 nt, Homo sapiens
gaaaggaaagaagguagucaguuuggagaaaccaucagucagacucc

SEQ ID NO: 148659 - RNA, 46 nt, Homo sapiens
ugacccagagcccagaaggguucucuccgccucuuccuuccaccag

SEQ ID NO: 148660 - RNA, 64 nt, Homo sapiens
ucccggagacuaugcuggucaggccagggcuggguccggggccaggcuggcagcugucuggggc

SEQ ID NO: 148661 - RNA, 45 nt, Homo sapiens
gggacugugugggcgggcaguggguucgcagaugcugugccaggu

SEQ ID NO: 148662 - RNA, 45 nt, Homo sapiens
cuccugcaugcuggggaaggucucggugcagcucagggcugagca

SEQ ID NO: 148663 - RNA, 57 nt, Homo sapiens
cugucaaagccccgagugguuugaaggaagugcucccgggcgaccacagggcuagau

SEQ ID NO: 148664 - RNA, 27 nt, Homo sapiens
agaaaauaugagaacagaggcugggag

SEQ ID NO: 148665 - RNA, 71 nt, Homo sapiens
ggaggcugguucgcccaggcuuuuaugaggcauuuagcuugaacuguggggacaugaggaagcauugccga

SEQ ID NO: 148666 - RNA, 76 nt, Homo sapiens
cucacugccuucaccacugucaccccaggagguagugggaggcagugucugcccucccccaaccaauugccuggau

SEQ ID NO: 148667 - RNA, 81 nt, Homo sapiens
cuggagacaugcagugggaggggugaaagaaugagggggucaaggaugcugggggggugggguaccacccauggggggagg

SEQ ID NO: 148668 - RNA, 59 nt, Homo sapiens
gggaugucgggaucuccagugcugcuagaggagguuggguguggaaucagcacuaaaug

SEQ ID NO: 148669 - RNA, 45 nt, Homo sapiens
cugcgcaggcuucuugggaaagguacucaacucaggcugcgggga

SEQ ID NO: 148670 - RNA, 41 nt, Homo sapiens
gaagccggccacggccgcaggcagugagcucucggaagcgg

SEQ ID NO: 148671 - RNA, 45 nt, Homo sapiens
gcugcagagggucuccgaaagcucugcauauccacgggccccggg

SEQ ID NO: 148672 - RNA, 45 nt, Homo sapiens
gcgggaugucuucaggcugucgguccuggaaguggagcccagcgg

SEQ ID NO: 148673 - RNA, 46 nt, Homo sapiens
cgcugggcuccacuuccaggaccgacagccugaagacaucccgcag

SEQ ID NO: 148674 - RNA, 351 nt, Homo sapiens
ggggauaccugagaugaggccucuucuuuuuuuuuuuuuuuuuuuuuuuuugagacggaguuuuucucuguugcccaggcuggaguggugcaggggcaugaucucgggcucacugcagccuccaccucccggguucaagcgauucuccugccucagccucccaaguagcugggauuacaggugccccccaccacaccgggcuaauuuuuguauuuuuaguagacgggguuucaccacguuggccaggcuguugucgaacuccugacuucaggagauccgcccacuucagccucccgaaguucugggagcuccaggccgagaugaggccucuuugagccccacaauccgcac

SEQ ID NO: 148675 - RNA, 45 nt, Homo sapiens
guaugacgauguggaacccagagaugacuccagccccagccccaa

SEQ ID NO: 148676 - RNA, 87 nt, Homo sapiens
agggaagccucugagaggcaggagcagcuggaggggcuguguguuccaggugagacuguggauggccaugccugguaucuggcgggc

SEQ ID NO: 148677 - RNA, 46 nt, Homo sapiens
ggacccaaaguugcugaagcagcugaggaaggcagagaaggccgag

SEQ ID NO: 148678 - RNA, 49 nt, Homo sapiens
cgggcggacggcgccgccuucuccccuuuuccuuggccgacucuaggga

SEQ ID NO: 148679 - RNA, 40 nt, Homo sapiens
gcuaccccguccugcccggggaaaagcuagaagccccggu

SEQ ID NO: 148680 - RNA, 42 nt, Homo sapiens
guuccagcccucccagugagcucugcacggccgggccggggc

SEQ ID NO: 148681 - RNA, 99 nt, Homo sapiens
aacagaucgcagaccgcgcugcccacgacgaguccccggggaacaacgugguggacaucagcgugccgcccaccacggacggacagaagcccaacaagc

SEQ ID NO: 148682 - RNA, 63 nt, Homo sapiens
cucggcaggcagggcacgugcuggcucaccccacgucccccuguacccccuuugcagagaucu

SEQ ID NO: 148683 - RNA, 49 nt, Homo sapiens
cuggcugugaccagauguggguccuggcugggugcgcagccccuguccu

SEQ ID NO: 148684 - RNA, 88 nt, Homo sapiens
uuccagaaaagaacaacuuguccuucaucgagaccucagccuuggauuccacuaacguagaggaagcauucaagaacauccucacagg

SEQ ID NO: 148685 - RNA, 39 nt, Homo sapiens
ggccuugggaugggccaggugggugggcggggucccuga

SEQ ID NO: 148686 - RNA, 40 nt, Homo sapiens
agacgcaggcaucagagaggugucuggaaggcaggaggcc

SEQ ID NO: 148687 - RNA, 48 nt, Homo sapiens
ccugcgccaccugcgggcugugcccacugacgaggcccgcgccuucgc

SEQ ID NO: 148688 - RNA, 51 nt, Homo sapiens
ugggcgcccugcugguguacgacaucgccaagcaccugaccuaugagaacg

SEQ ID NO: 148689 - RNA, 46 nt, Homo sapiens
ccaucaggacccacucagcugccuuuuucuggaccccucccaagcc

SEQ ID NO: 148690 - RNA, 93 nt, Homo sapiens
gacgcugagauucgggggcgugggcuugcagcgcgugggcuuggaaggauguguaggaguugggcaggagaaggggagagugugcucccaaga

SEQ ID NO: 148691 - RNA, 46 nt, Homo sapiens
accugcugucgcgcuucacccgcaacgaguucaaccuggagagcaa

SEQ ID NO: 148692 - RNA, 28 nt, Homo sapiens
gaugccuguccugaggcucccugagguu

SEQ ID NO: 148693 - RNA, 51 nt, Homo sapiens
cguguugggggaacagcauggaggccuguguggcuggagcagagugagccg

SEQ ID NO: 148694 - RNA, 43 nt, Homo sapiens
auuuguuuuccuucgugaauguucuuuccuucccccaggaaug

SEQ ID NO: 148695 - RNA, 48 nt, Homo sapiens
cgccccucguggcaggaggaagcuuuggaaggguuuuggagacuggga

SEQ ID NO: 148696 - RNA, 104 nt, Homo sapiens
ggggcccgggagaggcggggcaggcaaugggggcugggccgagaugagggccugggggugaggugugugguggugggagccuuggauuggggugcaaagcuggg

SEQ ID NO: 148697 - RNA, 41 nt, Homo sapiens
cgcagccccagccgcgcccgcacccgagcccgcccccucga

SEQ ID NO: 148698 - RNA, 25 nt, Homo sapiens
uggaguccugcgauguggguguggc

SEQ ID NO: 148699 - RNA, 40 nt, Homo sapiens
cggauguccccgccgcugggagggccaggggugcccgagu

SEQ ID NO: 148700 - RNA, 49 nt, Homo sapiens
aggaggccaggagagacucaggauggaucggggacagcgccgaccagga

SEQ ID NO: 148701 - RNA, 43 nt, Homo sapiens
ucgcuggcuacuccgcggggccggcucagcugccgcugcagcg

SEQ ID NO: 148702 - RNA, 46 nt, Homo sapiens
cagcaguucgggucccaggcgccucaccccuuccagcauccuggcc

SEQ ID NO: 148703 - RNA, 44 nt, Homo sapiens
gcgcccacgcaccugacuggccuuggcauugacaucacccaugc

SEQ ID NO: 148704 - RNA, 43 nt, Homo sapiens
ugagguucuugaaauuaaaucccuuacaucuuccaagucccag

SEQ ID NO: 148705 - RNA, 32 nt, Homo sapiens
ccucccuacgcgcuacucuccggcgguugggc

SEQ ID NO: 148706 - RNA, 50 nt, Homo sapiens
uacccuauuuccgacuuaccugagagccugacauuccaaaaucuaccuuu

SEQ ID NO: 148707 - RNA, 46 nt, Homo sapiens
acacugggcagcgagauggaggucaugccuuugaguaggaccugau

SEQ ID NO: 148708 - RNA, 42 nt, Homo sapiens
acuuguccacaaugugccacauuuggagcacagaccccacug

SEQ ID NO: 148709 - RNA, 46 nt, Homo sapiens
gcugcugggagauugauucucacuggcccggcuggaggcaugggag

SEQ ID NO: 148710 - RNA, 47 nt, Homo sapiens
uuuccccacuggccaggcagggacccggguagauccucuccaguucu

SEQ ID NO: 148711 - RNA, 45 nt, Homo sapiens
cuuuggaggaaagugaaagugaaaggaggaagaggaggcuucaug

SEQ ID NO: 148712 - RNA, 25 nt, Homo sapiens
aggagcagagacagggacuucaugg

SEQ ID NO: 148713 - RNA, 52 nt, Homo sapiens
aagggcagcguucggggaacuucaaaugcacagacuaccccguagugagacu

SEQ ID NO: 148714 - RNA, 42 nt, Homo sapiens
aggcagccagaaggucccauuuccgguccaugggccccaugg

SEQ ID NO: 148715 - RNA, 41 nt, Homo sapiens
uaccugcuaccuccagggugaccucagcgcugcgccccgag

SEQ ID NO: 148716 - RNA, 33 nt, Homo sapiens
uccucaagggagggcccugaaagaccuggcagg

SEQ ID NO: 148717 - RNA, 38 nt, Homo sapiens
uugaauccuugcagguggacagguagacagcugugggg

SEQ ID NO: 148718 - RNA, 47 nt, Homo sapiens
gaugaugggagaaggaugaggcuaauauuuucugcccuccagacacu

SEQ ID NO: 148719 - RNA, 44 nt, Homo sapiens
gcuacuacagaagcuugggccagagaugaugguggcuuccacag

SEQ ID NO: 148720 - RNA, 53 nt, Homo sapiens
gacgaggccgaccucgucugcgacccagggagggcaaggguggaccaggcaaa

SEQ ID NO: 148721 - RNA, 61 nt, Homo sapiens
gacgugggugggugucaagaagaccggaagggaguucugcaggaagguugggggagggggc

SEQ ID NO: 148722 - RNA, 46 nt, Homo sapiens
acugaggcaaggaggaggagauguagggacccagagacaagagaaa

SEQ ID NO: 148723 - RNA, 51 nt, Homo sapiens
caaaaacaaggagggagacagggaccaagacacgacugcucagagagguag

SEQ ID NO: 148724 - RNA, 46 nt, Homo sapiens
uccccccaggcugcccgaagccuguggauggggcuggacugcaggg

SEQ ID NO: 148725 - RNA, 37 nt, Homo sapiens
ggauagggaaguccagcauccagcccagacacuccgc

SEQ ID NO: 148726 - RNA, 109 nt, Homo sapiens
aaaggcaggggcuccuggcaaggccugaccccaugguggggggaggggaggggaggggagggaaugaggcagcucuaggaucuauacuguagcuaauaaaauguaaaaa

SEQ ID NO: 148727 - RNA, 28 nt, Homo sapiens
gagcugggggaggcucgggccacaguag

SEQ ID NO: 148728 - RNA, 39 nt, Homo sapiens
aacuugaagcacaacuaacagaaaauaauaucgugaaag

SEQ ID NO: 148729 - RNA, 57 nt, Homo sapiens
gcuuucauccccgccauggcggagcugauccagaagaagcuacagggagaaguggag

SEQ ID NO: 148730 - RNA, 41 nt, Homo sapiens
ggaagccuggaagcugguggguggcucugacggggaaagga

SEQ ID NO: 148731 - RNA, 45 nt, Homo sapiens
acacagugugucaagcuggcuggugccacccacuacccgcuagac

SEQ ID NO: 148732 - RNA, 69 nt, Homo sapiens
aucagagcuggucuugcgagggggccguugggggcaaugggagagaagcacggaaccccagagagaggc

SEQ ID NO: 148733 - RNA, 128 nt, Homo sapiens
cacacguuccaccuggcaggcagaccaaggucagaucuagauggaccccuuucugaggcugaccccacccccagcccccuuccuuguccucaccucauccucagugaguucucccgcccucuugguga

SEQ ID NO: 148734 - RNA, 47 nt, Homo sapiens
guugaguacucgcaaaauaugcuggaacuuuucagggaucacuagag

SEQ ID NO: 148735 - RNA, 24 nt, Homo sapiens
uaccauggcugcagcacaagcggc

SEQ ID NO: 148736 - RNA, 45 nt, Homo sapiens
caccagcuucuuucggcagguaggacacuccuuguuccuggggua

SEQ ID NO: 148737 - RNA, 45 nt, Homo sapiens
aggcacuccuugguggucaucguauucuucagcauguccaggcag

SEQ ID NO: 148738 - RNA, 50 nt, Homo sapiens
gcuuuaaucaaaucagucucaguccguguggugaggacaggaacaaggcg

SEQ ID NO: 148739 - RNA, 36 nt, Homo sapiens
uaagaauuaagguuagugacccagagaccaagggga

SEQ ID NO: 148740 - RNA, 46 nt, Homo sapiens
agagaacagcuguuccucaucaaauucaugggugaacuggcccgag

SEQ ID NO: 148741 - RNA, 42 nt, Homo sapiens
uugauuugagauugaaggagaaaagggauuuauucuccagcg

SEQ ID NO: 148742 - RNA, 70 nt, Homo sapiens
cucccuuccuggguuaucaucagaccugucacuugcagugaggccucaccucaacuaaggaggucaaaau

SEQ ID NO: 148743 - RNA, 49 nt, Homo sapiens
agugggagucaacuccagauuguggugggcugagaaguaagugggaggu

SEQ ID NO: 148744 - RNA, 42 nt, Homo sapiens
agcuuugccaacgaggagggcgaagcccagaaguuuagggaa

SEQ ID NO: 148745 - RNA, 42 nt, Homo sapiens
ccgcaccccucgcugcccacccaguggucuguugacucccuu

SEQ ID NO: 148746 - RNA, 41 nt, Homo sapiens
cagcacucugaaacugagaaauguucagaauguacggaaag

SEQ ID NO: 148747 - RNA, 54 nt, Homo sapiens
gguagccuucagucccggagagcgccagacccaaagaagaggccacauggggau

SEQ ID NO: 148748 - RNA, 37 nt, Homo sapiens
uuaaauuccaaaucuuucucugaucuuuagauccuac

SEQ ID NO: 148749 - RNA, 41 nt, Homo sapiens
augaccuuggccgcagggcuauugcuuaugccacucacaga

SEQ ID NO: 148750 - RNA, 45 nt, Homo sapiens
uccuacucccucccuccaguacugcgagaacugugacacccacuu

SEQ ID NO: 148751 - RNA, 42 nt, Homo sapiens
cggguggccacacugagcuggagggaggagagaaggagggag

SEQ ID NO: 148752 - RNA, 25 nt, Homo sapiens
aucaaauauuauaaugcagggugau

SEQ ID NO: 148753 - RNA, 43 nt, Homo sapiens
ccgcagccccaaacagugaguuucugagggcgagucgggccgg

SEQ ID NO: 148754 - RNA, 43 nt, Homo sapiens
cgucacuuccggucucccccaaaccugccaccgacggccacuu

SEQ ID NO: 148755 - RNA, 41 nt, Homo sapiens
ccaaggucuucaccaacaccuccaagcugucaggcuccucc

SEQ ID NO: 148756 - RNA, 41 nt, Homo sapiens
gaaagccacuuuggccaccaggcugcagaggaguagaauaa

SEQ ID NO: 148757 - RNA, 44 nt, Homo sapiens
aacgaugugucaggcaaaggacuggggcagaaagccggagagua

SEQ ID NO: 148758 - RNA, 42 nt, Homo sapiens
guggcucagcagaggcagcagcacugggaagcagcucccagu

SEQ ID NO: 148759 - RNA, 56 nt, Homo sapiens
auuauaggaagccaggacagaguggggugacacaggguguggggacaacaagggag

SEQ ID NO: 148760 - RNA, 46 nt, Homo sapiens
acagcagaacugcugggaggugggggaggcaggggaagccccgggg

SEQ ID NO: 148761 - RNA, 37 nt, Homo sapiens
cacugccugggggccaggggaguggacggggcccugg

SEQ ID NO: 148762 - RNA, 45 nt, Homo sapiens
gcuugagcccccacugucugaacgcucucggggaacuaggccuga

SEQ ID NO: 148763 - RNA, 42 nt, Homo sapiens
ugccaccaccacucaccagagugggagccgcagccacaccug

SEQ ID NO: 148764 - RNA, 62 nt, Homo sapiens
uucagguucugucucugguguuggggcugaugcuggagguggagcuggaggugcagggaguu

SEQ ID NO: 148765 - RNA, 45 nt, Homo sapiens
cucugucucuggaggccgagagguuucugcccaggccgucuuagg

SEQ ID NO: 148766 - RNA, 44 nt, Homo sapiens; identical to SEQ ID NO: 59158

SEQ ID NO: 148767 - RNA, 48 nt, Homo sapiens
uugagcgaggaauacuucuuuccauccuuucccuuggcagucggcccc

SEQ ID NO: 148768 - RNA, 43 nt, Homo sapiens
ccaccuuagcacccuguaaccaugggccagaaaacagagggcc

SEQ ID NO: 148769 - RNA, 38 nt, Homo sapiens
cgaaagcagguggaaaauauauggaaacaggaauggca

SEQ ID NO: 148770 - RNA, 42 nt, Homo sapiens
cggguucggcuccucccgucucccucgcucacuccgcggcug

SEQ ID NO: 148771 - RNA, 28 nt, Homo sapiens
agagagagagagagagggagagagagag

SEQ ID NO: 148772 - RNA, 43 nt, Homo sapiens
agugagagagacacaaagagaagagcaaugaaagagagagaga

SEQ ID NO: 148773 - RNA, 87 nt, Homo sapiens
ugauguaugcagcucaugacuagguggacaggccucuggggacagcugguacaggagggaaagggaccucacgggaggcccagaaac

SEQ ID NO: 148774 - RNA, 34 nt, Homo sapiens
aaguaaagugucucuugcaucugcauagagagag

SEQ ID NO: 148775 - RNA, 109 nt, Homo sapiens
aaucccccacaccucagagccuggcccaacccccggcccgauuccuggcccuccaggagggccuuggaagcuuagccagguccgaggaucaacccagcccggcuccggc

SEQ ID NO: 148776 - RNA, 52 nt, Homo sapiens
ugagaggucuccaagccgccuuggggcacuagccccacuccaaccuggggcc

SEQ ID NO: 148777 - RNA, 45 nt, Homo sapiens
aaacgcgguagucaucuggugucuaaauggcauuuaagccuugag

SEQ ID NO: 148778 - RNA, 45 nt, Homo sapiens
agaacccccagggugagccccacaucggccuguguauaucccagg

SEQ ID NO: 148779 - RNA, 91 nt, Homo sapiens
ucauuguugucagcuuccuccacccacuucugcagcaagggccgcagcuuacacauguucuugaagcuaagcugcagagccucaaagcggc

SEQ ID NO: 148780 - RNA, 27 nt, Homo sapiens
gguucucgauacugguucgcuuucucu

SEQ ID NO: 148781 - RNA, 42 nt, Homo sapiens
ucgagcccaagcugcugggcgauguggcugaucugcugcagu

SEQ ID NO: 148782 - RNA, 87 nt, Homo sapiens
ggagaaugacauuagacaaugagcugagacgggccugacucugcuuggacauucuauccaaagccaacagcccuagagcaguuagag

SEQ ID NO: 148783 - RNA, 45 nt, Homo sapiens
ccaaaauggggcccuggggccagaggaaaggacacuggucccccu

SEQ ID NO: 148784 - RNA, 113 nt, Homo sapiens
ggcgcggucaggggcagaggcggggccgggagcgaggcguaggggguguggccaaagcgcaguagggggcucucgcgguugguaagggacguucgggaagagucgguuggggg

SEQ ID NO: 148785 - RNA, 30 nt, Homo sapiens
ggugguugucucugccugggaaacugacca

SEQ ID NO: 148786 - RNA, 42 nt, Homo sapiens
caccuggcucucagacauuccccugguccaacccccaggcca

SEQ ID NO: 148787 - RNA, 41 nt, Homo sapiens
ucguucggcagcugcaagagcugcggcggcuggaggaggag

SEQ ID NO: 148788 - RNA, 77 nt, Homo sapiens
cugaggcugagggccugcgugcugcuuuggcuggggcugagguuguccggaagaacuuggaagaggggagccagcgg

SEQ ID NO: 148789 - RNA, 45 nt, Homo sapiens
cacagaugaauuaucacaucgugaacacacccauguagccagcac

SEQ ID NO: 148790 - RNA, 42 nt, Homo sapiens
cuccaauccccagaugagcagcuaagcagcugacaguuggag

SEQ ID NO: 148791 - RNA, 45 nt, Homo sapiens
aggcagcgagggccaccccucucacccacccgcagaggaccgaga

SEQ ID NO: 148792 - RNA, 45 nt, Homo sapiens
guggacaaccgaccucaggaggagccagaccuagacccaccccgg

SEQ ID NO: 148793 - RNA, 45 nt, Homo sapiens
gguuuuggcagugcagcccaggcacuguugccugccugucaccug

SEQ ID NO: 148794 - RNA, 42 nt, Homo sapiens
agaugucucugggccccugccuccugcauacagcccccgaua

SEQ ID NO: 148795 - RNA, 46 nt, Homo sapiens
gccuaaggaguuaguauuguaugaaaucccuacgaaacccggugaa

SEQ ID NO: 148796 - RNA, 23 nt, Homo sapiens
uugucccuguuuagccaaagaug

SEQ ID NO: 148797 - RNA, 76 nt, Homo sapiens
aggugagugggaggcgaagagugagaggaaggcagggagaagcuaggagaucggaaggcgugggucagggugaaug

SEQ ID NO: 148798 - RNA, 51 nt, Homo sapiens
uguagcugccacauugauuuuucuauaaucacuugggguuuguacauuuuu

SEQ ID NO: 148799 - RNA, 48 nt, Homo sapiens
cccucagggagcgauccaggggaagccagugacacuaaaacaagagga

SEQ ID NO: 148800 - RNA, 49 nt, Homo sapiens
ggaggugcugaugcucuguagggcccagcccuuugggcagcucaccgac

SEQ ID NO: 148801 - RNA, 62 nt, Homo sapiens
uggagaggaaaggcagagcccaagggagaggaguuggaaaagguggccagcggaggagagug

SEQ ID NO: 148802 - RNA, 46 nt, Homo sapiens
augugggauggagcaaccacagcuucuccaguggcuauguggagau

SEQ ID NO: 148803 - RNA, 43 nt, Homo sapiens
gcauccaggaucccuucuccugcugggaagcugucacucugag

SEQ ID NO: 148804 - RNA, 43 nt, Homo sapiens
ggacggcaugccgggggccugggcaaggaguucucccggagcu

SEQ ID NO: 148805 - RNA, 42 nt, Homo sapiens
cagguuaggauagcuuuuccugcagcaggggaggggagagua

SEQ ID NO: 148806 - RNA, 32 nt, Homo sapiens
cuugcauuguggcucucgcucugucuccgccu

SEQ ID NO: 148807 - RNA, 43 nt, Homo sapiens
ucucaaucuccuccuucgcucccuggccucaguuuccaguuua

SEQ ID NO: 148808 - RNA, 47 nt, Homo sapiens
cuuugcuucucuggaaaauaaagagccacaaaaccugccugauaugg

SEQ ID NO: 148809 - RNA, 37 nt, Homo sapiens
aggaacauggugaucugggggaagaugggaaggaaau

SEQ ID NO: 148810 - RNA, 41 nt, Homo sapiens
gcgccccagcgccucucgcgggcaccgaaagcgcagccgca

SEQ ID NO: 148811 - RNA, 103 nt, Homo sapiens
agauguguacguaauauuuauuuuaacuuaugcaagggugugagauguucccccugcuguaaaugcaggucucuugguauuuauugagcuuugugggacuggu

SEQ ID NO: 148812 - RNA, 51 nt, Homo sapiens
gcugcgagguagaggguuggggguuggugggcugucacggagcgacugucg

SEQ ID NO: 148813 - RNA, 58 nt, Homo sapiens
uuaagaagacguuucuggaggcuuagggaccaaggcuggucucuuuccccccucccaa

SEQ ID NO: 148814 - RNA, 55 nt, Homo sapiens
aaagggaaggauuccacuugacagagugggacagacuccuccagaguagagcuug

SEQ ID NO: 148815 - RNA, 43 nt, Homo sapiens
augggcaccagaaagaaauacagggucacccagaauggcagaa

SEQ ID NO: 148816 - RNA, 40 nt, Homo sapiens
ccccccagaagaaaaaacaaaaaacaagauagaggcagca

SEQ ID NO: 148817 - RNA, 46 nt, Homo sapiens
agccucggugaacuccaucucguccaugcccucgccuguguaccag

SEQ ID NO: 148818 - RNA, 42 nt, Homo sapiens
gagaugcgcuugaagagcuccuggauggcugugcuauugcca

SEQ ID NO: 148819 - RNA, 45 nt, Homo sapiens
ucucacagugccggaacucacccagcaggucuucgaugccaagaa

SEQ ID NO: 148820 - RNA, 77 nt, Homo sapiens
aaugcugaccuccgcaaguuggcagucaacaugguccccuucccacgucuccauuucuuuaugccuggcuuugcccc

SEQ ID NO: 148821 - RNA, 45 nt, Homo sapiens
ugcauugacaacgaggcccucuaugauaucugcuuccgcacucug

SEQ ID NO: 148822 - RNA, 45 nt, Homo sapiens
cgggggcacaggcucuggaaugggcacucuccuuaucagcaagau

SEQ ID NO: 148823 - RNA, 36 nt, Homo sapiens
uccagagccugugcccccgcccagugagugggucag

SEQ ID NO: 148824 - RNA, 47 nt, Homo sapiens
gggcgccgagcugguugauucuguccuggaugugguacggaaggagg

SEQ ID NO: 148825 - RNA, 45 nt, Homo sapiens
ccugggaccauggacucuguucgcucagguccuuuuggccagauc

SEQ ID NO: 148826 - RNA, 42 nt, Homo sapiens
uguggcuucauuguaguacacagagaugcgguccagcugcag

SEQ ID NO: 148827 - RNA, 47 nt, Homo sapiens
ugcagcuggaccgcaucucuguguacuacaaugaagccacagguaag

SEQ ID NO: 148828 - RNA, 45 nt, Homo sapiens
gggucgaugccauguucaucacugaucaccucccagaacugccga

SEQ ID NO: 148829 - RNA, 66 nt, Homo sapiens
uccugagggacucauuaaagaaaaccacacacccccauuuucucgacauaucuguucacgcccuaa

SEQ ID NO: 148830 - RNA, 47 nt, Homo sapiens
caggcuggaagguuggaaugcgccccagaggcuggagcagcgaggug

SEQ ID NO: 148831 - RNA, 43 nt, Homo sapiens
gaugacuuggggcucccugcucucccgaggaagaugcucugca

SEQ ID NO: 148832 - RNA, 45 nt, Homo sapiens
gccucccugggguaucgcugaggcagccuggccugcacccagguu

SEQ ID NO: 148833 - RNA, 49 nt, Homo sapiens
cuccugccuucccauucacaugccugauauuuccacaggcaaccaagac

SEQ ID NO: 148834 - RNA, 54 nt, Homo sapiens
ggcuuccguaucuacucccucauucccuccaggaaccuccagcucuccccagug

SEQ ID NO: 148835 - RNA, 29 nt, Homo sapiens
acauccuuccacagcucccuuccccgcuc

SEQ ID NO: 148836 - RNA, 72 nt, Homo sapiens
guccccuccgccccuuugugccagagcaggagcugcugcguuccuugcgccucugccccccacacccuaccg

SEQ ID NO: 148837 - RNA, 80 nt, Homo sapiens
aaacagggccccucgccgcgccacaccuccagcccacccacccccccgcuccagcagccugggaaacucaccagaacgag

SEQ ID NO: 148838 - RNA, 45 nt, Homo sapiens
guauguggagaaagaggacuuuaggacaaugccaaagccugagca

SEQ ID NO: 148839 - RNA, 45 nt, Homo sapiens
ugugacagaaguuuggguuucagaaggguggggugggaaaucaga

SEQ ID NO: 148840 - RNA, 39 nt, Homo sapiens
guuucuacaaccauauuauauucugugucaaauaaaguc

SEQ ID NO: 148841 - RNA, 46 nt, Homo sapiens
caucaauagacucuauguccagguuauugguuggcucguccuacau

SEQ ID NO: 148842 - RNA, 40 nt, Homo sapiens
uucuuucucauuuccccaugggucugcaagggaagacaaa

SEQ ID NO: 148843 - RNA, 187 nt, Homo sapiens
cuuccuucguuuguuuuuccuggagaggaagaggaaaaaagagaaaccugagcccugcgcggcaguccuugaaauguaggccagcguuccagagucuccuucuuccuccacugccaggagagaacaguggcccccagcccagaagucccucaggugcucaccgccugcuugguggacuucccgccug

SEQ ID NO: 148844 - RNA, 47 nt, Homo sapiens
agggcuaaaggaaaacagggcagggagggaaggggaagaaagugcag

SEQ ID NO: 148845 - RNA, 46 nt, Homo sapiens
accuccuccugcuaguuacucucucaccuuagccuucccuuuugac

SEQ ID NO: 148846 - RNA, 45 nt, Homo sapiens
gcacuuucucuucuuccccagccuguuuaucuucuacugccagcu

SEQ ID NO: 148847 - RNA, 43 nt, Homo sapiens
uccggcggcugcugcuugggcgccuucggcaucgcgguggcag

SEQ ID NO: 148848 - RNA, 41 nt, Homo sapiens
uuuuaacuuuuuuuauauuaguaauaaaugcaguggaaacc

SEQ ID NO: 148849 - RNA, 50 nt, Homo sapiens
aacuggcccugaggaaaugggucaggaguuguauuggcaagagggagggg

SEQ ID NO: 148850 - RNA, 47 nt, Homo sapiens
caagaaacagcaccaaagagguuuccuguucagcagucauuugauga

SEQ ID NO: 148851 - RNA, 46 nt, Homo sapiens
agucagugacacacccaucccauccaccacuucccccguguggggu

SEQ ID NO: 148852 - RNA, 27 nt, Homo sapiens
aggguuucucuguuccuugugaaagcu

SEQ ID NO: 148853 - RNA, 52 nt, Homo sapiens
ugguucaugucuggagacacuuagguuguuuuggauagcgacgguacgguga

SEQ ID NO: 148854 - RNA, 53 nt, Homo sapiens
gacugggaugacaguuuguauccagacuuugacugaaaagguacaggugcagc

SEQ ID NO: 148855 - RNA, 42 nt, Homo sapiens
aggggcuaauaaggugcgaaggagggggcuguaacggaagga

SEQ ID NO: 148856 - RNA, 41 nt, Homo sapiens
agcagcccccgcugcccgagcgggaagagacuggagaugag

SEQ ID NO: 148857 - RNA, 46 nt, Homo sapiens
agcucggcggagggcgggccaggugacugguccgggccaugccgag

SEQ ID NO: 148858 - RNA, 52 nt, Homo sapiens
cccucgcggccuaucgcggaggggaucccccacccccccuacaucuggaagg

SEQ ID NO: 148859 - RNA, 42 nt, Homo sapiens
ccgcaggcuuaaccagcagccuucucaggggcuggguccacg

SEQ ID NO: 148860 - RNA, 26 nt, Homo sapiens
gccucugauuucuccccuuuccaaac

SEQ ID NO: 148861 - RNA, 82 nt, Homo sapiens
caagcuccauuugcauaaacugucucugaugagauuuagggcgcuuacggugguauggcuguagacaacugucucaggaaac

SEQ ID NO: 148862 - RNA, 91 nt, Homo sapiens
ugcuguacacuuuuugcaacugguuugaugucacauuucagcuccaacuuugcauccugagaacacuuaaacguuucugcagguccauuuu

SEQ ID NO: 148863 - RNA, 45 nt, Homo sapiens
cauaucuuucuuuucugcucauccaauaaacagcugugcccuacu

SEQ ID NO: 148864 - RNA, 51 nt, Homo sapiens
gcauucaacaaauggaguuuccccaagcacaguucuguaagaagugcgugu

SEQ ID NO: 148865 - RNA, 47 nt, Homo sapiens
aauguuuuuuuaccauaauugucgugcaccaaauucacagccagaau

SEQ ID NO: 148866 - RNA, 96 nt, Homo sapiens
aagaagaucauuaauguuuugugaccauacaaguuguaacaguggauuguuuuuauguguagguauuguuaaauacagggacuguuuccaggcaca

SEQ ID NO: 148867 - RNA, 46 nt, Homo sapiens
ucucaccacgugucuguagauauaggaccgcagaccuucgcuuuau

SEQ ID NO: 148868 - RNA, 46 nt, Homo sapiens
augugaguauuuuaaggcuuggagucaaagaauuaaccuaacaugc

SEQ ID NO: 148869 - RNA, 48 nt, Homo sapiens
gagaauuuuugauucuuacauuugucuacaagcucuagcaguagcagc

SEQ ID NO: 148870 - RNA, 46 nt, Homo sapiens
ucaauaugguacugcaagauaucacugaguuugaaaucccaccaga

SEQ ID NO: 148871 - RNA, 61 nt, Homo sapiens
ugccaaacacagcccacuccauuucagaccgccuuccugaggagaaaaugcagacucaggg

SEQ ID NO: 148872 - RNA, 46 nt, Homo sapiens
uggaccguacagaccugccuaacaugccagcgcagccaacgcuucc

SEQ ID NO: 148873 - RNA, 51 nt, Homo sapiens
agucaaggcacaaagguaagaggaggagagucuggacaaaguccuguugag

SEQ ID NO: 148874 - RNA, 47 nt, Homo sapiens
uucaggacuggacccagguggacacgaagacguuccagcaggacacg

SEQ ID NO: 148875 - RNA, 29 nt, Homo sapiens
uguucuucaucucuuaaaucccucuuaau

SEQ ID NO: 148876 - RNA, 29 nt, Homo sapiens
ggggcauuggagaggggaaagaggaaacg

SEQ ID NO: 148877 - RNA, 114 nt, Homo sapiens
gcgaaauuuaccgaaauuaucuaccuaucccgcuggagugggagccgggggagagcuggaaccgcgucucugcugcucaccuuuguguccuuagcuccuucgcaugggguccga

SEQ ID NO: 148878 - RNA, 68 nt, Homo sapiens
cuguucuuuccacuucuggggcugugacuugaguuucuccgcaggagcagauaguguuuguguaggga

SEQ ID NO: 148879 - RNA, 45 nt, Homo sapiens
ugcccgccugcugcuggaagcuuagcaggucagugauuuuggagg

SEQ ID NO: 148880 - RNA, 46 nt, Homo sapiens
ccaggacccauaucugcuuucuucauguuuccugaucccacccugg

SEQ ID NO: 148881 - RNA, 52 nt, Homo sapiens
gagacugaaggccuaaggcagugggugacuucuuagauaucacuuccugcag

SEQ ID NO: 148882 - RNA, 62 nt, Homo sapiens
ggaggccaagagauaucuagguaaugugugugggcaagaaugucuaaucuaaagagagcccu

SEQ ID NO: 148883 - RNA, 57 nt, Homo sapiens
cacaaacauuugcagacccccuacuuugugccagauauuggagauaaaaaggucagu

SEQ ID NO: 148884 - RNA, 91 nt, Homo sapiens
guucuaggcagaaggaauuacauugucgaagggcuuagccaggaaagagcauagcacuuugaggcauggagagcgguuugguuuggcugug

SEQ ID NO: 148885 - RNA, 47 nt, Homo sapiens
acauaugcaauaauuuuuagacaguuucaggagguuuagagaccauc

SEQ ID NO: 148886 - RNA, 58 nt, Homo sapiens
acuugcaguauguuacaacugaaaaacugcugagccaggcuuauuuccucaacaguaa

SEQ ID NO: 148887 - RNA, 49 nt, Homo sapiens
ggacguuauaucccuguuuuguuuacucuugggucuuauagacuggggg

SEQ ID NO: 148888 - RNA, 40 nt, Homo sapiens
aagagagagagagagacaagguugccugagaguggagagg

SEQ ID NO: 148889 - RNA, 33 nt, Homo sapiens
gcuagagacagccaaguccaaggaccccuccag

SEQ ID NO: 148890 - RNA, 69 nt, Homo sapiens
aaacaggaugcagucuuacauggcaggggugggguacauauagauauuuuagacugaacaguggggugc

SEQ ID NO: 148891 - RNA, 68 nt, Homo sapiens
uggaagaggugacagauuuuguccaggagggaaaagugcgucggcucaugagugagacccacagaguu

SEQ ID NO: 148892 - RNA, 45 nt, Homo sapiens
uccucaucacugccaucacaagcccucuuaacaagucauuggcag

SEQ ID NO: 148893 - RNA, 47 nt, Homo sapiens
guuguuuuaugcagugaccccacuggaaugucagcuccauaaaaaag

SEQ ID NO: 148894 - RNA, 46 nt, Homo sapiens
gcuuuuuucuuucccuucuaggacacgagagacuuccuaaacaggu

SEQ ID NO: 148895 - RNA, 87 nt, Homo sapiens
gggcuucaccuggggcaaggucuacugggaaguggaaguggagagggagggcuggucugaggaugaagaagagggggaugaggagga

SEQ ID NO: 148896 - RNA, 35 nt, Homo sapiens
augaggaaucguugggcgaugaagaggaagaagag

SEQ ID NO: 148897 - RNA, 50 nt, Homo sapiens
ucugugaagaggaagggagaccucucccugcggccagaggauggcgugug

SEQ ID NO: 148898 - RNA, 46 nt, Homo sapiens
ucgcccuggauuaugaagggggcaccgugacuuucaccaacgcaga

SEQ ID NO: 148899 - RNA, 59 nt, Homo sapiens
cccaccuucccuggcauuuuaaacagaccuaccccaccccaacucagaguuaagcauac

SEQ ID NO: 148900 - RNA, 54 nt, Homo sapiens
auagcuuccaggaugaucaucuauauacuuauuauugauuaacagggauaggga

SEQ ID NO: 148901 - RNA, 46 nt, Homo sapiens
agaccaccaucucaggaagaagucaaugucaagugauuaaaauaca

SEQ ID NO: 148902 - RNA, 37 nt, Homo sapiens
uauaccugugacacacagaggcaacaccaugagggca

SEQ ID NO: 148903 - RNA, 57 nt, Homo sapiens
agggacaggcuauaucugccccaaccaccagaagagggugugcagguucugugagga

SEQ ID NO: 148904 - RNA, 48 nt, Homo sapiens
agacugagacucugguugaagagagaggcaaucccaggagaggggcgg

SEQ ID NO: 148905 - RNA, 45 nt, Homo sapiens
gaggggggcgcauccccaccaugggcugccuggaccugcccggag

SEQ ID NO: 148906 - RNA, 22 nt, Homo sapiens
aagcaaaggaugagggggcgag

SEQ ID NO: 148907 - RNA, 41 nt, Homo sapiens
cccggaaggacgauggauggaguugacacuugguccacagg

SEQ ID NO: 148908 - RNA, 44 nt, Homo sapiens
guggaauuccccacucauuucugggaacacauucacacgcccau

SEQ ID NO: 148909 - RNA, 55 nt, Homo sapiens
cagggaggagaggaggaagggggaugagacacccuucccuuuuucugucgcugag

SEQ ID NO: 148910 - RNA, 56 nt, Homo sapiens
gaugccuuguccauccugucugguugcaauguuuugcucccagaagagaaucagau

SEQ ID NO: 148911 - RNA, 62 nt, Homo sapiens
uggguugaggaggggauccuagagcaggacaucaggcgguuguacauuuggucuagcgauga

SEQ ID NO: 148912 - RNA, 46 nt, Homo sapiens
uacggucaccuguauucgcuguggcuucaacaucaacguucggggu

SEQ ID NO: 148913 - RNA, 56 nt, Homo sapiens
uuguuaauaaacuuccaacucccuccucagacccgaccgcaugucugucauggacc

SEQ ID NO: 148914 - RNA, 40 nt, Homo sapiens
ugucucacugaggguuccaagccccagcuagaaaugugcc

SEQ ID NO: 148915 - RNA, 32 nt, Homo sapiens
gaguagcucacucuaucugugggaagaaaaug

SEQ ID NO: 148916 - RNA, 46 nt, Homo sapiens
gcugccaggccagugugaucuccacaggguagaagcccagggccca

SEQ ID NO: 148917 - RNA, 45 nt, Homo sapiens
gagccgccauguccgccgcgguccaggagcgcagguccuaguucc

SEQ ID NO: 148918 - RNA, 46 nt, Homo sapiens
ccgugugcuccggucccaauacuccggucccuccugcuccaaccac

SEQ ID NO: 148919 - RNA, 58 nt, Homo sapiens
ucgccaucuuucaguccuuugagugcacccagucucucuccaacccaaaacccuuuau

SEQ ID NO: 148920 - RNA, 57 nt, Homo sapiens
uggggcuccgaaacaacuucccacacugacugcagcuguuagucagcuugggauugu

SEQ ID NO: 148921 - RNA, 45 nt, Homo sapiens
agcucagacuggucccggaagcucuucccacacacagagcaugaa

SEQ ID NO: 148922 - RNA, 47 nt, Homo sapiens
gauacucugauagauaugaagauaggagaaaaggaugagaggaagga

SEQ ID NO: 148923 - RNA, 61 nt, Homo sapiens
ccagagagggcuuccagguggaagacuggagagagaaauggaaagaaggguaauaaaaaug

SEQ ID NO: 148924 - RNA, 41 nt, Homo sapiens
ugguugaucugagaggugaggcacugggcaguugcugugga

SEQ ID NO: 148925 - RNA, 49 nt, Homo sapiens
acguguaaacgaucuauuuaccucuguuuugccauuccugaaaagagag

SEQ ID NO: 148926 - RNA, 38 nt, Homo sapiens
gaaaacaggguauugagagggagagacgguccaagaac

SEQ ID NO: 148927 - RNA, 48 nt, Homo sapiens
aaauuggaggcagcauuaucagaagaugaagaacaacucagggauggg

SEQ ID NO: 148928 - RNA, 44 nt, Homo sapiens
uguaauauucaggcaccacagaaccaagaucugccccaaacuua

SEQ ID NO: 148929 - RNA, 59 nt, Homo sapiens
cuguuguccuaugaaaaaucgaagaagaaaauaaguccugacccccuuacccccagacc

SEQ ID NO: 148930 - RNA, 46 nt, Homo sapiens
gugggagggggcuggggaucaggccagggaagcugggcgccagugg

SEQ ID NO: 148931 - RNA, 44 nt, Homo sapiens
ucuuccccacaucuuuuccuuccguguaccccuucccucgucuu

SEQ ID NO: 148932 - RNA, 43 nt, Homo sapiens
ggugauuggggaaggcuaaugaucaagaggugggcagaggcac

SEQ ID NO: 148933 - RNA, 65 nt, Homo sapiens
cacgugguggagagaaucugcagugaugaauaguguguggaagagggaaacgguugcaagaaaag

SEQ ID NO: 148934 - RNA, 119 nt, Homo sapiens
gagccaguggauuacagaggagagagggagaggaaagagagagagagagaggaaugagggagaggagagagaggggcagaaaggcagcugcauggaucugguaguugguacuaagagag

SEQ ID NO: 148935 - RNA, 65 nt, Homo sapiens
ccucaugcaccccguguuuuuccaacuuguuuuuuauucccacccaagacucuggacgaccugga

SEQ ID NO: 148936 - RNA, 42 nt, Homo sapiens
uucacuauacguugagcguuacccugcacuaagcacuuuggg

SEQ ID NO: 148937 - RNA, 46 nt, Homo sapiens
caucgugggacuuuucuaugagacugaagcccggaaaguuuuuugu

SEQ ID NO: 148938 - RNA, 62 nt, Homo sapiens
gacuuccuuggguagagagagaaaaaaaaaaaaacgauggaguuguauguucaguagguucc

SEQ ID NO: 148939 - RNA, 35 nt, Homo sapiens
cugauuugagagggcuggggcagcccugcagcuga

SEQ ID NO: 148940 - RNA, 46 nt, Homo sapiens
aagugauugagucagaauuggauugcaccccuucccccacacccac

SEQ ID NO: 148941 - RNA, 46 nt, Homo sapiens
cggccguucuggugugcgccuggaggacuucaacuacaacaaccag

SEQ ID NO: 148942 - RNA, 45 nt, Homo sapiens
ccugcccaucaugagaggaagaauaagcagaaauauguguaaagc

SEQ ID NO: 148943 - RNA, 45 nt, Homo sapiens
cuaaucuuuucugagaauaggggagaguugcucuuuugcuaugag

SEQ ID NO: 148944 - RNA, 80 nt, Homo sapiens
gaaaaagugauguggucugggcaaguuggguggacauaagggauaggggacacagggugagguuugcuaggucagagggg

SEQ ID NO: 148945 - RNA, 49 nt, Homo sapiens
uucaucaccuccucuucuccuacuaucccaauugugcuucuuccuccag

SEQ ID NO: 148946 - RNA, 59 nt, Homo sapiens
ggucucccaacaagugcucuuuccaccccaaaggggccucuccuuuucuccacugucau

SEQ ID NO: 148947 - RNA, 49 nt, Homo sapiens
gguuuggagagcugcuuccaguggauaguugaugagaauccugaccaaa

SEQ ID NO: 148948 - RNA, 41 nt, Homo sapiens
gcaggagucgagagccaaacggugcggcuagcagagugccc

SEQ ID NO: 148949 - RNA, 55 nt, Homo sapiens
gucaaggagacaauaagauuaacacaaggauggcuaggauaaagauuaggauuau

SEQ ID NO: 148950 - RNA, 46 nt, Homo sapiens
ccaucaccgucaggaggaugcacucagugguccccagggacaggaa

SEQ ID NO: 148951 - RNA, 46 nt, Homo sapiens
gggacacaacuuauggugaaacagagguccaagaaggagagguugg

SEQ ID NO: 148952 - RNA, 1285 nt, Homo sapiens
aagccaucucaaugucaggcugcaaaggagugaagaaugccaggucauaaaucuccccauccuacuacugaauagcaaauuaaggaaguauguggaugucuaguuaaugcucaagagggcuaccaaacuugauguuacugucaaaugauaaaaacuggaguaauaaauuuggacaauaauuauuuugucuguaugacaaccaaaaaaagcuaccuacacaguauaaugaacacaaugagccaccggcuaucuuuucccagcugcuagugaaagcugggagacuaaauaaagcaggagauaaaucaccuucucaggauugaguuaaaucauuguaaaacugaaauaauauacccaucaauuccacugaguuguugggagaacaaagaaucaaaaugaaaauuacuuuucacuuuuaagacugaagcaugucauaaucauuuuuguuuaccaaacagccaauuccccauacuguaacaccuagaaaugaauuagcacaugaaacaggucaagguuauaauaagucuuaccaagcaccccacuggagguuccacuggaaucucccauuccaacgagaccgagcuauuucacugacuccagaaaaagccauuugcauuuguuaccuccaugccuuagaccaugcacuuuucccacgugccaauccauguccuuuguccaccuacacuuugaggauacagguaaagcuccauuuccucagucaagucuuccacugccuuggccccuuagggauuucuccuucagcuaaauuauuuggaucuuauggccugacccacucauuauauguaucacacucuuauuuggguguuuuuacuauucucacauccucuugucuuguuuuggaaaauaccucauauacuuucucaguaauuuucuaaaccagacacaccauaagcugcacaauggaaucccucagagacccuuuaaaaauacugauucuuggcucucauuacccagacauucugauuuaggugguaugaacugcaaucuaggcagcgggauguuuaaaagcuccccaguaauucuaaagcguggccaacuuggggaaccacuuccacaggcguuaguccugcguuuguggaccaagauuaaaacgaacugaacgaaggugcaguuucugguguaaguggagagggucugcaguagauuaucaggacgugaaguuauaacuuaguggcaggcagguccugcagagaucccaggcuagcugagugggugggagcugugggugagucauacucacaucguugccauacgacucugcugggag

SEQ ID NO: 148953 - RNA, 40 nt, Homo sapiens
ggaccugcgcuccuggaccgccgcggacaccgcggcucag

SEQ ID NO: 148954 - RNA, 56 nt, Homo sapiens
ucuaggacaauuaagggaugaagucucugaggaaauggaggggaagacagucccug

SEQ ID NO: 148955 - RNA, 45 nt, Homo sapiens
acgagcuccacguccugggucugguccuccccaucccgcugccag

SEQ ID NO: 148956 - RNA, 61 nt, Homo sapiens
ugagugugaggcagagaacaaggccugaggggaaaaguccuggugccaaggcugcuguggg

SEQ ID NO: 148957 - RNA, 52 nt, Homo sapiens
gauugucuuccccuccacucccucagagacuucaucccuuaauugucccaga

SEQ ID NO: 148958 - RNA, 24 nt, Homo sapiens
cccaggucucggucagggucaggg

SEQ ID NO: 148959 - RNA, 45 nt, Homo sapiens
ucuggccucaucagaaguggccauucucacagugaugucuuauga

SEQ ID NO: 148960 - RNA, 44 nt, Homo sapiens
gacaccgauugcuccaacauuucuucgugagguacccuccauga

SEQ ID NO: 148961 - RNA, 44 nt, Homo sapiens
ccaguucaaacacagaggugucagcacagaccagugcaauaaca

SEQ ID NO: 148962 - RNA, 44 nt, Homo sapiens
gcuuuuaaucauggaauaaucuuauguauugguguaagaguuga

SEQ ID NO: 148963 - RNA, 45 nt, Homo sapiens
aaauggaaauaggguggaaaaguacucgguaaacaguaguaacca

SEQ ID NO: 148964 - RNA, 49 nt, Homo sapiens
guuaaaaacuucuuuuugcccaaaauaacucauuuuguauuaucugaaa

SEQ ID NO: 148965 - RNA, 43 nt, Homo sapiens
gcuagugucucuuuaauuaauuggaaauagauggaggcuaaaa

SEQ ID NO: 148966 - RNA, 47 nt, Homo sapiens
uagagacuuuaugauuagaauugcauauauuuaugaaacuuaaagau

SEQ ID NO: 148967 - RNA, 46 nt, Homo sapiens
gucagcuucuaguguuuuucaaacaacugacacaaaaagcaaaaga

SEQ ID NO: 148968 - RNA, 1370 nt, Homo sapiens
caacacacacuugaagguuggcuugcauuuuguaguuuauuugaaugacagccaauuaauugaacuuguaaaaauuuauauugcuaaauuuuguuuguuaggauguauaauuuuuaaaagaaugaacuucaaaguacacacauauauauaucuaucuuccugcuuugguaguuuaaagaacagauacacuucagucaagucaaauguuguuauugugcuucccucuuugaagccuaacauaaugcuggcuaguaugagacccccuuuuaaguccccauaauguguuacuaaguccgcuuuaauaaagcuuauuuuaaaguaaaaacaauguauuagccuuggagauuaaaaaggaauucaucugaauuuuuucauuuucuaaaucuugcauaaaauuaauacacugaaacaucuuuugaguuuuaaugaaauuaagagguuguguuuuuggugccacagugagcagaucaugucacucagaaccucccacugauuuacauuuuacagaguuaauaaaagucaucugugacuucccuauuagcuuucuuuuucuuuuucuuuuuuuuuuuuuuuuuuuuugagauggaguucacucuuguugcccagguuggagugcaauggcgcaaccucggcucccugcaaccucugccucccagguucaagcgauucuccugucucagccucccgaguagcugggauuacaggcaccugcuaccaugccuagcuaauuuuuuuguauuuuuaguagagauaggguuucacuauguuggccaggcuggucucaaacuccugaccucaugauccacccgccucggccucccaaagugcugggauuacaggugcgagccaccgugcccagccggaauuaaccucuuaugugaucaucaggaacugcauguguucaaugucuugauaauguuacaauacaagaugauaaguugcuuggaaacugacugccuguauucaguauaugaauucaguuguguuaaccugauauauaucuuaaacauuucuaguaaagauguuauaguuuuauguugauaagacaugaaccaaaauucacauuuuaaaaacaaagucuuuuuaaaaaauuacucaacauuaaugcuauuuaugaagaauagcauuuagucuaaugugaaauaucuuuuuaggaauuugucuacuaauuuguacucaguuuguuuaccuugcugucucuaaaauccgaauucuuaaaauuuaaggauuguauuauuucuuuuaagaaugaauccuaagaauuuuguaauauggaaucauugucauuguuuuauugauaaugggcauuuuuauuuuuuauauagaucucucugcaagaguagaugcaguuaaggaagaaaaucugaagc

SEQ ID NO: 148969 - RNA, 44 nt, Homo sapiens
uggacaccgauugcuccaacauuucuucgugagguacccuccau

SEQ ID NO: 148970 - RNA, 44 nt, Homo sapiens
ccacauuggacagugaucuaggugaagacgaaggccuccucucc

SEQ ID NO: 148971 - RNA, 49 nt, Homo sapiens
uuucuauggaucacugccaaacauugggaucaucuccucuguccagagg

SEQ ID NO: 148972 - RNA, 58 nt, Homo sapiens
guggacauuccaaguucauaugcgugaacaaaagaaaagaggaacccaguggauguaa

SEQ ID NO: 148973 - RNA, 41 nt, Homo sapiens
cuucuaaaggacuuggauauucuucauaauucaucacagau

SEQ ID NO: 148974 - RNA, 42 nt, Homo sapiens
aauguaucaagucuacugaauauggaaagggcacgagacaaa

SEQ ID NO: 148975 - RNA, 42 nt, Homo sapiens
gaagaaucaguggugagucgugauauccuuaaccggcugggu

SEQ ID NO: 148976 - RNA, 29 nt, Homo sapiens
agcugcagaggacacaguucaggccagua

SEQ ID NO: 148977 - RNA, 57 nt, Homo sapiens
uugcaugugcuuuucugccucugcggcugccuggcugugguuuauccuuuugacugg

SEQ ID NO: 148978 - RNA, 44 nt, Homo sapiens
aggggagaaagaacuggaaaguacucaaugaaauguggagccag

SEQ ID NO: 148979 - RNA, 50 nt, Homo sapiens
ugcuuuuagccuuaaauuacauuugguugauacuagccuuccuuguuuua

SEQ ID NO: 148980 - RNA, 44 nt, Homo sapiens
cagauauugacaagaaguuaggauaucucauacaaaugcugaaa

SEQ ID NO: 148981 - RNA, 41 nt, Homo sapiens
acgcagugcucugaggaaagguuaauagaacuugaccagua

SEQ ID NO: 148982 - RNA, 46 nt, Homo sapiens
cauuacaaauacaacagucgaauucaaccaaucauagcaguggcug

SEQ ID NO: 148983 - RNA, 30 nt, Homo sapiens
ugaacguagaaaucuaucuccauaaauuga

SEQ ID NO: 148984 - RNA, 47 nt, Homo sapiens
gccgcgagaaggagccccccgcgcgccgugugcaguuuccgaagccu

SEQ ID NO: 148985 - RNA, 45 nt, Homo sapiens
ggguuuaaaaagcgacuuuggaucccccaaaaaguuguggucgag

SEQ ID NO: 148986 - RNA, 34 nt, Homo sapiens
acacucacugacagaaaccaccccguccacagga

SEQ ID NO: 148987 - RNA, 49 nt, Homo sapiens
uagcaacuugacaccaggacauuagcuuuucccaaugcugguugaggaa

SEQ ID NO: 148988 - RNA, 44 nt, Homo sapiens
ggccugagcaaaagcaaauucuccuugggaucauuucuccacuu

SEQ ID NO: 148989 - RNA, 72 nt, Homo sapiens
auuccaauuguguaauuuauaucuagccccugcaucuacaugucacaggcuuagaauauacauuucucacag

SEQ ID NO: 148990 - RNA, 51 nt, Homo sapiens
guguuuaccugccuagauuuugagaccaaaaugccuaagaacaaaacaaaa

SEQ ID NO: 148991 - RNA, 38 nt, Homo sapiens
gcucacaaagggcuaaaaaucauuuuaguucccaccaa

SEQ ID NO: 148992 - RNA, 76 nt, Homo sapiens
aaaaugugucauaaauggucaguugguacucagcaacuuuugagggucuuucgguaagucuauuaugaguagguug

SEQ ID NO: 148993 - RNA, 50 nt, Homo sapiens
cuguaagauggcuaacagugacuuuaaacaauaaaagauccccuaguagc

SEQ ID NO: 148994 - RNA, 41 nt, Homo sapiens
uggacuucaggcaacgacauuucagaggagugaucagaaug

SEQ ID NO: 148995 - RNA, 44 nt, Homo sapiens
caaagucaauuuuacaacuaauuacaaagccaacauccugguca

SEQ ID NO: 148996 - RNA, 35 nt, Homo sapiens
acauugccaguccuucccuuccccacuccccagaa

SEQ ID NO: 148997 - RNA, 50 nt, Homo sapiens
acgauaaucauuuauuugcuuuucuuuaaguuuuaccacccauguaugua

SEQ ID NO: 148998 - RNA, 44 nt, Homo sapiens
uuaauuuauuuauagauuuuaaucacauaucacucaugcacaua

SEQ ID NO: 148999 - RNA, 42 nt, Homo sapiens
aaggcuugcgcaaggucacccagaaaacagauucauuucuaa

SEQ ID NO: 149000 - RNA, 89 nt, Homo sapiens
guucaccaauauggagcccaggguuauacccuuggugcugaccuaaauaguccaggcucccucuuccaguucacugcuggguauaggag

SEQ ID NO: 149001 - RNA, 45 nt, Homo sapiens
gcggguggggguggaauaaaauacuauuuuuacugccaaaaaaaa

SEQ ID NO: 149002 - RNA, 41 nt, Homo sapiens
guguggcaugccuugauggcggcugccaaggagaggcaguc

SEQ ID NO: 149003 - RNA, 58 nt, Homo sapiens
ugguucagccaugggcaugugggacaaaucuaaugagaugugagggggaagcugagag

SEQ ID NO: 149004 - RNA, 30 nt, Homo sapiens
ucaaucagcacuuuguggacucgccaggau

SEQ ID NO: 149005 - RNA, 80 nt, Homo sapiens
gguccagaacauggggaaugagacugggccugggguucucuggaggcccuuauccaaaggacguguuaggcuaauuguga

SEQ ID NO: 149006 - RNA, 41 nt, Homo sapiens
gguaccauggggaagugguggugguaccugaucugggaccc

SEQ ID NO: 149007 - RNA, 37 nt, Homo sapiens
uugcuggggggccccgaggcugaggacccggccccac

SEQ ID NO: 149008 - RNA, 38 nt, Homo sapiens
caagagccgcaacaggucgggcacccccacucccccgu

SEQ ID NO: 149009 - RNA, 35 nt, Homo sapiens
aggagggaaagguugggaacuggggaugagaaaua

SEQ ID NO: 149010 - RNA, 42 nt, Homo sapiens
gucugggcugugggagguauggaagugggaagaggaaguggg

SEQ ID NO: 149011 - RNA, 34 nt, Homo sapiens
uuaccccuagauuaagguucuuggcccccucaac

SEQ ID NO: 149012 - RNA, 53 nt, Homo sapiens
aaggcucugaacugagccacuggggaagggaaguuucaguaacaugacacuaa

SEQ ID NO: 149013 - RNA, 45 nt, Homo sapiens
augacuccggaggggcuucgggagucuccccaccugccccuaggg

SEQ ID NO: 149014 - RNA, 41 nt, Homo sapiens
cagcaaacucacugugucgccccaugaagcggguucccucc

SEQ ID NO: 149015 - RNA, 42 nt, Homo sapiens
gacccuccgccaggccuuugccauccuucuuuccugccuucu

SEQ ID NO: 149016 - RNA, 44 nt, Homo sapiens
guggucuuugcugcccuccugcucagagucuacgcgcggggccg

SEQ ID NO: 149017 - RNA, 81 nt, Homo sapiens
auagaugcgguuggagugggucuggggauccucaagggaaaagccagaagauagcagggcgguuucaaacagcagcaccac

SEQ ID NO: 149018 - RNA, 46 nt, Homo sapiens
ggccaucauauagcccaugguggaguugucccgaagugccugggcu

SEQ ID NO: 149019 - RNA, 46 nt, Homo sapiens
ggugcuggucacaaugcagcaaggugaagacacaagucuauuggag

SEQ ID NO: 149020 - RNA, 53 nt, Homo sapiens
uccaucuucuucuucuccuccucauccucaggcagcuccagacccuccuuggu

SEQ ID NO: 149021 - RNA, 46 nt, Homo sapiens
cggucauauauaccaccucgaagccccguuuccgcacucgcuccac

SEQ ID NO: 149022 - RNA, 45 nt, Homo sapiens
ucaucucaucuccagacugggagguaugauagcgcagcagcucag

SEQ ID NO: 149023 - RNA, 46 nt, Homo sapiens
gaaugccucauagaauuucuuguaauucuccuugucuucugccagc

SEQ ID NO: 149024 - RNA, 46 nt, Homo sapiens
uuugcgaaugacuuucaagauuuugcucugcuggagcauuucucgg

SEQ ID NO: 149025 - RNA, 45 nt, Homo sapiens
ucuccauacuccucuugggugaugucaucaggguuucugguccaa

SEQ ID NO: 149026 - RNA, 45 nt, Homo sapiens
uaguuuucuucuucuuauccuuaccgcugucauccuccucaucug

SEQ ID NO: 149027 - RNA, 48 nt, Homo sapiens
ucaccuuucucuuccucugccucaucaucacuaauuuccuucucucgu

SEQ ID NO: 149028 - RNA, 87 nt, Homo sapiens
acacuaccagggaaagcaaaagccagggacaaugagauucuccagaacaggaaacauccugcacguuaaguguaaaagauuuaaaag

SEQ ID NO: 149029 - RNA, 63 nt, Homo sapiens
cacauaaagggugaugggauagccuaugaacugagaaugcuucuucacuacuucuuugacccg

SEQ ID NO: 149030 - RNA, 40 nt, Homo sapiens
cuuaccauggucagcacgcacagugaaggaaccuccagca

SEQ ID NO: 149031 - RNA, 61 nt, Homo sapiens
ucacaaccacuuucucugccaccaaguaggcagaauaaaagccaacaccaaacugcccaau

SEQ ID NO: 149032 - RNA, 95 nt, Homo sapiens
ccuccaugaaugcuuuaguaccagacuuggcaaugguucccaaauuauuuaugagaucagcuuuggucaugccaaugccugugucuaccaaaguc

SEQ ID NO: 149033 - RNA, 42 nt, Homo sapiens
aagggucugucaggcucucauagcgaaucuuguccaaggccu

SEQ ID NO: 149034 - RNA, 48 nt, Homo sapiens
aaaagucuccaccuccuccucuccauggugcacuuccucaggcaucua

SEQ ID NO: 149035 - RNA, 89 nt, Homo sapiens
aaaaggcaguaacguggcaacuguacagggugcaugauggguaagaacugggcauggggaguugggagggggacauggagagaacacag

SEQ ID NO: 149036 - RNA, 46 nt, Homo sapiens
ucuccaagcccaagagccuccacuggccugcacaagcagggaucag

SEQ ID NO: 149037 - RNA, 59 nt, Homo sapiens
acaccccgucccucgacucugagccccaaacccacaauguccccacuguccguccagag

SEQ ID NO: 149038 - RNA, 41 nt, Homo sapiens
gugauagugaagaugaagcagacagagaaagccaggacuga

SEQ ID NO: 149039 - RNA, 51 nt, Homo sapiens
aaagggaggagauggguggcagggggagggagcaaaaggaggagagaaaga

SEQ ID NO: 149040 - RNA, 41 nt, Homo sapiens
agaaggaaaaacucccaaagucacauaggacagaggaucgg

SEQ ID NO: 149041 - RNA, 42 nt, Homo sapiens
aagcaguuuauaagcugggaaacaggaggguggagagcagga

SEQ ID NO: 149042 - RNA, 51 nt, Homo sapiens
gcaagaggacgagaggggucagggacagugaugacaagggaaggagggaga

SEQ ID NO: 149043 - RNA, 39 nt, Homo sapiens
ggccagcagaagggucagagcagagcaagccugggcagu

SEQ ID NO: 149044 - RNA, 40 nt, Homo sapiens
ugaccagcaugauggguuuucccaucccugacacauccag

SEQ ID NO: 149045 - RNA, 60 nt, Homo sapiens
uggggccauagccacagcuggagagcgcagcccgcgccgggccugaccggugugggccgc

SEQ ID NO: 149046 - RNA, 45 nt, Homo sapiens
ccacucuugaggccuccccagcgucuggcgagugucgcuggcuga

SEQ ID NO: 149047 - RNA, 137 nt, Homo sapiens
gguggggguaggggacugagaggucagggagugucaggucaggguggaucaggagccccaaaagaaaaauugagaauugccuggagaagaacuccugcuagacugagggagaaggguuagggaacuccaggggcauu

SEQ ID NO: 149048 - RNA, 46 nt, Homo sapiens
cugggguggccugggggugggggugggcaaggcugacacuggaaaa

SEQ ID NO: 149049 - RNA, 65 nt, Homo sapiens
agagccaagaggaguaccuggugcaccuggugccgguggcuggagaccuggggggcagguggauc

SEQ ID NO: 149050 - RNA, 79 nt, Homo sapiens
aggggugcagagggaguucccccagaucaguaccccccaccccuccccagcuaguagcaugaccaggagaggguuaaug

SEQ ID NO: 149051 - RNA, 43 nt, Homo sapiens
aaacccccaaguuuaaauaccuuaaugaaagcaggggcugggg

SEQ ID NO: 149052 - RNA, 42 nt, Homo sapiens
agacuuccagucuugcgaggacagccucauagagaaugagau

SEQ ID NO: 149053 - RNA, 91 nt, Homo sapiens
ugccacgucugcuuuggacacuucaaauaccucagugcccacaacuacaagguguggggcaaggguggcaggcggauggcugcgggcagga

SEQ ID NO: 149054 - RNA, 59 nt, Homo sapiens
ucagcuuccuccgcuacaaccccucauucuacucuccucaucaggaauucuacuauugg

SEQ ID NO: 149055 - RNA, 38 nt, Homo sapiens
ggaccuaaugucuaggguaggguagggcagagcagaug

SEQ ID NO: 149056 - RNA, 48 nt, Homo sapiens
guauucugccauggguggacauagguaacccugaaggccccugccagu

SEQ ID NO: 149057 - RNA, 45 nt, Homo sapiens
cugucagaacuggcaggggccuucaggguuaccuauguccaccca

SEQ ID NO: 149058 - RNA, 48 nt, Homo sapiens
gaggcucuugaccuuauaacucugggggugucugugggcggggaggcu

SEQ ID NO: 149059 - RNA, 42 nt, Homo sapiens
cccugcugcuguggugcuucucggcccuccuucccaccaucg

SEQ ID NO: 149060 - RNA, 65 nt, Homo sapiens
uuggacuuggauucugaucucuuuaucggugugaaacccaguguggaaaagcagggcugcuccga

SEQ ID NO: 149061 - RNA, 44 nt, Homo sapiens
ugacguugaacuuguccaugguggugaugaugauggcuggagug

SEQ ID NO: 149062 - RNA, 42 nt, Homo sapiens
gcgcugccuggucaucaaugucguccucuucauccuccucuu

SEQ ID NO: 149063 - RNA, 46 nt, Homo sapiens
ucaccaguagauguucugagggucaggggcauaggacacgguccag

SEQ ID NO: 149064 - RNA, 46 nt, Homo sapiens
gagucccugcacaucuccaacuggaccguguccuaugccccugacc

SEQ ID NO: 149065 - RNA, 46 nt, Homo sapiens
gugaagcggacccucuucaucaauggaaucuccaaauaugcagagu

SEQ ID NO: 149066 - RNA, 46 nt, Homo sapiens
uggaggugugucuacgcaugcuguagacggugagcagcagauacag

SEQ ID NO: 149067 - RNA, 51 nt, Homo sapiens
uggcaaaguugucacaucugcuagccagaaguguccagaugguccccagac

SEQ ID NO: 149068 - RNA, 60 nt, Homo sapiens
gaauugccauucauaugccuuguuaaaagggaccacugccacucagcuccaauccacaag

SEQ ID NO: 149069 - RNA, 47 nt, Homo sapiens
aggggaugggggcaagcccagcugacugcuccacccucugcccagga

SEQ ID NO: 149070 - RNA, 32 nt, Homo sapiens
uauauugaguucaaaacucuaaccaaaugaaa

SEQ ID NO: 149071 - RNA, 41 nt, Homo sapiens
cccaggguucugugcaucuuauguuuacauacccgggcucc

SEQ ID NO: 149072 - RNA, 46 nt, Homo sapiens
caagguaacagaaguaaagagcuuggcauccuuccugguaauugau

SEQ ID NO: 149073 - RNA, 92 nt, Homo sapiens
gccacguagagggauauggcaggugacaacccugucuggcucugcuaaucaggauccaguaagaagcucaagacagguggccacucugcugg

SEQ ID NO: 149074 - RNA, 49 nt, Homo sapiens
gacagaugaggaaacugaaauaauucuggggcggggagauugcucagag

SEQ ID NO: 149075 - RNA, 51 nt, Homo sapiens
cuuagauggacaagacaagccauccccugcccacagcugccccaccugaag

SEQ ID NO: 149076 - RNA, 49 nt, Homo sapiens
gagugucuuagagguaagaccgagaguggcccuuugaagguggcgaggg

SEQ ID NO: 149077 - RNA, 53 nt, Homo sapiens
uguauauugaaaccuuauuucaaaggaaugugugcuggggagccaggggaucg

SEQ ID NO: 149078 - RNA, 68 nt, Homo sapiens
acacuuucucuuuucucugccuccacaaugggcacguggauccugcccugucucucugugccucggga

SEQ ID NO: 149079 - RNA, 61 nt, Homo sapiens
gggggacagaacuagugguuucaauggugugaggacauagguccuuuuaggcugcacccca

SEQ ID NO: 149080 - RNA, 49 nt, Homo sapiens
gaugcgcgugcagcauguggagggaauccccaaagcacagcaauguccu

SEQ ID NO: 149081 - RNA, 49 nt, Homo sapiens
gggaguuaaggaggucuggggaggagaggcuugggcgguacuuggcagg

SEQ ID NO: 149082 - RNA, 36 nt, Homo sapiens
ugggggaaagggcagggcacaggugcucucucucag

SEQ ID NO: 149083 - RNA, 42 nt, Homo sapiens
ucuugucuugcucuaucuuucuuuggucugcaauggguaggg

SEQ ID NO: 149084 - RNA, 38 nt, Homo sapiens
uguguuucacagcucccucccacccuaucugggcugag

SEQ ID NO: 149085 - RNA, 34 nt, Homo sapiens
ugcccuccuccuucugccaugggugcagccuggg

SEQ ID NO: 149086 - RNA, 41 nt, Homo sapiens
ccuuuccaggguucaggaaggacuauucccaugcugcccgu

SEQ ID NO: 149087 - RNA, 44 nt, Homo sapiens
gcgagggcugaagagaccgaguggcagugacagcaagcccccuc

SEQ ID NO: 149088 - RNA, 42 nt, Homo sapiens
accuuggcaugguggagguagagcagcaaggcaaggcuccaa

SEQ ID NO: 149089 - RNA, 39 nt, Homo sapiens
uuccaaaauccacagugauuuggggaaguagagcaaucu

SEQ ID NO: 149090 - RNA, 31 nt, Homo sapiens
gcuagcccccagcgccacgaccuccgagcua

SEQ ID NO: 149091 - RNA, 44 nt, Homo sapiens
accaggcauaugacauggaucccccuggggaaccaggcugaucu

SEQ ID NO: 149092 - RNA, 56 nt, Homo sapiens
auucuugcucaccgucuggggcucauucccauucaugcugauccccgucuuuuuga

SEQ ID NO: 149093 - RNA, 54 nt, Homo sapiens
gacaagaaccuggcaaauuuagagauggguggaagucgaucaucagagaaggaa

SEQ ID NO: 149094 - RNA, 67 nt, Homo sapiens
gccaaauuagacacgguuucuacccaguucugcaaagauguucagucuuguugaggaauggugugua

SEQ ID NO: 149095 - RNA, 30 nt, Homo sapiens
uacuggaaggaguguggaggaacaggaggu

SEQ ID NO: 149096 - RNA, 46 nt, Homo sapiens
cccuucucugccccucccugugcaauguccuggaucccugccccag

SEQ ID NO: 149097 - RNA, 48 nt, Homo sapiens
acccuguugagggcuugggcuaguguggcagugaugaaaaucgaaaug

SEQ ID NO: 149098 - RNA, 55 nt, Homo sapiens
aggaaggggcaggacggggggcagcauggagacucaggaauccaggcuggggcag

SEQ ID NO: 149099 - RNA, 79 nt, Homo sapiens
aguuuuguuauuuuguuuuuuuuugggggugaugguguaauuguuaaccucauuuccguuuccuaccuguuugcuuccc

SEQ ID NO: 149100 - RNA, 46 nt, Homo sapiens
gacccaacugcauguuaccucugaagaauaaauauucuaagaaaaa

SEQ ID NO: 149101 - RNA, 25 nt, Homo sapiens
gccugcugcccauuaacaggggcac

SEQ ID NO: 149102 - RNA, 56 nt, Homo sapiens
uagccccgcugacagagaugaggugguccaggcaccuucugcccgacccgaagaga

SEQ ID NO: 149103 - RNA, 46 nt, Homo sapiens
ccucagagaacucuauuacccugcggccaggauacagugggugugg

SEQ ID NO: 149104 - RNA, 45 nt, Homo sapiens
ggagcugaccaacaagcugcuggaugccaagaacaccaucaacaa

SEQ ID NO: 149105 - RNA, 60 nt, Homo sapiens
ucaggcuaggagagggaagaggaagcagggcgcgguggcagccagggcaccuuguugagc

SEQ ID NO: 149106 - RNA, 50 nt, Homo sapiens
cggaccaaccaggaguuggaggacaagcugcacacacugguaaucugucu

SEQ ID NO: 149107 - RNA, 46 nt, Homo sapiens
gaagaugccuuagagaucaucuaauuccuauuagaaaacugaaguu

SEQ ID NO: 149108 - RNA, 43 nt, Homo sapiens
agcuggaaauugggcaggacugccuggagcuggagcugggcca

SEQ ID NO: 149109 - RNA, 68 nt, Homo sapiens
ccucccagaaugacuagugccgccccugcuaagaaacccuaccguaaggcaccaccagagcaucggga

SEQ ID NO: 149110 - RNA, 45 nt, Homo sapiens
cagcccccgccgagagagaacacuuggcugcccccucaccugccc

SEQ ID NO: 149111 - RNA, 43 nt, Homo sapiens
aacucccggacagcggaacagagagagcugccgacaaacagac

SEQ ID NO: 149112 - RNA, 43 nt, Homo sapiens
ggcagugggacaggcaguaaaugcagacagacucucuggggau

SEQ ID NO: 149113 - RNA, 76 nt, Homo sapiens
cccaaggaggacagugaugcauggugcaguggauaacaaagagagaagcaucgggacacuuggccugcaagcuggg

SEQ ID NO: 149114 - RNA, 42 nt, Homo sapiens
aaggugagauuaggagcaucaucaaugagcagccugugcaga

SEQ ID NO: 149115 - RNA, 145 nt, Homo sapiens
cucuccaccacauguucugcaaaguccccugucuacaggagaucagcccagugaaagaaacagacaaguaaacagagcccucaccaaacaacaugguaagugccaaaacagagguucaaagaaagugcugcaggggaccaagagg

SEQ ID NO: 149116 - RNA, 34 nt, Homo sapiens
gaaauuugggagcaaugaagcacaggacagauga

SEQ ID NO: 149117 - RNA, 73 nt, Homo sapiens
cacuggcccucugaugaccuuuccuauuuguuuggcacaugugauuuugagaagcagacgguaucugucagac

SEQ ID NO: 149118 - RNA, 98 nt, Homo sapiens
gcagagcuuuuggauaauacagauuuuuuugucgugagaauauccucauuaggcuauuuaaggcaauguuaaaaugccagugauuuccuguuugaagc

SEQ ID NO: 149119 - RNA, 70 nt, Homo sapiens
uauacuagucagaucucagcacuaauuucuguuucaugguugaaccugcugucucuuuauauagauagca

SEQ ID NO: 149120 - RNA, 119 nt, Homo sapiens
uuccucuggggauguggauuuugguggggguaucagaggugagggaaaggcagguugggauuagagagaaaaaauguagaucaguuucugguaagagaucaaguggacugauguaaagc

SEQ ID NO: 149121 - RNA, 49 nt, Homo sapiens
gggagucacgagaaaacaaauucugaucguguucacugaccauuuaggu

SEQ ID NO: 149122 - RNA, 50 nt, Homo sapiens
cuacuuggaaagaagaagagauagcgacuugccccaguccaaccccagag

SEQ ID NO: 149123 - RNA, 45 nt, Homo sapiens
ggguuggacuggggcaagucgcuaucucuucuucuuuccaaguag

SEQ ID NO: 149124 - RNA, 50 nt, Homo sapiens
agaggggaaagggaucuuucuaguagagugggauagugaggaagagagau

SEQ ID NO: 149125 - RNA, 45 nt, Homo sapiens
ggagaagcagagucacaaguuggaggaaaauuucuuagccgcgaa

SEQ ID NO: 149126 - RNA, 42 nt, Homo sapiens
gggcugccacuggacccuagggccccgguccgccccagcucc

SEQ ID NO: 149127 - RNA, 48 nt, Homo sapiens
ggccugccccgcggcaagauggcggccugaacgcagcuggcagcggcg

SEQ ID NO: 149128 - RNA, 44 nt, Homo sapiens
gccgcugccagcugcguucaggccgccaucuugccgcggggcag

SEQ ID NO: 149129 - RNA, 46 nt, Homo sapiens
agaccguggcccaccugaagcagcaagugagcgggcuggagggugu

SEQ ID NO: 149130 - RNA, 42 nt, Homo sapiens
gucacacagcaaguuaauggugaagguuuuaucagagcccag

SEQ ID NO: 149131 - RNA, 61 nt, Homo sapiens
cuuauuggcccagugccucaccccaccugucggacagauauccaaaggccacagcccccac

SEQ ID NO: 149132 - RNA, 47 nt, Homo sapiens
aaguggacgcagcucuguucagaccuuucugcucacacaccagaucc

SEQ ID NO: 149133 - RNA, 55 nt, Homo sapiens
agacaagaagcacaggacaggcugcacuggggccaaacacagacucagcaaagag

SEQ ID NO: 149134 - RNA, 87 nt, Homo sapiens
gaaaagauugcuguccacugcacaguucaaggauccaaggcagaagaaauccuggagaaggaucuaaaggugcagaaguaugaguua

SEQ ID NO: 149135 - RNA, 57 nt, Homo sapiens
ucuccuuuucaccuugauccgccaugauagagaacaggaagagcucagguucucuua

SEQ ID NO: 149136 - RNA, 21 nt, Homo sapiens
uugcugccuguuccaaggccu

SEQ ID NO: 149137 - RNA, 44 nt, Homo sapiens
agucugcaggggagguuggggcccuggacaaaucugugcuggag

SEQ ID NO: 149138 - RNA, 30 nt, Homo sapiens
ggucuaagauuucuaggaagggugagauua

SEQ ID NO: 149139 - RNA, 60 nt, Homo sapiens
uccuggaucagcugaacgacagugcugcggagccaggagcccagaacaccucugcuccug

SEQ ID NO: 149140 - RNA, 40 nt, Homo sapiens
agccucagcuggcagaugugagcccagggcuccccgcugc

SEQ ID NO: 149141 - RNA, 46 nt, Homo sapiens
acugcagccggggaugcgagugcggaugcuggaugauuaugaggag

SEQ ID NO: 149142 - RNA, 42 nt, Homo sapiens
gaagacauugaggacaugguugaggcugaugaguaccaaggg

SEQ ID NO: 149143 - RNA, 29 nt, Homo sapiens
ucuaugcugugccuuaugugcugccugag

SEQ ID NO: 149144 - RNA, 42 nt, Homo sapiens
cccuucucucugauguucuggcugcagauggugcugggccag

SEQ ID NO: 149145 - RNA, 44 nt, Homo sapiens
ugaggguggcaugaggacagcuuugucaggacccuacacauccc

SEQ ID NO: 149146 - RNA, 36 nt, Homo sapiens
gccauguuauaagaaguuuaaaaaauugaaaaaaau

SEQ ID NO: 149147 - RNA, 24 nt, Homo sapiens
ggagggagaggaggaagaggagga

SEQ ID NO: 149148 - RNA, 47 nt, Homo sapiens
aacccaagaguuugauuauaugacguguguguuuggcgacugcuaga

SEQ ID NO: 149149 - RNA, 41 nt, Homo sapiens
aaauggagggcuguuggguggagcuuggaaugguaggagaa

SEQ ID NO: 149150 - RNA, 44 nt, Homo sapiens
caaugaaggaaaugggaaggaagacugggccaugaaaacaggga

SEQ ID NO: 149151 - RNA, 40 nt, Homo sapiens
uuaauggggaaagcagggcuaggggaggauggcgaggaga

SEQ ID NO: 149152 - RNA, 73 nt, Homo sapiens
uaggacgugcugucuggagcuggaguggcgggggaggggccugagagugaugagguggggguggggagggagc

SEQ ID NO: 149153 - RNA, 46 nt, Homo sapiens
gcuccucacugcuccaauccccagugccuucugaagggcccugaug

SEQ ID NO: 149154 - RNA, 45 nt, Homo sapiens
cuccucuuguucaggaucuugguucaggggcugguaggaguagcc

SEQ ID NO: 149155 - RNA, 42 nt, Homo sapiens
uucaucuucacucucuaauggugggucuggcaaaugaagccc

SEQ ID NO: 149156 - RNA, 48 nt, Homo sapiens
gaagggagacacagcugcccugggagggaagaaguccaagaagaagag

SEQ ID NO: 149157 - RNA, 45 nt, Homo sapiens
ccugacugaauuccucugcgccaaccacgugcugaagggaaaaga

SEQ ID NO: 149158 - RNA, 45 nt, Homo sapiens
aagguggugauggacauccccuaugagcuguggaacgagacuucu

SEQ ID NO: 149159 - RNA, 48 nt, Homo sapiens
auccuggaccagaaggccucuggagucaaauacaccaagucguaagug

SEQ ID NO: 149160 - RNA, 114 nt, Homo sapiens
gagugggggagggggugggcgaaggcugugugcagaggggagucaaagagggcuucauacaggaagcacgaagaggcauuaggaguuagccggaugaagagaaguggaaagaga

SEQ ID NO: 149161 - RNA, 107 nt, Homo sapiens
cgguaccccuggaguucacacauugguagaaacaagcaaugauaauucagaguaguagaugccaugauaggggagguacagagcuuccuuuugggggccggacgagg

SEQ ID NO: 149162 - RNA, 41 nt, Homo sapiens
gugacucauuuaccaacauuaaacccuaggauacaugcaac

SEQ ID NO: 149163 - RNA, 46 nt, Homo sapiens
uauucuugaccuuggcuuguccacguuucaaaaugaguucucggac

SEQ ID NO: 149164 - RNA, 36 nt, Homo sapiens
ucagguugaaguuccugcuuuagagaggguguccuc

SEQ ID NO: 149165 - RNA, 45 nt, Homo sapiens
ggaguccauaaaaggauuacuauuuuuuuggccaauugcugcagu

SEQ ID NO: 149166 - RNA, 50 nt, Homo sapiens
uacuaggggugugggugggagggaugagugcgugugguggguugggggga

SEQ ID NO: 149167 - RNA, 439 nt, Homo sapiens
cuuggacuuggccaugucugcaccuggaagacaaaaguggagaucaggguuaagggcucgccaggcugggccaccucugccccccccauucuggucagaaugagccugcaggcagagaaugugcagccuccacgagucucggcuuacucugcacgaccaaacgccaguccuggccucccaaacccagguaaugaugcccugaaaucaacuccuuacccccggaaagcugcauuccccaauaaaguggcuuucccugccaucccccuccuaggaccuagaagcaccauucccaccccgcagcuuuugcucccgacagacacacggucggucaccaguccucuccgcagcccgcgccccgccgccacccguaagucgcggauggcaucggaugccgcgcggccaacacucaccauaagccgcggcucccgaagcgccuaga

SEQ ID NO: 149168 - RNA, 46 nt, Homo sapiens
gcauguauguguuguguuuuagcuucuccccuuaccccaccccaaa

SEQ ID NO: 149169 - RNA, 29 nt, Homo sapiens
uagguuguuuccccuccaagugauaagcu

SEQ ID NO: 149170 - RNA, 65 nt, Homo sapiens
uuaacuuuaguagugaacaaacugcuagagacaucugucauccuuaacaggccacugugguccuu

SEQ ID NO: 149171 - RNA, 46 nt, Homo sapiens
gaggugccaugaggucaaugucacucaaguuccuggccagccaaac

SEQ ID NO: 149172 - RNA, 27 nt, Homo sapiens
acgaacucuaggaggggaggagcgcgg

SEQ ID NO: 149173 - RNA, 44 nt, Homo sapiens
gggauaacacuaaccucuugagggcuaaccuauacauuaggaac

SEQ ID NO: 149174 - RNA, 30 nt, Homo sapiens
caucagcagaggacaucuguggcaaagagg

SEQ ID NO: 149175 - RNA, 43 nt, Homo sapiens
gcauacuuuacaugccagguacaaauaugagcucacgaccauc

SEQ ID NO: 149176 - RNA, 57 nt, Homo sapiens
agccuuguugcugaauuuuuuauuuggggggagaugacuuugaauuuuguuugaaau

SEQ ID NO: 149177 - RNA, 53 nt, Homo sapiens
aagaauuccucucugcccagaugguagguugauauuucuggacucuagccaag

SEQ ID NO: 149178 - RNA, 46 nt, Homo sapiens
gacugucacugugacacuaccaguggcaggcaauguggucaauuca

SEQ ID NO: 149179 - RNA, 226 nt, Homo sapiens
aaaacauggcucuuaaagcaguccaguuggguagaaauaaucuuaguuuugaagcugggcauggugcugcaugccuguaaucccagcuacucuggaggcugagacaggaagguuggcuuaagcccaggaauucaagaccagccugggcaaaacagcaagaccccaucucaaaauaaguacauaaauaaaguuuaaaaaaaaaagaaucuuaguuuugggacaugag

SEQ ID NO: 149180 - RNA, 22 nt, Homo sapiens
uaugauugugccauguaauccc

SEQ ID NO: 149181 - RNA, 47 nt, Homo sapiens
uuauauuuagucuuguaaagauguaaacuucuggauauuagucaagg

SEQ ID NO: 149182 - RNA, 65 nt, Homo sapiens
uggggcaaagagaauugcacugagaagagaaugcacuaggaagagaauuuucaugcuagccagaa

SEQ ID NO: 149183 - RNA, 46 nt, Homo sapiens
caggugguaggugagggcugaagucacggugagccaggcuagguag

SEQ ID NO: 149184 - RNA, 41 nt, Homo sapiens
gggccugggcauagaggccgggggucagcuggcugcccgag

SEQ ID NO: 149185 - RNA, 29 nt, Homo sapiens
accuuugcccagugcaagaagggggugcg

SEQ ID NO: 149186 - RNA, 41 nt, Homo sapiens
gccaaagaaugaaccacaaaauccaggagcaaauucugcca

SEQ ID NO: 149187 - RNA, 45 nt, Homo sapiens
ccuaaauguuaauaacaauggaauuggagcauuuaaccagcccag

SEQ ID NO: 149188 - RNA, 46 nt, Homo sapiens
uguacuguuacuaaaacagcuaauuauuucucucucccccuuugac

SEQ ID NO: 149189 - RNA, 46 nt, Homo sapiens
uaauuauuuuagguauuuucauuauaugaaagcuaccaugugucag

SEQ ID NO: 149190 - RNA, 42 nt, Homo sapiens
gaaaacgguucaccaguguuuaguuuuauauugaggugcuca

SEQ ID NO: 149191 - RNA, 46 nt, Homo sapiens
cucuggagccagccaguaaagcagcauuuacaaguucauggcuaac

SEQ ID NO: 149192 - RNA, 66 nt, Homo sapiens
uuacucugugauuuaguaagguuugguucacugguugaaaaaagcagaggcccuuuggauggugau

SEQ ID NO: 149193 - RNA, 57 nt, Homo sapiens
augacaccaaccucccccacguccccaccaucacgucauguugaugaggaaagggaa

SEQ ID NO: 149194 - RNA, 41 nt, Homo sapiens
ggaggggagaggaaauguccaaggaugagaauagugaagac

SEQ ID NO: 149195 - RNA, 359 nt, Homo sapiens
auguguauaugaauccacaggaggacuucuuaauggccaggcacgguggcucacgccaguaaucccagcacuuagggaggccgaggugggcggaucaccugagguuggcaguuugaggccagccuaacuaacauggagaaagccugucucuacuaaaaauacaaaauuagcugggcgugguggcacaugccuguaaucccagcuacucgggagucugaggcaggagaaucgcuugaacccaggaggcggagguugggaugagcugagaucgugccacugcacuguagccugggcaacaagagugaaacucuguuucaaaaaaaaaaaaaaaaaaaagaugcagauucugacuccacggu

SEQ ID NO: 149196 - RNA, 42 nt, Homo sapiens
cauuggaacugacagauuugugcauuuuuuuuuggggaacag

SEQ ID NO: 149197 - RNA, 45 nt, Homo sapiens
auguuuacuagugggucuaaaaauccaacucuuucgaauucaaaa

SEQ ID NO: 149198 - RNA, 47 nt, Homo sapiens
agauaccacuuaagaacuuucuuucuaccaagguauauacaauaugu

SEQ ID NO: 149199 - RNA, 45 nt, Homo sapiens
uagaauguugugaaauuacagaagagugagaugguagcccugcug

SEQ ID NO: 149200 - RNA, 46 nt, Homo sapiens
gauccagcuucauuccacauuacuaccaguuauuugauaacgauag

SEQ ID NO: 149201 - RNA, 42 nt, Homo sapiens
uccagcacagcaucaccgcgcaggaccaucagcucacgccgc

SEQ ID NO: 149202 - RNA, 112 nt, Homo sapiens
cugacaaguugcucuagcaacccaaagaagugaagagaaagaagcugccucaccgcccagacauugauuuguucagauguuucaaugccucaugauacaauaaaaccacaac

SEQ ID NO: 149203 - RNA, 44 nt, Homo sapiens
gaagagaggccaccugcaucagcccuguccaccccaagcaccac

SEQ ID NO: 149204 - RNA, 49 nt, Homo sapiens
aaguaugauucuggaaguuuugccacccaggccuaccgaggagcccaga

SEQ ID NO: 149205 - RNA, 48 nt, Homo sapiens
ccuuucacagccuccucccccgcccccacccucggggccuuccgagca

SEQ ID NO: 149206 - RNA, 53 nt, Homo sapiens
ccagccuaaccauuucucaggugcuugcgaggugaucagaaggcaaagauguc

SEQ ID NO: 149207 - RNA, 73 nt, Homo sapiens
ggcuagacggggucgguucgaaguuuccaaagaggagcccuagucccuaaaccccuucugggguucagcccag

SEQ ID NO: 149208 - RNA, 45 nt, Homo sapiens
aggcagacacggaggaggaggaagaggaggagggcgacuguauga

SEQ ID NO: 149209 - RNA, 88 nt, Homo sapiens
ccugcgguagggguaggccgucacucugagaccgagagucggcccuugccgcggcagggaacucagcgggcaaccugggcgcggggau

SEQ ID NO: 149210 - RNA, 42 nt, Homo sapiens
gcucaaaaggcagccagucgcucugcagggccucccggacga

SEQ ID NO: 149211 - RNA, 78 nt, Homo sapiens
cccucagccugagcaagcaccccacugccugggcagcccguuucugcuccaagucucugcucccacccccuccccagg

SEQ ID NO: 149212 - RNA, 48 nt, Homo sapiens
gccugcgggagcaggagaaggaggagaaggagcggaggcgcgagcggg

SEQ ID NO: 149213 - RNA, 46 nt, Homo sapiens
cggccucgggcucggagucagaggaggacgggggaccccggccccg

SEQ ID NO: 149214 - RNA, 45 nt, Homo sapiens
cuggccagguuuccuggcgggcucugugcuugaggacugcggcuu

SEQ ID NO: 149215 - RNA, 54 nt, Homo sapiens
ucaagcacagagcccgccaggaaaccuggccagaaggagaagagagugcggccc

SEQ ID NO: 149216 - RNA, 64 nt, Homo sapiens
cuccuccagggcgaucccgccuccagagacacggccacguccggggacaucugugguugucaug

SEQ ID NO: 149217 - RNA, 51 nt, Homo sapiens
ccccagugaauggcgaggccacaucacagaagggggagagcgcagaggaca

SEQ ID NO: 149218 - RNA, 27 nt, Homo sapiens
uuuaaugaaaaaagaaaucacuuuuau

SEQ ID NO: 149219 - RNA, 46 nt, Homo sapiens
ggcucaccgcguguucaaaugcccgcuggcggaagcugggacccag

SEQ ID NO: 149220 - RNA, 71 nt, Homo sapiens
cuaaagccgcauuugaaagggaaagugaugucccucugaaaacugaggaauuugaagugaccaaaacagca

SEQ ID NO: 149221 - RNA, 42 nt, Homo sapiens
guacuucacacaguucaaggcagaggugcggggcgcugagau

SEQ ID NO: 149222 - RNA, 48 nt, Homo sapiens
uccacccuagagcuaucuucgucuuccaggacagucuuccacccuaga

SEQ ID NO: 149223 - RNA, 102 nt, Homo sapiens
uagagcugucaccacccuccagaacagcccuucacccuagagcugucaccacccuccaggauaauuccuccacccuagagcugccuccauccucuaugacag

SEQ ID NO: 149224 - RNA, 46 nt, Homo sapiens
cagcaauggcagaugagucuggggaccagcgaagaccaccagcacu

SEQ ID NO: 149225 - RNA, 45 nt, Homo sapiens
aauauacguguauguucacuuacgccucucaaggagggaccaaug

SEQ ID NO: 149226 - RNA, 52 nt, Homo sapiens
ccgagaggcgcuguccggauauuuggugcugaaauaaauagcauucuccucc

SEQ ID NO: 149227 - RNA, 60 nt, Homo sapiens
uccuguggccuuuggggaaguguagucuugagcccccaagauuccuuuucuguucuaugg

SEQ ID NO: 149228 - RNA, 58 nt, Homo sapiens
gagcccagggcugcaaccccucauuauccaccacgcacagaugguacagcuggggcug

SEQ ID NO: 149229 - RNA, 43 nt, Homo sapiens
ggcaggcuggcacccccccaccgcccuccccacagccagcagc

SEQ ID NO: 149230 - RNA, 45 nt, Homo sapiens
gaagguggccaacaccuucaagccccacaggcuucaggcccgaaa

SEQ ID NO: 149231 - RNA, 23 nt, Homo sapiens
cgccgccagguggaggaccucca

SEQ ID NO: 149232 - RNA, 45 nt, Homo sapiens
gaccggcggcguccaaucggucaugggcucccgcuugggccagau

SEQ ID NO: 149233 - RNA, 46 nt, Homo sapiens
ucugcugcagagaccaugucugccgacggggcagaggcugauggca

SEQ ID NO: 149234 - RNA, 24 nt, Homo sapiens
gugggccuggacuuucuccuggaa

SEQ ID NO: 149235 - RNA, 35 nt, Homo sapiens
ggggcgggacuugacgagcgggggcccccucugua

SEQ ID NO: 149236 - RNA, 65 nt, Homo sapiens
gugcgggagggacgccgaggguccaggguuuggaggggcgcgagcugccggggguuggaggucga

SEQ ID NO: 149237 - RNA, 39 nt, Homo sapiens
gggcccggucgcgcacgcgcgcggggggggccggcaagg

SEQ ID NO: 149238 - RNA, 90 nt, Homo sapiens
ggacuucugggauucccucuuccguaaauaggaauccgaggaaugaaugaaucaaugaaugaaugaauaaacgaaccaacucggccacuu

SEQ ID NO: 149239 - RNA, 45 nt, Homo sapiens
gcuuuucuuucaauucccucuuuucauucuccuuccuccucaauc

SEQ ID NO: 149240 - RNA, 41 nt, Homo sapiens
gacaaaagcaaccccgacuccuuagagcauggcauggcuca

SEQ ID NO: 149241 - RNA, 42 nt, Homo sapiens
acccacacgguggacucgcuguccaggcugaccaagguggag

SEQ ID NO: 149242 - RNA, 45 nt, Homo sapiens
cagagugagucagacaaguccuccacccacggugaggcggccgcc

SEQ ID NO: 149243 - RNA, 46 nt, Homo sapiens
caaccccgacaaccccaaggagcggggcuucugguacgacgcggag

SEQ ID NO: 149244 - RNA, 46 nt, Homo sapiens
agcgggccguccugcaagcacugcaaggacgacgugaacagacucu

SEQ ID NO: 149245 - RNA, 45 nt, Homo sapiens
guacucccuaguccuggcggggggcuaugaggaugauguggugag

SEQ ID NO: 149246 - RNA, 49 nt, Homo sapiens
uuccggcaacaagaggaccgcggaacagucuugugaucagaaacucacc

SEQ ID NO: 149247 - RNA, 96 nt, Homo sapiens
cuggcucucaacugcuuugcucccaucaaugaccaagaaggggccgaggccaaggacuggcggucggggaagccggucaggguggugcgcaauguc

SEQ ID NO: 149248 - RNA, 46 nt, Homo sapiens
aaggaggggaaggaccggaucaagaagcuggggcugaccaugcagg

SEQ ID NO: 149249 - RNA, 46 nt, Homo sapiens
uguguuuaguucuuugaaaacauaaaagccugcaauuucucgacaa

SEQ ID NO: 149250 - RNA, 64 nt, Homo sapiens
guugcugccaccaacucuuuaagaaggcgacaggaucaguccuucucucggguucuggccccca

SEQ ID NO: 149251 - RNA, 66 nt, Homo sapiens
cagccuauaccucaauaaaacagggauauuuuaaaucacauaccugcagacaaacuggagcaaugu

SEQ ID NO: 149252 - RNA, 33 nt, Homo sapiens
cuuagauuauuaauguauuagggaagaaugaga

SEQ ID NO: 149253 - RNA, 35 nt, Homo sapiens
ugagggccugaggugcauuuguagguggcuuuguu

SEQ ID NO: 149254 - RNA, 49 nt, Homo sapiens
ggcccugccugccuggugcacgcuggcaugugcgauggggcccuuccug

SEQ ID NO: 149255 - RNA, 34 nt, Homo sapiens
guuuggaucugccguggcccuccugggcuugcgu

SEQ ID NO: 149256 - RNA, 21 nt, Homo sapiens
gugcucuguggugaggcccug

SEQ ID NO: 149257 - RNA, 46 nt, Homo sapiens
ccuggagugcaucccgggccucgcugaaggccaagcuccuccgcag

SEQ ID NO: 149258 - RNA, 46 nt, Homo sapiens
auuuacauucuagacaaauuagucugaaagaaaacagacacuggag

SEQ ID NO: 149259 - RNA, 46 nt, Homo sapiens
uuuccaaauugaagauggagaucaagaagagccggcgccauccccu

SEQ ID NO: 149260 - RNA, 46 nt, Homo sapiens
ccccuuucuccggggaggaagaugugagugacccggacgccuugag

SEQ ID NO: 149261 - RNA, 46 nt, Homo sapiens
cagucacugagcacgggggcaccgcaggagcccgccuucucggggg

SEQ ID NO: 149262 - RNA, 35 nt, Homo sapiens
ggcccggagcccccuucuaggacagcuggccgcuc

SEQ ID NO: 149263 - RNA, 70 nt, Homo sapiens
ggugggcuccugggcggccugcgcagaugggccacagaagggcaggccggagcugcacacucuccccacg

SEQ ID NO: 149264 - RNA, 49 nt, Homo sapiens
cgagaugaaggauacgcuguauuuuuugccuaaugucccugccucuagg

SEQ ID NO: 149265 - RNA, 45 nt, Homo sapiens
gcugggaagaaauaauguuuuaguuaagaguccuguuggcugcag

SEQ ID NO: 149266 - RNA, 61 nt, Homo sapiens
ucccgggagccuagaucucacuccagguaaguaauuguaguaguugagaaagagaaaggac

SEQ ID NO: 149267 - RNA, 42 nt, Homo sapiens
ucccggaguuccgcgcggcgccagcccuuccgccacggccgu

SEQ ID NO: 149268 - RNA, 41 nt, Homo sapiens
aagaacgugagcaagcccaggcacagccgacgccgcggggu

SEQ ID NO: 149269 - RNA, 43 nt, Homo sapiens
caagaggaagcgggaggagcugagcaacguacuggccgccaug

SEQ ID NO: 149270 - RNA, 49 nt, Homo sapiens
agccaaaguccugucuaagcaucagaacaggcugaacagucaaaaaguu

SEQ ID NO: 149271 - RNA, 38 nt, Homo sapiens
guucgauccaaacagcccccaguaaccccacgaccucc

SEQ ID NO: 149272 - RNA, 44 nt, Homo sapiens
uugagugugacucuguaggcagcggcggucaggccugcgagaca

SEQ ID NO: 149273 - RNA, 45 nt, Homo sapiens
ugaggcuccaggagguagcugccuggggcggaggggacccccgcu

SEQ ID NO: 149274 - RNA, 46 nt, Homo sapiens
gacggcgacccgggcucucccgcucauucccaucgugguggagcag

SEQ ID NO: 149275 - RNA, 42 nt, Homo sapiens
ccaccccgaaucuggggacaccccugcccucuccaccugcag

SEQ ID NO: 149276 - RNA, 68 nt, Homo sapiens
cagaggccugccagacccccagcugggcccugcucaccccuuguugcugggcuuggaggggccucuug

SEQ ID NO: 149277 - RNA, 181 nt, Homo sapiens
gccuggggacguggagcaucagauggggcggggacacgcugggggcgguaccuagagcggggauuuggagcggggacagaggagacgagcgccgggaccgggcagggccacacugggggcgguuacaguaccguuuagcgugggggcggggcuacggugcugggguuguggggccaggggg

SEQ ID NO: 149278 - RNA, 57 nt, Homo sapiens
ccaagguuaggggcggaaacggauguggagccagaugauguugagagacagagacag

SEQ ID NO: 149279 - RNA, 80 nt, Homo sapiens
ggucuguugucuuuucaucuguucaagaggagauugaaacugaaaacaaaaugagaacaacaaaaaaaauuguauggcag

SEQ ID NO: 149280 - RNA, 49 nt, Homo sapiens
ccccagcagccaagcccccucuucucucccucccgcccuggcucagcuc

SEQ ID NO: 149281 - RNA, 48 nt, Homo sapiens
cucuuguuuuuaaaauaaacuuuuaaaaaggaaaaaaaaaagucacuc

SEQ ID NO: 149282 - RNA, 42 nt, Homo sapiens
uuuuuuccuuuuuaaaaguuuauuuuaaaaacaagagggccg

SEQ ID NO: 149283 - RNA, 61 nt, Homo sapiens
cagccagagaagauagcgagaucuaaaucucugccaaaaaaaaaaaaaaacuuaaaaauua

SEQ ID NO: 149284 - RNA, 48 nt, Homo sapiens
aggaucccaauuuugaaagaaaaagcaugugagacacagaacaggcga

SEQ ID NO: 149285 - RNA, 49 nt, Homo sapiens
uuuuucacagaugaagaaguucacauucauucgauucauugagccugcg

SEQ ID NO: 149286 - RNA, 42 nt, Homo sapiens
gcugaagucacgcugcucccugauggagaaggagggacagag

SEQ ID NO: 149287 - RNA, 38 nt, Homo sapiens
ggagggcggaggcgcuagggucguaggggagcugcccu

SEQ ID NO: 149288 - RNA, 46 nt, Homo sapiens
aggcggccuggcucuggcagggacugguggggacgcggggagcggc

SEQ ID NO: 149289 - RNA, 45 nt, Homo sapiens
cccagcaguucagaagucccgccugcgagucucagcgcuccccag

SEQ ID NO: 149290 - RNA, 42 nt, Homo sapiens; identical to SEQ ID NO: 59916

SEQ ID NO: 149291 - RNA, 41 nt, Homo sapiens
cccagccgccgcccacgcagcagggacagcagcaggcaagu

SEQ ID NO: 149292 - RNA, 46 nt, Homo sapiens
ccggagcacccccacagcaggacuacacgaaggcuugggaggagua

SEQ ID NO: 149293 - RNA, 41 nt, Homo sapiens
ugagccgguggggccgcaggggccggugcggggccggggac

SEQ ID NO: 149294 - RNA, 46 nt, Homo sapiens
caugaggagcaggcggcugccacuggggguagguauugccccagcc

SEQ ID NO: 149295 - RNA, 37 nt, Homo sapiens
guccaacugggcagagaggacccuagaaggaaggaga

SEQ ID NO: 149296 - RNA, 44 nt, Homo sapiens
gcccaggcauucuguuggcguggucauuggccggaguggagaga

SEQ ID NO: 149297 - RNA, 36 nt, Homo sapiens
gguuaaccuugcuuguaaaggaacgcgcuggaguga

SEQ ID NO: 149298 - RNA, 46 nt, Homo sapiens
ccaugccgucugggacccuguacucuucugucauugaaguccugua

SEQ ID NO: 149299 - RNA, 34 nt, Homo sapiens
uugguuuugggggccaaaagagacaguuggaaga

SEQ ID NO: 149300 - RNA, 53 nt, Homo sapiens
ccugcccgugccccuacaguccuggccccacgccugcucgcgccccugcaggu

SEQ ID NO: 149301 - RNA, 61 nt, Homo sapiens
aggaacacguaaugccccugccccugagggucccccacgucccuucaccagacccccaucc

SEQ ID NO: 149302 - RNA, 54 nt, Homo sapiens
acaccccagggcccugcggggacccagaaccagcugauggaggggcucuguccc

SEQ ID NO: 149303 - RNA, 49 nt, Homo sapiens
uuuaccaaaagccucagcucuggcugggagccacaucccuggcucaaga

SEQ ID NO: 149304 - RNA, 83 nt, Homo sapiens
uggggguggggcuccaauugccucacucuggaauaaaaggcuuagccuaaggcuggggucucagccuggggucauaggucauc

SEQ ID NO: 149305 - RNA, 42 nt, Homo sapiens
gcucaagacauacacggacacugagguucucagccaccagcu

SEQ ID NO: 149306 - RNA, 24 nt, Homo sapiens
gccaugugacuccgaaggugggcu

SEQ ID NO: 149307 - RNA, 52 nt, Homo sapiens
ggcggguggcccugcguucauccaugucuuggagcuucuguaaggacaggga

SEQ ID NO: 149308 - RNA, 59 nt, Homo sapiens
aaauaaacaaaaauaaaaccacaagccgagagggaguggaaggcaggaaaaugagaggg

SEQ ID NO: 149309 - RNA, 78 nt, Homo sapiens
cauaggaggauguagagagugaggacgaauggacggagggauggacgcacggauggacggauggacgcaaaaaaagga

SEQ ID NO: 149310 - RNA, 48 nt, Homo sapiens
guccacaggaagaccugcaccacugucgccuucacacaggugaacuca

SEQ ID NO: 149311 - RNA, 40 nt, Homo sapiens
uggaauucaaaguaucuagguaaaacaaaguuuucuuggu

SEQ ID NO: 149312 - RNA, 41 nt, Homo sapiens
uuuuuaguagguauuaaaagacuggacauuuuauguagguu

SEQ ID NO: 149313 - RNA, 46 nt, Homo sapiens
auuuuaucucuuuaagucauaauuuucucaucuauucaauagggau

SEQ ID NO: 149314 - RNA, 28 nt, Homo sapiens
ccugauuagcuucugcaaaaauguuggg

SEQ ID NO: 149315 - RNA, 45 nt, Homo sapiens
auccugagaacauggguaauuuccuacauaaucacaguaccaaua

SEQ ID NO: 149316 - RNA, 40 nt, Homo sapiens
aauuacgguuacuggaaacaguaaagaaauuuauggcccu

SEQ ID NO: 149317 - RNA, 46 nt, Homo sapiens
uggaccuuuacacaggcucaccaugaugauuaaggacaagcagcag

SEQ ID NO: 149318 - RNA, 46 nt, Homo sapiens
uuaaaaugcagcuauagacaauuaauaaaagaaaugaauucugcca

SEQ ID NO: 149319 - RNA, 59 nt, Homo sapiens
ucacaggaugcaacuggguagcugacauuuuguauaguaaagugaaaugcucagcaggu

SEQ ID NO: 149320 - RNA, 54 nt, Homo sapiens
ugcccaugccauucauuugacuguggguggcccucuagucuagggcucucuuag

SEQ ID NO: 149321 - RNA, 36 nt, Homo sapiens
aaccacagcagugcuuuacucaaaaugcugcuugca

SEQ ID NO: 149322 - RNA, 39 nt, Homo sapiens
cuuaagauuauuugugaucuggauuuauguauuuguuag

SEQ ID NO: 149323 - RNA, 46 nt, Homo sapiens
gaucuuuccauaucauauuucauuaaugaucaguuagugucaagga

SEQ ID NO: 149324 - RNA, 43 nt, Homo sapiens
ugacaguauugcagaagcacccuaaaccuugacaguugaaaug

SEQ ID NO: 149325 - RNA, 55 nt, Homo sapiens
gaguuagagcuagaaacacaaaagagaauuuuucuacaaauuuugugcauugagu

SEQ ID NO: 149326 - RNA, 37 nt, Homo sapiens
uuucaagcuguauaauaauggagguggccuaaucuua

SEQ ID NO: 149327 - RNA, 68 nt, Homo sapiens
aaugucuacuguggugccaucucugugccaggcaccuuugcacaccuacuuauuuaauuuguuuuaua

SEQ ID NO: 149328 - RNA, 46 nt, Homo sapiens
aaauuccuugguuacaguacaaugaagucaaugaaagcagcaguga

SEQ ID NO: 149329 - RNA, 42 nt, Homo sapiens
gagaaugaaccugagcuacaaagugauagcaguggcccugaa

SEQ ID NO: 149330 - RNA, 55 nt, Homo sapiens
auuuuuaaaaaaagacaaaacuuacagucuuugauaauuuauuuuuuugaaagug

SEQ ID NO: 149331 - RNA, 106 nt, Homo sapiens
ugacuguauguucuuggauccaccauacucaagaguuauuacacaaagggaaacagaaaauaaccaaaugacaucagaaaguggagccacagcaggaaggcaagag

SEQ ID NO: 149332 - RNA, 46 nt, Homo sapiens
cagguuuuaauaggcaugaggcgaaacaaagaaguguucaaagaug

SEQ ID NO: 149333 - RNA, 54 nt, Homo sapiens
cucaagaugaaaugguuaguacgaaacaacaaaauaauacuagccaggaaagac

SEQ ID NO: 149334 - RNA, 46 nt, Homo sapiens
aggaaucauuaggcaauacaguauuugaguuggaaaacagagaggc

SEQ ID NO: 149335 - RNA, 41 nt, Homo sapiens
accuuaggaagcaguacaaaucuucauaaucacucugaggg

SEQ ID NO: 149336 - RNA, 45 nt, Homo sapiens
ggcccaaaccagcaggaggguaucagacaauuacaggcaggagau

SEQ ID NO: 149337 - RNA, 42 nt, Homo sapiens
acgcugccauauaugucacaguacacugaaaaggagccagca

SEQ ID NO: 149338 - RNA, 47 nt, Homo sapiens
ucacagaauaagaaaguaugagaaauuaaaaagauuguuacagagag

SEQ ID NO: 149339 - RNA, 32 nt, Homo sapiens
cuguucucgcuccggagccgcugcacauuucg

SEQ ID NO: 149340 - RNA, 41 nt, Homo sapiens
gaaaaugaaguuaagccgccaguucaccguguucggcagug

SEQ ID NO: 149341 - RNA, 41 nt, Homo sapiens
uuaagccgcccgcaccagcccagagccccugagcgcacgga

SEQ ID NO: 149342 - RNA, 116 nt, Homo sapiens
gauaagacuaaauuauuuuuuuucuggguuaagacagaacauaaauugugugugugugugugugugugugugugugugugugucuguguguguagggaggaugggcagcccggugg

SEQ ID NO: 149343 - RNA, 40 nt, Homo sapiens
ggagcuggugcugucuccuggaaccuguagaaaacgucag

SEQ ID NO: 149344 - RNA, 61 nt, Homo sapiens
ggaaggcuaugcagaggugacguuuggcaugagaguugaagcauuauguaaacagagacca

SEQ ID NO: 149345 - RNA, 62 nt, Homo sapiens
gguaggguggggaggagcuggcuuggaacggagauaagaugaaggugaagcuaaguugagag

SEQ ID NO: 149346 - RNA, 43 nt, Homo sapiens
guggaugagaucauguaagagaguauagagagguaagaggcuc

SEQ ID NO: 149347 - RNA, 47 nt, Homo sapiens
aggucaguuuugguggaguggugagcagaugcugauuguaaugggca

SEQ ID NO: 149348 - RNA, 46 nt, Homo sapiens
aaaauagaccauuuggagcguuugcuagcugagaauaaugagauca

SEQ ID NO: 149349 - RNA, 44 nt, Homo sapiens
ugucuguuugcuucacaaaguggaagucacaauucagaugugca

SEQ ID NO: 149350 - RNA, 78 nt, Homo sapiens
uagauguuggauguuuacagucuaauuucuuuugacaauccagaugguggaguuuggaagcaaggauuugacauuacu

SEQ ID NO: 149351 - RNA, 69 nt, Homo sapiens
uaugaaucuaaugaaugggacacugaaccccuucaagucuuuguggugccucauucccauaacgaccca

SEQ ID NO: 149352 - RNA, 40 nt, Homo sapiens
cguauagggcugcaggaugaacaaaacgccugcuguccua

SEQ ID NO: 149353 - RNA, 55 nt, Homo sapiens
auugaaguauccaggagguguucuuugguaccaaaucagguuaaaagugccccag

SEQ ID NO: 149354 - RNA, 82 nt, Homo sapiens
ccuauagcuucauacgugccacauuguaggugcucaguaaauaauuguaggauggaugaguagauuucaauuaaagcaagag

SEQ ID NO: 149355 - RNA, 44 nt, Homo sapiens
ucuuauagccaaauugcaacuaucuuuagauaaaauuuccagga

SEQ ID NO: 149356 - RNA, 95 nt, Homo sapiens
aguauauuuuuaauaacaugguccuaaagcugaaagaagacucacggaggaaguuuauuuggucugagaucucuuaccuuucaaaguggugggau

SEQ ID NO: 149357 - RNA, 53 nt, Homo sapiens
gacugggaaagauaggguagaagaaaauagauaaaugcuggaaaacauuuuaa

SEQ ID NO: 149358 - RNA, 56 nt, Homo sapiens
cgaagcauaacgcauaaggggcagguuugguccauagccucuagacuguggcuaaa

SEQ ID NO: 149359 - RNA, 37 nt, Homo sapiens
uauauauauauauauagauagauagauagauagauag

SEQ ID NO: 149360 - RNA, 25 nt, Homo sapiens
ccucaccauaagaggaaauuuucuc

SEQ ID NO: 149361 - RNA, 67 nt, Homo sapiens
aucccucacacuuguggaccugauccuaaaauaugcugccaguuugauuuuaaacgucuuccuggag

SEQ ID NO: 149362 - RNA, 44 nt, Homo sapiens
ugacagcugcauccuugugauuuaguagcaugacuggcagaugc

SEQ ID NO: 149363 - RNA, 46 nt, Homo sapiens
ggaguggcuauuuuacauccagacccuuuuacaaacgaauggacag

SEQ ID NO: 149364 - RNA, 46 nt, Homo sapiens
uaaauuucucucaucaucacuuuacacggcacugacagaagccaga

SEQ ID NO: 149365 - RNA, 63 nt, Homo sapiens
ucaacaucaugaugcuaucacaggaacugcaaaagacugggugguuguggauuaugguaccag

SEQ ID NO: 149366 - RNA, 47 nt, Homo sapiens
aacuuguaauuaagguaggugggagaaaacggaacacagggugagcg

SEQ ID NO: 149367 - RNA, 47 nt, Homo sapiens
uauauaguggcagacaugcuaacaucuccuuaauacaacaaccauaa

SEQ ID NO: 149368 - RNA, 46 nt, Homo sapiens
acaugaaacuaaauuaaacaaaacaucuauuuuaauucuuggggua

SEQ ID NO: 149369 - RNA, 45 nt, Homo sapiens
ucugcauuucuucuuauuuugaaggacaaacucacauacgacucu

SEQ ID NO: 149370 - RNA, 58 nt, Homo sapiens
uaggauuugaaacaaaaaucacaagauucucugccacaaaaaaauauaauaaggcuga

SEQ ID NO: 149371 - RNA, 87 nt, Homo sapiens
uuugucauauucuucaugagucuucuuuaauguuguaaggguuggcuuuuuuuuuaguuauaaacacaguuccuguuugaguaacaa

SEQ ID NO: 149372 - RNA, 45 nt, Homo sapiens
cuucacuagugaugcugaagaguaaagcugacacugaaagagggu

SEQ ID NO: 149373 - RNA, 34 nt, Homo sapiens
cauuuaguuuugauagaauuuaacagcaccaugg

SEQ ID NO: 149374 - RNA, 47 nt, Homo sapiens
gggcuacccugaucaucuugucuuuuuuacuuucaacucguauccaa

SEQ ID NO: 149375 - RNA, 54 nt, Homo sapiens
agcaggcacuuaacuaauauuagcaaugauguaacuuagcucaaaacccuucuu

SEQ ID NO: 149376 - RNA, 40 nt, Homo sapiens
aucaguuaggaaaaucauaccaaacacaaugaaacugaaa

SEQ ID NO: 149377 - RNA, 60 nt, Homo sapiens
uccacuuuguacugcagccaguccuagaaggaagccugugugcucccagucuguuguuca

SEQ ID NO: 149378 - RNA, 88 nt, Homo sapiens
uaugugaguuccccgacagugcaaguguucucugcuucaggaaaaccuguggaaguucaagucagcgcaguuugggauacagcaaaua

SEQ ID NO: 149379 - RNA, 45 nt, Homo sapiens
ucuuuucgagcacauauaccgccauugggacugaaaguguauaag

SEQ ID NO: 149380 - RNA, 33 nt, Homo sapiens
uagagaacuccuuuguuuuacuucgguuugauc

SEQ ID NO: 149381 - RNA, 50 nt, Homo sapiens
augaaguaaaugugcaauuuucaugguauggaaccacaauuaaaagagac

SEQ ID NO: 149382 - RNA, 337 nt, Homo sapiens
auugauacuuagcaauuuguagucgaaaguuagauaaaugguugggcgcaguggcucacaccuguaaucccagcauuuugggaggccaaggaggguagauugcuugagcucaggaguucaagaccagccugggcaacauggcaaaaccccuuuucuacaaaaaauacaaaaauuaggcaugguggccugcaccuacagucccaguuacucaggaaggcugaggugggaggauggcuugagcccggaaggcaguugcagugagccaagaucacgccacugcacuccagccuggguugacggagcaagaccccguuagauaaauaguuuuuuagaguug

SEQ ID NO: 149383 - RNA, 96 nt, Homo sapiens
gcccuuugucagagugacacauggaaggauuuauucggaagugacuugcuuuuuugaccauguuacucauagaguccgacuauaccacauacaggg

SEQ ID NO: 149384 - RNA, 47 nt, Homo sapiens
cugaaucuggggcuuccaucccuggagucugccccacuuguaaacaa

SEQ ID NO: 149385 - RNA, 48 nt, Homo sapiens
uggaaguuuccaauauuguggacauccgaaaaguauauaaccgugaga

SEQ ID NO: 149386 - RNA, 57 nt, Homo sapiens
aaccuagaaugacacugagcaaauugccucuucaagcaaaugucuaucccaugacca

SEQ ID NO: 149387 - RNA, 67 nt, Homo sapiens
ucugcucagucauuagggguuucgaguuugaauagugguauguauugcuuacacucuuuuccacucu

SEQ ID NO: 149388 - RNA, 103 nt, Homo sapiens
cuuuucagcuuuuuucuuucaacaaccagacuauuaguuaaguuuggguuuugugagaacaacauaaaaagaugaaucuccuaaaucuucagaugaagaacag

SEQ ID NO: 149389 - RNA, 47 nt, Homo sapiens
ucuauuucgaauacuacuagaaaaaagaagugcuguuaauacgguau

SEQ ID NO: 149390 - RNA, 44 nt, Homo sapiens
uuggggaaacaccaacgguuaggaagaacuaauuugguuuggag

SEQ ID NO: 149391 - RNA, 51 nt, Homo sapiens
auauaagaggugagaaauguuuaauguagaacaaagaacuaaagcaauaaa

SEQ ID NO: 149392 - RNA, 28 nt, Homo sapiens
gauuucuggggguagagugcuccaggaa

SEQ ID NO: 149393 - RNA, 61 nt, Homo sapiens
ugacugcugacucagcuaccauuuauaacaugaggcuaaugucacguauugcugugucagg

SEQ ID NO: 149394 - RNA, 72 nt, Homo sapiens
aagccuuuugagaacaaaggcacucuguaaacauaccuuguuauccuaaugacacuuacuccaacuugguug

SEQ ID NO: 149395 - RNA, 68 nt, Homo sapiens
uaauaaugccuauugauaacuaccaugcuggcucauaaucagaacuaaauacuuggcaguuuugcauu

SEQ ID NO: 149396 - RNA, 56 nt, Homo sapiens
gagggaauacacugucuauuuuucuugugucuucaguaauaauaggacaccuacag

SEQ ID NO: 149397 - RNA, 49 nt, Homo sapiens
acauuccgaauccaguugaggugaaccugacuuucacauuuggauugag

SEQ ID NO: 149398 - RNA, 44 nt, Homo sapiens
ccaugaacuaccaccaucaguaugaauugaugcaacaaaugaag

SEQ ID NO: 149399 - RNA, 38 nt, Homo sapiens
ggaauaaaauguuuguggguaaaagcuaauggccaaaa

SEQ ID NO: 149400 - RNA, 45 nt, Homo sapiens
aucauucaacaguagaaaaagaggcauauuuucauuacuugacaa

SEQ ID NO: 149401 - RNA, 43 nt, Homo sapiens
auaagucuuguuaaaucaguguccauauuacuguuuggggaag

SEQ ID NO: 149402 - RNA, 44 nt, Homo sapiens
acuauuugaauguacugagaugucagaaaacaaaacaaggaagg

SEQ ID NO: 149403 - RNA, 37 nt, Homo sapiens
gcuuuuuaagguuacuuuuagaauaaaucaucaggga

SEQ ID NO: 149404 - RNA, 46 nt, Homo sapiens
uuuguuguacuugugccgaaguguuuugauauuccuuugucuggaa

SEQ ID NO: 149405 - RNA, 47 nt, Homo sapiens
uuuuguucaccuuggaaucaacagguuuugauauuuucucuuggaag

SEQ ID NO: 149406 - RNA, 563 nt, Homo sapiens
ggaauauauucagcgaaacuuaccugaagggguugccauggaaguaacaaagguauagcuugaauuucugccucuuucgguggggcgguggggagugguaucuguauuguuguuuugauacauugcagccugguccuggcccacugaguagaguuugcccuaaacuguggcaaacugggagacacaguugccacagcgguugggggcuacccaccccuugcaacagaauccugccauuucagcccaaguccuccgugaaccaccuaugaaguucucccuccucaauaugaguugucuagaccuggggaucccauuaaguggcaauccaugaagaucauugaggaucaaaucgauuauguaugugagaguguuuuauagaccaucaaguuuccuucuuuccauuucaaaacccuauagaaagacuagggggauaaaagaaaaagaaguaaagaggauuugaccaaauuaauaaguccgauuuguagucaaagaguucuguuaaauccacauuauaguuuuguuucuuucuuuuuuuagacacaauuagaacaguuaccagaaca

SEQ ID NO: 149407 - RNA, 2226 nt, Homo sapiens
gaccaaaccugugguauguacucccuguuucuugguauaaggagcuaccuuggcaauagguuuuccuuauuauuucauuggguuuuuuuuccccaaacacucuaugaauaaaaaaauuuuguccuagaauacuggcaaaugcacaacgcauauauucucuuaacucccuggauuauauugucuucaggguaucaaaguaaguucuaaaggaauaaauuauuuacccccaaauaacuguguuaauuaguagucucuugcuuuuagcuuggcauaauggaagaguugucagaauuugugauguagaauacuugauuuauguuauggaaaaguauuuuucuuguagccuucaagucuuuguuuucauuuuguguauugagccugggccuggacagugcuuuauuguucacagugagaaaaugcguuagcacaaauaauaaacaucuagaaggaacuugguaacccuguagaagcuaugauuucaucaauccaguuuuuuguguuacuuguaauuuuuaaaaauccuuucauuuccaccccucaaaaauaacccccuuuaacaguuugggauuacaguucuagacauuugucuguagguacucacuuugucugugcacaugucuaguuuacugcucuuuucuaacuuuucucuuaauagauauuggauauuuauuuauuuauuuauuuugagacagagucucgcucugucacccaggcuggagugcaguggcaugaucucggcucaccucaccucagccuccuggguucaaguaguucucaugccuuagccucccgacuagcugggauuacaggcacacaccaccaugccuggcuaauuuuuguauucuuaguagaaaugggguuuucccauguuggccaggcuggucucaaauuccuggccucaagugaucugccugccucagccucccaaagugcugggauuacaggcaugagccaccacaccuggccaguacuggauguauuucuaugauaguacauuuaagccccagucugcaacucacaugccugcaggagccaggccuauaagaaaagguggcagaauuggcauggugugccacugucuuuauaagcaagacagcagcuacuuauucuagccacuuguugcccugugggaaaucagaccuagugaugccagccugucuaaaucuuccaagcuaaacugaaauccagauuuucuugugaaaucuucugauuuuuaauauuccuaacaaauucaaaguaucuuuuaacacccuguagggaucagucagaacacaucuugaggcuauauucccccuucucaucccucaacuuaggacacaggcuaucaguauauucuguucuuccaacaacccuuuuuggaguaauugagaguggauaucuagcuuucuggcuaguaaguaaaucuuucaggagugaagugauuuaacucugaaucauuggauuaguaguauaauuuacugguuuaacggaugaaugaaaugaagguaauucaccuuuuggaagaaagucaaaaaugucaaacccauuauuucuaaggucuuuagguauuaggguggaagagguugaaguuauagguauagucagugucauaucauuuaaauuagaaaugaguaauuuguuuauuagggcagacaaaacauacgcgaauaaaaccuaauaaaaaauaugaauagaacuaacuuggcuuuguauaauaauguuuuauaauuaauaagcacuuuaaucuguguuuucuuauuuuuuucuuagagaaauacuaugagcaauagcauagguuuacccucuuucauaugugaggaaacuaaugugcagugagacgauaugauuuguccguugucauucagcuaccauuagcagagcuuaauccucaauccaagucuucugcccaggcucuuuacuagcagacccuggaguccuuuuucauugugaauuugaagcugaaucguuauuuuaaguuggaaaguuccuuuaguaauuuuguggguugccuugaaaauucuuuucauuuacacuguauuuuaacagauucugaggcucauaguccagaucugaacaugaaaguaucuagacacuucagcuaacacugccgucacucaguguuuuucuccucauuuauuaguaaacucugaaguuguucaauugaggcuaauguuuuaaauuugcuaguuagaaauagaagaggaacuaaaacugaaacuuuucuuuuggauuuuagguaacaaucuc

SEQ ID NO: 149408 - RNA, 46 nt, Homo sapiens
uuaagacaaaauuuggauaucauauuauuaugguugaaggaagaaa

SEQ ID NO: 149409 - RNA, 42 nt, Homo sapiens
aaaucauggaagccauggaaaaguuaaagucugggaugagau

SEQ ID NO: 149410 - RNA, 41 nt, Homo sapiens
cucugggagugacagugcugacaagaaggcucaagguccca

SEQ ID NO: 149411 - RNA, 43 nt, Homo sapiens
cccguuuuaugggaaugcucuuuagaauucauuuuguucagcc

SEQ ID NO: 149412 - RNA, 47 nt, Homo sapiens
cugucccaugguauuuaacauaaaaaaaaauaaaacuguuaacagau

SEQ ID NO: 149413 - RNA, 44 nt, Homo sapiens
guguaaauuuuuccuccuuuaccuuugcuaauaucauggcagaa

SEQ ID NO: 149414 - RNA, 46 nt, Homo sapiens
uaaaaacaaacuguucggcuacuggacagguuguauauuaccagau

SEQ ID NO: 149415 - RNA, 36 nt, Homo sapiens
aaauuuuugcuuggucaguucuuucuucuuugcccc

SEQ ID NO: 149416 - RNA, 46 nt, Homo sapiens
uauggaaccuagcaaagcuguuccacugaaugcaucuaagcaagau

SEQ ID NO: 149417 - RNA, 43 nt, Homo sapiens
uauuugaauugcacaaccagagcacggaaaaugaccuucaaug

SEQ ID NO: 149418 - RNA, 58 nt, Homo sapiens
caaaaaagcuagcaagagaaaaacucagagaauugaaguaggcugcuuuaaaacguug

SEQ ID NO: 149419 - RNA, 82 nt, Homo sapiens
uaaaauauaucugaaacaguuuuuuaauaauaggggcggcuauuauuagauugguuggggugggagaaaugggggugaagaa

SEQ ID NO: 149420 - RNA, 68 nt, Homo sapiens
gaacaaaugggguaucaguaaguauaauuagggaaucccuuucccaccuguuuguauaauacaguauu

SEQ ID NO: 149421 - RNA, 44 nt, Homo sapiens
uuuuuguuuuaauauaugcauacauuauuaaaugaucaccacag

SEQ ID NO: 149422 - RNA, 45 nt, Homo sapiens
caaguuuaugguacagacaauuuuugcuccaccaaacacuucaga

SEQ ID NO: 149423 - RNA, 51 nt, Homo sapiens
gcuguaauaacacagggagcaggaacacacauggauucaucucucccagau

SEQ ID NO: 149424 - RNA, 48 nt, Homo sapiens
cguuguugagaauccaauuaaauuuuguuuucucuuuaauuuuuaaac

SEQ ID NO: 149425 - RNA, 40 nt, Homo sapiens
acagcaaaauguucaucguagaaugugagugaugagugua

SEQ ID NO: 149426 - RNA, 50 nt, Homo sapiens
agguuguuugauguuuguguuuuuuucauuuguaaaguaagagguuagga

SEQ ID NO: 149427 - RNA, 970 nt, Homo sapiens
uuucaggauauuaacaugaagguggauuugguuaaauggguguguuacuuaagaaaaggucugggcuuuggauaauuuccuuacuucagguccuuuuauauuuacuagucagcagacaucuccuuuucuuuucuuucuuucuuucauuuuuuucuugagauggagucucgcuuugucacccaugguggugugcaguggcgcuaucucggcucacugcaaccucugccucccgaguucaagcgaugcuccugccucagccucccaaguagcugggauuacaggcgugcaccaccaugccuggcuaauuuuuguauuuuuaguagagacgggguuuugcccugugggccaggcuggucucccugaccucaagugauccaccugccucugccucccaaaguguugggaugacaggcgugagccacugugcccagccuccuuuauugucagcucuuuacccuguccuccacacugcugcuggaacuacgcuuuggaaaaaggaggcuguuacuguuagucccuugauugaagaacucuaaauguuuucuuacuauguacuugaaaaauccaaaauccacugccuaacucuccagccucagugucuauucuuuuucuucuguccauaacuuuggcuauaugaaaccauuuucccaaacacuccaggccacugcaaugcuuugcacaggcucugcuuagaauauuguccucccucacgucugucaggcagccucuuauuucaagaaucacuuccucuugagaagucguugauacucuaccaguccaaguuggucagagccuucaugccacuguugaagcuugugcuuaccuguaauaacaguacuuucacauuagauaguaguuaggcuuacauauucuccccucccaaacuauacuaugaacucugaguauauaccuguuaauguuuguaguaacaaguucuggcaucauaaaaugauugcccaguaaguguuga

SEQ ID NO: 149428 - RNA, 48 nt, Homo sapiens
guggaugucuggaugaggacgaaaugcaucuuauuuggggguguguga

SEQ ID NO: 149429 - RNA, 63 nt, Homo sapiens
gcugcagcaguacuggcaaguggugaccccuuggacugaggucaugguauuggaggugaugaa

SEQ ID NO: 149430 - RNA, 27 nt, Homo sapiens
ugaagaagaaaggaaaaugcauguuca

SEQ ID NO: 149431 - RNA, 55 nt, Homo sapiens
aauauuggaacuacaguugugagugaaacacaagccauguuuucauggggcaguu

SEQ ID NO: 149432 - RNA, 337 nt, Homo sapiens
uuuauaauguauuacacauuuuauuuuucuaccuauuagcaguuuuuuuaaauuuuuuuauuuuuugagacggagucuugcucuguugcaguggcucgaucucggcucauugcagucucugccucccggguucaagcaauucuccugccucagucuccagaguagcuggaacuacaggcaugcacuaccaugcccagcuaauuuugaauuuuuuguagagacgggauuuugccaggcuggccucgaacuucugaccucaggugauccgccugccuuggccucccaaagugcugggauuacaggcgugagccaccgcaccugaccccuauuagcaguu

SEQ ID NO: 149433 - RNA, 67 nt, Homo sapiens
gaaagaagcccuuucucuaugugccccaucccucccuuaggaagcauuuaaggaaaaggcuuguuuu

SEQ ID NO: 149434 - RNA, 54 nt, Homo sapiens
guuuuuguguugccaguaaaaauaagacuagccagggaagcagaaaaggugugu

SEQ ID NO: 149435 - RNA, 91 nt, Homo sapiens
agguguucagcaauucugaagacaaaauucagacagcagagcugcugccuucucuggcagauggaggaguguccgugaaggagggcccuuc

SEQ ID NO: 149436 - RNA, 111 nt, Homo sapiens
uguuaccaaauuucuccuuuuuuucugggaagcagagaccauguucucuccauccuucgcagguccacaugaggccauaccagaaucacgcacuccaucuagcggcauuua

SEQ ID NO: 149437 - RNA, 38 nt, Homo sapiens
gaaaacugaauggcuccaucacccacgcuuggugagaa

SEQ ID NO: 149438 - RNA, 48 nt, Homo sapiens
gcaccggagcacagaggagcugcccaggccacuggugagccugaggca

SEQ ID NO: 149439 - RNA, 16 nt, Homo sapiens
uacccagugcuggcag

SEQ ID NO: 149440 - RNA, 63 nt, Homo sapiens
aggaugaauuuuaucugacuuauuaccugaaagaaagagaagcuggcugcaaauccuauaguc

SEQ ID NO: 149441 - RNA, 33 nt, Homo sapiens
auguugauaaaauuaaaauuuaaaaacaaauag

SEQ ID NO: 149442 - RNA, 47 nt, Homo sapiens
gaaccccaggccguggucgucagcucaguguuuguucacagccgcuc

SEQ ID NO: 149443 - RNA, 30 nt, Homo sapiens
ccugcaggcucuucgggaacaugguuggga

SEQ ID NO: 149444 - RNA, 55 nt, Homo sapiens
aaggaccauuuucauuuucaucauuuucaaaucaaaagcauuuuccagccuccuu

SEQ ID NO: 149445 - RNA, 46 nt, Homo sapiens
ugauuaagccuagacuguguucuuuuuuuuuuuuuuuuuuuuuuuu

SEQ ID NO: 149446 - RNA, 43 nt, Homo sapiens
gauguaccuuuaugcuuuuaagaacuacaaagauucaauaaag

SEQ ID NO: 149447 - RNA, 43 nt, Homo sapiens
ugcuuugcuuaccguuuuaaagaaaauuuguaaaacuaaagac

SEQ ID NO: 149448 - RNA, 50 nt, Homo sapiens
cagugucuaguguacauacacugggaaaccuaguacuucuaauaugaaga

SEQ ID NO: 149449 - RNA, 46 nt, Homo sapiens
cuacaaucauuuugacaauuuccuuucgcacuuuguaauccaaguc

SEQ ID NO: 149450 - RNA, 47 nt, Homo sapiens
ugaguuguccaauaguauccugucguuacaaccagagccugagauac

SEQ ID NO: 149451 - RNA, 45 nt, Homo sapiens
guucugugaagcaagugccaaggauaacuucaauguggacgagau

SEQ ID NO: 149452 - RNA, 53 nt, Homo sapiens
ucuuaguuggaaauaaguuggacugugaaacggacagagaaaucaccaggcag

SEQ ID NO: 149453 - RNA, 21 nt, Homo sapiens
ggcacuccucaccuggcugcg

SEQ ID NO: 149454 - RNA, 42 nt, Homo sapiens
auucaacagcauuaccucagcuuauuacagaagugccaaggg

SEQ ID NO: 149455 - RNA, 45 nt, Homo sapiens
auggugcuggcacacgguagauauuuaagaaauacuugcugaaug

SEQ ID NO: 149456 - RNA, 37 nt, Homo sapiens
cauuacagugaaaacucaaguuuauggggaaaaagag

SEQ ID NO: 149457 - RNA, 58 nt, Homo sapiens
uuauaaaguauguccaaauguccuggugccucccuggagcucugcccacuaagucuau

SEQ ID NO: 149458 - RNA, 46 nt, Homo sapiens
ccacuuccccucaagagccucaucugacugcagcaccucauuggug

SEQ ID NO: 149459 - RNA, 25 nt, Homo sapiens
caaaagaaauaucaucugccaguua

SEQ ID NO: 149460 - RNA, 69 nt, Homo sapiens
acugcuggaguucgguaaguuguucaaguugguugggaaaggcagucugacauauucagacuccauugu

SEQ ID NO: 149461 - RNA, 46 nt, Homo sapiens
cugcaauaaguuaauguagauaaggcccuuagaauauuaucugaaa

SEQ ID NO: 149462 - RNA, 40 nt, Homo sapiens
uaucauccuccuuuuguccuuuaauucacgucuuugacau

SEQ ID NO: 149463 - RNA, 38 nt, Homo sapiens
uuuuuguauuguuaaucaaaucagaaacugguuuaaaa

SEQ ID NO: 149464 - RNA, 51 nt, Homo sapiens
augaaguuuaaagucaccuauggagaauguuaaaacuaaaacuacaguaag

SEQ ID NO: 149465 - RNA, 46 nt, Homo sapiens
guagguguaaggagaggcaauguguuucaucuuggacaugcugagu

SEQ ID NO: 149466 - RNA, 77 nt, Homo sapiens
ugaggauuugaaauguguuucuaggaaggaaggagagguagcaagugggcaguguguguguuuguuuguucacuuua

SEQ ID NO: 149467 - RNA, 45 nt, Homo sapiens
gugauuugucuaagguuauacagauaauagguggauaucccagau

SEQ ID NO: 149468 - RNA, 35 nt, Homo sapiens
uugaggcccauugagauuguuugacuaaaugguaa

SEQ ID NO: 149469 - RNA, 42 nt, Homo sapiens
uggggguguucacggccggcuagacauucugugcucgugcag

SEQ ID NO: 149470 - RNA, 43 nt, Homo sapiens
aagggaaaguggcccuuucaccaccuggcucccaggcugggag

SEQ ID NO: 149471 - RNA, 47 nt, Homo sapiens
guuggggcuacgucuuuuccuacaccugccuacacagaugcuggcaa

SEQ ID NO: 149472 - RNA, 93 nt, Homo sapiens
ggcggcuuuggacacacauggucucucuuccaggucucauacaucuugagagagagaggggagaggggcgaguggccaaguacacacuagcca

SEQ ID NO: 149473 - RNA, 46 nt, Homo sapiens
guucucagaagcgugauguguccagucccgaugaaaacaaugguca

SEQ ID NO: 149474 - RNA, 45 nt, Homo sapiens
cacaacgcucaggguucaggaagcgauccugaaagagcuggggag

SEQ ID NO: 149475 - RNA, 47 nt, Homo sapiens
ccagaaucaaaagacuuggggucccagaccccucaagccuuaacauu

SEQ ID NO: 149476 - RNA, 46 nt, Homo sapiens
cccuauagcugugagguguguggaaaaucauuuauccgugccccag

SEQ ID NO: 149477 - RNA, 41 nt, Homo sapiens
cuguagcuagaggcggugggacagggacacuuugccuggaa

SEQ ID NO: 149478 - RNA, 23 nt, Homo sapiens
ccaaaccguuucacugucuuguc

SEQ ID NO: 149479 - RNA, 46 nt, Homo sapiens
ugguuacaguuuuaaauagaaguugauugccuuuucauagccguaa

SEQ ID NO: 149480 - RNA, 47 nt, Homo sapiens
ccuuucauaaaaccuucacaaguuaaguuuauuccuguuguaccuua

SEQ ID NO: 149481 - RNA, 43 nt, Homo sapiens
cccuaaagaacuugccuuguuucaaaaaugguggagguuuugg

SEQ ID NO: 149482 - RNA, 67 nt, Homo sapiens
aaacuaacuuaaaaaaaaaaaaaaagguacuagccuaaggcugcaggcucagaaaaccgauaccuac

SEQ ID NO: 149483 - RNA, 55 nt, Homo sapiens
aaaauaaaugauguucuagauuguguagauuuauuguacaagcaggcuaggggaa

SEQ ID NO: 149484 - RNA, 55 nt, Homo sapiens
aagaugcuauagguucucuaaguauugcacagucugaaaaaauaacaaaaaaagg

SEQ ID NO: 149485 - RNA, 46 nt, Homo sapiens
acuagaagcugaaauccacugaaguccugguugagguccgguggag

SEQ ID NO: 149486 - RNA, 45 nt, Homo sapiens
agagagaaagggacaucuuucaaugcagucacagugguauggcag

SEQ ID NO: 149487 - RNA, 89 nt, Homo sapiens
aucacggacuccacagagcucguuucagaaaucuuggccccacggcgggaaauugugaacugauuuggaucuuugccauccuuucucag

SEQ ID NO: 149488 - RNA, 281 nt, Homo sapiens
gguaaaacacauguuaaaauuuucugcuaacaccaugcauggucauuucuuauucauugcuauccacauuuauucaaaguuagacaccuacuuuaaaugggcaguacuagucaccuuuuauuaaauacgaccacugauguuuucaguuucaucacacaaaaauauuuuucuacuacugguacuuuaguaaggucaaaagaugccuaauacuaaaugaauuaaaaaugucuccuaaauuucagcuaccaguuugagcucaaccuagaauagaauacuacaua

SEQ ID NO: 149489 - RNA, 44 nt, Homo sapiens
cuuauucccgggaggcccaccacaacagacagcgcgugucucua

SEQ ID NO: 149490 - RNA, 30 nt, Homo sapiens
gcguuucagggccucccacagaaacgcagc

SEQ ID NO: 149491 - RNA, 43 nt, Homo sapiens
uaaacgaacgucuguucccccgggcuaaagcugcgaguuccgg

SEQ ID NO: 149492 - RNA, 41 nt, Homo sapiens
cagaaguggcaccgacuucaccuccggugcaccucagguau

SEQ ID NO: 149493 - RNA, 72 nt, Homo sapiens
aguuucacuguaauccucaggcccuuccagucacccguugccuuggcaaugucaucaccaaccuuuuuugga

SEQ ID NO: 149494 - RNA, 42 nt, Homo sapiens
guggaagcuaucaggaccaauuacaaugacagauacgaugag

SEQ ID NO: 149495 - RNA, 53 nt, Homo sapiens
aaaacccuuuaauacuauaguaaagcacuguuaagaagcaaauaauagaguca

SEQ ID NO: 149496 - RNA, 48 nt, Homo sapiens
gggacuuagaagggaguacugcuugagcgauugugggaaagucugagg

SEQ ID NO: 149497 - RNA, 41 nt, Homo sapiens
uugauuuaaaagacaauauucauacuagaguguagauguga

SEQ ID NO: 149498 - RNA, 46 nt, Homo sapiens
gugcaggacccaggacuaaaggcaguauugguaccugagauauuac

SEQ ID NO: 149499 - RNA, 48 nt, Homo sapiens
uucuaaaaucuguggcucauaacuugauuuuaguuuuaagguuauaca

SEQ ID NO: 149500 - RNA, 36 nt, Homo sapiens
acacaugggcauugcuuuugggacuuuggguuaacu

SEQ ID NO: 149501 - RNA, 24 nt, Homo sapiens
auuuuguuuguuuugacaaagcug

SEQ ID NO: 149502 - RNA, 43 nt, Homo sapiens
uucuauucuugccucgcaguaucuacuuaaauaacauagaaag

SEQ ID NO: 149503 - RNA, 34 nt, Homo sapiens
uccacaugugcccuuuggacugggacucauguuu

SEQ ID NO: 149504 - RNA, 53 nt, Homo sapiens
uguguuucuggugaacacagauuucuccuagcuaaaucaaacuuuagcuucag

SEQ ID NO: 149505 - RNA, 41 nt, Homo sapiens
acgucuuggaaacagagacaauuuuuacuccaaguucugug

SEQ ID NO: 149506 - RNA, 67 nt, Homo sapiens
cucaucugcaauucuuaaaaauucucaucuuuuagugucaacuguuggcuguaaaugaauaauauag

SEQ ID NO: 149507 - RNA, 45 nt, Homo sapiens
ucucacauggaguggacguggggcggauucccagaguccaccaag

SEQ ID NO: 149508 - RNA, 90 nt, Homo sapiens
gaacgaucugaccaucauccuaggacagcuacaauuacaccaucagaaaauacucauuuucggguaauucccagugaggacaaccucauc

SEQ ID NO: 149509 - RNA, 57 nt, Homo sapiens
ccauggaagacacugucuguaccauagugaagcccaaacccagagcccuggguacac

SEQ ID NO: 149510 - RNA, 49 nt, Homo sapiens
cccaacgcagccuuagcggaggcgcccucagaauccaaaccggcagcua

SEQ ID NO: 149511 - RNA, 46 nt, Homo sapiens
gaauuugcagaaaacccuggacuuauagacaauccuaaccuuguaa

SEQ ID NO: 149512 - RNA, 45 nt, Homo sapiens
cgagggaucacaggagcucgaagaauccaucacaguggaccccau

SEQ ID NO: 149513 - RNA, 53 nt, Homo sapiens
cccagaauuuauacgaaggacgcuuuuccaucguuucuguggcugccauucca

SEQ ID NO: 149514 - RNA, 42 nt, Homo sapiens
uuuccugcugugagcuggggccuccuuccauugcaucauuuu

SEQ ID NO: 149515 - RNA, 47 nt, Homo sapiens
ucccucugucccugugucugcuagcacuagacuuuguugcugcagau

SEQ ID NO: 149516 - RNA, 54 nt, Homo sapiens
uaggcuaauuaaugugagucuuuuuccuuguuuaaaggagucccucuugcugaa

SEQ ID NO: 149517 - RNA, 41 nt, Homo sapiens
agaggaggacacagaauccauuugaagagacucaaagugaa

SEQ ID NO: 149518 - RNA, 46 nt, Homo sapiens
aacagcuggaguuauauaagguuuggugacaucaaacaguucaggu

SEQ ID NO: 149519 - RNA, 46 nt, Homo sapiens
auuagaaagauacaucucuagccugauuauuagcacauaugccagg

SEQ ID NO: 149520 - RNA, 49 nt, Homo sapiens
uuuuuuacauaaauaguaauauaagaugcauauuuucuucugacaaucu

SEQ ID NO: 149521 - RNA, 78 nt, Homo sapiens
augaaauacuuugauugcuguccaaaagugugucauuucaccacaauaagaaaacuuaugcuuuauuuaaacggaauc

SEQ ID NO: 149522 - RNA, 66 nt, Homo sapiens
uugauaauacaggcauacaggaaucuuucuuugguuauauucauauauacauacauagccaaauca

SEQ ID NO: 149523 - RNA, 46 nt, Homo sapiens
aagcgaaguaggccuggcugugcggggagaaggcgcaagggacccc

SEQ ID NO: 149524 - RNA, 66 nt, Homo sapiens
uugaaacagcucacaucacacaccucaggauaccugauguuuccaaaucacuuugcagugauucgg

SEQ ID NO: 149525 - RNA, 30 nt, Homo sapiens
auagccaauagcagacaaggucuguuagag

SEQ ID NO: 149526 - RNA, 48 nt, Homo sapiens
aaugcuaccaacugcugugccaagagccaauaagucagucugguuacu

SEQ ID NO: 149527 - RNA, 51 nt, Homo sapiens
caguuauuuaaacguagaugagacugaaaacugucccuacugcacagaucc

SEQ ID NO: 149528 - RNA, 25 nt, Homo sapiens
agacaggauguaaggaacaaaagaa

SEQ ID NO: 149529 - RNA, 46 nt, Homo sapiens
ugauacauagggaacugacacugcuauugucgccuuuccauuugcu

SEQ ID NO: 149530 - RNA, 32 nt, Homo sapiens
uucuuagugguuuccacacccaguguccaggu

SEQ ID NO: 149531 - RNA, 49 nt, Homo sapiens
uucaaugcuaaccuacagaacagaaaggauuguuaauguguuaccagac

SEQ ID NO: 149532 - RNA, 46 nt, Homo sapiens
aaaguuucugaaaaguuuugacucugcuuuccauuaacugguagag

SEQ ID NO: 149533 - RNA, 40 nt, Homo sapiens
ucuuuaccuucuucauacaccaacuuugccuucuguccag

SEQ ID NO: 149534 - RNA, 48 nt, Homo sapiens
cuucaucccaauuauccuagucgaaauaccaacaaggaaagcauucau

SEQ ID NO: 149535 - RNA, 34 nt, Homo sapiens
caccacugggcaaggugagccagaguuuauauag

SEQ ID NO: 149536 - RNA, 44 nt, Homo sapiens
gugcucaggacagcaaaguggcaugggauccacugcugugaauu

SEQ ID NO: 149537 - RNA, 34 nt, Homo sapiens
uuaaagguaaacagauacccuaacacugccaaga

SEQ ID NO: 149538 - RNA, 79 nt, Homo sapiens
gcuuucccaagaugcuuauauggcucuggcucuuaagaugagcacacaaaucucuguucugucauugguauuaaaaacu

SEQ ID NO: 149539 - RNA, 44 nt, Homo sapiens
ucuucuggcuguauccuucauuccuacaugcaugaccagaaugg

SEQ ID NO: 149540 - RNA, 46 nt, Homo sapiens
ggccgcgauguucagcuggcuggguacggacgaccgccggaggaag

SEQ ID NO: 149541 - RNA, 54 nt, Homo sapiens
ucacaaagauggcgagugccaguuucaccugcugagcucuguaaguagggggug

SEQ ID NO: 149542 - RNA, 53 nt, Homo sapiens
guggagccccacaccaccacugcagagaucaagaaccucuucaccaagacccc

SEQ ID NO: 149543 - RNA, 34 nt, Homo sapiens
auuaucaauuuagguagccuguaagaguauugaa

SEQ ID NO: 149544 - RNA, 45 nt, Homo sapiens
auuaccugguaucauuuaaaaagauauuuucucuaagauaaaaga

SEQ ID NO: 149545 - RNA, 75 nt, Homo sapiens
uuugaaauuauugguguaugaggaguggaugggaagaaaggauguuaaugccauuguuuagagagucaaucucca

SEQ ID NO: 149546 - RNA, 46 nt, Homo sapiens
aaaguuccugggauauugaugggagagcuacuaagagaaggaaaaa

SEQ ID NO: 149547 - RNA, 45 nt, Homo sapiens
uuguuuuuuuugccaccuggucagcacuugucagacuauucccag

SEQ ID NO: 149548 - RNA, 44 nt, Homo sapiens
acagcuuuaaucgggcaauccauaagaaagcaaaagggacugaa

SEQ ID NO: 149549 - RNA, 42 nt, Homo sapiens
cucuuuuucguggugccuuggaggcauucaccugcuucaaga

SEQ ID NO: 149550 - RNA, 41 nt, Homo sapiens
aagcauauggccacagaaguugcugcugaugcucugguuga

SEQ ID NO: 149551 - RNA, 52 nt, Homo sapiens
cauggccguguccgccugcuaaugaguaaggggcauuccuguuacagaccaa

SEQ ID NO: 149552 - RNA, 45 nt, Homo sapiens
agaagguaagaaaccuaggaccaaagcacccaaaauucagcgucu

SEQ ID NO: 149553 - RNA, 48 nt, Homo sapiens
agcacaaauggugccauauugcucuggagaagcagcauacuaagaaaa

SEQ ID NO: 149554 - RNA, 34 nt, Homo sapiens
guucccgguacgcacggugcagcuguucggccgu

SEQ ID NO: 149555 - RNA, 30 nt, Homo sapiens
ucagaguggcuggugcugcgggacggcugc

SEQ ID NO: 149556 - RNA, 50 nt, Homo sapiens
cggacuccugcauagagauguaauguauacaacugucugcguuuagccaa

SEQ ID NO: 149557 - RNA, 57 nt, Homo sapiens
auuuaugugccuguacauggaaggaaagacaauauucacuuuagugguagauuacua

SEQ ID NO: 149558 - RNA, 46 nt, Homo sapiens
uuaagaacacugaaacacuaacccgcuaccacgagaagagacggag

SEQ ID NO: 149559 - RNA, 21 nt, Homo sapiens
guucuuuauuugauaaugguu

SEQ ID NO: 149560 - RNA, 29 nt, Homo sapiens
cagugcaagcugugguaaauguuauauuu

SEQ ID NO: 149561 - RNA, 37 nt, Homo sapiens
uuuaagggaagaauuuagaagaguauuuuccuguuuu

SEQ ID NO: 149562 - RNA, 46 nt, Homo sapiens
ggggaaccuaggcaccuucugaauuguaaaggggaaaggaaaaauu

SEQ ID NO: 149563 - RNA, 122 nt, Homo sapiens
ggaaagaucugcauaugggauguuuccaaacuuaugaagguauguuugaauuuugaaguaacaaauuaguaauugaaaaaagaucaguuguaaacuuaggcuuuucauuuguuuaggugcac

SEQ ID NO: 149564 - RNA, 42 nt, Homo sapiens
aggacuccucuaguugcucagauauaccaaaauuggaaggag

SEQ ID NO: 149565 - RNA, 27 nt, Homo sapiens
ugauuuacuggaggauucagacaguga

SEQ ID NO: 149566 - RNA, 20 nt, Homo sapiens
aauugucuuuauguauuaaa

SEQ ID NO: 149567 - RNA, 35 nt, Homo sapiens
gaacuuggggcaaauccuuguuuaacaaacucuaa

SEQ ID NO: 149568 - RNA, 64 nt, Homo sapiens
agugcuuuauaaaaugaauuaugccacucggauagugacuuuagaagaggagccaauaaaaaua

SEQ ID NO: 149569 - RNA, 58 nt, Homo sapiens
caacauaucaaagauccccaggacacaauuaccucgcucauuuugcuuccacccgaua

SEQ ID NO: 149570 - RNA, 46 nt, Homo sapiens
cagcagcaaaggaggcauccucaacauuugcaucagcaacaccaug

SEQ ID NO: 149571 - RNA, 42 nt, Homo sapiens
uuccacagauacaagugacacugcugaaaaauaaagcuccag

SEQ ID NO: 149572 - RNA, 46 nt, Homo sapiens
cgucccugguugauuugaaugaagaaaugcagcacauggauguaga

SEQ ID NO: 149573 - RNA, 46 nt, Homo sapiens
ugaucuaucagggcaugcuggaauguugacguuaacaagccccaaa

SEQ ID NO: 149574 - RNA, 53 nt, Homo sapiens
cugagguaggaaauauuacucuuauuuuacauuagaagaaacugagccacaga

SEQ ID NO: 149575 - RNA, 48 nt, Homo sapiens
aauuucaugagaagcuuguuaauacucuuugcagaaaaacagaugaug

SEQ ID NO: 149576 - RNA, 43 nt, Homo sapiens
ucugucuauugguauuuugucuuacugaauuaugugaaagaug

SEQ ID NO: 149577 - RNA, 48 nt, Homo sapiens
aaaauguuuaguuuauaccuuacuuuuuccauacgauaauagccugag

SEQ ID NO: 149578 - RNA, 48 nt, Homo sapiens
uaugugagucacuuauugucccauaacuaguauucuucuaccugcuac

SEQ ID NO: 149579 - RNA, 45 nt, Homo sapiens
cuuggccucuuugucaauugacauuuggacauuaggagaagaggu

SEQ ID NO: 149580 - RNA, 46 nt, Homo sapiens
uuggcucauaaugcagugcagaggcucaaaguggcgcuaggugcaa

SEQ ID NO: 149581 - RNA, 46 nt, Homo sapiens
ccugugaagagcucuuuaaacacuugugcaucaguggaaccccaaa

SEQ ID NO: 149582 - RNA, 47 nt, Homo sapiens
ggaauuguacaauucggaacagcuucucaucuuuccacaggauaggu

SEQ ID NO: 149583 - RNA, 46 nt, Homo sapiens
ucauguuacuuuccugcauuggucaaagaucacuuaguaauagugg

SEQ ID NO: 149584 - RNA, 67 nt, Homo sapiens
aagcuuacuuaaucucuuggauaauuuauugucaccucuucagccacaguuacccaugcauaggagg

SEQ ID NO: 149585 - RNA, 46 nt, Homo sapiens
uuugagugacuucgcaguuguuccagaacuggcuauuggccuggag

SEQ ID NO: 149586 - RNA, 123 nt, Homo sapiens
ugucuggacaugacuuuuaguuucuaaaugcagcuaugacuuuugcaaggugucuucccucaggcuuguuuaaagacuuuauaauagcaugcauguaaguuaguuaugaaagggaaaucagag

SEQ ID NO: 149587 - RNA, 52 nt, Homo sapiens
uuuuaaauacagaaauucucagauuuugaguuguaagcuuucuuuauagguu

SEQ ID NO: 149588 - RNA, 59 nt, Homo sapiens
uuuuuccucagagauucuuguucugaaaauaaggguuuuuaaauaaaggauuugagaua

SEQ ID NO: 149589 - RNA, 151 nt, Homo sapiens
aauccauaaaauuuggaauucuguacauugucaggaacucaguauuuuuaagaguucccuugagauguuauaguggaaucaguuguuuauagugcauauuauguuuaggaagaugauggggaauucauauguauaaggaauuugcuuuaua

SEQ ID NO: 149590 - RNA, 61 nt, Homo sapiens
uaaucuuggaauauaacaguauugggauuguguuuauacauguggcuacuauggaaacauu

SEQ ID NO: 149591 - RNA, 38 nt, Homo sapiens
agguaggaaagagagaaaaauguuuuuaggauuaggaa

SEQ ID NO: 149592 - RNA, 50 nt, Homo sapiens
ccuguagguaaucaguggaguuuuauuaacaauaaucuacacacucagag

SEQ ID NO: 149593 - RNA, 46 nt, Homo sapiens
gcaacuuaaccuacuaaaagcaaagcagaaggcauugguagaacag

SEQ ID NO: 149594 - RNA, 45 nt, Homo sapiens
aaaagaaaguccugagauagaaccacuuccauuuacucuggccca

SEQ ID NO: 149595 - RNA, 42 nt, Homo sapiens
uccuuuagauauugauuuggaaaaggacccucuugcagccaa

SEQ ID NO: 149596 - RNA, 42 nt, Homo sapiens
ugauuaugggaccuacaauuacaacccuuacauuggaggucu

SEQ ID NO: 149597 - RNA, 93 nt, Homo sapiens
gaguaauaauugucaauguuuucuuuuucuuucaauugcuuuuuguagcccuggaugcucgccuagaaguuggacuugaacagcaagcagaac

SEQ ID NO: 149598 - RNA, 54 nt, Homo sapiens
ccacuggaacagaugauucacuucuaggggguuuacaagcagcaaaccaaacca

SEQ ID NO: 149599 - RNA, 42 nt, Homo sapiens
uuagcuugguaucccaauacuuugcuccggacauggugccuu

SEQ ID NO: 149600 - RNA, 50 nt, Homo sapiens
uuauacucuaaaaagcauuauaaaaguauuuauuguguaauucaggugaa

SEQ ID NO: 149601 - RNA, 46 nt, Homo sapiens
accucucgaugcccaagugaagcucuuagaauucacucuggagcag

SEQ ID NO: 149602 - RNA, 43 nt, Homo sapiens
cuuguuaacauuuuagugcagcugccucuuucaggcaauaggg

SEQ ID NO: 149603 - RNA, 46 nt, Homo sapiens
aaacaugaaaacuuucaugguggguuggaugccauaucaguugggg

SEQ ID NO: 149604 - RNA, 46 nt, Homo sapiens
agaaguaugguaucaacuauuaugaaauuucuugacucugguccaa

SEQ ID NO: 149605 - RNA, 46 nt, Homo sapiens
acauugaaaacaagaauacuagcuucugagccugacaaugcugaag

SEQ ID NO: 149606 - RNA, 47 nt, Homo sapiens
ccuacugcccaaccagcugaagugcuauugcaggccacaccuccuca

SEQ ID NO: 149607 - RNA, 63 nt, Homo sapiens
uggucauaagugguggcuuuugaaguucagcuggauuuuucauaugggaauugaaacaggaag

SEQ ID NO: 149608 - RNA, 63 nt, Homo sapiens
aauaguaaaccauagcauauuaaucaaagguaguuuuguauuauuugugauaauuuugaguaa

SEQ ID NO: 149609 - RNA, 44 nt, Homo sapiens
uuuuaggugaauauuagacuguuuaaguauaauuuuuauuguag

SEQ ID NO: 149610 - RNA, 46 nt, Homo sapiens
cuagcucagaaagcauugcccagucaauagauauuucccaggacaa

SEQ ID NO: 149611 - RNA, 42 nt, Homo sapiens
cagccgaccuaguugcuccuauucuuagguuuuugacagaag

SEQ ID NO: 149612 - RNA, 45 nt, Homo sapiens
ggaagaugagaaagugacaauguuucuucagucuccauguccagu

SEQ ID NO: 149613 - RNA, 74 nt, Homo sapiens
uacuagccacgucauccagcauccaauguauggagcaggccacaaauuccguacucuucauuugccagucucaa

SEQ ID NO: 149614 - RNA, 45 nt, Homo sapiens
gucaggcaagucagauuuaaguauuaguuuuuguuuaacuuuaug

SEQ ID NO: 149615 - RNA, 59 nt, Homo sapiens
aaguaucacagcuaaauuaauuagugaacaaaaagaugacaaagaaaagaaaaaccaug

SEQ ID NO: 149616 - RNA, 52 nt, Homo sapiens
gucagcuacaccaccucgcccaccauccaggagggggaggacaauaccugau

SEQ ID NO: 149617 - RNA, 45 nt, Homo sapiens
accccagucuaucaaaaacagauucuuauaaaagacuacacccug

SEQ ID NO: 149618 - RNA, 85 nt, Homo sapiens
guuaagucuuuacuuugaaucugauguugaaaaugugaauggccaagccaacacuuuucuuuuucuuuaggugagugcuccaguu

SEQ ID NO: 149619 - RNA, 39 nt, Homo sapiens
aaaaacuagauuuaauuagggaguacagaauaaaguuuu

SEQ ID NO: 149620 - RNA, 37 nt, Homo sapiens
auguguuguuccuugcgucugucuucuuucauuuagu

SEQ ID NO: 149621 - RNA, 42 nt, Homo sapiens
aagaggaacauguuaccugccuucugcagguauauuuguaaa

SEQ ID NO: 149622 - RNA, 75 nt, Homo sapiens
uccuucuguacuucucgagcuucucagucaguccugccucaucccagccaugucaucuuaucuacgaaaugauuc

SEQ ID NO: 149623 - RNA, 44 nt, Homo sapiens
cuacaaauucuuauugaaauaaaucuuuaccuuuuuaauagugg

SEQ ID NO: 149624 - RNA, 38 nt, Homo sapiens
uggugccccuauuguugccccuuucuacagagaacggu

SEQ ID NO: 149625 - RNA, 46 nt, Homo sapiens
uuagccaaaaugaagaccuguguugauaccuauaccaaccguuuaa

SEQ ID NO: 149626 - RNA, 55 nt, Homo sapiens
ccuguuacuuaauaauuugucaagaccugguaauagagaaucauuuacaacuggg

SEQ ID NO: 149627 - RNA, 45 nt, Homo sapiens
cuaaaagggaaaauguuaaaacaggaguaaaaccagaugcgucug

SEQ ID NO: 149628 - RNA, 46 nt, Homo sapiens
agaugggaaauugggauuuaaaguaaauuaccacuacaugucucag

SEQ ID NO: 149629 - RNA, 54 nt, Homo sapiens
uuuucguucgucagguuuguuuaagcaucuuaaacacguggcauggaagaccag

SEQ ID NO: 149630 - RNA, 28 nt, Homo sapiens
gugcagagccacaacaggugcugaggag

SEQ ID NO: 149631 - RNA, 45 nt, Homo sapiens
ccuccuacauacacuucaauaaaaguuaaauggacauacucccuc

SEQ ID NO: 149632 - RNA, 47 nt, Homo sapiens
acauuuuuaaaauaauaaaucugccauaaaaugcauuauaucuggag

SEQ ID NO: 149633 - RNA, 35 nt, Homo sapiens
auaugacauugccauuuucuuucucaguucacgga

SEQ ID NO: 149634 - RNA, 28 nt, Homo sapiens
aaagagcacaaagaaacagcaaaaaaga

SEQ ID NO: 149635 - RNA, 25 nt, Homo sapiens
guuggcuuuacgagaugaacuggag

SEQ ID NO: 149636 - RNA, 46 nt, Homo sapiens
ucauuggauggucuugucuauaauauuaauuuccaacauccccguc

SEQ ID NO: 149637 - RNA, 42 nt, Homo sapiens
ugugguacuuggucaucuccucaguacuggguuugugagggu

SEQ ID NO: 149638 - RNA, 46 nt, Homo sapiens
gaagccagaugccucaggcuucuuggcaugguucaggcccccagcc

SEQ ID NO: 149639 - RNA, 44 nt, Homo sapiens
uguccagcacuaggcaacauuacaaauuggaaccacuuccuccc

SEQ ID NO: 149640 - RNA, 71 nt, Homo sapiens
uauaaauacacagagaaauagaaagcauaaaaucugagguguugguggagaaaggcaggggacuuggcaag

SEQ ID NO: 149641 - RNA, 49 nt, Homo sapiens
cagaacucagcaucugucaugaaaaaaaucaauugaaaaacaagcagau

SEQ ID NO: 149642 - RNA, 28 nt, Homo sapiens
auaauguuucucuuuuguuaacuuauuu

SEQ ID NO: 149643 - RNA, 77 nt, Homo sapiens
gacugaaagccauuuccuucccgugaagaauuuuuaucagugcaaguaacaaauauuucccaggcagcaguuguggg

SEQ ID NO: 149644 - RNA, 98 nt, Homo sapiens
agcucucccgaagccgcgggucuccggccggcggcggcggcggcggcggcggcggcgcaggugagcagggcagggggcagccgagggagcgcggggag

SEQ ID NO: 149645 - RNA, 65 nt, Homo sapiens
uaauuaaacaauauugaaaucuaaauaauacaauacaaaauaauaauacaauuuaauaauaauga

SEQ ID NO: 149646 - RNA, 44 nt, Homo sapiens
auuuuccuuaauaauaauuaaguguaaauaauuaaaugauaauu

SEQ ID NO: 149647 - RNA, 46 nt, Homo sapiens
agugagccaaguagguaacuggggaagagcauuucuggcagaggga

SEQ ID NO: 149648 - RNA, 49 nt, Homo sapiens
acaugcuuagguuguuuauuuaacagaaauaaaauaacgcuuagcaacu

SEQ ID NO: 149649 - RNA, 62 nt, Homo sapiens
uacuugaucagaugaccacauaaaugugaaaacccaaauguguuuuaggguaaaggaagaag

SEQ ID NO: 149650 - RNA, 41 nt, Homo sapiens
aucuucugugcaucuuauugccuaaauucauuugcaagaau

SEQ ID NO: 149651 - RNA, 53 nt, Homo sapiens
augauugugggaaaagguaauuuuuuaaaaaauuacaaaaaugauugggaaau

SEQ ID NO: 149652 - RNA, 49 nt, Homo sapiens
cuaacugggucuuggaugugagauaggauguucuacucccugcccaggg

SEQ ID NO: 149653 - RNA, 60 nt, Homo sapiens
uauuuuaaguagggggaaaguaagcugagaaaccucaggaaaugaacagaaaagucucau

SEQ ID NO: 149654 - RNA, 40 nt, Homo sapiens
ggucuuuguucauuccuugaacauuaaaaauaaccccaag

SEQ ID NO: 149655 - RNA, 44 nt, Homo sapiens
ucauguacagcauuguagugaauggagcaaaacaacugucccuu

SEQ ID NO: 149656 - RNA, 48 nt, Homo sapiens
gcuuuauccaauuuugucuuugguucaucaugccccucaggcauggag

SEQ ID NO: 149657 - RNA, 48 nt, Homo sapiens
cauucaaacugugggaaugaauuugaguuauuagagaaaugauaauag

SEQ ID NO: 149658 - RNA, 48 nt, Homo sapiens
aaacuacuauuaucauuucucuaauaacucaaauucauucccacaguu

SEQ ID NO: 149659 - RNA, 46 nt, Homo sapiens
gcccguacuuuggaaccacuagcaaagaagaucuuuaaaggaguuu

SEQ ID NO: 149660 - RNA, 46 nt, Homo sapiens
uacaaguucggcuaccaaaacuccuuuaaagaucuucuuugcuagu

SEQ ID NO: 149661 - RNA, 66 nt, Homo sapiens
auaguuuugcuaauccauuuuauguguuaaauggcaauggcauguuuggagaaauugguucuucag

SEQ ID NO: 149662 - RNA, 137 nt, Homo sapiens
cauggagguaugaaauuuuuuccuuagcccacaaacaacauuuuuaagggagaagugagagugaucuaguccacaauaaugaauacuuugauuccuguucugccccuaaaaaugucuaauaucuugaaucugaagaa

SEQ ID NO: 149663 - RNA, 45 nt, Homo sapiens
uugcuguucaaccauguuuuuugaucuagcucucugauuccauac

SEQ ID NO: 149664 - RNA, 80 nt, Homo sapiens
agcuuagaugggaggcugaacgugaugacuggcuacacaacagagaugcaaaaaguaucaucaagaaaaagaaacauuuu

SEQ ID NO: 149665 - RNA, 63 nt, Homo sapiens
guuugagaccuuugagagaagaagaaaagaugaguguacuaccacacuguagacucuuggugg

SEQ ID NO: 149666 - RNA, 46 nt, Homo sapiens
gauccaaguuugauaacauuggcaugaaugccauggcuaacaaaga

SEQ ID NO: 149667 - RNA, 42 nt, Homo sapiens
uagggccaagaaaaaagaaaagaaacuuaaaugauuccagcc

SEQ ID NO: 149668 - RNA, 42 nt, Homo sapiens
uugaaguccacuccaaagucaguacuaagaaaagcaagagaa

SEQ ID NO: 149669 - RNA, 89 nt, Homo sapiens
aaguuucuuuaggaaguauggaugaugaagaauuugcugaaguugaugaagauggaggaacauucauggauguguuagaugaugaaagu

SEQ ID NO: 149670 - RNA, 69 nt, Homo sapiens
cuaaggauaacacauuagaugaagauucagaagguagugaugaugaacuugguaaccuggaugacgaug

SEQ ID NO: 149671 - RNA, 43 nt, Homo sapiens
agcauuucccaaauuguugucccucagaacaguagaccacaga

SEQ ID NO: 149672 - RNA, 44 nt, Homo sapiens
aacuguuucagcucuggaaaggaugauauggauuuugcugggua

SEQ ID NO: 149673 - RNA, 50 nt, Homo sapiens
aaaaguugcuguuaaagagaaacaaaaacgggaugcagaugaagaaagua

SEQ ID NO: 149674 - RNA, 46 nt, Homo sapiens
uuguagugaacaguaaggaguuccuugcaaaagaagaaagccaaau

SEQ ID NO: 149675 - RNA, 46 nt, Homo sapiens
cagugugucaaucugcucccuuacuuugucaucaccagucugggaa

SEQ ID NO: 149676 - RNA, 46 nt, Homo sapiens
gcgcccuuuuaacaggugugaauagggcauacccuuauucccagac

SEQ ID NO: 149677 - RNA, 45 nt, Homo sapiens
gauuuaaaaagcaaauugcauaauauugagcuuuggagcugauau

SEQ ID NO: 149678 - RNA, 149 nt, Homo sapiens
ucgagcccuuaccguggcucaugagcugcuuuguaacaagccugaggaagaaaaggcucuucuugugcaagugguaaauaaacugggagauccucagaacagaauugccacaaaagcaucccaucuguuagagacauuacuuuguaaac

SEQ ID NO: 149679 - RNA, 54 nt, Homo sapiens
ugggaugcuuuuguggcaauucuguucugaggaucucccaguuuauuuaccacu

SEQ ID NO: 149680 - RNA, 95 nt, Homo sapiens
acugauauuaugguauuuugaacaccagcugaaacacuuaguggcugaauuugugcaggucuuagaaacuuuaagucaugauacauuaguaacca

SEQ ID NO: 149681 - RNA, 45 nt, Homo sapiens
caaacagcagugccuuauggccuuggauacuuucaaagaguugcu

SEQ ID NO: 149682 - RNA, 46 nt, Homo sapiens
cauccugucaccuaguguccccgaugacacaauugccuucauccag

SEQ ID NO: 149683 - RNA, 116 nt, Homo sapiens
acaaaagcuuccuuaguugaagaagaugaaccagcugaaaaagaaaauuccagcaaaaaagaaguaaaaauaccuaaaauaaauaauaaaaauacagcagaaagucaaaggacauc

SEQ ID NO: 149684 - RNA, 47 nt, Homo sapiens
uaugcuggcuacuuuggaugagaaugaggaagugauagauggaggca

SEQ ID NO: 149685 - RNA, 32 nt, Homo sapiens
ggccuuggcgccccgaggaggcaguagaagau

SEQ ID NO: 149686 - RNA, 26 nt, Homo sapiens
cuuggcauggaacuccaaaggcuccu

SEQ ID NO: 149687 - RNA, 42 nt, Homo sapiens
ggaaacauuccccucuugguaauuuguccuucuauagaagcu

SEQ ID NO: 149688 - RNA, 50 nt, Homo sapiens
auuugagaccaguaguauggcucuaaucuuacccuuagcccucccaacca

SEQ ID NO: 149689 - RNA, 53 nt, Homo sapiens
uaaaaauauccuugaaagaauaguagcaaacaguaugcaguacuccuguguuc

SEQ ID NO: 149690 - RNA, 26 nt, Homo sapiens
gugaagaucagauauguaugaaugca

SEQ ID NO: 149691 - RNA, 42 nt, Homo sapiens
uucuccggagcaaagguuacaaccguucccuagauauguggu

SEQ ID NO: 149692 - RNA, 42 nt, Homo sapiens
ugugacuuuggauuugcacgcaucauuggugaaaagucauuc

SEQ ID NO: 149693 - RNA, 44 nt, Homo sapiens
uucaggagaaugugguaaguaaucguuauagcuaauguguaaac

SEQ ID NO: 149694 - RNA, 49 nt, Homo sapiens
aagaacauaacgcaauaggaaaauggacaaagaauaugaacagagaguu

SEQ ID NO: 149695 - RNA, 41 nt, Homo sapiens
auguaucaaagauuugaguguaaagaaauuaaacagaagaa

SEQ ID NO: 149696 - RNA, 45 nt, Homo sapiens
auauuccgcuaaugaggguuguacaauccaucaagcacacaaaga

SEQ ID NO: 149697 - RNA, 46 nt, Homo sapiens
cuccaaauauuccaguuugggaggguacuuucuauuccgcucauug

SEQ ID NO: 149698 - RNA, 44 nt, Homo sapiens
cagaaccuuccagucugggaacagauacagauauaccaauggau

SEQ ID NO: 149699 - RNA, 50 nt, Homo sapiens
cacuaccuaauacccuugccuugggaguuaagauuuuuaaggggaacaaa

SEQ ID NO: 149700 - RNA, 45 nt, Homo sapiens
gagacugggaaguccagggcacuggcagauucugugucuggugag

SEQ ID NO: 149701 - RNA, 53 nt, Homo sapiens
acuuuguagucuaauauagccagugguacuccauauccucuuucauuuuuaga

SEQ ID NO: 149702 - RNA, 25 nt, Homo sapiens
aauaauauucuguuugugagugauu

SEQ ID NO: 149703 - RNA, 40 nt, Homo sapiens
gaaauuauucucauaauuguuauauaaaggaaagagaaau

SEQ ID NO: 149704 - RNA, 27 nt, Homo sapiens
aaguuccacacacauuugcuguucacu

SEQ ID NO: 149705 - RNA, 49 nt, Homo sapiens
uuaugaaaauuacuuauguuauagucacauguccaccaggaaccaagua

SEQ ID NO: 149706 - RNA, 49 nt, Homo sapiens
guugagacacagagcagcuaagugacuugugugaagucagagagcaaau

SEQ ID NO: 149707 - RNA, 45 nt, Homo sapiens
accauaaacgaugugccuucaagauuccaaauaacuguaguggag

SEQ ID NO: 149708 - RNA, 29 nt, Homo sapiens
aaacuagguuaguguuugcaccuaaaaca

SEQ ID NO: 149709 - RNA, 38 nt, Homo sapiens
uuuuaaaauauaguuuagguaucguguuaaguuggggg

SEQ ID NO: 149710 - RNA, 36 nt, Homo sapiens
uugguaagaaaaacugaucucaacacuuggucaaau

SEQ ID NO: 149711 - RNA, 91 nt, Homo sapiens
cucuucauaaccauugaaaaagaaucgacaacuauuuuaaaagauuaaagaaaggcagaugucugcaaauaauuccccuccaucagcccag

SEQ ID NO: 149712 - RNA, 104 nt, Homo sapiens
auauuaagagaaauaggaccuuuggggcauucaacuccuugauaaaacuuaaaaguaucggcaugaguggcuuaacagaggaaauaaagaaguuuucaacuaaa

SEQ ID NO: 149713 - RNA, 41 nt, Homo sapiens
ccugaaauuaaagagacaaguacagacugaaaggaaaauag

SEQ ID NO: 149714 - RNA, 66 nt, Homo sapiens
ccaaaggaaaaguacugaauagauuaauccaaaacacuuacuguuuuuuaaacgaagaggauuuca

SEQ ID NO: 149715 - RNA, 55 nt, Homo sapiens
uuuguauuucgucauagaaaaguucauccccccagaaugaaaaugaggacauuug

SEQ ID NO: 149716 - RNA, 57 nt, Homo sapiens
aguaaggugcuuggaguuuaccuggcuuauuuaauaugcuuauaaccuaguuaaaga

SEQ ID NO: 149717 - RNA, 42 nt, Homo sapiens
uuuuuggaaucuuuguaccaaaauuuuaaaaaagggaguuuu

SEQ ID NO: 149718 - RNA, 53 nt, Homo sapiens
agcgguucuucaugaguagugggcuaugcaggagcuucugggagauuuuuuug

SEQ ID NO: 149719 - RNA, 42 nt, Homo sapiens
gaaaaugaauuucaguuauggucuaaccauuaaacccaaguc

SEQ ID NO: 149720 - RNA, 54 nt, Homo sapiens
caccacugccaacaccucugucuugggcuaccacauucccaaggacacuguggu

SEQ ID NO: 149721 - RNA, 38 nt, Homo sapiens
uuaguauuaaaaucauagaaacacccauggugggugag

SEQ ID NO: 149722 - RNA, 23 nt, Homo sapiens
cagggccccggguuugggguuuc

SEQ ID NO: 149723 - RNA, 42 nt, Homo sapiens
cugaggcaacggaggcggcagcuccgguccgcgcccccgggc

SEQ ID NO: 149724 - RNA, 49 nt, Homo sapiens
aaaagagagcagcaacuaaaaucuuggaaaagcccucaggacaccacag

SEQ ID NO: 149725 - RNA, 46 nt, Homo sapiens
uucugagugaagcugaucuugaucuacgaagagagauagaucuuga

SEQ ID NO: 149726 - RNA, 45 nt, Homo sapiens; identical to SEQ ID NO: 60599

SEQ ID NO: 149727 - RNA, 46 nt, Homo sapiens
ucucaaauuuucugcccuuuaaagaauaaggugaagcuagguguag

SEQ ID NO: 149728 - RNA, 44 nt, Homo sapiens; identical to SEQ ID NO: 60601

SEQ ID NO: 149729 - RNA, 46 nt, Homo sapiens
uccuggaggauuucucgcaauccauacaguucuuaaaggaccauaa

SEQ ID NO: 149730 - RNA, 42 nt, Homo sapiens
uucagauuuagccagguggcaaucaugagugaauggaugaag

SEQ ID NO: 149731 - RNA, 103 nt, Homo sapiens
gcagacuguugaaacuaugaaugaaggggaccauagagugagggagaagcugaugcauuuguucacgucuggagacugcaaagcauacagcccagaggaucug

SEQ ID NO: 149732 - RNA, 52 nt, Homo sapiens
caugacuguguguguguauguguguguguguauaauucuuuguuguuuuggu

SEQ ID NO: 149733 - RNA, 37 nt, Homo sapiens
gcuggcgcaccguguuccauauucucaacauagaaac

SEQ ID NO: 149734 - RNA, 66 nt, Homo sapiens
guuuugugguacgccuugguuucuaguucuggauauauguauuaaucuuaaagaaugaucuaaagu

SEQ ID NO: 149735 - RNA, 47 nt, Homo sapiens
cuuccugaguuccucuguacugggauguauauuuuccuagccccaaa

SEQ ID NO: 149736 - RNA, 77 nt, Homo sapiens
aggcaucugccaucaccaccauugacacaagaaguggaccuucauuccauugcugggccgccuguuccuccacgaca

SEQ ID NO: 149737 - RNA, 73 nt, Homo sapiens
ugccuucuucccaaacagcccuucccccuuuacaccaccuccuccucaaacaccuucuccucacggcacaaga

SEQ ID NO: 149738 - RNA, 45 nt, Homo sapiens
caacccacaucaaaagccuauucaccacgauauucaauaucagac

SEQ ID NO: 149739 - RNA, 46 nt, Homo sapiens
ccaaaggcacugaugaagugccugucccuccuccuguuccuccacg

SEQ ID NO: 149740 - RNA, 79 nt, Homo sapiens
guaggaucccugaaagugaaacagaaaguacagcaucugcaccaaauucuccaagaacaccguuaacaccuccgccugc

SEQ ID NO: 149741 - RNA, 85 nt, Homo sapiens
ccugguguucguccaucaaacccaagaccagguaccaugaggcaucccacaccucugcagcaggagccaaggaaaauuaguuaua

SEQ ID NO: 149742 - RNA, 41 nt, Homo sapiens
auaaauagguauauaaucugauccaaugaagcacucacuga

SEQ ID NO: 149743 - RNA, 67 nt, Homo sapiens
agugaccaagauaaaucacauaaugucuuuuaauuaaaguguaugcaauugccugacagcaaaauuu

SEQ ID NO: 149744 - RNA, 55 nt, Homo sapiens
cuuucuugggaaaauaaaguuuccauuguuuuuuguuacuugucagugcccagcc

SEQ ID NO: 149745 - RNA, 97 nt, Homo sapiens
uuucuauaugucucaugucuuuuuccucuauuccuccuuucuuuugcauugaguguugaugaaaaugauaauauuugucauuagaaaauauugaaug

SEQ ID NO: 149746 - RNA, 44 nt, Homo sapiens
uuaagccaagucuucauauauaucccaaaguaugagggcauuug

SEQ ID NO: 149747 - RNA, 25 nt, Homo sapiens
uucuugcucauuccuguggccgaug

SEQ ID NO: 149748 - RNA, 42 nt, Homo sapiens
cuugucaaauaaaaugucaugucaaucaaaauaggcacauaa

SEQ ID NO: 149749 - RNA, 48 nt, Homo sapiens
cucaaaaaccugaauuagauuuauuuugaguuuguguccuauauaagc

SEQ ID NO: 149750 - RNA, 46 nt, Homo sapiens
ggggaaaaauuauccaauuggauggaucauucuaaaucuggcaaug

SEQ ID NO: 149751 - RNA, 42 nt, Homo sapiens
acuggaaaggaugcuugauguaacaaugcuacaggaagagaa

SEQ ID NO: 149752 - RNA, 46 nt, Homo sapiens
auauugaugguugggagggaaaagacauuggacaguguuguaauga

SEQ ID NO: 149753 - RNA, 46 nt, Homo sapiens
agugaaucugcaugucgguuuuauagucagcaaaugaaggggaaac

SEQ ID NO: 149754 - RNA, 49 nt, Homo sapiens
uagaaacaauaaauuucuguaaucucaguaaaaauugcccauuugauca

SEQ ID NO: 149755 - RNA, 28 nt, Homo sapiens
auguaaaacauugccauucuucuacuaa

SEQ ID NO: 149756 - RNA, 82 nt, Homo sapiens
aaaaccauugacuaguaacuacacuuuuaaugagugaauuuuaugguaugugaguuuuaucucaauaaaaaaauuacacaga

SEQ ID NO: 149757 - RNA, 119 nt, Homo sapiens
ggagagugacuuuacuggguauuuagguauccaccuuccaaaaaaaucauagguuuucuucuugugguaaugaaauguucuagaauuugauacuggugaugacugcacaaccaauauug

SEQ ID NO: 149758 - RNA, 71 nt, Homo sapiens
uucguauauaaacuaugccucaaagucaacuugauaaauauagucacugauaaaaaaaucaaauaauagua

SEQ ID NO: 149759 - RNA, 51 nt, Homo sapiens
acuucuuaagacgaugaaaagguacuguaucuugauugugccgaugguuag

SEQ ID NO: 149760 - RNA, 46 nt, Homo sapiens
auguaagugaaaaugaauucacagaauucuccauguacuccaaagg

SEQ ID NO: 149761 - RNA, 46 nt, Homo sapiens
aggagaacaaacuuacuaugauuugguaaaagcauuuauggcagaa

SEQ ID NO: 149762 - RNA, 46 nt, Homo sapiens
gguuucuguuuacauaguagcagucuuagaauacauuucugcagac

SEQ ID NO: 149763 - RNA, 39 nt, Homo sapiens
augucaaauucugguaacuuccuguuggaguugggagug

SEQ ID NO: 149764 - RNA, 59 nt, Homo sapiens
agaaaauucacuuuggccauagaauggaaaaugguuuggagaagaaugagacguaaagu

SEQ ID NO: 149765 - RNA, 60 nt, Homo sapiens
agggcaugucuggagagacaacugguuuaugaacaguuuuuauauauguuaagcuaagga

SEQ ID NO: 149766 - RNA, 42 nt, Homo sapiens
gugaggggauauacaaacuaaaacuaucacuucucuccucca

SEQ ID NO: 149767 - RNA, 50 nt, Homo sapiens
acaaccagacuauuuuuguuuucuuuucuucauuuaccuuuucuguaaag

SEQ ID NO: 149768 - RNA, 75 nt, Homo sapiens
cuccgauuaacaggggcuggugcacaugcuaccaauuucagggggguuuuguuuuguuuuugcagcguucgagau

SEQ ID NO: 149769 - RNA, 28 nt, Homo sapiens
ccauucccuguuauuaaggcuaguaauu

SEQ ID NO: 149770 - RNA, 38 nt, Homo sapiens
cuuggaagcuaacugaacugaauaugacacuuccugug

SEQ ID NO: 149771 - RNA, 120 nt, Homo sapiens
guucaguuagcuuccaagaaggcagauuccgucaggggcaaaacaacaccacugaucgugcaaagagaagauagccaucaaagagaaccacaaaccaacaccacagaucgugcaaagaga

SEQ ID NO: 149772 - RNA, 79 nt, Homo sapiens
ucgauguguacucucuuugaugguuaucuucucuuugcacgaucugugguguugguuugugguucucuuugauggcuau

SEQ ID NO: 149773 - RNA, 44 nt, Homo sapiens
uggagcaaaaugaaccucuggugaaaucaaaagaugcucagugu

SEQ ID NO: 149774 - RNA, 46 nt, Homo sapiens
aagucacuucagcuauaauggaaaaguaugaaaaauuagcuaagac

SEQ ID NO: 149775 - RNA, 46 nt, Homo sapiens
auauucuuggguguggcuauauuacaaaaugggaugcuggcaauga

SEQ ID NO: 149776 - RNA, 43 nt, Homo sapiens
cugucuucaguuacuuuguaauuuauuguggcaugagauaaga

SEQ ID NO: 149777 - RNA, 42 nt, Homo sapiens
uggucacacugaggacuucuugaaggauauauggucauuaga

SEQ ID NO: 149778 - RNA, 1585 nt, Homo sapiens
gguaaggcuaaaggcaguuaguucauugucuuauuccugguucuguuuucuacauucucccaacuagaaugucauucauccaacaaacaaaugauuauaauaagucaguuucgagggauaucugaucaagauguuaaaauggaauccgcuuucaaagacauagccagggucaaaaagcaagaucaacaacagaaucucaaagcaguauacaggucugaagcuaacaggccugcugggcuccaguuacaaaaguaucccacaggagauggagaaccacagccaaguucauugcuugugguaccugauaaucaggcaugaugguuuuuuuaccuaccucccccauuaaaggaagagauaaucccuauccugugcaaacuguuucagacuacagacaaggaauucugaauaaaucaguguuuaauacugaugcuaaaaucaaacaagauuaguacagaaaacaaaaauuauaaucuuaugaaaaucauuuuuaaaaaucuaaauaaaauauuagcaaauagaauuacacauuaucaaauaguaaacuaucccaggaaagcaaggaugguucagcaucagaaaauguauuuauguaauacacaauaccaaguauuaagagaaaaucauguaacucuucaguagaugcccaaaaagcauucaguaaaaucugucauuaaugauuuuuuuuaaauaauacuucuuagcaaauugggaauagaaaggaauguccuucaccuagcaaagccuguuaaaaauauguuuaaugaucaaauuaauucccauuaaaguggagaacuaaauaaggauguuugcuauuaucacauuucauuauugucuauuaaaugagaaagggaaaguaugaggauuagaaagaaagauaaaaagaucauuuuuugcugaugguaugauuauguacauagaauauaaaacccuauuaauaaguuacuagaguuaguaagagaauucagaguugcuggauaugaguaacaccaaagaauagcuuuccuaaauaaucagugaaaaacuuaauuggaaaaaagaucccuuucacaaaggcaauaaaguaacauacauaagaauaaaugaaauccaaacauuuuuaagaucauuaucuaggaaccuccaaauuauuuuuuuuuaagacauaaaagauucagcaagugaagaacuacaucauguccauggguagaaagacuuaaaugagaaagaugccaguucuucaguuaauccacagguucaguggaucugcaguaagaaucccaacaugauguuuugugccacuugauaagcugcucuuaaaauucauauggaauggccaggcgcggcggcucaugccuguaaucccaacacuguaggaggcugaggcaggagaauugcuugagcccaggauuucaagaccagccuggacaacauugggagaccccaucucuacaaauaauuuuuuaaaguaaaaaauaaauuuauauggaagagccaaagaccaagaauaagaaaauaaauguugacaaaucguuuucuacccaauauugaaacuuacuauaaagccauagugauuaagguagugugguaacaacacaggaauaaauag

SEQ ID NO: 149779 - RNA, 56 nt, Homo sapiens
ccuucuugucauucucacauuuugcuuaauaggaguauuuuucuggaaaaggauuu

SEQ ID NO: 149780 - RNA, 46 nt, Homo sapiens
agagguagagacuucaaccaagugguucgauuugagacggucaauc

SEQ ID NO: 149781 - RNA, 42 nt, Homo sapiens
cauguccacuuagaauguuugaaaugcugguaguuccugaac

SEQ ID NO: 149782 - RNA, 41 nt, Homo sapiens
augugccccaagguaaugggaaagcuccuagagaagagguu

SEQ ID NO: 149783 - RNA, 47 nt, Homo sapiens
gugauguuuucuagugaccauaagaauugaaucaaaagggggaagau

SEQ ID NO: 149784 - RNA, 54 nt, Homo sapiens
uuuccuguaucauacacccuagaaugcauauugugccuagauacgucuauuuug

SEQ ID NO: 149785 - RNA, 46 nt, Homo sapiens
acagaccuguguuuuagaaauaucuguuugcaguacggugagagau

SEQ ID NO: 149786 - RNA, 46 nt, Homo sapiens
gugucccuugaaaauucacugugcaucaucauggauaaacccagau

SEQ ID NO: 149787 - RNA, 46 nt, Homo sapiens
gagcccagcaaagccaucccaaguuccaccuagaccaccaccuccc

SEQ ID NO: 149788 - RNA, 46 nt, Homo sapiens
uuuucuauauuauuucagccuaagucuaucuucauaccacaggaaa

SEQ ID NO: 149789 - RNA, 50 nt, Homo sapiens
guaugcauugauguuuacuuuuuuuuuuuuaauaaagaugcaguuucaug

SEQ ID NO: 149790 - RNA, 49 nt, Homo sapiens
caucaaucuggcagcuuaauauugauggaaauuucaauaucaguaacac

SEQ ID NO: 149791 - RNA, 51 nt, Homo sapiens
aauuugaauccuggagacuccuggcuaugacccugcaauuauuguuuuguc

SEQ ID NO: 149792 - RNA, 48 nt, Homo sapiens
uuugcccgugcaccacuggagaacaaauccuucagguaagugaguguc

SEQ ID NO: 149793 - RNA, 43 nt, Homo sapiens
uauacguaauuauuuuagauacuauauacaaaguaaaccaaga

SEQ ID NO: 149794 - RNA, 46 nt, Homo sapiens
uauaauauuguacaaguucauauacguaauuuacuuuuaaaauagc

SEQ ID NO: 149795 - RNA, 52 nt, Homo sapiens
gaggacaaaaggcagcuuuacuucauucuuuucaugguuguuggaaagcaca

SEQ ID NO: 149796 - RNA, 27 nt, Homo sapiens
aaaaacacuauguuaaugacuauguag

SEQ ID NO: 149797 - RNA, 55 nt, Homo sapiens
cugucuuaccauuacauaagaaaaaaugagaaauugaugcuauuaaauguuaaau

SEQ ID NO: 149798 - RNA, 46 nt, Homo sapiens
cauauauaauuuuuaaagauaauuuauuccuacauuaacaaugaaa

SEQ ID NO: 149799 - RNA, 54 nt, Homo sapiens
uucccauaacaaguuacauauauauaucuacucaaauauaaugcuguaguaaua

SEQ ID NO: 149800 - RNA, 54 nt, Homo sapiens
uuaauaaugagaagaaaauaacuguuaauaaguacuaaggauugaaguaggagc

SEQ ID NO: 149801 - RNA, 58 nt, Homo sapiens
aguaaaaggaaagaaaauagaggacugcuccuccaagaaaaaaacauaaagggccaaa

SEQ ID NO: 149802 - RNA, 49 nt, Homo sapiens
uaaaacucagcuauucacuauggaaauguuuuaaaaugagccaguauag

SEQ ID NO: 149803 - RNA, 21 nt, Homo sapiens
auauaacauguauauguguau

SEQ ID NO: 149804 - RNA, 23 nt, Homo sapiens
ucuuuauuguuuuggguugagca

SEQ ID NO: 149805 - RNA, 64 nt, Homo sapiens
ggaaauaacauuuugaugaaaacuaauauaucacuuuuauauuaacauucauacuauguuagua

SEQ ID NO: 149806 - RNA, 49 nt, Homo sapiens
uuacucauuauuguaaccccagagcuuaaaauagcaccugacuacuagu

SEQ ID NO: 149807 - RNA, 54 nt, Homo sapiens
gaugaaugagauauaaaaaugagaauauaauuaauuucagugacuacuuuagac

SEQ ID NO: 149808 - RNA, 90 nt, Homo sapiens
gagcuugcugaguucagggauuuucugucccaucucuguaccaugaaugguacauuuccugguacauuuuuaagagauuaaauaaugaau

SEQ ID NO: 149809 - RNA, 59 nt, Homo sapiens
aaauauauaaauaauuauacuuaguuuggucaguuuuaagucugugauguguuacaaaa

SEQ ID NO: 149810 - RNA, 44 nt, Homo sapiens
aguaggagagagauuauuugcuaauagucugaccaggcuaaaau

SEQ ID NO: 149811 - RNA, 98 nt, Homo sapiens
aguaaaaaaccauagcaugauuuuuaaaugguggcaguugucuuauuuggaggagaugcuaaaggagaauccuaccagagaaaagauaucaaagugug

SEQ ID NO: 149812 - RNA, 31 nt, Homo sapiens
uguguuucaaaggauacccauaagaaaauga

SEQ ID NO: 149813 - RNA, 66 nt, Homo sapiens
auauggcauucucaaaaagaaaaacuguagucauagagaacacguuaguguuuccaggguuuaggg

SEQ ID NO: 149814 - RNA, 44 nt, Homo sapiens
auguagacuuuugucuuccucuuggcuugaacaaaacuccaggu

SEQ ID NO: 149815 - RNA, 47 nt, Homo sapiens
cauucuuuccucaugcucacaucaugaaauggagucacuguuuagag

SEQ ID NO: 149816 - RNA, 26 nt, Homo sapiens
acaggaacuugauaaaguggcacagu

SEQ ID NO: 149817 - RNA, 102 nt, Homo sapiens
gacguuuugauaacuuugauaguuuuaaggagugcuggucaauguuuuguagaguguuucuaaauuuaagguuuuuuguuuuuuuuuuucucaugguuagau

SEQ ID NO: 149818 - RNA, 36 nt, Homo sapiens
gauuugaaggaacccguagggaaauaucgucaagag

SEQ ID NO: 149819 - RNA, 52 nt, Homo sapiens
auuaaaugugauagaaauaagggaagcaauuugagguguuugaugaaccgaa

SEQ ID NO: 149820 - RNA, 47 nt, Homo sapiens
aauguguuguuuagauuuaaauggauaaaguggaagggcacuguagu

SEQ ID NO: 149821 - RNA, 85 nt, Homo sapiens
uugcuucuuugugaaagauuaguugaauauauuugugugggucuguuucuggacucuuguguuaauuugcuauagcuucuauuag

SEQ ID NO: 149822 - RNA, 41 nt, Homo sapiens
ugugguagauaauguuucacauauauaagauacagauaaau

SEQ ID NO: 149823 - RNA, 45 nt, Homo sapiens
gcuuuuccuacuaauauugcagugaaacauaauuguggaaaacuu

SEQ ID NO: 149824 - RNA, 37 nt, Homo sapiens
cuucaugauccaaaaaaaugaaaaaaugauccauagg

SEQ ID NO: 149825 - RNA, 47 nt, Homo sapiens
agggaccuaggagcuggcaacugaagcucuuuaguugggccucagga

SEQ ID NO: 149826 - RNA, 28 nt, Homo sapiens
uuauuuuuuucaggccaaugcauauaua

SEQ ID NO: 149827 - RNA, 37 nt, Homo sapiens
uuagguuuuuaaaagagcucccuacuacagcaugaag

SEQ ID NO: 149828 - RNA, 49 nt, Homo sapiens
aaauagccauuuaaauaauuauugccguuuaauuuugugaugcagaaaa

SEQ ID NO: 149829 - RNA, 49 nt, Homo sapiens
caaguaagcacuuuggguuguagcaguaaacgauagacuugguuccaaa

SEQ ID NO: 149830 - RNA, 46 nt, Homo sapiens
accacuucuaaaugugggaagauaaaucacucuucccuggccaacu

SEQ ID NO: 149831 - RNA, 30 nt, Homo sapiens
cuuguuuuuuaaaaagugacuugaauacuu

SEQ ID NO: 149832 - RNA, 34 nt, Homo sapiens
ugacuuuuuuuuuuuuuuggaaagagcaacuuug

SEQ ID NO: 149833 - RNA, 46 nt, Homo sapiens; identical to SEQ ID NO: 139962

SEQ ID NO: 149834 - RNA, 45 nt, Homo sapiens
gugcccgcuagaggucgccaaacggaguccuuuugcgcugguucu

SEQ ID NO: 149835 - RNA, 36 nt, Homo sapiens
cgggucuaguuuuccuuccacucaugugcacacaug

SEQ ID NO: 149836 - RNA, 44 nt, Homo sapiens
uuaaaaaagaauauuuucaugucaaccuccuccugcucugcccc

SEQ ID NO: 149837 - RNA, 40 nt, Homo sapiens
ggacaggagcagagaggugaugugagggaagcaggguggg

SEQ ID NO: 149838 - RNA, 27 nt, Homo sapiens
gcaucugccuaagcucuccaagcaccu

SEQ ID NO: 149839 - RNA, 42 nt, Homo sapiens
uggccagggggagcccgcgccagccguacaauagccggcaga

SEQ ID NO: 149840 - RNA, 41 nt, Homo sapiens
cggggcagcagggaccucaggcgucggcguggggggcuaga

SEQ ID NO: 149841 - RNA, 42 nt, Homo sapiens
caaucaauaccgagaacguaaggacgguuuuaccacuuagcc

SEQ ID NO: 149842 - RNA, 46 nt, Homo sapiens; identical to SEQ ID NO: 60805

SEQ ID NO: 149843 - RNA, 42 nt, Homo sapiens
gguauccugauuucgguuuguucuggggauggaggaggagaa

SEQ ID NO: 149844 - RNA, 53 nt, Homo sapiens
gaacacacacagagauucugacaccaugugccaggccacagaacuugggagcu

SEQ ID NO: 149845 - RNA, 99 nt, Homo sapiens
ugaggaccgguguagaauccauaaggggaaaaucagaaaggcaggccuuauguuguguagagaagcaggucuaugggugcugggaaacugcucugaggg

SEQ ID NO: 149846 - RNA, 45 nt, Homo sapiens
ugcuaaugccauuuuaugcagauguguauuucuauugugugaauc

SEQ ID NO: 149847 - RNA, 41 nt, Homo sapiens
ccuaccaagacucgacaccccgggugggccguucugguugg

SEQ ID NO: 149848 - RNA, 128 nt, Homo sapiens
cccccuacuccgguaaagcgagggccagagguaggggcagauagaccaccagucaggaggagaaagacagggguacauacggagggaccaggacacagaguacaagagacuggcaggagagaagagag

SEQ ID NO: 149849 - RNA, 43 nt, Homo sapiens
cucugugccucucagcucaccgcagacauuccgaccuacccau

SEQ ID NO: 149850 - RNA, 26 nt, Homo sapiens
uuaucuccuuagaaaggauccagagg

SEQ ID NO: 149851 - RNA, 33 nt, Homo sapiens
uuauguauaaugcuaguguguagcauuguagaa

SEQ ID NO: 149852 - RNA, 47 nt, Homo sapiens
agcuuuguauauuuguuaagcaaauauauauucucaucaccucuuca

SEQ ID NO: 149853 - RNA, 50 nt, Homo sapiens
gccuggccaggagauaauagaguuaacaaauguuugaugaauuuaauuga

SEQ ID NO: 149854 - RNA, 28 nt, Homo sapiens
aggaaaaggaaauggaauggguggaggg

SEQ ID NO: 149855 - RNA, 43 nt, Homo sapiens
uaaaacgucuugguaucaguaugguuggacugggggaagggaa

SEQ ID NO: 149856 - RNA, 57 nt, Homo sapiens
uaauauuacauuacaguagguuucuugcuuuuggaauucacugcuuuagcaucaggu

SEQ ID NO: 149857 - RNA, 47 nt, Homo sapiens
agggaaucugcagcagcuggaccuccccaagaaaagagagagagaga

SEQ ID NO: 149858 - RNA, 45 nt, Homo sapiens
ugauuuuccuucuaauuaaaagugcucucagcuuucagcacaggu

SEQ ID NO: 149859 - RNA, 41 nt, Homo sapiens
gagggacacuguaugagguuggaaagccugaaaugcaacaa

SEQ ID NO: 149860 - RNA, 43 nt, Homo sapiens
guauaauggaaguuuuaccugcuuccauuuuggaagaaaguua

SEQ ID NO: 149861 - RNA, 46 nt, Homo sapiens
auaggaaauggaacuuaaugguguagaaaaauacccagccaaggaa

SEQ ID NO: 149862 - RNA, 44 nt, Homo sapiens
gagguaacuauaugagcacuguucaacuauuucugaaaagauga

SEQ ID NO: 149863 - RNA, 30 nt, Homo sapiens
auaugauaauuacacaguauaaagcgagug

SEQ ID NO: 149864 - RNA, 51 nt, Homo sapiens
cccugccacagugcucugcacguucuaaaugaugcauaaaaucaucaacaa

SEQ ID NO: 149865 - RNA, 40 nt, Homo sapiens
ucuugccgcuugacuuugagccccuaaauaaggugacugc

SEQ ID NO: 149866 - RNA, 45 nt, Homo sapiens
uuccuaagcaaaaaauuggggaagaauguaagcaaaguuuauauu

SEQ ID NO: 149867 - RNA, 66 nt, Homo sapiens
uuacuauguccugcuuggguuaccuccuggugccacagucuagaaaguguucucagacagaaagcu

SEQ ID NO: 149868 - RNA, 63 nt, Homo sapiens
uuaaagaguauugaauuuucuucugguaaucagauaauuaacucucagaucagacuaucagau

SEQ ID NO: 149869 - RNA, 72 nt, Homo sapiens
guuuugaguucccaggaaaagaaagacuuaaacauuuccaauuaaagcaucagagauuagucugacuagggu

SEQ ID NO: 149870 - RNA, 47 nt, Homo sapiens
caaaaaggauucauucaaagcaaagcuauuuuaaacuuacccugaaa

SEQ ID NO: 149871 - RNA, 21 nt, Homo sapiens
ggaaaaggaagaaagucacag

SEQ ID NO: 149872 - RNA, 62 nt, Homo sapiens
uauuaaaaccaaauucauuuauucaaauuaggaugaagaguauuuuucuuuguaauggagaa

SEQ ID NO: 149873 - RNA, 45 nt, Homo sapiens
aacaaguggggcuuauuuuauaaaugugucuuuguggcaauagcu

SEQ ID NO: 149874 - RNA, 52 nt, Homo sapiens
cuuuccuguuuaauacuuuuuuuccccuuacuuuccagaaaggccagugugg

SEQ ID NO: 149875 - RNA, 46 nt, Homo sapiens
auaaauaaaagauguguaaauccuuauuccaguggccuucuuuggg

SEQ ID NO: 149876 - RNA, 55 nt, Homo sapiens
uuugucgggguauuuuuuuaacauacgccgugagaaugacauuucuuauauuacu

SEQ ID NO: 149877 - RNA, 98 nt, Homo sapiens
auuuauaguuggucauauaauauuugccaaaacgucauaguuuacauaaaaaauuagugauuccccuguagucauucuacugaaauaugaaugugagu

SEQ ID NO: 149878 - RNA, 58 nt, Homo sapiens
gauccaaaccucuuuuacgauuugaaaccuagucggauauguguugacaaauuuaagc

SEQ ID NO: 149879 - RNA, 30 nt, Homo sapiens
uccuugcucuucccugccuuccucagcauu

SEQ ID NO: 149880 - RNA, 63 nt, Homo sapiens
agucuguuacucuuccuuucucucuucuaaaugcccaccacaaaccaaugcagaacauaaguu

SEQ ID NO: 149881 - RNA, 52 nt, Homo sapiens
ugucuucacuaguagaauuaaacuauguccuggacauuucaagagaguuauc

SEQ ID NO: 149882 - RNA, 45 nt, Homo sapiens
cauuuuaaaauuggauuguaggcauaacuucguuuuaauggcauu

SEQ ID NO: 149883 - RNA, 47 nt, Homo sapiens
uuacauugucuuucuuucuggugaucauggaaaggaauucuaaugau

SEQ ID NO: 149884 - RNA, 52 nt, Homo sapiens
aguagacuagcagcaucaauaucaucugacaauaugcuagaaaugugcauuc

SEQ ID NO: 149885 - RNA, 40 nt, Homo sapiens
aaauaagcgcagaauuuaagaugauaguuuggauggggca

SEQ ID NO: 149886 - RNA, 39 nt, Homo sapiens
uauggagaaaccucauaagauguaauguuaagcgagaaa

SEQ ID NO: 149887 - RNA, 46 nt, Homo sapiens
aaucuuguacauuauuuauagcaguauaaauugguaccaccacuuu

SEQ ID NO: 149888 - RNA, 62 nt, Homo sapiens
uaacaauuaacauccccuuccacacaauugaggaacuaucuuuuuacuaccuuugcagaaga

SEQ ID NO: 149889 - RNA, 37 nt, Homo sapiens
gaaguauggugagagcguugaggcuagguugaaaaug

SEQ ID NO: 149890 - RNA, 53 nt, Homo sapiens
aagacaguauucucauuguggguuguaugguauuuggagccaaagaagaaagg

SEQ ID NO: 149891 - RNA, 33 nt, Homo sapiens
auuacaacuguggcaguuaaaauccccccagau

SEQ ID NO: 149892 - RNA, 45 nt, Homo sapiens
guaggcauauaagaaaauuauuuuucugccaaauuuuaguuuaaa

SEQ ID NO: 149893 - RNA, 27 nt, Homo sapiens
uuaaagucaaggcugaauacuugacua

SEQ ID NO: 149894 - RNA, 44 nt, Homo sapiens
gggagacucuguaucugguuguaaauaggaaauacugcuuuuag

SEQ ID NO: 149895 - RNA, 44 nt, Homo sapiens
uacgcaaauuauuugacaauugauucugugaugaagaaaguggg

SEQ ID NO: 149896 - RNA, 50 nt, Homo sapiens
aucaguauagaaugagcuacugagguuucuugggguuuuaugaagagaga

SEQ ID NO: 149897 - RNA, 47 nt, Homo sapiens
uuggccuguaaaggauaagaaaccaacacaacaacugacacagaggc

SEQ ID NO: 149898 - RNA, 46 nt, Homo sapiens
uucaucagguaccuacagugcuguaauucuagacgugaccuugggu

SEQ ID NO: 149899 - RNA, 45 nt, Homo sapiens
ugauaccacuauugguaauuguugagaaauuguggaagcuuggag

SEQ ID NO: 149900 - RNA, 41 nt, Homo sapiens
uaagagaucuucuguuucuuauuuuaucuucuggcccagau

SEQ ID NO: 149901 - RNA, 41 nt, Homo sapiens
ucucuuuugauuugugagauaggaugauuuggggggcugaa

SEQ ID NO: 149902 - RNA, 65 nt, Homo sapiens
guaaguauagguauaaccgauauucuugguauaugagacacauuuuaagaagacuccagugcuga

SEQ ID NO: 149903 - RNA, 44 nt, Homo sapiens
ugaaaaccauuuuucuuuuagguauccuagcauauucuccaauu

SEQ ID NO: 149904 - RNA, 65 nt, Homo sapiens
auuauuuuaaauuuaauuguuauaaauauuuucaauaaaaaauauuuuucuuuauaaugcaauau

SEQ ID NO: 149905 - RNA, 51 nt, Homo sapiens
auuauuuggaaggaaucaagaguagauauggcacaagagauuaugguagcu

SEQ ID NO: 149906 - RNA, 53 nt, Homo sapiens
acuucauaaaggagguacuguuaugauuccauuuuuauaggaaacugagguac

SEQ ID NO: 149907 - RNA, 33 nt, Homo sapiens
guggagguuugaagauucuguagcugggaagau

SEQ ID NO: 149908 - RNA, 45 nt, Homo sapiens
gaggucaugaucagcaguuauguguagcagagaaguuuggcagaa

SEQ ID NO: 149909 - RNA, 45 nt, Homo sapiens
ucuuuucagggcuguugcaaagaaaguucauaguacaauccagaa

SEQ ID NO: 149910 - RNA, 24 nt, Homo sapiens
uagcaauaccauuauuaggcagau

SEQ ID NO: 149911 - RNA, 54 nt, Homo sapiens
agaguuagacucaguuuucuggguugaauugccauuugaauagcauaauauggg

SEQ ID NO: 149912 - RNA, 47 nt, Homo sapiens
ucauuaguucaggcuagaacuagacugggguguggggcagaagaaau

SEQ ID NO: 149913 - RNA, 66 nt, Homo sapiens
uaaaaaacaaccuuuuuuugaaguauaacauacagaauauuguacauaaauguacagcucagagau

SEQ ID NO: 149914 - RNA, 51 nt, Homo sapiens
uucagagacaccauccacaagcacuguguggggagguacaugcaagaagga

SEQ ID NO: 149915 - RNA, 46 nt, Homo sapiens
cuauugcugauacugcuuuagaagacagaaaaaauaaauuggauac

SEQ ID NO: 149916 - RNA, 43 nt, Homo sapiens
ugauuggugauguuauuuucuuauucuacagaguaggacaagg

SEQ ID NO: 149917 - RNA, 46 nt, Homo sapiens
cacagaucagugauggcucagaagucguuguuguuaaggaggagcu

SEQ ID NO: 149918 - RNA, 57 nt, Homo sapiens
uugaaugaauguguguauguguuugucaguuaggugagaagagaauggagagacaga

SEQ ID NO: 149919 - RNA, 50 nt, Homo sapiens
aauuugauuaguaguugggaacuuauuuaagugcuuuucacuguuaaaau

SEQ ID NO: 149920 - RNA, 45 nt, Homo sapiens
augcaaaguauuuuguuugaaaggauucucaagaaacugguaaaa

SEQ ID NO: 149921 - RNA, 42 nt, Homo sapiens
gaagagucagggcacacaaagggauuugcccugcacccagcg

SEQ ID NO: 149922 - RNA, 46 nt, Homo sapiens
cuucuccaagcauggauguccagugaaggcagcaagcucacugugg

SEQ ID NO: 149923 - RNA, 38 nt, Homo sapiens
ggugcuuuggcaugauggaaaggagacaggagagacag

SEQ ID NO: 149924 - RNA, 41 nt, Homo sapiens
aaagucagggugacugggcgucccggcuugauucaucuauc

SEQ ID NO: 149925 - RNA, 46 nt, Homo sapiens
aggucuugcuauccagggggauguccaugugggaugggugcuggau

SEQ ID NO: 149926 - RNA, 45 nt, Homo sapiens
gaccugaagcuagagcuggugcucagagaagagcugccccauggu

SEQ ID NO: 149927 - RNA, 46 nt, Homo sapiens
caaccacuagcacaaucaauuuuggaacaucucuuuaccccaaaag

SEQ ID NO: 149928 - RNA, 43 nt, Homo sapiens
cggucccuuggugugaaaagggccggcguaccggagagggagg

SEQ ID NO: 149929 - RNA, 39 nt, Homo sapiens
gcccacccaacgcgaagacgguaacccgugugacuuuga

SEQ ID NO: 149930 - RNA, 61 nt, Homo sapiens
acaucacacucugcauaguguuccugaugacgugcaaaccccccccuccccauauaugggc

SEQ ID NO: 149931 - RNA, 62 nt, Homo sapiens
ccugaguauaucaaguacuucaaugauaaaaccauugaugaggaacuagaacgggacaacag

SEQ ID NO: 149932 - RNA, 98 nt, Homo sapiens
ccccuaucuaugcugaccucucccuuaaguacaacuguacagggcuaaauuuugggacgguggaugcuggacgcuauacugauguuaguacgcgguac

SEQ ID NO: 149933 - RNA, 55 nt, Homo sapiens
acucccuacccugauccuguuccaagguggcaagaagguaaugcggcagccacag

SEQ ID NO: 149934 - RNA, 56 nt, Homo sapiens
uggagacaauaucccugaggagcagccuguggcuucaacccccaccacagugucag

SEQ ID NO: 149935 - RNA, 32 nt, Homo sapiens
gugcuuccucuccugucaauuccaggcucuuu

SEQ ID NO: 149936 - RNA, 47 nt, Homo sapiens
augcgggaagauguugagagccaggaagaauggagcacaauguaauu

SEQ ID NO: 149937 - RNA, 43 nt, Homo sapiens
ucauccuagagaugucugugguggguggcuggacccaugagac

SEQ ID NO: 149938 - RNA, 61 nt, Homo sapiens
uacacauaaauagcucaugaaccuaccuuucccaaaacucccaggccacaugcaucauugc

SEQ ID NO: 149939 - RNA, 32 nt, Homo sapiens
ggccaggggaacuuuacagaauacugaccaug

SEQ ID NO: 149940 - RNA, 50 nt, Homo sapiens
uucuacuacagucaaguuccugaguacucagcuccaauuaucuaauauuc

SEQ ID NO: 149941 - RNA, 30 nt, Homo sapiens
cuuucauuucucuuaucucuucucacccca

SEQ ID NO: 149942 - RNA, 73 nt, Homo sapiens
cacgggucacauuuguauauaaccaggagauggccaaauaacaucuacugcagugauuuugcaaauucagcau

SEQ ID NO: 149943 - RNA, 46 nt, Homo sapiens
uaagaaucauccuugaagaaugucaaggagccauagaaacaggaag

SEQ ID NO: 149944 - RNA, 23 nt, Homo sapiens
agaaaaacccaacggaggagaaa

SEQ ID NO: 149945 - RNA, 45 nt, Homo sapiens
gguuaagaauucaaacccaaagcagccaaacucaccaacauccag

SEQ ID NO: 149946 - RNA, 53 nt, Homo sapiens
cgagacaaaugaaucuaaaguuaaaggaagacaggucaugaagggcuuugcaa

SEQ ID NO: 149947 - RNA, 53 nt, Homo sapiens
gggggaugggacuggagaaugaacguauccaagacaacuuugcaagggauucg

SEQ ID NO: 149948 - RNA, 75 nt, Homo sapiens
ugaaccuccgggagagugaggggcguggggugggccacacagacaccuugugugaauuccuguccacgugcgagc

SEQ ID NO: 149949 - RNA, 178 nt, Homo sapiens
uuuucucugagcgugcguacaugcaugggagcacuguauccucugugcugaagagcuaauaaugugacugcaugugguggauaugaggugcauccaggugagugaacauuguuccacgugggcuguaguucucauccuguccacugagcauagcaucaggaaauggccugcuugugga

SEQ ID NO: 149950 - RNA, 42 nt, Homo sapiens
guucugaggguguuggggcugaggaugcuaugaaugcaggaa

SEQ ID NO: 149951 - RNA, 48 nt, Homo sapiens
cuggccccgcagccgucucugaggagggcccuccuggcuugccagugc

SEQ ID NO: 149952 - RNA, 42 nt, Homo sapiens
gaggacgcgcugcuggccgcccgggagguguucaagacccag

SEQ ID NO: 149953 - RNA, 41 nt, Homo sapiens
uucgucaguauagaguugaaguuuauaagaauagagcugga

SEQ ID NO: 149954 - RNA, 44 nt, Homo sapiens
uuaucaggaccucaaccgguuguugaaaggcaaaaagggagagc

SEQ ID NO: 149955 - RNA, 46 nt, Homo sapiens
cuucagccaguauaugaaauuggauauugcagcagucagagcccuu

SEQ ID NO: 149956 - RNA, 31 nt, Homo sapiens
auuaagcagccucucauggauaagaacagaa

SEQ ID NO: 149957 - RNA, 46 nt, Homo sapiens
ggaagcuuuuguagaagaugcagaauugaggcagacuuuacaagaa

SEQ ID NO: 149958 - RNA, 59 nt, Homo sapiens
cagacuuaaagaaauacaacuuuaugaugacaagauauaagauaauuauagauuuaaau

SEQ ID NO: 149959 - RNA, 70 nt, Homo sapiens
cuccuugagggauacagauggagugugaguucccugaggugacugagguggagugugagcucccugaggg

SEQ ID NO: 149960 - RNA, 45 nt, Homo sapiens
ucccugagggauacagauggagugugagcucccugagggauacug

SEQ ID NO: 149961 - RNA, 48 nt, Homo sapiens
ugugagcucccugaggguuacagauggagugugagcucccugagggau

SEQ ID NO: 149962 - RNA, 94 nt, Homo sapiens
ccugagggauacagauggagugugagcucccugaggguuacagauggagugugagcucccugagggauacagauggagugugagcucccugagg

SEQ ID NO: 149963 - RNA, 77 nt, Homo sapiens
gugauugagguggagugugagcucccugagggacagagauggagugugagcucccugagagauacagauggagugug

SEQ ID NO: 149964 - RNA, 47 nt, Homo sapiens
gagcucccugagggauacagauggagugugagcucccugaggugauu

SEQ ID NO: 149965 - RNA, 46 nt, Homo sapiens
cuccaaguuucaggaaaugauagaaacaacuuuagauauggaucag

SEQ ID NO: 149966 - RNA, 43 nt, Homo sapiens
aauuguagcaccuuuguggacaguggauguaauauuaagugac

SEQ ID NO: 149967 - RNA, 45 nt, Homo sapiens
ugauccuaaucucagugaauuaagagaaauaaugaaugacuugga

SEQ ID NO: 149968 - RNA, 84 nt, Homo sapiens
cuuuuggaguguucuaaucaucuucaaguuuuucguggauuaguuauaacauaugaaaaaagauagggcugaaugggccacaug

SEQ ID NO: 149969 - RNA, 50 nt, Homo sapiens
uucuugaccagaauauuuaaccugauuuuaaacaagaaguaaaaauucaa

SEQ ID NO: 149970 - RNA, 41 nt, Homo sapiens
auaaauguccaugucacggcagcaaaaaagaaaucaacagg

SEQ ID NO: 149971 - RNA, 32 nt, Homo sapiens
caaauaaauugccuguuuuucaaaagaaagau

SEQ ID NO: 149972 - RNA, 34 nt, Homo sapiens
gaaguguccauuguggacugcaucuuagcccgag

SEQ ID NO: 149973 - RNA, 45 nt, Homo sapiens
gauaugauaucauggaaccagcagcaaagaagugcuaucuggaaa

SEQ ID NO: 149974 - RNA, 41 nt, Homo sapiens
ccucuguguuucuagugcuuauuuuuuaaucaguuuuuuug

SEQ ID NO: 149975 - RNA, 52 nt, Homo sapiens
ucagaagaaaacaucacaauaaaguuaaaacagcuaaaagcugaaguaauag

SEQ ID NO: 149976 - RNA, 78 nt, Homo sapiens
auuuuacuuugaggacauuuucaaagauuuuuauuuugaaaaaugagagcuguaacugaggacuguuugcaauugaca

SEQ ID NO: 149977 - RNA, 47 nt, Homo sapiens
gguguggauucuaaucagggagccccuguaagccuguggucccuuac

SEQ ID NO: 149978 - RNA, 41 nt, Homo sapiens
augucuacaccuuaagccgcggcucccgaagcaccuagaac

SEQ ID NO: 149979 - RNA, 32 nt, Homo sapiens
ucuuccccggccggucccucgccucccggccg

SEQ ID NO: 149980 - RNA, 38 nt, Homo sapiens
gggcuccgggggaugucgaacugaggggaguguggcuu

SEQ ID NO: 149981 - RNA, 39 nt, Homo sapiens
aauuuuccuuucuauaaacgaauacuuaaacuuggacag

SEQ ID NO: 149982 - RNA, 51 nt, Homo sapiens
acuaauaauggcaacuacuugauaggguuguuaugaauaagauuaaaagag

SEQ ID NO: 149983 - RNA, 40 nt, Homo sapiens
uaaguccaugaccuuuuuaagauuugauuuuuguguguga

SEQ ID NO: 149984 - RNA, 58 nt, Homo sapiens
uuauuguuuuaauuuuaaacuauaaaaauaauaagcacauuaaagaaaaauugggaaa

SEQ ID NO: 149985 - RNA, 39 nt, Homo sapiens
auuuaauuuagcuaaugauaaauuuagugaauaagaagu

SEQ ID NO: 149986 - RNA, 46 nt, Homo sapiens
cagauaagagagcugaaaccccaggagcugaaaagauugcaggauu

SEQ ID NO: 149987 - RNA, 41 nt, Homo sapiens
gaacuggcuucaugaaagcacuaaucuucuaacaaacuuca

SEQ ID NO: 149988 - RNA, 61 nt, Homo sapiens
cauccuuuggaccagcuugcuaccagaacccagaaaaaaaaucagcgacuucaaagccccc

SEQ ID NO: 149989 - RNA, 50 nt, Homo sapiens
cuagucuuuaccacuucuguuaagacaauucuuuuuaaaguucaccuuuu

SEQ ID NO: 149990 - RNA, 44 nt, Homo sapiens
cacagaaggcuauuuuguuauaggcaaauuuaguuuuaaacagu

SEQ ID NO: 149991 - RNA, 86 nt, Homo sapiens
auuuauaggauuucacugugugagauggagaaacuuaaagguccaggguauuauguuucuguuuuauuguauaaagaaguauuuau

SEQ ID NO: 149992 - RNA, 40 nt, Homo sapiens
cucuguaaucaagcagaaccaggugcgaaaccucaaaggu

SEQ ID NO: 149993 - RNA, 50 nt, Homo sapiens
agcaauugagagauugaaguuaaugcuucgauuuuucuuacauugaccaa

SEQ ID NO: 149994 - RNA, 46 nt, Homo sapiens
aauucguacauguuuagguucccuaauaaguacugcaaagacacaa

SEQ ID NO: 149995 - RNA, 48 nt, Homo sapiens
gggaagggauacuaauuacuuauuucuuucaaaacauuuuugguuuuu

SEQ ID NO: 149996 - RNA, 47 nt, Homo sapiens
guuaggaucaugccugaucagaaauacaugaugugaaguccuaaaag

SEQ ID NO: 149997 - RNA, 57 nt, Homo sapiens
cagcuaaaaauuuugcugauguauuuuucauauacuucucuccugacacgcaauccg

SEQ ID NO: 149998 - RNA, 52 nt, Homo sapiens
gucuuaauuuguuucuaauuuuuuuuuuguugucgugugagcaaagacaaac

SEQ ID NO: 149999 - RNA, 46 nt, Homo sapiens
caauuccuauuagaaugguagcuuugaaguguuuuuacuucagaga

SEQ ID NO: 150000 - RNA, 46 nt, Homo sapiens
uuaaugcaauuuuacagacacaauaccuucaugaauuucaaaauuc

SEQ ID NO: 150001 - RNA, 43 nt, Homo sapiens
gaugcuaaacuaauucauuguaucuuuuuuuuacaauggugga

SEQ ID NO: 150002 - RNA, 41 nt, Homo sapiens
aauagauuauacacaucaucuuaauaacuauuuuuaaguua

SEQ ID NO: 150003 - RNA, 34 nt, Homo sapiens
uuccaaauucagagaaagaaaacagauuaccuga

SEQ ID NO: 150004 - RNA, 40 nt, Homo sapiens
cauacuagauguucaguuaaauauacuuuagcacaaaguc

SEQ ID NO: 150005 - RNA, 56 nt, Homo sapiens
uacuacaacaacuuaacacccuuuugugaagaucacagcauuuaucuaagaaacug

SEQ ID NO: 150006 - RNA, 51 nt, Homo sapiens
cugccauuuuuuuucuuaaagcauauucuuugcaucuaacugccagugcca

SEQ ID NO: 150007 - RNA, 47 nt, Homo sapiens
guauuauguugccaucauauaguguauaaaaauguauaauugccaau

SEQ ID NO: 150008 - RNA, 46 nt, Homo sapiens
cagguauuaguagugaauuuuugcccauaaaaauauuuuuugacag

SEQ ID NO: 150009 - RNA, 31 nt, Homo sapiens
gacagucuugcagagcuuuugacuagugggg

SEQ ID NO: 150010 - RNA, 43 nt, Homo sapiens
ggguuuaucuuaagaaaaucauuauauuguguaacuguuuggg

SEQ ID NO: 150011 - RNA, 42 nt, Homo sapiens
cccguuucgccuuacacgugucccuuugaugcguggagaaug

SEQ ID NO: 150012 - RNA, 43 nt, Homo sapiens
ggugccauuugccauuguaguucagauggagggaucaccuggu

SEQ ID NO: 150013 - RNA, 42 nt, Homo sapiens
cccagauccacccacaccgccuauauuaagugagaagccgac

SEQ ID NO: 150014 - RNA, 48 nt, Homo sapiens
gcguccgcuuuucugacaagggaagaggugaggugggagaggggcugc

SEQ ID NO: 150015 - RNA, 84 nt, Homo sapiens
acagcaacauggcggcgcccauggacucuuagaaaaggagaaagcuuuuucucuguggacuggaaggggcauuuuucaugauca

SEQ ID NO: 150016 - RNA, 47 nt, Homo sapiens
cuguaaaccgugcaaguaucugcuagacaggacagcggucaucaaaa

SEQ ID NO: 150017 - RNA, 48 nt, Homo sapiens
gaaagaagauacaguuucaguguuuuauuccuuuguuuaguacugggu

SEQ ID NO: 150018 - RNA, 36 nt, Homo sapiens
uggucuggaacacacuaugcacucaauaaauacuug

SEQ ID NO: 150019 - RNA, 33 nt, Homo sapiens
auggggaauuuagcauggaucuucguaccaaga

SEQ ID NO: 150020 - RNA, 47 nt, Homo sapiens
guuaugaaauggccucccaccuucggcguucccaguacugaccucgu

SEQ ID NO: 150021 - RNA, 46 nt, Homo sapiens
auggaugcugcccgaaaagucccgaggaacauacuuggagagagcu

SEQ ID NO: 150022 - RNA, 3302 nt, Homo sapiens
uccaucagccuggccgaggugaauggggagcggggugggcaccgggguaaguggcauggggaagcugggaacaaacuaggggucagaucuagaucuagagaagagacugggaacaugggagagagcuucguggggauggggacagcacacaccucaccucugccucugcucuccccacagcugccuuugaggcuuucccuauacucacggucacugccaacccaggguggaguuucauuugucagacaaaucugcccagcuguggcugcaauuucaguggcuuccuuucauuuuaguugugaggucuuuaggaagcaaaucauucugggguugcacaagggcuuucucucaugaaccgauuuaggcugguugguaaggcauuucugggaccccagguuuagaaguguuauagaauucuucugaauuucaguaggaaaaaaacgggauccuuuaacaaugucuacuucaggcagcacgugguguguuuucaggcucugaucuagucaguccucuuguuuuccagaaaagacugcaaggcucagagaggugggaugacuaucccaaggucacaucauagucacugggccaggaugaggcuccccuguaccucguggcaccuaguuuuuucccccacacuugauguccuauaaaggaacuggccaaccauggcugccuguggagugugacuucaggggcauuaggaaguuccuaauguaacccuuuuaguucccacugaugcacugaugccucagcuuccuuaucacaaacuguauuagucaagaguucuucagaaaaacagaaucaauagguguguguucccugggggaagagagauuaauauuuauuuuaaggaauuagcucaaaugauuauggagacuuggcaaguccaaaaucuucagggaaggcuggcaggcuggaggcccagggaagacuugccauucaaguccaaagguagaguucugcuggcagaauucccuuuuccuaacagaggacaaucuuuucucuagcaaggccuucaacugauuagacaaggcucacccacaguauggugggaaaucggcuuuacucaaagacuacugauuuaaauauuaguauaaaccauacccucacaaaaacaccuaggauaauguuuaagcaaaugucuggguagcauagccuagcuaaguugacacauaaaauuaacuguugcagggaccaagccucuuauggcucagacaaagguaaggcuaagguguaagcauccugggagaugcuguggucaagucuguuuagggugaaggggcacaguucuaauuuuuuucacaggauuucacugugagacugcuugcaacugggaagucguccggaucugagacaucuguaucuguuuuuucugcuucuccuuccuguuauccuucuggccuauggguugucuuguguuucaaucagcugugugugugucuuguccaggugaauggggaacaaugagauaagguaucgugguacaaaccucaauugccuaggcaaugagugcuauggaggagggcaguuugccauaggaggcucauggagcagaugcugagauaccugccucucacagaaagaccaauuuuuaaauuaaaaauuuuaauuuuggaauaauuuuaccucuauagagauauuguaaagauagaacagaaaguuccuguaggccgggcgcaguggugcacgccuguaaucccagcacuuugggaggcugaggugggcggaucacaaggucaggagauugagaccauccuggcuaacacggugaaacccugucucuacuaaaaauacaaaaaauuagccgggcaugguggcgggcaccuguagucccagcuacuugggaggcugaggcaggagaguagcgugaacccaggaggcagaacuugcagugagcugagaucacgccacugcacuccagccugggcuacagagcaagacuccaucucaaaaaaaaaaaaaaaaaagaaaguuccuguaugccucucacccaguuucucccauuguuuauauccuacauuuccauaguacauuguauuuuuuucuuuuuuuucaaacccaggauaaucucuguauauaguacauuacauuuccauaguauuuuuuuuuuuuuuugagauggagucgcucugucgcccaggcuggagugccaguagugugaucucagcucacugcaaccuccgcuguccagggucaagugauucuccugacucagccucccaaguagcugggauuacaggugugcaccaccacgccuggcuaguuuuuuuuuuuguuuguuuguuuuuuuuguauuuuuaguagagaugugguuucgccauguuggccagucuggucuugaacuccugaccucaggugauccaccugccucagccucccgccaaagggcugggacuauaggcaugagccacugcgucuggccccauaguacauuugucaaaacuaagaaacugacauuggcauauuccuaacuaaacuccagauuuaccuggauuuuuaccaguuucuccauuaauguccucuuucuguuccucugguacccacuccauuuagcugccaugucuacccaggcuccucugaucuauggcaacuucucagucuuuguuuuucaugacucugauagucuugagggggacuggcuagggauccuguagaaugucccccagcugggguuugacugaugcuuuucucgugauuuaacuggaguuaugaguuugggagaagaauaccacggaggugaagggcccuucccaucacauagccucagaagguugaggacaucauguggcaucacugggacauucaccuccaucccuugguuaaggcaggguuugccaggucucuccccuggcaagugacuauuuuucccuuucccugcucuauuauucggaagccagcauugaccuacuuucauagcaaguuguaaaugaaagaucaguuggugcgacgaugagggcaguggguauuuaagagggagaggguaguagagaacguagugccagagagcaggguguccaagagcagggcaaaagggguucagaaagucuuccuuacaaugugagcuagcacugcucccaaccaucagaggaagugggguacgguggaaaccaucacagaggggauggugaagaaguguauuucaugucaccuucuggcacuaugguguggcccacuugagagcugaaucaucugaaacaguuacugcccacgggcuuggauggggccccucucuggagaaggugugguuaauacucaugucugcucccuccaucagcuggcaguguuuauuuacuaugcugugu

SEQ ID NO: 150023 - RNA, 52 nt, Homo sapiens
aauagggcucuguuaguaacagaaaccccgcauggagguuucuccagugccu

SEQ ID NO: 150024 - RNA, 47 nt, Homo sapiens
gcaugugauaguauuguguguguagaguaccauaugugaaaaguaca

SEQ ID NO: 150025 - RNA, 45 nt, Homo sapiens
gcauuuuuggucagucagguuaggcuaguugaugcuuugguaaca

SEQ ID NO: 150026 - RNA, 45 nt, Homo sapiens
ccuugacaaguuccgaacuccuuuauauauauggugcccuagacu

SEQ ID NO: 150027 - RNA, 131 nt, Homo sapiens
uauauuguuuguauuauaaaugauuuuauaaaugccucccagauucaagugauucuugugccucagccuugcugaggccugcuggagaaguuauguuauaaaaucuugaaacuguaaaugcuaaagggaag

SEQ ID NO: 150028 - RNA, 48 nt, Homo sapiens
guuaagggaaaaugggaaguuuucagugggguagagugguggucacuu

SEQ ID NO: 150029 - RNA, 68 nt, Homo sapiens
ccugcccauguuaaggcccuguuguccucugccugggaaggcuuauguugucuuuccuccuuaucuca

SEQ ID NO: 150030 - RNA, 81 nt, Homo sapiens
ugcuccaugcuuuugccugaaauggccuucucccagccucccccucccagccaccccgcuuuuuuuuauggagaaucucaa

SEQ ID NO: 150031 - RNA, 46 nt, Homo sapiens
ucugcuucccaguggguagugcuuuguugguuuccaagcucuuggu

SEQ ID NO: 150032 - RNA, 29 nt, Homo sapiens
uuaaaauguuaaaaccuagaauaauuuuu

SEQ ID NO: 150033 - RNA, 46 nt, Homo sapiens
uuuuggcaauuuugcuuucgauaaaaauuccauaaauauucgacag

SEQ ID NO: 150034 - RNA, 46 nt, Homo sapiens
ucagugcuugaagauacauucacaaauacuugguuugggaagacac

SEQ ID NO: 150035 - RNA, 49 nt, Homo sapiens
gugcguaacucucaguuugugcuuaacuccauuugacaugaggugacag

SEQ ID NO: 150036 - RNA, 54 nt, Homo sapiens
uucucuuuuuuccaaauauguuaguuuuguucuuguaagauguaucauggguau

SEQ ID NO: 150037 - RNA, 49 nt, Homo sapiens
aaugauuguguugcuuuuaggauugaucagaagaaacacuccaaaaauu

SEQ ID NO: 150038 - RNA, 45 nt, Homo sapiens
uuuauagcguguggaaauugagaaaaaugaagaaacaggacagau

SEQ ID NO: 150039 - RNA, 37 nt, Homo sapiens
uugagacugagcaaggcuacuuguuaucucaugaaau

SEQ ID NO: 150040 - RNA, 46 nt, Homo sapiens
ucagcacugaaagaagcuaaagaaaaugcaucucgugaucgcaaac

SEQ ID NO: 150041 - RNA, 35 nt, Homo sapiens
uaggguuaugcaagauagacgagaacaagcaagac

SEQ ID NO: 150042 - RNA, 50 nt, Homo sapiens
agagcaggaacgucuaagaguagaacaugagaaguugaaagccacagauc

SEQ ID NO: 150043 - RNA, 59 nt, Homo sapiens
uugaacagcagauccagagccauagagaaacucaucaaaaacagaucaguaguuugaga

SEQ ID NO: 150044 - RNA, 26 nt, Homo sapiens
auacauauuaauguugcuuugaaaca

SEQ ID NO: 150045 - RNA, 46 nt, Homo sapiens
aaaagcaugaagccaaaaucaagucauugacugaauaccuucaaaa

SEQ ID NO: 150046 - RNA, 23 nt, Homo sapiens
gcaaaacugcagggaaccaguuu

SEQ ID NO: 150047 - RNA, 90 nt, Homo sapiens
gaaguaaaaaccauggugaaacguugcaagcaguuagaaagcacacaaacugagagcaacaaaaaaauggaagaaaaugaaaaggaguua

SEQ ID NO: 150048 - RNA, 24 nt, Homo sapiens
aggaauugcugugggaaauaauga

SEQ ID NO: 150049 - RNA, 86 nt, Homo sapiens
aaacuugaaacaccgaugaguauuugauuugaauuuucauguaguagauuuaacuauacuuuuuguuuuggguucucuuaggcaac

SEQ ID NO: 150050 - RNA, 44 nt, Homo sapiens
gacucggguuucaacuucauuucuuucuguauaugaagccuuag

SEQ ID NO: 150051 - RNA, 45 nt, Homo sapiens
cucaggaaguugaagacaaaacuaaggaauaugaauugcuuagug

SEQ ID NO: 150052 - RNA, 57 nt, Homo sapiens
cuuuuggcaucuaccagaagggaucaagacaauaugcaagcugagcugaaucgccuu

SEQ ID NO: 150053 - RNA, 44 nt, Homo sapiens
agcaaagucaacugguagagaaacugaagacgcaaauguuggau

SEQ ID NO: 150054 - RNA, 45 nt, Homo sapiens
aagaagaaauugcuaaauuauacaaacagcuugaugacaagguag

SEQ ID NO: 150055 - RNA, 46 nt, Homo sapiens
gagacggugccuauugaugaacaguuugacaaagagaaagccaacu

SEQ ID NO: 150056 - RNA, 46 nt, Homo sapiens
uaagaacacaguuugugucaauguggaguuaacugcagaacagugg

SEQ ID NO: 150057 - RNA, 46 nt, Homo sapiens
agagcguuuuguauguaguccagaugaaguuauggauaccauagau

SEQ ID NO: 150058 - RNA, 44 nt, Homo sapiens; identical to SEQ ID NO: 61185

SEQ ID NO: 150059 - RNA, 43 nt, Homo sapiens
cauauagucaggaggcuugcaaggccuggauuaguugucaaac

SEQ ID NO: 150060 - RNA, 79 nt, Homo sapiens
gaugauugaaagcauugacacugaagacagacuaaaguucuuuaggguuuugaugugaaaguuucuccaaaguucagcu

SEQ ID NO: 150061 - RNA, 44 nt, Homo sapiens
aguuaauacuguauuggggcuauuuaauuuggaaauagggcaga

SEQ ID NO: 150062 - RNA, 112 nt, Homo sapiens
auuagauucauacuucugcaguuaaggucuaucuugaagaaaauuguuguuugguaaucccaagaauagugagauacuguuuuuuuguaaugaaaaacauaacuagaguuga

SEQ ID NO: 150063 - RNA, 160 nt, Homo sapiens
ccgacuuugguugggucagauaagugcuccgaaagacaaaucgcauucuugcuagguuuuaugggauaacagccuaggaaaaaguauuaacuuuuuguuuuuguaucagacagaaaguguuauaaaaacaaacuuauaaaaaagauaaaaauugaccagu

SEQ ID NO: 150064 - RNA, 106 nt, Homo sapiens
cauguuaacaacuacaaauggcaaaucgaugauuguagaaagaaauaguugagcuuuuuuuuuuuugaaacaggaugaucaguuuuguuuaaucuagcagaccuag

SEQ ID NO: 150065 - RNA, 44 nt, Homo sapiens
ccuggacacucccccaccuggggcaauggaggaacguccgggca

SEQ ID NO: 150066 - RNA, 49 nt, Homo sapiens
guuugccgguucagauaacccaguggagggagacugcgcagccucgcgu

SEQ ID NO: 150067 - RNA, 46 nt, Homo sapiens
cccucgcgaccacaagcccucagguccggcgcguucccugcaagac

SEQ ID NO: 150068 - RNA, 45 nt, Homo sapiens
augaacuugcccauuucagcagcaaccccucgggccuauagcaaa

SEQ ID NO: 150069 - RNA, 43 nt, Homo sapiens
uccggcuuucaguuccccgcgcccaggcaggucacgggcagcc

SEQ ID NO: 150070 - RNA, 48 nt, Homo sapiens
caaugaguggucauugaagauaagaaaggaaaugagaguuguugacag

SEQ ID NO: 150071 - RNA, 45 nt, Homo sapiens
gccaagaagggccagaaggaugucugcauaguucuggccaaggag

SEQ ID NO: 150072 - RNA, 25 nt, Homo sapiens
uugcgaguggcugguucccugcaga

SEQ ID NO: 150073 - RNA, 42 nt, Homo sapiens
cuucaucauuucuuuggacaacucccucaugguggccugaau

SEQ ID NO: 150074 - RNA, 1575 nt, Homo sapiens
aauucucuuugaaauuacagcagguaugaccgugagauccauccuuucuccucucuuuuuauggccauucuuccuucauucacuaaauuagcuaguagcuuuuucuuuaggcauuaacucccuucuacauuuuuaacguuuuacacugugcagcuuauuucuugaaaaguaagcacaauaucuauaaccaucuuuuaaaaaacacaauucuuaaaauuuuuagaguuugcaugauuuuaaaggaagauacugcucucauauacugcuguugggauuuuaaacugguguagacuuucuugaaagcaauuuggccauagccauucaaaagcccuugccuucgccaagugcgauggcucacgccuguuaucccagcacuuugggaggcucaggugggggaucgcuugagcccaggaguuugagaccagccugggcaaccauagcaagaccgcaucucaaaaaaauauauauuaaaaaaaaaaauuugaccuaauagauugacuucugggaguuuaaugaaauaauuaagaaugugcugaaauauuuaauucaaggaugucuguaguagcauuauuuauaaaaaugaaacguuugagggccaggugcaguggcuuaugccuguaaucccaacaccuugugagggaggcugaggcaaguggauugguugaacucaggagcccagccugggcaacauggugaaacccugucucuacaaaaaauauaaaaauuagguaggugggugugguggcacacaccuuagucccagcugcuugggagacugaggugggaggauugcuugagcccaggagguccaggcugcaguuggccaugaucgcacuacugcaguccagccugucucaaaaaaaaaaaaaaaaaaagguucgaaacaaacuaaaugccuaauaaaaucauuuguguuauauuuauuuuaauggaauacuauauauugugauagaugguauagaaauauacucguuaacauggaaugauguuuacaacaugugaauaaagccuuuuuacugaaauacauacuuuuguguaaaaacaugucuauagaagucuggaagggagaugauaaaaauaguaaucuccaagugaugguuaaugaguuuuuaaacuuuauuuuuacuucuagauuuucugaguuuuauguuuaauuaaaaaaauggugggguuuaauuuuuauuaguucauuuguuggguuuaaguuguuggggaaaggaagacaguuacuccaagaaaauauuuugugaagauuuagaaacaauuuaguuuuauucagaaagaagauuuaaaguuuucaguagcauuuaggaauuuagauuaggagcuucagaaccgagauucuuaaaauccuuacaauuauuaugacuuugguaucauuacagguagcuauuugcacauuucccagagugaguaaacccccccaaaaacagcuugcuguacugucucauuuuuguaucuggucagauugguccaggaaugaaaggcagggaagauugaggggcugcuuccuuaagccaaugugguguucaucuuugcucuuucuuuucaggggccuugggcaaagcacccagu

SEQ ID NO: 150075 - RNA, 42 nt, Homo sapiens
uaucaauuagaucugcuucuguggugaaauuuguuagcugaa

SEQ ID NO: 150076 - RNA, 66 nt, Homo sapiens
uguauuuuauuccuauaucaaaugaaaaguauuuuugcauuaagauuuuugcuguauauuucauuu

SEQ ID NO: 150077 - RNA, 30 nt, Homo sapiens
aacaacacaguuuucuuguacccugggaga

SEQ ID NO: 150078 - RNA, 31 nt, Homo sapiens
auggugcauugguucagcaucaggaguggga

SEQ ID NO: 150079 - RNA, 46 nt, Homo sapiens
ggacaggaguuaauuaagagaaugaccaagcucaguucaaugagca

SEQ ID NO: 150080 - RNA, 42 nt, Homo sapiens
gaaaaagucaaugaucucugauuccuuaaugggcagggagaa

SEQ ID NO: 150081 - RNA, 45 nt, Homo sapiens
aagcuaagccaucaaagccagucauccugucauggggggugacca

SEQ ID NO: 150082 - RNA, 46 nt, Homo sapiens
gcugccauugauggcaggauugggggucccagcaccacccccugcu

SEQ ID NO: 150083 - RNA, 51 nt, Homo sapiens
cccacagaacacucccaacugagguccugagaguuagggaauaggguggaa

SEQ ID NO: 150084 - RNA, 44 nt, Homo sapiens
caugggagggugggccuuaugaaauguauauacacacgccuugg

SEQ ID NO: 150085 - RNA, 30 nt, Homo sapiens
cuguccucagagccaguacugaucuagggg

SEQ ID NO: 150086 - RNA, 41 nt, Homo sapiens
accuuccagccacugcugugccucagccaccuaggagccau

SEQ ID NO: 150087 - RNA, 47 nt, Homo sapiens
agaaucuuuuauaucaaguaaaaugaaaguugaugauagaauaucaa

SEQ ID NO: 150088 - RNA, 46 nt, Homo sapiens
gauuuuggucccacagagcaggggauguaguuuguacccaccaugg

SEQ ID NO: 150089 - RNA, 47 nt, Homo sapiens
uuccuucguggaggaaguggacucgaauccuggaggaggaaauaaag

SEQ ID NO: 150090 - RNA, 28 nt, Homo sapiens
agcugccuggaugagcgcccaugcagca

SEQ ID NO: 150091 - RNA, 43 nt, Homo sapiens
ugccccggugguccccagccaucaucucuuaacuacggaggcc

SEQ ID NO: 150092 - RNA, 45 nt, Homo sapiens
ccaucucucgccucugcgaggacaaguacaaggaccuaagaagau

SEQ ID NO: 150093 - RNA, 47 nt, Homo sapiens
ugguagaaaugugggcauuaaaggugauucuggugaagacucagaaa

SEQ ID NO: 150094 - RNA, 43 nt, Homo sapiens
uguccucauaagaagagauuaggacacagacaacacagaggga

SEQ ID NO: 150095 - RNA, 46 nt, Homo sapiens
aauuguuuugauaaugauagccuuaaugucuguucuuuugaugggc

SEQ ID NO: 150096 - RNA, 46 nt, Homo sapiens
aggugugggaugaccaggcuguauggaauguggauuacugccagau

SEQ ID NO: 150097 - RNA, 94 nt, Homo sapiens
cuuuguuccucaaagggauuuuaaguucuaaccaaaacacgcaacagggcaacaggguugagauuuuuauguagggaaauucagugaagggaaa

SEQ ID NO: 150098 - RNA, 77 nt, Homo sapiens
caaucaaguaaucauuagaugauuaggaaugauugcagguuccuaugucauaauugaguaauguauguacugcccag

SEQ ID NO: 150099 - RNA, 49 nt, Homo sapiens
gaaggacucuuugugucuccgccacaugaagagcugugugcuccgaggc

SEQ ID NO: 150100 - RNA, 34 nt, Homo sapiens
uaagugcagagcucagcccgugggagccccacac

SEQ ID NO: 150101 - RNA, 48 nt, Homo sapiens
uacauaacagaugaguauaaaauuuuuccaguuuugaccacaccuaau

SEQ ID NO: 150102 - RNA, 51 nt, Homo sapiens
cauucauuugccaguuuuuaaaaaugcaacuucaagacauuugcuucaagc

SEQ ID NO: 150103 - RNA, 93 nt, Homo sapiens
ugaccauggcucucucaccaacaaagagaacgugggugggauccuuucuguggggccuuuaauuccauauuuuuaaauggaguuuauaaggga

SEQ ID NO: 150104 - RNA, 45 nt, Homo sapiens
ugcuccaccauuuuccuagaugauagcacagucagucaaccaaac

SEQ ID NO: 150105 - RNA, 74 nt, Homo sapiens
gaggauuaagugaaaggagaccacuucucaaggaauuauuccagguuuugaagcuugaagccauuugaaaauaa

SEQ ID NO: 150106 - RNA, 33 nt, Homo sapiens
uguuuuacagaugaggagaugaggcacaaagaa

SEQ ID NO: 150107 - RNA, 57 nt, Homo sapiens
auuaaccauguaagugaagcugucucccuguguucuucauaaugacuguacagugua

SEQ ID NO: 150108 - RNA, 43 nt, Homo sapiens
gcugaaguuucugugcuucugaagaaauccuuuggccuuagau

SEQ ID NO: 150109 - RNA, 62 nt, Homo sapiens
cauggaauucaauccuucagaucauccucgggccagcacaauauuccucaguaaaucucaga

SEQ ID NO: 150110 - RNA, 54 nt, Homo sapiens
uggcauucuaaguuguuuauaccauccugacaaguuguagaccuuggagcuugu

SEQ ID NO: 150111 - RNA, 23 nt, Homo sapiens
ugaaugcaaaucuuguccaucug

SEQ ID NO: 150112 - RNA, 40 nt, Homo sapiens
agaagcuggaagccuaaagagcuuauccuaacaaagacau

SEQ ID NO: 150113 - RNA, 48 nt, Homo sapiens
uaaaaucauucagagauugagaaaaaacagcaacacauaacaacaaua

SEQ ID NO: 150114 - RNA, 41 nt, Homo sapiens
gaggacacgggcugcaaccugcagcacaucagcgaccggga

SEQ ID NO: 150115 - RNA, 46 nt, Homo sapiens
ggaacacuaccucgugcugcgugucguccagucccaagcuccggag

SEQ ID NO: 150116 - RNA, 58 nt, Homo sapiens
caaccaggucuucuguuuuucuucagucuuuccauauaccaagcuuguucagccccgu

SEQ ID NO: 150117 - RNA, 45 nt, Homo sapiens
cccucugcugggacucuuccuggaagccuggcuucaucuucuaau

SEQ ID NO: 150118 - RNA, 27 nt, Homo sapiens
cuaagccucauuuuguguaucugugaa

SEQ ID NO: 150119 - RNA, 45 nt, Homo sapiens
guuaguguauccguggagguuugugguaaagaugaguccagacaa

SEQ ID NO: 150120 - RNA, 46 nt, Homo sapiens
gggccucuagugagcacacgcggacaggcagggauuagcucagggu

SEQ ID NO: 150121 - RNA, 42 nt, Homo sapiens
ugagucuaggaugugacacugaaaucauggaaaggagaugaa

SEQ ID NO: 150122 - RNA, 45 nt, Homo sapiens
cuacaugagaaaagccaaaugcucgagagaaacaggcuucuucug

SEQ ID NO: 150123 - RNA, 47 nt, Homo sapiens
gcaggacugagucucaacugggcagcagcaggggguauccuuucuca

SEQ ID NO: 150124 - RNA, 48 nt, Homo sapiens
cuggagacaaaggugggagaggagauugugaaaucccuugcaccugac

SEQ ID NO: 150125 - RNA, 67 nt, Homo sapiens
uuugaguuuaaccaccugagggauugggauagaaauaguaguugaguugaguacaauaagaaaaguu

SEQ ID NO: 150126 - RNA, 46 nt, Homo sapiens
auucaggaaggaacacaauguaccaaauguaaaaauaacugggcac

SEQ ID NO: 150127 - RNA, 48 nt, Homo sapiens
guacauccucugccccgggcuuuuuaucauuagucaacagagcuucca

SEQ ID NO: 150128 - RNA, 46 nt, Homo sapiens
caucucgccaaaccuaugaugacaagcucacagcaguggaaaguga

SEQ ID NO: 150129 - RNA, 85 nt, Homo sapiens
gaucuccgucagcaacuucgugagauuacagaaaaaaccagcaagaacaaggauacgcuggagaaguuacaggcgagcggggaug

SEQ ID NO: 150130 - RNA, 46 nt, Homo sapiens
aacgacacccuggaggauaugaacagccagcucaacucauucacag

SEQ ID NO: 150131 - RNA, 50 nt, Homo sapiens
ugaacaucauuagcaauaucaguuacacagcccaccaccugcggacgcug

SEQ ID NO: 150132 - RNA, 84 nt, Homo sapiens
uccguuuggauucuguuucucucaggaugcaacaagauuugaugaggucgagguuagacacugaaguagccaacuuaucaguga

SEQ ID NO: 150133 - RNA, 46 nt, Homo sapiens
gacuccaagcauggucagcucaucaagaauuuuacaauacuacaag

SEQ ID NO: 150134 - RNA, 48 nt, Homo sapiens
gaggaucccagggacccccuggcccaacuggcaacaagggacagaaag

SEQ ID NO: 150135 - RNA, 43 nt, Homo sapiens
agcgguggugccccuggcccugcagaaugagccaaccccagca

SEQ ID NO: 150136 - RNA, 46 nt, Homo sapiens
ucugugaagacaagucuucacaucuuguuuucauaaacacuagaga

SEQ ID NO: 150137 - RNA, 48 nt, Homo sapiens
aaacagaugguagggagagagagccacuggaucggccucacagacuca

SEQ ID NO: 150138 - RNA, 54 nt, Homo sapiens
ccggauaacuggggucauggccaugggccaggagaagacugugcuggguugauu

SEQ ID NO: 150139 - RNA, 47 nt, Homo sapiens
ggaacgauuuccaaugugaagacgucaauaacuucauuugcgaaaaa

SEQ ID NO: 150140 - RNA, 44 nt, Homo sapiens
uaguacugucaucugcauuauaacggacugugaugggaucacau

SEQ ID NO: 150141 - RNA, 57 nt, Homo sapiens
caauuacugaaaaaaaauugacagcuaguguuuuuuaccauccgucauuacccaaag

SEQ ID NO: 150142 - RNA, 45 nt, Homo sapiens
ccuccgucaguaaccgugcgauuauacaaauuaugucuuccaaag

SEQ ID NO: 150143 - RNA, 55 nt, Homo sapiens
aauuuuuuuccuuuuuuuuuuuuugucauuuuaccgacauaauacauggagccaa

SEQ ID NO: 150144 - RNA, 45 nt, Homo sapiens
uaaauauaaaaugaauguacuaauaccugucucacagaauucuug

SEQ ID NO: 150145 - RNA, 91 nt, Homo sapiens
aguugggcugacgagcaacuccuuaaucccaccuagggacuuuguagucugcgaaucaauacaguggcuaaauuauuaaauguccucccua

SEQ ID NO: 150146 - RNA, 50 nt, Homo sapiens
uuuggcacuuccuuuguucuccaguuguuuuguucauucaguaaauuuuc

SEQ ID NO: 150147 - RNA, 38 nt, Homo sapiens
guaugaagaauuuguuagacauacuaagaaaggaauag

SEQ ID NO: 150148 - RNA, 46 nt, Homo sapiens
augaaugauuccauuugaagugacugcuggcaggaaaacugggcag

SEQ ID NO: 150149 - RNA, 57 nt, Homo sapiens
uaugaaaaaauuauauacugcucucucgggagagccaaauaaaaaccauguguggag

SEQ ID NO: 150150 - RNA, 48 nt, Homo sapiens
uuuucuguguaacguucauuuucauauauuguuagaucuccuaagaag

SEQ ID NO: 150151 - RNA, 42 nt, Homo sapiens
auagagaagaaggaauggauguagaagaaggcgaaaugggag

SEQ ID NO: 150152 - RNA, 51 nt, Homo sapiens
aucuccuaauuuauugaguauccucucuggagugaggagauagacaaggag

SEQ ID NO: 150153 - RNA, 44 nt, Homo sapiens
gguuucuauauuaugugcagacaguucauuguuuauauagacua

SEQ ID NO: 150154 - RNA, 37 nt, Homo sapiens
aaguuagcccaauacacacaggcacuggguccacaag

SEQ ID NO: 150155 - RNA, 64 nt, Homo sapiens
ucaccucagacaccuggaagagugccagugaaggaaaauuuuccuuaaugccuucucuuuucuc

SEQ ID NO: 150156 - RNA, 40 nt, Homo sapiens
gucauuaguuauaauugaaagaauuuccauuacugucuag

SEQ ID NO: 150157 - RNA, 50 nt, Homo sapiens
ggugacucaucaucuuguagccuacuaacuugccccagagcccuuauguu

SEQ ID NO: 150158 - RNA, 43 nt, Homo sapiens
aacacucagcugccucugucacagucacuaauguugaauagag

SEQ ID NO: 150159 - RNA, 46 nt, Homo sapiens
uuuuaagaguuauaaauuagaugauacucaggccucaagaaaaaag

SEQ ID NO: 150160 - RNA, 32 nt, Homo sapiens
agaaacaagauaaauaucuucauggaccagaa

SEQ ID NO: 150161 - RNA, 52 nt, Homo sapiens
aaaacucugauaaauuaaaauuccaaaauccauaaaucuaaugcuaagaagg

SEQ ID NO: 150162 - RNA, 50 nt, Homo sapiens
gagaugugugauagguugucuaguguacaaagcuggagacuaggaacaag

SEQ ID NO: 150163 - RNA, 57 nt, Homo sapiens
uuuauaaaugguaauucaaacuguagaguguaugaaaugagcuaaaggggagagugu

SEQ ID NO: 150164 - RNA, 45 nt, Homo sapiens
uuuuugagggagcuuauuuaaugcuuauggaaaggagcuuggaaa

SEQ ID NO: 150165 - RNA, 45 nt, Homo sapiens
cucauuuuauuccaauaucucaaggggcaggucaaauucaaaagg

SEQ ID NO: 150166 - RNA, 45 nt, Homo sapiens
ugauaaacugauuuuguaguaucuucaauccaaagugauugcuca

SEQ ID NO: 150167 - RNA, 25 nt, Homo sapiens
ggacuuccuagggaaaggacccacc

SEQ ID NO: 150168 - RNA, 46 nt, Homo sapiens
augcccacuuuggaggaauucuuugaagaagccauugaacaggcag

SEQ ID NO: 150169 - RNA, 56 nt, Homo sapiens
uguuacuccaaaauuugaguuaggcagaggaugaggaggcugaaauggaaugugag

SEQ ID NO: 150170 - RNA, 46 nt, Homo sapiens
ggagaagcccucacuucuuccagccaaccaaccagcaguuuaaaag

SEQ ID NO: 150171 - RNA, 41 nt, Homo sapiens
cuugguaacaaaaucuaucacaguuuuaauaaaaagaaaaa

SEQ ID NO: 150172 - RNA, 49 nt, Homo sapiens
cuagguuaggccuaagaguguuuaccgaauaaucugcacucacucagua

SEQ ID NO: 150173 - RNA, 50 nt, Homo sapiens
uaccuuugauuauacauuuauuauugugucucucucugauguacugugga

SEQ ID NO: 150174 - RNA, 84 nt, Homo sapiens
gaagacacauagguggguuuauguuucaccucauuuggaacaaaagaggacagaagcagaccacucugugcaccaaccuaaaaa

SEQ ID NO: 150175 - RNA, 46 nt, Homo sapiens
gguggagacuggcauaucgcuuacguucuacucuaugggccucgca

SEQ ID NO: 150176 - RNA, 42 nt, Homo sapiens
auuaaguuugaugaugacaaagucagcaucguaacaccagaa

SEQ ID NO: 150177 - RNA, 42 nt, Homo sapiens
auuggcuccaauaauuguggauacuaugacuuacaagcagua

SEQ ID NO: 150178 - RNA, 42 nt, Homo sapiens
cgauuuuuuuauaaagagaaggaaucugugaaugccaaaguu

SEQ ID NO: 150179 - RNA, 47 nt, Homo sapiens
uuaugacuuuuuucaaauuuaacaauaauucauuggugcugauuggc

SEQ ID NO: 150180 - RNA, 46 nt, Homo sapiens
uauugcaacagaaauuggaagcaauagaggaugauucuguuaaaga

SEQ ID NO: 150181 - RNA, 70 nt, Homo sapiens
uuaaaguaggcuccaucuaaauucccuuuucagcauuccuuuuuuucuccauauuucuggucaugcaaga

SEQ ID NO: 150182 - RNA, 55 nt, Homo sapiens
ccuacaaccuuaagugaccuauuuaaugauacacagcaagcuaaugcugaaugua

SEQ ID NO: 150183 - RNA, 62 nt, Homo sapiens
uaguuuaaucauaguguauaugcagucucccucucacuucaguguuugauauuaacugaaug

SEQ ID NO: 150184 - RNA, 48 nt, Homo sapiens
agaaaauucguugagucacaucaguuuccgaaagaugcaaacaaauga

SEQ ID NO: 150185 - RNA, 38 nt, Homo sapiens
uaagcugucauuuuacuuucuuuuuuaaaauuuauuuu

SEQ ID NO: 150186 - RNA, 45 nt, Homo sapiens
gauuuuguuugagauuacauugaaucuguagcucaauuuggggag

SEQ ID NO: 150187 - RNA, 46 nt, Homo sapiens
accaaaauacauuccagaugacuuuuuuucauguguauauccaguu

SEQ ID NO: 150188 - RNA, 46 nt, Homo sapiens
uuugaagguguagaauugaauacagaugaaccuccaaugguauuca

SEQ ID NO: 150189 - RNA, 27 nt, Homo sapiens
aacaccauucucuuuuuguauguauga

SEQ ID NO: 150190 - RNA, 26 nt, Homo sapiens
auuugauccuuagccagcuuccaguu

SEQ ID NO: 150191 - RNA, 33 nt, Homo sapiens
cucugcagaauaguuucugacgcugcccuggug

SEQ ID NO: 150192 - RNA, 48 nt, Homo sapiens
agcugcuccugguccccgucccuuugccgcccucgucaggcccagcuc

SEQ ID NO: 150193 - RNA, 27 nt, Homo sapiens
guaagauaaauguaugauauuguggau

SEQ ID NO: 150194 - RNA, 44 nt, Homo sapiens
ugaggaaacaaugugucgcauaucaguacacaggagagaaggau

SEQ ID NO: 150195 - RNA, 114 nt, Homo sapiens
uuaaauccuggagugaauuauugaggggaccuggcuugccuggaugacugcucgaauauagcccugagaaggcagaggaauauguaaguggacaaccgaagaguaaguaugggu

SEQ ID NO: 150196 - RNA, 8863 nt, Homo sapiens
cguacguucccuuccauuucucguguuccauuuuacuuaaaguacagaaugauuuagaauauuuaauaauccaaacacaaauagcauauauguguucauauuguaggaauucuaaguuucugaacauaaauauagucauuuauugauguucuuaauguuggcuuuaguuagccacuuucuuugaaagcuuuucuuguauuaaauuuugugugugugauugaggagaguuuaaugauuaagggauaauuuaugaagaagccagcagggaaggugaaacaccggugccaagcugcagugggcgggccuccuggagcacagcaugagcugcagcuguagaggggcuuccaccuggcgcgggagagccaggggaugaacagcuguagacgggccucggccuggcgaggggagccagggguugaacaccccagccucucuccucccuucuccugccauugcugcugguggcugaacccaacaguagugagaauguuaaggggccuggugacaggcagacacacugcagugcugaagaagcuaagccuugaggccccuuccgaggccuuguaccuguuccuuuagucagguuuauugagucugauuugccugcuguaaaacugaaccuuuuugguauacagcucugugaguguuaagaaaugcauagaguuguguucuagauauagaacagauccaucggccuccaaauucucuuccuuccuuuugucgucaaauccuucccagcucgcagccccuggaaacuacucaucuguuuuuuuugucccuauaguuuugcuuuuacaagaguaucaucuaaauaaauccuauagggugcaaccuuugcgcucagcauguugcauuaacguauggugauuguuuugucagauauauuuccuauguuuggggugggaugcuggaaauuaggacaagcauugagauauagcaucugcaaaaugcuaauguaagugguaggaguuuucucauaaaagauguacgaguuggucuuagcgguauugggguuaugccauucgaauuuguaagaagagagugguuuagaagggucuugguaauuaaauuugugguauagaguucugguaaauauacaguguguagugcuccuaggaaaauaguaguaguuagggcauuuauuaugauaauauucauguauucugcuauaaagaagggggcaaaugagccugcggcauauucgauguugaagccugagacuaacucugacucuccuuuuguuagaucaaaagaggcucaguuaguuucugcuaguguggggauaaaucauauuauggcuaggggccaugaugauaggagcagucagaggaauucuugugaugaguauguguaaguuaaaugagcugcuuaucaguagaacugauagcuggauaauagcuagggugacuucauaugaaaucgugugggccacagcucauagugcgcugauuagugcauauuuugaauuagaugcucauccugaucauagaauagauagacggcuaggcuugauguggcuaguuuaaauaggaggccuacauuaaaauuagaggaucugguauagggagggggguucauaagaggagagcgauagagagggcuaggauuggagcaauaauauaaagggugauaguagauguuaagggccgcgaggguucuuuggugaaaaguuuuauugcaucaaaaaaugguucaagcagucuguaaggaccuacaauguugaguccuuugcauaguuguauauagccuaagauuuuucauucgaugaguguaaggaacgcuaucgcgauaagaguggggauaaugagcaggaggagguuaauuacaggcauguuguuaagaagaggaguugaaccucugauuauaaaguguuaaguuuuaugcaaucgcugggcucugccaucuuaacaaacccuguucuuggguaggaugugugaugauuuaagagacugggauggcaucaucuauggagugagggcacuuuaugaagugggcccuauuucucuuguccuuucguaguaggaggaauguuaaguagguagaaaccgaccuggauuacucuggucugaacugagaucacauaggacuuuaaucauugaacaaacaaacucuuaauagcggcuacaccauuaggauguccugauccaacaucgaggucguaaacucuauugucgauauggacucuaguauaggauugcgcuguuaucccuaggguaacuuacuccguuuaucaaauuauugggucgauguguaauaacucacuuagacuuguguggucuuagguuguuaggagguugaauuaugcuccgaggucaccccaaccaaaauuuuuaaugcagggauaggaggcuagggccuguaggcuuguuggaguuuuuauuugcauugaugaauuaaagcuccauaagguuuucucgucuuauuuguuuauauccgccucuucacggauagaucaauuucacugguugaaaguaagagacagcugaaccuucguguggccauucauucaagucccuauuuagagaacaagugauuaugcuaccuucgcacggucaggauaccacagcuguugaauauaugucacugggcagauagugccucuaauacugguaaugcuagaggugauguuuuugguaaacaggcgggguaagauuugcugaguuccuuuuauuuuuuuguaauguuuccuuagagcaugccuguguuggguuaacagugcaaauaauacgguguuuauuauaucauuuauuaauauugggauguuaacugucaguggguuacucccgucugauguaagcuuaugcaauggagaaugucuucaucuuacuuacauuaacauuacugcuucuauuaaguaauagauuaguccaaugugauguuaggaguucaguagacugguuagaauuuaagauaguuagauauugagcuuaaaugcuuucuuaauuaguggcugcuuuugggccaacuguggugguaauguuuuuuacucucuguaggaagggucuaaagagcugucugucucucuagacuaacaguuaaacuuacagggaguuuaaguaauucuguggguaaguugaaaguugaacuaagccagccagcuaucaccaggcucgguaggcgugucaccgcuacucaugaaucuucccacuguuuugccacauaggugagugugcucuuucagcuauucuuggguagcucgucugguuucgggggacuuggccauaguucuauguaaaguuauuucuaguuaaugcauuaugcagaagguauaagggcuugucuuugcuuuuuaguccucaauacaguucuuucauccuucccuuacaguacugugucuauugccagaaauaucuaccaggguagaaauuucuaucgccuauacuuuuguuuaagguaaaugguuugauuaagauaguuugauaauauuuuuagcgagguuuggggcuagaguugucugaguggucaggucaugaugaaaucuucuggauguaagccggaugcuuuggguuaagcuacacuuugguuuauccaagcgcacuuuccaguaugcuuaccauguuacaauuuaucuccucuauaccuguguagaaaauuaucaguaauagugauuucuagaguaguauucgaggaaggugaugggcugugugugcgugcuucauggccuuauucaaccaagcacucugcucuugguuuacugcuaaauccuccuuaagcccuuagauuucauaaggcugucaugagauuuucuggacauagaaaauguugcccauuucuugccaccucaugggcuacaccuugaccuaacguuuuuauguguauacuugugcuuacucuauaaccuuuuuaggguuugcugcagaugggcauauaggccaggggcaagagguggugagacguaucgggguuuauugauuauagaacaggcuccucuagagggauauaaagcaccaccaaguccuuugaguuuuaaauuguugcuuguaguacucuggcgaaugguuuuguuaauguaacuguuaggguuuagggcuaagcauagagggguaucuaaucccaguucuugucuuagcuacugugucuucaggguauuaaagcuacuuucguaguauguuuuauuucaacuggaguuuuuuacaacuuagauggagcuuagcacucuuuacgccaaguucuauuagcuuggguuaacuguauggccaugguggcgggcacgaaauuaaccaacccuaaauauuaguauagcuuaguuaaacuucuguuuauuacuagauuuaacacugcuguuuccugugggggugugguugagcaaaguguuuugagcugcauuugugcaugcuugauaccugcuccuuuugauccgggugaucuagaggacauuuucacugggguagggguguuugcauguguaaucuuacaaagaacuaauaaaaaggucaggaccaaaccuaucuauaagguuuuguggacccaucuagacauuuucagugucuugcuuugagugguuaagcuacauuaacuguguagaauacuuaaguggaaaauuaaaguaugagaaagaaagaaagaaagaaagaaagaaauagaaauaguugcuuacaguucuggaaauucagggucuuuaaaguuggauuggcagagguuuggcugagaggguuauucauaauuagaguaugguugauuuaggguuaugguguacuggggcagcacuuucagaggguuaugcucaagguaucauaucaguauuagggcagaaguuuaguuaaucuauuauacauaguggaggauuuauuggguaggaggagccuuaagauuuuuuagaaaauuacaucaaucgagggguagcuguugggguguucgugguuaaaauaugucugggcucugacuggguugcauuuuaguuucuuguguuugggguuuggcaaagguauguuuaccuagguugaugguaaagucagauuaggaggggggaguuugcggauuuauucggaaauaguucuugaaauugagcauacgugcaugcgugagcaucuauugauuaauuguuaaguccuucaaccaugaauuaacaccuuaugguuguuaugucaguccggaauauucaguauaaguucagcuacaauggauuuggcaggagucaggcuguugccaugcugagucacagcaucccaaaguuaaaaaauaccaaaugcaugacagugcucccgugacuggcuaauagggugguagugauuaauccaucaagaugucuuauuuaaagggaaccuaugggcaaucuuaauuuuauggccauacguuaaugcagggguccccaacccccaggcuguggaccagaacagguccauggccuguuaggaacuaagcugcacagcaggaggugaauggugggccagugagccuuacugccugagcuccgccuccugucagaucagcggcggcauuagauugucacaggagcucgaacccuguugugaagugcacacgugagggaucuagguugugucuuccuuaugagaaucuaaugccugaugaucugagauggaacagcuuuauccugaaaccauacccucacuucaccccagucuggaaaaauugucuuccaugaaacuggucccuggugccacaaagguuggggaccgcugcuuuaaugugaucuuauuuagcuuauauauaagaaauaauucuguguauaaacauuuugacauaguuuaggggccacaguugcucccauuuuauucaguagcaaggaucagcuucucugaggcauuuuuaucaccuguaaaaugucuuccugacauaccugauuaaguuauugugacacuacauuaauagauauaugaaaaguuugaaaagugaagcauucauuucauaugcaacuuauuuuuaguuuacacacagaaaaguagcagcaugaguagauuugaaacauuucuaauguauuuugucugucuuuacugaucgggcaacgggucagaauuagaaaguuucuuauaaaguacggcaagaaauagaauuaacuaaugcaggaauccuuuugcucaaauguuaucuaauggcuauuggaauuuauaaaacggaaucuaaguuucauagcaucuagugggaggaucagacacaggaaugagaguuguacguucugacggggaggcaggaugaacuggugcugggugggaaaaacaauacagaaagcagcuguaaaguuuggaaaggcuucugugaaugcuuuacagaagacaagaauagagguaaauuuuuguuuguuuguuuguuuuugaguguugcucuguagcccaggagugcaguggugcgaucucagcucacugcaaccuccaccuccuggguucuaagugauucuccugccucagccucccaaguagcugggguuacaggcgcccaccaccacacccagcuaauuuuuguauuuuuaguagagaugggguuucgccauguugccgagacugaucacaaacugcugagcucaaagugauccacccgccuuggccuccccaaguucugggauuauaggcaugagccaccacgccuggccagcagagcugauucuugaaaaguaaaccauuugccuauagcuuuuuaagcauugucucauccaauugaggccuggguucaaauuucagcucugucucuuccaggcuuuugacuuugccaaguuguuuaaucuuucuaaauuuguuuucuuguuuagaaaaugaagguaggcugggugcaguggcacuuugggaggcuugggaugaaggauagcuugaggucaggaguuugagaccagccugggcaacguaaggagacccggucucuacaaaaaauagaaaaauuagccggguuugguggcgcacaccuguagucccagcuacuugggagacugaggcaggaggaucacuugaucccaggagacugaggcugcagugauccaugaugacaccacugcauuccagccuggcaacaacccugucucaaaaaauaaaaaaaauuaucugagugugauggcacaucccuauaguccuagcuacucaggagacugaggugggaagaauccuugaguccaggaacuggagaguacagugagcuaugauugcaccauugcacuccaagcugagcaauagagcaagaccgugucucuaaaaaaauaauaaauaacaauaauaaaguaaauaauaaaaugaagguaauaacacauaauaacauuauuaauucagcaaauaauugucaggcaccuauuguaugcuaaauccuggagauaaaguggaaaucaaaguaggcaaaaccuacacuucugaaacucaugaucucuuaggacaaacaagaagaacaaauacaacuucucgauaguggaaaauugugaugacuagauuaaaccuacacggaaggauuagcacagugcugucacaaagugguuaaggagcuugccugugagaacaaaagugacuggcugagccuaggcccagaccuuccuggugauggagcccaugugcuuagcagccucccucauggagcuuuacaggaagagucggagcuacccgggagagaaagacauguagguaaaggcacaggggcgcuaaagacccaaaguuaccuuggaggcauaaaagccaaacuugguaaaguugaaucuucaguacuuuaaggacaugguucaaacucugcaguugaagcagguagacuuagagcagcugguggagcauucacacauacucuuucucuccccaguguuuugcuggauucuccuuuaugucugcacguguccacugagguuggcaugcucugcuccacaaugcugaugacgugguggggcuggcauuaugagauugagaggccaguguucacuuggacucagggcagcccucuccauacacucauaccuuuccuuugcuguguuuucaaggauuuguagaauuacaaccucauuaaaagcaugaggagcaaguuuuaucucuucuuucaaaugaagucacuucaauggaacaaguuuuugcuagaggagaaugguggucaauuuuugagcucuggaaccaaaaaugaaauauagacuaggccaagguucagcaaacuauggcccaugagucaaaccugacccauugucuauuuuuguaaauaaaguuuuauugaaaugcagccacacucauugacauaauaugucugggugcuuucaagcugcagugacagagaagaccuacuuugaguucucugugugaauauugugaaaccaucacacagugaccacuaauuuuuaaaucuauuugacaaguuagauaggaccaaugacuguuguaaauuggcauagcuuuauugcauguacuuggaaguguuauuagauagggaccgaauaaaaguaauuaagauuauaguuauguguuuuguauauagagagaaagauaaaugugacagaauguuuacaauugaugaaucuaugugaagugcuuauggguauuuuuuguauuuuugcaacuuuucugaaggcuuaaauuuuaucaaaauaagaaaaaaauuuuaaagugguccaugguugcugcugagaggagaccugggaucagggacaagagaaagaguuuguuuucacuaguuugugauuucugauuuuuaaaauccuguuuauauguucucgcuuagaaaaguaagucaaucaugaaauagaugaaaaugaauuuuuuguaugaugcuguaguuugcaguacacugguccccaaacaauuggaaaaauaaagauugccaaaguuugccucaauauguucaacguaguaucuaaauauauauauaguuaaagauuuaauuuuucuuaaaaugcaaaauuuucuccauuuuauuuuaggaugggagcaaaguguuuacggcaucgugugauaaaacugccaaa

SEQ ID NO: 150197 - RNA, 126 nt, Homo sapiens
cauuagaucgaugacauuuaaaggugaaguuaucuuuggcgcugaaagacaaagguucauguaagucuuccuuuguuaaaaaaaguccagugaaaucugcaagcugacagagucacacuuacgggu

SEQ ID NO: 150198 - RNA, 140 nt, Homo sapiens
ugcuauucacuauaucaaccccccgaacccguaagugugacucugucagcuugcagauuucacuggacuuuuuuuaacaaaggaagacuuacaugaaccuuugucuuucagcgccaaagauaacuucaccuuuaaauguc

SEQ ID NO: 150199 - RNA, 45 nt, Homo sapiens
ucacccucuggguccgacagcacacagaauccuucaaccgaacac

SEQ ID NO: 150200 - RNA, 45 nt, Homo sapiens
ugcugucggacccagagggugacggcgccgcuaggaugaagcucg

SEQ ID NO: 150201 - RNA, 26 nt, Homo sapiens
gaugaugaagaugagggaagcgggag

SEQ ID NO: 150202 - RNA, 48 nt, Homo sapiens
gugaacuguguccuaaucaggauggaauuuucaaggagacagaugcug

SEQ ID NO: 150203 - RNA, 34 nt, Homo sapiens
uccuauuguaaaaugucuuugcaagagagagaga

SEQ ID NO: 150204 - RNA, 46 nt, Homo sapiens
ucaguacagauaucuuuccaguggacaauucagauacuaguucuag

SEQ ID NO: 150205 - RNA, 42 nt, Homo sapiens
uuuugcugagguuaaacgggaaguuucuggcaaauuugaaac

SEQ ID NO: 150206 - RNA, 44 nt, Homo sapiens
auccgucuaacauaguuuucggccuugucgcuguuaucugcagu

SEQ ID NO: 150207 - RNA, 49 nt, Homo sapiens
ucuguucauucauuauuuccuggagcaguucuaaacugggaugacuugg

SEQ ID NO: 150208 - RNA, 40 nt, Homo sapiens
auguguugacuaacaagagucucucaugggaggaugggca

SEQ ID NO: 150209 - RNA, 25 nt, Homo sapiens
caauuucaguugaacuaguccagca

SEQ ID NO: 150210 - RNA, 77 nt, Homo sapiens
acacaucgcuccagaaccacccgucaacaauuaugcuuuaggccucagcauuagaagccaaacuaccagcucuaggg

SEQ ID NO: 150211 - RNA, 38 nt, Homo sapiens
caauaaauuaacuuuguacacauuuuuauauaaaaaaa

SEQ ID NO: 150212 - RNA, 54 nt, Homo sapiens
cuagaucuggaggcaaccacaggacacuaaacuucucccagccucuucaggaaa

SEQ ID NO: 150213 - RNA, 42 nt, Homo sapiens
aaauuuuccagauauucuacuucaggauguauuuggccaugg

SEQ ID NO: 150214 - RNA, 42 nt, Homo sapiens
cguucacggugagcaugaaaggcagccgcguggagcgcgcgg

SEQ ID NO: 150215 - RNA, 45 nt, Homo sapiens
cacaccgugcugcagaccucugcugacuuuauugacgcucugaag

SEQ ID NO: 150216 - RNA, 48 nt, Homo sapiens
uggccaaggaggauguuaacugcagaacuauaggcagcauguccccug

SEQ ID NO: 150217 - RNA, 55 nt, Homo sapiens
ggacaugcugccuauaguucugcaguuaacauccuccuuggccauggcaccaggg

SEQ ID NO: 150218 - RNA, 41 nt, Homo sapiens
ggcagccaguuacccacggaagccagauauauggcccaaaa

SEQ ID NO: 150219 - RNA, 46 nt, Homo sapiens
augagauuccugcccauguuccuuucggauaacccuaaccccaagu

SEQ ID NO: 150220 - RNA, 366 nt, Homo sapiens
auggauaaaagauugaaauguaagaacugggccaggcgugguggcucacgccuguaaucccagcacuuucggaggccgaggcggguggaucacaaggucaggagaucgagaccauccuggcuaacacagugaaacccuaucucugcuaaaaauauucuuuaaaaaauuagcugggugugguggcaggugccuguggucccagcuacucgggaggcugaggcaggagaguggugugaacccgggaggcagagcuugcagugagccaagaucaagucacugcacuccagccugggcgacagagugagacuccaucucaaaaaaaaaaaaaaaaaaaagaaauguaagaacuggaagaaaauucaggag

SEQ ID NO: 150221 - RNA, 45 nt, Homo sapiens
aaccaguuaagaauccagauagguuuucuucuccucacuuggugg

SEQ ID NO: 150222 - RNA, 32 nt, Homo sapiens
ucuggucagcccccagcagccaggcucgccug

SEQ ID NO: 150223 - RNA, 45 nt, Homo sapiens
ugacccugucagcgcagcauuugagggcugcuugaggcggcuguu

SEQ ID NO: 150224 - RNA, 49 nt, Homo sapiens
auugaauacauguucaauaaggacaauggacaggcaccuuuuaccauca

SEQ ID NO: 150225 - RNA, 45 nt, Homo sapiens
uuacaaaccagacgaaaacaaaugugaaagaguuacaauacuacg

SEQ ID NO: 150226 - RNA, 42 nt, Homo sapiens
uauggggacaagagguacaauugcgaauauucuggcccacca

SEQ ID NO: 150227 - RNA, 36 nt, Homo sapiens
aggccuggugcacacacaaauuauccuuuguuaugu

SEQ ID NO: 150228 - RNA, 75 nt, Homo sapiens
ccaggagucgggaggagggcaaggcgcggagggagaacgagcgugcggauguggaaggaaagggaaagggaaggg

SEQ ID NO: 150229 - RNA, 34 nt, Homo sapiens
cgaggcugggagaaagugagagggggacugcggg

SEQ ID NO: 150230 - RNA, 50 nt, Homo sapiens
accucgcaggcgccucggcgcggcacucacguagagcccaaggagcaguc

SEQ ID NO: 150231 - RNA, 47 nt, Homo sapiens
cugcgucccccucagccauguggccccuggaccugcccugcagccgc

SEQ ID NO: 150232 - RNA, 37 nt, Homo sapiens
uaaaauaaauagucacuuaaagagucuacuauacucu

SEQ ID NO: 150233 - RNA, 43 nt, Homo sapiens
aagaagaaacucuccaagaucaaucuuaaaugagcuccuauuc

SEQ ID NO: 150234 - RNA, 47 nt, Homo sapiens
gaauaagcagaacauacuguucucaacauacuguaaucaaaaggagg

SEQ ID NO: 150235 - RNA, 46 nt, Homo sapiens
uucauguggugaauaugcaaggcgguacacuacgcacuggacagca

SEQ ID NO: 150236 - RNA, 40 nt, Homo sapiens
agacugaaaggugugaacagcuuuguauguuuaugaaggg

SEQ ID NO: 150237 - RNA, 46 nt, Homo sapiens
gggacaaggucagcaguauggaggauauagaccaacacagccugga

SEQ ID NO: 150238 - RNA, 35 nt, Homo sapiens
ugcaucuuagagggaaaaaaguuacuuaagcagac

SEQ ID NO: 150239 - RNA, 45 nt, Homo sapiens
aaaaagacuaaaacauuaaagauaauuuuuuccucaguggaaauu

SEQ ID NO: 150240 - RNA, 44 nt, Homo sapiens
aaugggagauaguuuuuuuucccucaaugaggauuaucagauuu

SEQ ID NO: 150241 - RNA, 45 nt, Homo sapiens
acucugucaacacaauauuaauuuuaugaagauguauguuuauga

SEQ ID NO: 150242 - RNA, 48 nt, Homo sapiens
acauguguauuguuauaaccuuucuguucaaaauauauugguuuguua

SEQ ID NO: 150243 - RNA, 49 nt, Homo sapiens
ucaguuuuuacugcauuuaauuauauauuuuugggacuauaugauaaaa

SEQ ID NO: 150244 - RNA, 34 nt, Homo sapiens
uuuuguccuaaauuaaagcuuaugaaauuauauu

SEQ ID NO: 150245 - RNA, 23 nt, Homo sapiens
cuuguugcaugucucugccuguu

SEQ ID NO: 150246 - RNA, 47 nt, Homo sapiens
cuuacauucacauuuaugagaauaaaauugaaaaggaggaaaaaaga

SEQ ID NO: 150247 - RNA, 42 nt, Homo sapiens
auaugaaaagcauacaacauaaaauaaaaaacacgucuuacu

SEQ ID NO: 150248 - RNA, 75 nt, Homo sapiens
aauuaaauguauuuggaauaaaauuuucuagauuuugauuuauaaaauaaacagagcacuaaaauguacccagau

SEQ ID NO: 150249 - RNA, 41 nt, Homo sapiens
aguggaggugcugcuguacuugucuuagagugguguaaguc

SEQ ID NO: 150250 - RNA, 58 nt, Homo sapiens
auggcuccccaguugucacaauaccauuuacugaauuaguuuucuauugcucacuaau

SEQ ID NO: 150251 - RNA, 57 nt, Homo sapiens
augguacuuugaauuaggauuuugacuuaaauucucuguguaacauugaagccuaag

SEQ ID NO: 150252 - RNA, 48 nt, Homo sapiens
aagagagcacagagcaaaagagguaagguagccuggcuuauagaagau

SEQ ID NO: 150253 - RNA, 41 nt, Homo sapiens
ggcccucccccaccuccacgcucucacaacaugccuucaga

SEQ ID NO: 150254 - RNA, 44 nt, Homo sapiens
uuuuagaaauacuuuguauucagaguacauuugaaacagcagaa

SEQ ID NO: 150255 - RNA, 45 nt, Homo sapiens
aguacaaauuaagacaucaguaucuuucugauauugaggugagga

SEQ ID NO: 150256 - RNA, 42 nt, Homo sapiens
gaagugauguaucugaaguaaauaauaugcccuaauagaauc

SEQ ID NO: 150257 - RNA, 52 nt, Homo sapiens
ugagucaguuuuacagcaucuuuaacauccccaaaagacacuggguauccuu

SEQ ID NO: 150258 - RNA, 123 nt, Homo sapiens
uaauuuuuuacuuuuuacuaacagcuuuauugagauauaauucacauaccauacaauucaccuauuuuaauguguacaauucaauguuuuuuaguauauucauagaguugugcugguauuacg

SEQ ID NO: 150259 - RNA, 50 nt, Homo sapiens
ugacaauaaccaucuuauucaguguauaauggacucucagaauaaaggaa

SEQ ID NO: 150260 - RNA, 46 nt, Homo sapiens
cccucuacugaguucuuucaguguccaagcugacugagaaagccac

SEQ ID NO: 150261 - RNA, 40 nt, Homo sapiens
ugggguucuccuuuucaccuugauccgccaugauagagaa

SEQ ID NO: 150262 - RNA, 46 nt, Homo sapiens
cugaaaccuggccuacccagcaccacagagaaguccaggccguaga

SEQ ID NO: 150263 - RNA, 42 nt, Homo sapiens
uuuuucuguugcagaccagaugucuucuuuccuggggcagcc

SEQ ID NO: 150264 - RNA, 53 nt, Homo sapiens
uuaggaaaucgugaagauaauugaguaauaaagcaaggcucuucucauccaga

SEQ ID NO: 150265 - RNA, 48 nt, Homo sapiens
agacuaagaacaaaaauguguuuacggagauccaaacauaagugagug

SEQ ID NO: 150266 - RNA, 46 nt, Homo sapiens
cugcaugaugugguagguaugcugggcucaggggacaugugggcug

SEQ ID NO: 150267 - RNA, 46 nt, Homo sapiens
gucaucaucuccuccucacagcccacauguccccugagcccagcau

SEQ ID NO: 150268 - RNA, 95 nt, Homo sapiens
aaggggguggguuugaaggccaggcccaagggguccucaggucuacuucugggaggggacagccuugaggaaggagucauggcaagccacagcua

SEQ ID NO: 150269 - RNA, 39 nt, Homo sapiens
ccacaugaagaaacuggaugucagcagugaugggcaguu

SEQ ID NO: 150270 - RNA, 63 nt, Homo sapiens
caaggacaccgggguccuucugguucuuuguaaaggcagccagcucuguauucaugaagcuua

SEQ ID NO: 150271 - RNA, 46 nt, Homo sapiens
cuccaagacggaguuccuaagcuucaugaauacagagcuggcugcc

SEQ ID NO: 150272 - RNA, 57 nt, Homo sapiens
ucaaugcaccgcucagucucuguagggcuggagauuuuugccauguuggagcugagc

SEQ ID NO: 150273 - RNA, 42 nt, Homo sapiens
aaaaucugugcuaaugaugcaauucccaagaagugcaagagg

SEQ ID NO: 150274 - RNA, 73 nt, Homo sapiens
ucccaauaccacaagacagagcacggggcggcugccgccuccgccuccgcgccuuaaccuaggcggcuugccg

SEQ ID NO: 150275 - RNA, 50 nt, Homo sapiens
gccacguguaaguuccaggggagcucgguuugcgcccaccccuaaggagg

SEQ ID NO: 150276 - RNA, 48 nt, Homo sapiens
acacggcagauuucauguuugagguuuaacuuccguagcuugggcaaa

SEQ ID NO: 150277 - RNA, 45 nt, Homo sapiens
aacagaguauggauccuguuagauugaccacaaugaccaauagga

SEQ ID NO: 150278 - RNA, 38 nt, Homo sapiens
agacuguuuauuaugacaguaacuaguuaaucgauaga

SEQ ID NO: 150279 - RNA, 50 nt, Homo sapiens
uugagauucuuacacaucuaacaacaaaaaaaauuaucuacaucagucau

SEQ ID NO: 150280 - RNA, 51 nt, Homo sapiens
cugcuaaaaaguaacaacugauuuuuaguuccacaaccucucuuucuucaa

SEQ ID NO: 150281 - RNA, 48 nt, Homo sapiens
uuaaaauguagguugaaagauuggauugauugugaaucuacacuaaag

SEQ ID NO: 150282 - RNA, 45 nt, Homo sapiens
cccagccacagcgacaaccugcugcacggccucaaccugcugugg

SEQ ID NO: 150283 - RNA, 66 nt, Homo sapiens
agccaucucuggaaaauuagccaaacugaguggugacggggaagccaacaguuugcgaagcgggga

SEQ ID NO: 150284 - RNA, 91 nt, Homo sapiens
ucauaaagaaaaaacuccuauugcaagaaauaagcagaugaggaggaaaggcaagggagaagaacaagaaggaaggggaauaggaaaagau

SEQ ID NO: 150285 - RNA, 48 nt, Homo sapiens
uuagcccuuggaaaacgcauuauauaccuucccuccugugcccuacac

SEQ ID NO: 150286 - RNA, 46 nt, Homo sapiens
uuacaguaggaaggugauuccuggucuuuugcugaggucuguuuug

SEQ ID NO: 150287 - RNA, 41 nt, Homo sapiens
uaaauucuauuuuuaggcuuugggauggucacagaggaaaa

SEQ ID NO: 150288 - RNA, 43 nt, Homo sapiens
gagguucccagaacuguaguuuuuuuuaccaggguguuguauu

SEQ ID NO: 150289 - RNA, 69 nt, Homo sapiens
cauauauuauuaaaaagcauacagucuaaauaauaaacaguuguaaaauaaugaagguagaaauuauaa

SEQ ID NO: 150290 - RNA, 57 nt, Homo sapiens
auugucccuuucuugaaaguuucuuuuuuaagacaaauacauuauuucugcauugau

SEQ ID NO: 150291 - RNA, 49 nt, Homo sapiens
guugugaaaguuuaagaaauugaaaaaaaaaaaagaaucagcacucagg

SEQ ID NO: 150292 - RNA, 42 nt, Homo sapiens
uucggggcuuauuaaucaucagagaauccauacuggggagaa

SEQ ID NO: 150293 - RNA, 45 nt, Homo sapiens
uacccaaagagcuacagacuuggguucgagaucaucauccagaga

SEQ ID NO: 150294 - RNA, 80 nt, Homo sapiens
ucaguggaagaagauucaauacuuaucaucccaacuccagaugaagaggaaaaaauucugagagugaaguuggaggagga

SEQ ID NO: 150295 - RNA, 43 nt, Homo sapiens
uaggaggucuugucauuucacagaugaaauagugaaggcccua

SEQ ID NO: 150296 - RNA, 59 nt, Homo sapiens
caacugaaucaguaucugcuuuaccaggauuucaaguuauuugugugcacuuugaaacc

SEQ ID NO: 150297 - RNA, 84 nt, Homo sapiens
ucuuaagcagcagacugcaaaacucuugggagcacucaccauuuaugcaaauacuuguuaaaugccuggcuuucucaauagagu

SEQ ID NO: 150298 - RNA, 51 nt, Homo sapiens
acugaagacuuuacagugccugguaagcaauaagcacuugguauaaaugcu

SEQ ID NO: 150299 - RNA, 47 nt, Homo sapiens
uuuucauagauuugcucaaggucuuucuccuugaugaaguuauucac

SEQ ID NO: 150300 - RNA, 26 nt, Homo sapiens
guccucaguuaccugguugcuuccaa

SEQ ID NO: 150301 - RNA, 48 nt, Homo sapiens
auagucacauugaaacagucaagauagagaaaauuuucauggccacaa

SEQ ID NO: 150302 - RNA, 67 nt, Homo sapiens
uauaaaugggauaagugucuuuuggaauuggcuuuauucacucagcauaauucucuggagauugauc

SEQ ID NO: 150303 - RNA, 75 nt, Homo sapiens
uuuauuguuccuugcagccugaggucccuagccuucuucucuccacaguuaagaaucuucucauguuuguuuuau

SEQ ID NO: 150304 - RNA, 182 nt, Homo sapiens
auguaauguucagaguuuucaguugugcuuagugggaggaauagggaaaauacaucugcuucaucuuccuggaauugaauauccccgaaggaucaguuuguaacauuucuucuuuucaugggcugauguuuuccuaauauguguaaaauaugaauugcaagaaaaaugaaauuaaaaaccac

SEQ ID NO: 150305 - RNA, 50 nt, Homo sapiens
ccccaugcguggcagggacuguaaaaaaagguaggaaggcagcacuguca

SEQ ID NO: 150306 - RNA, 89 nt, Homo sapiens
uuagacugggggcaaaagaugacuaaaacagcucugccacuggggauaggaaauaaggguaacauggucucugaucugaaaccugugag

SEQ ID NO: 150307 - RNA, 35 nt, Homo sapiens
uaucagcugguccuugugcugugguccugcccuau

SEQ ID NO: 150308 - RNA, 67 nt, Homo sapiens
ggaaaugaggcuaaugcacuacuucacaugacuuuguaugcaggagcauacaggugcauuuuuagaa

SEQ ID NO: 150309 - RNA, 45 nt, Homo sapiens
cauuucagcugagacccagaggucaaaaagauuuuaauaauacaa

SEQ ID NO: 150310 - RNA, 54 nt, Homo sapiens
aagagaauggcuuguacuaaaaucccaguuuaguaauuugagaaauguaacaau

SEQ ID NO: 150311 - RNA, 53 nt, Homo sapiens
cuaauuaauuaguacacucacuucugauuagggaggucaaucugaaggcuaaa

SEQ ID NO: 150312 - RNA, 45 nt, Homo sapiens
gaagauacaggaugaaaguuugucugugagcuuugcuuugcagug

SEQ ID NO: 150313 - RNA, 85 nt, Homo sapiens
uaccauuuaaaauuuaccaaguguuuacugucauguaugaguguguuguucauuuucucauuuaguuuagugcaauggggcuaua

SEQ ID NO: 150314 - RNA, 56 nt, Homo sapiens
cucauaaguguugcugcaacugaaauuugaacucauuugaauuucagcauuuggcu

SEQ ID NO: 150315 - RNA, 71 nt, Homo sapiens
agcaucaguuguacuaacagccaggauuuauuacagcacaggaaaaaggugcacggggugaaguucagagg

SEQ ID NO: 150316 - RNA, 47 nt, Homo sapiens
uguaggcaucuccugccuaacacauaccaaaauuccagauucccgga

SEQ ID NO: 150317 - RNA, 44 nt, Homo sapiens
uauauauauuuuuaaauuuugcauuugacuuaaagugccaugag

SEQ ID NO: 150318 - RNA, 93 nt, Homo sapiens
uccaguaaugccuaggcuaauuccuaacuuaaauuuucacuuuuuccaaauguuuuaauacauuuuucauccaaagucagccuauuaguuugc

SEQ ID NO: 150319 - RNA, 45 nt, Homo sapiens
guucaauuuaauggcaagugagaugauugcacucaacagaucuuu

SEQ ID NO: 150320 - RNA, 38 nt, Homo sapiens
cugcgaacuguccauagugucauuaaucgcucaccaag

SEQ ID NO: 150321 - RNA, 601 nt, Homo sapiens
gugaguuccugcaagagaaucagcaucuuccccacuugaagagaaugcauugcuggguuaggacuuggggguaggaaggauggagcauuauuuagaggguaaacuuugugacaucagggauuuguuuuauucuucguuguauccccagcacugagagcagcaccugguacauaguaggugcucuagaguuaugaauugaaugauugaauacauccugcaggacugucuggcacagugccugacacaacgagggcgaucaauaaauagcagcagcagcaguguuguuauucucuuuuagagaggggacggcaugacagcugggauuugccaguaaguuagggaagguggggaugggaaagagcuggcucccacuccugucugugugcccagugguucgcuugggguaggagcucaagagugucugccggcacauucguguuugcucggauauuguuugggucacugauacuggucuaggcucugggauaggaggcagcauccccuccccaagggcugacuccacuggguacucccugcaccccccaccucaccuuacaaugauauuugcuucucccaggaugcagucaugcugcacagcuuc

SEQ ID NO: 150322 - RNA, 904 nt, Homo sapiens
uucagaagguaaguccugcucucaccuggugggagugcugaugggcccuuacuuuucaccaucugucuggaguccaucgugacuaaaaucacugugcuuuugggaguugaguggugcagagcauggacccugggaccagauugccuggguuuguauuuugaugccacuacuuguaagcuuuaugaccuuggcuuacuuagccaacccuuacgugucucauuucccuagcuucuaaacugagaauaugaucauauccacuguauaggcaggcugugggaauuuaaaagauuucauuacugauaagugcaccuuuuagcucuuauuguuauugagauucuuugcagauaguaaacuacuuuuauauauuuucuuguuuuuuuucuaugagggcaauaggauaggaauuauaauccuuauuuugcagaugaaagacacaucugagaggcagagcugggcuuccugauugcaaguccagugggauucucauuugcagggcuucuuagugucuuucugagcaguucaaauugucagcaugugucugagcccuuggcuuaguggcguguagaccuaugggagcucuacaguccuagcuucuauucuugcucugcuguuuaucaccucugcgaccuugggcaauugacuucacuucucugaggcucaguuuccucagcuguaaaauaaggucaucaacaccccccucauaaagcugggauggaaguaagaagagagaaugccuuuaagccuguaacguagaaguuggcagauagcaaguucuuggugcugcuuuugaaagcacaggugugaccagcaucuaauguacuuuucuccuugcaagaugauuugucucacauugagccuguucuuccccagcuucaagacaaagccacugugcuaaccacggagc

SEQ ID NO: 150323 - RNA, 59 nt, Homo sapiens
acuccaggccccaugggaacggauguggaaggaagaacugucacccucuuaaggcccag

SEQ ID NO: 150324 - RNA, 44 nt, Homo sapiens
aggggaugggcaggagggcuugugcaggguuuuguaagcaguga

SEQ ID NO: 150325 - RNA, 55 nt, Homo sapiens
acccauagagagaaagcaaggugaggugaugacagaaguauggaagggagucagc

SEQ ID NO: 150326 - RNA, 50 nt, Homo sapiens
uuaaacaggaauguuuugaaagauuucuuaacuugcuuuuaugacaucag

SEQ ID NO: 150327 - RNA, 45 nt, Homo sapiens
gcucaauuuucgcugguauccuguuccccaaagagaaauggacag

SEQ ID NO: 150328 - RNA, 71 nt, Homo sapiens
auuaauccauuuauucucugauuuuuuuucucuacuuggucauauauagauuuuuuuuucaggauggaaua

SEQ ID NO: 150329 - RNA, 64 nt, Homo sapiens
aaaaucuucaugcucuuuuuagaacaugaaauugagaccuuugagcucuucugagccauccuag

SEQ ID NO: 150330 - RNA, 46 nt, Homo sapiens
gcuuuaauuuaaggaguuugagaucuaaacucaguuaggaccugag

SEQ ID NO: 150331 - RNA, 101 nt, Homo sapiens
uucaggacaccuaccauggcaggaggccuuuuuucaauagacagagauuacuuucaggaaauuggaacauaugaugcuggaauggauauuuggggaggaga

SEQ ID NO: 150332 - RNA, 46 nt, Homo sapiens
guuucggaaagcuacaccuuacacguuuccaggaggcacagggcag

SEQ ID NO: 150333 - RNA, 85 nt, Homo sapiens
aaacauguguuaccuaaaacaacacuaauaauucagagucaauuauuucuuucaacagguguuacaaagguagauuauggagaua

SEQ ID NO: 150334 - RNA, 60 nt, Homo sapiens
uaucgucaagaguuggucuaagacacaaacuacaaugcaaaccuuuuuccugguaccuag

SEQ ID NO: 150335 - RNA, 50 nt, Homo sapiens
auacgaguuuuuagggaaagaguauucugggcacagggaagaacaaguau

SEQ ID NO: 150336 - RNA, 45 nt, Homo sapiens
guaaacaaucuagaccuuuacugguuuagucaguuuuaggggcug

SEQ ID NO: 150337 - RNA, 45 nt, Homo sapiens
aucagugucuagauaacauggcuagaaaagagaaugaaaaaguug

SEQ ID NO: 150338 - RNA, 45 nt, Homo sapiens
auuuccagguuuucucuuauacugccaacaaagaaauuagaacag

SEQ ID NO: 150339 - RNA, 67 nt, Homo sapiens
cucauguuaagauuuuuucuauuucagaaauuaacccugcagcaugugaacaguaaucagugccugg

SEQ ID NO: 150340 - RNA, 69 nt, Homo sapiens
auaaugaagagauuuccaagauuuuuuuuccugauuagaacugguagccaguauauuaaauauugauau

SEQ ID NO: 150341 - RNA, 47 nt, Homo sapiens
aaacuauauuaaacaggguuuaaaggaaauuaaaacagaacuaugag

SEQ ID NO: 150342 - RNA, 43 nt, Homo sapiens
uggaugcuuuuauuuuccuuggggugcugaaauugagcugaaa

SEQ ID NO: 150343 - RNA, 36 nt, Homo sapiens
uucuaaaaaauggaaauuuaacaaugucugaucuca

SEQ ID NO: 150344 - RNA, 80 nt, Homo sapiens
guuuucacagcaauaaaucuucaguucuuuguuuaugauuccacuuaacaaaaggccugcagaagugauuuauuauuugg

SEQ ID NO: 150345 - RNA, 42 nt, Homo sapiens
uuuuccaugagcuguguuaauucuaucuccaguaggccuaau

SEQ ID NO: 150346 - RNA, 63 nt, Homo sapiens
gcauagauucuuauaaaaaucacaaaauuuguuguaaauuagaggggagaaauuuagaauuaa

SEQ ID NO: 150347 - RNA, 52 nt, Homo sapiens
gccuaaaauaccaagaaagcuuauacugaauuuaagcaaagaaauaaaggag

SEQ ID NO: 150348 - RNA, 39 nt, Homo sapiens
gcuagaguagcuuaaaaaguugucauaguuucaguaggu

SEQ ID NO: 150349 - RNA, 47 nt, Homo sapiens
gaucucauucaccaccaucaugacuaccaucauauucuccaucauca

SEQ ID NO: 150350 - RNA, 57 nt, Homo sapiens
guauuucauguuucuuguugaacauguccucacauugaucaaacaauuuaaagauaa

SEQ ID NO: 150351 - RNA, 46 nt, Homo sapiens
ugucucugcuggggguuaucuuagugccucucaugaaucggguguu

SEQ ID NO: 150352 - RNA, 43 nt, Homo sapiens
ucaaccaaauugaugcuagaucuugucugauucauacaaguga

SEQ ID NO: 150353 - RNA, 46 nt, Homo sapiens
ucaaugcaucaaagcuacugacaucucauggcaugggcauccaggu

SEQ ID NO: 150354 - RNA, 48 nt, Homo sapiens
agucuauaaaggugaacauuauuaauaaaaaauagaaaaugagggguu

SEQ ID NO: 150355 - RNA, 47 nt, Homo sapiens
gaauguuuacaacauagcaggcaugcuuuguggcaagugccuugcug

SEQ ID NO: 150356 - RNA, 66 nt, Homo sapiens
ucauuauuuuaauauaccugugugucuguccugucucugcuacucuaucucuaguuaugaggaguu

SEQ ID NO: 150357 - RNA, 70 nt, Homo sapiens
ucacaucaaagagccgggugagccggcuggcugguaggaaaacaaaugaaucugugagugagccccgaaa

SEQ ID NO: 150358 - RNA, 45 nt, Homo sapiens
gaguggagcugcuuacaucuuuggggaagaguuuuccaggucuug

SEQ ID NO: 150359 - RNA, 49 nt, Homo sapiens
uuucuagagacaauagagacuccaagaccuggaaaacucuuccccaaag

SEQ ID NO: 150360 - RNA, 46 nt, Homo sapiens
cuguccuugacauuccuucuaccacuggcauguucuggucggugag

SEQ ID NO: 150361 - RNA, 42 nt, Homo sapiens
aaggagcucaccgaccagaacaugccagugguagaaggaaug

SEQ ID NO: 150362 - RNA, 35 nt, Homo sapiens
ucaccauaaucaugcugcuucugguaaaaauaagc

SEQ ID NO: 150363 - RNA, 73 nt, Homo sapiens
gaaggguucagaaaauuacuucaaaauauaggcauagauaagauuaaaagaauccauauacaccaugaccacg

SEQ ID NO: 150364 - RNA, 46 nt, Homo sapiens
cugacaaagaauuauuuucuccauagcgguagaaaagcuguuguag

SEQ ID NO: 150365 - RNA, 42 nt, Homo sapiens
cuugauccugaccuuugcccucucugucacaaauccccuuca

SEQ ID NO: 150366 - RNA, 37 nt, Homo sapiens
cugagugcuaagagacugccauuagcacuguaaaagc

SEQ ID NO: 150367 - RNA, 193 nt, Homo sapiens
cauguauacuuaauuuuuuuuuuaaaguuuuuuuuuuuuuuuucuagagacgaggucucacuauguuguccggguuggucuugaacuccuggccucaagagauccuccaccuccaauucccaaagugcugggauuacaggcgugaccacuacgcccagccucaaauaaguguauacuuuaaauacacauugaa

SEQ ID NO: 150368 - RNA, 38 nt, Homo sapiens
cuauguauggacauaaugugucugauucauugucaagu

SEQ ID NO: 150369 - RNA, 67 nt, Homo sapiens
cuuguaauauacauuccuucauguguuuuccuccuucgccuugcaaaauagguuuuaccgguauuuu

SEQ ID NO: 150370 - RNA, 35 nt, Homo sapiens
cuacgccguaccuccauuucccacuguucccugua

SEQ ID NO: 150371 - RNA, 46 nt, Homo sapiens
agaagagaccgacuccuuugugaauaagcuagaucccagcaaagug

SEQ ID NO: 150372 - RNA, 41 nt, Homo sapiens
gcagggugaagagagacuuuaacgaugcuucuucggcggcg

SEQ ID NO: 150373 - RNA, 46 nt, Homo sapiens
ggcuccucaggcucucaucaguuguuucaaagcucaacccuccaau

SEQ ID NO: 150374 - RNA, 46 nt, Homo sapiens
cacaacucuuccauccaccuuguguggccuugcauucauagcugca

SEQ ID NO: 150375 - RNA, 46 nt, Homo sapiens
aaugccaccaacaaauaucuuuuucacaguuaagugggcaccuggu

SEQ ID NO: 150376 - RNA, 46 nt, Homo sapiens
acugggcagacgcugacagcugucacagccccacccacguccagga

SEQ ID NO: 150377 - RNA, 65 nt, Homo sapiens
aucuauaguugugaccuggauaucaacguccagcuuaagauguaagagaacacucgggacaggga

SEQ ID NO: 150378 - RNA, 57 nt, Homo sapiens
gaggugauagaggccuagagugaaucuuuggguaguauggcaguguuuagucaggga

SEQ ID NO: 150379 - RNA, 46 nt, Homo sapiens
uuuuaagaaacccuuaucauauauaaaaaugacauuaauuucauau

SEQ ID NO: 150380 - RNA, 45 nt, Homo sapiens
uuuggccuugccagugagaacauccuacaaagcauuuaguacaag

SEQ ID NO: 150381 - RNA, 46 nt, Homo sapiens
uauuuuggauguuaucgcuuauuguugucuucaacuuuagccagug

SEQ ID NO: 150382 - RNA, 51 nt, Homo sapiens
gugguuuauucauuggcaaaaguuggcacugcuuaguguuuuucuuucuag

SEQ ID NO: 150383 - RNA, 42 nt, Homo sapiens
ccacuacaagccagacuuaacccucuucugauuuauugcuca

SEQ ID NO: 150384 - RNA, 23 nt, Homo sapiens
cauguaaauaaauguuauuuuuu

SEQ ID NO: 150385 - RNA, 45 nt, Homo sapiens
cacauggugaaaguagauuggcuggauagauugacauuuagagaa

SEQ ID NO: 150386 - RNA, 46 nt, Homo sapiens
aaguuuugaauuagugaaaguuccugacccccagaugucuauggua

SEQ ID NO: 150387 - RNA, 49 nt, Homo sapiens
gaauaaccuuggucacagaaacugcaucuugaaugcagcucagugucgu

SEQ ID NO: 150388 - RNA, 50 nt, Homo sapiens
aacacgucauuuacuggccacuuagucugugccggacacuauacugugac

SEQ ID NO: 150389 - RNA, 46 nt, Homo sapiens
auaugcaauaugaaaauaaacuaggcuuaaauauuuuauuagggaa

SEQ ID NO: 150390 - RNA, 57 nt, Homo sapiens
acucucccagaaauaguggaaagcauaauaauaagcauccgugacuugagauuuggg

SEQ ID NO: 150391 - RNA, 22 nt, Homo sapiens
cacuuuuaaaagugaugauaaa

SEQ ID NO: 150392 - RNA, 45 nt, Homo sapiens
uuauucagaaguaagcauguucgcaguugaagauucuuccauuug

SEQ ID NO: 150393 - RNA, 45 nt, Homo sapiens
agaauucuuuggacaagaaauuacaaagcuaggcuguggugugga

SEQ ID NO: 150394 - RNA, 47 nt, Homo sapiens
guugggaauuauauggaaucuuuaaauaauagaguuuggauuauaag

SEQ ID NO: 150395 - RNA, 47 nt, Homo sapiens
uaauuagcaccucuuacucccuauguuuuacaaguuggagacaaaag

SEQ ID NO: 150396 - RNA, 47 nt, Homo sapiens
gggauagguuucguauuaaaagcauggagcucauuaaauaaaccaug

SEQ ID NO: 150397 - RNA, 45 nt, Homo sapiens
ccgcuuagaccugucggaugaagaggcugugcauuacaugcagag

SEQ ID NO: 150398 - RNA, 50 nt, Homo sapiens
aaugaaguaguugcacucucugggauaagcuacagguuuucacagccucu

SEQ ID NO: 150399 - RNA, 50 nt, Homo sapiens
uaaguaaauuauuuucuguuuauuucuuuuuaauuuuuguaguacuggag

SEQ ID NO: 150400 - RNA, 69 nt, Homo sapiens
uauauuggagacuucagaguaaccagcaaggaagagaaaucuuaaucuucaaguuaccauauuuuccaa

SEQ ID NO: 150401 - RNA, 67 nt, Homo sapiens
uccuuaguaaaggacuuaucaaacugguuucaaagcacagagcucaaguaauuuacaccagaaauac

SEQ ID NO: 150402 - RNA, 45 nt, Homo sapiens
guucgggacaagcucaauaacuuagucuuguuugacaaagcuacc

SEQ ID NO: 150403 - RNA, 45 nt, Homo sapiens
aggacgacgagaagaaggacgcuggaaagucagccaagaaaaaca

SEQ ID NO: 150404 - RNA, 43 nt, Homo sapiens
ggacagcauggucacgucgggcugggggcuggguacgccgggc

SEQ ID NO: 150405 - RNA, 42 nt, Homo sapiens
aaacacucuaacugugguugucuuaaaagcucgacaucugcc

SEQ ID NO: 150406 - RNA, 61 nt, Homo sapiens
uggggaaguucuaauuccucucucgggaauugaauuaucugaaggaaaaauguuaaugaau

SEQ ID NO: 150407 - RNA, 46 nt, Homo sapiens
gaugaccucugacccauauaucaaaaugacgauccucccagagaag

SEQ ID NO: 150408 - RNA, 26 nt, Homo sapiens
acuucagaagagaaacaagagaagcu

SEQ ID NO: 150409 - RNA, 45 nt, Homo sapiens
ugauauuuacccugaaaaccuaaauagcaaaaagaaguuuggagc

SEQ ID NO: 150410 - RNA, 47 nt, Homo sapiens
ggcgggcggaggaggaagcggcggggcggcggcggcggcggcggccg

SEQ ID NO: 150411 - RNA, 36 nt, Homo sapiens
ccucccgacccccugcccuccgcugggacauggccu

SEQ ID NO: 150412 - RNA, 75 nt, Homo sapiens
gaggaauggaauggaauggagaugcccacaggagguccugaugucaucacugcacgcaggugugagaggagagac

SEQ ID NO: 150413 - RNA, 45 nt, Homo sapiens
aaggauccuaaggaugugacacugguuuucaacaacaugcuuaga

SEQ ID NO: 150414 - RNA, 41 nt, Homo sapiens
caaauauucagaagaucuuuugcauuuucuucugucaggaa

SEQ ID NO: 150415 - RNA, 50 nt, Homo sapiens
ugucaguauccguccugaacggggccuagucaggaagcggucuagaagug

SEQ ID NO: 150416 - RNA, 42 nt, Homo sapiens
cucuagcgacgcgggcccgcggcuuccuccuuuccugcccag

SEQ ID NO: 150417 - RNA, 38 nt, Homo sapiens
uagaagaaagguugcaucuggucuugggaugaagcaga

SEQ ID NO: 150418 - RNA, 31 nt, Homo sapiens
ugaagaaaauuuguggucuugcagucucugu

SEQ ID NO: 150419 - RNA, 47 nt, Homo sapiens
uauacucuaauauauauccauauuuacaucucauucguacugaauug

SEQ ID NO: 150420 - RNA, 69 nt, Homo sapiens
acuagauuuaaagggucgauuaguuuuaauuucaacauuuuggacaagaauaccuaauaagugauuuaa

SEQ ID NO: 150421 - RNA, 45 nt, Homo sapiens
agaucucagagggaaagcugcagagauuucuuggucaguagauug

SEQ ID NO: 150422 - RNA, 47 nt, Homo sapiens
cuaucuaaccauacucuucagaaagucuuuugcucuuugggccaccu

SEQ ID NO: 150423 - RNA, 40 nt, Homo sapiens
acugccacagcaguuaaggaugaaaagaaacacagugggg

SEQ ID NO: 150424 - RNA, 58 nt, Homo sapiens
augagaagagauugagaaauaggagggguauauuuuuaaagaugaggggaaaggugga

SEQ ID NO: 150425 - RNA, 52 nt, Homo sapiens
uccacagacgauaauucuuuuccauuaucguuuauacaugguaagaugacca

SEQ ID NO: 150426 - RNA, 42 nt, Homo sapiens
caauauacuccacuugaaauucucagugcuuugagugugaag

SEQ ID NO: 150427 - RNA, 46 nt, Homo sapiens
acgucauuaguaauguugaggaaagugaauuggacuaguggcugca

SEQ ID NO: 150428 - RNA, 42 nt, Homo sapiens
ugccaucacuagaagauuuggauaauacaguauuuggagcag

SEQ ID NO: 150429 - RNA, 44 nt, Homo sapiens
uuucuuuugcugaaauuauuaaugauauaauucagaaauauagc

SEQ ID NO: 150430 - RNA, 47 nt, Homo sapiens
ccuacuaguagagauagaaguucuccucccccagguuacauuccaga

SEQ ID NO: 150431 - RNA, 46 nt, Homo sapiens
aggaacauauccaagaagguaucauguuucauaucaucaucaagag

SEQ ID NO: 150432 - RNA, 46 nt, Homo sapiens
ggucuccugugaguuucaguccuacugaucauuccuuaagcacuag

SEQ ID NO: 150433 - RNA, 46 nt, Homo sapiens
uuguuguugucauggucucugugcaccacugacuuuaaauucuucu

SEQ ID NO: 150434 - RNA, 37 nt, Homo sapiens
aaaaaaaaaaaaaagcaguuuucuuuaguauaaauua

SEQ ID NO: 150435 - RNA, 46 nt, Homo sapiens
cccaggaaaaaacacuuuccauauuuauggaauauaugccaggggu

SEQ ID NO: 150436 - RNA, 45 nt, Homo sapiens
ucuggaggguguccauuauuugcacaguaauaugauuguccauag

SEQ ID NO: 150437 - RNA, 64 nt, Homo sapiens
cugacuuuaaaacucaaaaacucagcuguuugcagggauaaaggauguagguaaaugcauaaag

SEQ ID NO: 150438 - RNA, 45 nt, Homo sapiens
cagagacagcuuccccugucugugaccugccuuggacuguuccuu

SEQ ID NO: 150439 - RNA, 44 nt, Homo sapiens
guagcucuauuguuuuuggaaaacauguuguuggauucuggaug

SEQ ID NO: 150440 - RNA, 61 nt, Homo sapiens
uauuuacaaagcaguaaaugcaagaaagaaaaggaagucgcaaagagaaagugauguaaug

SEQ ID NO: 150441 - RNA, 47 nt, Homo sapiens
cacuaucucuaauagaauugugcuacuauaaaacaugaagauaucag

SEQ ID NO: 150442 - RNA, 74 nt, Homo sapiens
aagugcuaaguacuuuauuaguacuuuauuuaguacuuuauuuuaaaggucuagaaaacaacagucuuccugga

SEQ ID NO: 150443 - RNA, 48 nt, Homo sapiens
uaaauuaacauccuuaaggaggucacaaucuaggaggaacaugggcaa

SEQ ID NO: 150444 - RNA, 41 nt, Homo sapiens
uucagcaaugauguuuuaaaauguuauuuuuuauuaaggga

SEQ ID NO: 150445 - RNA, 46 nt, Homo sapiens
ugcaugugugugugugugugugugugguuagaguuggaggcaggga

SEQ ID NO: 150446 - RNA, 53 nt, Homo sapiens
gccuagagauucuuuuuucagugguccuguaagcauucaagguugagcuucag

SEQ ID NO: 150447 - RNA, 43 nt, Homo sapiens
cauagaauucuuauuuuucauaauugugcauuuuaauugauag

SEQ ID NO: 150448 - RNA, 44 nt, Homo sapiens
agaggacuaguugaaacauuugagcuggagaggcuuaugggcaa

SEQ ID NO: 150449 - RNA, 59 nt, Homo sapiens
uugaauauuuccuguauuccaccccaaaagauuucaacuuuuaguuuuucuaucacugg

SEQ ID NO: 150450 - RNA, 39 nt, Homo sapiens
caagaagaaauccaggaagcggcacuaugaggaugaaga

SEQ ID NO: 150451 - RNA, 59 nt, Homo sapiens
gguggaugagucaggcaccaaaguggaugaauauggagccaaggacuacaggcugcaaa

SEQ ID NO: 150452 - RNA, 42 nt, Homo sapiens
gcuaaaucuugggcauccucagagucaaaacugacauucagg

SEQ ID NO: 150453 - RNA, 46 nt, Homo sapiens
gccauaucuucuuggaagccuucucuccaguuuacaaauaugccca

SEQ ID NO: 150454 - RNA, 54 nt, Homo sapiens
aacuaacugccuacuccuuguaugcagcugucagcguugggcugcaaaccagug

SEQ ID NO: 150455 - RNA, 49 nt, Homo sapiens
gacuagggugggggcugugggaauagagaggaaaggcagaaugcaagau

SEQ ID NO: 150456 - RNA, 29 nt, Homo sapiens
cuugaagcacaacagguaagagauuccau

SEQ ID NO: 150457 - RNA, 47 nt, Homo sapiens
uugaaaguugccacccugauguaauccagcaucuucuccaggacccc

SEQ ID NO: 150458 - RNA, 49 nt, Homo sapiens
ugacauccccauggaccuguuugacuucuaugagcaaauggacaaggau

SEQ ID NO: 150459 - RNA, 46 nt, Homo sapiens
uuuucugauugggccuaagcucuacgaagccaacuggauggagcug

SEQ ID NO: 150460 - RNA, 46 nt, Homo sapiens
cuggcaaaaguaggcauuuagaugaaguucucuuuacaaguuggag

SEQ ID NO: 150461 - RNA, 37 nt, Homo sapiens
gaaaguccuggcagccacugaccuggaugccgaggag

SEQ ID NO: 150462 - RNA, 45 nt, Homo sapiens
gaagaugcaucaagggcuuggcugugccuucauaggucaucuagg

SEQ ID NO: 150463 - RNA, 24 nt, Homo sapiens
aguuuccacaccuaugacgugagu

SEQ ID NO: 150464 - RNA, 26 nt, Homo sapiens
aaaccucuaccucuugcauucuuaau

SEQ ID NO: 150465 - RNA, 50 nt, Homo sapiens
cagucuguaagccagucuagcccacuguuuguuuuuguaugacccaggag

SEQ ID NO: 150466 - RNA, 46 nt, Homo sapiens
guugauacugauggcauucuuauuauuuggcacauauauucagaag

SEQ ID NO: 150467 - RNA, 57 nt, Homo sapiens
aaggaucucuuaaaauagcauucaaaguaaaguuuauauaauuuucaccuauaccug

SEQ ID NO: 150468 - RNA, 50 nt, Homo sapiens
uuuuauuuuuggcauuuuuugaguggcccaucaaacuuuccagauaauug

SEQ ID NO: 150469 - RNA, 46 nt, Homo sapiens
auuucugcaauuuugcauccaaguaccuacuugaauaaaauacuuc

SEQ ID NO: 150470 - RNA, 46 nt, Homo sapiens
uuucgucaagacuggggacccauuacuucaauuucauuucgcacag

SEQ ID NO: 150471 - RNA, 52 nt, Homo sapiens
uuuuuuuugucuucugguagcuuaaucuaauagaagugaaugaauacuggag

SEQ ID NO: 150472 - RNA, 46 nt, Homo sapiens
caguaauggcagcuggaagcccauguggccauauuggacucuggga

SEQ ID NO: 150473 - RNA, 90 nt, Homo sapiens
agugaagcgggaaagaauuacaguuuauuucucccccaauacccacucccucccuuguagcuccagagucaguggcuuagcaagcacuac

SEQ ID NO: 150474 - RNA, 45 nt, Homo sapiens
uuugagauucagaaugggucauagugcuccucuuaccaauaucag

SEQ ID NO: 150475 - RNA, 50 nt, Homo sapiens
aaaaugaaaucucucuuagguuuucucauccugcaaaauugagauacaga

SEQ ID NO: 150476 - RNA, 67 nt, Homo sapiens
uuauuggcucuuuuagcaaauugagagaggcguuuuaccaugggcaagcaacuuaaugccucccacu

SEQ ID NO: 150477 - RNA, 42 nt, Homo sapiens
ucccuguauucaguuguuucauuacggccacuuccugcagau

SEQ ID NO: 150478 - RNA, 46 nt, Homo sapiens
aaccaagugaugaauugauagaauaugauucgccagaacaguugaa

SEQ ID NO: 150479 - RNA, 48 nt, Homo sapiens
uggccuuguacccagauaugcugcaccugaacaaaauaaugaucccca

SEQ ID NO: 150480 - RNA, 46 nt, Homo sapiens
cuuggaguuuuggcucaaaaaucagauuucugcuugaaacuugaag

SEQ ID NO: 150481 - RNA, 46 nt, Homo sapiens
gauugggaugaugcuggacagaaagcgugauuuugaguuagcccag

SEQ ID NO: 150482 - RNA, 41 nt, Homo sapiens
uuaugaagaaaaaaggaaugcuuuuuuccucgguggccuuu

SEQ ID NO: 150483 - RNA, 47 nt, Homo sapiens
aaaaaaggcguaaauuaaacgcuuugcagccuuuuccugcccuuaaa

SEQ ID NO: 150484 - RNA, 46 nt, Homo sapiens
gaucgcuccccaucugaacacugggaccugcgauacuggcgguaac

SEQ ID NO: 150485 - RNA, 44 nt, Homo sapiens
acuugacuccuaggguuugaaagccugagugacuuaaauuucac

SEQ ID NO: 150486 - RNA, 62 nt, Homo sapiens
auguuacuauucagauuucauucuguaucuauaaaauauguuauacuuagcucacagggugg

SEQ ID NO: 150487 - RNA, 48 nt, Homo sapiens
ggacuaguuuaguauguuaggccuucuuauccugucucuuaccucuuu

SEQ ID NO: 150488 - RNA, 53 nt, Homo sapiens
gcuauaaauuaguaacagugugcauaugauuucugauuauuuuuccucuugag

SEQ ID NO: 150489 - RNA, 49 nt, Homo sapiens
aauuauauaucccuuuuuauuugaaauacuuaguauuuucauugccuau

SEQ ID NO: 150490 - RNA, 38 nt, Homo sapiens
auucccuuguauuaaaacuucuucuguaaaugucuuag

SEQ ID NO: 150491 - RNA, 70 nt, Homo sapiens
aaggugugaucuuugaaaauuugacauuuuugccaaaaccugaaugacaugaaggacuagucauuugaag

SEQ ID NO: 150492 - RNA, 43 nt, Homo sapiens
agauggauuuccuguacuucggauccaggguuuuugacagaag

SEQ ID NO: 150493 - RNA, 43 nt, Homo sapiens
augccauuugacagaguggaauaacaguaucuaaggaaacggg

SEQ ID NO: 150494 - RNA, 34 nt, Homo sapiens
cuggcgacaaggacacaugcauugguggccaaaa

SEQ ID NO: 150495 - RNA, 45 nt, Homo sapiens
ugggccuuaaaggaugaggauauauuauaacagcagaggaaaaaa

SEQ ID NO: 150496 - RNA, 46 nt, Homo sapiens
uguaauugcaaaaaaggcauuccaaaguaaauuuaugacuucacaa

SEQ ID NO: 150497 - RNA, 49 nt, Homo sapiens; identical to SEQ ID NO: 61885

SEQ ID NO: 150498 - RNA, 28 nt, Homo sapiens
uuuuuauucaguauucccucuuguaaac

SEQ ID NO: 150499 - RNA, 53 nt, Homo sapiens
aauaaguguaaaacuccaauggcuaguuaguucuuaguucuuuuuaagauuaa

SEQ ID NO: 150500 - RNA, 49 nt, Homo sapiens
acaacuacaaggaaguauugaagaugaagcuauggcuucuucuggacag

SEQ ID NO: 150501 - RNA, 42 nt, Homo sapiens
aguaaaacugcggucaaaaaugucccuccguucuuauggaag

SEQ ID NO: 150502 - RNA, 46 nt, Homo sapiens
auuuccaagaagaggguuuguaaauggaagcagagaaaguacugga

SEQ ID NO: 150503 - RNA, 30 nt, Homo sapiens
uagauauaaaugccaauagcuauagcacgg

SEQ ID NO: 150504 - RNA, 34 nt, Homo sapiens
uccaaucccagcaaaagaugagagcuuucuccuc

SEQ ID NO: 150505 - RNA, 44 nt, Homo sapiens
ccagacaguauagaucauucuaggaagguucaauauccaaauaa

SEQ ID NO: 150506 - RNA, 42 nt, Homo sapiens
gcuaugucuagcucccaagacagcuguauauccaugcgacag

SEQ ID NO: 150507 - RNA, 46 nt, Homo sapiens; identical to SEQ ID NO: 61900

SEQ ID NO: 150508 - RNA, 46 nt, Homo sapiens
gaguguuuugaggaauuugucuuggcgagcagauguaaauaguaaa

SEQ ID NO: 150509 - RNA, 46 nt, Homo sapiens
ggugauuauguuuuugacaccaaucgacaugaugauaauaggucag

SEQ ID NO: 150510 - RNA, 41 nt, Homo sapiens
ucaagaggaagcuuagauaguucucguucugaaaaagauag

SEQ ID NO: 150511 - RNA, 47 nt, Homo sapiens
ucuucaaagcgagguuugcagaucuccaccacugcagcccagauugc

SEQ ID NO: 150512 - RNA, 46 nt, Homo sapiens
cucugcugcccauacacauucaaacacuuacaauuucacuaagucg

SEQ ID NO: 150513 - RNA, 46 nt, Homo sapiens
agaggucaaaugaaacccucgauugaauccuauucugaagaugaug

SEQ ID NO: 150514 - RNA, 46 nt, Homo sapiens
uuauagucuuaaauauucagaugagcaguugaacucuggaaggcaa

SEQ ID NO: 150515 - RNA, 49 nt, Homo sapiens
ccaauuauagugaacguuacucugaagaagaacagcaugaagaagaaga

SEQ ID NO: 150516 - RNA, 49 nt, Homo sapiens
aaaaguggugcucagacacccaaaaguccaccugaacacuauguucagg

SEQ ID NO: 150517 - RNA, 24 nt, Homo sapiens
aaguaaaacaccuccaccaccucc

SEQ ID NO: 150518 - RNA, 46 nt, Homo sapiens
gaccuauuagaugauucagaugaugaugauauugaaauacuagaag

SEQ ID NO: 150519 - RNA, 49 nt, Homo sapiens
accucaucuguaaccauaccugaauuggaugacaauaaagcagaggaag

SEQ ID NO: 150520 - RNA, 54 nt, Homo sapiens
ugguaagaaaaagaaaccaacuucaccaguaaaaccuauaccacaaaauacuga

SEQ ID NO: 150521 - RNA, 90 nt, Homo sapiens
gagaguuuucucagacaacaaagauucaaagaaacagaauuugaaaaauaauuccaaggucuucaaugauaagcucccaaauaaugaaga

SEQ ID NO: 150522 - RNA, 91 nt, Homo sapiens
aauuaagaaaggcaaaagaaaauaaggaaucagaggcuaaaguuaccagccacacagaacuaaccuccaaccaacaaucagcuaauaagac

SEQ ID NO: 150523 - RNA, 45 nt, Homo sapiens
caccugaucaagaagaaaaacccuuuacaaguaauaaaggcccac

SEQ ID NO: 150524 - RNA, 51 nt, Homo sapiens
uacaaguccuguuucuaaaaaaggcccaccccuuaagacuccagccuccaa

SEQ ID NO: 150525 - RNA, 46 nt, Homo sapiens
caguaguauuccaagaagugagucugccuccaaaggacuaaaucag

SEQ ID NO: 150526 - RNA, 46 nt, Homo sapiens
agaccuguauuaguacgccagucaacuuucaucaaagaagcuccaa

SEQ ID NO: 150527 - RNA, 29 nt, Homo sapiens
aagauucaaaagauaaucaggcaaaacaa

SEQ ID NO: 150528 - RNA, 47 nt, Homo sapiens
acaaaauaauccugucccuguaucagagacuaaugaaaguucuauag

SEQ ID NO: 150529 - RNA, 48 nt, Homo sapiens
aguauguuuguacaguauguuuuacauguauuuaaaguagcaucccau

SEQ ID NO: 150530 - RNA, 49 nt, Homo sapiens
ggagugggggagggagaguuaccuaacguaaggcacuucaaaggagugc

SEQ ID NO: 150531 - RNA, 41 nt, Homo sapiens
aauaagauuaaaagacuaugaaaagggaacuuugagaugag

SEQ ID NO: 150532 - RNA, 49 nt, Homo sapiens
aaugcaaaaaguaaauugcccauaguuaaaggaacaucugaguagucag

SEQ ID NO: 150533 - RNA, 41 nt, Homo sapiens
aaugcaauuuuuuuuuguucccuugagaccaaaauuuaagu

SEQ ID NO: 150534 - RNA, 64 nt, Homo sapiens
uagacuauauaaucagauugacagcauauagaauauauuaucagacaagaugaggagguacaaa

SEQ ID NO: 150535 - RNA, 72 nt, Homo sapiens
uuaaauccuuuucccauaaauaaaaguacaguuuucuugguggcagaaugaaaaucagcaacuucuagcaua

SEQ ID NO: 150536 - RNA, 73 nt, Homo sapiens
auccagccaguacaguauuuuuuaaggcaaauaaagaugauuagcucaccuugagauaacaaucagguaagau

SEQ ID NO: 150537 - RNA, 52 nt, Homo sapiens
guuauagagagcaauuugucuggacuagaaaaucugaguuuuacaccauacu

SEQ ID NO: 150538 - RNA, 39 nt, Homo sapiens
ggagcacuuuaaacuuaaugcagugggcaguguccacgu

SEQ ID NO: 150539 - RNA, 49 nt, Homo sapiens
uuauuuuaauaauguugccuuggaaacauuuuugagauauuaaagauug

SEQ ID NO: 150540 - RNA, 36 nt, Homo sapiens
ucauccaaguuuuguuaucuaguagcuacauuaggc

SEQ ID NO: 150541 - RNA, 60 nt, Homo sapiens
ccguccuuucuuccugaagcacgagucccagauggacaguguggucaaggaccuuaaaga

SEQ ID NO: 150542 - RNA, 45 nt, Homo sapiens
uaaucuucacaacaacacaaugaggcuuauccauacuagauaggu

SEQ ID NO: 150543 - RNA, 44 nt, Homo sapiens
aaugccaauguaaagaauuucugccauucuaccauugcagagug

SEQ ID NO: 150544 - RNA, 46 nt, Homo sapiens
agaagaacugcaugacugaccuucuggccaagcucgaggccaaaac

SEQ ID NO: 150545 - RNA, 35 nt, Homo sapiens
uugcaggcccgcccccgccaggguguggcgcuguc

SEQ ID NO: 150546 - RNA, 52 nt, Homo sapiens
gugacaguauugugugucauaguugagcaguagcugguagaauuaggcaguu

SEQ ID NO: 150547 - RNA, 79 nt, Homo sapiens
aacaacuuuggaaagccagagcugaaaaaaagaaacuacgcaaaacguugcgggaauuugaagaagcauuuuaucaaca

SEQ ID NO: 150548 - RNA, 41 nt, Homo sapiens
gaaggagaaacugcacauuuuuuugaagaaaucaagguaau

SEQ ID NO: 150549 - RNA, 52 nt, Homo sapiens
aaauacacagccaagacagaaauaauugucacuguaaggugagauuacugau

SEQ ID NO: 150550 - RNA, 28 nt, Homo sapiens
uuucuuuuuuuucuugcuucaggugacc

SEQ ID NO: 150551 - RNA, 46 nt, Homo sapiens
gaaagcuucucuucagaaaagucuucuuuacuaugaaagucaacau

SEQ ID NO: 150552 - RNA, 55 nt, Homo sapiens
aguguugcaaauacuuuacauagaacucauaaauaguccucuuuagagcccuuua

SEQ ID NO: 150553 - RNA, 43 nt, Homo sapiens
agaaugcugaugaguucauuuauguuggagucaguuggcaaga

SEQ ID NO: 150554 - RNA, 56 nt, Homo sapiens
agaggacagaacaccuuaucagcuggucaagaaacuucagaagaaaaucagacaau

SEQ ID NO: 150555 - RNA, 47 nt, Homo sapiens
ugguaucuuuggcuuuguguuauguguaugguuuguucugacugugc

SEQ ID NO: 150556 - RNA, 70 nt, Homo sapiens
uuuuccccccccuuuuuugcauugcuugcugaaauggaaauguuauguuuguguuuguuaaaaucuaguu

SEQ ID NO: 150557 - RNA, 64 nt, Homo sapiens
aaacaaauauuguaccauauuccuguauuucugucuuagguuaugaagguauggugcaggggac

SEQ ID NO: 150558 - RNA, 53 nt, Homo sapiens
caccaguuuaagcagagcguguauaauuaccuuguccuuaguaucaucaguag

SEQ ID NO: 150559 - RNA, 35 nt, Homo sapiens
uguuagaacugauuuuuuuaaaaagucacccagca

SEQ ID NO: 150560 - RNA, 46 nt, Homo sapiens
ugauaauguuacuuguaaccgaaauuacccuaagcaaugauaagac

SEQ ID NO: 150561 - RNA, 46 nt, Homo sapiens
uugguguucaaggggaagcagcgugugucaguauuccacauuuaga

SEQ ID NO: 150562 - RNA, 49 nt, Homo sapiens
cuguuuuacuugauaagguguuggacacuguagugucuaguacuggacu

SEQ ID NO: 150563 - RNA, 58 nt, Homo sapiens
agguuaaugaacuuucugaggaagaagaggaagaugaaaagcuggaacauauugaaga

SEQ ID NO: 150564 - RNA, 47 nt, Homo sapiens
acacuuacuauauuaaaaugacuuguuuaaggcaccuggaaaaucag

SEQ ID NO: 150565 - RNA, 83 nt, Homo sapiens
ggaagacaugaaagagcaagaaauagugagcaggauaauggcuggacuucuggaaaacuacuaugaguuuuuugagaaugaag

SEQ ID NO: 150566 - RNA, 46 nt, Homo sapiens
uagacaagucaggggagccaagaaaggcuuuccaaaaguaugagua

SEQ ID NO: 150567 - RNA, 44 nt, Homo sapiens
uuuagagcuggguuagugugaggcuauuuucaaccuuccuuuuu

SEQ ID NO: 150568 - RNA, 42 nt, Homo sapiens
aggagaguaaaagaaagguaggagagucagaaugggcaaugg

SEQ ID NO: 150569 - RNA, 46 nt, Homo sapiens
acaggggguggcacaaguuuaacuggaggcucacuggcaacaguag

SEQ ID NO: 150570 - RNA, 46 nt, Homo sapiens
aaucaucuguuacuggggucaugggggcuucuaagggugcagagcc

SEQ ID NO: 150571 - RNA, 46 nt, Homo sapiens
uccccaaguggauaaucaccuccuggggaggcagaaucuauaggag

SEQ ID NO: 150572 - RNA, 42 nt, Homo sapiens; identical to SEQ ID NO: 61999

SEQ ID NO: 150573 - RNA, 48 nt, Homo sapiens
agcacguaucauuccauuuguaugaaauauccagaauaggcaaaucua

SEQ ID NO: 150574 - RNA, 46 nt, Homo sapiens
cccucuuagcauaaacuuguuuacuucucucagauccucuacucca

SEQ ID NO: 150575 - RNA, 68 nt, Homo sapiens
cccugccgucaugucgcaagggauccuuucuccgccagcgggcuugcuguccgaugacgaugucguag

SEQ ID NO: 150576 - RNA, 46 nt, Homo sapiens
guccguauugagaauguggagacccuuguucuacaagcacccaagg

SEQ ID NO: 150577 - RNA, 42 nt, Homo sapiens
cuaacugugaaggagaugguaaaggauguacucaaagggcag

SEQ ID NO: 150578 - RNA, 42 nt, Homo sapiens
cauggggaaagcuggcaugaacccuggagggcaacuggggag

SEQ ID NO: 150579 - RNA, 45 nt, Homo sapiens
aauauccucaaggagucacugacaaguuuuuaccaagaagagauu

SEQ ID NO: 150580 - RNA, 46 nt, Homo sapiens
guugcauaaguaucagaaaauguuagaaccaccacccucagccaag

SEQ ID NO: 150581 - RNA, 64 nt, Homo sapiens
ccagguuucugccaaaaagcgccuugguaccaaccaggaaaaucagcaaccaaaccaacaacca

SEQ ID NO: 150582 - RNA, 46 nt, Homo sapiens
gaaacccugagcagaaagaggccuucuggauggccaaacccaagau

SEQ ID NO: 150583 - RNA, 39 nt, Homo sapiens
aaagggauugagaaugaggcugcaguggaggaaaggagg

SEQ ID NO: 150584 - RNA, 47 nt, Homo sapiens
uauuauugaauauugaaguuauuucuaauauauugauaauauaaaac

SEQ ID NO: 150585 - RNA, 45 nt, Homo sapiens
ugugguucuuggacuuggccaugucugcaccauaagccgcggcuc

SEQ ID NO: 150586 - RNA, 52 nt, Homo sapiens
ugggcuuugaggccuaguuccuuaccuugaacaguuucuaaguuuuccacau

SEQ ID NO: 150587 - RNA, 65 nt, Homo sapiens
uccagucgggcccccacagacagagguugggagggccgaauggggacuaucgcgaguuacgagac

SEQ ID NO: 150588 - RNA, 27 nt, Homo sapiens
cgauuggguuuuuaaguuugugauuuu

SEQ ID NO: 150589 - RNA, 51 nt, Homo sapiens
uuaagaguuugucaggaggaaacagaauacaguugagaacuacagaaacgc

SEQ ID NO: 150590 - RNA, 46 nt, Homo sapiens
uccuuuuguuccccagugccagaacuuccagagccuucucgcucag

SEQ ID NO: 150591 - RNA, 72 nt, Homo sapiens
ccaacucuaaucucacucuaaauuccacaaauggcuauggagggagccaccagugacagucaucaagaacag

SEQ ID NO: 150592 - RNA, 31 nt, Homo sapiens
ccauuucgaacagcuucagugaugccugcug

SEQ ID NO: 150593 - RNA, 91 nt, Homo sapiens
ugcugcucacguccugugccuuuaucuuuagcagaaacauguacuaucccauuggcaucaaugucaaauguaacuucaaucugaggaacuc

SEQ ID NO: 150594 - RNA, 41 nt, Homo sapiens
auuuaauguacaaaacacaaaguuuauaagcaacaguagua

SEQ ID NO: 150595 - RNA, 64 nt, Homo sapiens
agacuggaagacuccuaauuuacgguauguucagaacaaaggcugaugucuuuauagggaauag

SEQ ID NO: 150596 - RNA, 47 nt, Homo sapiens
aauaaguuugguaaagacaccuccuagaguuucaauacccagagaca

SEQ ID NO: 150597 - RNA, 45 nt, Homo sapiens
uuuacuuggggcucugccaaaaagauccuguacagucugcugaac

SEQ ID NO: 150598 - RNA, 46 nt, Homo sapiens
gaagaauccauuguaagauagggcaaauugaugucagucugcaaag

SEQ ID NO: 150599 - RNA, 46 nt, Homo sapiens
gcagcagcugugggcucauuaaucacccgaagcacauucaguccag

SEQ ID NO: 150600 - RNA, 42 nt, Homo sapiens
gagacgggcugcugcagcucggcuggcacuuaucauggcgga

SEQ ID NO: 150601 - RNA, 72 nt, Homo sapiens
gcuagugcuuggagaaggcuuguguuugugugcauguggaagcagagaguugagcuaggaagaugguggagu

SEQ ID NO: 150602 - RNA, 46 nt, Homo sapiens
cuuuuagucauaucuuaagacucagcacuuucguuucugguagcaa

SEQ ID NO: 150603 - RNA, 48 nt, Homo sapiens
augaaggaaguagggaggugggggcccuuggcccauuaaauuuccugg

SEQ ID NO: 150604 - RNA, 20 nt, Homo sapiens
aaacacaucuggaagagucu

SEQ ID NO: 150605 - RNA, 42 nt, Homo sapiens
uugcuaaucugucaugagagauguuucuuauuucuuugugca

SEQ ID NO: 150606 - RNA, 35 nt, Homo sapiens
aacagagcccugagagcaggaaggggguuaguagg

SEQ ID NO: 150607 - RNA, 102 nt, Homo sapiens
cuaagguugcuguaauucauuaagguuggcuagcucuaguagguuuugugauagaucuugcgaaggagugcucuguaaguuaauuggaaaaguagaaacugu

SEQ ID NO: 150608 - RNA, 46 nt, Homo sapiens
uguuuaguuacucugaacaauaccauuaauuguagagaaccagaag

SEQ ID NO: 150609 - RNA, 44 nt, Homo sapiens
caugcaggcaacauaaacuucaagugggauccuaaaagucuaga

SEQ ID NO: 150610 - RNA, 98 nt, Homo sapiens
uuagguuacaacccuuguaaacaccaauaguaaagggcccucuaauaagaagagaggucguucuaagaaggcccauguuuuggcugcaucuguugaac

SEQ ID NO: 150611 - RNA, 104 nt, Homo sapiens
aagcaacugagaauuucuuggagaagggggauaaaauugcgaaggagagccaguuucucaaggaggagcuuguggcugcuguagaagauguucgaaaacaaggu

SEQ ID NO: 150612 - RNA, 47 nt, Homo sapiens
aaguuaacuaaagguauuugagcuugcacuggaucuugaaagguaga

SEQ ID NO: 150613 - RNA, 26 nt, Homo sapiens
ugugacuaucguaccacuaaccacag

SEQ ID NO: 150614 - RNA, 55 nt, Homo sapiens
gaaaaaacauuuuauagugacaacuauacauccuuugucccccagauggccagaa

SEQ ID NO: 150615 - RNA, 53 nt, Homo sapiens
cugcgaaugcauuuuccuugaguagaagaucucaacuuacugaaagcagucag

SEQ ID NO: 150616 - RNA, 57 nt, Homo sapiens
ucagacugauguacccacaucuacuauaggcagccuggaagauagauguuaaaagac

SEQ ID NO: 150617 - RNA, 77 nt, Homo sapiens
auagcuuugaagagcauugugugggugugugugagagagauugcauuuuaauuugucugaucugguuagugugguuu

SEQ ID NO: 150618 - RNA, 44 nt, Homo sapiens; identical to SEQ ID NO: 62081

SEQ ID NO: 150619 - RNA, 51 nt, Homo sapiens
cuaaaaccugaaguggauaagcugaacauuauggcagccaaaagacaacag

SEQ ID NO: 150620 - RNA, 34 nt, Homo sapiens
uugaacauaaucccuuauguauuuuuuucaugug

SEQ ID NO: 150621 - RNA, 53 nt, Homo sapiens
uuuuacuaaagccuuuuuuucccuucugaguauugugagugaaagagggauac

SEQ ID NO: 150622 - RNA, 42 nt, Homo sapiens
cgauccucuauacugcaucccaggcaugccuacagcacccug

SEQ ID NO: 150623 - RNA, 54 nt, Homo sapiens
uaaaauacuuucuuagcauaaugccauaauuacuuuucauaaaugaugcgcuag

SEQ ID NO: 150624 - RNA, 34 nt, Homo sapiens
cuuucauaaaguagggaugcuaugaaauauagaa

SEQ ID NO: 150625 - RNA, 46 nt, Homo sapiens
guggaccccuugagcuucagcgaggagcgcuuuaggccuucccugg

SEQ ID NO: 150626 - RNA, 57 nt, Homo sapiens
guaagauauuuauggaugaggaguuuucuauaacauguuggaucugagauguuuuca

SEQ ID NO: 150627 - RNA, 53 nt, Homo sapiens
augaagcauucaaaaacauuuagaaccucuagugagugucagaauauaaccag

SEQ ID NO: 150628 - RNA, 61 nt, Homo sapiens
guauagaauuauguauaguaaguaggauauacaaagaaagaaaagauuggcauucauuggc

SEQ ID NO: 150629 - RNA, 42 nt, Homo sapiens
agcauaacuggcuagaagcagucuucuuuccccauuaguagg

SEQ ID NO: 150630 - RNA, 84 nt, Homo sapiens
ggugggauuucaggcacuguggcaggaaguaagaaagauguguuacgguagagguggucacccuuagaucagugugggcaguug

SEQ ID NO: 150631 - RNA, 107 nt, Homo sapiens
guggggcauauuuugggggaggggcauuucucucuaaauugauguacuaggagauagagcauauuuuugcugccccaaguaaacuuuugaugcauuacaaaaaggaa

SEQ ID NO: 150632 - RNA, 49 nt, Homo sapiens
ccuaauuugaagcuuugcuuuccuuccagagauguuugaacuacauuua

SEQ ID NO: 150633 - RNA, 41 nt, Homo sapiens
ccacaaaaugguuucuguguagaacauaucauggaugacag

SEQ ID NO: 150634 - RNA, 26 nt, Homo sapiens
uuuuuaauguacuuguaagucauugg

SEQ ID NO: 150635 - RNA, 45 nt, Homo sapiens
caagaugucauuucuuagcuuuaauuucuguuaagaugggaagua

SEQ ID NO: 150636 - RNA, 878 nt, Homo sapiens
cuguccugaggauguuuaucuguagcaagccaaggacauuauaguugacccuugagcaacauggguaugaauuguuaaggucuacuuauauguggauuuccucccaccugugauacuuauauguggauuuccucccaccugugauaacccugagacaguaagacugacuccuuuucuuucucuuccuucucggccuacucaaugugaagacaacaagaaggaugaaggccuuuauggugauccaguuccacuuaaugauaaauguauuuucucuuaugauuuucuuucuuucuuuuuuuuuuuuucuuuuuuuuuaagauggagucucacucugucacccagacuggagugcaguggcaugaucucagcucacugcaaccuccaccuccggguucaagcaauccuccugccucagccucccgaguagcugggauuacaggcgcauaccagguugccuggcuaauuuuuguguuuuuaguagagacaggguuucgccuuauuggccagacuggucucaaacucuugaccgcaggugauccacccaccucagccucccaaaguacugggauuacuggcgugagccaccaugccccaccaugauuuucuuaauaacauuuucuuuucuccagcuuauuuuuguaagaauaccauauaucauacauauaacauauaaaauauguauuauuuugacugacgguauuaaauauguguuaucuaauauggacugaccguuuauguuaucaguaaugcuucuagucagcaguagcuauuaauaaaaauuuuugggaagucaaaaguuaugcagauuuucgacuguguggagcaggggguuggcaccccuaaccccaguguuguucaagggucaauuguaguuuaaa

SEQ ID NO: 150637 - RNA, 61 nt, Homo sapiens
ggcaauugguaccuuuccgaagcucucugugguguuaguucacuguaauggaggauucaga

SEQ ID NO: 150638 - RNA, 60 nt, Homo sapiens
uuuuauuccauuugauucugcuuagaauguuacccuggcaaaucucgacucagcaccuug

SEQ ID NO: 150639 - RNA, 56 nt, Homo sapiens
ugcuucauuaauaaaauugguguaugcugaaccuugaguuaaaauauaaauuuaau

SEQ ID NO: 150640 - RNA, 40 nt, Homo sapiens
uugucucuuggcuucucuuauuuuggcaaaacucccucaa

SEQ ID NO: 150641 - RNA, 39 nt, Homo sapiens
agaaucauagguucuuagucugguguguaaaucccuuuc

SEQ ID NO: 150642 - RNA, 62 nt, Homo sapiens
ugggaaacucucccuccagagacagcauauuuaacugguaugguagauucucuggcuguuag

SEQ ID NO: 150643 - RNA, 45 nt, Homo sapiens
uggcuagaaugaagcuuucaaaaaccuguagcaaacuuccuguau

SEQ ID NO: 150644 - RNA, 43 nt, Homo sapiens
auaaaacaguauaaaaagguuaugcuuuaaucuggaguuucac

SEQ ID NO: 150645 - RNA, 75 nt, Homo sapiens
gaguacuuacguaaucuuuugcuucuuuuuuaaaaaucuuuugcuucuuaauuuaaauauuuuucugaguuuuaa

SEQ ID NO: 150646 - RNA, 52 nt, Homo sapiens
ggauuuuagauggaagucuuggggacagaucacugacacagaacccacauag

SEQ ID NO: 150647 - RNA, 43 nt, Homo sapiens
ggcagagagauaaugaaugaaugaaugaaugaaugaaugaaug

SEQ ID NO: 150648 - RNA, 46 nt, Homo sapiens
uccagacagaagacgaucagcugauagcuggccagagugcccgggu

SEQ ID NO: 150649 - RNA, 54 nt, Homo sapiens
uccccaggagcaaaaagcgaagauugcggaacagguggccagcuuccaggaaga

SEQ ID NO: 150650 - RNA, 46 nt, Homo sapiens
aaaaauacaucggaugucaucagugcugccaagaaaauugcugagg

SEQ ID NO: 150651 - RNA, 47 nt, Homo sapiens
ggaugugugagacacaagccuccuuacacaagccaaagauuguaaag

SEQ ID NO: 150652 - RNA, 66 nt, Homo sapiens
ugccucagguaauugggugauuuugcuccagcaagaggagaggaagcaugugagugccacacugaa

SEQ ID NO: 150653 - RNA, 64 nt, Homo sapiens
ggaccugcuggccuaccugcaacgcaucgcccucuacugccaccagcugaacaucugcagcaag

SEQ ID NO: 150654 - RNA, 79 nt, Homo sapiens
gucaaggccgaggugcagaaucucggcggggagcuuguugucucugggguaagcauuagcugaacaaaaagagggccag

SEQ ID NO: 150655 - RNA, 45 nt, Homo sapiens
gucccugauccaggcagccaagaacuugaugaaugcuguggugca

SEQ ID NO: 150656 - RNA, 72 nt, Homo sapiens
ggcuucccucaaccuuccugcugugucauggaagaugaaggcaccagagaaaaagccauuggugaagagaga

SEQ ID NO: 150657 - RNA, 44 nt, Homo sapiens
auuugcuaaauacaacacugauacuagauuccacagggaaaugg

SEQ ID NO: 150658 - RNA, 46 nt, Homo sapiens
uuguuaguaaugcucugaccaagccgagaugcccauucucuuagug

SEQ ID NO: 150659 - RNA, 56 nt, Homo sapiens
aagaugaccugugguaagcaaccugggcaucuuaggaagcagucccuggagaaggc

SEQ ID NO: 150660 - RNA, 49 nt, Homo sapiens
auugggcucacuucuaauaacugcaguguuucccgccuugggcuugcag

SEQ ID NO: 150661 - RNA, 54 nt, Homo sapiens
ugaaugggaauaguaauauguauuuuuauagcuaucuuaagaauucagagaaua

SEQ ID NO: 150662 - RNA, 29 nt, Homo sapiens
uaaagaugcaggaugcuuuugcaguuaaa

SEQ ID NO: 150663 - RNA, 53 nt, Homo sapiens
aaggcugaaaaaagcaagaaaaagaaggaagaggaggaagaugaggaagauga

SEQ ID NO: 150664 - RNA, 61 nt, Homo sapiens
uuguccugaauuuugguuuugacauucuaaauggugucggugggcuugaccucaaggguga

SEQ ID NO: 150665 - RNA, 89 nt, Homo sapiens
ucuggauguuguagccugagagaguguggccauccuccagccguuucccagcaaauaucagacgcugcuggucaggugggauacccucc

SEQ ID NO: 150666 - RNA, 46 nt, Homo sapiens
ucuuuugguggauguagcacaauuuccacacugugaaggcaguauu

SEQ ID NO: 150667 - RNA, 47 nt, Homo sapiens
gcugagacuguuacuaaguaaaaagcugucaaacauuuacugaaaau

SEQ ID NO: 150668 - RNA, 53 nt, Homo sapiens
aauuuguuaaaggcaaguaugucauauuacugaggcuacaaguuagucagcag

SEQ ID NO: 150669 - RNA, 31 nt, Homo sapiens
gguccucacaggaaacauuuugaagaucugg

SEQ ID NO: 150670 - RNA, 46 nt, Homo sapiens
gcaggaaucacaugucugacuuccggauccagaagcagcaggagag

SEQ ID NO: 150671 - RNA, 46 nt, Homo sapiens; identical to SEQ ID NO: 62156

SEQ ID NO: 150672 - RNA, 32 nt, Homo sapiens
ccagggacaucccguucauucggucugcaaau

SEQ ID NO: 150673 - RNA, 70 nt, Homo sapiens
gacccacuccccacccuucuccccuuccuuugcccggggacgccgaacucucucaaugguaucaacaggc

SEQ ID NO: 150674 - RNA, 45 nt, Homo sapiens
ugcggcaggaggaaaaggaagagguuacugugggcagcuugaaga

SEQ ID NO: 150675 - RNA, 46 nt, Homo sapiens
uugcagacuuuguuugccaugucacaauacagucaagcuggcuuua

SEQ ID NO: 150676 - RNA, 46 nt, Homo sapiens
caccuagccucccugcagcugggacugcuguuaaacggggucugca

SEQ ID NO: 150677 - RNA, 38 nt, Homo sapiens
gcggugaguguuucuaaacacccuugguuuggggguag

SEQ ID NO: 150678 - RNA, 45 nt, Homo sapiens
auaggucgauuacccagggcauccacgaaugcagagagccccuug

SEQ ID NO: 150679 - RNA, 38 nt, Homo sapiens
cggaaaaaaaaaagaaacaacaaaaaaaaaagagagau

SEQ ID NO: 150680 - RNA, 42 nt, Homo sapiens
auuuucauuuuagcaaaaauugucuuauaauacuagcuaacg

SEQ ID NO: 150681 - RNA, 88 nt, Homo sapiens
ggcaccacuggcccaaggcugacccuuagggccccucagaaacacuccaaagagccucaucuccauuuuucauaugggaaaacaaggu

SEQ ID NO: 150682 - RNA, 61 nt, Homo sapiens
ugaugggguugugggagaggcauugaguccguguggggucugugaugguggcagggugcac

SEQ ID NO: 150683 - RNA, 46 nt, Homo sapiens
gacacuacuaaccugcuuucaccucgcaggauggcugcccgguguc

SEQ ID NO: 150684 - RNA, 53 nt, Homo sapiens
aaaagagcacacauacuuguacacacaagcacaaacgcaugagcaugggcuca

SEQ ID NO: 150685 - RNA, 45 nt, Homo sapiens
ucuguaaaauggggaugaugacauuuaugccugugggguuacugu

SEQ ID NO: 150686 - RNA, 68 nt, Homo sapiens
gauggugggagagggggcggggguuggugcuggagaugcuaaaaaguugaggaaaugaggaauugagg

SEQ ID NO: 150687 - RNA, 45 nt, Homo sapiens
cuccucucugccccucucucacccugcucuucuccagcccugggg

SEQ ID NO: 150688 - RNA, 42 nt, Homo sapiens
ggagaguccuggauccucaggcuuccaccuggagcugggagu

SEQ ID NO: 150689 - RNA, 44 nt, Homo sapiens
cccaggacugcugcuccucccuucagccacaaagcugaauuuau

SEQ ID NO: 150690 - RNA, 55 nt, Homo sapiens
gcagagggggcugugggugggaauaguguugucccugguggucaggccugggccu

SEQ ID NO: 150691 - RNA, 64 nt, Homo sapiens
aaggugggcggccuuucucuacagacaucacagagccaaggaagguuucugaauggccgugagg

SEQ ID NO: 150692 - RNA, 51 nt, Homo sapiens
cuaugaucagaaccgaggguaagaccagagauaaaugugcaacaucuggug

SEQ ID NO: 150693 - RNA, 111 nt, Homo sapiens
cugguggacagaguaacaucucuucuuccucuugggccugggggucauccgcuccucuacucccaguccuuccccucucacugggagguuuagaaccuuagguuccucagg

SEQ ID NO: 150694 - RNA, 24 nt, Homo sapiens
uuagaagaaaaaauaggcauaaau

SEQ ID NO: 150695 - RNA, 24 nt, Homo sapiens
ccaccugguauuguuuggguagug

SEQ ID NO: 150696 - RNA, 47 nt, Homo sapiens
ccuucaagcuccccaucccugcagggguccucuaccagaccucagga

SEQ ID NO: 150697 - RNA, 50 nt, Homo sapiens
ggagcaggcucagggagaagaugguaaguuccauuuguaguggcugagcu

SEQ ID NO: 150698 - RNA, 42 nt, Homo sapiens
uccagcaaauguguaccuucucagucugcauccagggcuugg

SEQ ID NO: 150699 - RNA, 57 nt, Homo sapiens
ggcugaggccgcccucugcaccuuguuucugcccacccaccuguuucccacccuugc

SEQ ID NO: 150700 - RNA, 36 nt, Homo sapiens
aaagugcaugagcaaagagagaggaacuuggcggga

SEQ ID NO: 150701 - RNA, 47 nt, Homo sapiens
gagagaaggcccugccgaaaccuagaucauggcagaugcacuuaugu

SEQ ID NO: 150702 - RNA, 31 nt, Homo sapiens
gugauugaguauucuuaccuagaugagguuc

SEQ ID NO: 150703 - RNA, 39 nt, Homo sapiens
auauaaaaaaaaaauuagaaauugugaaaaguccuagga

SEQ ID NO: 150704 - RNA, 57 nt, Homo sapiens
aagguuaaaggagucuugagggcucugacuagagcccaggcauucuacaucucugau

SEQ ID NO: 150705 - RNA, 26 nt, Homo sapiens
guuuuggcaagguauccuuuuaaaag

SEQ ID NO: 150706 - RNA, 45 nt, Homo sapiens
auacuuuuugacucaucuacaucucccauccccuacucugaaguc

SEQ ID NO: 150707 - RNA, 42 nt, Homo sapiens
uuuuggaacaaagcagaauaaagugacuaaauaaaugcaggu

SEQ ID NO: 150708 - RNA, 46 nt, Homo sapiens
ggucugcuuucauguuacagcugggcagaacauguacugaucacag

SEQ ID NO: 150709 - RNA, 44 nt, Homo sapiens
cgaaguuugaggagaaagagggugugaaguagucaucuagaaga

SEQ ID NO: 150710 - RNA, 47 nt, Homo sapiens
augcuuauaugcugguaggaaugagccaguugagaggaggcaauuaa

SEQ ID NO: 150711 - RNA, 25 nt, Homo sapiens
agagcagaaaagaagagcaaggacu

SEQ ID NO: 150712 - RNA, 46 nt, Homo sapiens
uuguagauauuuuuaacagauaaggcccaaaagacuuccugauaga

SEQ ID NO: 150713 - RNA, 45 nt, Homo sapiens
gcccugagagugaaaucauuugccccaagguuauagaauuggaca

SEQ ID NO: 150714 - RNA, 45 nt, Homo sapiens
ggcagaggacuccuggaggucugacuguaggaaggaaagaaccga

SEQ ID NO: 150715 - RNA, 92 nt, Homo sapiens
gggcaggucauucuugguagacauaaaagcuugaauaaaaucacgaagaaagaaagcucaaacauguuuugggaccagcacacuguacaaug

SEQ ID NO: 150716 - RNA, 109 nt, Homo sapiens
ggaggacaaauauguauuuagggauaucagaaaagacuuccaggaggagauggaauuauugcuagacccugaaagaugggucaaguuggauuuugguaguggguaguag

SEQ ID NO: 150717 - RNA, 50 nt, Homo sapiens
uggagaucaaugaggggguuauaaaguccuagaagccagggaaacugggg

SEQ ID NO: 150718 - RNA, 42 nt, Homo sapiens
acacuccuauccuaaauaacagcauuuaucuagucuuccaag

SEQ ID NO: 150719 - RNA, 45 nt, Homo sapiens
cucaauuuaugaaaucugauuugaagauuucaucuguucauagca

SEQ ID NO: 150720 - RNA, 61 nt, Homo sapiens
cucuguccacaugacucagggaguaauccaaugacauaacucuccauucuaggguucaaag

SEQ ID NO: 150721 - RNA, 23 nt, Homo sapiens
gcuuccuuccuuucugcuuaggc

SEQ ID NO: 150722 - RNA, 31 nt, Homo sapiens
uuuacuucugacccucucuuaccugaggcuu

SEQ ID NO: 150723 - RNA, 79 nt, Homo sapiens
uuuaaaagaaagaaaggagucucagaccauuacaggauccgguuguuacaggcugaauccaaggcccauaagugaagag

SEQ ID NO: 150724 - RNA, 78 nt, Homo sapiens
cugcauccagggcaacuuuucuagcauuguuauugguugauuugauuuuaggggaaaaauagugaaaauaaaaauuuu

SEQ ID NO: 150725 - RNA, 46 nt, Homo sapiens
ugagaucacgaauuaggaguagcaccuuuuugccuaguagacaauu

SEQ ID NO: 150726 - RNA, 359 nt, Homo sapiens
ggacccggguuuagaaaccaucuuuuguggccgggcaugguggcucacgccuguaaucccagcacuugggcaggccaaggcagguggaucaugaggucaggagaucgagaccauccuggcuaacaugguuaaauccuaucuguauuaaaaauacaaaaaauuagcuggguguggugugccacaggccuguagucccagcuacuggggaggcugaggcaggagaaucacuugaacuugggaggcagagguugcagugagccaagaucgcgccacugcacugcagccugggugauagagcgagacuccaugucaaaaaaaaaaaaaaggaaaccgucuuuugcauuuuccagcugggugau

SEQ ID NO: 150727 - RNA, 41 nt, Homo sapiens
ugaacuagagcuccaugucagguuguaagaacugaagcaca

SEQ ID NO: 150728 - RNA, 47 nt, Homo sapiens
uaaaagauacuaugucaacuuuuuucuuccuauuuucuuauguaacu

SEQ ID NO: 150729 - RNA, 90 nt, Homo sapiens
gauguauacacacacauacacauauauauguauauauacauuguguguguguauauguauauagauacacacaucuccuugagaguggaa

SEQ ID NO: 150730 - RNA, 39 nt, Homo sapiens
cacguccuuuuugaacagaaauuucauuacaggcuaagu

SEQ ID NO: 150731 - RNA, 53 nt, Homo sapiens
uuagaauugugaaaaacauggaaauacucuuguuaguguguguuuuggucuaa

SEQ ID NO: 150732 - RNA, 41 nt, Homo sapiens
uggcaguuugaagguaucuaaauuaauguuaagaaacuugu

SEQ ID NO: 150733 - RNA, 51 nt, Homo sapiens
agaguaggacgaggagagcuguuuaauguguuuguggauggggguuugaga

SEQ ID NO: 150734 - RNA, 57 nt, Homo sapiens
agaccuuaugaggcccucaauaauacuguauuucuaaaauuagacaacauacccccc

SEQ ID NO: 150735 - RNA, 42 nt, Homo sapiens
gaaaggcuuaagucuagucaguggagauaaaugauagcccau

SEQ ID NO: 150736 - RNA, 69 nt, Homo sapiens
caaaaaguguaccugugaacauauuuuuugucuuggugauauuaugcaacacaguguucagaauugcaa

SEQ ID NO: 150737 - RNA, 45 nt, Homo sapiens
gaaaugagaaaguccuuuauaacauagugugaauguuuguggcca

SEQ ID NO: 150738 - RNA, 43 nt, Homo sapiens
ucucugcucuaaguaaauuguagagaauuuuagugcaaaucgu

SEQ ID NO: 150739 - RNA, 54 nt, Homo sapiens
acauugcaaccagcuucguuagacauuauaacaaccagagagaagggaaaaaag

SEQ ID NO: 150740 - RNA, 50 nt, Homo sapiens
acaauuucuagcaggguagaguuugauaaaccacaaugcucaggaugcca

SEQ ID NO: 150741 - RNA, 43 nt, Homo sapiens
uaaccccuuccucaccaaaagauuuuaguuuugucuguuggga

SEQ ID NO: 150742 - RNA, 33 nt, Homo sapiens; identical to SEQ ID NO: 62247

SEQ ID NO: 150743 - RNA, 45 nt, Homo sapiens
ccuuauuuugauucaggguugguuagauagaugcucaaaucauug

SEQ ID NO: 150744 - RNA, 37 nt, Homo sapiens
uucuugguaacugauuaccugccaauugcuaccgaga

SEQ ID NO: 150745 - RNA, 65 nt, Homo sapiens
uagcuuuccuggucccucacccccauggccccaggcccacagcgugggaacucacuuucccuugu

SEQ ID NO: 150746 - RNA, 89 nt, Homo sapiens
ccuaggcgauuuugucuaccauuuguguuuugaaagcccaaggugcugaugucaaaguguaacagauaucagugucuccccguguccuc

SEQ ID NO: 150747 - RNA, 43 nt, Homo sapiens
cuaggcaagacugaaguccaacucauagaguggcucugaccaa

SEQ ID NO: 150748 - RNA, 54 nt, Homo sapiens
gagugccacugcgggagcucuguauggucaggauguagggguuaacuuggucag

SEQ ID NO: 150749 - RNA, 56 nt, Homo sapiens
agaugggucacagaaccauccuagcuuuguggcaaagguggguggcacuaagccag

SEQ ID NO: 150750 - RNA, 48 nt, Homo sapiens
aaaaaaaagaagaagaagaaggagagcaagaaggaaagauuugugaac

SEQ ID NO: 150751 - RNA, 52 nt, Homo sapiens
gaagauaaguguuuaaacaaacuuaugaggggaagugggguuugguggaggg

SEQ ID NO: 150752 - RNA, 40 nt, Homo sapiens
uaccucugagaagacacaaggugauuucagacugcagagg

SEQ ID NO: 150753 - RNA, 51 nt, Homo sapiens
gugcugucaucugucugucugcuggucaucguggggcuucucauguuuagg

SEQ ID NO: 150754 - RNA, 45 nt, Homo sapiens
gggagguagguaauauuaggauguuuacauuauuauccuuuugac

SEQ ID NO: 150755 - RNA, 45 nt, Homo sapiens
uucugaaaugggucacagacgugggugggaagaauguguccuagu

SEQ ID NO: 150756 - RNA, 42 nt, Homo sapiens
gaggcagugugcauacaacagucucuuggcccuguccagagu

SEQ ID NO: 150757 - RNA, 47 nt, Homo sapiens
cacaagcacuggccacaccaaacaaggaggagcacgggaaaagaaag

SEQ ID NO: 150758 - RNA, 24 nt, Homo sapiens
cugcuccucagcugcccuucuccc

SEQ ID NO: 150759 - RNA, 50 nt, Homo sapiens
agauuaauugcagaaaagaggagucuguuuucagaggaggcagccaauga

SEQ ID NO: 150760 - RNA, 43 nt, Homo sapiens
gcccacaaguuucccagucgagucugaggcugugauggaggau

SEQ ID NO: 150761 - RNA, 86 nt, Homo sapiens
ggcuagggcacuagguugucgccccggccuaggcugggggcgguugcggcgcuuaguauggacccucugucucccccagccccagu

SEQ ID NO: 150762 - RNA, 52 nt, Homo sapiens
gcugccgcuggugcacgucucugcgaccacgccagaaccuugugagcuggac

SEQ ID NO: 150763 - RNA, 26 nt, Homo sapiens
cggagugucccggauccggguugggg

SEQ ID NO: 150764 - RNA, 23 nt, Homo sapiens
uuucaacagauuggugugauaga

SEQ ID NO: 150765 - RNA, 42 nt, Homo sapiens
gagcuccuugguuucucccucuuggcaagaguaggaaaagcu

SEQ ID NO: 150766 - RNA, 45 nt, Homo sapiens
ucucagggcaaagcggucacuuguggccccaaagccauuccaauu

SEQ ID NO: 150767 - RNA, 40 nt, Homo sapiens
uggugaggacccgucucaagauucaauucauuccuucagu

SEQ ID NO: 150768 - RNA, 35 nt, Homo sapiens
cagugcaacacaagaagaugcacucaaagcacuga

SEQ ID NO: 150769 - RNA, 49 nt, Homo sapiens
gcugccauggccaaaaaggcccugguggaagguaggcuggggcgggggu

SEQ ID NO: 150770 - RNA, 95 nt, Homo sapiens
ucccaucucagauugagggguugucuugguaaugacaauugucuucccaagcuuggauuccaaguccaccuuguagucccuaugccguaaaagcu

SEQ ID NO: 150771 - RNA, 46 nt, Homo sapiens
ugauggaguccuucaccacacagucacagacauugcaguaauaucu

SEQ ID NO: 150772 - RNA, 49 nt, Homo sapiens
ugaccucaaaacguuucuucaccugauccaggguggaacguuccacacg

SEQ ID NO: 150773 - RNA, 58 nt, Homo sapiens
aaggcaacaaauguuuccgcuaauauacagaacucaggagauacaacucugggggugg

SEQ ID NO: 150774 - RNA, 47 nt, Homo sapiens
caggauaaaggugggauguucagacaagaggugggauagaugaagag

SEQ ID NO: 150775 - RNA, 45 nt, Homo sapiens
ccgaagcucaucauguucuaaugagucauggcccugccugugacc

SEQ ID NO: 150776 - RNA, 46 nt, Homo sapiens
cuuauccuuuuucuugcuugcuuuaggaucagugcuagcaacuggc

SEQ ID NO: 150777 - RNA, 44 nt, Homo sapiens
acuacagaggauucuuccugcucuccauccuccuggggaccccc

SEQ ID NO: 150778 - RNA, 42 nt, Homo sapiens
cccuggcugugcaaaguggagacgaugaaacuaaguacccgg

SEQ ID NO: 150779 - RNA, 42 nt, Homo sapiens
ugaacucgcuuacaggagaaauaucaacuuuagaaggauuag

SEQ ID NO: 150780 - RNA, 50 nt, Homo sapiens
gaagacacaccucuugggacagucauugcucuuuucuaccuacaagacag

SEQ ID NO: 150781 - RNA, 42 nt, Homo sapiens
accuucccccacucauccuacucagucuacaucgcugagaac

SEQ ID NO: 150782 - RNA, 46 nt, Homo sapiens
accagaaugacaacccgcccgagauccuguacccggcccuccccac

SEQ ID NO: 150783 - RNA, 46 nt, Homo sapiens
ugggcuguacacgggcgaggugcgcacggcucgggcccugcuggac

SEQ ID NO: 150784 - RNA, 46 nt, Homo sapiens
uuccauuuaaaauauuaacuucuucaagaaacacguauaaauuagu

SEQ ID NO: 150785 - RNA, 45 nt, Homo sapiens
gcaggaggugcugccggauaucacugaccgccccgaccccucuga

SEQ ID NO: 150786 - RNA, 42 nt, Homo sapiens
uccucguggccaugauucuggccauugccuugcgccugcgac

SEQ ID NO: 150787 - RNA, 45 nt, Homo sapiens
agauuaugaagaaaccgguuucuaugaaauagaaauacaagcaga

SEQ ID NO: 150788 - RNA, 58 nt, Homo sapiens
caacccaccuaccuucucucaagucuccuacuuuaccuauaucccagagaacaacgcc

SEQ ID NO: 150789 - RNA, 80 nt, Homo sapiens
cgagcugcgagugagcgcggagaagcugcacuucagcguagacgcgcagagcggggacuuacuugugaaggaccgaauag

SEQ ID NO: 150790 - RNA, 49 nt, Homo sapiens
aacguugcccuaugccuauaauuuuugugugccuggggaucaaaugaau

SEQ ID NO: 150791 - RNA, 46 nt, Homo sapiens
cuccuguuuuuuaaauauggaacuucucguggaagacaccuugaag

SEQ ID NO: 150792 - RNA, 42 nt, Homo sapiens
uggcggaccucggcagccucgagucucuggcuaacucugaaa

SEQ ID NO: 150793 - RNA, 45 nt, Homo sapiens
ggaaucugcuauagaugcagauguagggccucacucucuccagag

SEQ ID NO: 150794 - RNA, 59 nt, Homo sapiens
gcccugaauccgcgcagcggcagcuuggucacggcgggcaggauagaccgggaggagcu

SEQ ID NO: 150795 - RNA, 53 nt, Homo sapiens
cuguaugggggccaucaagugucaauuaaaucuagacauucugauggaggaua

SEQ ID NO: 150796 - RNA, 42 nt, Homo sapiens
guuucauccaaggaaaucugcccuuuaaauuagaaaaaucuu

SEQ ID NO: 150797 - RNA, 42 nt, Homo sapiens
caaggggcaagccuaucguccuacguguccaucaacuccgac

SEQ ID NO: 150798 - RNA, 47 nt, Homo sapiens
gggaguauuuuauuauaguccagucuaugggauauucccuuauacac

SEQ ID NO: 150799 - RNA, 42 nt, Homo sapiens
uuccugcagccccaguucugccauuuggauuaacccccaaaa

SEQ ID NO: 150800 - RNA, 46 nt, Homo sapiens
acccccuucuuuaccuggagguacugcuaucucuccacccccuccu

SEQ ID NO: 150801 - RNA, 42 nt, Homo sapiens
ugcuccuggggauaguaccacuccuccuccuccuccuccucc

SEQ ID NO: 150802 - RNA, 34 nt, Homo sapiens
ggugguggaauaauagugccagagucaccaggua

SEQ ID NO: 150803 - RNA, 44 nt, Homo sapiens
aauuugcugcuuuucagaaugcagugcaucuuuuucucccugaa

SEQ ID NO: 150804 - RNA, 45 nt, Homo sapiens
cagaguuaacagcccgacaugagcuacagguggaaaugaaaaaga

SEQ ID NO: 150805 - RNA, 42 nt, Homo sapiens
uugucuguaucucaucccuaauagguaccauugucaggccuu

SEQ ID NO: 150806 - RNA, 50 nt, Homo sapiens
ugcugagguuaaagcagcccaaucgaucacagcccagagagucagcucca

SEQ ID NO: 150807 - RNA, 42 nt, Homo sapiens
uaccuggagcacaaugcacguggguugguagaaguccacuac

SEQ ID NO: 150808 - RNA, 42 nt, Homo sapiens; identical to SEQ ID NO: 62321

SEQ ID NO: 150809 - RNA, 45 nt, Homo sapiens
aguaauuuccguauuuguggaaggacaccgucaugacccggucag

SEQ ID NO: 150810 - RNA, 44 nt, Homo sapiens
acuccgauuaaccagguaaguuauuacaaaugagcccccugaag

SEQ ID NO: 150811 - RNA, 46 nt, Homo sapiens
uaguccugcuuaaauucacaugguguggucugauguucugagagca

SEQ ID NO: 150812 - RNA, 70 nt, Homo sapiens
augguuacuccagauaagugggugaacuuauuguucuuggccaugaggcugggagccuagucacggaguu

SEQ ID NO: 150813 - RNA, 58 nt, Homo sapiens
agucuuaagguuuuauggaucaguccuggaacuuaucuaaacauuuaacaucauggac

SEQ ID NO: 150814 - RNA, 46 nt, Homo sapiens
acaacuucuucaagcacauugacauccacccagaaaacacccacau

SEQ ID NO: 150815 - RNA, 30 nt, Homo sapiens
ggcagggagggucucauagccaggggccag

SEQ ID NO: 150816 - RNA, 40 nt, Homo sapiens
gagaaacaugaagcaggaaaggauagggagugugucggca

SEQ ID NO: 150817 - RNA, 46 nt, Homo sapiens
guacuauugucccaauuuuuacauaggaggaaacggcucagagaga

SEQ ID NO: 150818 - RNA, 43 nt, Homo sapiens
uuuucccuuuugugcuuugggggaaacugaagacccagagggg

SEQ ID NO: 150819 - RNA, 44 nt, Homo sapiens
cucccaguugucccaauuguaacucgaagggugaauaccaaggu

SEQ ID NO: 150820 - RNA, 43 nt, Homo sapiens
accuugguauucacccuucgaguuacaauugggacaacuggga

SEQ ID NO: 150821 - RNA, 45 nt, Homo sapiens
gggaggccaucaagaaauuaagcaagcgacaccaguaccacaucu

SEQ ID NO: 150822 - RNA, 48 nt, Homo sapiens
gaagaguugccugaggggaauuuugauggcucuauaguacuuuacagu

SEQ ID NO: 150823 - RNA, 29 nt, Homo sapiens
uauaauugcagugcagugugaugagcaga

SEQ ID NO: 150824 - RNA, 27 nt, Homo sapiens
gcccuucuuaauucuguucugagccag

SEQ ID NO: 150825 - RNA, 52 nt, Homo sapiens
cucgcuguugguuagacuuaacacuguuaaucuucagccaaauaucacauau

SEQ ID NO: 150826 - RNA, 51 nt, Homo sapiens
aaaaugauguaucaaugguucuuuuuuagaacaaguuuucaaagcauaaaa

SEQ ID NO: 150827 - RNA, 41 nt, Homo sapiens
gucucuuuauuuguucacuucuaugccaagccuacacacua

SEQ ID NO: 150828 - RNA, 61 nt, Homo sapiens
uuuacuuuuuaugugacaaaaauuggauaaaucaauaauuuuuggaggcuuuucuguaaac

SEQ ID NO: 150829 - RNA, 43 nt, Homo sapiens
uucaucaaugaacucagcugagcuuuuucaaacuucugcauuu

SEQ ID NO: 150830 - RNA, 57 nt, Homo sapiens
cuacugguaagauuuucauuucaaccuucagggugcaauuaaagaacagccuuuaaa

SEQ ID NO: 150831 - RNA, 46 nt, Homo sapiens
agcaaggcagauuugucccuccagacaugaugcagccacaacagcc

SEQ ID NO: 150832 - RNA, 46 nt, Homo sapiens
uuuuauccgaaugguuuuuaugauuagaacucaacagagcuauucc

SEQ ID NO: 150833 - RNA, 46 nt, Homo sapiens
ccccgugauucauuucucuuuucuguuacuuaauuacauaccaaug

SEQ ID NO: 150834 - RNA, 59 nt, Homo sapiens
agugcccaagaauuuaaaaaacaaaacaaaauucaaauucacuguggcucuguaauagu

SEQ ID NO: 150835 - RNA, 49 nt, Homo sapiens
uccuuuaucaggaguaugaucuuucaugcauaaucuucuuccucuagag

SEQ ID NO: 150836 - RNA, 47 nt, Homo sapiens
aaacaagucgcaaaaaaaguuaagcccugaugagaggagguuggguu

SEQ ID NO: 150837 - RNA, 49 nt, Homo sapiens
uuuaugacacaaucucuuuauaauuuuacaaauaaaggaaaaaagaacc

SEQ ID NO: 150838 - RNA, 47 nt, Homo sapiens
acaguuucuggaauacagguuugaggauacaguguuggcagcuucaa

SEQ ID NO: 150839 - RNA, 45 nt, Homo sapiens
augauuaaggauaaccuguuucaucaauuccaagacugucagagu

SEQ ID NO: 150840 - RNA, 47 nt, Homo sapiens
aggaaaaccucagucuucacuuaugucaauuaguguucaguucaaua

SEQ ID NO: 150841 - RNA, 45 nt, Homo sapiens
ggauggucuggugccagccacuaaaacaguuccuuacucuucaau

SEQ ID NO: 150842 - RNA, 25 nt, Homo sapiens
agguaguaacacucugguacagauc

SEQ ID NO: 150843 - RNA, 41 nt, Homo sapiens
accccuuugguuguagccaccccuaaugggcagcaggcagu

SEQ ID NO: 150844 - RNA, 44 nt, Homo sapiens
auaguuucuuuuuguugauagucucauuuuauucuugcgcuuua

SEQ ID NO: 150845 - RNA, 43 nt, Homo sapiens
cuguuugaugaugucuuauaagucccuuaggcucucuugacuu

SEQ ID NO: 150846 - RNA, 53 nt, Homo sapiens
acuuacuucucccaaaaguggcagaaagaaauauugguuagaauaugauguaa

SEQ ID NO: 150847 - RNA, 42 nt, Homo sapiens
auuaauucuagugugagggauuuagguuagcuauuuguagua

SEQ ID NO: 150848 - RNA, 33 nt, Homo sapiens
uuuucucaaauccagaagaaaacaaauuuuuaa

SEQ ID NO: 150849 - RNA, 49 nt, Homo sapiens
agaugccaguuaaauuuuuuucuuuuguuugguuagcuuuuguagcuau

SEQ ID NO: 150850 - RNA, 48 nt, Homo sapiens
gcucuacugaauuuaugcaagaagaaugaucaauggaaauaagggaug

SEQ ID NO: 150851 - RNA, 83 nt, Homo sapiens
aagauucaggggcggaguuaaaaauguagauucaccuugguaauucuaguuuuguaucccugggcuggcucaugaaaaaucga

SEQ ID NO: 150852 - RNA, 41 nt, Homo sapiens
aacaaucauguuuagcuaagagagcauucgaugacauaagu

SEQ ID NO: 150853 - RNA, 55 nt, Homo sapiens
caugcucugcgcauuuaugaagcaccgaauaaauguaaguuguuagaacuaaugg

SEQ ID NO: 150854 - RNA, 41 nt, Homo sapiens
ugcugcaggguaagugcaggggaagcccaguaggauuuggu

SEQ ID NO: 150855 - RNA, 80 nt, Homo sapiens
gucuaaugaaugaugaaugaaaaucugcuaaaggggaugcagacaguacuuguggggugaaaugggaauggcagggucgg

SEQ ID NO: 150856 - RNA, 48 nt, Homo sapiens
acucucuaauagauauggauacaacuuuuuaaauguuuuauuuuugaa

SEQ ID NO: 150857 - RNA, 82 nt, Homo sapiens
aggagucauggcucaauccucgggaaagaaacauggccauacggagucacugccuuacguggacacaguaugcauccaugaa

SEQ ID NO: 150858 - RNA, 45 nt, Homo sapiens
aggccaggcuucugggcccaaaaaguaacagccaacacccaauuu

SEQ ID NO: 150859 - RNA, 480 nt, Homo sapiens
auccaaaugagguaacuuguguaaagugcuuagcacaguugugaccuaaaugaagaaacugaggcaaaaucaauauaaaaagagaguucauucgagccaaguuugagggcugcauccugggagugaaggugcccugaguauacauucugaugagcagaagucgaaaguggguuuuuaaaggagaauaagaagcacuuccuaaguuguuuaccaagaauuuauauuaaaauaacauaaacuauugauugucuguacauuguucuuuguaucacaaauuccaggaacuugaagauaauggguaaggcagcuggucaggaacaaaaugccuuuaaccaguugcucccaggaauggguugggugaggaggggaccacuaaaguccuauacucuugucucucugggcuugauugauuuugcauauuucacuguaacucacacaaucugcucugagcuauuuuucuuuuucucacugcuacugaug

SEQ ID NO: 150860 - RNA, 42 nt, Homo sapiens
aggaagaugaggaagaugaagaggaugaggaggaggaggaag

SEQ ID NO: 150861 - RNA, 45 nt, Homo sapiens
agcugaaaguccccgaauggguggacaccgucaagcugcuggcca

SEQ ID NO: 150862 - RNA, 44 nt, Homo sapiens
accuguaccucugggguggcgcugggguuggcuccaugaccaag

SEQ ID NO: 150863 - RNA, 46 nt, Homo sapiens
ucucgccgucgucauauuccucccggucccgagugucagagcagac

SEQ ID NO: 150864 - RNA, 45 nt, Homo sapiens
gcuccauccacaaugaagguaacaggagcauucuuuggcugggau

SEQ ID NO: 150865 - RNA, 45 nt, Homo sapiens
uuuucaaucacuuuggcauucugugcauaugagucagcaacuucc

SEQ ID NO: 150866 - RNA, 66 nt, Homo sapiens
ugagaaaccauaaccuuacaguuccuuaaccucaacuccagacagugaccuuuaccuuuccugcac

SEQ ID NO: 150867 - RNA, 31 nt, Homo sapiens
aauaaagugcaaagucaagacaguugcauag

SEQ ID NO: 150868 - RNA, 51 nt, Homo sapiens
aaauaacaugauauguuaguauuuaguuucucuauuuucuuuauuaacuug

SEQ ID NO: 150869 - RNA, 43 nt, Homo sapiens
ggcugacaccugagccuggauuuucacucaucccugagaagcc

SEQ ID NO: 150870 - RNA, 49 nt, Homo sapiens
uuguuaaaucaguuacccguaguagagcuauuucuuguacuucuaaguu

SEQ ID NO: 150871 - RNA, 42 nt, Homo sapiens
cuuugggauagguugcaguaccagccacagccagcagauaga

SEQ ID NO: 150872 - RNA, 47 nt, Homo sapiens
gagaacuaagaauaacaguuuuaugugcagagagaguuugccagauc

SEQ ID NO: 150873 - RNA, 40 nt, Homo sapiens
ucaguccuagaaucuccccaagugaguggaagugacauga

SEQ ID NO: 150874 - RNA, 46 nt, Homo sapiens
ggcagucuuuggguucuguucuuugucacguccccuacaaguaaau

SEQ ID NO: 150875 - RNA, 46 nt, Homo sapiens
gggauccagaugcugugaagaucgucucugccaagaaccaccaguc

SEQ ID NO: 150876 - RNA, 44 nt, Homo sapiens
aauucccaguggugggugcacauuugggacuuugggccccuacu

SEQ ID NO: 150877 - RNA, 57 nt, Homo sapiens
guuccgugccaucaccauugccagccaaaccaauugcccucucuacgucacaaaggu

SEQ ID NO: 150878 - RNA, 45 nt, Homo sapiens
uggaaauggggauaacuggcccagaaggccauguacugagcaggc

SEQ ID NO: 150879 - RNA, 47 nt, Homo sapiens
aaugagauaagcaaguauaguuucagaggcagcugagacugagagag

SEQ ID NO: 150880 - RNA, 42 nt, Homo sapiens
ugcucaaguucaugcugagaauggggauaucauugcccaggu

SEQ ID NO: 150881 - RNA, 45 nt, Homo sapiens
ugguuuauauggcuuauaaggauuuguaucaaguaucuaacacag

SEQ ID NO: 150882 - RNA, 27 nt, Homo sapiens
aggaagugcagaaccucaucaaggaca

SEQ ID NO: 150883 - RNA, 47 nt, Homo sapiens
ccugaguccagccugacugaggccuaugagaaauggagagagugggc

SEQ ID NO: 150884 - RNA, 77 nt, Homo sapiens
gugaucccuggaggcaucgauguccauacucacuuccagaugccauauaagggaaugaccacaguagaugacuucuu

SEQ ID NO: 150885 - RNA, 58 nt, Homo sapiens
uggagacaaucugauuguuccuggaggagugaagaccauugaagccaaugggaagaug

SEQ ID NO: 150886 - RNA, 46 nt, Homo sapiens
ucaaugaugaucaguccuuuuaugcugauauuuacauggaagaugg

SEQ ID NO: 150887 - RNA, 61 nt, Homo sapiens
gaggaaaccaaaagaagaggagucacagaaaaccagcucucucugugcaaggcaucuugaa

SEQ ID NO: 150888 - RNA, 46 nt, Homo sapiens
ugugaauuucuucaaaccaggcugccuugaauucauugguuuuaac

SEQ ID NO: 150889 - RNA, 53 nt, Homo sapiens
gcugcagccaccaccgccaccauguccuaccaaggcaagaagaacaucccgcg

SEQ ID NO: 150890 - RNA, 47 nt, Homo sapiens
aagacugcuugagcucaaauccugacccauucacuaauuagcuuguc

SEQ ID NO: 150891 - RNA, 54 nt, Homo sapiens
aagacaaucugaaaggcucagaaacacuuguuccccuuucaggaugccugaaau

SEQ ID NO: 150892 - RNA, 45 nt, Homo sapiens
cugaaaacagcccugcuggacuacaucaaacgcugccguccugga

SEQ ID NO: 150893 - RNA, 46 nt, Homo sapiens
auauaaacaacaucagccuacugacauggucauggaaaaccugaag

SEQ ID NO: 150894 - RNA, 81 nt, Homo sapiens
caaguuuuaugaaauuguaaaugugcuucugaaggacccucagacagguugcugucuaaaggacaugcuagcagguuagau

SEQ ID NO: 150895 - RNA, 66 nt, Homo sapiens
uagcagauucugacagaugugaugagaagaagaaugcauuggagaucuuugcuaaaguugaacaau

SEQ ID NO: 150896 - RNA, 44 nt, Homo sapiens
aaggcugaaaaaagcaagaaaaagaaggaagaggaggaagauga

SEQ ID NO: 150897 - RNA, 53 nt, Homo sapiens; identical to SEQ ID NO: 62448

SEQ ID NO: 150898 - RNA, 42 nt, Homo sapiens
auuugugaccggucuuugcuuugugucugcgcugcaggugag

SEQ ID NO: 150899 - RNA, 30 nt, Homo sapiens
ucuggacagauucauucuuccauagaaauu

SEQ ID NO: 150900 - RNA, 45 nt, Homo sapiens
uggugcaugugagaagguauguauguccaggguggaaggguauga

SEQ ID NO: 150901 - RNA, 40 nt, Homo sapiens
ccugagcacuuuuucagcagcucucugcuucuaccagucc

SEQ ID NO: 150902 - RNA, 48 nt, Homo sapiens
gaaguguucucuuucucuaacuuuuaacgcuuuuucugguagcaacuu

SEQ ID NO: 150903 - RNA, 29 nt, Homo sapiens
gaccccccgccacccgggccuacgcuuuc

SEQ ID NO: 150904 - RNA, 50 nt, Homo sapiens
augccacaacauucauuguaagguuuaauaaaauuaaauuugcaccaaau

SEQ ID NO: 150905 - RNA, 42 nt, Homo sapiens
aauugaauuuuuaauugauuuaguauuuccuccuccucuuug

SEQ ID NO: 150906 - RNA, 60 nt, Homo sapiens
auauucuagaaauaucaaaugucaguaucuugaaaucaucugccucuaacuuugugguau

SEQ ID NO: 150907 - RNA, 41 nt, Homo sapiens
uuuugaugaagagguuuuacuaucucucacugugggaaaau

SEQ ID NO: 150908 - RNA, 61 nt, Homo sapiens
acagucacauuagguaugucaucaucuuuagucaguaaaaaccuuguaaugaggaguagua

SEQ ID NO: 150909 - RNA, 96 nt, Homo sapiens
aaaaacucaguuuaccugugaguucaaugagcuggaucacucacuuggauuuuuguguugacauuuuauucugaggguugauguuacacuauuuaa

SEQ ID NO: 150910 - RNA, 46 nt, Homo sapiens
ucuucacuuucuucacaucugagguuucuuucucuaauccacugaa

SEQ ID NO: 150911 - RNA, 44 nt, Homo sapiens
cuggaugagaaggaaauagcuaaaaauuuaauccagccuauaaa

SEQ ID NO: 150912 - RNA, 45 nt, Homo sapiens
gaaguuuggacaucaugaagaugcuucuuauguauugugccaaga

SEQ ID NO: 150913 - RNA, 46 nt, Homo sapiens
uuacuaaugugccagugccuguugucaguuuuaaucuguguguggg

SEQ ID NO: 150914 - RNA, 33 nt, Homo sapiens
uuguagaccauugaaaucuugggucagaauaau

SEQ ID NO: 150915 - RNA, 56 nt, Homo sapiens
aaaagcaggaaccaauugaaacuaaggcagggacacuggagaaggaugugauuuag

SEQ ID NO: 150916 - RNA, 41 nt, Homo sapiens
cuuauaugugaggguaugucuguucucucuuuuggccaaac

SEQ ID NO: 150917 - RNA, 47 nt, Homo sapiens
ucagcuugauguagauauuauugauaaacucauauuuaagucaaauu

SEQ ID NO: 150918 - RNA, 46 nt, Homo sapiens
aggacauaaagagauugcucaguauuuacuugaaaagggggcagau

SEQ ID NO: 150919 - RNA, 80 nt, Homo sapiens
cgggauggcaaacuccggcuucucaccaaauuguuggcaagcaaauccaaagaggagguuuccuccuugaucucugaaaa

SEQ ID NO: 150920 - RNA, 40 nt, Homo sapiens
auaauugaaaaauagccuuauuguauauuuuaugccauga

SEQ ID NO: 150921 - RNA, 46 nt, Homo sapiens
aggauaauuaaguaguucuuuaguaggaagauaaagaucauguguu

SEQ ID NO: 150922 - RNA, 49 nt, Homo sapiens
uaaccugauuucacacuuuuuguauccccaucaaaugcaauagcuuagc

SEQ ID NO: 150923 - RNA, 92 nt, Homo sapiens
cugggaacuguuguuucucaucaccaucaucaguggagaugguggcaguagguucucccugccuuuuggcaguucuuaaucuuauuuuugug

SEQ ID NO: 150924 - RNA, 28 nt, Homo sapiens
ucugcuuuuaauuuuucuguggucuuug

SEQ ID NO: 150925 - RNA, 45 nt, Homo sapiens
cgggauuccaauucuaaauguuugcccagccugaauacuugggaa

SEQ ID NO: 150926 - RNA, 47 nt, Homo sapiens
aaggucauuacuuggaguugauuuccaauguggucccuuuuaauuag

SEQ ID NO: 150927 - RNA, 49 nt, Homo sapiens
uagaaaguacuucauaaaucgugguugaauuaaugaaaaauggauagag

SEQ ID NO: 150928 - RNA, 92 nt, Homo sapiens
acugggaagcgauuuugaaagauuacagauaaucccaggagcuaaacauggaaauauucaagugggauguguagacuguucaaugcaacaag

SEQ ID NO: 150929 - RNA, 55 nt, Homo sapiens
ccauaauuaaaggcccaaacuaaacacuuccuccagaucaaugcagcacaaguga

SEQ ID NO: 150930 - RNA, 51 nt, Homo sapiens
ccuaggucaguggauuggucauuucccuccacauauuaagggagcaucauc

SEQ ID NO: 150931 - RNA, 52 nt, Homo sapiens
guagaaagggaagguggccuggaaaggcugugaaagcaaagaauggugggag

SEQ ID NO: 150932 - RNA, 47 nt, Homo sapiens
cuucuuuuuuagucaguuagguaaguuuaacaaaguggcuacuagac

SEQ ID NO: 150933 - RNA, 63 nt, Homo sapiens
cacagaaaaaguacuauuugauuaaagaucugaaggagaugugggaacuagauacguagauau

SEQ ID NO: 150934 - RNA, 46 nt, Homo sapiens
aagcgguuuggcagccagaagaacauuauucuucuucuccagagaa

SEQ ID NO: 150935 - RNA, 24 nt, Homo sapiens
gcguccuggaaacuuguuagaaau

SEQ ID NO: 150936 - RNA, 46 nt, Homo sapiens
uguuggguccuugagcagacaauucauuuagaugaguuaagcacag

SEQ ID NO: 150937 - RNA, 47 nt, Homo sapiens
uaaagagaauaucacaucaaacacaaagcauuuaguucacuuagauu

SEQ ID NO: 150938 - RNA, 48 nt, Homo sapiens
cuucuguagauggcuccccaccuuuuccuguuucuuuaucgugggucc

SEQ ID NO: 150939 - RNA, 132 nt, Homo sapiens
aguuuaauaaaacagaguaacuccaguucuggguuacauccuccaaagaaaacucugacucgauccaugaccagucuugcacagaaaaucuguggaaagaaaacugcauucgauccuucaguggauauggaa

SEQ ID NO: 150940 - RNA, 78 nt, Homo sapiens
augaagcugaaucuaaucaugaacgccgccuuaggucucucacaaucagugcuaguggaagcacuaccagagaccccc

SEQ ID NO: 150941 - RNA, 49 nt, Homo sapiens
agaaauagauucuguuccuccacuuccuuuauaugccuuacuugcagca

SEQ ID NO: 150942 - RNA, 55 nt, Homo sapiens
ucaacuucuaaugacugauacucauauguuagagacagaugaagaaaauacaaag

SEQ ID NO: 150943 - RNA, 50 nt, Homo sapiens
gccuuagcagauacaauugcaacuacaagcacugauauuggagaaagccg

SEQ ID NO: 150944 - RNA, 51 nt, Homo sapiens
uuuuauauuuaaaagagagauuucguaaggaaaaagccccaaguguuuuuc

SEQ ID NO: 150945 - RNA, 45 nt, Homo sapiens
auagagcugaaaaaaacaccaggaugacacaguuuuuuggacaca

SEQ ID NO: 150946 - RNA, 48 nt, Homo sapiens
uuaauauggagacuaaagucuccaggggcggauggagaauaguagagg

SEQ ID NO: 150947 - RNA, 65 nt, Homo sapiens
guuaucaguguguagauguuauugaaagucauggggacuauaugaauucaacucagggaauauag

SEQ ID NO: 150948 - RNA, 24 nt, Homo sapiens
uaacaggaaaaaguggacuggcag

SEQ ID NO: 150949 - RNA, 47 nt, Homo sapiens
auuuacuucuccuuuuucuucuuaugcacaucagauuucauaugcaa

SEQ ID NO: 150950 - RNA, 94 nt, Homo sapiens
augguacgauuuguccauuugcuaaccagaaaaaaaggaauauauucacugaaugaugaaaacuaaaggccugcugguuucaaagccaagcuaa

SEQ ID NO: 150951 - RNA, 43 nt, Homo sapiens
ucagaauauuaauuucauugugcugauuuuaaaugauaaacug

SEQ ID NO: 150952 - RNA, 39 nt, Homo sapiens
gaaaauuuucauuaguaucaggcuacauuccaaaaauau

SEQ ID NO: 150953 - RNA, 62 nt, Homo sapiens
cauaugcauuaggauggcuaccaaaaaaaaaacaaaaacaaaaacaaaaaaaauaacagugc

SEQ ID NO: 150954 - RNA, 55 nt, Homo sapiens
uaacuaaaccaaccaucuguaaauguauccgucauacuguuaggugcuugaggau

SEQ ID NO: 150955 - RNA, 45 nt, Homo sapiens
ccgccgaagagaguuugucugcagguccugcaauucuucgccaca

SEQ ID NO: 150956 - RNA, 46 nt, Homo sapiens
uagauccuauggcccuagguuagggaucaacaaacuauggccaucc

SEQ ID NO: 150957 - RNA, 88 nt, Homo sapiens
uccaaacaccaucuggcacugucugugaagaggcuuuggcaguauuuggugaagcaggaagaaauucaggaaaccuuuaucaaaaaua

SEQ ID NO: 150958 - RNA, 44 nt, Homo sapiens
uuucuuucauuggguaaguuuuguuacuaaaaaguucaggugaa

SEQ ID NO: 150959 - RNA, 35 nt, Homo sapiens
gaguagaagcugaugugcuaaaugagggguggcaa

SEQ ID NO: 150960 - RNA, 30 nt, Homo sapiens
ccauggcuugguaguacacagacuggcaga

SEQ ID NO: 150961 - RNA, 49 nt, Homo sapiens
agauaaauccuuucucuguuuagagaacugccaaaacuagcagauaaga

SEQ ID NO: 150962 - RNA, 56 nt, Homo sapiens
aguccaguuaugaacagcaaguguugaacucuuucugcuuguuuugauucaaagug

SEQ ID NO: 150963 - RNA, 51 nt, Homo sapiens
uuuuuuuaacaauggugugcaugugcaggaaaugacaaauuuguaugucag

SEQ ID NO: 150964 - RNA, 45 nt, Homo sapiens
gcauaccaaucaaaaaaugccucccacuguuugugaagcauuaga

SEQ ID NO: 150965 - RNA, 47 nt, Homo sapiens
ccuagaucuacuccagaaaauguaagauaaacuagaaaaaggaauag

SEQ ID NO: 150966 - RNA, 41 nt, Homo sapiens
uuagagauucagugaauacaaaaagaaguuuccauauucag

SEQ ID NO: 150967 - RNA, 51 nt, Homo sapiens
uaauaaaauaugggcaacgauuaucuuggaaauuaaagagucaaagcaaag

SEQ ID NO: 150968 - RNA, 42 nt, Homo sapiens
gauagcaguugaaggggcugaaaaugggauaaccuccaggag

SEQ ID NO: 150969 - RNA, 328 nt, Homo sapiens
ucagagcuauuuaaaaaucccugauuuaggccaggcaccuauaaucccagcacuuugggaggcugagauggguggaucacuugaggccaggaguucaagaccagcuugaccaacauggcaaaacccccucucuaauaaaaauacaaaaauuagcccggcaugguggugcacgccuguagucccagcuccuugggaggcugaggcaggagaaucgcuugaacccaggaugaggagguugcagugagccaagauugcaucgcugcacuccagccugggugacagagcgaggcuccaucuagaaaaaaaaaaaaaauucuguagcauaaaa

SEQ ID NO: 150970 - RNA, 48 nt, Homo sapiens
agagccuaucugugaaaguauccaagaagcugauacaagugaccacaa

SEQ ID NO: 150971 - RNA, 58 nt, Homo sapiens
cauaacuucaagagaagaccuguauugggcuggaaaccucuuuuaaagauuggagaau

SEQ ID NO: 150972 - RNA, 46 nt, Homo sapiens
cgaagaucugcauaauaauggaaagaaguguugggaugccucaaag

SEQ ID NO: 150973 - RNA, 52 nt, Homo sapiens
ucauuguugaaggagagaugcuuccuaauugagauuucccauuccugagugg

SEQ ID NO: 150974 - RNA, 45 nt, Homo sapiens
cuuaauaaauggucuugacuguauaagcuuuuuuggucuuucuua

SEQ ID NO: 150975 - RNA, 45 nt, Homo sapiens
caacagacaauguguguuggcauaaccaguagauuggcacacauu

SEQ ID NO: 150976 - RNA, 44 nt, Homo sapiens
ggagucaggcccaguguuguugaacacacugaggaagcuggcag

SEQ ID NO: 150977 - RNA, 47 nt, Homo sapiens
uguaaacagauaaagauuugaaauguuucagagaugggacucugaaa

SEQ ID NO: 150978 - RNA, 50 nt, Homo sapiens
uacauauaaagcauuuuguacuuuuaaaauaacaccuuagguuuguuuuu

SEQ ID NO: 150979 - RNA, 90 nt, Homo sapiens
ucaccugggcuggcuuguuuuugucaugugguuacagaguccaucccaauggcagagagagcccucugaccauaagcaccacaccccaca

SEQ ID NO: 150980 - RNA, 48 nt, Homo sapiens
aauaaacaucaacaaaauaaauaaguaaaauauauaauaaguggagaa

SEQ ID NO: 150981 - RNA, 46 nt, Homo sapiens
aacuagagaugauggcuuuacugacugcugcaggaauggagagaaa

SEQ ID NO: 150982 - RNA, 30 nt, Homo sapiens
gugagaaaaauuuauaaagaaauauaauau

SEQ ID NO: 150983 - RNA, 77 nt, Homo sapiens
gaagcucucuuguguagcacacggcccuggugagaucccuuaagaucucuuguggacuaucuguggacaucuggguu

SEQ ID NO: 150984 - RNA, 1456 nt, Homo sapiens
auaguuaauuuuauaaguaacuaggaacagaguuucuucuaagaaggugaugaagcaaagagacuauaagcagaauucccuacguggcucugauagcuuuaggugccugaagccuccagaccacauuuguugaagucaggguugacugucaagaagugaauaagcagcucaugaauuuuccuuccaguuugaccugccauuuaugcuuggugccagcucaccuggcuucaauauguguuuucauguggccuacgcagccaggcugagaagcuggggaccagggguguccccagaggcacaggcuguucugccugucauggacuguccaguagacuccugcuuccagggugcagccccucucccuugccugcugcugccuucuuugagccucagauacuccuaacaacaaauguuaacugagauagcaccuccucugcagggccuggagaagcaaaaauguguguguagauaaccccaucuucagagaguuuuugguucagggcaucacacacagcacaugugcauccauaguacaaaaauacaugauggagagggaugaguacagcucagaggaucagacaguggacccuaugaaagucuagaagaggggguauucaccaaaagucaugauggacagaagugacuucaaagagggguaacuuguauuccagcuaguuccuuuaagcaaauggagaagagaaaaagaaagagugagugacagggaaccuacuuaugcugugugcugggaucaggaagaaugucuacagaaguguggagagcagugaucauggugggcauucguggugauguuguagugguacauggggccagucuagaagcuggacuuucccagggggacauuguauguagguaacagagauaagacccugugagucaggagacugauccuacucaugacuuuguuccugguugucugugcaaccuucaauagcuacuuaaucuuucugaaguucaguuuccccauuggaaaaauuaaggcuaggcacaauggcucacaccuguaauuacagcacuuugagagguugaaggaggugggucaguugaccccaggaguucaagaccggccugggcaacaaagugagaccccccaucucuacaaaaaaaauuuaaaaauuaggcacaguggaaugcaccuguagucccagcuacuugggaaaaucaggaagaucauucgagcccaggaguucaaggcugcagugagcuauggucgugccauugcauuccagccugggugucagagcaagauucugucucaaaaaaaaaaaaagaaaaaagaaauaggaugguuuucagcuggauggaggagggcagaugcaaaguaguguuuuaguaaugccaagcuggcaagaaccaugaguuggucuggagggcaagauugaaccugaguauaaggagccucgccaagaaagugugagaguagccagucacaaaggga

SEQ ID NO: 150985 - RNA, 47 nt, Homo sapiens
ugugacugaucaugauuuauuugaagauggagcacugcugauuuaug

SEQ ID NO: 150986 - RNA, 46 nt, Homo sapiens
aguacuguggaaaugaacuauauuagcuauuaugaauaauguccag

SEQ ID NO: 150987 - RNA, 49 nt, Homo sapiens
acgcccaagcagccaggccaguuaaagaaugcccuguacagaguccaua

SEQ ID NO: 150988 - RNA, 46 nt, Homo sapiens
gucuuggaaguggacgaaauuauccagccagaauaugcagagcaag

SEQ ID NO: 150989 - RNA, 40 nt, Homo sapiens
gguaggcaugccauuaauuggaauaggaaacaucagaaga

SEQ ID NO: 150990 - RNA, 45 nt, Homo sapiens
uaggcuguaauuuuuugagacaggagguuugucuacuggugcgag

SEQ ID NO: 150991 - RNA, 43 nt, Homo sapiens
caggcccggcagccauggcgguggaaggaggaaugaaaugugu

SEQ ID NO: 150992 - RNA, 47 nt, Homo sapiens
gacugauugccgugggugucggggcacagcuuguccugagucagacc

SEQ ID NO: 150993 - RNA, 362 nt, Homo sapiens
cacggugaguugggggcgggaccaacaugggcggucugggacugccagagcagcuugguucgggcucaggaaggugggugaggugggugggugaggaagaccuuugugaguguccagggaccggcugugccaaaacgggccccuguaaugcauagacuccaaacuugacuucuguccuuugcuccugcaguuugccaucuuucugucucuuaucauguugguggagguggccgcagccauugcuggcuauguguuuagagauaagguaagcagggaauaaugggaagggccugccucagccgggucugggacccuggugcuugaauucugacugcaacagugcuccuccguacucucaggug

SEQ ID NO: 150994 - RNA, 87 nt, Homo sapiens
augucagaguuuaauaacaacuuccggcagcagauggagaauuacccgaaaaacaaccacacugcuucgauccuggacaggaugcag

SEQ ID NO: 150995 - RNA, 277 nt, Homo sapiens
acgagaaggcgauccauaaggagguagggaggagacuguguaugggacuugggaaaccugggaaauguuuuagaaugcaagagacccaggauggagguggacagggucagggauggggaggggaucuggaaaugcuaaggguggggugaaagguacaggggcagggaagagacugauggaccaagggaggggguuggggugggaaguuucugauggugcuuuuguccuuugugccugccaccuucagggcuguguggagaagauugggggcuggcug

SEQ ID NO: 150996 - RNA, 234 nt, Homo sapiens
uugucgagguaagagauaacccugagcaggggcugggacucuguccagggugccuggagggaaggggcugaggggaggagggugcugaacaggagguacuggccugggaguguguguuuggagucucuugcaugggucugagguagcuagcccuucugacuccucuccaccccuguccccaucuuuccuucuagguuuugggaauugucuuugccugcugccucgugaagagua

SEQ ID NO: 150997 - RNA, 51 nt, Homo sapiens
guggaauaguauccuccagguuuuucaauuaaacggauuauuuuuucagac

SEQ ID NO: 150998 - RNA, 54 nt, Homo sapiens
uaaaggcuccuuagcugcugauaagguuguugaagaaauaagaaggagaggugg

SEQ ID NO: 150999 - RNA, 42 nt, Homo sapiens
gguaacaauagggaucuagugaguauuuuguaaauauuucuu

SEQ ID NO: 151000 - RNA, 50 nt, Homo sapiens
uugcgggguucauuccaagugacacgggcagcaugggaacacaugaagaa

SEQ ID NO: 151001 - RNA, 50 nt, Homo sapiens
caccauugcuccuaaugcgggaucacggaugacucagacaguuaugccug

SEQ ID NO: 151002 - RNA, 26 nt, Homo sapiens
guucuuauacuuugugcacucaccag

SEQ ID NO: 151003 - RNA, 42 nt, Homo sapiens
ugucacgagaguugugaggagaaugguggcuuguuugaggua

SEQ ID NO: 151004 - RNA, 44 nt, Homo sapiens
ugugauaggucaauaaauauaacauuauuuauuuuuacauaaaa

SEQ ID NO: 151005 - RNA, 53 nt, Homo sapiens
agaccauauaaaaaauaaaauaaaaauugccuacauuaucacuauccagagag

SEQ ID NO: 151006 - RNA, 45 nt, Homo sapiens
uaaaaugugaagcaguuguugcugauguccuagauaaaggauccg

SEQ ID NO: 151007 - RNA, 42 nt, Homo sapiens
ucucuuucuuguuggcucuggaggcuuugguggaaaacggac

SEQ ID NO: 151008 - RNA, 51 nt, Homo sapiens
guguggcgggguuugugaggauaaguuugggaauauaucuaaguguggcau

SEQ ID NO: 151009 - RNA, 46 nt, Homo sapiens
uccggauauguagggcuugcaguguguugagaaguaaugauggagu

SEQ ID NO: 151010 - RNA, 149 nt, Homo sapiens
ugagucauugggaaaguaaauaaucuauagaaccauuauauggagucauggggaaggaaaagagcuuauuggaauuauacaaagcauauuaaaaagaaugaugcuuucuuaugaauuauagaauauuuucuauaaauaaaacuuguuaa

SEQ ID NO: 151011 - RNA, 85 nt, Homo sapiens
uggagggaaguucccgcuagugcgaggucuaggauaggaccacgagggugggugugugaguuaucacaaaggacaaggucauugg

SEQ ID NO: 151012 - RNA, 44 nt, Homo sapiens
uuuugcaaaaccaguauauccaggacaaacucuacaaacugaga

SEQ ID NO: 151013 - RNA, 44 nt, Homo sapiens
aaaacuaauacugugguuuugagcuugugugcuugaggauguug

SEQ ID NO: 151014 - RNA, 58 nt, Homo sapiens
ucuuuugauaccagaauaauuaauucuugaggauaccaugugaucauuaaaaccucug

SEQ ID NO: 151015 - RNA, 46 nt, Homo sapiens
acccagucaaugacuauuaugggcaccucagagaagaagacacucc

SEQ ID NO: 151016 - RNA, 46 nt, Homo sapiens
uugaugccaauuccucaguucuucaugaugaguucauggcucacaa

SEQ ID NO: 151017 - RNA, 23 nt, Homo sapiens
caccaagcacucagcagaacucu

SEQ ID NO: 151018 - RNA, 89 nt, Homo sapiens
uauccucccgggacugcccaugugaagaguucugcugagugcuugguggaguucacccucgaugugcagugcaaugaugaccagauuug

SEQ ID NO: 151019 - RNA, 35 nt, Homo sapiens
augcaguguaccccaaacccaaggaguggccaaag

SEQ ID NO: 151020 - RNA, 46 nt, Homo sapiens
uugcccauggggucacagggcaccugugacucauccucauccagcu

SEQ ID NO: 151021 - RNA, 45 nt, Homo sapiens
aacguguggucuuuaugaaaugcuauuuaaugcuaacuaacuuua

SEQ ID NO: 151022 - RNA, 36 nt, Homo sapiens
cucaaacaaaagaggaaaacuuagucuuuaccaaug

SEQ ID NO: 151023 - RNA, 43 nt, Homo sapiens
cuucgcccaccgggacugcagaguggagcggaggacagcaaga

SEQ ID NO: 151024 - RNA, 42 nt, Homo sapiens
cugggccuuucauaaguaucguaguaguuguaauaaggguug

SEQ ID NO: 151025 - RNA, 46 nt, Homo sapiens
aagggucgucgcccaccaugccguccacgcggcugggcggccgcag

SEQ ID NO: 151026 - RNA, 83 nt, Homo sapiens
ucccauuggaucugcuggcgccaggcgcccggagccgccggcggcucgcgcgggggcugcuguuggccggcggcgggaggggc

SEQ ID NO: 151027 - RNA, 44 nt, Homo sapiens
acggggagcggcgcggcagucccggagagcgggcagugucugga

SEQ ID NO: 151028 - RNA, 44 nt, Homo sapiens
acggaacacacauccugagacacacuggcuuaaucuggggcgaa

SEQ ID NO: 151029 - RNA, 47 nt, Homo sapiens
cuuaacagucuacugaauaucugcguggcuucucaacugcuuugggg

SEQ ID NO: 151030 - RNA, 46 nt, Homo sapiens
ggaggacggagaggaccuguucaccagcacugucuccacccuagag

SEQ ID NO: 151031 - RNA, 35 nt, Homo sapiens
ggagggugugccgcugccaggggagcgcaaugaag

SEQ ID NO: 151032 - RNA, 58 nt, Homo sapiens
uuuguuuuugauuauucaucucagcaccuuauuuaauguacucauuuagguuacuaau

SEQ ID NO: 151033 - RNA, 44 nt, Homo sapiens
acagaauuacaacagguaaacaugccaauccauuaccuauuauu

SEQ ID NO: 151034 - RNA, 55 nt, Homo sapiens
caaacuccaauggcccaaaacccacagaaguuguauuagaugaugacagagaaga

SEQ ID NO: 151035 - RNA, 45 nt, Homo sapiens
ggaauuuccagucacaucacucuaugaaaaauguggacuguccag

SEQ ID NO: 151036 - RNA, 52 nt, Homo sapiens
guuucaacauauauaguccauuuuccuuccucugguuaccacaguuugaaag

SEQ ID NO: 151037 - RNA, 60 nt, Homo sapiens
cuccugcagucacaccugucacuccuacuacacucauugcuccuagaauugaaucaaaga

SEQ ID NO: 151038 - RNA, 62 nt, Homo sapiens
guaugucugcucccgugaucuuugauagauccagggaagagguacaggaaaauguauucuaa

SEQ ID NO: 151039 - RNA, 48 nt, Homo sapiens
guuuuacuuuaaaaauaucuguacaagaagacaaccuugaaauaaaac

SEQ ID NO: 151040 - RNA, 46 nt, Homo sapiens
agaagaagcaaauggagacauuuuugacauagaaauugguguauca

SEQ ID NO: 151041 - RNA, 51 nt, Homo sapiens
augguucuggagaugagcaaaauaaguggcuucuugaguuauguaggcggu

SEQ ID NO: 151042 - RNA, 64 nt, Homo sapiens
augccuagguuauugacuagagggacuuugcagcugugagagugauccauggagaaaggcaaca

SEQ ID NO: 151043 - RNA, 46 nt, Homo sapiens
agcaaauauuuacauguugguuauauugugccaccagcuccagaaa

SEQ ID NO: 151044 - RNA, 48 nt, Homo sapiens
caaggucaaaguggguaaagaagacucaucauccacugaguuuguaga

SEQ ID NO: 151045 - RNA, 45 nt, Homo sapiens
uugaaacuuucuaauuucacugguuuuuuuguuugcuugcucuuu

SEQ ID NO: 151046 - RNA, 46 nt, Homo sapiens
gagcugauuuuucggcuugaauaaugagaugaauuaaugagcccaa

SEQ ID NO: 151047 - RNA, 45 nt, Homo sapiens
uagugguuugaagaaaagcagcagcaauuugagaaucuggaucag

SEQ ID NO: 151048 - RNA, 34 nt, Homo sapiens
uucaucccuuuggaauauaagcagugauuugucu

SEQ ID NO: 151049 - RNA, 47 nt, Homo sapiens
ugaugguugcuaacaaaccagauaaaauacagcaagcuaaaaaugaa

SEQ ID NO: 151050 - RNA, 53 nt, Homo sapiens
aaagagauuuugaacagauaucuaaaacgauucgaaaagaagugggaagauuu

SEQ ID NO: 151051 - RNA, 44 nt, Homo sapiens
uugugucuuaaauacuugcacuaaauagugcacugcaagaccag

SEQ ID NO: 151052 - RNA, 45 nt, Homo sapiens
aggagucuugagaagcugaugaucaggaguggucacaggucccag

SEQ ID NO: 151053 - RNA, 46 nt, Homo sapiens
cgaccaccuuggguugacacuugauguccuguaacaucgucacugg

SEQ ID NO: 151054 - RNA, 32 nt, Homo sapiens
caacauucauuuuaguauauggacucugagcc

SEQ ID NO: 151055 - RNA, 46 nt, Homo sapiens
gaaguuucgaagaaagucuuuaagaaggcuacagauagcauggaua

SEQ ID NO: 151056 - RNA, 103 nt, Homo sapiens
gaugcagcaaaaaagggaguugucaaggcugaaaaaagcaagaaaaagaaggaagaggaggaagaugaggaagaugaagaggaugaggaggaggaggaagaug

SEQ ID NO: 151057 - RNA, 47 nt, Homo sapiens
accacuuuuucaagcucauuuccugguaugacaaugaauuuggcuac

SEQ ID NO: 151058 - RNA, 52 nt, Homo sapiens
uggugugcuuuuuauuucaaaccacaccaagcaggaggugguuuaaacuagg

SEQ ID NO: 151059 - RNA, 47 nt, Homo sapiens
auuuggaucugggacagaaaaauauaugauacauaagacaucugggg

SEQ ID NO: 151060 - RNA, 47 nt, Homo sapiens
cagggcacauguccugauuauugguuagaccauauauauccccacca

SEQ ID NO: 151061 - RNA, 48 nt, Homo sapiens
aauuccugaaaucuuaucccuccaaaguuuuccccaaugaauuagaag

SEQ ID NO: 151062 - RNA, 29 nt, Homo sapiens
cgcugaagagugugguaugauagggaggu

SEQ ID NO: 151063 - RNA, 46 nt, Homo sapiens
caccacuuguuacuucuaugccaccuccuguuucuccaucaacugc

SEQ ID NO: 151064 - RNA, 46 nt, Homo sapiens
aacuggauauuguagugaccucaaauaaagaaguaaaaguugcugc

SEQ ID NO: 151065 - RNA, 45 nt, Homo sapiens
gcccuaucguauuaugaagauauaguggaguuuuaauuuaaagaa

SEQ ID NO: 151066 - RNA, 41 nt, Homo sapiens
gauagcuugcgucgaacuggggugauccaugaaaaacagac

SEQ ID NO: 151067 - RNA, 34 nt, Homo sapiens
guugaaauuuuacuacuauaaaagauaacuuuag

SEQ ID NO: 151068 - RNA, 69 nt, Homo sapiens
gucuaaaugaauccaguaguuuuuaucauuuuccuguagccugcaauuuuucuuucucuagaaaggcau

SEQ ID NO: 151069 - RNA, 45 nt, Homo sapiens
uaauacauuuuauuuuuucauugcuauaugacagcuaaggggcaa

SEQ ID NO: 151070 - RNA, 43 nt, Homo sapiens
uuguuucugcuuccacucauauucucuacacauuuuaauacag

SEQ ID NO: 151071 - RNA, 48 nt, Homo sapiens
cuuugugccauuuggucuuuacuuuuuauggauguuuucaaagaaacu

SEQ ID NO: 151072 - RNA, 49 nt, Homo sapiens
aauauuaaauauauguuacuuuccaagcacuguauaaugacuguucagu

SEQ ID NO: 151073 - RNA, 52 nt, Homo sapiens
uauagguugccuugguguacuuuuguccaggaguaacagggacagaauacuu

SEQ ID NO: 151074 - RNA, 45 nt, Homo sapiens
cugguaagccuccugcucggaaccgugugagugggugaggaagau

SEQ ID NO: 151075 - RNA, 27 nt, Homo sapiens
aauuuaauaucaaccucaguugacaag

SEQ ID NO: 151076 - RNA, 74 nt, Homo sapiens
uuuccucguaaugauucuguuauuacuuuccuauucuuuauuccucuuucuucugaagauuaaugaaguugaaa

SEQ ID NO: 151077 - RNA, 51 nt, Homo sapiens
auauucuauguucuaaaaguugggcuauacauaaauuauuaagaaauaugg

SEQ ID NO: 151078 - RNA, 38 nt, Homo sapiens
ggcaauagaaacaaaauuggcaaaaugauaucaaggag

SEQ ID NO: 151079 - RNA, 50 nt, Homo sapiens
auagacucaauggagugaucuggaugauaacuguagagauaaagaaaagc

SEQ ID NO: 151080 - RNA, 56 nt, Homo sapiens
uuuuauugaaaaugcagaagacugggagagaagacggcagauuuuguacauggagg

SEQ ID NO: 151081 - RNA, 36 nt, Homo sapiens
ugccagaagccaggaagccugcaagggaugaggcca

SEQ ID NO: 151082 - RNA, 61 nt, Homo sapiens
uuguaauuugugcaugaaauucaugucauuuccugggagaggagagggccgacuggagagg

SEQ ID NO: 151083 - RNA, 54 nt, Homo sapiens
ccuaagaaguucaucccuccugcucuuacuguuuccggcccuggaggagaauga

SEQ ID NO: 151084 - RNA, 28 nt, Homo sapiens
uuaaaugacauuguuuuugaggcccuag

SEQ ID NO: 151085 - RNA, 40 nt, Homo sapiens
aaccucuuugaaugcugaaaggucuucccucagcucacuu

SEQ ID NO: 151086 - RNA, 46 nt, Homo sapiens
aaucuguauucaaauccccccaauugucucccagguaacuuaugug

SEQ ID NO: 151087 - RNA, 54 nt, Homo sapiens
cugugcccaugggcuuguuagugggaaaagcaaauacaacaauguuuuaccaaa

SEQ ID NO: 151088 - RNA, 138 nt, Homo sapiens
agauaagcugccuggggggcuguuagcuaauggguacaaggacacccccucccgagaagagaagccacagaugagugggccagcgaggccagucuucaauguccacuaauucacucuaagcauuuggccaaaaaaagg

SEQ ID NO: 151089 - RNA, 108 nt, Homo sapiens
aagccuggagacuggaccugccacauguuccaagucugucugccuaggucacugcugccacuucuccucccacuaacagaccuuucuugaagacccacuagguccaga

SEQ ID NO: 151090 - RNA, 61 nt, Homo sapiens
gcucccagguucggaaaucuacccucuaggccuggaggccucucucgcagagcauggaagg

SEQ ID NO: 151091 - RNA, 33 nt, Homo sapiens
ggggcuaccccaggugaacagagguggugagau

SEQ ID NO: 151092 - RNA, 47 nt, Homo sapiens
gguaagccccagucucaggggucacccugucuuagagcuagagauga

SEQ ID NO: 151093 - RNA, 51 nt, Homo sapiens
uuuccugugguaaaagacugaggcaggccaggggucugccaguaacauguu

SEQ ID NO: 151094 - RNA, 40 nt, Homo sapiens
cucaguauucgcugccauaugucccuguccuccaggcugu

SEQ ID NO: 151095 - RNA, 38 nt, Homo sapiens
uuuucugucccucacuguguuccgccgacuguccccuc

SEQ ID NO: 151096 - RNA, 41 nt, Homo sapiens
uuugauccaaagaaaggauuuuggugccaacugcuugaagg

SEQ ID NO: 151097 - RNA, 46 nt, Homo sapiens
ucuggucuuggauggcaaacugcuucgcacagaaccugccaaagug

SEQ ID NO: 151098 - RNA, 47 nt, Homo sapiens
aguggcgccccggcgggcagcagcccucuugcccaaagccaaggucc

SEQ ID NO: 151099 - RNA, 53 nt, Homo sapiens
cuaccccagcucugagaccuuugaggagauccaguuuuuuaauggccacaacu

SEQ ID NO: 151100 - RNA, 50 nt, Homo sapiens
accacugcccucuaccuguuccugggcaugcacccugaccuaagcagcaa

SEQ ID NO: 151101 - RNA, 46 nt, Homo sapiens
agacgugugaccgcuucccaaagcuccucaucaucggcccccagaa

SEQ ID NO: 151102 - RNA, 61 nt, Homo sapiens
ggcuuuuaaaaaguggaagcagaagcuggaauuggugacagucucauaguucagaccagga

SEQ ID NO: 151103 - RNA, 92 nt, Homo sapiens
gcacuccuggacgaaccuccggcugcagacacugcccccugugcaguuggcgcagaaguacuuccagaucuucuccgaggagaaggacccgc

SEQ ID NO: 151104 - RNA, 24 nt, Homo sapiens
ucaugacgcaccuguccaacuaug

SEQ ID NO: 151105 - RNA, 48 nt, Homo sapiens
uaauaauauuaaauaaacuucaaguggugguuguuauucagcucugug

SEQ ID NO: 151106 - RNA, 42 nt, Homo sapiens
ugcuccucaauccugugagugcuccacagcccauggcugcug

SEQ ID NO: 151107 - RNA, 78 nt, Homo sapiens
aaugcuggcaagagaagcugguuuaaauaagguggcuaggugggccuuccuggaauaagccacgcugccacaugagga

SEQ ID NO: 151108 - RNA, 47 nt, Homo sapiens
cggaucaguugccauaaauagagggcaaccauaacaauaaauccaau

SEQ ID NO: 151109 - RNA, 41 nt, Homo sapiens
gugugaauuaugagcaggaguuugucaggccaagaagacgg

SEQ ID NO: 151110 - RNA, 39 nt, Homo sapiens
cacucuccacagccuuagccccgugggccccacggagug

SEQ ID NO: 151111 - RNA, 25 nt, Homo sapiens
ugcuccuucccucuggcgucagccu

SEQ ID NO: 151112 - RNA, 53 nt, Homo sapiens
gcagggcaucuggcaaauguuagcugucuuaggugaucacagaggggcugcgg

SEQ ID NO: 151113 - RNA, 46 nt, Homo sapiens
cagggagaggucuaggcugaccuggcagauuccugauggaggagaa

SEQ ID NO: 151114 - RNA, 35 nt, Homo sapiens
agugugugugugugugugugugugugugugucccc

SEQ ID NO: 151115 - RNA, 35 nt, Homo sapiens
guaaaaugaggccaugaucaaguagaggccaagca

SEQ ID NO: 151116 - RNA, 35 nt, Homo sapiens
aaaguuggcaugugauaccgcagcaaugccuguga

SEQ ID NO: 151117 - RNA, 46 nt, Homo sapiens
uggucaucauugucccaaaggcccaucaguugguugaacuggaaag

SEQ ID NO: 151118 - RNA, 48 nt, Homo sapiens
ggccacacucuuccaucuccaccucccucugcaggggcaguggcagau

SEQ ID NO: 151119 - RNA, 47 nt, Homo sapiens
uguauuuucugggcccugagaggauauuuggaacaauggagguggga

SEQ ID NO: 151120 - RNA, 38 nt, Homo sapiens
cugcagacauuguuguucuccuguuuuguggaugggcu

SEQ ID NO: 151121 - RNA, 45 nt, Homo sapiens
aauaucuggacuguuuggaggacuuggacauucuuuacuugaaau

SEQ ID NO: 151122 - RNA, 25 nt, Homo sapiens
uuccaugcuuugggaccaaagccag

SEQ ID NO: 151123 - RNA, 67 nt, Homo sapiens
uugcuaccagaaauccuaccgauaagcccaucaugacuaucaaaauucaccuguauaauaaacaguu

SEQ ID NO: 151124 - RNA, 41 nt, Homo sapiens
uccaccuccaaagcccugguggccuauuaccagaaauaugu

SEQ ID NO: 151125 - RNA, 41 nt, Homo sapiens
agccccuggagaugacugagccgcgcaugcuacaauacgag

SEQ ID NO: 151126 - RNA, 49 nt, Homo sapiens
gugccgcucggucucuggcugaucccgaggcuuugucuuccucucguca

SEQ ID NO: 151127 - RNA, 55 nt, Homo sapiens
ucaggggucccugugcuggccaagccagugagccugcggggaggcugguccaagg

SEQ ID NO: 151128 - RNA, 59 nt, Homo sapiens
agcaaaaaaggccucaaccaaagauucugagucaccgucccagaagaaaaagaagaaaa

SEQ ID NO: 151129 - RNA, 65 nt, Homo sapiens
uucaggaacuuuacuuuacuucccuuaggaaaaaaagacaaagaaaaaaaagaaaagaagaagaa

SEQ ID NO: 151130 - RNA, 53 nt, Homo sapiens
agaggagcuucagaaggggauggggacgguugaagguggagaucaaagcaacc

SEQ ID NO: 151131 - RNA, 53 nt, Homo sapiens
aagcggaagcuaucgggagaccagccagcugccaggacccccaggagcaagaa

SEQ ID NO: 151132 - RNA, 68 nt, Homo sapiens
uggaacaggaaagaaagaaggugguggacaccaccaaggagagcagcaggaagggcugggagagccgc

SEQ ID NO: 151133 - RNA, 76 nt, Homo sapiens
gcucuccccaucugugccauuguaagaaaagauggagucacucccugcacccucuucgcucuuagguaccauaaga

SEQ ID NO: 151134 - RNA, 126 nt, Homo sapiens
cuggagucauuuucugucccccacccuaacuggaguuuuuaguauaaagagacagggaaaagcuguaaguuagaaaugaagucagggugugaaauugguggaaaggugugagcuuaggagaccagc

SEQ ID NO: 151135 - RNA, 36 nt, Homo sapiens
ccugaccaggaagggccgaguguggguaaucaucag

SEQ ID NO: 151136 - RNA, 26 nt, Homo sapiens
aggcaaagccccaacaggcagcaggc

SEQ ID NO: 151137 - RNA, 35 nt, Homo sapiens
agcuuccugagguccagcaggccaccaaagccccu

SEQ ID NO: 151138 - RNA, 49 nt, Homo sapiens
gugggaacacucccugcaacaaguccccagagcaccuccguccaggcca

SEQ ID NO: 151139 - RNA, 45 nt, Homo sapiens
gucgacccuaaucguaguccagcuggcccagcugcuacacccgca

SEQ ID NO: 151140 - RNA, 109 nt, Homo sapiens
aacugaggaucagaaaguugaggggcuugaccacacagugaagucaugagagaggcguaaugagaagcaggucuucuccuauacccugggcaagcuucacugcccaccu

SEQ ID NO: 151141 - RNA, 45 nt, Homo sapiens
ucugugacuugcuggaaugaaggcacaguuagaaugagcucagcu

SEQ ID NO: 151142 - RNA, 53 nt, Homo sapiens
agacuuccuggguuggugggguggaccuugaggcuccaggccacauccccaga

SEQ ID NO: 151143 - RNA, 42 nt, Homo sapiens
cuguaagaaacuaaauucugguguuacauugaggccuagcau

SEQ ID NO: 151144 - RNA, 57 nt, Homo sapiens
aggccagagucugugcuggggucaggacagcuuccagauuuaaaaacaaguagguga

SEQ ID NO: 151145 - RNA, 45 nt, Homo sapiens
gggguccucggagagcagugaggaagagcugccacugacccaggu

SEQ ID NO: 151146 - RNA, 45 nt, Homo sapiens
acuccaaaccugccagaagcaagacccuggccccagcacccccag

SEQ ID NO: 151147 - RNA, 60 nt, Homo sapiens
cuuaaggcuccaguuccaccaugcccuccuccgucugcugucauccacaucuccuuaggu

SEQ ID NO: 151148 - RNA, 53 nt, Homo sapiens
gcagggaagcaggaugacucagggagcagcagcgaggaaucagacagugaugg

SEQ ID NO: 151149 - RNA, 41 nt, Homo sapiens
cugccaaggagucccccaggaaaggggcugccccaacaccu

SEQ ID NO: 151150 - RNA, 39 nt, Homo sapiens
ggaggacucagggagcagugaggaggagucagacaguga

SEQ ID NO: 151151 - RNA, 57 nt, Homo sapiens
uagcuaaugcuaaggaaggcacgcacaaugaguuugaguguuuauuauguuccagac

SEQ ID NO: 151152 - RNA, 43 nt, Homo sapiens
aaugacauugccaccuagcugaaagggagccuggaaaacaucu

SEQ ID NO: 151153 - RNA, 44 nt, Homo sapiens
gaaaagcaggaagacucugagagcagugaggaggaaucagacag

SEQ ID NO: 151154 - RNA, 50 nt, Homo sapiens
caccuccuaggaaaacagggccugcagccgcccagguccagguggggaag

SEQ ID NO: 151155 - RNA, 46 nt, Homo sapiens
gaaggcaggggcuguagccucccagaccaaggcagggaagccagag

SEQ ID NO: 151156 - RNA, 54 nt, Homo sapiens
aguugcccucucccagccucuaacccuuccaggaaccugucuggggcuucagac

SEQ ID NO: 151157 - RNA, 45 nt, Homo sapiens
aggccgacagcuccagcgaggacaccuccagcuccagugaugaga

SEQ ID NO: 151158 - RNA, 52 nt, Homo sapiens
aagacuagcaucuaccaacuccucaguccugggggcggacuugccaucaagc

SEQ ID NO: 151159 - RNA, 40 nt, Homo sapiens
ucggaagaggaggaagaagcagaagccgaaaccgccaaag

SEQ ID NO: 151160 - RNA, 45 nt, Homo sapiens
gaaaaugaaacaggaucacagggcagagcaugccuuggaagaggg

SEQ ID NO: 151161 - RNA, 46 nt, Homo sapiens
uggcuaugugcgugcggcgcgggaagugaaggagcagagcggccag

SEQ ID NO: 151162 - RNA, 45 nt, Homo sapiens
ucaggaaauaaguggcucacaaaccuggcuuggcaccaggaucaa

SEQ ID NO: 151163 - RNA, 55 nt, Homo sapiens
aaaaauucagauuuccagauucucuugaaaaacgaggcacgucaacacuggucuc

SEQ ID NO: 151164 - RNA, 67 nt, Homo sapiens
ugcugguucucccagguggauuuugcuggaauucucccaugucaucaccccaccaccgucacuucug

SEQ ID NO: 151165 - RNA, 76 nt, Homo sapiens
aguccugccuguccuucuacucagcuguuacccacucugggaccagcagucuuucugauaacugggagagggcagu

SEQ ID NO: 151166 - RNA, 77 nt, Homo sapiens
aaggaggacuuccuggagggggugacuguccagagccuggaacugugcccacaccagaagccaucagcagcaaggua

SEQ ID NO: 151167 - RNA, 33 nt, Homo sapiens
gcauaaauccaaucacaccaccucccugcccag

SEQ ID NO: 151168 - RNA, 53 nt, Homo sapiens
agugccuggcucuaaauuaguagggacuuuuguuuguuuccagauuggggggg

SEQ ID NO: 151169 - RNA, 18 nt, Homo sapiens
uuuuuauuugagcuuguu

SEQ ID NO: 151170 - RNA, 85 nt, Homo sapiens
ccggagaggucacauagguauuucagaaaggucccucuggcuggggugugagaacagguggaggggacagauuggaggugaggag

SEQ ID NO: 151171 - RNA, 45 nt, Homo sapiens
cuagcucagagucucuaagccacccccagccccaggcccagcaga

SEQ ID NO: 151172 - RNA, 50 nt, Homo sapiens
ggaaacuaaggcacagagagagucuggggacgcagccgaggccacgugag

SEQ ID NO: 151173 - RNA, 46 nt, Homo sapiens
aggacaccaugcggcuuccgggugcgaugccagcucuggcccucaa

SEQ ID NO: 151174 - RNA, 46 nt, Homo sapiens
ugaagcaccaggcacacugcccugcccuucagcuuuaguuuucagg

SEQ ID NO: 151175 - RNA, 66 nt, Homo sapiens
acccccggggccagagcuuguccucaaugucuccagcaccuucguucugaccugcucggguucagc

SEQ ID NO: 151176 - RNA, 43 nt, Homo sapiens
ugugggaacggaugucccaggagcccccacaggaaauggccaa

SEQ ID NO: 151177 - RNA, 45 nt, Homo sapiens
gacuggagaccgaugagcggaaacggcucuacaucuuugugccag

SEQ ID NO: 151178 - RNA, 56 nt, Homo sapiens
ccauuccaugccgaguaacagacccacagcugguggugacacugcacgagaagaaa

SEQ ID NO: 151179 - RNA, 45 nt, Homo sapiens
cuacaccugcaaugugacggagagugugaaugaccaucaggauga

SEQ ID NO: 151180 - RNA, 40 nt, Homo sapiens
gcagagagcggcuacgugcggcuccugggagaggugggca

SEQ ID NO: 151181 - RNA, 91 nt, Homo sapiens
gccugucucuucaagguucuugaacuucccucccugccuuugugcagcuugcauccaaguaggggaagacaaacacuaacaguagggagga

SEQ ID NO: 151182 - RNA, 61 nt, Homo sapiens
aaaccccagcaaauuacauagguuagaagguaacuaacacugcgggagaggaaaaacaggg

SEQ ID NO: 151183 - RNA, 46 nt, Homo sapiens
uuccgaagaggagagccagcuggagacuaacgugacguacugggag

SEQ ID NO: 151184 - RNA, 44 nt, Homo sapiens
cugugaguccccagccucaguggccccugacgaucccaaucccu

SEQ ID NO: 151185 - RNA, 47 nt, Homo sapiens
guacaugcauaggaacacauucuggcaaacacaauauggguacacac

SEQ ID NO: 151186 - RNA, 46 nt, Homo sapiens
cacagcccgcagcagugagaagcaagcccuuaugucggagcugaag

SEQ ID NO: 151187 - RNA, 52 nt, Homo sapiens
ucaugacagugcuuugugguggguuuaauuagccccacuuaacagcugggga

SEQ ID NO: 151188 - RNA, 73 nt, Homo sapiens
ccugguggacuaccugcaccgcaacaaacacaccuuccugcagcaccacuccgacaagcgccgcccgcccagc

SEQ ID NO: 151189 - RNA, 51 nt, Homo sapiens
gcuacauggacaugagcaaggacgagucgguggacuaugugcccaugcugg

SEQ ID NO: 151190 - RNA, 57 nt, Homo sapiens
acaugaaaggagacgucaaauaugcagacaucgaguccuccaacuacauggccccuu

SEQ ID NO: 151191 - RNA, 56 nt, Homo sapiens
ccucagggagggagagagcagggauaugggaggaccuggccuuuugucgugguagg

SEQ ID NO: 151192 - RNA, 42 nt, Homo sapiens
ccuuuaaaguggauggcuccggagagcaucuucaacagccuc

SEQ ID NO: 151193 - RNA, 42 nt, Homo sapiens
ccuggacaccagcuccguccucuauacugccgugcagcccaa

SEQ ID NO: 151194 - RNA, 46 nt, Homo sapiens
uccacccugaaugaagucaacaccuccucaaccaucuccugugaca

SEQ ID NO: 151195 - RNA, 43 nt, Homo sapiens
uagcuuccuguagggggcuggccccuacccugcccugccugaa

SEQ ID NO: 151196 - RNA, 66 nt, Homo sapiens
agccucccuggcugcuggcugagcuagggccuagccuugagcaguguugccucauccagaagaaag

SEQ ID NO: 151197 - RNA, 50 nt, Homo sapiens
gagcacacgcagccauagcaagugccugugucccuguccuucaggcccau

SEQ ID NO: 151198 - RNA, 71 nt, Homo sapiens
gaaccaugccccuuccccaggcccccagcaagucucaagaacacagcugcacaggccuugacuuagaguga

SEQ ID NO: 151199 - RNA, 135 nt, Homo sapiens
aucaccuccugcagcccaccacuccagcaccugugccgaggucugcgucgaagacagaauggacagugaggacaguuaugucuuguaaaagacaagaagcuucagauggguaccccaagaaggaugugagaggug

SEQ ID NO: 151200 - RNA, 47 nt, Homo sapiens
agguuuacaaauauuuuuaggacucacguuaacucacauuuauacag

SEQ ID NO: 151201 - RNA, 44 nt, Homo sapiens
ggcauuggcucugaagaaauuagauaagggccuaagauagaaag

SEQ ID NO: 151202 - RNA, 45 nt, Homo sapiens
ugcagcaccugcuaaggcaguguggaauccccuuuggggcagaag

SEQ ID NO: 151203 - RNA, 45 nt, Homo sapiens
gcucuaaugagguaaauguggaggacuuuugggccacgauggaga

SEQ ID NO: 151204 - RNA, 79 nt, Homo sapiens
uaggagucagauugcugggucaugugguaaguguguguuuaauuuuauaagaaaacugcauuaccaaaguggcuguacc

SEQ ID NO: 151205 - RNA, 71 nt, Homo sapiens
uaaaucugauucaugguguuucuaauacaugguauuagaaacugcacagaagcauguggcaaggccuggac

SEQ ID NO: 151206 - RNA, 42 nt, Homo sapiens
gcagagcacggggcaagcccucauuacuggcugcagcaagac

SEQ ID NO: 151207 - RNA, 39 nt, Homo sapiens
ugaagauuguauauaaaacaugcaaccaaguaccuugca

SEQ ID NO: 151208 - RNA, 54 nt, Homo sapiens
gagcuaagcuugauagaacccagccuuuauguuuccuaguuuacagugcccuuu

SEQ ID NO: 151209 - RNA, 42 nt, Homo sapiens
ugugccugaaucugcggucuacaauuuuuaggugccucauuc

SEQ ID NO: 151210 - RNA, 42 nt, Homo sapiens
ccagcccagggugcuccuuuacauaugucaccaggcacaagc

SEQ ID NO: 151211 - RNA, 65 nt, Homo sapiens
aguggagggauuucugccagcauugccauuacuggccagacuuugcuuuuguuuucaaguuguca

SEQ ID NO: 151212 - RNA, 46 nt, Homo sapiens
aagaaaaaguauaaaauacauggagaaaagacaaagaaacccaggu

SEQ ID NO: 151213 - RNA, 48 nt, Homo sapiens
cuugacuccacaugcagugcucauuauaccuuauuuguggagugaggu

SEQ ID NO: 151214 - RNA, 57 nt, Homo sapiens
gggacagagaaagugucucgcauauuucagguauugaccuuaacucuguuuuacaga

SEQ ID NO: 151215 - RNA, 61 nt, Homo sapiens
caucccagugaugccuuauuugaaacugggcuuaaacugcaaaaagaaugaaguuggauuu

SEQ ID NO: 151216 - RNA, 37 nt, Homo sapiens
uuguggagcauguugaagcuuugagaucugagcagga

SEQ ID NO: 151217 - RNA, 38 nt, Homo sapiens
guucccccggaccggccuauuccaacccaguuucuguu

SEQ ID NO: 151218 - RNA, 42 nt, Homo sapiens
ucuuguuacuccagcuccagccaacacaaaaugcccccaguc

SEQ ID NO: 151219 - RNA, 68 nt, Homo sapiens
ccaggccgcaguuugugaagggcuucucggcgguuaccaggcugggccacuuguuucucggcggccgc

SEQ ID NO: 151220 - RNA, 45 nt, Homo sapiens
cgcugcuacucgccauccugagagacgaagauggaggcuggggcc

SEQ ID NO: 151221 - RNA, 45 nt, Homo sapiens
uuggugauguugaucgccaaauagauguccccgaaggagccagac

SEQ ID NO: 151222 - RNA, 45 nt, Homo sapiens
aaguuguccugaaguugagaauuucuaucagauagaucaucagau

SEQ ID NO: 151223 - RNA, 51 nt, Homo sapiens
caucaaaauaaaacaauaaaaaagaaaagcacaugaauuugggauugaggu

SEQ ID NO: 151224 - RNA, 42 nt, Homo sapiens
uuaagcuuggagaauuuuaaaucagauuggcaguaucuaaag

SEQ ID NO: 151225 - RNA, 46 nt, Homo sapiens
guccacaaccacuggcuaguguacauaugaacuaaaauuucuagau

SEQ ID NO: 151226 - RNA, 52 nt, Homo sapiens
ugaaagaaugccuuuccccuucagacaaaagaauuacuuuuuucauuuuucu

SEQ ID NO: 151227 - RNA, 44 nt, Homo sapiens
cuaagugcauaguaaauaaaagcacugaaaaauaucuugcuaga

SEQ ID NO: 151228 - RNA, 48 nt, Homo sapiens
augagcuggcacuggaggcaucccauaaaccacaagccacuaauaaag

SEQ ID NO: 151229 - RNA, 37 nt, Homo sapiens
uuuaccauuauuccugcccacuuccaaccccgauacc

SEQ ID NO: 151230 - RNA, 44 nt, Homo sapiens
acaggagccaagggcuggaacuuuauuauugucacagagcacag

SEQ ID NO: 151231 - RNA, 34 nt, Homo sapiens
cuccacggucaggccagcccugucacuacggaug

SEQ ID NO: 151232 - RNA, 51 nt, Homo sapiens
ccuugaaaaauuuuccauuuguucucuggcugcauuccaaaucgaacgaag

SEQ ID NO: 151233 - RNA, 47 nt, Homo sapiens
uuaugcuuuucuuugcuuuuucuacaaacccuuaaaaaucacuuguu

SEQ ID NO: 151234 - RNA, 56 nt, Homo sapiens
gcaccuagaggaauuagccauucucuuccuuaugcaaagauugaggaaugcaacaa

SEQ ID NO: 151235 - RNA, 45 nt, Homo sapiens
aucguggucaucgccaccccccugcaccuggacaacagcagcagc

SEQ ID NO: 151236 - RNA, 42 nt, Homo sapiens
uggcugagucccugcugcaggugggcgucacgcagcgcuuua

SEQ ID NO: 151237 - RNA, 47 nt, Homo sapiens
ugcaaacucagucgcuuaacaagggcugaacugggaugcgagucagu

SEQ ID NO: 151238 - RNA, 81 nt, Homo sapiens
agaaguucaugagguagggcuggcagagcuguggggauggcguuccaggggaaccgagaagaggugggggaggaaccagcu

SEQ ID NO: 151239 - RNA, 43 nt, Homo sapiens
ucuggaaaaauggguaauuugggacucuuugcacauggagggg

SEQ ID NO: 151240 - RNA, 27 nt, Homo sapiens
aaggagcuggguggaggagaggcgccg

SEQ ID NO: 151241 - RNA, 43 nt, Homo sapiens
auccuggaucacaugcacaauguuaacgaugaagaagggcagc

SEQ ID NO: 151242 - RNA, 46 nt, Homo sapiens
uugacaaaucugagggccgcuuccauguccagaaccuuagccaggu

SEQ ID NO: 151243 - RNA, 59 nt, Homo sapiens
ugacuugggaugguuugcccaguuuuaaacucucugggucuuuccguguauagcacauu

SEQ ID NO: 151244 - RNA, 57 nt, Homo sapiens
gguccacacugguucgcagagcuacaauacuuacuuucuauuguuugugauuuuacu

SEQ ID NO: 151245 - RNA, 42 nt, Homo sapiens
aucuguagacaugugcugaagaaugaagaaguagcacaggua

SEQ ID NO: 151246 - RNA, 318 nt, Homo sapiens
auuuguuggccgaggcaggcggaucacuugaggucaggaguucaagaccagccuggccaacuuggugaaaaaccucgucucuacuaaaaauacaaaaauuaacuggaugugguggcacgugccuguaaucucagcuguuggggaggcugaggcaggagacuugcuugaaccugggagauggagguugcagugagcugagaucgugccucugcucuccagccugggcgacacagcaaggcuccaucccaaaaacaaacaaacaaacaaaaaaacuuagguuuagguuugucagauggaaauuaauuuaaccuuacugag

SEQ ID NO: 151247 - RNA, 43 nt, Homo sapiens
cugcuccucaaaagcaggccaggaauuaauguccugcuguggu

SEQ ID NO: 151248 - RNA, 46 nt, Homo sapiens
aauuacuaggaaaagccuccagacuacuaguacgaggacguaggua

SEQ ID NO: 151249 - RNA, 59 nt, Homo sapiens
ggguuuuuuuccauuuccucuugcagcauucauugcccugcccugagagaagcccacag

SEQ ID NO: 151250 - RNA, 26 nt, Homo sapiens
ggacuguugugaagaauacauuaguc

SEQ ID NO: 151251 - RNA, 45 nt, Homo sapiens
guaccuguuuggccuuaggccuuuagaguaucaucauaguaucag

SEQ ID NO: 151252 - RNA, 46 nt, Homo sapiens
uguuguugacaguaugcuaagcugggccugaguuuggugguuccag

SEQ ID NO: 151253 - RNA, 44 nt, Homo sapiens
caccacaggccaagccugauggugucacugccacggcugcugau

SEQ ID NO: 151254 - RNA, 46 nt, Homo sapiens
agauuauugcuucuauaggaagauaauuaugaaaauaaaaccugaa

SEQ ID NO: 151255 - RNA, 46 nt, Homo sapiens
cggcggaagcagcacucccugcugaagcgccugcgcaaggccaaga

SEQ ID NO: 151256 - RNA, 68 nt, Homo sapiens
agcauggugggcgucuacaacggcaagaccuucaaccagguggagaucaagcccgagaugaucggcca

SEQ ID NO: 151257 - RNA, 48 nt, Homo sapiens
auguauucucaauaggcuguauucccagcagucaauaaaugaacaccc

SEQ ID NO: 151258 - RNA, 45 nt, Homo sapiens
auucaguaagccugcugugaguuaauaagguagcacagauuagau

SEQ ID NO: 151259 - RNA, 48 nt, Homo sapiens
gguaaagaggcagauugauuuucccucuuuccugguaauuccuaagua

SEQ ID NO: 151260 - RNA, 56 nt, Homo sapiens
caguuauuaaucuuuucuaacucugcuuagcugcuaauaauccugaggcauagaaa

SEQ ID NO: 151261 - RNA, 40 nt, Homo sapiens
uuuaugguaguagaaagaaaaacagaaagagaaaccccaa

SEQ ID NO: 151262 - RNA, 46 nt, Homo sapiens
uaaaagggaagggauugaccccacucccuauuacugguauacggau

SEQ ID NO: 151263 - RNA, 51 nt, Homo sapiens
gacagacaccauuaaugaaccaaucuugcugugucgauuuccuguggagau

SEQ ID NO: 151264 - RNA, 46 nt, Homo sapiens
uucagaugcuaucguuuggcuaaaagaacaugauguaaagaaagaa

SEQ ID NO: 151265 - RNA, 46 nt, Homo sapiens
auugaagucaccugcagggagcauagugcaugagcucaacccggua

SEQ ID NO: 151266 - RNA, 25 nt, Homo sapiens
cuauugucucguucuucagguacac

SEQ ID NO: 151267 - RNA, 45 nt, Homo sapiens
guugauguccagcucaacaacagacacaugaugauccgaggagaa

SEQ ID NO: 151268 - RNA, 46 nt, Homo sapiens
caaagaguaaagguguuuggcuggguccacaggcugcgcaggcaag

SEQ ID NO: 151269 - RNA, 60 nt, Homo sapiens
uccuuucagaagggacauagagaaauaauguuuuagaguuaugaggcuaguucuuuaggg

SEQ ID NO: 151270 - RNA, 32 nt, Homo sapiens
gauaguuuacgaagagaaaagaaccuggaaga

SEQ ID NO: 151271 - RNA, 51 nt, Homo sapiens
uaaaucacaguugaagaacauuaaaaagauguggcauagggaacaaaugaa

SEQ ID NO: 151272 - RNA, 42 nt, Homo sapiens
ccauuuccuaccauuuacguagauucacaaaaagaaaaugag

SEQ ID NO: 151273 - RNA, 42 nt, Homo sapiens
agaauccauuggcuauaacugccacauaaggaagaugguuaa

SEQ ID NO: 151274 - RNA, 46 nt, Homo sapiens
uucuccuugguuccaucucccguggcaucgcuucccucucggucag

SEQ ID NO: 151275 - RNA, 35 nt, Homo sapiens
uaguaaggugacuaauaguuaauggccagaccaua

SEQ ID NO: 151276 - RNA, 44 nt, Homo sapiens
auuauuaacuaauguuuuuaugagauggauguuauugaaaugga

SEQ ID NO: 151277 - RNA, 60 nt, Homo sapiens
aaaaaaaagagagagaccuggauggauguuaacuguucagaccuacuaguugugaggccu

SEQ ID NO: 151278 - RNA, 51 nt, Homo sapiens
uccauccaggucucucucuuuuuuuuuuuuuuuuuccuacugcacaguaug

SEQ ID NO: 151279 - RNA, 42 nt, Homo sapiens
caggaaggggcuuuaggauucuaguuguuuuucucccacccu

SEQ ID NO: 151280 - RNA, 57 nt, Homo sapiens
aucacuuugaagaacugcaggaguaggggcuacccugugucugaacccgucccagcg

SEQ ID NO: 151281 - RNA, 54 nt, Homo sapiens
gcccggagccaccgccaucgcagcccgggggaacgacggacucggggaagcccg

SEQ ID NO: 151282 - RNA, 47 nt, Homo sapiens
uggagucauaagacggcgucgguguugcagucuguguccuuggaggu

SEQ ID NO: 151283 - RNA, 59 nt, Homo sapiens
ccuggaacuuucucucucaugauuguguggaucagcaggcgcucagaagccugugcgug

SEQ ID NO: 151284 - RNA, 51 nt, Homo sapiens
cagagggaaaagaagcaaagaagcacugcucacugaacuauggccugagag

SEQ ID NO: 151285 - RNA, 34 nt, Homo sapiens
auaaacagagaggcagucccauggugcugauaga

SEQ ID NO: 151286 - RNA, 43 nt, Homo sapiens
aaaaagauacauauguaagcccgcuaaaggucacgaaggugua

SEQ ID NO: 151287 - RNA, 48 nt, Homo sapiens
ggagcuuggggcacuugcucucugacagcagccuccauucauuaacgg

SEQ ID NO: 151288 - RNA, 29 nt, Homo sapiens
uuccugauuauuugaugcuagcuggaauu

SEQ ID NO: 151289 - RNA, 34 nt, Homo sapiens
uuggaacuuuuuagaucugucuguugcuuguuua

SEQ ID NO: 151290 - RNA, 45 nt, Homo sapiens
ugacuugaacaagggauugccugccucacugcauugcagagauac

SEQ ID NO: 151291 - RNA, 47 nt, Homo sapiens
guuugaauguuuuauucagcuuaaaacuuuaccaugaagucauaaac

SEQ ID NO: 151292 - RNA, 54 nt, Homo sapiens
aaaauugauuuuaaaauuuuuauguaagucauugugucuaugaugccacuuuua

SEQ ID NO: 151293 - RNA, 56 nt, Homo sapiens
gccuuuuaucuuuuauacuuagugauauacuuugcuugaaaaucacucagcaaagu

SEQ ID NO: 151294 - RNA, 46 nt, Homo sapiens
ggggaaucauucugauuauucuuacuacaaauggagauggcuauua

SEQ ID NO: 151295 - RNA, 46 nt, Homo sapiens
aacuugagaaauccucuugagauaaaaggcugccaaauccaguauu

SEQ ID NO: 151296 - RNA, 55 nt, Homo sapiens
ccaaacgagugcugugugugcaaacagucuggcguugcuuuuuauguugauauuu

SEQ ID NO: 151297 - RNA, 51 nt, Homo sapiens
auaauuuuuauauuuauauuuguaacuuaaggaauuuauuucucccuuuac

SEQ ID NO: 151298 - RNA, 50 nt, Homo sapiens
auuuuuuuuuccucuauuuaucaaugauauauuucacuuuuaaaggaaau

SEQ ID NO: 151299 - RNA, 52 nt, Homo sapiens
uuugaaaucaaagaauauuuugucugagagcuuuaaggaucugguaauagac

SEQ ID NO: 151300 - RNA, 56 nt, Homo sapiens
ugcccucaugccucccagaauaugaggucuaauuaagaagucccaucagguuuauu

SEQ ID NO: 151301 - RNA, 46 nt, Homo sapiens
ggucaguaugaugcagccucugagcagaauauugaccaguaagagg

SEQ ID NO: 151302 - RNA, 48 nt, Homo sapiens
uugucuacgguccacuucauuauauuuguuguggugcaaacuguauua

SEQ ID NO: 151303 - RNA, 49 nt, Homo sapiens
gucucagugaccucagggacagcaacaucaucauauacuguaaugcaga

SEQ ID NO: 151304 - RNA, 48 nt, Homo sapiens
cugguaauuucuugcuaucuuguuagcuucauuuaccuucacccaggu

SEQ ID NO: 151305 - RNA, 85 nt, Homo sapiens
gguagaauugucccauuuauugcagaucuccauguguccugguuuucuaguuauugaagguggaagaacaguucccauagcaguc

SEQ ID NO: 151306 - RNA, 57 nt, Homo sapiens
acuucauugacaucaaagagcaccugcacauaguaaagagggacauagauaacuuag

SEQ ID NO: 151307 - RNA, 46 nt, Homo sapiens
guuauauuaaaauguuaugcuuaauuugaguuuaaguggaaaagcu

SEQ ID NO: 151308 - RNA, 83 nt, Homo sapiens
ugagcucaaguuucugaacuagugcucuggaacuuuuucuuuaggauuuagcuucaaaaaaaaaauguaaagagauagaaaau

SEQ ID NO: 151309 - RNA, 25 nt, Homo sapiens
acaagaacuggauacuguugugaaa

SEQ ID NO: 151310 - RNA, 96 nt, Homo sapiens
cagcugaaccggcaguuagauaugauucuugaugaacagagaagauaugucucuuccuuaacagaggaaaucucuaaaagaggagcaggaaugccu

SEQ ID NO: 151311 - RNA, 46 nt, Homo sapiens
gagaguguaggagaucgagagcuaagacaagucuuugaaggacaga

SEQ ID NO: 151312 - RNA, 73 nt, Homo sapiens
gaaauuucggaaaaggaaaaagaaaaguaucaggaggaauuugagcacuuucaacaagaauuggauaaaaaaa

SEQ ID NO: 151313 - RNA, 46 nt, Homo sapiens
ugauguccuuucuuuucugacuuuccaguugacugaaccuggaaaa

SEQ ID NO: 151314 - RNA, 57 nt, Homo sapiens
ugauuaucccugcacaagggcauuuuggaauaucugcugcaacuggaggucuugcag

SEQ ID NO: 151315 - RNA, 68 nt, Homo sapiens
agcuuuggcaaguugccagagggacuuccgcaacaaacccuauccuguccgagcaaagauuaccuauu

SEQ ID NO: 151316 - RNA, 46 nt, Homo sapiens
gaaaaauaauccugcuauaguaauuauaggcaacaauggacaaauc

SEQ ID NO: 151317 - RNA, 36 nt, Homo sapiens
gcucccauggcccuauuuaauggauaaauacaaauc

SEQ ID NO: 151318 - RNA, 56 nt, Homo sapiens
gaucagcugaucuguggaaugguguuggaauauuuuuugauucuuuugacaaugau

SEQ ID NO: 151319 - RNA, 72 nt, Homo sapiens
aacuguucccuauuacauauuuucaggcaauuugguaugcagaaaaucaaggcuuggagggcccuguguuug

SEQ ID NO: 151320 - RNA, 48 nt, Homo sapiens
caaaagcggccuuugagaacugggaaguugaggugacauuucgaguga

SEQ ID NO: 151321 - RNA, 43 nt, Homo sapiens
uccuucauuuuacagguaaacauauggugaauccaagagaaua

SEQ ID NO: 151322 - RNA, 62 nt, Homo sapiens
gcuugaaccuagccuggagauguaaaccaccguuuuagggaucacuauuuucucugagaauc

SEQ ID NO: 151323 - RNA, 44 nt, Homo sapiens
cuagucaaaucagcuaccuugacuuccuuuacagagccggaacc

SEQ ID NO: 151324 - RNA, 45 nt, Homo sapiens
ugugcaaggcaagagagucagcauuugguuuugaaaacuguaaau

SEQ ID NO: 151325 - RNA, 41 nt, Homo sapiens
cgcggccaaagaacugaguaggagugccaaaaaaugcgaua

SEQ ID NO: 151326 - RNA, 46 nt, Homo sapiens
aaauucgagcaccaguuugagacucuggacguccagacgcagcaaa

SEQ ID NO: 151327 - RNA, 55 nt, Homo sapiens
auuugagcuuugcuauccuggggccagguagagcccuuaacuaauaaugcuaguc

SEQ ID NO: 151328 - RNA, 360 nt, Homo sapiens
cuucucacaucaaaauagggaucauuggcugggugcguuggcucauaccuguaaucccagcacuuugggaggcugaggcgggcggaucacgaggucaggagaucgagacaauccuggcuaacauggugaaacccugucucuacuaaaaauacacacacacaaaauaaguuagccgggcaugguggcaugugccuguaaucccagcuacuccagaggcugaggcaggagaaucgcuugaaugugggagauggagguugcagugagcagagaucgcaccacugcacuucagccuggagacagagccagacucgucucaaaaaaaagcaaaacaaaauagggauccuguuuuuuuagccacag

SEQ ID NO: 151329 - RNA, 100 nt, Homo sapiens
gugagauuaaagagagaaacagcuaaacaccaaauccuggugagagagacgucgauuuaaaaggccagccacucacuguagcgugacaacucccucuggg

SEQ ID NO: 151330 - RNA, 52 nt, Homo sapiens
gaaaugaagggaaaaaaaaaugagggcaaguauccugaagccuaugagugga

SEQ ID NO: 151331 - RNA, 49 nt, Homo sapiens
cuuacaugggacuugccaccagauagacucuuuauaccaugauccaguu

SEQ ID NO: 151332 - RNA, 50 nt, Homo sapiens
auaucccgaggguggcaguaguuacauaacuguaugcauuugucaaaaug

SEQ ID NO: 151333 - RNA, 35 nt, Homo sapiens
aaauuauuuuucaugaagucuuuagacuugauggg

SEQ ID NO: 151334 - RNA, 57 nt, Homo sapiens
uuuauauaagauuuauaccuguguuuaauuggaauuuuacacauuguacauuacuua

SEQ ID NO: 151335 - RNA, 45 nt, Homo sapiens
guuuucaaccaucagauguuccugggaaauugucaacccucugau

SEQ ID NO: 151336 - RNA, 35 nt, Homo sapiens
ugaaguucaaaauauuuauguuuauaggcacagaa

SEQ ID NO: 151337 - RNA, 42 nt, Homo sapiens
acugccauuccuacuguauuuuuauacuuuuuggcagcauua

SEQ ID NO: 151338 - RNA, 67 nt, Homo sapiens
ggauguguuaaguguuuuuaaugaguguaugaaauguagaaagauguacaagaaauaaauuagggga

SEQ ID NO: 151339 - RNA, 47 nt, Homo sapiens
acaaaaagcaucugcuaacaaccugugguuuaaaaauauaggccaac

SEQ ID NO: 151340 - RNA, 50 nt, Homo sapiens
cuccaagaauugcacaggaauuuuuuucuuuauacagaccauuuuuuaaa

SEQ ID NO: 151341 - RNA, 34 nt, Homo sapiens
uauguuuauuuuucaugaaaauuucaauguaguu

SEQ ID NO: 151342 - RNA, 45 nt, Homo sapiens
ucgagaggacagaaaggccaccacagcucagaaggugcagcagau

SEQ ID NO: 151343 - RNA, 48 nt, Homo sapiens
aagacuuaucuccugccuuugaucauucaccaaacaaaauaaugacug

SEQ ID NO: 151344 - RNA, 45 nt, Homo sapiens
auaaaacaaguguuacugaacaugagaaaauaccgaaugggucuu

SEQ ID NO: 151345 - RNA, 46 nt, Homo sapiens
ugaaaccagaacaauaucucacuuucauuauacuaccuggccagau

SEQ ID NO: 151346 - RNA, 48 nt, Homo sapiens
uaauuggagaagagguagugcccuucuuuguuaucaucacuaaagagu

SEQ ID NO: 151347 - RNA, 46 nt, Homo sapiens
ugcaaguguguuuuccacucuccucucuaauagugcugcacaauuu

SEQ ID NO: 151348 - RNA, 41 nt, Homo sapiens
aaaacagaaaucgaaacagauacagagauguaagcccaugu

SEQ ID NO: 151349 - RNA, 47 nt, Homo sapiens
auucuuggaaguguguguguccauucuccccuuagggcguuuguaaa

SEQ ID NO: 151350 - RNA, 47 nt, Homo sapiens
cgguguuccgaugccuaucgcccuaaucgugccuguucagcucacau

SEQ ID NO: 151351 - RNA, 61 nt, Homo sapiens
ggagccgcggugguuggggguggcucguggccucuggcgagggcagcgcucucgggacccu

SEQ ID NO: 151352 - RNA, 45 nt, Homo sapiens
cguggaugagauccuugugguccgccgcgaugcugcgagccacaa

SEQ ID NO: 151353 - RNA, 43 nt, Homo sapiens
uucuucccauacagcagcuguucggucaaaagaacaggaagcc

SEQ ID NO: 151354 - RNA, 95 nt, Homo sapiens
agcuuacaugagaucucaugcugcaaagaccacuggcugagauucauaacaucuggugccucauagauucuuacuauaccaucugcggaacaggu

SEQ ID NO: 151355 - RNA, 42 nt, Homo sapiens
ucaucacuuccuacggcgaucaugggggaaugagcacgagag

SEQ ID NO: 151356 - RNA, 46 nt, Homo sapiens
ugcaauaucaugaacaggaucagugacugucauaagaguuucagcu

SEQ ID NO: 151357 - RNA, 46 nt, Homo sapiens
aaaaauucucacaucuuuggucgcuauugcuagaauauggaaagau

SEQ ID NO: 151358 - RNA, 46 nt, Homo sapiens
aucgaacugagccacuauauggauuucaaacuuuguuggcccacca

SEQ ID NO: 151359 - RNA, 46 nt, Homo sapiens
ucacagaucuaacacagaugguuauuggcacaauaagaauacagau

SEQ ID NO: 151360 - RNA, 44 nt, Homo sapiens
gaaacaaugaagacaggaacaaaacaccaaacaaaacaaaaaca

SEQ ID NO: 151361 - RNA, 81 nt, Homo sapiens
guuacagcuuagcuuccaggaugaugaguaaguucauaccuucauuugcuuguacuguguuaaaagugggucuuacgcagu

SEQ ID NO: 151362 - RNA, 45 nt, Homo sapiens
caaucuuguuuucuguguuuaaauuuguauuugcguauuuauggg

SEQ ID NO: 151363 - RNA, 44 nt, Homo sapiens
gguagacuguaucacuggacccaaaauguugguucaguccccag

SEQ ID NO: 151364 - RNA, 48 nt, Homo sapiens
cuuugugaggauauggagaaauugaaauccucauacauuauugguaga

SEQ ID NO: 151365 - RNA, 42 nt, Homo sapiens
uaaauggcugcgugcccuuuaggguuacauguucccugguug

SEQ ID NO: 151366 - RNA, 45 nt, Homo sapiens
uuccaggaaugauauaugaagaccuagaaggaccagaaccuccag

SEQ ID NO: 151367 - RNA, 47 nt, Homo sapiens
gcugacaacauuucuaucauccuguaauguaaugcacacacagagcu

SEQ ID NO: 151368 - RNA, 48 nt, Homo sapiens
aggcgaacaugugaaugucacgaguccaucgaaaagaauaaagacagu

SEQ ID NO: 151369 - RNA, 46 nt, Homo sapiens
gcuacaauuaauuacagucuguugaggaaaucacguagcacaucag

SEQ ID NO: 151370 - RNA, 46 nt, Homo sapiens
augccaguuauuuacgucugucuuuaggagaguucuuugcucaaag

SEQ ID NO: 151371 - RNA, 128 nt, Homo sapiens
uuucuugugagaagaaauaagacuuuucccuccauuagugaccuggcccuugucugugugcaggccuggagguaggaaccaggguggcauauuggaggaauggaaagcaggcaggcagagcugcucug

SEQ ID NO: 151372 - RNA, 118 nt, Homo sapiens
aggagcaggguaggcagguaugaagggagaauggcagaugauuccaggggccaaaucaugagggcuccugguaggagggggguuuuaucucagaugaacugggaggaagugcuuagag

SEQ ID NO: 151373 - RNA, 49 nt, Homo sapiens
agaagagagaaccuauugccuuaauaagaaaaucugauguaucaagagg

SEQ ID NO: 151374 - RNA, 46 nt, Homo sapiens
ugcaggagauuuaaaugaacagucccaggcacagcuaagugaagga

SEQ ID NO: 151375 - RNA, 48 nt, Homo sapiens
aguacuucacaaguggaugaaaaugaugugacguuaacggcugauaaa

SEQ ID NO: 151376 - RNA, 48 nt, Homo sapiens
aauacugauccuucccaacuugcugcaaugaucaaggcacuuucaaau

SEQ ID NO: 151377 - RNA, 48 nt, Homo sapiens
aagaacaaacuacucaagacauucauccgguggacuuaagugcuacua

SEQ ID NO: 151378 - RNA, 36 nt, Homo sapiens
cacuuuuuuggggggagaugggaaauacuccaaugu

SEQ ID NO: 151379 - RNA, 45 nt, Homo sapiens
gauaaaugaggccagaauggcauguuuuauaauuaacugaauaaa

SEQ ID NO: 151380 - RNA, 45 nt, Homo sapiens
uaugaaucaaaauuccuguguugugugccaagguauaaaguggag

SEQ ID NO: 151381 - RNA, 46 nt, Homo sapiens
gaugauguguuuuaaaaguugcacuaucuuaauguugaaaauauuu

SEQ ID NO: 151382 - RNA, 39 nt, Homo sapiens
cuucgcauuagcccugugcuucacuacccaacgcguggg

SEQ ID NO: 151383 - RNA, 53 nt, Homo sapiens
ccaauagauaguucaguuauuucucucgcuuucccaucuuaauguaggucuaa

SEQ ID NO: 151384 - RNA, 42 nt, Homo sapiens
uguugguucaugaaguuuuaccaucaauucaaguaaucauaa

SEQ ID NO: 151385 - RNA, 48 nt, Homo sapiens
cugggacugggcuuucugaaaagacuucugucuguaggcaaguagaca

SEQ ID NO: 151386 - RNA, 53 nt, Homo sapiens
uugucccagaggaaaaagauuguggugaugcugaaggcaauucaaagaaaaga

SEQ ID NO: 151387 - RNA, 47 nt, Homo sapiens
uagaggaaaagauuacuuuaaugaguaaauaaaauucugccauuggc

SEQ ID NO: 151388 - RNA, 52 nt, Homo sapiens
cuuacacuuaaaccuguuacguaaaauaggucaaggauuuguuugaaaggcc

SEQ ID NO: 151389 - RNA, 42 nt, Homo sapiens
cauggcauuuuuacaggauuucuagggccucaggaagcacaa

SEQ ID NO: 151390 - RNA, 60 nt, Homo sapiens
gauaucacuguuuuggaccugggaugugguaaagguggagauuugcugaaauggaaaaaa

SEQ ID NO: 151391 - RNA, 36 nt, Homo sapiens
gacgucagcgucuuucugauguggugaguuaaaaga

SEQ ID NO: 151392 - RNA, 46 nt, Homo sapiens
ggagauuauccuuuauuuggcugcaaauaugacuucaacuuggaag

SEQ ID NO: 151393 - RNA, 61 nt, Homo sapiens
uucucucauuccuggaauuuuuuaauccugugggugaaaaagggaaccaguugccuucagc

SEQ ID NO: 151394 - RNA, 34 nt, Homo sapiens
uuugcauuucacuauaacuuugaaauugccuaug

SEQ ID NO: 151395 - RNA, 66 nt, Homo sapiens
gauugaacuugauuuucuacuuuuuagaaacaaaaaucuuuuguuuugaauauuaacugagaaaaa

SEQ ID NO: 151396 - RNA, 33 nt, Homo sapiens
aacuugguuucauuucuaaaggcuuauuuuaga

SEQ ID NO: 151397 - RNA, 96 nt, Homo sapiens
aacugccuggaauaaaagacuuaauuuugcucauguugccuuuccaaggaggauuaauugaaguaacagaauccugccuuacguauaccucuuaca

SEQ ID NO: 151398 - RNA, 62 nt, Homo sapiens
ggagagaccuaauauaauuaagauuuaaggaaggugccuguaaagaaucgauguuugaguca

SEQ ID NO: 151399 - RNA, 60 nt, Homo sapiens
gaaagcuuaaucuggcugcgauuggaaaauucauugagggagaguaagaauggaagcagg

SEQ ID NO: 151400 - RNA, 124 nt, Homo sapiens
ggacaagcaaagugaguuuauggacuggugccacugaguggugauggugacugaagcagcaggauggugccaaaugcaggagguaagaaguggaccuauuugaaauugauguuuucuagguaaa

SEQ ID NO: 151401 - RNA, 32 nt, Homo sapiens
uuuaguuaaguccagaagaugucauugcugua

SEQ ID NO: 151402 - RNA, 99 nt, Homo sapiens
auuacacagccauugauuguuuuuccuuuuucuccuuaccagacaauguuugguuggacagaccuaaaauauucagugagcauuuuuauuauugaucag

SEQ ID NO: 151403 - RNA, 33 nt, Homo sapiens
guucuaaacuugucucugagaagguggaugacu

SEQ ID NO: 151404 - RNA, 63 nt, Homo sapiens
acuacaauaguaccacagugguauuagcugcugcugugacuuugucaucaguagaaguuacag

SEQ ID NO: 151405 - RNA, 70 nt, Homo sapiens
uuauuuuguuauuccuuugaaaaaacacaaaaauuguauuuuuuccaccagugcuguuugauauuucaag

SEQ ID NO: 151406 - RNA, 45 nt, Homo sapiens
gccugugguucuucagcaguggguguugaggaagucagguugcag

SEQ ID NO: 151407 - RNA, 69 nt, Homo sapiens
accuucuagaagucuacacuguaauggaaggaacaggcacaaauaaacacuacuaggcaaauuuuuaag

SEQ ID NO: 151408 - RNA, 62 nt, Homo sapiens
ugucugugacagaugaacuuuugcauguguauauaagaaugaguugggaccucugucuuuaa

SEQ ID NO: 151409 - RNA, 45 nt, Homo sapiens
cagguucguuuucauucuagggcagugccaggaaguauauugaua

SEQ ID NO: 151410 - RNA, 47 nt, Homo sapiens
cacaacagugagcugcuagugcagaagagggacccuuccuguugagg

SEQ ID NO: 151411 - RNA, 45 nt, Homo sapiens
cguggggcaguucaaauuccugagcucagauuucguuucccgcgg

SEQ ID NO: 151412 - RNA, 52 nt, Homo sapiens
gcacuuauuauuaauacuucuuauaaguaguaagcaucuuuacuaacacaac

SEQ ID NO: 151413 - RNA, 160 nt, Homo sapiens
ggauuauauauuucuaaaacacuaaacuugaaaauacccauagguuuugggaccuaucuuuauuuugugccaacauacuagaaugugaacugcaaggacccacaauauauccugaagucuuacuuucgccuucuggccagcaaaugucuaauauuuaaag

SEQ ID NO: 151414 - RNA, 45 nt, Homo sapiens
uuuucuauuacuuaaacugacaaaguaaauauaagccauacauua

SEQ ID NO: 151415 - RNA, 51 nt, Homo sapiens
uuaucucgccugagagaccugguugaugauacgaauggagaacggucaccg

SEQ ID NO: 151416 - RNA, 53 nt, Homo sapiens
ccauuucuuugacauauguaaaguuacaggguagaaguaaguaguuuuaagag

SEQ ID NO: 151417 - RNA, 52 nt, Homo sapiens
ucugucacuuacuagcaagugcaauauuugugcaaaucauuuaaccucuuua

SEQ ID NO: 151418 - RNA, 50 nt, Homo sapiens
aagaacguuuuaaucaaaauaagaccacagauccaaaagaagagauuaaa

SEQ ID NO: 151419 - RNA, 54 nt, Homo sapiens
acaaauuauuaucaaccugucaucaaaaacaaaauugaauaggaaguacucaag

SEQ ID NO: 151420 - RNA, 42 nt, Homo sapiens
cccaagaaaucgucuuucaaggacaguucagaacacagucuu

SEQ ID NO: 151421 - RNA, 41 nt, Homo sapiens
guggaagacuggguucauuggacauugagaagaauccacau

SEQ ID NO: 151422 - RNA, 66 nt, Homo sapiens
uuuuucuaugcugcaaccaauauugagugaccaauguuacugugauuguauuaguguaucagauau

SEQ ID NO: 151423 - RNA, 43 nt, Homo sapiens
uguuguaaauguacuagcauuuauaacauugaaagugaauauu

SEQ ID NO: 151424 - RNA, 38 nt, Homo sapiens
uaguuuagccauucgucagagauauaccaguauuacag

SEQ ID NO: 151425 - RNA, 40 nt, Homo sapiens
ucgcguuggguaacaggccugagcuuucggcggagagcug

SEQ ID NO: 151426 - RNA, 59 nt, Homo sapiens
uccucccccgaguccacgauucuucauuugugaucaggguugggguaacuucaccuugg

SEQ ID NO: 151427 - RNA, 46 nt, Homo sapiens
cuuauauacuuugcucagguggagaacaagguaugaaagccauuau

SEQ ID NO: 151428 - RNA, 50 nt, Homo sapiens
uccugauuuuugccauuugugugacuugucagguuauuuaaucucuuuga

SEQ ID NO: 151429 - RNA, 44 nt, Homo sapiens
gcgggcggcgacagcagcagcagcgacgaccgguccuccuccuc

SEQ ID NO: 151430 - RNA, 58 nt, Homo sapiens
caugcccugggcaucguccccuccguacagcacccccgccgccgccgccgcggccgcc

SEQ ID NO: 151431 - RNA, 43 nt, Homo sapiens
cgccugcuccccguucagggcggccgccgccgccccacaaccg

SEQ ID NO: 151432 - RNA, 42 nt, Homo sapiens
cggcggcggccgcccugaacggggagcaggcggcccugcucc

SEQ ID NO: 151433 - RNA, 47 nt, Homo sapiens
guggggagguccagcugggcauggccccgggcguggguggggagacg

SEQ ID NO: 151434 - RNA, 41 nt, Homo sapiens
aaguucuuguaagggaggcugaacgcuuuuagaagacacuc

SEQ ID NO: 151435 - RNA, 45 nt, Homo sapiens
acagguccuuugucugaacaaugugggaggagucugucugcagua

SEQ ID NO: 151436 - RNA, 50 nt, Homo sapiens
gucuaacaaauggagauugaaaaacuguggaggaacaaugugaggagggg

SEQ ID NO: 151437 - RNA, 58 nt, Homo sapiens
gcacagucagacaacuggguucagcagugugagagcuucacgucacuggaggauagaa

SEQ ID NO: 151438 - RNA, 41 nt, Homo sapiens
gacuccuguucguggugaagagcccauuuuuguugucacug

SEQ ID NO: 151439 - RNA, 46 nt, Homo sapiens; identical to SEQ ID NO: 63291

SEQ ID NO: 151440 - RNA, 16 nt, Homo sapiens
caggaauucacaauug

SEQ ID NO: 151441 - RNA, 49 nt, Homo sapiens; identical to SEQ ID NO: 63293

SEQ ID NO: 151442 - RNA, 46 nt, Homo sapiens
aagucauagggauuauaaauucaauuugaguaaaauuuaaaaccau

SEQ ID NO: 151443 - RNA, 46 nt, Homo sapiens
uaccagauugacuuguuaaaaaugguuccaagaaucagucuaaaaa

SEQ ID NO: 151444 - RNA, 56 nt, Homo sapiens
caucuguugggguagacguguugauugauugcauugcccaccagcacccuacaguc

SEQ ID NO: 151445 - RNA, 45 nt, Homo sapiens
agauguguaugaauggccagaaucugcaucaagcccuccugugau

SEQ ID NO: 151446 - RNA, 59 nt, Homo sapiens
gaccagaauggagcuuuaguagauauauucuagagcaggaaauucgagaauauauaaag

SEQ ID NO: 151447 - RNA, 45 nt, Homo sapiens
aguucugaaggaaaaauauuuccaagccagaauucuaaaccuaga

SEQ ID NO: 151448 - RNA, 378 nt, Homo sapiens
auucuagaauugaaaaauguaguagucuauaagaacugagugagcuggguguaguggcucaugccuguaaucccagcacuuugcgagaccaagguggaagaauugcuugagcccaggaguuugagaccagcccuggcaacguagugagacccccaucucuauaaaauuaaaaaaaaaaaaaaaauuagccaggcauaguggcauaugccuguaguccuagcuauucaggaggcugagaugggaagaucacucgagcuugggaggucaaggcuggagugagucaugauugggccacugcacuccagccugggugacagagcaagacccugucucaaaaaaaaaaaaaaaaaaaaagagugaaugaggcuuauggcagau

SEQ ID NO: 151449 - RNA, 70 nt, Homo sapiens
ggaaagcaaaaauagauaguuaucaggaaccauuuacucacucagccccagagagcauaccugauacuuu

SEQ ID NO: 151450 - RNA, 76 nt, Homo sapiens
ugcaaaucuuauaguuaugucuaugguagaaaauggccugucagaacaagaggcacaaaagaaaaucuggauguuu

SEQ ID NO: 151451 - RNA, 43 nt, Homo sapiens
gagagaauaucacgaagaauuuuuguuugauuuguaagggaaa

SEQ ID NO: 151452 - RNA, 95 nt, Homo sapiens
uuacagggacagcugcaguagcucuagcaggucuucuugcagcacaaaaaguuauuaguaaaccaaucuccgaacacaaaaucuuauuccuugga

SEQ ID NO: 151453 - RNA, 47 nt, Homo sapiens
acacacucauucaguucgaagacuuuggaaaucauaaugcauucagg

SEQ ID NO: 151454 - RNA, 48 nt, Homo sapiens
ugacauuuugagggaagucugcccucacugcuuccaucaaacgcuuac

SEQ ID NO: 151455 - RNA, 93 nt, Homo sapiens
aaagacccauuuuacaugggcuuguaccagaaacgagaucgcacacaacaguaugaugaccugauugaugaguuuaugaaagcuauuacugac

SEQ ID NO: 151456 - RNA, 70 nt, Homo sapiens
cuugugcaggaauacggccugauagaugccugccaguguguauugaugugggaacugauaauaucgugag

SEQ ID NO: 151457 - RNA, 82 nt, Homo sapiens
gauggagagagaauucugggucuuggagaucugggugucuauggaaugggaauuccaguaggaaaacuuuguuuguauacag

SEQ ID NO: 151458 - RNA, 56 nt, Homo sapiens
ucagauuuagaagggccaggguugaguagaguuggugaggagagugagaaaugcuu

SEQ ID NO: 151459 - RNA, 102 nt, Homo sapiens
aaguauguuucaagcuggaagaaaauuuaauguuucaucguaguuaggaggaaugagcccaggagaaaggauaauuguuagagcaaggucuagggaaaggaa

SEQ ID NO: 151460 - RNA, 63 nt, Homo sapiens
ggugacugguaagagugguuucuuugaugugauagagcaaaagagauacugugauagauugaa

SEQ ID NO: 151461 - RNA, 35 nt, Homo sapiens
uuguaaacaggauguuacagguagcaggcaaagua

SEQ ID NO: 151462 - RNA, 46 nt, Homo sapiens
aaugagaaaaagguacaagcagauauauucugagagcaugcagagg

SEQ ID NO: 151463 - RNA, 61 nt, Homo sapiens
uugacaaagaacaggaaaccuuuuaaaucauucagacauucuuuucauuuauguccuucau

SEQ ID NO: 151464 - RNA, 42 nt, Homo sapiens
aacaaaauaaaaacccuggacuacgacugguaagcugaguga

SEQ ID NO: 151465 - RNA, 46 nt, Homo sapiens
guugaagaaccugaacccguaaagaagccucccaaagagcaaagaa

SEQ ID NO: 151466 - RNA, 50 nt, Homo sapiens
agauuugggaacuuaauuuuucaacauuuccuucaccguuuaauguucau

SEQ ID NO: 151467 - RNA, 347 nt, Homo sapiens
agaguuagggacgucaggaagacaagcuguuaagggguuagaacaaugagaucacauggacacaggaaggggaauaucacacucuggggacugugguggggucgggggaggggggagggauagcauugggagauauaccuaaugcuagaugacacguuagugggugcagcgcaccagcauggcacauguauacauauguaacuaaccugcacaaugugcacauguacccuaaaacuuagaguauaauaaaaaaaaaaaaauuaaaaaaaaaaaaaaaaaaaggaaaaaaaaaaaaaagagaagcuauuaagccguaaagcuguuaacuuacugacuuugaggagcug

SEQ ID NO: 151468 - RNA, 102 nt, Homo sapiens
uggcaacuaaaaugacuccgcaauacacagggacugacaugagcaaccaucaggauaaauuagaauaaauagaagucuaagauaacugauguuuccagauuc

SEQ ID NO: 151469 - RNA, 31 nt, Homo sapiens
uagcagcccccuacuguuucuuauaucuggu

SEQ ID NO: 151470 - RNA, 52 nt, Homo sapiens
cauaccaccuuuuuguuuuugaaauucuguuuucugcccugccacugugcuu

SEQ ID NO: 151471 - RNA, 171 nt, Homo sapiens
uuccauguucaccaguuuucuuaucuuggugucucugaggaaaaucuaacacuucuuucccaguuugccaagggcaagucucucuagccucucuuuuuucacucauuucuuucccugagagcaguuugucaacugacguuuguuccuugacauuuuaggcagguuaauuuu

SEQ ID NO: 151472 - RNA, 46 nt, Homo sapiens
uaccggcauuucaguucuaaccugcccaagaauguccaggguuagg

SEQ ID NO: 151473 - RNA, 36 nt, Homo sapiens
agguccucaucugagaguggcucagguguggcugua

SEQ ID NO: 151474 - RNA, 39 nt, Homo sapiens
ucggagcaacgcaggagaaacacucaccucaggcugcuu

SEQ ID NO: 151475 - RNA, 46 nt, Homo sapiens
uuucguauaugcauacccuugauggccugagcaguuucacgagugu

SEQ ID NO: 151476 - RNA, 44 nt, Homo sapiens
ugccaacuccaccauuguaacgucggaaugguacacacuguuuc

SEQ ID NO: 151477 - RNA, 70 nt, Homo sapiens
caagcagugcagaacccuacuggacggacagaagcugccauucugaacauuuacuguguaaggccacaua

SEQ ID NO: 151478 - RNA, 96 nt, Homo sapiens
cccgcucgcucagcuccaaaacucgcggcgaagcccgcucggugcucccugcuuuuccaauuucuccauggcuccggccggggcucaauccauucu

SEQ ID NO: 151479 - RNA, 82 nt, Homo sapiens
cccggcggggcugacagcgcgggggaggguggcgcggcggcggcggagggccccagacgggucgcgcguucucgcccccccc

SEQ ID NO: 151480 - RNA, 49 nt, Homo sapiens
uaggggagucucuggucuuucccccugcgcuccugggggcccagguccu

SEQ ID NO: 151481 - RNA, 43 nt, Homo sapiens
aaaugaaaaccaccaccuccucgaaccucagaggucugggggc

SEQ ID NO: 151482 - RNA, 45 nt, Homo sapiens; identical to SEQ ID NO: 63355

SEQ ID NO: 151483 - RNA, 45 nt, Homo sapiens
acagaggcauucuuuuagcccaacuguuugucuuagcuguggggg

SEQ ID NO: 151484 - RNA, 46 nt, Homo sapiens
ucuacucaccaguugguuugagaaaauccaucggguaucuggagua

SEQ ID NO: 151485 - RNA, 45 nt, Homo sapiens
ucuuuuuuuguucuauuuucaacaaaacguuuugggugaguaacc

SEQ ID NO: 151486 - RNA, 63 nt, Homo sapiens
aaaaauucaaccuaagggacauagaaacugaagaauguaaaugguccauguagauucccgggc

SEQ ID NO: 151487 - RNA, 42 nt, Homo sapiens
caacacuucacacaccaaagcaauccccagcucgcucuuguc

SEQ ID NO: 151488 - RNA, 46 nt, Homo sapiens
uuuuuccugcucaauucucauuagaagcuuugaguaaacaauaccc

SEQ ID NO: 151489 - RNA, 48 nt, Homo sapiens
gggacuaguagccacauaugaaucucaagcaaagaguuggccacccuu

SEQ ID NO: 151490 - RNA, 44 nt, Homo sapiens
cugugucauuagaacaaugacaucaacaaagaggggauuuagaa

SEQ ID NO: 151491 - RNA, 33 nt, Homo sapiens
uucacauauuagcaggcacagaagcccucagcc

SEQ ID NO: 151492 - RNA, 34 nt, Homo sapiens
uuuacucugucuuacuauucaucacccucaagag

SEQ ID NO: 151493 - RNA, 42 nt, Homo sapiens
ggggcagaggaagcuggguggggacuggagccugagaucugu

SEQ ID NO: 151494 - RNA, 37 nt, Homo sapiens
uggcaccggccaacaggaggaggaggaggaggagcaa

SEQ ID NO: 151495 - RNA, 83 nt, Homo sapiens
acccuuuugguguggaggaggguguucugaaacacaagaagcuuuugcuuauuuucccaauucgggacaacaaaccuggccug

SEQ ID NO: 151496 - RNA, 53 nt, Homo sapiens
cccucgcucccugcagccccagcuccuccucuuggggaccuggggggcacaaa

SEQ ID NO: 151497 - RNA, 42 nt, Homo sapiens
cccagccagacugcaggaacgcugugguuuguggcagcaggg

SEQ ID NO: 151498 - RNA, 37 nt, Homo sapiens
gucucagugugucagcagcagcccuguacacaaaggg

SEQ ID NO: 151499 - RNA, 46 nt, Homo sapiens
caggagcagauggccaaaaaagaaagacgcuacaauggcaggggcu

SEQ ID NO: 151500 - RNA, 45 nt, Homo sapiens
aaaguuugacacagcaaauaccuuuacacccuggucaucacugac

SEQ ID NO: 151501 - RNA, 45 nt, Homo sapiens
agaaggcaagaacauugaaucagacuuagcagauaacagauucag

SEQ ID NO: 151502 - RNA, 73 nt, Homo sapiens
aagccauuggaauuuuagcagaguuuuguauauauguggauuuuucuaauaaguagcaaaucagaggccuuaa

SEQ ID NO: 151503 - RNA, 346 nt, Homo sapiens
aaugguuugccauuuagaaaugugcugcugugagaaaaacgaauuuuuuuuuuuuuuuuuuggagacagagucuugcucuguugcccaggcuggggugcaguggggcgaucucggcucacugcagccucgccuccuggguucaagugauucuccugccuuagccuccugaguagcugggauuacaggcacacaccaccacgcccaacuacuuuuuguauuuuuaguggagacaggguuucaccauguuugccaggcuggucuugaacuccugaccucagaugauuugccugccucggccucccaaagugcuggaauuacaggcgugagccaucaugccuggcugaa

SEQ ID NO: 151504 - RNA, 48 nt, Homo sapiens
uauauugaaaaaaaacuuauuagugucuguuuuacccaagaaccacaa

SEQ ID NO: 151505 - RNA, 45 nt, Homo sapiens
uaacucucccaacucugcaguccgugaccuucaggugcccuucaa

SEQ ID NO: 151506 - RNA, 47 nt, Homo sapiens
uuagccauuguauggcuaggaaccaaugcacuuggcaguuaauggau

SEQ ID NO: 151507 - RNA, 23 nt, Homo sapiens
aaggcaaagcaagcuccccaauc

SEQ ID NO: 151508 - RNA, 45 nt, Homo sapiens
cugaccgcgacccacugcucgcugccggggcuuguuccgaggagg

SEQ ID NO: 151509 - RNA, 39 nt, Homo sapiens
cgagcccagcuaucggcauccgcgaaaaagcggggagag

SEQ ID NO: 151510 - RNA, 45 nt, Homo sapiens
caucucggucugccuucaccuucaucccaccagucacacggcaga

SEQ ID NO: 151511 - RNA, 46 nt, Homo sapiens
uguugauuuucaggauagcugcugcagagaagagaauucaaagaug

SEQ ID NO: 151512 - RNA, 42 nt, Homo sapiens
acuuauuuuacucucucaacaaauccugcagccaccuggaac

SEQ ID NO: 151513 - RNA, 64 nt, Homo sapiens
gaucaacagagguaucagcuccaagaauacgcucuucaagaauagaggacaucucagcaguccc

SEQ ID NO: 151514 - RNA, 46 nt, Homo sapiens
auuuuggagccaguggcuacaaguuauguauaaaucagucccuaga

SEQ ID NO: 151515 - RNA, 41 nt, Homo sapiens
gucggucaccaauaaucaguucacgcugaccacgaccaauu

SEQ ID NO: 151516 - RNA, 42 nt, Homo sapiens
cuucauagcccugguuugggcagcggauccgacacgagauac

SEQ ID NO: 151517 - RNA, 46 nt, Homo sapiens
aguuuaucaagauauccccuuacacccgcauagauaacagccacuu

SEQ ID NO: 151518 - RNA, 3929 nt, Homo sapiens
agaaacaaaacuucuauugagucauggauugaagagaagguaaauuuuaauaauuguuucuucaauauuaaaaaaguauauuaauaaaggacugguaaaguccugaauauuaauaaagucuguuauuagaccggauuaacgaaaagugccuaaaagugaaaacauggcugccaaauggcuaccguaagucauuugcaugccacauaaaaggugaauauaggaaacauuuuuguucauucuguaacucccacagaaaggugcuucucauacacccugaguggucgcagaggccuaagccacacgucaaaccaucuguuuguugucucuuagacuagaggagaaagcagcccauuuggaaaggagcuuccacccuaccaaacugccaucagguuuuucucaguguuuuagacauucaaugaagcuccuaacauuuugcuugucacagaccucacaauguccaauacuucauacuguccauugugauucuagcaugaaacacaaaucugacuacccugcucuguguuuaaaacuucucagagccucaccauuccuguggcagggguugaaacccaaauaccugcagggucugggcagauaacguccaugaaggggagcaagccuguauaccaaagaauugccuggcagaccaagcugauuguugccacaggggaauauucacaauuuccaaauuacaaaauagggagaagaauagcaucguuuuauaucuuuacaaaucucuuuaguaucuuugacuuaagagaagaugguuggauucucacuucugcauucagucuguugagauauguugcuucgauugaaguaugugaagaucuagccucacacagauaaguagguagaaaaggauagaauauuuuaauaggccuuuuacaugauaauaguggauguucuuccguauuacauugaaaacuugacaagugauauuucuuaucaauaagauuuuuauaccuuuuuauuuuaaaacucaucagucuaucuugcucuuugaauuaaucuuuuaccaguaugugguuuuauguaacaucaggcaucggucauuuggcaaauacuaguuuacuguguuauguagauuuugcaaacguuaaacaccuuucauuauacaauaucccaaaauugcauucacguauaucaauauaucauuuuuaugagaaaaaauccuuaaguauuggaaagcugucaggcucacagugguagauacaagguuuuuuuuuuuguaauucuaguauacauuugaaagccuuaauuuuuuacuauuaacccauacugucagucauuucccuugaagugacugccugacuguucguuuuugagaaaauguucaccaaguccugaagucugaauaaccuuaguuugcuauauuacucauucuuucaaauaagaauaguguuacauuaaaaaagcuggcucuacagcuuuuguuagcuuacagcuuaacaacuauuuuccuugagaugaucauucuacuugggcacgcuuuauguauacuucucauuuugucacacagacuguuaaaaauaaaggacaucuccuugagaguugagauuuaauauuuaaaaacaauuuuuacugcuucaucaaggacauucuuacauggaauugcucauaaugacuaccaacacaguuuggugccacugccuugguuuuugcuaagaugccaacaguuuuauucaccauugcaaaugucaaugcaacaaaaagacaaauaacauuucaguauuauuaugaaaauagcuuggccuugcugaccagcaagaaaaaguccugaauacucaaagugaucuauaaagcaugcuuugagaaccacugauguacagguugaagucugagcuucuuagcuucuacauaaguaagaccuuuuaugacuucuuuuuuuguuuucuggcgacggagucucgcucuguugcccaggcuggagugcaguggcacaaucuuggcucgcugcaaccuccacuuccuggguucaagugauucuccugccuuagccucccaaguagcugggauuacaagguguaugccaccaugcccagcuaaguuuuguauuuuuaguagagacaggcuuucaccauguuggccaggcuggucucaaacuccucaccucaaguaauccacccgccuuggccucccaaagugcugggauuacaggcgugagccacugcaccuggcggacuucuuuuuaucuacuucuccagccuaauuuccuacccuucucuacccugucucacacuugauacuaaauuacucauaguuuguacaucuuaugcuucuguauccuugcacauguuguucccucugccuagaaugcucuucccucucuuuuugccugauuucuugcuucucaagacuuaguuaagguauuguuucucccaaggacccuuccuggauacucccuagacuuggcuaaguacuuuuuguuuccuuuguucccuuuucccauagcaucuaccacaccccuucaucaccuuuuaacacacaauauugauagaauccuaacuucauugaguguuucuguuaggcaaagacaugucuuagucauuuuauaaauucucuuauauuuaccaguuuuucuuuguaaauagccuagaacucuuuucuuugaaauucaguccauuuugaagacucugaagcuguguuuauaaaaaagaaaaugaaauuauucuuuacuuucuggggaggauggauuuauauaacuuaauagauucauaugcauuauagcuuaauaauuauuuuaguaaauaguuaacuuuaauaucacucaacaaauaauugcaacauuuuccauaaaacauuguccccugauaaucaaauauuucaaaguaucauuucuaauaagcauaauaaauauauugacauuagauuaacauuuuuuuguuuguuuuuguggaugaccaaggcugcuuauaaaccgccaugcuacauuuagaaauuaccucagaugagauugaguaugcugaaugguauggccauagacuagaaauuauuucagaacgggcacuuuauugcugaguaaaaaauucaaacaaaugaccauauuaaauuuauaggaaauguauagaaauuaccagacacuauauacaacaaauuugaagggauuuguauacuuauuguuaaaauaaauaauguaucuuuguaccacuaggugucaguggaacuuaagaaauccaaagccaauuuauuuccucaaguuaaagcuaacaguuuaaaugccuggaauauaugcaagcugaauaguuauguacaugcauaacauguacauauaaaugcauauauaaaugaguuauguguacaugugugauaguauaaaaaaagaaagaagaucuccuguauauaucugcuagcuuuaaaaaauguuuuucauaaaacagcucuccuguuacaccuuuccuggucauucccaugggcaucacugccacccaggauauaacuguuacccucugauacaacuguuacauucuggugcaccccacaaaacaguucuaucuugaauaaaacgguuccauccugaauaaaccuuuaccuuucuccugaaucuguuuaucugcaucccuucuauauaccugaauuguuuuguauugcugaacaacuaggagcauugaggacuuuuuauguaugagauaaaguuagcuaacuuuuaauaagccuuuaugagugcuuauuccuaaagaaacccugucagauauuuccuagguaaucacauacaaggcugguguucuauaucaaguucuuccuauauugugaugaaguugucuauugcuuccauguacacuaauauuacagcaaggaggaaguauuuuuaugaauguuagaaacuugagaaauaaguguucucaauaacauauuacugcaggccacuuagacagaggcaccugccaucuuauaucuuuguuacccacaggcuaaagaucgaauucagu

SEQ ID NO: 151519 - RNA, 77 nt, Homo sapiens
auuaucaacuagaugaagucuuuguuuuuccauaugauaugggaaguagauggaggaacuuuaaacagguauuuacg

SEQ ID NO: 151520 - RNA, 51 nt, Homo sapiens
guugauauuucuuauaugauauucuagauacuauagaacucaauuugucag

SEQ ID NO: 151521 - RNA, 36 nt, Homo sapiens
uguuggcgaacaccaggaggacagcaucccggagcu

SEQ ID NO: 151522 - RNA, 45 nt, Homo sapiens
gcugauuggacagccaguccaguccuucauagagcccgucgccgc

SEQ ID NO: 151523 - RNA, 43 nt, Homo sapiens
cuucuggcacucacaccacgagccgcacguuugccacaugaga

SEQ ID NO: 151524 - RNA, 60 nt, Homo sapiens
cacagaggacccgcccccugagcagccccgcguacuguggauccagcuguucgguucugg

SEQ ID NO: 151525 - RNA, 97 nt, Homo sapiens
ccaucccaucgacccggacacagcuuccagccuaaaccagcuagagaaaagcccguuucuccacuaaacaugaccuucagaaaauguggugaaagac

SEQ ID NO: 151526 - RNA, 52 nt, Homo sapiens
acauuccauagcucugcccacugagagugccuggaugcaguuauacacccca

SEQ ID NO: 151527 - RNA, 71 nt, Homo sapiens
caagaugagccuagaacauccugugccggaauauaaagcaguugcucaaugaggcaugucaacagaacaca

SEQ ID NO: 151528 - RNA, 58 nt, Homo sapiens
cauggaacuaccauaaaauuccacugauaugcacaagaaaauauuauuucccaaaagg

SEQ ID NO: 151529 - RNA, 51 nt, Homo sapiens
aggucuaggauagccagaggaugaagggcagggcagaaaccaaguuugcaa

SEQ ID NO: 151530 - RNA, 1694 nt, Homo sapiens
gcggugaugguggugagcuaugcccgugguccucagggccgggacccgggcccagcccaggcuccuuucgauguacugucuuucguuagcguccccgacccgcgcucgcgggccuguagggcucuccgacagggcgugcuaccggaguuggccugaaaccaguccucgcuuuguuuucuggcuccuccucucccgccucucccgcugucuccgcccuguucuauuuucccuaagaaugucugaacugggagggauacccuagcgcccuuguuuuaccagugagaaaacugaggccuuuaagaauuaagugacuuguccaaggucacuauccguauuuuaggagccaagacgagaucaaguucaauauuccaggagugguacugacuagaccuuguaguuauuuugaaaauguuagccuccaauuacaaaagcaagcauuuccuaguucucacucaacuucuccuuuucccuguuccucucaaaaaagaaaaaaaaaaucaacucugguaacucauugccagucugaauuuucaauaggccagauggaagacaacaaaaguaaucucaaguuagugacagauuaggugggaaaacguuaguuuacgccaaguuuuauuuaauuuaaacuuuuaaguggcuuuaacgcuuucaaaaccuaacuuuccucuucuuucaacaucauuuugguuuggguugucuguuuuuacugacaauugaggacuuuguaaguuaggaauuaguuugagauuuguuuucuucuuaucccaccagcaguguguguguaaacacacacauccacacacuuagguuuagcaguuguaauuguggguucauccuagugaagaguaaagcaaaacacuuagagccuuaucuaguaauuuuauuuuuuuugauuaauuaauuuuuuuuuuuuuuuuugagacagagucuugcccugucacccaggcuggagugcagcagcgcaaugucggcucacugcaaccucugucuccuggguucaagcgauucuccugccucagccuccugaguagcugggauuacagacaccugccaccaagcccagcuuauuuuucuauuuuuaguagagacgggguuucaccaucuuggucaggcuggucuugaacuccugaccucgugauccaccugccugggccucccaaagugcugggauuacaggugugacccacugugcccggccugguaauuuuauuuuuuuacuaauaguauuuaaucuuuuuuugauguuuaguauguaugacuucucccaauuuuuggaugcagucucugcagaagugaucggcaguuauguucaguuuuggagcuccuagggucaaaguacuugaguucaaauuuugccuuuccacuuucuaucucugugccucaguuuccucaucaguaaaauacagauuauuuuauuaauauaaauauguaacaauacguucugggaauuaaaugugauguuuaaaaaaaagcaaacccacacugcauuagcccagugccaagcacauaaguguuuaauaaagaguaaugauauuauuaacacacuugaaauguaucaccccuucaguuaauagaaugguaaacauguuaggaugccugccuagaggauuuagcagaaaaugcuuuguaaauguucuauaucugaaaguacauguugauguccagguuagcaagaugaacaaagaugcgcagau

SEQ ID NO: 151531 - RNA, 42 nt, Homo sapiens
gcuuaggugcccgagcuacugagggucuaaguccgggcagcc

SEQ ID NO: 151532 - RNA, 46 nt, Homo sapiens
aucaugaggcgcucaacaagcagauuauggaguacaaaaggaggaa

SEQ ID NO: 151533 - RNA, 34 nt, Homo sapiens
ugugccuuuuacucaccucuacguuccuggugcu

SEQ ID NO: 151534 - RNA, 44 nt, Homo sapiens
ggguuucugguugaggccgggggagcagcaggguccacaccucc

SEQ ID NO: 151535 - RNA, 50 nt, Homo sapiens
uuccagaaaaacggugggguuggagcacagaaucucagagaaaaucucca

SEQ ID NO: 151536 - RNA, 23 nt, Homo sapiens
ccauuugacuucaaaccuccagg

SEQ ID NO: 151537 - RNA, 61 nt, Homo sapiens
uguuuucugaauuauuuucuuaguaguuacuugaaggcuuacaauauucaucuuaacuuau

SEQ ID NO: 151538 - RNA, 28 nt, Homo sapiens
ggugggggcugaguggaggaagggagcc

SEQ ID NO: 151539 - RNA, 45 nt, Homo sapiens
agcaucaagauggugcucauguggaccaguggugacgccuucaag

SEQ ID NO: 151540 - RNA, 48 nt, Homo sapiens
gacaggacuguggguuuucagucaacagccaaggcacuucucguugag

SEQ ID NO: 151541 - RNA, 28 nt, Homo sapiens
caagcccaggcccccgagcacugccugg

SEQ ID NO: 151542 - RNA, 41 nt, Homo sapiens
gaguucguccacgugguggccaucuccuucaccgcacugau

SEQ ID NO: 151543 - RNA, 46 nt, Homo sapiens
ggauucgggugucaggaaaaggcgcccgaaaugcugguagaccagg

SEQ ID NO: 151544 - RNA, 42 nt, Homo sapiens
caguuccggcacauaggcaggcugcucauggugcacgggcgg

SEQ ID NO: 151545 - RNA, 45 nt, Homo sapiens
uggaggaaaugaugucagcaugauucaggcagcagacugugggau

SEQ ID NO: 151546 - RNA, 56 nt, Homo sapiens
ggcccgcauugugacacugcugcagcagcacacagggagacgcaccugcgccaucg

SEQ ID NO: 151547 - RNA, 37 nt, Homo sapiens
cuggcgcgcgcugcuuuugcugaagcaaacagugcuu

SEQ ID NO: 151548 - RNA, 40 nt, Homo sapiens
ggucccucaagguggccgcgguagucgagagccuggagag

SEQ ID NO: 151549 - RNA, 42 nt, Homo sapiens
ggccaugucuccuaucgugcaguauaaugacuggcuggaaga

SEQ ID NO: 151550 - RNA, 69 nt, Homo sapiens
ccucagcuucugcauucugcagcuguuucccuucaccuccgagagcaagcggaugggcgucaucgucag

SEQ ID NO: 151551 - RNA, 41 nt, Homo sapiens
gucuuuaugauccauaauggucuuuauuuuaaagaauaaua

SEQ ID NO: 151552 - RNA, 50 nt, Homo sapiens
auaguauugcuuuuggguuuacagaaguaggcacuaaugcaugaggcgug

SEQ ID NO: 151553 - RNA, 46 nt, Homo sapiens
gaauguagcugucaucgccugacuccaguauuuauuugcaagaauc

SEQ ID NO: 151554 - RNA, 38 nt, Homo sapiens
aaccacguuuggaauugggguguguguaugugucucag

SEQ ID NO: 151555 - RNA, 141 nt, Homo sapiens
gccgugaaagccaucgugcugugucacaacgugacccccguguaugagucucgggccggcguuacugaggagacugaguucgcagaggcugaccaagacuucagugaugagaaucgcaccuaccaggcuuccagcccggau

SEQ ID NO: 151556 - RNA, 59 nt, Homo sapiens
gguggaaacaauacugguucaacuccacuaagaaaagcccaaucuucagcucccaaagu

SEQ ID NO: 151557 - RNA, 80 nt, Homo sapiens
ggggucugcuuccacacacaucccgcgccaugaguccagcugagccucguguguucccaucuguaaauuagcacgcuucu

SEQ ID NO: 151558 - RNA, 42 nt, Homo sapiens
ggaugagauccagagccaugucagggacuccuacucacaggu

SEQ ID NO: 151559 - RNA, 49 nt, Homo sapiens
caagcagcaguaagaagcaaaguauaauagcauagcugaaguugggaau

SEQ ID NO: 151560 - RNA, 47 nt, Homo sapiens
aacccaaaaacuuuaucauucguugaugagaaguguuagucauuuau

SEQ ID NO: 151561 - RNA, 42 nt, Homo sapiens
gguauaauuagguuugauuggagugcacauuuccgguaagau

SEQ ID NO: 151562 - RNA, 52 nt, Homo sapiens
acaagacuguuauuuaaaauucauaauggaagcucuagccauugcagcaaga

SEQ ID NO: 151563 - RNA, 65 nt, Homo sapiens
uugggcgccggcccugccucccuaauaucccaugaaaaauggaaagauuucacagagugacaaau

SEQ ID NO: 151564 - RNA, 21 nt, Homo sapiens
ucuguuuaauauaucuaauau

SEQ ID NO: 151565 - RNA, 62 nt, Homo sapiens
ggggagacgucaucagugccgguagaaugaucuagaggugccauacuuuccugauagugaau

SEQ ID NO: 151566 - RNA, 52 nt, Homo sapiens
caucacuaccaugcauucugauuuauaauauuagggacauugugguuagcuu

SEQ ID NO: 151567 - RNA, 46 nt, Homo sapiens
cuauuauuagcuucugguuaauagcuaguuaagcagaugugugggc

SEQ ID NO: 151568 - RNA, 44 nt, Homo sapiens
aacaacacuuucgguagugaaauugaugcaacaugguaagacuu

SEQ ID NO: 151569 - RNA, 37 nt, Homo sapiens
uaguaaaagaauagggggucuuacaaauaaaaauauu

SEQ ID NO: 151570 - RNA, 36 nt, Homo sapiens
ccaggcagcccagagcauggcgguggcagugcugau

SEQ ID NO: 151571 - RNA, 116 nt, Homo sapiens
aauuaaaacugacaguacguuuauuagggugggacucaggugcaaucacagcuggaggacucuuccaaggguuugggggaaggagagagugcuguguugagggagccggguccagg

SEQ ID NO: 151572 - RNA, 39 nt, Homo sapiens
aggauaagaauaaugaaugaggaaagcauuuuagggagu

SEQ ID NO: 151573 - RNA, 52 nt, Homo sapiens
gaggaaccuugcagaacccggaagaauaccaauauuuaagggauaaggagag

SEQ ID NO: 151574 - RNA, 60 nt, Homo sapiens
auugugauaauuuaacauuagugggauguuuauauuuugauuuaaacuagauuggcaaaa

SEQ ID NO: 151575 - RNA, 42 nt, Homo sapiens
agccuauuguacuucauaaguacauacccuuugugaaagaga

SEQ ID NO: 151576 - RNA, 57 nt, Homo sapiens
uguuccagaggcugguguauguggcccugccugcuuuugcuaacgguaucuagcagg

SEQ ID NO: 151577 - RNA, 27 nt, Homo sapiens
uuugugaucaaacaaauuuauuaacaa

SEQ ID NO: 151578 - RNA, 40 nt, Homo sapiens
cuuauguggggcacauggcuuuguuucuccucucccuggg

SEQ ID NO: 151579 - RNA, 53 nt, Homo sapiens
cacaaguaugcagacaaccaaaugaaggccuuucagcaggcgaaucagaggua

SEQ ID NO: 151580 - RNA, 46 nt, Homo sapiens
uaaguuuaauggcagacaaucugguauuauaaaugcaaagucaaug

SEQ ID NO: 151581 - RNA, 47 nt, Homo sapiens
uacucauccacauggucucuguagugcuauucgucuugcuaccagcu

SEQ ID NO: 151582 - RNA, 46 nt, Homo sapiens
ugcuuuagaacuaauuuucaucaaucucuuauaaaugucaauaucu

SEQ ID NO: 151583 - RNA, 47 nt, Homo sapiens
cuuaaauuccaauuaaucaauuacuucaucacuuucuuaauucagau

SEQ ID NO: 151584 - RNA, 47 nt, Homo sapiens
aguacagcaugguggguugcucauggcaucguauugacuguguauua

SEQ ID NO: 151585 - RNA, 58 nt, Homo sapiens
uacugaauuuuuguaucuacuaacaguuuuaauacuauuuuauugcuuuuuaguuuca

SEQ ID NO: 151586 - RNA, 36 nt, Homo sapiens
aaauucuguuuaugugauuuuuaaguaauuaaaguu

SEQ ID NO: 151587 - RNA, 52 nt, Homo sapiens
caguaauuacaaaaauguaaaaauuaacacacaaggccauugcuagucuuaa

SEQ ID NO: 151588 - RNA, 64 nt, Homo sapiens
uagugggugugaaguaguaucucauugugguuuugguuuguauuuuccuaaugauuaaugaugu

SEQ ID NO: 151589 - RNA, 31 nt, Homo sapiens
uaauaaucauguaauguguucuauugguaua

SEQ ID NO: 151590 - RNA, 42 nt, Homo sapiens
acacgggaagcaauugaugaauuucggcguuuucagcgugac

SEQ ID NO: 151591 - RNA, 48 nt, Homo sapiens
augcauauuuuucauguuacuaaaauuaagcuguggcuuauaaaaugu

SEQ ID NO: 151592 - RNA, 46 nt, Homo sapiens
gcaugcuccagggugggaggaggucauccaggaggguguggguggg

SEQ ID NO: 151593 - RNA, 65 nt, Homo sapiens
cacguagccauccaucaggcuaugaagaagaaaauauaaagcaggaaaaaugaguagaggaugaa

SEQ ID NO: 151594 - RNA, 118 nt, Homo sapiens
ucaaucaauauugagcuccuucauguccagccauagucuagguaauguugauacaacagugaacaagacaaaccaaauccuguucuaauagaacuaaaauucugggagaaaaggcagu

SEQ ID NO: 151595 - RNA, 2109 nt, Homo sapiens
gauucagcauuuuuacuugaggaauuuauccuaaagaaauaaugauugacuuccucuuuuccuaauugaauacccuuuauuuccuucuccugccugauugcaaauugucccuguuugcagaugacaugauuguuuaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugaaugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuacaguucauauggaaccaaaaaagagucugcaucgccaaaucaauccuaagccaaaagaacaaagcuggaggcaucacacuaccugacuucaaacuauacuacaaggcuacaguaaccaaaacagcaugguacugguaccaaaacagagauauagaucaauggaacagaagagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcaauaccauucaggacauaggcaugggcaaggacuucauguccaaaacaccaaaagcaauggcaacaaaagccaaaauugacaaaugggaucuaauuaaacucaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuccacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacugugguggggucgggggaggggggagggauagcauugggagauauaccuaaugcuagaugacacguuagugggugcagcgcaccagcauggcacauguauacauauguaacuaaccugcacaaugugcacauguacccuaaaacuuagaguauaauaaaaaaaaaaaaaaaauuaaaaaaaaaaaaaaaagaaauaaugauugaucacaaagucua

SEQ ID NO: 151596 - RNA, 39 nt, Homo sapiens
cugaaagcucgcacaguauggcuuggauguccugaaaag

SEQ ID NO: 151597 - RNA, 351 nt, Homo sapiens
uuauuaucuuacgagaaguuuuaaugguuaaaagcuggaggccgggugugguggcucaugccuguaauccuagcacuucgggaggcuaaggcgggcagaucacuuugagcucaggaguuugagaccagccuggacaacauggugaaaccccauuucuacuaaaaauacaaaaauuagcugggcgagauugugagcuccuguaaucccagcuacuagggaggcugaggcaggagaaucacuugaaccugggagguggagguuacagugagccgagaucgagccacugcacuccauccugggcaauggaguaagacucugucucaaaaaaaaaaaaaaaagcuagagaaaauu

SEQ ID NO: 151598 - RNA, 41 nt, Homo sapiens
ugauuaccacaccuuaccacgagccaggauaaugcaaagga

SEQ ID NO: 151599 - RNA, 36 nt, Homo sapiens
uaagacaguguuuaucuaauuguccagucccaggau

SEQ ID NO: 151600 - RNA, 48 nt, Homo sapiens
aguuugagaaaauaccaucauucacauugauaaucauauuccccccag

SEQ ID NO: 151601 - RNA, 41 nt, Homo sapiens
cacguuuugcagacauucaggugacaccggguuguugcgag

SEQ ID NO: 151602 - RNA, 46 nt, Homo sapiens
ucaagcagccaugagccacuugcucgagaugugugugagcggagac

SEQ ID NO: 151603 - RNA, 45 nt, Homo sapiens
accucacucugucaacaguaagcuguaaaaacagaacaaugacau

SEQ ID NO: 151604 - RNA, 54 nt, Homo sapiens
uaauguugaaaacuuacauagacagaaaguagguuuuggaaagggaaaccacag

SEQ ID NO: 151605 - RNA, 42 nt, Homo sapiens
guaucuaaccugcucaguaaauauggacgcaauuaaagaugc

SEQ ID NO: 151606 - RNA, 46 nt, Homo sapiens; identical to SEQ ID NO: 63565

SEQ ID NO: 151607 - RNA, 46 nt, Homo sapiens
gaauauacuaaaugcagcuauguaaaaauaaaauucaaacgcccag

SEQ ID NO: 151608 - RNA, 60 nt, Homo sapiens
ucuucaucagcagcaaguuuuacuuuuuucuguggaaccuugcuaccaccuccaguagca

SEQ ID NO: 151609 - RNA, 48 nt, Homo sapiens
uaaagugauaaucuuuguuggccuucaguucacaaccgaaaagauagu

SEQ ID NO: 151610 - RNA, 43 nt, Homo sapiens
caacgcugcagcccccuggggcgagggugcgcucuacagagcg

SEQ ID NO: 151611 - RNA, 32 nt, Homo sapiens
aguagagaggguggagcaggggaugcggcgag

SEQ ID NO: 151612 - RNA, 72 nt, Homo sapiens
agguaaaaacaaguuuggcuuguuugagaaacaaagagaaagggucaaugugaucaggugugggcauuagca

SEQ ID NO: 151613 - RNA, 41 nt, Homo sapiens
ggggauggaagaggagagccugguggaggaacagauacgag

SEQ ID NO: 151614 - RNA, 43 nt, Homo sapiens
uggugaacaggugugguuuaaaagggaauggaggagguggauu

SEQ ID NO: 151615 - RNA, 46 nt, Homo sapiens
agggaccgagcccccgaaaagcaaaggaggauggcagcaaacaagu

SEQ ID NO: 151616 - RNA, 58 nt, Homo sapiens
ccggccgcauguguagugaacccuaaagcuuuccuaauuguaguuagcaucgucccua

SEQ ID NO: 151617 - RNA, 21 nt, Homo sapiens
cuuuggcauggccaugaggug

SEQ ID NO: 151618 - RNA, 47 nt, Homo sapiens
uugauguccucacuggaccuacuggaguuauagcaugucuuugcaug

SEQ ID NO: 151619 - RNA, 53 nt, Homo sapiens
ugaauaccuggagaaauagaagacauaaaaucugaggguuugggagagaaaga

SEQ ID NO: 151620 - RNA, 48 nt, Homo sapiens
uauuuccagggcacugagcaacauuauaaaugguguaaccaccuucug

SEQ ID NO: 151621 - RNA, 46 nt, Homo sapiens
cagaagccagaugccuugaacuucuuugcauggugcaggccuccag

SEQ ID NO: 151622 - RNA, 42 nt, Homo sapiens; identical to SEQ ID NO: 41051

SEQ ID NO: 151623 - RNA, 45 nt, Homo sapiens
gauuccuugggugggcuuguccauaauaguaauuuccaacacccc

SEQ ID NO: 151624 - RNA, 45 nt, Homo sapiens
ugcagaauucaaaugagugcaagaggaauuuuguggcuguguaug

SEQ ID NO: 151625 - RNA, 38 nt, Homo sapiens
cauaaagugccaaggacagagauacuuuuggugggaga

SEQ ID NO: 151626 - RNA, 43 nt, Homo sapiens
guguucaugugugccuauguggguggcuguguugauuuugggg

SEQ ID NO: 151627 - RNA, 39 nt, Homo sapiens
ugcagcggggaaagggcaguggggacacuuccaacgcgg

SEQ ID NO: 151628 - RNA, 42 nt, Homo sapiens
gggaggauuagacacaugcgcacgauuggucucuuugugugc

SEQ ID NO: 151629 - RNA, 44 nt, Homo sapiens
caguuguuguacuugauauggucgucuguaaaggauuuguagaa

SEQ ID NO: 151630 - RNA, 46 nt, Homo sapiens
uuuuaaaauuuuaguuaauuaggcacacagauuaauucauugguug

SEQ ID NO: 151631 - RNA, 49 nt, Homo sapiens
uuaaucuuuauuggcuuuaaaguauaggcacuuaugaguuuaaugggau

SEQ ID NO: 151632 - RNA, 50 nt, Homo sapiens
ugacauaguaagauacaaauauucuuaaugaaguacuguauauuccuggg

SEQ ID NO: 151633 - RNA, 46 nt, Homo sapiens
uguauauacauacuucuuuucugccucagaagaagugguuccugag

SEQ ID NO: 151634 - RNA, 62 nt, Homo sapiens
ugaacugagacuuuuacgugauaugaaggagccgugcaaagaucuguggauacaauacgcca

SEQ ID NO: 151635 - RNA, 46 nt, Homo sapiens
cagaauuaccuugcuauggauggcuuccucuuguaugaacuuggag

SEQ ID NO: 151636 - RNA, 46 nt, Homo sapiens
gggucagugauuaaagagaugguuuacuaauagaacugauggugau

SEQ ID NO: 151637 - RNA, 347 nt, Homo sapiens
gaaguguucggagagauggaaggugaggcaggagagggacggagcucagggggugcaggugugguuuucggcuaggagggccuuaggcagguaguaggcaacucaugagcuucaacuuugccaccccagugacucaccugaauaucuuaagaguuccaggcagacgauuuuagguuuuuacuuauauaagacuucgaaagcaaaaugcuguuaaggaaaaugugguccuuaaagaugaucuugucgucuuuggauguuuauagguaacaauuuugcuguauuuuuggcucuuauuuuauguccacagaccaugucugcaaaggagaagucgaaguuugaagauaugg

SEQ ID NO: 151638 - RNA, 46 nt, Homo sapiens
caucgcccaaagaucaaaagugaacacccuggccuauccauugggg

SEQ ID NO: 151639 - RNA, 47 nt, Homo sapiens
ugcauaucgugccaagggcaaaagugaagcaggaaagaagggcccug

SEQ ID NO: 151640 - RNA, 69 nt, Homo sapiens
gaagaugaggaggaagaggaugaagaugaagaauaaauggcuauccuuuaaugaugcguguggaaugug

SEQ ID NO: 151641 - RNA, 46 nt, Homo sapiens
uccuaaauauuuaaugguuuuuuuaauuucuuguguaugguagcac

SEQ ID NO: 151642 - RNA, 46 nt, Homo sapiens
cucuugcaguuauugaugagaaaaauacaucaguugaacauaccag

SEQ ID NO: 151643 - RNA, 42 nt, Homo sapiens
aagucaauuauucaggaaguugcaagagauuacagagaccuc

SEQ ID NO: 151644 - RNA, 48 nt, Homo sapiens
ugaaugauuuugcugucaaaucuauuaauuuuuaaauuuguuucugag

SEQ ID NO: 151645 - RNA, 48 nt, Homo sapiens
cugcaaauaagaugacaauuucucaagaaaugaggaaauuuauugaga

SEQ ID NO: 151646 - RNA, 46 nt, Homo sapiens
ugggucagcuucagccaagcuguguggguuaugaauagaggaggag

SEQ ID NO: 151647 - RNA, 47 nt, Homo sapiens
gauugauucauuggaacuaaaaacaagcugaauagcaacaagagaaa

SEQ ID NO: 151648 - RNA, 47 nt, Homo sapiens
ggugucaucaguaucaugugcuauggaaucuacacagccgacacaga

SEQ ID NO: 151649 - RNA, 49 nt, Homo sapiens
ccagcaguggaggaucuguagugccuacagugcaggagcccaaggaugu

SEQ ID NO: 151650 - RNA, 42 nt, Homo sapiens
aagaacauguuauucguauuuugcuaauaucaacugcaugga

SEQ ID NO: 151651 - RNA, 46 nt, Homo sapiens
guguuuggagcaaagagaugaacaguuugucugaaacaaacacaga

SEQ ID NO: 151652 - RNA, 50 nt, Homo sapiens
uugcaucuuaaguacuaaggaauuacuagugauuguuuuauuuuauccau

SEQ ID NO: 151653 - RNA, 69 nt, Homo sapiens
aagcuuguuuugcaguagugaaaagcuuagaugaguacggauaccucauuugaaacucagccuaguaag

SEQ ID NO: 151654 - RNA, 43 nt, Homo sapiens
uucauauuuauaauuagucauuuacauauuuuugucuuguuga

SEQ ID NO: 151655 - RNA, 46 nt, Homo sapiens
auucaacacuccuuaugcauuaaaugaucaaauaaaccaguguagg

SEQ ID NO: 151656 - RNA, 43 nt, Homo sapiens
uuacuaacuuguugaauucaugauauucugccuauggcacaaa

SEQ ID NO: 151657 - RNA, 43 nt, Homo sapiens
uagugguccagauucucuuuauucaucuucguagccaguugga

SEQ ID NO: 151658 - RNA, 37 nt, Homo sapiens
cuagagcugugccuggcacauacagucaccucagugg

SEQ ID NO: 151659 - RNA, 44 nt, Homo sapiens
gauuuuguccucaaggucauguugcagauaggcuucaaggggga

SEQ ID NO: 151660 - RNA, 45 nt, Homo sapiens
augauuuaaaaaauaaauauaauugggauuuuaaaaacaugagaa

SEQ ID NO: 151661 - RNA, 48 nt, Homo sapiens
acgacgcccugcagcaccgacgugugugacagcgacuacagcgccagc

SEQ ID NO: 151662 - RNA, 25 nt, Homo sapiens
gagccccggggagcucacucuagua

SEQ ID NO: 151663 - RNA, 53 nt, Homo sapiens
ccgcacgaguaugucagcgggaccccgcacgugccccucaauuucauagcccc

SEQ ID NO: 151664 - RNA, 42 nt, Homo sapiens
cucucucuucgucauggguggugucuauuuugugugccagcg

SEQ ID NO: 151665 - RNA, 64 nt, Homo sapiens
cagaggcaguggcuccugaaaggcugucugauucaggcaggaagggagcugaguucagauagga

SEQ ID NO: 151666 - RNA, 28 nt, Homo sapiens
gggccuccaugccagaggccaugcccuu

SEQ ID NO: 151667 - RNA, 47 nt, Homo sapiens
ccauccuuggcaagcaucucuacuggaucgaccgccagcagcagaug

SEQ ID NO: 151668 - RNA, 92 nt, Homo sapiens
gagcuucugguuggugggaaggcacccaggaccuugaggucuccagagagaaaagccagggaaagagggagaccgaaacccaugugacauga

SEQ ID NO: 151669 - RNA, 46 nt, Homo sapiens
acagcccuuuguuuugaccucucugagccaaggccaaaacccagac

SEQ ID NO: 151670 - RNA, 44 nt, Homo sapiens
accaccuucuugcuguucagccagaaaucugccaucagucggau

SEQ ID NO: 151671 - RNA, 92 nt, Homo sapiens
gagcgggucgugauugccgacgaucucccgcacccguucggucugacgcaguacagcgauuauaucuacuggacagacuggaaucugcacag

SEQ ID NO: 151672 - RNA, 54 nt, Homo sapiens
aggaucgugcgggccuucauggacgggaccaacugcaugacgcugguggacaag

SEQ ID NO: 151673 - RNA, 111 nt, Homo sapiens
ggcauggccguugacuggaugggcaagaaccucuacugggccgacacugggaccaacagaaucgaaguggcgcggcuggacgggcaguuccggcaaguccucguguggagg

SEQ ID NO: 151674 - RNA, 45 nt, Homo sapiens
guuccuaaaauguggcccuuuuccuccucaccugcugccagacca

SEQ ID NO: 151675 - RNA, 45 nt, Homo sapiens
gacaggaacggggggugcagccaccugugcuucuucacaccccac

SEQ ID NO: 151676 - RNA, 46 nt, Homo sapiens
ucuacuggacugacuggcagcgccgcagcaucgagcgggugcacaa

SEQ ID NO: 151677 - RNA, 31 nt, Homo sapiens
caugucuggaaguuugguauuaaaauuaaga

SEQ ID NO: 151678 - RNA, 46 nt, Homo sapiens
ggggagagaacccuaaaaucgagugugccaacuuggaugggcagga

SEQ ID NO: 151679 - RNA, 48 nt, Homo sapiens
gaggguggaugaggguaagaagugggguccccaggggcuuuagcaaga

SEQ ID NO: 151680 - RNA, 102 nt, Homo sapiens
ccugugcucguggcccagcccuggggguugugagugugcuggccggggagcuuuuccugcaaguggacuggugucuaggagccagcaugucaggcagcaggc

SEQ ID NO: 151681 - RNA, 42 nt, Homo sapiens
cgcaagauccuggugucggaggaccuggacgagccccgagcc

SEQ ID NO: 151682 - RNA, 46 nt, Homo sapiens
cguaccuggacgggucuggggcgcagacgcuggucaacaccgagau

SEQ ID NO: 151683 - RNA, 46 nt, Homo sapiens
gccaucgacuacgacccgcuagagggcuaugucuacuggacagaug

SEQ ID NO: 151684 - RNA, 118 nt, Homo sapiens
gaacagcuuuccugaggaggagguggcgggaggaacagcuucccugaggaggagguggcggugcugugugaccugggccuugaaggacagguccauugucaacagaacauuuugggag

SEQ ID NO: 151685 - RNA, 45 nt, Homo sapiens
aaaucagcucacacgguucaggaaguuguggaagaagccugagug

SEQ ID NO: 151686 - RNA, 46 nt, Homo sapiens
gccuuucuacacaugcgccugccccacgggugugcagcugcaggac

SEQ ID NO: 151687 - RNA, 53 nt, Homo sapiens
ggcugagggccccauguggacgggccagcgaugaggcagguggaauggugcca

SEQ ID NO: 151688 - RNA, 43 nt, Homo sapiens
uugucuguguguguguguauauguauuuauauacacauacacg

SEQ ID NO: 151689 - RNA, 42 nt, Homo sapiens
ccaugccugcaacaagcgcacuggggggaagaggaaggagau

SEQ ID NO: 151690 - RNA, 27 nt, Homo sapiens
gccugacgcaccccuucgcccugacgc

SEQ ID NO: 151691 - RNA, 76 nt, Homo sapiens
ccucccgucggguucugcuccugccacguucuccccucuccccaccaaaggcuggguuuucuuugucagggcuccu

SEQ ID NO: 151692 - RNA, 42 nt, Homo sapiens
ccuccuggcuuagcagguccuuggguggauggauggacggau

SEQ ID NO: 151693 - RNA, 45 nt, Homo sapiens
uguggaaggcucuggaggugcccuuugugccgacuugcccgagcc

SEQ ID NO: 151694 - RNA, 77 nt, Homo sapiens
ggcuugucccauugugggagcagaauggggacacucuggaagggggccgaauuuguccuggggucuuucccgggcaa

SEQ ID NO: 151695 - RNA, 40 nt, Homo sapiens
gcuuagaaaucugacuguaauaacuugcagcuaucccucg

SEQ ID NO: 151696 - RNA, 47 nt, Homo sapiens
acucguccaaguccuuccaagcacaugcccagugacaccgcggcaag

SEQ ID NO: 151697 - RNA, 47 nt, Homo sapiens
caauugaggagauaugccagaugcuuaaacacauuuaauugcuguca

SEQ ID NO: 151698 - RNA, 44 nt, Homo sapiens
cccgucuccccaggugucggagccugaccugaauuaaaguacug

SEQ ID NO: 151699 - RNA, 51 nt, Homo sapiens
auucuaggucggcccgaugaauuguuuugccugucugauuuguauaacacg

SEQ ID NO: 151700 - RNA, 34 nt, Homo sapiens
gccccaccggcccgcagccccugcugcccaauaa

SEQ ID NO: 151701 - RNA, 44 nt, Homo sapiens
gagugugguguccccguuggcgccgccagcucugcgccugggcu

SEQ ID NO: 151702 - RNA, 36 nt, Homo sapiens
ccuggacucuguggccaaaaauggacugggugggcc

SEQ ID NO: 151703 - RNA, 66 nt, Homo sapiens
accgugccugccaugcccgcgcugaccccugccccgagcccagcuuccuaacccaagacacaccuc

SEQ ID NO: 151704 - RNA, 62 nt, Homo sapiens
uugccaggccuccccaaccccuggccucaauuucccuuucuauaaaauggaagauguccaga

SEQ ID NO: 151705 - RNA, 68 nt, Homo sapiens
gugugcucccagggaugcggacggcacugggcagagcuucgggaugccuacagggcugauguggggac

SEQ ID NO: 151706 - RNA, 46 nt, Homo sapiens
guacauccuggagccccuaggggagggacggaccagugggggccgg

SEQ ID NO: 151707 - RNA, 46 nt, Homo sapiens
uaggcaaucgagguuggggcgggcugggggcggggccuggaccgga

SEQ ID NO: 151708 - RNA, 55 nt, Homo sapiens
ggcagucgggcagcaugucaaguccugcgcggccgggacacugagggcgcgggau

SEQ ID NO: 151709 - RNA, 26 nt, Homo sapiens
cggucaggcggcuggaccgcagcgug

SEQ ID NO: 151710 - RNA, 38 nt, Homo sapiens
gagggagcgcauaggaggaggggagggggugcauggga

SEQ ID NO: 151711 - RNA, 64 nt, Homo sapiens
guguuuguggugcgcggggcuggggccuacaucuguggagaggagacagcgcucaucgagucca

SEQ ID NO: 151712 - RNA, 48 nt, Homo sapiens
guggugaacgcagacgagggggagccgggcaccugcaaggaccgggag

SEQ ID NO: 151713 - RNA, 63 nt, Homo sapiens
agggcaguaaaggauuggcugucagaggagacaucuuugaggccucccuggguggaguggggu

SEQ ID NO: 151714 - RNA, 51 nt, Homo sapiens
aagaguagaaucuggcucucaggggcagacacaaggagagauguuuggaug

SEQ ID NO: 151715 - RNA, 38 nt, Homo sapiens
guggggcuccucauuucauccuaagugagccccuccau

SEQ ID NO: 151716 - RNA, 50 nt, Homo sapiens
ucucuccuugucacagccuuguagggcgugaaggggucauugccccauuu

SEQ ID NO: 151717 - RNA, 41 nt, Homo sapiens
ggauaaggcagcugcagcgccugcccacgaugguccuccgc

SEQ ID NO: 151718 - RNA, 45 nt, Homo sapiens
uguggggaccgggccgacuccgccucgcagcaacccggggagggg

SEQ ID NO: 151719 - RNA, 40 nt, Homo sapiens
cagagggacccuggggaggagggagggaaggagggggcag

SEQ ID NO: 151720 - RNA, 38 nt, Homo sapiens
agagaugggcugagugggucagagacggcagagacacc

SEQ ID NO: 151721 - RNA, 37 nt, Homo sapiens
agcaugaggggcuucaccaggcugacagggccacacg

SEQ ID NO: 151722 - RNA, 42 nt, Homo sapiens
ccgggagcugcggcccgaggagauugaagguaaaggguugga

SEQ ID NO: 151723 - RNA, 37 nt, Homo sapiens
gccacuggggcugagggcgggcagggcugcgugucug

SEQ ID NO: 151724 - RNA, 46 nt, Homo sapiens
guccccaggcccuagaggcggggccuugggaaccgggacccggggc

SEQ ID NO: 151725 - RNA, 40 nt, Homo sapiens
caaacugaggcucagcgaggguaggcggcaggcccaguau

SEQ ID NO: 151726 - RNA, 46 nt, Homo sapiens
gcuuccccgaguugaggccuuuggggcccggccuggggucccgucc

SEQ ID NO: 151727 - RNA, 46 nt, Homo sapiens
gccccaaaggccucaacucggggaagcaucugccuagaggccccag

SEQ ID NO: 151728 - RNA, 46 nt, Homo sapiens
ggggcacaggggaugcuccugcguguggggcaaggucugguucaga

SEQ ID NO: 151729 - RNA, 44 nt, Homo sapiens
aaccagaccuugccccacacgcaggagcauccccugugccccag

SEQ ID NO: 151730 - RNA, 47 nt, Homo sapiens
ugaugaagugcagggcauggugcagggacuggggcuggccccuugca

SEQ ID NO: 151731 - RNA, 43 nt, Homo sapiens
caguaccaggcacgcaguagguguuccauaaauguuugcugaa

SEQ ID NO: 151732 - RNA, 36 nt, Homo sapiens
cacacagacggagccgcgggggugggggcaggagca

SEQ ID NO: 151733 - RNA, 46 nt, Homo sapiens
uccagcgccaucuucuucgugccgggcuuccuguuguuggugccug

SEQ ID NO: 151734 - RNA, 42 nt, Homo sapiens
agggugaaccaggagcccaacuuccagggaccuccgcccagg

SEQ ID NO: 151735 - RNA, 56 nt, Homo sapiens
cgauucgaggccgcucuggguugcuucgcggcccacagcugcgucccgaccccguc

SEQ ID NO: 151736 - RNA, 57 nt, Homo sapiens
uggacauucccugggacucagaacugggcacucacucggccccacaguagagagacu

SEQ ID NO: 151737 - RNA, 48 nt, Homo sapiens
cacaccuugaaucccucaucuugccguuucucacacugcugggcaggu

SEQ ID NO: 151738 - RNA, 42 nt, Homo sapiens
gaacaccuugccaucugccaggaagauggcccgcaugggccg

SEQ ID NO: 151739 - RNA, 54 nt, Homo sapiens
gggcccuuccguuggcaugaacaacaugggcaaagacacagaggcagugggagg

SEQ ID NO: 151740 - RNA, 42 nt, Homo sapiens
cugagggcgcuggucaaggagcagggcgaccgcaucugccgc

SEQ ID NO: 151741 - RNA, 59 nt, Homo sapiens
acccgucccaggcccaggccgaagccagcgcccagcuuuccucacuguuccuguggagg

SEQ ID NO: 151742 - RNA, 53 nt, Homo sapiens
ggaccaucuccccgaccacugcccagcccucugcucccuccccagaggaggcg

SEQ ID NO: 151743 - RNA, 34 nt, Homo sapiens
cugcuggggcagcugugccccugaaucaugggca

SEQ ID NO: 151744 - RNA, 47 nt, Homo sapiens
aagaggggccgugggcguccagggcgcuaggaagccgggugggggug

SEQ ID NO: 151745 - RNA, 46 nt, Homo sapiens
agcccaagcugcgcucacccaggcgccucaacaguagcccccgggc

SEQ ID NO: 151746 - RNA, 31 nt, Homo sapiens
uccuccuccagccgcccuucaccgcagagaa

SEQ ID NO: 151747 - RNA, 42 nt, Homo sapiens
cggcgccgccauggcggccguguuugauuuggauuuggagac

SEQ ID NO: 151748 - RNA, 57 nt, Homo sapiens
cugugccccagaugauggauugauuguacagaaaucaugcugccaugcugggggggg

SEQ ID NO: 151749 - RNA, 36 nt, Homo sapiens
ugcccuggccuuggggacuccucgauccugggcagu

SEQ ID NO: 151750 - RNA, 42 nt, Homo sapiens
gagaugcagcauuuuuccaccgucuucuccagcaucgccagu

SEQ ID NO: 151751 - RNA, 107 nt, Homo sapiens
cagaaagggguagaacggugccccuggcagagggaagaacaagaguaaaugcucagcggugugggcuccgcccccuggagaggggaguaggucugugagucucagag

SEQ ID NO: 151752 - RNA, 45 nt, Homo sapiens
gaggguaaccacugacuggcgggacuucagggcaggcugaggccc

SEQ ID NO: 151753 - RNA, 54 nt, Homo sapiens
cgccuccugcaggggagggcaggugaagggcucacaaccaacugagaguagaga

SEQ ID NO: 151754 - RNA, 46 nt, Homo sapiens
uugcagccucaaugaagcggugcgucuccuuccagugcggcagcag

SEQ ID NO: 151755 - RNA, 83 nt, Homo sapiens
cuccaacaggugcucacagccaccgaggcaggggcugcagccacccacugggagucuuguuuuuauuuauaauaaaauuguug

SEQ ID NO: 151756 - RNA, 43 nt, Homo sapiens
gcagggugccgggggguaggaggcagcgccgagcggcuggaag

SEQ ID NO: 151757 - RNA, 43 nt, Homo sapiens
gucgagucuuuguuggggcgaagaagcuggagggugggccgcu

SEQ ID NO: 151758 - RNA, 60 nt, Homo sapiens
augguccggucaucgaaugugacaucgugaaagauuaugccuucguacacauggagcggg

SEQ ID NO: 151759 - RNA, 53 nt, Homo sapiens
ugaggguuuaagugcuuaagauuuauauucuuuacugcuuuggguggauacug

SEQ ID NO: 151760 - RNA, 74 nt, Homo sapiens
caaguguauaccagacacguuucaagcacucaguagucaugaggccuguggcuaccguauuaauagagacacag

SEQ ID NO: 151761 - RNA, 72 nt, Homo sapiens
uuaggucuuccaauacaaacuaugugucuaaggaaauaaguugaguucacugcuggcuguaaaaaggaaaca

SEQ ID NO: 151762 - RNA, 63 nt, Homo sapiens
gggauguagcuaauacagaguaguauucugacuuaaugcuuguuuacauauagggaaaaaaaa

SEQ ID NO: 151763 - RNA, 46 nt, Homo sapiens
aaguuacugaaguuuguugccaacauuuuccagaaaaccagcccua

SEQ ID NO: 151764 - RNA, 75 nt, Homo sapiens
uuuggagaaacaaaacccagcaauuuuaccuugauguuuuuuaacuaaauccaaucuucauuccugcuuuuauuu

SEQ ID NO: 151765 - RNA, 27 nt, Homo sapiens
ugaccaugacagucuaaaaaggagcca

SEQ ID NO: 151766 - RNA, 74 nt, Homo sapiens
uuacaauuuuuauagggauuaacuacuaguuagaaaaaugcagcauuugccuagagaccucuaggaacccacac

SEQ ID NO: 151767 - RNA, 29 nt, Homo sapiens
cguccaucuuguuuccucuagcuauuuuu

SEQ ID NO: 151768 - RNA, 65 nt, Homo sapiens
uuccacuucucacuaagauuguuauuacuuguaaugauucaaauucugccaauacuuccaaaauc

SEQ ID NO: 151769 - RNA, 46 nt, Homo sapiens
agacucccuccuguuucugucuccacaacuuuccuuuuuccccuua

SEQ ID NO: 151770 - RNA, 44 nt, Homo sapiens
acuucaacuacuuuuuaaaggagguugcugaaauagggucacag

SEQ ID NO: 151771 - RNA, 45 nt, Homo sapiens
gaaugcaugugcaguuguccacaagccggcuucggacugccccug

SEQ ID NO: 151772 - RNA, 52 nt, Homo sapiens
ugcugcugcagccaccacuuccuccuacuauggaagggacaggagcccacug

SEQ ID NO: 151773 - RNA, 53 nt, Homo sapiens
uugcaccuuuuggauacuguccggagagcacagguggcucuagccacuuuuau

SEQ ID NO: 151774 - RNA, 50 nt, Homo sapiens
ggcaaaguacuuaaccucucugagcuuuaguucccuucucuguaaaagaa

SEQ ID NO: 151775 - RNA, 47 nt, Homo sapiens
uacaauaaggaccccaugggacagaacaucaaaacauucaacuuuca

SEQ ID NO: 151776 - RNA, 56 nt, Homo sapiens
ccuuaaauguuccucucuucaacaacaaaaaacacaaacaaaaauugcuggaagaa

SEQ ID NO: 151777 - RNA, 42 nt, Homo sapiens
acaccaaguuccucuacuuauuacagacaaagggccaaaucu

SEQ ID NO: 151778 - RNA, 52 nt, Homo sapiens
aucaauagcuauauauaggaauccacuuauggcuauauauauaggacaagau

SEQ ID NO: 151779 - RNA, 42 nt, Homo sapiens
ggucauauaugagaacuugcuccgcgcgguccccuuugccgg

SEQ ID NO: 151780 - RNA, 46 nt, Homo sapiens
uagggaaagcaagauaagagggguuccacugcacaggaaaaagggg

SEQ ID NO: 151781 - RNA, 55 nt, Homo sapiens
uugccacuacauggucauuuuaaagggaaaggagaugcugcagguaggcagggag

SEQ ID NO: 151782 - RNA, 41 nt, Homo sapiens
uagggccauccugggauggggcaccacagggagggagggag

SEQ ID NO: 151783 - RNA, 45 nt, Homo sapiens
agccgcccgcagguaaucauuauaggagcccgaauagcgugcgua

SEQ ID NO: 151784 - RNA, 42 nt, Homo sapiens
augagacaauugaggggaggacuccaggugggcauuggggag

SEQ ID NO: 151785 - RNA, 45 nt, Homo sapiens
cccacugaguugaagccaggcuugauuuuuuuggccuggauaggg

SEQ ID NO: 151786 - RNA, 62 nt, Homo sapiens
gggaccucgcuuucauccgccguucuguugauaaacaaccaaggucuuucucugcagggccc

SEQ ID NO: 151787 - RNA, 54 nt, Homo sapiens
caaggauccuuaagccuauuacgugguuguccuggcuuuggcagggaugugggu

SEQ ID NO: 151788 - RNA, 41 nt, Homo sapiens
caaccuucugccacccuggcagcuccuuaccgcacucaguc

SEQ ID NO: 151789 - RNA, 48 nt, Homo sapiens
uauggagcccaggcagcuucauauaaugcccagcccucggccucuuac

SEQ ID NO: 151790 - RNA, 41 nt, Homo sapiens
gcugguuaccauaggaggcaagggaggaacccugagcccca

SEQ ID NO: 151791 - RNA, 46 nt, Homo sapiens
agcuucuucacucggcccauaugguggagcccagcccucagccucg

SEQ ID NO: 151792 - RNA, 50 nt, Homo sapiens
ucagcccaugacagcccaggcagccucuuaccgcgcucagcccucugucu

SEQ ID NO: 151793 - RNA, 96 nt, Homo sapiens
cuuuggucgcgaccgcagcccucugcgccguucaccuccccgagccucuuauguggcuccucugacggcccagccagcuaccuaccgggcccagcc

SEQ ID NO: 151794 - RNA, 47 nt, Homo sapiens; identical to SEQ ID NO: 63820

SEQ ID NO: 151795 - RNA, 46 nt, Homo sapiens; identical to SEQ ID NO: 63821

SEQ ID NO: 151796 - RNA, 44 nt, Homo sapiens
gggaaguacugugaaaaagcggagagaucauauuggaauguugu

SEQ ID NO: 151797 - RNA, 45 nt, Homo sapiens
acuucucagggauagauuauguagcaaaggggcauuggaagagcu

SEQ ID NO: 151798 - RNA, 59 nt, Homo sapiens
auuccuucauucccugaaguuuucuccuucuguguaguagauaaguauagcuuugagac

SEQ ID NO: 151799 - RNA, 47 nt, Homo sapiens
cagauagcauccugguacuuggaugcuaucuaagaguagccacaggu

SEQ ID NO: 151800 - RNA, 38 nt, Homo sapiens
ggaaugggcagcgccgcacgggcggggccuugggcgcc

SEQ ID NO: 151801 - RNA, 85 nt, Homo sapiens
gaagcccgguggcgccuguccgucuuugucaauaacauggugcgagcacagaagauccaggcccuggaccguggcacagcucagu

SEQ ID NO: 151802 - RNA, 45 nt, Homo sapiens
gcaacaagaugaagcaagccaagucugugggugaccucgccccac

SEQ ID NO: 151803 - RNA, 52 nt, Homo sapiens
cggugguggacugaagaggggcccccagcucgggaccuggugcugaucagag

SEQ ID NO: 151804 - RNA, 42 nt, Homo sapiens
ggcgauuuauccaaucccacguggagucuguggcagacccca

SEQ ID NO: 151805 - RNA, 53 nt, Homo sapiens
gcaggucacggagugagacaggucaagcgccagugggaagagugugagcagca

SEQ ID NO: 151806 - RNA, 46 nt, Homo sapiens
cuccaucagcuucucguuuuccugguucacugccagcaccuugcag

SEQ ID NO: 151807 - RNA, 45 nt, Homo sapiens
ugccaccucaaaggcaguguucagguuuccgauggggucauccua

SEQ ID NO: 151808 - RNA, 43 nt, Homo sapiens
caggguccccucuuggggaaggcgaguauuugaucagagcugu

SEQ ID NO: 151809 - RNA, 42 nt, Homo sapiens
uacagacuggcacgugucauauggggggcacgcagaccugga

SEQ ID NO: 151810 - RNA, 54 nt, Homo sapiens
gggcuucaguuucuucaauuguuaaaugagauacagcgacuauggaccccaccc

SEQ ID NO: 151811 - RNA, 55 nt, Homo sapiens
uagccggggagguuccucaaccacagaucaaagugacagagggaaccauggaaag

SEQ ID NO: 151812 - RNA, 53 nt, Homo sapiens
ggagugaguguugaccacaaggugguagggcagugcggcugaagggccgggac

SEQ ID NO: 151813 - RNA, 40 nt, Homo sapiens
uggucccauccuugcacccugaucuuggcacccacugcag

SEQ ID NO: 151814 - RNA, 44 nt, Homo sapiens
gaugccggcagggaugccggagccagcgaaggugagaacaucca

SEQ ID NO: 151815 - RNA, 51 nt, Homo sapiens
uaaucucuccagcuuuagcaggcagaugcucagacucuucuaaauccaggg

SEQ ID NO: 151816 - RNA, 46 nt, Homo sapiens
accaagcgcuaggcaccagggagacaacaguggaugaaacacacag

SEQ ID NO: 151817 - RNA, 42 nt, Homo sapiens
aagccagccgcaccucguaguagggcuucccuucuccaucga

SEQ ID NO: 151818 - RNA, 31 nt, Homo sapiens
uagaagagaccaggacagggguuaagaguga

SEQ ID NO: 151819 - RNA, 77 nt, Homo sapiens
cauucgacccaacaugcuuaccauucuacagaugacaaaacugaggccugcaguggggagcagcauugccucaggag

SEQ ID NO: 151820 - RNA, 47 nt, Homo sapiens
ucaucuccuggcuugggcagggggaugggcagcuugugagggccugg

SEQ ID NO: 151821 - RNA, 54 nt, Homo sapiens
uaaccaaguauuuccuggacacuugagccaugccuggaugggugcugugcacug

SEQ ID NO: 151822 - RNA, 30 nt, Homo sapiens
gcagccaguguggacucugcuccccaaggg

SEQ ID NO: 151823 - RNA, 31 nt, Homo sapiens
gcagccucccacauuaguggccuugccuugg

SEQ ID NO: 151824 - RNA, 46 nt, Homo sapiens
cgggagaggagagaacgcaagagcccuuguucccccggugcuggag

SEQ ID NO: 151825 - RNA, 50 nt, Homo sapiens
uccccucugccuccucuaaacugcccgagguugcugggauaccagggagg

SEQ ID NO: 151826 - RNA, 42 nt, Homo sapiens
gcccggacggcgcagagaccacccgcacccgcgaccgcaggg

SEQ ID NO: 151827 - RNA, 40 nt, Homo sapiens
ccugcucggccccgggccgcugcggcgggaugggcccggc

SEQ ID NO: 151828 - RNA, 53 nt, Homo sapiens
uaaaacaaguuaaaaaguguuuuauccuccucucauccuccuugucuuacuag

SEQ ID NO: 151829 - RNA, 373 nt, Homo sapiens
uagaggggacagggauguuugcugcagauuuauuuuuuucuuucuuuuuuucugagauggaguuuuguucuugucgcccaggcuggagugcaguggcacgaucuccgcucacugcaaucuccuccucccggguucaagcaauucuccugccucagccucccgaguagcuaggauuacaggcgcccgccaccacgcccggcuaauuuuuuguauuuuuaguagagaugggguuucaccauguuggucaggcuggucuugaacuccugaccucaggugauccacccgccuuuuccucccaaagugcugggauuauaggcaugaaccacugcgccugaccccgauuuauuuuuuucuugugauucuguggucuuuu

SEQ ID NO: 151830 - RNA, 47 nt, Homo sapiens
uggacagcccacuguuuccuacuuccugaaggcagcagcugggauug

SEQ ID NO: 151831 - RNA, 63 nt, Homo sapiens
gcaggccuggugaccuugaagcauguguaugagauugcccgcaucaaagcucaggaugaggca

SEQ ID NO: 151832 - RNA, 40 nt, Homo sapiens
caaaggaugaguagggauuuaauaagggaacaaaagauag

SEQ ID NO: 151833 - RNA, 32 nt, Homo sapiens
agccaucuuccuggcugcucagaaggaggcag

SEQ ID NO: 151834 - RNA, 46 nt, Homo sapiens
cgcagccgccugacuuugcccuggccuauagaccgagcuucccaga

SEQ ID NO: 151835 - RNA, 43 nt, Homo sapiens
gcucucuguccucugggaagcucggucuauaggccagggcaaa

SEQ ID NO: 151836 - RNA, 39 nt, Homo sapiens
ggcagugugggaugcguggcagagaccaccacaggccgg

SEQ ID NO: 151837 - RNA, 44 nt, Homo sapiens
gccacgcaucccacacugccuucugcccaccagccuccugugau

SEQ ID NO: 151838 - RNA, 60 nt, Homo sapiens
uaguuggcugcgaucacggggaucugguggucacgggacaaagcuggguguguggcaggg

SEQ ID NO: 151839 - RNA, 46 nt, Homo sapiens
cucucugucucucauucagcacagccuccugcccaccagcccccua

SEQ ID NO: 151840 - RNA, 87 nt, Homo sapiens
gccagcgacccgggugucuggaaacaugggggacuggugggcagggaagagcuccggauauuugguugagaucauagggggcuggug

SEQ ID NO: 151841 - RNA, 75 nt, Homo sapiens
uagcugggcaccgaggguggugaccagaggggcaugguuaggugggauuccaggcaaaugagugguggucugggu

SEQ ID NO: 151842 - RNA, 110 nt, Homo sapiens
ugccccucuggucaccacccucggugcccagcuacccccucaagccccagaugcccuuguccucagaacccaggccacccagcuucccauuaucccaacugcccagcccu

SEQ ID NO: 151843 - RNA, 45 nt, Homo sapiens
gaggguggggagggcugcgggcuggguggcagcaggcacagagau

SEQ ID NO: 151844 - RNA, 49 nt, Homo sapiens
ccuccugcccucucagagccccacuaaccagaccucacccaucagcccu

SEQ ID NO: 151845 - RNA, 45 nt, Homo sapiens
cuugggacuggggccaucuucccuugggauuuggggggcuuugga

SEQ ID NO: 151846 - RNA, 46 nt, Homo sapiens
ccuguggcugcccucaccagcucccacagcagccccaacagcccug

SEQ ID NO: 151847 - RNA, 45 nt, Homo sapiens
accugcagaaccagcgugugauggggugcagaccccccucaugga

SEQ ID NO: 151848 - RNA, 147 nt, Homo sapiens
gcuggacacauggccggggcugcaccagggacccaugggggcugcccagcuggacagauggcuuccugcuccccaggcccagccaggguccucucucaaccacuagacuuggcucucaggaacucugcuuccuggcccagcgcucgu

SEQ ID NO: 151849 - RNA, 46 nt, Homo sapiens
cucagggggcgggugcuggggucuucuccaauaaauggggugucaa

SEQ ID NO: 151850 - RNA, 46 nt, Homo sapiens
cuguggcuggguaucccccgggcuggcuggaauaaccaccgcuugu

SEQ ID NO: 151851 - RNA, 47 nt, Homo sapiens
aggagagaaggggguugaggucugggggccagacucgggcagaauga

SEQ ID NO: 151852 - RNA, 40 nt, Homo sapiens
ggccugugggaggaucgggccagcccugguagggggcgcg

SEQ ID NO: 151853 - RNA, 62 nt, Homo sapiens
gccgggagacggggucaggcccuaaagcgggggaggagacuccgggucggccuaggggaggg

SEQ ID NO: 151854 - RNA, 43 nt, Homo sapiens
acggcuguccuggggcugagcuuuccguuuuuuuugcuguaua

SEQ ID NO: 151855 - RNA, 61 nt, Homo sapiens
ccuccucaaucuucuucuuccucagcucaaugaguucaggggucuccauuccagcaggcac

SEQ ID NO: 151856 - RNA, 49 nt, Homo sapiens
ugaugaaaagccuccaggagugauaaggccacuguaaagagaggaacaa

SEQ ID NO: 151857 - RNA, 46 nt, Homo sapiens
guacagguccccauggauggucagcuuuggcuuggucugccacuug

SEQ ID NO: 151858 - RNA, 46 nt, Homo sapiens
uaaaagccucaaagauccucuuaaagaagauaaaguugggcucgua

SEQ ID NO: 151859 - RNA, 45 nt, Homo sapiens
uggcgccugggcugcccaggagcuucaggccaaguuggcagagau

SEQ ID NO: 151860 - RNA, 43 nt, Homo sapiens
ucaggaaagcugguaacugucaccagggaacuggcaagggaaa

SEQ ID NO: 151861 - RNA, 35 nt, Homo sapiens
cuuggcguuggcgccacaagugucuuucagccauu

SEQ ID NO: 151862 - RNA, 54 nt, Homo sapiens
ucacgccgcgccccagcuccgcccccaccgcgcgccgcugcggcccgccccuuc

SEQ ID NO: 151863 - RNA, 44 nt, Homo sapiens
agggcagggccggggcgggagcacagcucgggcccgugggcguu

SEQ ID NO: 151864 - RNA, 46 nt, Homo sapiens
guggcaggcguugugcgggcaucaaacacuagccagggguccaugu

SEQ ID NO: 151865 - RNA, 43 nt, Homo sapiens
ucuuccuccuuguccuaugaaggccacaccccccagcucuggg

SEQ ID NO: 151866 - RNA, 45 nt, Homo sapiens
aguggagaggagcagcauuacaaagggaggcugaaggcucauccc

SEQ ID NO: 151867 - RNA, 42 nt, Homo sapiens
gacuucuuggaacgcucaucccccgcuauaccuccccuuccu

SEQ ID NO: 151868 - RNA, 33 nt, Homo sapiens
ccccucgccguccggggccaguugcccccaccg

SEQ ID NO: 151869 - RNA, 35 nt, Homo sapiens
agcuagaacccacuucucccagaacacugagcccc

SEQ ID NO: 151870 - RNA, 32 nt, Homo sapiens
uccucacugcgggucucacccccagaucagcc

SEQ ID NO: 151871 - RNA, 45 nt, Homo sapiens
gagacugacaaacuggaagaugagaaaucugggcugcagcgagag

SEQ ID NO: 151872 - RNA, 42 nt, Homo sapiens
gacacaggcaguaccaguggcaccagcagcccaccagccccc

SEQ ID NO: 151873 - RNA, 46 nt, Homo sapiens
accgguccagcuggccuggacaguaucccacauccaacuccagcaa

SEQ ID NO: 151874 - RNA, 46 nt, Homo sapiens
aaaaaacugcaguaucugagcuucggugacuuugccuucugcgcug

SEQ ID NO: 151875 - RNA, 73 nt, Homo sapiens
cuuugccccagccugccaccugccaggaccucgccuccugcagacucaagguuccccauucugcuacccuggg

SEQ ID NO: 151876 - RNA, 48 nt, Homo sapiens
cuaucagugcaccugcccugaugguuaccgcaagaucgggcccgagug

SEQ ID NO: 151877 - RNA, 48 nt, Homo sapiens
ucuacaaaaugaggacauucauaucucccuccacguuuguugggagga

SEQ ID NO: 151878 - RNA, 36 nt, Homo sapiens
cucuguacugaggcucaccgucuuuguaggggccua

SEQ ID NO: 151879 - RNA, 33 nt, Homo sapiens
ugugaggggcagaaugagaaaggcaauaaaggg

SEQ ID NO: 151880 - RNA, 44 nt, Homo sapiens
gacagucuggcccacaucgcccaccaggaucuccuugcccuccu

SEQ ID NO: 151881 - RNA, 52 nt, Homo sapiens
uuggucucauagguugcaucauagagggcauagcggcaguccuuaucuggca

SEQ ID NO: 151882 - RNA, 83 nt, Homo sapiens
accugucagcuucuucuugauggcguccuuggagcuggcauaaaucauuuugcucuuaaggggcgcagacucgggggcccugg

SEQ ID NO: 151883 - RNA, 54 nt, Homo sapiens
guuugcuugcaauucaugcuugaucccuauaaagaagaaaggggagcaucugug

SEQ ID NO: 151884 - RNA, 45 nt, Homo sapiens
ugcaacccccaagggcagguguggggcugccagaugcuccaggca

SEQ ID NO: 151885 - RNA, 53 nt, Homo sapiens
gucuguuuggcaacuggggugaagggauugcccucccccugcugggauccccc

SEQ ID NO: 151886 - RNA, 38 nt, Homo sapiens
gggaauggggauguuguuaaaaaaaauacaggcucccc

SEQ ID NO: 151887 - RNA, 45 nt, Homo sapiens
ggacuacaaggacaucuuccccgaccucuucaaacgggccgccga

SEQ ID NO: 151888 - RNA, 41 nt, Homo sapiens
auuuucgaacccucgucgcuggacacgggccgcuuccguaa

SEQ ID NO: 151889 - RNA, 48 nt, Homo sapiens
guggggguggggggcggugaucugaucuaauuagcuugggguggcccg

SEQ ID NO: 151890 - RNA, 42 nt, Homo sapiens
cggccgccccgcccgggccgcgaggccaccucacccgcagcg

SEQ ID NO: 151891 - RNA, 42 nt, Homo sapiens
gccggccccaguggggcgaguuucgugucaucacccgcggag

SEQ ID NO: 151892 - RNA, 45 nt, Homo sapiens
gcuacuggucccagaccauccuggagauccugauggggcugaagu

SEQ ID NO: 151893 - RNA, 41 nt, Homo sapiens
guggaagggaaaacagggaccccugagaagccccucucaga

SEQ ID NO: 151894 - RNA, 46 nt, Homo sapiens
cagggccaugauaggaacuaggcagccugccuuggcaaccuguguu

SEQ ID NO: 151895 - RNA, 42 nt, Homo sapiens
ucaccagcaacuccagugcccagcgagacagccccggccucg

SEQ ID NO: 151896 - RNA, 42 nt, Homo sapiens; identical to SEQ ID NO: 63944

SEQ ID NO: 151897 - RNA, 45 nt, Homo sapiens
uccgcgggcagcaucccaggcgagaggagcacagauaccaccaag

SEQ ID NO: 151898 - RNA, 49 nt, Homo sapiens
cuggagaaagacacagaaguguguucuccaggcagguggcccagcaccu

SEQ ID NO: 151899 - RNA, 37 nt, Homo sapiens
gagcaggcucagagauuggagggccugguuaagcuga

SEQ ID NO: 151900 - RNA, 51 nt, Homo sapiens
gguaaguuguuaagagugggggagagcaggcuggcagcucuccagucagga

SEQ ID NO: 151901 - RNA, 25 nt, Homo sapiens
gccuccuccuggccuccaagcagcu

SEQ ID NO: 151902 - RNA, 41 nt, Homo sapiens
cagugggacccuggaggacgaguggcaggccaucucggaga

SEQ ID NO: 151903 - RNA, 46 nt, Homo sapiens
ccuuucugccacguaccuugucucugcggaacuccaucagcaggag

SEQ ID NO: 151904 - RNA, 46 nt, Homo sapiens
cugcccaacaccaccccggaccuccuccuggccaccacagccaagc

SEQ ID NO: 151905 - RNA, 25 nt, Homo sapiens
ugucaggaugccggggagcucuccu

SEQ ID NO: 151906 - RNA, 48 nt, Homo sapiens
ggggcacagaagaccucaucacgagccccuacuauccaaccccuagcu

SEQ ID NO: 151907 - RNA, 42 nt, Homo sapiens
ccagaacaucagaacuucuucgggauggacgagucgcugggc

SEQ ID NO: 151908 - RNA, 55 nt, Homo sapiens
gggcuggucccucugccuccguauugguucauccuccaucugguucaaccugcca

SEQ ID NO: 151909 - RNA, 46 nt, Homo sapiens
caggucccuggggcuuugggugucucaaucuugcauccugugagac

SEQ ID NO: 151910 - RNA, 54 nt, Homo sapiens
cguggucccuacuucuccuuucugggaggccugggccaggucucccacuuggga

SEQ ID NO: 151911 - RNA, 46 nt, Homo sapiens
uucuggugucugauguagaucccaggcaugggaggucaggggucac

SEQ ID NO: 151912 - RNA, 45 nt, Homo sapiens
cgaagagacccuggaucucgcgcuuccagccuuccugcauggaau

SEQ ID NO: 151913 - RNA, 43 nt, Homo sapiens
caggggugcaggagugggcggggagucgggcgucuugagcgag

SEQ ID NO: 151914 - RNA, 40 nt, Homo sapiens
uacagagcugcaaacgcacaugccuaccggagccagaugg

SEQ ID NO: 151915 - RNA, 26 nt, Homo sapiens
cagcaugggcgagagagggcaugugc

SEQ ID NO: 151916 - RNA, 44 nt, Homo sapiens
acaggagcagaggcagauagaugggcgggcggcugagguggaga

SEQ ID NO: 151917 - RNA, 42 nt, Homo sapiens
ggugcccgacaagcucaucgucaugacguaccugugccagau

SEQ ID NO: 151918 - RNA, 76 nt, Homo sapiens
caaguucugagaguccaggaggcagaggcugggguuugggggaugucagagggcaaaucuggggcuuggggggccc

SEQ ID NO: 151919 - RNA, 75 nt, Homo sapiens
ggugaaagagguuggggguucagagguuccagagauagcgacugggacagcagaaacugagauauuggggaccca

SEQ ID NO: 151920 - RNA, 58 nt, Homo sapiens
gauaucuggggauuuagggccacugaagauagaagauacaauacagucugagaugcug

SEQ ID NO: 151921 - RNA, 49 nt, Homo sapiens
cuggcagggggcccuguuaucaacugcccagggggcaauauccaggggu

SEQ ID NO: 151922 - RNA, 42 nt, Homo sapiens
uggcccaggagccccggaggcccgggcucgagucccccagcc

SEQ ID NO: 151923 - RNA, 86 nt, Homo sapiens
gaugacaugcagagucucgcaagccucaugagugugaagccuagugaugugggcaacuuggaugacuuugcugagagugaugaaga

SEQ ID NO: 151924 - RNA, 41 nt, Homo sapiens
gggccagcgggagccccgggccugagaagugggcggcgggg

SEQ ID NO: 151925 - RNA, 42 nt, Homo sapiens
ccucagacuucggagccugcgccuuccccccuaccgccucac

SEQ ID NO: 151926 - RNA, 45 nt, Homo sapiens
cugucugacgacgaggagccucccgaugccagccugccuccugac

SEQ ID NO: 151927 - RNA, 44 nt, Homo sapiens
gcaccaggcccggugggagagcuaguggggucuuggccuuagag

SEQ ID NO: 151928 - RNA, 42 nt, Homo sapiens
gaaggugcugaguucugagcaggagcacacaggguuuuugag

SEQ ID NO: 151929 - RNA, 71 nt, Homo sapiens
gaaaagguucugguccauggagugagcuucugccugaggcagguuucucugggacacugagauuguggacc

SEQ ID NO: 151930 - RNA, 42 nt, Homo sapiens
uccaggugcaccgcauugagagcucgaacgccgagagcgcag

SEQ ID NO: 151931 - RNA, 42 nt, Homo sapiens
gcccagcugggaagggauaccacauucucaccucccaccaga

SEQ ID NO: 151932 - RNA, 81 nt, Homo sapiens
gagagugacuuuucccuuuuccugcacccugacgggccacccaagccccagcagcuuccggagagcccuagccaggcucca

SEQ ID NO: 151933 - RNA, 47 nt, Homo sapiens
gugagugaggagaggucagugcagcagagccacccaacugccaccac

SEQ ID NO: 151934 - RNA, 43 nt, Homo sapiens
ucgcccccgaccaugcgcugguuccugccggacuugccuccuu

SEQ ID NO: 151935 - RNA, 60 nt, Homo sapiens
gcauggaagcaugaaacacugguggaggagggagaacccacacacaggccagugucucug

SEQ ID NO: 151936 - RNA, 28 nt, Homo sapiens
agcggcuggggcagggagagagggcggg

SEQ ID NO: 151937 - RNA, 45 nt, Homo sapiens
uuugcccccaggggcaucggcugguggguggcaggaaaugccaag

SEQ ID NO: 151938 - RNA, 46 nt, Homo sapiens
gagugcugcugcucucugggggccggcuggggcgaccacugcgaaa

SEQ ID NO: 151939 - RNA, 45 nt, Homo sapiens
agccgaguuccacagccucugcccagacggaaagggcuacaccca

SEQ ID NO: 151940 - RNA, 45 nt, Homo sapiens
gccgaguacagucccgcgcagcgccagugccugagcccggaagag

SEQ ID NO: 151941 - RNA, 45 nt, Homo sapiens
cgugccccggagcggcgcgacgugugcuggagccagcgcggagag

SEQ ID NO: 151942 - RNA, 43 nt, Homo sapiens
gacccagggaccuucagggcccgcagacccucccggcgccuug

SEQ ID NO: 151943 - RNA, 47 nt, Homo sapiens
ugccugccuuccucccagaggguguuuccuagaaacugauaaaucag

SEQ ID NO: 151944 - RNA, 28 nt, Homo sapiens
auuuuguaaaaaguuccagcaggcugug

SEQ ID NO: 151945 - RNA, 46 nt, Homo sapiens
ugggcacagggucaggugcuggacacuagaacaggacuccacuccg

SEQ ID NO: 151946 - RNA, 56 nt, Homo sapiens
uucaguaugcccagguuggcagcacugagaaccgcaggaacggccuguuguuacaa

SEQ ID NO: 151947 - RNA, 69 nt, Homo sapiens
gcaucugcuguggacuuuuuaagauugccccccauaagcucaucugcaaacuuuaaaugguagccuccu

SEQ ID NO: 151948 - RNA, 50 nt, Homo sapiens
ucacuccccacccucucugcaggcaagcaacaccgauccgccccacccca

SEQ ID NO: 151949 - RNA, 42 nt, Homo sapiens
agguaauguuuuaagugaauggauaaguuaaagggaggaaga

SEQ ID NO: 151950 - RNA, 54 nt, Homo sapiens
ucuguccccugaagcccugagcuagccacuuccucccccacaacuacacccagg

SEQ ID NO: 151951 - RNA, 65 nt, Homo sapiens
uccucgauaaagaagagagugucccguguggcccaggcuuuccugggcaugcgccagcccccaga

SEQ ID NO: 151952 - RNA, 52 nt, Homo sapiens
cugugcaaagcuggccagggccuccuguagggcuccucugcagccugcccuc

SEQ ID NO: 151953 - RNA, 45 nt, Homo sapiens
gugugguguccagccggauccagcaucucuccaccaucgacuacg

SEQ ID NO: 151954 - RNA, 46 nt, Homo sapiens
gaugagcagucucauugaguacugcaucgaacugagccaggcggcg

SEQ ID NO: 151955 - RNA, 24 nt, Homo sapiens
uggugcccagcugugcccgcuggc

SEQ ID NO: 151956 - RNA, 46 nt, Homo sapiens
ugcgcuuccaggagcugucgugggaccacaccucccccgaggagga

SEQ ID NO: 151957 - RNA, 45 nt, Homo sapiens
gcaguuccgaaggaacguguucuucccaaagcggcgggagcucca

SEQ ID NO: 151958 - RNA, 34 nt, Homo sapiens
cucccuagcacccgcuuccccccccggggcaggu

SEQ ID NO: 151959 - RNA, 46 nt, Homo sapiens
ucccaauuccuccaagaccuauggcaucaaguggaagcgucccacg

SEQ ID NO: 151960 - RNA, 44 nt, Homo sapiens
ccgugccggagagauaagggagagccgagaggaagcgggguagg

SEQ ID NO: 151961 - RNA, 45 nt, Homo sapiens
caaagaguaagauccccuggaccaccagccccagcaagagcauga

SEQ ID NO: 151962 - RNA, 46 nt, Homo sapiens
gaacugguguuugagguaguaggcgugagccaccacagccccgguc

SEQ ID NO: 151963 - RNA, 44 nt, Homo sapiens
cucaguugcccaaagaacaccuugcccaucaccuugcccagaag

SEQ ID NO: 151964 - RNA, 27 nt, Homo sapiens
gaugacuucagcccccgcuuuguugca

SEQ ID NO: 151965 - RNA, 36 nt, Homo sapiens
cuccccugaaucucacucacagacaaugcggcagug

SEQ ID NO: 151966 - RNA, 45 nt, Homo sapiens
gacgaagaggaaguccaggaugcccaggaggaacauaagagcugu

SEQ ID NO: 151967 - RNA, 42 nt, Homo sapiens
uguacauggccuucaugaccaucaugaucaaggugcacaccu

SEQ ID NO: 151968 - RNA, 46 nt, Homo sapiens
ucaccaccacccccggagccugcggaucaggggccacccccugccc

SEQ ID NO: 151969 - RNA, 54 nt, Homo sapiens
ugagaaauagaugcuugcagucagugugaccagugcugggcugagggccugugg

SEQ ID NO: 151970 - RNA, 45 nt, Homo sapiens
uguucccacuguggccccccaugggccccuuuccaccugucccgc

SEQ ID NO: 151971 - RNA, 46 nt, Homo sapiens
cagcaccuggaggcccggcugcagagccugcguaacauccacacac

SEQ ID NO: 151972 - RNA, 63 nt, Homo sapiens
agugacauguacauaaugccuggcaucuagcagugacagcacaggcuuggagaggaacuugag

SEQ ID NO: 151973 - RNA, 42 nt, Homo sapiens
cacuacaguuguugcugcugccuccuccaccagcaucccuag

SEQ ID NO: 151974 - RNA, 46 nt, Homo sapiens
aggggcugguggggaggcuccugggguuggggucguggccucugag

SEQ ID NO: 151975 - RNA, 53 nt, Homo sapiens
agaggcuggggcugggcuggggcagugucagugggcaacaggagacuccagcu

SEQ ID NO: 151976 - RNA, 47 nt, Homo sapiens
aagagggcuucucagaggcuaaaccuucugccuucauggccccagca

SEQ ID NO: 151977 - RNA, 41 nt, Homo sapiens
ccaccccuaagacugguacccauuuccuuuucuuacccuga

SEQ ID NO: 151978 - RNA, 47 nt, Homo sapiens
cugccaguugagaaguggccuuccuugggcgcugggauugcaguggu

SEQ ID NO: 151979 - RNA, 25 nt, Homo sapiens
uuugaaguugaaugcuuaaucccgg

SEQ ID NO: 151980 - RNA, 56 nt, Homo sapiens
uuugcaggcaggaauaugcugaccuuucacccugccaucccaucccaaccccagcu

SEQ ID NO: 151981 - RNA, 71 nt, Homo sapiens
acggcggucccagcuaccgcgaagauggagucgagaaagaggaagaagcgagggcgcgucaguacagaccg

SEQ ID NO: 151982 - RNA, 45 nt, Homo sapiens
gcucuacgugggugaugcccucuggcacgaggugaggcuggacug

SEQ ID NO: 151983 - RNA, 31 nt, Homo sapiens
cugggagacaaaaauaaaguuagaggcaaaa

SEQ ID NO: 151984 - RNA, 53 nt, Homo sapiens
ggagagggagagcugaggaggggccgguucugggggcugcagaacggggauuu

SEQ ID NO: 151985 - RNA, 48 nt, Homo sapiens
ccuugacugacuauugugagcgcccucucucuccggcggagcggagac

SEQ ID NO: 151986 - RNA, 42 nt, Homo sapiens
caccugcccaaggagccccaggacucugugaccaacuggggg

SEQ ID NO: 151987 - RNA, 46 nt, Homo sapiens
cucugguucuaaagugccugguauggaauagcagugggauucuaga

SEQ ID NO: 151988 - RNA, 39 nt, Homo sapiens
uagggaacaggacggggaggagaaggcucuggcacacac

SEQ ID NO: 151989 - RNA, 29 nt, Homo sapiens
uauaugugugccuguguguguaucgagga

SEQ ID NO: 151990 - RNA, 61 nt, Homo sapiens
ugugaacauaugaacacagguguguugugggagugcaagagaaugcaugguugagggugcc

SEQ ID NO: 151991 - RNA, 47 nt, Homo sapiens
auaaggagggacagugggcaggaaucugagaucggggcgaauaugag

SEQ ID NO: 151992 - RNA, 46 nt, Homo sapiens
gccccagacaugacucucccuggaaucuccccaccacccgagaaac

SEQ ID NO: 151993 - RNA, 42 nt, Homo sapiens
ccggacugaggagaacgugaccggggagcaaggggggccaga

SEQ ID NO: 151994 - RNA, 44 nt, Homo sapiens
cuggggugcugguguacacagacccugccgacaucaacgauggg

SEQ ID NO: 151995 - RNA, 46 nt, Homo sapiens
uacgugcuguaugggaaccaccgagacagcugggugcacggggcug

SEQ ID NO: 151996 - RNA, 45 nt, Homo sapiens
gucgaugcccggcagcagguucuccccggugacggcgcugcagcc

SEQ ID NO: 151997 - RNA, 66 nt, Homo sapiens
uccaggaccugggaggacaaaggugcugauggugguggccagugacugcagacccugccugccguc

SEQ ID NO: 151998 - RNA, 45 nt, Homo sapiens
uggcaguccugcaugcgcuggcggucugcgcuguccacuacccag

SEQ ID NO: 151999 - RNA, 34 nt, Homo sapiens
gcuucaucuucuucagaauggucaggagccccau

SEQ ID NO: 152000 - RNA, 53 nt, Homo sapiens
gugaggugugccugaauggugcugccuuuucccuguaucugccuuugugugug

SEQ ID NO: 152001 - RNA, 59 nt, Homo sapiens
ggagcgcagccucuggguugggggagaguuggaugagcgugccgugcaggugagggugg

SEQ ID NO: 152002 - RNA, 31 nt, Homo sapiens
ugggacucaguggcagagguggcugggcuga

SEQ ID NO: 152003 - RNA, 83 nt, Homo sapiens
ggucugaaggguuggggaagacagagauccaaguuucagaagagauccaaggcauggggagagggccuccuuagccccuagac

SEQ ID NO: 152004 - RNA, 35 nt, Homo sapiens
gaagugagugucccccaccccaugagguuuggggg

SEQ ID NO: 152005 - RNA, 45 nt, Homo sapiens
gcccaggcccggcggucuccgagaugucacgauggcuguggccau

SEQ ID NO: 152006 - RNA, 41 nt, Homo sapiens
caagaucaccugucuggagaaugcaagacaaacucgucgag

SEQ ID NO: 152007 - RNA, 40 nt, Homo sapiens
gaggaaagguggggagaucuggcuucaagccgggaggagg

SEQ ID NO: 152008 - RNA, 80 nt, Homo sapiens
cccuuugucucuggcuuucucugcccaccaagguguguguggagucgggggcacagcucugagccgaccugggcauuggg

SEQ ID NO: 152009 - RNA, 42 nt, Homo sapiens
uuccugccccaguaaguaggggcucuggacugggcccaggag

SEQ ID NO: 152010 - RNA, 33 nt, Homo sapiens
cuggaagcugaaaaggcaacacucuaccaccga

SEQ ID NO: 152011 - RNA, 53 nt, Homo sapiens
ugggccaagccccuuucacccucugggugaacaguuuguucaucuguucagug

SEQ ID NO: 152012 - RNA, 105 nt, Homo sapiens
cguggugagagaagcaggcaggaggugguugccaucaccucggggguggugcuaggucugugccacccuagggaggcagcccugaugcugggcuuugauggagua

SEQ ID NO: 152013 - RNA, 42 nt, Homo sapiens
agcacucggguggugcuacgugaggucucccucgucuggcac

SEQ ID NO: 152014 - RNA, 48 nt, Homo sapiens
aaagcggcucuguugcaggcacgggugaguccccagcaccccagccuc

SEQ ID NO: 152015 - RNA, 38 nt, Homo sapiens
cucccccgaccugggcccacacugcugccuucucccag

SEQ ID NO: 152016 - RNA, 58 nt, Homo sapiens
acaugggugacaccggacucgcgcgggagaagagaaggcuuccccacaaaggcuauag

SEQ ID NO: 152017 - RNA, 61 nt, Homo sapiens
ugagggaguagagaauccggggcgggcuggugacuggggaaagaaaaaugggcagcgagag

SEQ ID NO: 152018 - RNA, 80 nt, Homo sapiens
ggccgcgcgccuuccggcaccguggcccccccacacccccgcgggauggcuccacgagacacccagucaggcacccuggu

SEQ ID NO: 152019 - RNA, 46 nt, Homo sapiens
uggggcaguacagcacgggcaagaccaccuucauccgacaccugau

SEQ ID NO: 152020 - RNA, 43 nt, Homo sapiens
uggcugucgccccgccguccuuugucuccgaggccccagugag

SEQ ID NO: 152021 - RNA, 61 nt, Homo sapiens
guggcagugggagcccugcaaugagauucuggcccuaagcccuucugugcacugagggaca

SEQ ID NO: 152022 - RNA, 35 nt, Homo sapiens
ccccuggucacugggggauggggccaaagggagaa

SEQ ID NO: 152023 - RNA, 41 nt, Homo sapiens
ggucagagaccugcugggucacacagcucguuguugaguag

SEQ ID NO: 152024 - RNA, 47 nt, Homo sapiens
agaaccaugaggacaagauccgcguggugcugaacaaggcagaccag

SEQ ID NO: 152025 - RNA, 46 nt, Homo sapiens
ucauguggucccugggcaagaucaucaacacccccgagguggucag

SEQ ID NO: 152026 - RNA, 46 nt, Homo sapiens
uguucuguuugugguuuauaccccaucuacuuucaggaaggguuug

SEQ ID NO: 152027 - RNA, 59 nt, Homo sapiens
gguucacgccuacaucaucagcucccucaagaaagagaugcccaaugucuuugguaaag

SEQ ID NO: 152028 - RNA, 45 nt, Homo sapiens
auggugcggcaggaggagucccugaugccuucccagguggucaag

SEQ ID NO: 152029 - RNA, 74 nt, Homo sapiens
gggcaaggacaagcccaccuacgacgagaucuucuacacgcuguccccugucaacggcaagaucacgggcgcca

SEQ ID NO: 152030 - RNA, 45 nt, Homo sapiens
gaggcugcguucuuugucgccgccuccccugugugccagcccugu

SEQ ID NO: 152031 - RNA, 60 nt, Homo sapiens
ccccucccgggcccaggcuccccgugcgcgggcccugcccuuuccucccgcgccccaccg

SEQ ID NO: 152032 - RNA, 30 nt, Homo sapiens
ugcccuuccuggagguaucugggaugugag

SEQ ID NO: 152033 - RNA, 48 nt, Homo sapiens
cagagggacacugggcagauuuuugccaugaaaaugcugcacaagugg

SEQ ID NO: 152034 - RNA, 41 nt, Homo sapiens
aacgggaugggacccccugagggugggccucaggaggccca

SEQ ID NO: 152035 - RNA, 45 nt, Homo sapiens
caccaagauggcagaggagcuggaguccuugaggaacguaggcac

SEQ ID NO: 152036 - RNA, 40 nt, Homo sapiens
uaugagggcuuucugucggugagugggggccgagggaggg

SEQ ID NO: 152037 - RNA, 46 nt, Homo sapiens
guucucggcuaccccuguccuggccucugauguuauccaugcccaa

SEQ ID NO: 152038 - RNA, 42 nt, Homo sapiens
ugagcugcagcggcugcugcuggacgcgcggccaagaccccg

SEQ ID NO: 152039 - RNA, 41 nt, Homo sapiens
gggccugggugaggcacugggugccguggagcuuagccuca

SEQ ID NO: 152040 - RNA, 96 nt, Homo sapiens
gcgucugggugagaaaaacaggcugugauccagaagaagggaagauagagaaggagggaaaggauguaggcgaaggaggugagagacaggauagga

SEQ ID NO: 152041 - RNA, 67 nt, Homo sapiens
gaggugauaggaauuggaaggagguagaagccgugcagaggaagaggggagagggacgaaggaggag

SEQ ID NO: 152042 - RNA, 51 nt, Homo sapiens
gcggggcugacacugucagccaauccucccaucggggaagagaauccugga

SEQ ID NO: 152043 - RNA, 40 nt, Homo sapiens
cucgaaucuucaaccaguuguguauuggaaacuagggcgc

SEQ ID NO: 152044 - RNA, 49 nt, Homo sapiens
ucaaaugccacauucccaggagggacagacccugaugcucugugaggcg

SEQ ID NO: 152045 - RNA, 23 nt, Homo sapiens
uguggccaagaggaggucuuuca

SEQ ID NO: 152046 - RNA, 22 nt, Homo sapiens
caggcguggcugagggggugcc

SEQ ID NO: 152047 - RNA, 44 nt, Homo sapiens
gcgcacagcaaccucuacauccucacgggccaccagagcaccua

SEQ ID NO: 152048 - RNA, 90 nt, Homo sapiens
ugcaggcccuuuugggcaaaggggcccauccuagaccagaggagcccaggcccuggcccugcuggggcugaaggucagaaguaauccuga

SEQ ID NO: 152049 - RNA, 67 nt, Homo sapiens
gccuccuuguggcggaucuucccggaccucagauucagucuggaaacgggguuuggacugcagagug

SEQ ID NO: 152050 - RNA, 42 nt, Homo sapiens
uaaagagccaauaccuguaauauacaaauacaucuuaaaaac

SEQ ID NO: 152051 - RNA, 48 nt, Homo sapiens
gcuuuguuuuaaaaagcuuuucccucugauccuguaccccuugggaaa

SEQ ID NO: 152052 - RNA, 44 nt, Homo sapiens
ugauuccaggaaugccuacaguuauucccccuggacuuacucga

SEQ ID NO: 152053 - RNA, 105 nt, Homo sapiens
uucaccauaauuuuauauuucucccccuaaaauguggucuuuuacuuuuuauagguacuuucugaaaaaaaaaaaaugacaaaaagugguucugaaaguguguuu

SEQ ID NO: 152054 - RNA, 56 nt, Homo sapiens
cuauccacaguggaauugaaauuaaccucaaaauugcuuuuuuggaaaaaaaaguu

SEQ ID NO: 152055 - RNA, 66 nt, Homo sapiens
agauaugugguuugucauuuaauauuugaauaaauauuucauauaauugaauaagagcugcaggua

SEQ ID NO: 152056 - RNA, 47 nt, Homo sapiens
acaugguuuaugguucuggguaccaaugguaagcaagccuugguggg

SEQ ID NO: 152057 - RNA, 46 nt, Homo sapiens; identical to SEQ ID NO: 64151

SEQ ID NO: 152058 - RNA, 54 nt, Homo sapiens
uacaguccaaagauuuuccccaaagaauagacauuuuuuccucucaucacuucu

SEQ ID NO: 152059 - RNA, 73 nt, Homo sapiens
uccccugagcccaucuacaauagcgaggggaagcggcuuaacacccgagaguuccgcacccgcaaaaagcugg

SEQ ID NO: 152060 - RNA, 49 nt, Homo sapiens
accucaucacagagaugguugcacucaauccggauuucaagccaccugc

SEQ ID NO: 152061 - RNA, 51 nt, Homo sapiens
caacacgugugagugauaaagucaugauuccacaagaugaguacccagaaa

SEQ ID NO: 152062 - RNA, 64 nt, Homo sapiens
agagggaacacccugaagaacauagagaaggagugcaaugccaagauuaugauccgggggaaag

SEQ ID NO: 152063 - RNA, 51 nt, Homo sapiens
ggucugugaaagaagggaagguugggcgcaaagauggccagauguugccag

SEQ ID NO: 152064 - RNA, 45 nt, Homo sapiens
gauaagaaacauccugaagcaggguaucgagacuccagaggacca

SEQ ID NO: 152065 - RNA, 38 nt, Homo sapiens
ccaagaaaacuggaaguuuccauuuuggguauguuuuu

SEQ ID NO: 152066 - RNA, 46 nt, Homo sapiens
gaauauuugucccucauggcugaacugggugaagcaccugucccag

SEQ ID NO: 152067 - RNA, 82 nt, Homo sapiens
ggcuccaccucugggccugccaccacaccccuggccagcgcaccucguccugcugcucccgccaacaacccaccuccaccgg

SEQ ID NO: 152068 - RNA, 43 nt, Homo sapiens
gcccacccuggaugaauucuggcccuucagagagucggcccua

SEQ ID NO: 152069 - RNA, 45 nt, Homo sapiens
ggcaugguggacaucccaugcagcacaaccccaauggacccccac

SEQ ID NO: 152070 - RNA, 48 nt, Homo sapiens
gguggaggggcaucuugaagaggagagcugauguuuggugugguugug

SEQ ID NO: 152071 - RNA, 25 nt, Homo sapiens
ggcauuggugacaaagggcuuacuc

SEQ ID NO: 152072 - RNA, 42 nt, Homo sapiens; identical to SEQ ID NO: 64169

SEQ ID NO: 152073 - RNA, 47 nt, Homo sapiens
auguuuuguuuuaaucccaaaugucugaauguuuugcaguguguagg

SEQ ID NO: 152074 - RNA, 40 nt, Homo sapiens
uuuuuucgguguuagauucaacacugcgcuaaagcgggga

SEQ ID NO: 152075 - RNA, 41 nt, Homo sapiens
ggcgggagcgcacggagguggggucggccaggccggugcgg

SEQ ID NO: 152076 - RNA, 41 nt, Homo sapiens
caagugauucucaaggucacacgaggaagcgguagagccag

SEQ ID NO: 152077 - RNA, 42 nt, Homo sapiens
guagggccgggguaccuuuccguggggcaaggcucugccaaa

SEQ ID NO: 152078 - RNA, 39 nt, Homo sapiens
ccaggcuuugcuuucagccucccucagcaccuaguccuc

SEQ ID NO: 152079 - RNA, 45 nt, Homo sapiens
ggggcacucaguauccuauaccaucugugcuuaauaaaugucugu

SEQ ID NO: 152080 - RNA, 46 nt, Homo sapiens
gggauggccacaucucacaggaagaauuccagaucauccgugggaa

SEQ ID NO: 152081 - RNA, 37 nt, Homo sapiens
uuuauuuccacauuacaaaaauccacgguaaaauaaa

SEQ ID NO: 152082 - RNA, 53 nt, Homo sapiens
cugccgccacugcaaagcccuggugagagucccuuucccggcucacggcccaa

SEQ ID NO: 152083 - RNA, 46 nt, Homo sapiens
cuucucucugccccgcccuggcaggcgaggcuccaggccuccaggu

SEQ ID NO: 152084 - RNA, 43 nt, Homo sapiens
cagaaaguggccaggaagcccuggaccuucugaggcugaggag

SEQ ID NO: 152085 - RNA, 57 nt, Homo sapiens
cacucaacuguccacauuggguggguaccugugugugguguguguguguguggggug

SEQ ID NO: 152086 - RNA, 45 nt, Homo sapiens
cuaguaaguggggcccacaugcacugaaauucaguuuuucuuagg

SEQ ID NO: 152087 - RNA, 50 nt, Homo sapiens
uagaccccccucccguggccacccgaucccccuucgugcccccgcccccu

SEQ ID NO: 152088 - RNA, 42 nt, Homo sapiens
uugcccccuccgccccggcccccaaccugccggcgggcaaaa

SEQ ID NO: 152089 - RNA, 26 nt, Homo sapiens
ccugaucggagacccacgauucucca

SEQ ID NO: 152090 - RNA, 50 nt, Homo sapiens
cacuucuaagcacugaguuaggagugcuaacuccuaaacugggacccccu

SEQ ID NO: 152091 - RNA, 46 nt, Homo sapiens
gagugggguuuggggggcccucucccaggacacugccucuucuggg

SEQ ID NO: 152092 - RNA, 53 nt, Homo sapiens
cccaagggacuguccuuuccucuccuaccccaccccacucccagacagagcag

SEQ ID NO: 152093 - RNA, 46 nt, Homo sapiens
aggggcgcuucucccuugacggggaggccuggcaggguguauccga

SEQ ID NO: 152094 - RNA, 45 nt, Homo sapiens
gagucccggggugcccaugcagacgcccugcuucacgcugcagua

SEQ ID NO: 152095 - RNA, 48 nt, Homo sapiens
aggugauggcuuccggccaggggagggcggagagaaaaggggcaggcg

SEQ ID NO: 152096 - RNA, 42 nt, Homo sapiens
guacuucaaggaggcugaggugcgcguguaugggggugagau

SEQ ID NO: 152097 - RNA, 45 nt, Homo sapiens
gcuguacgccaugaaggugcugcgcaaggcggcgcuggugcagcg

SEQ ID NO: 152098 - RNA, 58 nt, Homo sapiens
ccagccaccauuuugcaccauccucccugccacuaucuccuccuaccugccgccagcc

SEQ ID NO: 152099 - RNA, 66 nt, Homo sapiens
aaaguaccugaagagaucuuggugggaagaagauggaagggaguggcggggccuagagacugaugg

SEQ ID NO: 152100 - RNA, 61 nt, Homo sapiens
agaggauggggcagguguaggggagugggggggcuguguaagugaugcagccuuggaagga

SEQ ID NO: 152101 - RNA, 30 nt, Homo sapiens
ggacucggagggggaagaagaggaagagga

SEQ ID NO: 152102 - RNA, 47 nt, Homo sapiens
aaggccaagggaguccaggugguggccugucugaguguuaaugaugc

SEQ ID NO: 152103 - RNA, 45 nt, Homo sapiens
gccagggaacaaggugaaccuggcagagcuguucaagggcaagaa

SEQ ID NO: 152104 - RNA, 41 nt, Homo sapiens
ggcgaacuugcuggaacuucucguguuugugggagcugagg

SEQ ID NO: 152105 - RNA, 67 nt, Homo sapiens
agccacgggaccccaccccccgcacaugcgagcucagcagauuguggguaagcaguuucaugucgcc

SEQ ID NO: 152106 - RNA, 42 nt, Homo sapiens
ggcacccugcagugcccggaaucuggacguauguuccccauc

SEQ ID NO: 152107 - RNA, 49 nt, Homo sapiens
uucugccguguguauccccaacccuugacccaaugacaccaaacacagu

SEQ ID NO: 152108 - RNA, 55 nt, Homo sapiens
ucuguguuagccuggggaacuuugcaucucuaagggugcugaguguuaaggugga

SEQ ID NO: 152109 - RNA, 46 nt, Homo sapiens
gcuacaaccugacagcacuggccuuggccccccagagccggcugga

SEQ ID NO: 152110 - RNA, 37 nt, Homo sapiens
ggggccuggggcccaggcugccuguguuccccaaggg

SEQ ID NO: 152111 - RNA, 47 nt, Homo sapiens
gcccagggaggagacacccccaaccccuauccggucuguccuggaga

SEQ ID NO: 152112 - RNA, 46 nt, Homo sapiens
ugucccaaggcacgcccggaucuggagucccacgaccccuccccaa

SEQ ID NO: 152113 - RNA, 38 nt, Homo sapiens
ccagagcagccccagcggaagauacuaggcguuugggu

SEQ ID NO: 152114 - RNA, 45 nt, Homo sapiens
cacaucuggggugccacgggcacgucgagcaggggcagggaucag

SEQ ID NO: 152115 - RNA, 56 nt, Homo sapiens
gcuggcugugcccugugggccccaacccagggucagcagugccauucccgccacag

SEQ ID NO: 152116 - RNA, 45 nt, Homo sapiens
uaccgccaggcacuacuauggggcugccgcugcguggagcuggac

SEQ ID NO: 152117 - RNA, 46 nt, Homo sapiens
uccagaaacugcugguugggcucauacuuuucgaugagcagccggg

SEQ ID NO: 152118 - RNA, 45 nt, Homo sapiens
uucugguugaugaaguccaugagcugcuccagcgucagguauggc

SEQ ID NO: 152119 - RNA, 36 nt, Homo sapiens
cuaugcaccuagcaucuucgagcacacaaaggccuc

SEQ ID NO: 152120 - RNA, 41 nt, Homo sapiens
gccggguggaggcccuagggaaggaagggcccagggggcag

SEQ ID NO: 152121 - RNA, 35 nt, Homo sapiens
caaggaguggaggcaaauuuuccagagcugaggga

SEQ ID NO: 152122 - RNA, 38 nt, Homo sapiens
ggagguugaguagagacuucgugucaggggguuugagc

SEQ ID NO: 152123 - RNA, 41 nt, Homo sapiens
cagcuuccuuuugcccucggcccccguggccguggccacgg

SEQ ID NO: 152124 - RNA, 42 nt, Homo sapiens
ugucccuuuacgcaaaguccagacccuaucuggcugcacugc

SEQ ID NO: 152125 - RNA, 41 nt, Homo sapiens
cucucccgguggaguucucggccuacggcguccccaagccc

SEQ ID NO: 152126 - RNA, 25 nt, Homo sapiens
gguacaagaacugugacccccaacc

SEQ ID NO: 152127 - RNA, 38 nt, Homo sapiens
gcccucugagaggcccagguccuagagcagcuucugcc

SEQ ID NO: 152128 - RNA, 52 nt, Homo sapiens
aaggcccgaacugcaagcuggaaaagcuguguccuacauuucuacuccgggc

SEQ ID NO: 152129 - RNA, 42 nt, Homo sapiens
ccuccccagcugacaucacccaucccacuccagccccaggcc

SEQ ID NO: 152130 - RNA, 49 nt, Homo sapiens
cuggagugggaugggugaugucagcuggggagggugcuccgggggcaga

SEQ ID NO: 152131 - RNA, 42 nt, Homo sapiens
ggugggaaggaagagucuucccuagagcuggggucggggcag

SEQ ID NO: 152132 - RNA, 39 nt, Homo sapiens
ccugguccccaguucuguggaccaccauacccagcaccc

SEQ ID NO: 152133 - RNA, 46 nt, Homo sapiens
cugggggagaugucccuggaagaacacagccagugugaaugcaggu

SEQ ID NO: 152134 - RNA, 46 nt, Homo sapiens
ccgcuuuguggagcugagcgaggcauaccgugugcucagccgugag

SEQ ID NO: 152135 - RNA, 17 nt, Homo sapiens
cccuuacugccccugcg

SEQ ID NO: 152136 - RNA, 47 nt, Homo sapiens
ugaggccuucucuccccugcucucccuuccgcuccgugcugcucgcc

SEQ ID NO: 152137 - RNA, 49 nt, Homo sapiens
ucucgucaccuugagugccagcuggaacuccaggaguuugguguagcag

SEQ ID NO: 152138 - RNA, 47 nt, Homo sapiens
uuuacaaggagggaaaugaaaucguugaggcacaugccuucugcucu

SEQ ID NO: 152139 - RNA, 46 nt, Homo sapiens
ugguggagguguugcaaucucuuccuccucauccauacugcccaga

SEQ ID NO: 152140 - RNA, 46 nt, Homo sapiens
ucagcucccgguagguaggaucacugaguaguguccuuguccuggg

SEQ ID NO: 152141 - RNA, 44 nt, Homo sapiens
cucauaagccuucugguagucuccuuucuuggcauaggcagcag

SEQ ID NO: 152142 - RNA, 45 nt, Homo sapiens
cguugaaucgaauccguccgcuccgcguucccaaccgcacgcgcc

SEQ ID NO: 152143 - RNA, 42 nt, Homo sapiens
gcaaagucccuuccccuucugggcuuucauuuccucaucuuu

SEQ ID NO: 152144 - RNA, 59 nt, Homo sapiens
cugaccagccccaccggcccauccuggucauguuacugcauuuguggccggccuccccu

SEQ ID NO: 152145 - RNA, 53 nt, Homo sapiens
cagcaucccccuccccccggacaagcacgggcagagugacagacagggaagcg

SEQ ID NO: 152146 - RNA, 42 nt, Homo sapiens
uuaggagaggcaggaggucagcguggcuaggguccggcgggg

SEQ ID NO: 152147 - RNA, 48 nt, Homo sapiens
gccagggagguugaggcccagaagggaaggaggggcagagacccagac

SEQ ID NO: 152148 - RNA, 46 nt, Homo sapiens
agccgccgggccugucuguccaucacacuaguucggcugcgggucu

SEQ ID NO: 152149 - RNA, 45 nt, Homo sapiens
cucaucaucuuccucuagggcuggggcuggcaauggagccccucu

SEQ ID NO: 152150 - RNA, 41 nt, Homo sapiens
ucagcagcggggguggcugggacagcgaggugggaggugga

SEQ ID NO: 152151 - RNA, 33 nt, Homo sapiens
agaggccaagccccagcagacuaggacacagcc

SEQ ID NO: 152152 - RNA, 51 nt, Homo sapiens
uuuccuaacauaaaaccauccugcaggaggaguagcugaaugacauggugc

SEQ ID NO: 152153 - RNA, 66 nt, Homo sapiens
uauaaacccaaauggagaugaggaaugaggcuggaggaaaagaauuuuaaaugggugcugccuuac

SEQ ID NO: 152154 - RNA, 46 nt, Homo sapiens
gaaggugcccgggucccggaccccgacuggggagggacggccccag

SEQ ID NO: 152155 - RNA, 34 nt, Homo sapiens
aaaaaccauuuuggacccuucugggaaggcaaag

SEQ ID NO: 152156 - RNA, 57 nt, Homo sapiens
uggggagacgagacagaggagggggacagggagggccgagagggcgcguugcgugca

SEQ ID NO: 152157 - RNA, 44 nt, Homo sapiens
cgguucuggguggggacgacgggcuggcugggccacccggucac

SEQ ID NO: 152158 - RNA, 43 nt, Homo sapiens
cgugaccggguggcccagccagcccgucguccccacccagaac

SEQ ID NO: 152159 - RNA, 45 nt, Homo sapiens
gcgggguggggagggcggcaggauggacggggcuggccagaggcg

SEQ ID NO: 152160 - RNA, 83 nt, Homo sapiens
cgcugcccacgacgaguccccggggaacaacgugguggacaucagcgugccgcccaccacggacggacagaagcccaacaagc

SEQ ID NO: 152161 - RNA, 945 nt, Homo sapiens
gagaccucagccuuggauuccacuaacguagaggaagcauucaagaacauccucacagguggccggggaccagauggguguggguagggcaccagccaggcaggguggaacacggccucugaaccuucgcuuguuuuguucguuugcuuguuuuuuucuuuuuuuugucggggcaggauggauuuuugcucuuugcccaggcuggagugugguggcucgaucucagcuuacugcaaccuccgccuuccagguucaggcaauucuccugccucagccucccgaguagcugggauuacaggugccugccaccacacccgcuaauuuuuguaauuuuuaguagagacaggauuucacaauguuguccagguugaucucgaacuccugggcucaagugauccuccugccucagccucccaaagugcugggauuacaggcgugagccacugcaccuggccuguuugauuuuuuuccaccaccaccccuaaccuuugcuuuuuaaaccugccgguccaccuggacacuucacagggucagaccaggucuagcccuugcuggcacuggggacacagagacccccuggccccaguuccuggggaugggcccugccuuaacucuuggcgcugcggggaggcggguagccucagggaccuggagccuuuuggcuucugggaguuuaccucugagggaggagggcgcuucugaucuuagggagcgagaggccggggcuggcugugaccagauguggguccuggcugggugcgcagccccuguccuuguuaccccugaugugaugggggcgcugugggggucuggagagggccucuggaguccugcagggagggguuccccucggcaggcagggcacgugcuggcucaccccacgucccccuguacccccuuugcagagaucuaccgcaucgugucacagaaacagaucgcagaccg

SEQ ID NO: 152162 - RNA, 278 nt, Homo sapiens
ccugcgccaccugcgggcugugcccacugacgaggcccgcgccuucgcaggugagcagacggagacgcaggcaucagagaggugucuggaaggcaggaggccccucacaguguuggggcccuggccacagcccuggcuucccuucccugaggaguggccuugggaugggccaggugggugggcggggucccugagagcaugugggagccugucacccugccuccccacucaccuaggcaguauucuuuguuccagaaaagaacaacuuguccuucauc

SEQ ID NO: 152163 - RNA, 53 nt, Homo sapiens
agugggcgcccugcugguguacgacaucgccaagcaccugaccuaugagaacg

SEQ ID NO: 152164 - RNA, 25 nt, Homo sapiens
gugccugccagcgugcaaggcugca

SEQ ID NO: 152165 - RNA, 40 nt, Homo sapiens
cuuuuaaaaauguauucaacauaccucuuagaaaacuuag

SEQ ID NO: 152166 - RNA, 37 nt, Homo sapiens
aggauuuuuuuuuuuuuuuaagaaaaaccuauagaug

SEQ ID NO: 152167 - RNA, 37 nt, Homo sapiens
auccucauccucugcccucccaggaagucagugauug

SEQ ID NO: 152168 - RNA, 49 nt, Homo sapiens
aaaagguacccuugccuuacuccaucuuauuuucuuagcccccuuugag

SEQ ID NO: 152169 - RNA, 49 nt, Homo sapiens
aucaucugugaguuccuucagguucucacucauagucaugauccuucag

SEQ ID NO: 152170 - RNA, 75 nt, Homo sapiens
uuaacuaucaacuugauaaauaacuuauaggugauagugauaauuccugauuccaagaaugccaucugauaaaaa

SEQ ID NO: 152171 - RNA, 43 nt, Homo sapiens
aagaaucaaauucauaggauaagucaauaccuuaaugguggua

SEQ ID NO: 152172 - RNA, 47 nt, Homo sapiens
caaaaaaaaggcagaauaaguacauggaaaccagaaaugcaacaguu

SEQ ID NO: 152173 - RNA, 46 nt, Homo sapiens
uuggugcuguuuuuaacggaaucacccuucuaauucuugguaaggu

SEQ ID NO: 152174 - RNA, 47 nt, Homo sapiens
uuugaggggguggauuuccuugguuaaggauaaaucuguagcagagc

SEQ ID NO: 152175 - RNA, 46 nt, Homo sapiens
ucugaaauuaaagacauuggaagcaaauacagugaacaaagcaaag

SEQ ID NO: 152176 - RNA, 37 nt, Homo sapiens
uguauaaauuauuuugcuuuuguugauuagcucuauc

SEQ ID NO: 152177 - RNA, 371 nt, Homo sapiens
caucugaaaucuccaucuccauaaaacauauaagcuggcugggugcaguggcucaugccuguaauccuaguacuuugugaggcugaggcgagcagauugcuugagcucaggaguucgagaccagccugcgcaacguggugaaaccagcucucuacuaaaaauacaaaaaauuagccaggugcgguggugcacgccuguaaucccagcuacuucggaggcugagucaggaaaaucgcuucaaucuggggggcggagguugcagugagccgagauugcaccacugcacuccagccugggcaacagaacuagacucugucuaaaaaaaacacacaaaaaacacacaaaaaaacauauaagcugaaccuccccug

SEQ ID NO: 152178 - RNA, 50 nt, Homo sapiens
ugaugaugcuaccuuauuuuucuacaugugggaaagcuugauugauagua

SEQ ID NO: 152179 - RNA, 48 nt, Homo sapiens
cuauuuaauguuuucaugccuuuauaaacuuuuuacuuccagcccaau

SEQ ID NO: 152180 - RNA, 45 nt, Homo sapiens
uaguagacauuuucugagacauaaaauaauccagauuuauuccac

SEQ ID NO: 152181 - RNA, 49 nt, Homo sapiens
cuauuuaauguuuucaugccuuuauaaacuuuuuacuuccagcccaauu

SEQ ID NO: 152182 - RNA, 45 nt, Homo sapiens
ggcaucuggaauaggaaguuacaacccugaacuuugggggcaagc

SEQ ID NO: 152183 - RNA, 47 nt, Homo sapiens
cauaacugcuguaccuauaauaaagaugaucaaauaaacuagcugua

SEQ ID NO: 152184 - RNA, 31 nt, Homo sapiens
auuauuggguuucagguagaugcauguauaa

SEQ ID NO: 152185 - RNA, 47 nt, Homo sapiens
gguuaacaacacuuacauguacacucaaguagaagggagguaaauaa

SEQ ID NO: 152186 - RNA, 50 nt, Homo sapiens
gacugggaggagaauaugugcauuuuaaauuuugauacauguugcugaau

SEQ ID NO: 152187 - RNA, 47 nt, Homo sapiens
aacaacugagcauacaugaaggcucuuugccaggugcuguggaagac

SEQ ID NO: 152188 - RNA, 46 nt, Homo sapiens
acaugaguuugcauuacauuuuccgaauaauauuaaaugccgcggu

SEQ ID NO: 152189 - RNA, 47 nt, Homo sapiens
aggcuccgagguagaaggaggcgugaugagaauagcucagggaagau

SEQ ID NO: 152190 - RNA, 51 nt, Homo sapiens
agcguuuggaaaaugggcaaaggggaaggggaacguaagguugugcaggcg

SEQ ID NO: 152191 - RNA, 32 nt, Homo sapiens
cguagccauggcggagccgucggcggccacuc

SEQ ID NO: 152192 - RNA, 42 nt, Homo sapiens
acuugagcgagccaguugccggauuauucuauuuccccuccc

SEQ ID NO: 152193 - RNA, 44 nt, Homo sapiens
uuccaaggucuaauucugcauacugcaacaacaguuaaugcugu

SEQ ID NO: 152194 - RNA, 46 nt, Homo sapiens
agugcagguuguuuugguucagaaagaucaacauuccuuugagcua

SEQ ID NO: 152195 - RNA, 47 nt, Homo sapiens
ugcaacuuauuuaucugauucccuugugcuaagugcaaagcuagauu

SEQ ID NO: 152196 - RNA, 64 nt, Homo sapiens
uaaucucuuuuguuuguauuuuccuuuuuuuuagguugcaguuguucugauggauacccagggg

SEQ ID NO: 152197 - RNA, 42 nt, Homo sapiens
gagauuggaguuucccuuaugaauauagcuauggacuccaag

SEQ ID NO: 152198 - RNA, 41 nt, Homo sapiens
cuccgaugucaccugcuuucucuuaccacauccaggacucc

SEQ ID NO: 152199 - RNA, 46 nt, Homo sapiens
aguagucuuucuaaagagacucauuaugguucuugguuuacaagag

SEQ ID NO: 152200 - RNA, 46 nt, Homo sapiens
aaguaaaauuaacuuccuaagggaaggcagcaugaugcauggcaga

SEQ ID NO: 152201 - RNA, 45 nt, Homo sapiens
accugaaaagcaguuucaagggaguuuucagagcugaguagggag

SEQ ID NO: 152202 - RNA, 64 nt, Homo sapiens
aaaucaaugaccagugauuucuaauugauuuaaaggaguaguagugugagggcauggcaaaggc

SEQ ID NO: 152203 - RNA, 46 nt, Homo sapiens
acugauaccguauguauuaaacccaucuaaguuaauggaaaaggag

SEQ ID NO: 152204 - RNA, 46 nt, Homo sapiens
ggcauauauuaaaauuuaucaaggagaagaucugccucaccccaag

SEQ ID NO: 152205 - RNA, 48 nt, Homo sapiens
acugcugaagccaacaacuuagcagcugcagccucugccaaggacauu

SEQ ID NO: 152206 - RNA, 81 nt, Homo sapiens
gagaaaccuuauuugucuccagacauucuagaggagaagcacugugaauucaaacaacuugcucuggaccauuuuaagaag

SEQ ID NO: 152207 - RNA, 41 nt, Homo sapiens
uagcacuccucaccuggggcuacaucagguauucuggucaa

SEQ ID NO: 152208 - RNA, 56 nt, Homo sapiens
aaugggcagauauuugugcuucuguuguaaaauaucucaguuuggaagaauuucau

SEQ ID NO: 152209 - RNA, 47 nt, Homo sapiens
uuguuggaagaccauccauggauaaaaaagcucaauagcaucuuaac

SEQ ID NO: 152210 - RNA, 81 nt, Homo sapiens
uacauauguauguauguuuuacacaacucuuguaauugucauuugagggguuuuguuuuugagaguucugcauaagaacag

SEQ ID NO: 152211 - RNA, 42 nt, Homo sapiens
aaacauucagguauauaagccuuaauuucuaagauaauuuaa

SEQ ID NO: 152212 - RNA, 46 nt, Homo sapiens
gguaagaucugaguguaaacuuuacauacaugaaguaugaauggaa

SEQ ID NO: 152213 - RNA, 61 nt, Homo sapiens
uucuggaaaguguuuuauaaaguuuucucagugaggguucuuaagaguuuucuuuggccuc

SEQ ID NO: 152214 - RNA, 42 nt, Homo sapiens
agcuuuuucaauaaaagaugcauuaucauuacuggcuauaaa

SEQ ID NO: 152215 - RNA, 49 nt, Homo sapiens
uuccaaaauuuucuauuaaaauauuucaggauaaauuaaguguugauaa

SEQ ID NO: 152216 - RNA, 48 nt, Homo sapiens
auacaggugaaacauuaagccacaaauaaaaauaaugaacaagaaaga

SEQ ID NO: 152217 - RNA, 433 nt, Homo sapiens
aaggaaguaaguuccacuugagcagaagauaaaguuguagucguggggcaaucugcugccacaaacuggugauacauaccuuuaaaauggcugucuguccaagucaagggaugggguugauagcaucugugucuguuccacaacugccuuugagcuggcccuucagaugccuaugaaugagggugcuuaaaugguguuagagguuaagaccaauggguagucuguauuccuguggucauagcauuaauauuucaguguugcccaugcuaaugugugaauguuggauuuaaagcugacguucuuagagguggggcucugcuuuauuuagccuagugaaucuuaggauuuuucaucggccuucagucacuaacuccaugucuuuauucuuugcagcugacaucauguacacaggcacgcuugacugcuggcggaa

SEQ ID NO: 152218 - RNA, 42 nt, Homo sapiens
gcuuuaacgugucugugcaggguauuaucaucuaccgagccg

SEQ ID NO: 152219 - RNA, 73 nt, Homo sapiens
aucagauuuguagaucuuaaccaggcagucaccgaggccucggaauucccuuucagcuccagcuuuacccaca

SEQ ID NO: 152220 - RNA, 46 nt, Homo sapiens
gaaagggaauuccgaggccucggugacugccugguuaagaucuaca

SEQ ID NO: 152221 - RNA, 46 nt, Homo sapiens
ggguacgggcaaaaucaagaggguacacaaaacacagggauguggc

SEQ ID NO: 152222 - RNA, 45 nt, Homo sapiens
cacccaggcucuuaacuucgccuucaaagauaaauacaagcagau

SEQ ID NO: 152223 - RNA, 41 nt, Homo sapiens
gcuccaguuucaggcguuccagcucaagaggggagcccucc

SEQ ID NO: 152224 - RNA, 50 nt, Homo sapiens
cuggcgcuggcaggcaggucggaggccugcaguccagccgagaggcccac

SEQ ID NO: 152225 - RNA, 45 nt, Homo sapiens
accuucacagucauguuggcacuuacagccccugggaugucaggg

SEQ ID NO: 152226 - RNA, 29 nt, Homo sapiens
gcugaaaacaggggucccuggcaggguga

SEQ ID NO: 152227 - RNA, 42 nt, Homo sapiens
aauguggaaagggaacucaccuucagauucucuaugucccga

SEQ ID NO: 152228 - RNA, 42 nt, Homo sapiens
gaggaggcagugagcgcccuguguuggggcaccggcggcgag

SEQ ID NO: 152229 - RNA, 41 nt, Homo sapiens
cucgccaucuugcccuucuuugccgcagaugcuggugggcu

SEQ ID NO: 152230 - RNA, 44 nt, Homo sapiens
cucggugcugaagugcuucaccguccuguccgcgcagcccacca

SEQ ID NO: 152231 - RNA, 60 nt, Homo sapiens
auuuugacugguggagaaggggauaaggguauucuagaaagaggguacugccugggagag

SEQ ID NO: 152232 - RNA, 46 nt, Homo sapiens
aggacacauccucugacccagugaggcuccccugcccugaugguug

SEQ ID NO: 152233 - RNA, 46 nt, Homo sapiens
ccaccuguggcaaccacaugggggugugcugggucuuggcgcaucc

SEQ ID NO: 152234 - RNA, 46 nt, Homo sapiens
agauaugggaccugcagggcucugaggaaccuguguucagggccaa

SEQ ID NO: 152235 - RNA, 46 nt, Homo sapiens
cucuagguccguguuuaugauccagcauccccccagcgccggccag

SEQ ID NO: 152236 - RNA, 46 nt, Homo sapiens
gagugagggucauggcuguuaguggguacucuccauagguggucuc

SEQ ID NO: 152237 - RNA, 62 nt, Homo sapiens
ugggaaacacucaugggcagcuggcagaaauugaccuucggcaaggugaguggacuagggua

SEQ ID NO: 152238 - RNA, 46 nt, Homo sapiens
acugggcugucugaaggggcuggcaggcagugugcguggguugcag

SEQ ID NO: 152239 - RNA, 46 nt, Homo sapiens
uugcagguuuaucucaagucucaauugaacugccuccucuugucag

SEQ ID NO: 152240 - RNA, 45 nt, Homo sapiens
ugucccugccugacaagaggaggcaguucaauugagacuugagau

SEQ ID NO: 152241 - RNA, 46 nt, Homo sapiens
cccugacuccuaagcuuucuucccacucaccaggaugagccccaag

SEQ ID NO: 152242 - RNA, 46 nt, Homo sapiens
auccuuggaggcagcugccaagcggaagcucucggguuuggagcag

SEQ ID NO: 152243 - RNA, 44 nt, Homo sapiens
ggucggguuucggcggcuucagugcucggggaggaggcagugac

SEQ ID NO: 152244 - RNA, 59 nt, Homo sapiens
ccugccggcccggcuccgggugagcgaauuccuugccguccaaucaggaaagccucugu

SEQ ID NO: 152245 - RNA, 36 nt, Homo sapiens
cccccuccgcccaccgaagugugucagucuuuggag

SEQ ID NO: 152246 - RNA, 44 nt, Homo sapiens
cccggggcaguuacacgggccgggccggagucucaggaccacgg

SEQ ID NO: 152247 - RNA, 46 nt, Homo sapiens
cgcgaaaguccacgagaagugcagaaggggcucggggauuuguuga

SEQ ID NO: 152248 - RNA, 34 nt, Homo sapiens
ucccucccccucccgacaccauguccugccggga

SEQ ID NO: 152249 - RNA, 47 nt, Homo sapiens
agcuuugcgugcuguccgacaacgcagugaauucacccucauggcca

SEQ ID NO: 152250 - RNA, 46 nt, Homo sapiens
gcauugggaaagaccuuagcaacacauuugccaagcuggagaagcu

SEQ ID NO: 152251 - RNA, 47 nt, Homo sapiens
uggcaaagcgcaagucccucuuugaugauaaagcaguggaaauugaa

SEQ ID NO: 152252 - RNA, 37 nt, Homo sapiens
aggaauuguguguaugaaaauaguucuguugaugccu

SEQ ID NO: 152253 - RNA, 46 nt, Homo sapiens
uaccaggacaucaauagccucaacaaacaaauugcucagcuccagg

SEQ ID NO: 152254 - RNA, 41 nt, Homo sapiens
cacccuguuccucggcggccuugucacccggcaccucggau

SEQ ID NO: 152255 - RNA, 46 nt, Homo sapiens
gcagacuuuucccuuugucacuccguaaguacuccuugccccagac

SEQ ID NO: 152256 - RNA, 45 nt, Homo sapiens
auagucuccccuguaucgaucauagaaauuacgguaacccugaga

SEQ ID NO: 152257 - RNA, 44 nt, Homo sapiens
caguucuuuuccugucugacuguaggguauagaacaggcagccc

SEQ ID NO: 152258 - RNA, 44 nt, Homo sapiens
ggaggguaaagccauuugaagaauaaagucauccagagccucag

SEQ ID NO: 152259 - RNA, 114 nt, Homo sapiens
ucccuucucacaacuccucccuuuucccucuccugggcccuuccuuaggucaguaauuguugugagccccuuaggcuccuugcaucccaucccuaacccuugccugaccaugug

SEQ ID NO: 152260 - RNA, 46 nt, Homo sapiens
agaccccggugaacagcacuaugaguauugggcaagcacgcaagau

SEQ ID NO: 152261 - RNA, 48 nt, Homo sapiens
cagaagguuuugguacccuccacugacccuacacccagggcugcuacu

SEQ ID NO: 152262 - RNA, 27 nt, Homo sapiens
gcgauccagacgcugauaccuguggcg

SEQ ID NO: 152263 - RNA, 44 nt, Homo sapiens
cgaccugcaaagagaagcggugucggggccagaugcccccccac

SEQ ID NO: 152264 - RNA, 27 nt, Homo sapiens
uugggacggcagcgaggcugcgcagaa

SEQ ID NO: 152265 - RNA, 69 nt, Homo sapiens
aggaaaacccgcugccuccagggagggcuggacggcgagcugggagccagccccaggcuccagggccac

SEQ ID NO: 152266 - RNA, 56 nt, Homo sapiens
uggcugaggucugggaaggaauagaaaggggcccccaauuuuuuuuuaagcggcca

SEQ ID NO: 152267 - RNA, 44 nt, Homo sapiens
ggggaccuggugugugacgagaaggagggcgggaagggucagcg

SEQ ID NO: 152268 - RNA, 45 nt, Homo sapiens
guccaucgcagccucgaugcccugguucccugugagggccagagc

SEQ ID NO: 152269 - RNA, 55 nt, Homo sapiens
cucugaggaagugggcucccgucccaggauauguccaaggggagucucuaaaggc

SEQ ID NO: 152270 - RNA, 45 nt, Homo sapiens
uuuccucuucacucaaagcggguuugccuucuccggcagcagaac

SEQ ID NO: 152271 - RNA, 52 nt, Homo sapiens
agcagcccggcgcaucucaucuuccuguagccgcugucgugcugcugacaac

SEQ ID NO: 152272 - RNA, 45 nt, Homo sapiens
acaggaccuggcucuggugccacuggggguggcugagagcccaca

SEQ ID NO: 152273 - RNA, 68 nt, Homo sapiens
cggagaguccggaccgagauaccaugccaggacucuccgggguccugugagcugccgucgggugagca

SEQ ID NO: 152274 - RNA, 58 nt, Homo sapiens
aacguggccuggaggaagaacuggaugguuggcggcgaaggcggcgccggcgggaggu

SEQ ID NO: 152275 - RNA, 46 nt, Homo sapiens
uuaucgugaccccgggagagcggcggaagcaggaaaugcuaaaggu

SEQ ID NO: 152276 - RNA, 49 nt, Homo sapiens
auuguaagaggauggguauaaggagcuucauaaaccuggaugagauauu

SEQ ID NO: 152277 - RNA, 42 nt, Homo sapiens
ggcuguggcuucuucaggcucuuuccaacuacugcuggacaa

SEQ ID NO: 152278 - RNA, 89 nt, Homo sapiens
gcugauaguugccuggcggaccgcugucucugggaucggcugcaugcccagccucguuugggcacuguccccaccuucgacugguucuu

SEQ ID NO: 152279 - RNA, 72 nt, Homo sapiens
guaagugugguuuuagcuguaguagccagauugggcggccgggaguggugggggugccggguggaaggcucu

SEQ ID NO: 152280 - RNA, 46 nt, Homo sapiens
cgagauaaaagggcucaggaacgcuugaggaaacaaagucgcggcc

SEQ ID NO: 152281 - RNA, 36 nt, Homo sapiens
agaaaaaugaagaaaacacuaggcacugugguuuaa

SEQ ID NO: 152282 - RNA, 41 nt, Homo sapiens
aacccuauauucaccaagaaaacaauggaagaaagggaaaa

SEQ ID NO: 152283 - RNA, 54 nt, Homo sapiens
uuaggggucugccuggggauuacccuugcuguggauagaagcaacuuuaagacc

SEQ ID NO: 152284 - RNA, 85 nt, Homo sapiens
ugccuaaggacacugcaggugauagacugacuuagggacauugcagguggccuuuaccuuacuucccaacccuucacuuggcagg

SEQ ID NO: 152285 - RNA, 42 nt, Homo sapiens
ccucauggaucagauggaccgugagggaaucaggaccaagcu

SEQ ID NO: 152286 - RNA, 55 nt, Homo sapiens
uccugauucccucacgguccaucugauccaugaggucaccaaggucaggagagac

SEQ ID NO: 152287 - RNA, 68 nt, Homo sapiens
ggugcuagagcuucaggggcuucaaaagaacaugacucgguucaggauugaugagcuggagccucggc

SEQ ID NO: 152288 - RNA, 111 nt, Homo sapiens
cuuucugucucuggucgugaugagaacaguguggaguuaaccauggcugagggacccuacaagaucaucuugacagcacggccauuccgccuugaccuacuagaggaccga

SEQ ID NO: 152289 - RNA, 42 nt, Homo sapiens
ucagccaugguuaacuccacacuguucucaucacgaccagag

SEQ ID NO: 152290 - RNA, 52 nt, Homo sapiens
uuuugcuuagugucaaugcccgaggacucuuggaguuugagcaucagagggc

SEQ ID NO: 152291 - RNA, 45 nt, Homo sapiens
gggaaccuagugugaaagagcauagggguguugugaggucuggca

SEQ ID NO: 152292 - RNA, 42 nt, Homo sapiens
ucucccagcccccaggcccuaccuggcugucccaccaccguc

SEQ ID NO: 152293 - RNA, 43 nt, Homo sapiens
gguaggaaccagacccgggugcgguuuuuuccauuuccuguac

SEQ ID NO: 152294 - RNA, 48 nt, Homo sapiens
gggucugugucuccuucuuccccuucucacaucaucacauuucccaga

SEQ ID NO: 152295 - RNA, 37 nt, Homo sapiens
accaagcgugagauuaaccuuauccgagaaacugggg

SEQ ID NO: 152296 - RNA, 63 nt, Homo sapiens
ccuccugccccaguuucucggauaagguuaaucucacgcuugguagcauaugggauaagauca

SEQ ID NO: 152297 - RNA, 45 nt, Homo sapiens
acucaggggaaggcagagaaagaugagccaggagccugggaggag

SEQ ID NO: 152298 - RNA, 44 nt, Homo sapiens
aagcagaagcucugaagcuuguuuguuuuucuuccaggccccau

SEQ ID NO: 152299 - RNA, 45 nt, Homo sapiens
gcauggagcaugucuaugggaucccugagcaugcagacaaccuga

SEQ ID NO: 152300 - RNA, 64 nt, Homo sapiens
ugucagagacuggcaucauugacgucuuccugcugcuggggcccuccaucucugauguuuuccg

SEQ ID NO: 152301 - RNA, 59 nt, Homo sapiens
cacaaccugcccugugaugucaucuggcuagacauugaacaugcugauggcaagcggua

SEQ ID NO: 152302 - RNA, 46 nt, Homo sapiens
agcacauggcgacugcugaugggcugagacagcgcucugggggcau

SEQ ID NO: 152303 - RNA, 29 nt, Homo sapiens
aagaaggcccuggccaggacaaaggggcg

SEQ ID NO: 152304 - RNA, 46 nt, Homo sapiens
cgagagccauggcuguuaccaucucagcacaaugauauaauccgag

SEQ ID NO: 152305 - RNA, 88 nt, Homo sapiens
cugugggugcaguacccucaggaugugacuaccuucaauauagaugaucaguacuugcuuggugagaaaugaggauaguugguggugg

SEQ ID NO: 152306 - RNA, 59 nt, Homo sapiens
ccuuggccaggcagauagaccuggacaccaugggcuccagagucugauacagggugaac

SEQ ID NO: 152307 - RNA, 49 nt, Homo sapiens
ugacauucaaagcuaccagaagcaucaugguccccagacccuguaccug

SEQ ID NO: 152308 - RNA, 50 nt, Homo sapiens
uccugcgcaagccuggcaucaauguggcaucugauuggaguauucaccug

SEQ ID NO: 152309 - RNA, 43 nt, Homo sapiens
acccagaacaucccuuggguuaucgcaggugaauacuccaauc

SEQ ID NO: 152310 - RNA, 46 nt, Homo sapiens
agcccucucauccugcccaaauguuggcagaaucugggucuuagac

SEQ ID NO: 152311 - RNA, 48 nt, Homo sapiens
gaugagagggcugacccugggcuccaaauuccucuugugaucuccuca

SEQ ID NO: 152312 - RNA, 41 nt, Homo sapiens
ggcaugaauggauagacucugggggaguucagggcuccuaa

SEQ ID NO: 152313 - RNA, 38 nt, Homo sapiens
uccuuuuccccuucccucccaccagauugcucucccac

SEQ ID NO: 152314 - RNA, 46 nt, Homo sapiens
uccacaccucuuaggggaugcgcauuaaacuucuuuugcccccuuc

SEQ ID NO: 152315 - RNA, 132 nt, Homo sapiens
gguuucagugaaucauggucaccuguauuuauugcuaggagaagccugaggguggggggagaugaucaugugugcucgggguuggcuggaagcccugggugggggguugggggaggacuaauggggagucgg

SEQ ID NO: 152316 - RNA, 44 nt, Homo sapiens
acuuccucuugguucccagcugugacacguuuugaucaaaggag

SEQ ID NO: 152317 - RNA, 46 nt, Homo sapiens
gguuuuguguagggggggcuguuagagguguuguuagauaaggaag

SEQ ID NO: 152318 - RNA, 45 nt, Homo sapiens
accuucggccgauccggagaacaaggcccacugcucggcucaggu

SEQ ID NO: 152319 - RNA, 61 nt, Homo sapiens
ucgcucuccgaccugagccgagcagugggccuuguucuccggaucggccgaagguguuccg

SEQ ID NO: 152320 - RNA, 45 nt, Homo sapiens
gguagcuggagccuggcucuggccuggcaggagccgagcucguuc

SEQ ID NO: 152321 - RNA, 44 nt, Homo sapiens
cggcggcgggaacggccauggcggccaacauguaccggguggga

SEQ ID NO: 152322 - RNA, 46 nt, Homo sapiens
ucggcgcugccgcaaaguaagccgcccgggagagaagggaggggga

SEQ ID NO: 152323 - RNA, 47 nt, Homo sapiens
cccuaggaacccuacucuccagcaguacagucuguagacccccgaau

SEQ ID NO: 152324 - RNA, 46 nt, Homo sapiens
cggaaucagcaaagcucacccacugcaccaccugggcugcugccuc

SEQ ID NO: 152325 - RNA, 46 nt, Homo sapiens
uuguuguggugcaugaugcccaagguggggaacacccagguacugg

SEQ ID NO: 152326 - RNA, 73 nt, Homo sapiens
gugaugucagccaaugucacucguucgcccaccagaaaaguccucgucuucaaguaagcauccagcagcccca

SEQ ID NO: 152327 - RNA, 46 nt, Homo sapiens
uuuugcuaugaucacauuacuauucuggaccagcaucaguccaaga

SEQ ID NO: 152328 - RNA, 43 nt, Homo sapiens
caaagaccagaagaggaaaaaaaaucuugucauggaaacagaa

SEQ ID NO: 152329 - RNA, 42 nt, Homo sapiens
agcgguugguauugggaaaggccuggcggaaagaaggcucua

SEQ ID NO: 152330 - RNA, 59 nt, Homo sapiens
auuagcuaccacauugacacccuacauucugcagguccccauaacccaaaagcaagaca

SEQ ID NO: 152331 - RNA, 42 nt, Homo sapiens
aacccuucucuuuccgugguguguccuuuuuagguugggucu

SEQ ID NO: 152332 - RNA, 44 nt, Homo sapiens; identical to SEQ ID NO: 146280

SEQ ID NO: 152333 - RNA, 54 nt, Homo sapiens
auguaagcagugaacauucucaaagggccuccaccccaaaucuuacacccaugu

SEQ ID NO: 152334 - RNA, 35 nt, Homo sapiens
gcuguagccgaggccccacaacaagguggggaacg

SEQ ID NO: 152335 - RNA, 28 nt, Homo sapiens
cacccaccccccaccgcguggauagugg

SEQ ID NO: 152336 - RNA, 48 nt, Homo sapiens
agguugcaucuguccugggccucaaaagggacuucugcccugggacuc

SEQ ID NO: 152337 - RNA, 61 nt, Homo sapiens
cucugagggagguggaacacugacauuccugcuuggaggcagacucugaggaggcucccac

SEQ ID NO: 152338 - RNA, 42 nt, Homo sapiens
ccuagguugugaccgagauucccgacgagagagacugagggg

SEQ ID NO: 152339 - RNA, 41 nt, Homo sapiens; identical to SEQ ID NO: 64546

SEQ ID NO: 152340 - RNA, 42 nt, Homo sapiens
accaucuacuuugacaaccugcagucgggugaggugacccag

SEQ ID NO: 152341 - RNA, 46 nt, Homo sapiens
gcagagcggggaugaugaggaguaccagcgcaucuacaccacgaag

SEQ ID NO: 152342 - RNA, 57 nt, Homo sapiens
aucaagccacggcugaagucggaagauggaguggaaggagaccucggggagacccag

SEQ ID NO: 152343 - RNA, 46 nt, Homo sapiens
ugaaaucuccaauguggauguggagacccagucugggaagaccgug

SEQ ID NO: 152344 - RNA, 41 nt, Homo sapiens
ugcuggccacucgaagcuccaggucaccaugccugggauaa

SEQ ID NO: 152345 - RNA, 45 nt, Homo sapiens
cuuggggguagggcaguagagguacagggcccaucucuggagagu

SEQ ID NO: 152346 - RNA, 42 nt, Homo sapiens
cacuugagggugaccuaggccugaaaggugccaagccacagg

SEQ ID NO: 152347 - RNA, 46 nt, Homo sapiens
ccucugcuccccaaauuggggguagcaucacuggccccagugugga

SEQ ID NO: 152348 - RNA, 51 nt, Homo sapiens
cucuggggaugucagccugccugagauugcuacuggugggcuggaaggaaa

SEQ ID NO: 152349 - RNA, 56 nt, Homo sapiens
cugcuccuggggugcaaggugauguuaaaggcccucaaguggcacuuaaaggcucc

SEQ ID NO: 152350 - RNA, 89 nt, Homo sapiens
cgcaccuaaagugaaaggggguguagaugucacacuccccagaguagaagggaaagucaaagucccugaaguugaugucagaggcccca

SEQ ID NO: 152351 - RNA, 98 nt, Homo sapiens
aaguggaugucagugccccagaugucgaagcgcauggcccagaauggaaccugaaaaugcccaagaugaaaaugcccacguucagcacuccaggagcc

SEQ ID NO: 152352 - RNA, 72 nt, Homo sapiens
auaugagugucaagacaccaaagaucuccaugccugauguagauuugcacgugaaagguacaaaggugaagg

SEQ ID NO: 152353 - RNA, 106 nt, Homo sapiens
gacauugaugccccagauguggauguucauggcccagacuggcacuugaagaugcccaagaugaaaaugcccaaauucagugugccaggguucaaagcagagggcc

SEQ ID NO: 152354 - RNA, 60 nt, Homo sapiens
gauguggacauuuccgggcccaagauagauguuacugcuccugaugugagcauugaggaa

SEQ ID NO: 152355 - RNA, 58 nt, Homo sapiens
cuccaugccugauguggacuuacaucugaaaggcccuaacguaaagggagaauaugau

SEQ ID NO: 152356 - RNA, 45 nt, Homo sapiens
gauguggagguucaaggcccagacuggcaccugaagaugcccaag

SEQ ID NO: 152357 - RNA, 79 nt, Homo sapiens
ccugaaggaaagcugaagggccccaaguucaagaugccagagaugaauaucaaggcccccaagaucuccaugccugaug

SEQ ID NO: 152358 - RNA, 86 nt, Homo sapiens
uggacuugcauaugaaagguccuaaaguaaagggagaauaugauaugacagugccaaagcuggaaggggaccugaaaggcccaaaa

SEQ ID NO: 152359 - RNA, 74 nt, Homo sapiens
uuucugcaccaaaaguagauacuaaugcuccagaucugagccuugaaggaccugaagggaaguugaaaggcccg

SEQ ID NO: 152360 - RNA, 46 nt, Homo sapiens
aagaugucuuugccagauguugaccuggaucuuaaaggacccaaaa

SEQ ID NO: 152361 - RNA, 47 nt, Homo sapiens
cagauguggacaucagaggucccaagguagauauuaaagcaccagau

SEQ ID NO: 152362 - RNA, 46 nt, Homo sapiens
cccaagguggacaucgaagccccagaugugagccucgaagguccag

SEQ ID NO: 152363 - RNA, 62 nt, Homo sapiens
gucaaaggggauguggaugugucugugcccaagguagaaggugaaaugaaagugccagaugu

SEQ ID NO: 152364 - RNA, 71 nt, Homo sapiens
aaaguggacaucaaugccccagauguggauguucaugguccagacuggcaucugaagaugcccaaagugaa

SEQ ID NO: 152365 - RNA, 48 nt, Homo sapiens
gguccagaagggaaguugaagggccccaaguuuaagaugccugagaug

SEQ ID NO: 152366 - RNA, 94 nt, Homo sapiens
auguggagguucaaggcccagacuggcaccugaagaugcccaagaugaaaaugcccaaguuuagcaugccuggcuucaaaggagagggccgaga

SEQ ID NO: 152367 - RNA, 42 nt, Homo sapiens
auguugaagucccagaugugagccuugagggcccggaaggaa

SEQ ID NO: 152368 - RNA, 63 nt, Homo sapiens
ugccugauguggaccugaaucuuaaggggccaaaauugaagggagauguggauguguccuugc

SEQ ID NO: 152369 - RNA, 50 nt, Homo sapiens
ggcuucaaaggagagggcccugaaguggaugugaagcugcccaaagcuga

SEQ ID NO: 152370 - RNA, 95 nt, Homo sapiens
uaaaaggucccaaauucaagaugccagaaaugaguauaaagccucagaagauauccauaccagauguugguuugcauuugaaagguccuaaaaug

SEQ ID NO: 152371 - RNA, 54 nt, Homo sapiens
agcuccugauguugacaucaaaggccccaaaguugauauuaaugcaccagaugu

SEQ ID NO: 152372 - RNA, 46 nt, Homo sapiens
acccaagguggacauugauguuccagaugugaaucuugaagcucca

SEQ ID NO: 152373 - RNA, 69 nt, Homo sapiens
guuggacuuaauuugaaagccccuaaacugaaaacugauguagauguuucccuucccaaaguggaagga

SEQ ID NO: 152374 - RNA, 47 nt, Homo sapiens
gaaaggccccaaagucaaaggggauauggaugugucugugcccaagg

SEQ ID NO: 152375 - RNA, 65 nt, Homo sapiens
uugacauuaaagggcccaaaguggacauugaugccccagauguggagguucacgacccagauugg

SEQ ID NO: 152376 - RNA, 64 nt, Homo sapiens
cugacauugaugugucuggacccaguguggacacugaugcuccugauuuggauauugagggacc

SEQ ID NO: 152377 - RNA, 47 nt, Homo sapiens
cagagggccgcaaguugaugucaaagguccuuuuguggaagcggagg

SEQ ID NO: 152378 - RNA, 61 nt, Homo sapiens
caaagucaaaggggaugcggaugugucggugccaaaauuggagggagauuuaacaggcccc

SEQ ID NO: 152379 - RNA, 64 nt, Homo sapiens
ccccaaagucaaaggggauguggaugugucggugccaaaauuggagggagauuuaacagguccc

SEQ ID NO: 152380 - RNA, 59 nt, Homo sapiens
ccccaaagucaaaggggauguggaugugucuuugccaaaauuggagggagauuuaacag

SEQ ID NO: 152381 - RNA, 76 nt, Homo sapiens
gaaaggccccaaagucaaaggggauauggaugugucuguucccaagguagaaggugaaaugaaagugccagauguu

SEQ ID NO: 152382 - RNA, 62 nt, Homo sapiens
aaaguggacauugaugccccagauguggauguucauggcccagacuggcaccugaagaugcc

SEQ ID NO: 152383 - RNA, 65 nt, Homo sapiens
gguggauguugaagucccagaugugagccuugaagguccagaagggaagcugaagggccccaagu

SEQ ID NO: 152384 - RNA, 53 nt, Homo sapiens
uaaagggacccaaaaucaaaggagauguugauguuucugccccaaagcuggag

SEQ ID NO: 152385 - RNA, 70 nt, Homo sapiens
gaaguagcuguggaaggcccaaauggcaaguggaaaacuccuaaguucaagaugccagauaugcacuuua

SEQ ID NO: 152386 - RNA, 141 nt, Homo sapiens
aagcucccaaaaucucuaugccagaccucgaucuacacuugaagagccccaaggcaaaaggagagguggauguagauguucccaaauuggaaggggaccuuaaagggccacauguggaugucagugggccagacauugaca

SEQ ID NO: 152387 - RNA, 48 nt, Homo sapiens
augccugacuuugauuugcaucugaaaggucccaaggugaagggcgau

SEQ ID NO: 152388 - RNA, 147 nt, Homo sapiens
gguguucaaggcccagacuggcaccugaagaugcccaaggugaaaaugccaaaguucagcaugccuggcuucaaaggagagggcccagauggggaugugaagcugcccaaggcugacauugaugucucaggacccaaaguggacauu

SEQ ID NO: 152389 - RNA, 173 nt, Homo sapiens
gaaggcccugauguuaacauugaaggaccagagggaaaguugaaagggccuaaguucaagaugccagagaugaauaucaaagcccccaagaucuccaugccugauauugacuuaaaccugaaaggacccaaagugaagggugauguggauguuucccuuccuaaaguggaagg

SEQ ID NO: 152390 - RNA, 58 nt, Homo sapiens
cgcaccugauguugauguucauggcccagacuggcaccuaaagaugcccaagauaaaa

SEQ ID NO: 152391 - RNA, 526 nt, Homo sapiens
aggaccugaaggaaaguggaaaaguccaaaguuuaagaugccagagaugcauuuuaagacuccaaagauauccaugccagauauugaccugaaucucacagguccaaaaauaaaaggagauguggauguuacaggcccuaagguagagggagaucugaaagguccugaaguugaccucaaaggccccaaaguggacauugaugucccagauguuaauguucaggguccagacuggcaccugaagaugcccaagaugaaaaugcccaaguucagcaugccuggcuucaaagcagagggcccugaaguggaugugaaccugcccaaggcugacguugaugucucaggccccaaaguggacguugaaggcccugauguuaacauugaaggaccagagggaaaguugaaagggcccaaguucaagaugccagagaugaauaucaaagcccccaagauccccaugccugacuuugauuugcaucugaaaggucccaaggugaagggcgauguggauauuucucugcccaaa

SEQ ID NO: 152392 - RNA, 168 nt, Homo sapiens
guggaaggugaccucaagggcccugaaguugacaucagggguccccaaguggacauugaugucccggaugugggcguucaaggcccagacuggcaccuaaaaaugcccaaagugaaaaugcccaaauucagcaugccuggcuucaaaggagagggcccagauguggau

SEQ ID NO: 152393 - RNA, 85 nt, Homo sapiens
gcccagagggaaaguugaaaggucccaaauucaaaaugccugagaugaacaucaaagcccccaagaucuccaugccugacauuga

SEQ ID NO: 152394 - RNA, 116 nt, Homo sapiens
ucuuaaccugaaaggucccaaagugaagggugacauggaugugucucugccaaaaguggaaggugacaugaaaguuccugacguggauauuaaaggccccaaaguggauauuaaug

SEQ ID NO: 152395 - RNA, 89 nt, Homo sapiens
ccccagauguggauguucaaggcccagacuggcaccugaagaugccuaaaauaaaaaugcccaagaucagcaugccuggcuucaaagga

SEQ ID NO: 152396 - RNA, 84 nt, Homo sapiens
auucaagaugccagagaugaacaucaaagcuccuaaaauaucaaugccugauuuggaccucaaucuuaaaggcccuaaaaugaa

SEQ ID NO: 152397 - RNA, 46 nt, Homo sapiens
ccugcucuugacauaaaaggcccaaagauagauguagaugcuccag

SEQ ID NO: 152398 - RNA, 45 nt, Homo sapiens
gguccaaaacugaagaugccugacaugcauguaaacaugcccaag

SEQ ID NO: 152399 - RNA, 42 nt, Homo sapiens
aagggagauguugaugucucugggcccaaguuggaaggugac

SEQ ID NO: 152400 - RNA, 46 nt, Homo sapiens
ucuaaaguucagacaccugaaguggaugucaaagguaaaaagccag

SEQ ID NO: 152401 - RNA, 45 nt, Homo sapiens
ugaaaagucccaaagucaaaggagacuuagauauugcagguccca

SEQ ID NO: 152402 - RNA, 56 nt, Homo sapiens
aaguggauauuaaggcaccagaagucaaucuuaaugcaccugauguggauguucau

SEQ ID NO: 152403 - RNA, 45 nt, Homo sapiens
uagcuguggaucuaccaaaaggagacaucaacauagagggcccaa

SEQ ID NO: 152404 - RNA, 82 nt, Homo sapiens
gucccaaauucaagaugccugacaugaauaucaaagcucccaagaucuccaugccugacauugacuuaaacuugaaaggccc

SEQ ID NO: 152405 - RNA, 75 nt, Homo sapiens
uggacaucaaugccccagauguggauguucaugguccagacuggcaucugaagaugcccaaagugaaaaugccca

SEQ ID NO: 152406 - RNA, 136 nt, Homo sapiens
augcaaagcugaagggccccaaguucaagaugccugagaugaacaucaaagcccccaagaucuccaugccugacuuugaccugaacuugaagggacccaaaaugaagggugaugugguugugucuuugcccaaagu

SEQ ID NO: 152407 - RNA, 53 nt, Homo sapiens
agauguggauguucgaggcccagacuggcaccugaagaugccuaagauaaaaa

SEQ ID NO: 152408 - RNA, 84 nt, Homo sapiens
uuaacaucgaaggcucagaggguaaauucaagggacccaaauuuaagauaccagagaugcaccugaaggcucccaaaauaucga

SEQ ID NO: 152409 - RNA, 111 nt, Homo sapiens
ugccugacauugauuuaaaccugaagggccccaaagucaagggcgauguggauguuucucugcccaaaauggaaggugaccucaaggguccugaaguugacaucaagggcc

SEQ ID NO: 152410 - RNA, 58 nt, Homo sapiens
ugcuccagauguugauguucaaggcccagacuggcaccugaagaugcccaaggugaaa

SEQ ID NO: 152411 - RNA, 141 nt, Homo sapiens
ggcccagagggaaaguugaaaggucccaaauucaagaugccugagaugaacaucaaagcccccaagaucuccaugccugacauugaucuuaaccugaaaggacccaaagugaagggugauauggaugugucucugccaaaa

SEQ ID NO: 152412 - RNA, 175 nt, Homo sapiens
guggaaggugacaugcaaguuccugacuuggauauuaaaggccccaaaguggauauuaaugccccagauguggauguucgaggcccagacuggcaccugaagaugccuaagauaaaaaugcccaagaucagcaugccuggcuucaaaggagaagguccagaaguggaugugaacc

SEQ ID NO: 152413 - RNA, 77 nt, Homo sapiens
agguccagaugcgaaacugaagggcccuaaauucaagaugccagagaugaacaucaaagcccccaagaucuccaugc

SEQ ID NO: 152414 - RNA, 78 nt, Homo sapiens
cugacuuugauuugcaucugaaaggcccuaaggugaaaggagauguggauguuucucugccuaagauggaaggugauc

SEQ ID NO: 152415 - RNA, 101 nt, Homo sapiens
aguggacauugaugccccagauguggauguucauggcccagacuggcaccugaagaugcccaaggugaaaaugcccaaauucagcaugccaggauuuaaag

SEQ ID NO: 152416 - RNA, 50 nt, Homo sapiens
augguccagaagggaaacugaagggccccaaauuuaaaaugccugaccug

SEQ ID NO: 152417 - RNA, 49 nt, Homo sapiens
gcccugaaguugacaucaagggccccaaaguggacauugaugucccaga

SEQ ID NO: 152418 - RNA, 58 nt, Homo sapiens
agguggacauugauguuccugaugugaauaucgaagguccagaugcgaaacuaaaggg

SEQ ID NO: 152419 - RNA, 64 nt, Homo sapiens
cagaaguugacaucaagggccccaaaguggacaucgaugccccugauguagauguucauggccc

SEQ ID NO: 152420 - RNA, 71 nt, Homo sapiens
agacuggcaccugaagaugcccaaggugaaaaugcccaaauucagcaugccaggauucaaaggagagggcc

SEQ ID NO: 152421 - RNA, 57 nt, Homo sapiens
guccagaugcaaaacucaaggguccaaaguucaagaugccagagaugaacaucaagg

SEQ ID NO: 152422 - RNA, 117 nt, Homo sapiens
ugacauugacuuuaacuugaagggucccaaagugaaaggugauguggaugucucucugcccaaaguggaaggugaucucaagggcccugaaauugacauaaaaggccccaguuugga

SEQ ID NO: 152423 - RNA, 92 nt, Homo sapiens
cauugacacaccugaugucaauauugaagguccggaaggaaaauugaaggggcccaaauuuaagaugccugagaugaacaucaaagcuccca

SEQ ID NO: 152424 - RNA, 87 nt, Homo sapiens
uguuucacuaccuaagguggaaagugaucugaaagggccagagguagacauugaagguccugaagggaagcucaaaggucccaaguu

SEQ ID NO: 152425 - RNA, 46 nt, Homo sapiens
caaaucuccaugagugacauugauuugaauuugaaaggaccuaaga

SEQ ID NO: 152426 - RNA, 46 nt, Homo sapiens
ccuaaagugggcauugacacuccugauauugacauucaugguccag

SEQ ID NO: 152427 - RNA, 68 nt, Homo sapiens
ccgaaguugacaucagggaccccaaaguggacauugaugucccagauguggacguucaaggcccagac

SEQ ID NO: 152428 - RNA, 87 nt, Homo sapiens
ugucucaggacccaaaguggacguugauguuccugaugugaauaucgaagguccagaugcgaaacuaaagggccccaaguucaagau

SEQ ID NO: 152429 - RNA, 105 nt, Homo sapiens
gccugagaugagcaucaaagcccccaagaucuccaugccugauauugacuuaaaccugaaaggacccaaagugaagggcgauguggauguuacccuuccuaaagu

SEQ ID NO: 152430 - RNA, 75 nt, Homo sapiens
uggacaucaacaccccugauguggauguucauggcccagacuggcaccugaagaugcccaaggugaaaaugccca

SEQ ID NO: 152431 - RNA, 46 nt, Homo sapiens
cccaagguggacguugauauuccagaugugaauaucgaagguccag

SEQ ID NO: 152432 - RNA, 46 nt, Homo sapiens
gggacuuugaaaggcccagaaguagaucuuaaagguccacgucugg

SEQ ID NO: 152433 - RNA, 63 nt, Homo sapiens
caucgaagggccagauguuaaaauccccaaauuuaagaaacccaaguuuggauuuggggcaaa

SEQ ID NO: 152434 - RNA, 102 nt, Homo sapiens
aagccccaaagcugacaucaagucaccuucacuggaugucacuguuccugaggcagagcugaaccuugagacuccugaaauuaguguugguggcaagggcaa

SEQ ID NO: 152435 - RNA, 74 nt, Homo sapiens
uuaaaucaccuaaauuuaaagcugaggccccucucccuagccccaaacuggagggugaacuccaggcaccugau

SEQ ID NO: 152436 - RNA, 46 nt, Homo sapiens
cagcgauucacgucgaaggucuugacaucaaggcgaaggcucccaa

SEQ ID NO: 152437 - RNA, 47 nt, Homo sapiens
gcuaaagucaaaacaccguccuucggcauuucugccccucaagucuc

SEQ ID NO: 152438 - RNA, 46 nt, Homo sapiens
aaaauuaaguuccccaaguuuuccaugcccaagaucggcaucccag

SEQ ID NO: 152439 - RNA, 44 nt, Homo sapiens
ccaugcccagcuacccucucuugaaggagacuugagaggaccag

SEQ ID NO: 152440 - RNA, 46 nt, Homo sapiens
agggcucaaccucaguggugucgguggcaaaaugcaggugggagga

SEQ ID NO: 152441 - RNA, 61 nt, Homo sapiens
ccacaacaaagcuuaacguuggggcaccagaugugacacugaggggaccaagccugcaggg

SEQ ID NO: 152442 - RNA, 56 nt, Homo sapiens
ccgacuugcacgucaaugccaaggggccacagguuucuggcgaacugaaggggcca

SEQ ID NO: 152443 - RNA, 72 nt, Homo sapiens
gacuuuaacuuggaaggaccaaaagugaaagggagccuuggggccacuggugagaucaaaggccccacuguc

SEQ ID NO: 152444 - RNA, 71 nt, Homo sapiens
ucuggaugugaugugaaccugccaggcgugaaugugaaacucccaacugggcagauuucugggccugaaau

SEQ ID NO: 152445 - RNA, 46 nt, Homo sapiens
ucagauuuuggcaucaacuugaagggcccaaaaaucaaaggaggug

SEQ ID NO: 152446 - RNA, 46 nt, Homo sapiens
ggacacaucuaaguuugcugggggccuucauuucucaggaccaaag

SEQ ID NO: 152447 - RNA, 49 nt, Homo sapiens
cuucccuaaagcagaggccagcauccaagcuggugcuggagacggcgag

SEQ ID NO: 152448 - RNA, 82 nt, Homo sapiens
ugaaagagaguucucuggaccuuccaccccgacggggacgcuggaguuugaagguggggaagugucucuggaaggugggaaa

SEQ ID NO: 152449 - RNA, 112 nt, Homo sapiens
guuaaagggaaacacgggaagcugaaauucgguaccuuugguggauuggggucaaagagcaaaggucauuaugaggugacugggagcgaugaugagacaggcaaguuacagg

SEQ ID NO: 152450 - RNA, 29 nt, Homo sapiens
cgagguggagcugucaguuuccacaaaga

SEQ ID NO: 152451 - RNA, 45 nt, Homo sapiens
ggaacuauacagauagguaaagaguuccaaguucguccagcccau

SEQ ID NO: 152452 - RNA, 27 nt, Homo sapiens
uauauauauauuuuuuugcauugacug

SEQ ID NO: 152453 - RNA, 47 nt, Homo sapiens
uuuguuaguaaggguggguggggugauggguugcagacggaggucag

SEQ ID NO: 152454 - RNA, 33 nt, Homo sapiens
uuaaaguguauuuauuuugaaugcaaaucuacc

SEQ ID NO: 152455 - RNA, 73 nt, Homo sapiens
agcccaagaaaggugggguggcaagaacggcaaaaaggguguugcuuggggcaggaaguugaggaagagggag

SEQ ID NO: 152456 - RNA, 31 nt, Homo sapiens
aaaaggucuuaacaucaaggcagaggguuga

SEQ ID NO: 152457 - RNA, 60 nt, Homo sapiens
ccuuccuucucauccaagucaucuccuggagagggaucagcccaggagcuacaggagcgc

SEQ ID NO: 152458 - RNA, 43 nt, Homo sapiens
uuuuucuuggugcacaaggcaaaaucaugaacugaaagcaaga

SEQ ID NO: 152459 - RNA, 53 nt, Homo sapiens
guucaggaucuacaccuugaggaaacagaaccagcuccuguccuugggagcag

SEQ ID NO: 152460 - RNA, 43 nt, Homo sapiens
caucaccagaagcagaaugaaccuaacaugagaaacccacaug

SEQ ID NO: 152461 - RNA, 26 nt, Homo sapiens
cuauggggcuguaucgaggaagaugc

SEQ ID NO: 152462 - RNA, 40 nt, Homo sapiens
auagcugugcaucaggccacacgcaggauggccccguggc

SEQ ID NO: 152463 - RNA, 54 nt, Homo sapiens
gccgcuacaggcaggcgggaaggaggaaagucuagcugguuucggcuucaggag

SEQ ID NO: 152464 - RNA, 82 nt, Homo sapiens
ucugcagguuuacaccgcuggagcuaauaucccagcaggccucguugaugagguccuugagugccuccaacaccuucuugag

SEQ ID NO: 152465 - RNA, 761 nt, Homo sapiens
auacuagaagacaggagacacaugcuuuaaaaucaacgccgucugcugaagggcuguauuucgaacgcgguuagaagggguuaccacucucacccaucaggccgucucagaacugguggaggguaagcggacugcuggaggaugccauuauuaaugcagacguuuugggacgcaucuggcaguauuuauacuaaaauaccaccagcagugucccuucuggauagaaacaaucuccugccacuaaguaggaugacaggcugccacauuucucgcaagggcauuauaaagcauuuaaagucaaccgcgacugagccgggaggaucgcuugagcccagaaguuggagaccagcccgggcaacacaccgagaccgucucagaaacaagaaagccacagcuaaagcguccauucaaggccaacaggauuuagugagcaaagagcccuggaacaguguuccuggcacugcggaaaaacccuugauuuucccgccaccacccgcuuugugacuuuggcgcgaaaaagcagguucgcgcagcagccagcgcgggcuuuuccgaaccgcgcgcucagcugggccccaccccacugcguggcaggccaaugagaaggcgcggauggcccacgccagccaaugagggcuaggcucgaaagcgcucccgccaagcaccggaggugcaggcgggccggggccggcuucccggggccgcgaggcucaccuggugagguucacgcccauggccagguugcggucgcagcgguaggu

SEQ ID NO: 152466 - RNA, 25 nt, Homo sapiens
auguguguguuuuuguguuuuucag

SEQ ID NO: 152467 - RNA, 40 nt, Homo sapiens
gaaaaacguuacaaauguaaugagugugguaaggucuuua

SEQ ID NO: 152468 - RNA, 46 nt, Homo sapiens
aaagccuuacaaaugucaugaaugcggcaaggucuuuaggcguaau

SEQ ID NO: 152469 - RNA, 45 nt, Homo sapiens
ccuaacuacccaucaggucauccauacuggagaaaaaccuuacaa

SEQ ID NO: 152470 - RNA, 47 nt, Homo sapiens
acucagaauucacaccuugcaagacaucggggaauucauacuggaga

SEQ ID NO: 152471 - RNA, 42 nt, Homo sapiens
ccaucagacaauccauacuggugggaaaccuuacaaauguaa

SEQ ID NO: 152472 - RNA, 38 nt, Homo sapiens
caauuccucaacccuuaugaaacauaagauaauucaua

SEQ ID NO: 152473 - RNA, 40 nt, Homo sapiens
gggaaggcacaguccugacaacggggcugaggaagaccca

SEQ ID NO: 152474 - RNA, 46 nt, Homo sapiens
uccugcagcucccugaggacccagcaagagccuguuaggacaggaa

SEQ ID NO: 152475 - RNA, 24 nt, Homo sapiens
cccacauucaauccugcagagugg

SEQ ID NO: 152476 - RNA, 50 nt, Homo sapiens
uguucauuuuuaaggcaacuuuaaaaaaguacuaguuggcugaaaagcug

SEQ ID NO: 152477 - RNA, 50 nt, Homo sapiens
cccaugggggauccacgaggucguaacuaaucaugauacuaaaauuauga

SEQ ID NO: 152478 - RNA, 46 nt, Homo sapiens
ucccgugggccaggggagaccugcgcaauccugagcuuagacgcag

SEQ ID NO: 152479 - RNA, 48 nt, Homo sapiens
gggccucccacaacccucucccuugagcugaaaugcccuccaaaugga

SEQ ID NO: 152480 - RNA, 60 nt, Homo sapiens
cuugaggauacgcaugggcagaugaggaaauugaggcaaagagaagucaaaaucagccgg

SEQ ID NO: 152481 - RNA, 43 nt, Homo sapiens
agacacgugagcugaguuugaagaaaaaguuaaaaggaaggug

SEQ ID NO: 152482 - RNA, 42 nt, Homo sapiens
ucggcucccauuuucccgaacgggcacccugaggcuccuggc

SEQ ID NO: 152483 - RNA, 39 nt, Homo sapiens
gaggugacggagggcuggcuaugggcggccggccggggu

SEQ ID NO: 152484 - RNA, 46 nt, Homo sapiens
uggcgcaccugcgagguggacgcggucgucauggcggcgacuaagg

SEQ ID NO: 152485 - RNA, 47 nt, Homo sapiens
cgggagcuggauaccuaagcaaaaaacgcuggcauuuagggccaaau

SEQ ID NO: 152486 - RNA, 46 nt, Homo sapiens
cugcagcuucaucaguuucucagcauguucccucuccucaugagau

SEQ ID NO: 152487 - RNA, 49 nt, Homo sapiens
acuuaugcuguuaauacuuucauucucacuagggaugaagcacauuccu

SEQ ID NO: 152488 - RNA, 42 nt, Homo sapiens
ggugacuguggcgguguacagcuucuuccugacuugucuagu

SEQ ID NO: 152489 - RNA, 42 nt, Homo sapiens
cuggaaggagaaaugguuuggcgaauauuuucuuugcggaac

SEQ ID NO: 152490 - RNA, 20 nt, Homo sapiens
cagcggccgccacccagccc

SEQ ID NO: 152491 - RNA, 52 nt, Homo sapiens
agagcgcucccgggcgccgccuccgccgccgcccgcugcuccggccccgccc

SEQ ID NO: 152492 - RNA, 48 nt, Homo sapiens
ccacuugucgccgggcuggucgugcgcgcggaucugcucccagcagaa

SEQ ID NO: 152493 - RNA, 39 nt, Homo sapiens
guccacggagcaggucugcgggggaggagggggccucag

SEQ ID NO: 152494 - RNA, 53 nt, Homo sapiens
ccugggggcaguauuugagcgugcagguguuugcaugucugggugaguguggu

SEQ ID NO: 152495 - RNA, 59 nt, Homo sapiens
gggguguaauggaaccuucucaggacccuugaaggguagggccuuuguacucgggccac

SEQ ID NO: 152496 - RNA, 53 nt, Homo sapiens
aguggagaagcugcuucucugccugccuguuaaguccuggccaagccugaggc

SEQ ID NO: 152497 - RNA, 99 nt, Homo sapiens
ugucugcucuccuucaggaugccuuccgugccuuccaucaagaucucaauuuugugcgcaaguuccuacagccccuguugauuggagagcuggcuccgg

SEQ ID NO: 152498 - RNA, 45 nt, Homo sapiens
ucaacaggggcuguaggaacuugcgcacaaaauugagaucuugau

SEQ ID NO: 152499 - RNA, 42 nt, Homo sapiens
ccaacaucuuccacaaagacccagacgugacgguggcgcccg

SEQ ID NO: 152500 - RNA, 47 nt, Homo sapiens
cuagaaucuagaguugccuuugacccuuggccccagccagccccgug

SEQ ID NO: 152501 - RNA, 45 nt, Homo sapiens
caguauggcaagaagaaacgcagauaccuacccuacaaccagcag

SEQ ID NO: 152502 - RNA, 47 nt, Homo sapiens
gaacuuugaaguggaaaaucuggcguacaugcuggugugcaugcagu

SEQ ID NO: 152503 - RNA, 43 nt, Homo sapiens
acggcgucccuggggugcugcucuucuuuguugcugucaggua

SEQ ID NO: 152504 - RNA, 47 nt, Homo sapiens
cugguucguguggaucacacagaugaaccacauccccaaggagaucg

SEQ ID NO: 152505 - RNA, 47 nt, Homo sapiens
cuuuucaccaacugguucagcgggcaccucaacuuccagaucgagca

SEQ ID NO: 152506 - RNA, 46 nt, Homo sapiens
cugaggccgugcuuggcacacagcgacuugaccagcggggccaccc

SEQ ID NO: 152507 - RNA, 42 nt, Homo sapiens
uggccccgcuggucaagucgcugugugccaagcacggccuca

SEQ ID NO: 152508 - RNA, 47 nt, Homo sapiens
gcaugaggcugaccuggacaaggguaggcauaggcccuggggaagcc

SEQ ID NO: 152509 - RNA, 82 nt, Homo sapiens
ucucugcccgccuggguguugccuucacugauggagguaggcguccagccagaugucaccagacuucuucagggaccuggga

SEQ ID NO: 152510 - RNA, 42 nt, Homo sapiens
ggugacaucuggcuggacgccuaccuccaucagugaaggcaa

SEQ ID NO: 152511 - RNA, 45 nt, Homo sapiens
gaggggugaggguaucgaucccgccgggggcuggcuugguugcug

SEQ ID NO: 152512 - RNA, 82 nt, Homo sapiens
guacuguugucuuccccucggcccccucacauguguauucagcagcccuauggccuuggcucugggccugaugggacagggg

SEQ ID NO: 152513 - RNA, 83 nt, Homo sapiens
uagagggaaggugagcauagcacauuuuccuagagcgagaauugggggaaagcuguuauuuuuauauuaaaauacauucagau

SEQ ID NO: 152514 - RNA, 50 nt, Homo sapiens
uugugcacacaacccaauuccccaggaugaccauuugcucugucaccuag

SEQ ID NO: 152515 - RNA, 49 nt, Homo sapiens
gggacucccccuuccugucaccgccuguuuaaauccuguuggcuccuag

SEQ ID NO: 152516 - RNA, 70 nt, Homo sapiens
gugagaggggagggagggaaguccugggaggauccugagcugcuguugcagucuaacccacuaaucaguu

SEQ ID NO: 152517 - RNA, 33 nt, Homo sapiens
uggagcugagaagaggaggaggugggggcugga

SEQ ID NO: 152518 - RNA, 46 nt, Homo sapiens
uucaacgacugguucaguggacaccuuaacuuccagauugagcacc

SEQ ID NO: 152519 - RNA, 45 nt, Homo sapiens
cugguuugugugggucacacagaugaaucacaucgucauggagau

SEQ ID NO: 152520 - RNA, 47 nt, Homo sapiens
agcccgagagggaugggaugcucugugggacagagaugcggugggga

SEQ ID NO: 152521 - RNA, 51 nt, Homo sapiens
gggagcugucaucgacccauuucauggauggaacagcuaaggccaagagac

SEQ ID NO: 152522 - RNA, 44 nt, Homo sapiens
gauauggguaggaugauguucggccuucacuuuucuccagaguc

SEQ ID NO: 152523 - RNA, 55 nt, Homo sapiens
uguucugggcgaauggcagcccaucgagguacgacuaagaggaugguguugaccu

SEQ ID NO: 152524 - RNA, 53 nt, Homo sapiens
ccacuuccagcaccacgccaagccuaacaucuuccacaaggaucccgauguga

SEQ ID NO: 152525 - RNA, 59 nt, Homo sapiens
cugcucagcuuucugucucuauagauuucccuauucugggcguuucaugucgguggaau

SEQ ID NO: 152526 - RNA, 43 nt, Homo sapiens
caggcccaagcuggauggcugcaacaugauuauggccaccugu

SEQ ID NO: 152527 - RNA, 34 nt, Homo sapiens
gugaggcgugacacccucacuuccccuagcugac

SEQ ID NO: 152528 - RNA, 48 nt, Homo sapiens
ccuguucaagaccaaccacguguucuuccuccuccuccuggcccacau

SEQ ID NO: 152529 - RNA, 77 nt, Homo sapiens
gaccuggaauucgugggcaaguucuugaaaccccugcugauuggugaacuggccccggaggagcccagccaggacca

SEQ ID NO: 152530 - RNA, 36 nt, Homo sapiens
uggcagcuguagcaaccaccagcguggggaugccgg

SEQ ID NO: 152531 - RNA, 42 nt, Homo sapiens
aacucuacucagcucauucccgagugugauagugggcaggug

SEQ ID NO: 152532 - RNA, 46 nt, Homo sapiens
acugaguucccuccaaaaaucagugcucacaucucuccuaacagag

SEQ ID NO: 152533 - RNA, 45 nt, Homo sapiens
ccggggggccagcgggucaucgggcacuacgcuggagaagaugca

SEQ ID NO: 152534 - RNA, 45 nt, Homo sapiens
cacagucggcaggcagcauggggaagggagggaaccagggcgagg

SEQ ID NO: 152535 - RNA, 70 nt, Homo sapiens
uccgccaggaaggcagggacacucccgagcgcaggcgagaaggcugggggagggggcgcggugggaggag

SEQ ID NO: 152536 - RNA, 42 nt, Homo sapiens
gauggugauuugccccaacucacgugugagucaguggcagag

SEQ ID NO: 152537 - RNA, 42 nt, Homo sapiens
aacugcuuccgcaaagacccagacaucaacaugcaucccuuc

SEQ ID NO: 152538 - RNA, 43 nt, Homo sapiens
uccgaaugcucauguguuugcuuuucuucacagcuugggaaac

SEQ ID NO: 152539 - RNA, 45 nt, Homo sapiens
acuauuggggcugaaagccuuccugggccuuuucuucauagucag

SEQ ID NO: 152540 - RNA, 26 nt, Homo sapiens
gcauagaguaccaguccaagccccug

SEQ ID NO: 152541 - RNA, 45 nt, Homo sapiens
cagggcagcucuggcuagaugccuaucuucaccaauaacaacagc

SEQ ID NO: 152542 - RNA, 46 nt, Homo sapiens
cuguuggggcagggguguaaauuauuuccuuuuucuaguuuggcac

SEQ ID NO: 152543 - RNA, 42 nt, Homo sapiens
cuggaaccacugauuuugguuuauucccuccagggucuaaag

SEQ ID NO: 152544 - RNA, 51 nt, Homo sapiens
cuagaaacaaaggggaugcccagugguuucccuuugcuucccaaccuaaaa

SEQ ID NO: 152545 - RNA, 75 nt, Homo sapiens
uuauagaauuauuuuugagcaggagcagaaagauuaaauaugaucacuucauacuucuaaaucagaaauaggaag

SEQ ID NO: 152546 - RNA, 95 nt, Homo sapiens
aaacuaggaggaaaagacagagccuccacuuaguuuugggaggggauggcagacagucaaggagaugagcguccuaaggcauguugggauagggu

SEQ ID NO: 152547 - RNA, 49 nt, Homo sapiens
ucacuccaaaauaggugcugauccuuccuauuccuauucuuugccaccu

SEQ ID NO: 152548 - RNA, 49 nt, Homo sapiens
gaauguuacaaugguaaaaugagugaucucaaauccacugacagauaua

SEQ ID NO: 152549 - RNA, 47 nt, Homo sapiens
ucaaaccacccauuguuaaucaagugcaauuacagcauguuaagagu

SEQ ID NO: 152550 - RNA, 27 nt, Homo sapiens
ucuggguccagcaccucagguuccaag

SEQ ID NO: 152551 - RNA, 45 nt, Homo sapiens
aagucgccgcacgaucuccucgaugcucuugugcuucuggaugag

SEQ ID NO: 152552 - RNA, 46 nt, Homo sapiens
uggugcgguagaacaugcccaucagguggcugguggucucacccuc

SEQ ID NO: 152553 - RNA, 28 nt, Homo sapiens
guugguauguguccaauacuccaagaaa

SEQ ID NO: 152554 - RNA, 44 nt, Homo sapiens
accauacauucauucaacacauuuauugagcaccuacugugugc

SEQ ID NO: 152555 - RNA, 68 nt, Homo sapiens
ccagcaggguggacagcagccacacaggggcagaaggggaggauguggguagucguggggugggagau

SEQ ID NO: 152556 - RNA, 55 nt, Homo sapiens
gcuggaauguuccauugggcaggagugcaaagguccuuuagcuccugcaugucag

SEQ ID NO: 152557 - RNA, 59 nt, Homo sapiens
uuccuuccucuuucuccuuaaguccggcuccaguucuguugccagaccugccaucuuau

SEQ ID NO: 152558 - RNA, 58 nt, Homo sapiens
cagcccacauugacugccagccauguaagugagcagacucagaaguucuagcccuuuc

SEQ ID NO: 152559 - RNA, 37 nt, Homo sapiens
gccccuuauuuaugggaaccauuucauucuaacagaa

SEQ ID NO: 152560 - RNA, 34 nt, Homo sapiens
gcacccuggcccgaaaggaggcuggggggcggcg

SEQ ID NO: 152561 - RNA, 92 nt, Homo sapiens
gucgggggcaacacaggugugaggggcaaguuugagcgggcagaggaggaggccaggaaggaggagaccgaagccagggaggaggaggagga

SEQ ID NO: 152562 - RNA, 42 nt, Homo sapiens
ccugccuccacuccagccccugcucucccauccagcccugcu

SEQ ID NO: 152563 - RNA, 46 nt, Homo sapiens
ggagcaggcgcuggcugugacggacgacaaggucucagugcuggag

SEQ ID NO: 152564 - RNA, 46 nt, Homo sapiens
acauccacaaaaugggauucaucauaauagaaccugguucacagaa

SEQ ID NO: 152565 - RNA, 25 nt, Homo sapiens
uccucauccuccuacccuguacucc

SEQ ID NO: 152566 - RNA, 58 nt, Homo sapiens
cugcuucggggccaugcagcccuccugccagcccccugcccuuuucuugcccugucuc

SEQ ID NO: 152567 - RNA, 44 nt, Homo sapiens
ggggcccaacucgaggccaaggugcgagggcuggaacgccaggu

SEQ ID NO: 152568 - RNA, 46 nt, Homo sapiens
caggccaacagaagagagaagccccaguugaugucuugacccagau

SEQ ID NO: 152569 - RNA, 48 nt, Homo sapiens
acagcacuuucuuuccaggguuaguuuggugcuugcuugggguagggg

SEQ ID NO: 152570 - RNA, 46 nt, Homo sapiens
uucagcuccaugagggcagggacuauguccacuaucaaggcagcau

SEQ ID NO: 152571 - RNA, 83 nt, Homo sapiens
gccgguagagggcacuuuuugccgccccuccugccaccuggugauucauagcaugaaaugaaacuaacaaaaggaaagagaag

SEQ ID NO: 152572 - RNA, 65 nt, Homo sapiens
gggcagccaaaguugagaaccgccgcuccuuaggggcagcuaugagcagcggcgggacagucaga

SEQ ID NO: 152573 - RNA, 46 nt, Homo sapiens
gggagucagugauuauagacaaaaaauagugcugagaaggggagcu

SEQ ID NO: 152574 - RNA, 30 nt, Homo sapiens
ugacccuuuacaggggcuuccuggcucugg

SEQ ID NO: 152575 - RNA, 45 nt, Homo sapiens
accuggcggcgccucuccuucuccuccuccaggugacgggcaaag

SEQ ID NO: 152576 - RNA, 42 nt, Homo sapiens
cucaugcugaccccggggggagccaggugcccugggugucag

SEQ ID NO: 152577 - RNA, 42 nt, Homo sapiens
ugagauagcuccccuaaaaccucccacuggugugugucccau

SEQ ID NO: 152578 - RNA, 42 nt, Homo sapiens
uuccauuccugaaaaacccaagcuuagauuuauugaaagggc

SEQ ID NO: 152579 - RNA, 45 nt, Homo sapiens
cuuugaaaugaugcgccugacaaucaaccgcucuauggaccccaa

SEQ ID NO: 152580 - RNA, 45 nt, Homo sapiens
uugaccacuacgugacaccugugaaggcuggccgccuuguuguag

SEQ ID NO: 152581 - RNA, 46 nt, Homo sapiens
gcugugagccgcgggacucuagagaagaugcgaaaagaucaagagg

SEQ ID NO: 152582 - RNA, 65 nt, Homo sapiens
ccccucagccuacccacugaagucuuuggguagcucuuaagccauaacuaaggagcagcauuuga

SEQ ID NO: 152583 - RNA, 46 nt, Homo sapiens
aacugggggacaaguauauaaagcuggugcagccauacugcaggag

SEQ ID NO: 152584 - RNA, 46 nt, Homo sapiens
agccaggaaaaaguacauggggguguggagggaaugauugaucuga

SEQ ID NO: 152585 - RNA, 39 nt, Homo sapiens
agauguguugacuaacaagagucucucaugggaggaugg

SEQ ID NO: 152586 - RNA, 42 nt, Homo sapiens
aggaccuccacgaccucgaacaccaccucuucuuaagcccau

SEQ ID NO: 152587 - RNA, 46 nt, Homo sapiens
uaggguucugguggcacgucccccacguaguccuccucugggcaag

SEQ ID NO: 152588 - RNA, 45 nt, Homo sapiens
uugagugacuccuaaucucuggacguaaacuuucugaauuuguag

SEQ ID NO: 152589 - RNA, 45 nt, Homo sapiens
aauuggaagaaaagcuaccaguggcaguuaaugaacaaacaggca

SEQ ID NO: 152590 - RNA, 32 nt, Homo sapiens
ugcuuugccucagaggcccccccaggguccag

SEQ ID NO: 152591 - RNA, 45 nt, Homo sapiens
uuugcuuagaaguagggcuuugcauugaguucgugucucuaccag

SEQ ID NO: 152592 - RNA, 45 nt, Homo sapiens
gggucacccuuuuccuccuaguguuccuccuguucucagcccccu

SEQ ID NO: 152593 - RNA, 49 nt, Homo sapiens
acagguaagccugugauuagcccuacccauaaagaacucuccuacuuuc

SEQ ID NO: 152594 - RNA, 45 nt, Homo sapiens
cuugcugccaugaaucccaaguugcuacaagggcgaguugggcag

SEQ ID NO: 152595 - RNA, 46 nt, Homo sapiens
cacagcagcacccuccuggcccaggaccccaccugcaaaaccuaag

SEQ ID NO: 152596 - RNA, 66 nt, Homo sapiens
ccaauguuuagaccggacacaacucaccuccauccacagcaccgucgacucuugcaucagagacag

SEQ ID NO: 152597 - RNA, 46 nt, Homo sapiens
cucaauggugcgggagauagaggaagucaccggagcagucaucaag

SEQ ID NO: 152598 - RNA, 42 nt, Homo sapiens
aaagaaaaacaaguucgagacaagaggagaaaaacccuuguu

SEQ ID NO: 152599 - RNA, 45 nt, Homo sapiens
uugauguggaggacuaugaaagacguuaucuccuaagucuggaag

SEQ ID NO: 152600 - RNA, 46 nt, Homo sapiens
aauuuguagcauguaugacaacuuaagggggaaauugccuggacaa

SEQ ID NO: 152601 - RNA, 43 nt, Homo sapiens
gcaagcagcugacauucucaugacaacagccaggaaccucccu

SEQ ID NO: 152602 - RNA, 53 nt, Homo sapiens
uacauguauuguacaacaguaagauccucuguuaaaaccagcuguccuguucu

SEQ ID NO: 152603 - RNA, 49 nt, Homo sapiens
accagcuguuccccagugauguuaccuagcuucccucuaccguugucua

SEQ ID NO: 152604 - RNA, 46 nt, Homo sapiens
ugucugaaagaaagaccaucuccuucaaucauugcuucacucagau

SEQ ID NO: 152605 - RNA, 44 nt, Homo sapiens
guguucauauaacaggaggacaggaaagguaaggacccagaaca

SEQ ID NO: 152606 - RNA, 42 nt, Homo sapiens
gagguuuaggagaauguuuuaaugcuuaagaggcaggaucaa

SEQ ID NO: 152607 - RNA, 53 nt, Homo sapiens
aguacuugcagacaagugguuagcuuggcuaaaauguacaaaacacccagaac

SEQ ID NO: 152608 - RNA, 43 nt, Homo sapiens
ucaaccuagucgguaacaauccacuccccaccccuuucaugcc

SEQ ID NO: 152609 - RNA, 45 nt, Homo sapiens
guggagaaggcccggcggcggcccucggcagaacggaugcucagg

SEQ ID NO: 152610 - RNA, 46 nt, Homo sapiens
uacacacgcugugcugcucaguucuuucuguucaccuucuuugguu

SEQ ID NO: 152611 - RNA, 294 nt, Homo sapiens
ccucuggccuacgucaagaaagacaacucuucagcaugugcacggaggacacucuaucccggagggaagacacuuaggcauccaugugggcagccaaggaaggcagaggaaauaagcaucccaguuccccaaaggccuuaggcaugccagauucuauuccaagcugcuacuuuccugagaggcacugauguccccuuggagagggaaucaccuuggauccucccuucugccuuugcuaucaguucccucuacucaccagcaggucagugguaaucaaaacucugcuagagccag

SEQ ID NO: 152612 - RNA, 1311 nt, Homo sapiens
ugaccaccuucuguaucugagcagagagaggcaggugcucauaugucaguuaccacugugcccggcaccauucuuaaauguuuuucauguauugauuccuaaccaacaacuuuggggcaugcacuauuauuaaacucacauucagcugagaaacaggcagaggcuaaaauccacuuaagaucgugcugucaauagguggcaaagacaggauuucaacucagucugguuccugaguguacagugauucacaaugaggccgcucagauaauuaauucaguuucuuuacucuagauauuuagaacccuuaaccuucugaaaacuaauuugaccaacugccucaucacgcagcaaccauuuuuuuuuucuuuuuuugagacagagcuuugcucguugcccaggcuggagugcaauggcacaaucucagcucacugcaaccuccaccuccuggguuaaauucuccugccugagcuucccgaguagcugggauaaaaggcacacgccaccaugccuggcuaauuuuuguauuuuuaguagaagcgggguuucacuauguuggccaggcuggucuccaacuccugaucucaagagaucugccugccuuggccucccaaaguguugggauuauacgaguugagccaccacacccagccagcaaccaguuuuauagaacaggugaugcauauccauguccuauugcacuccugccauaggacccaagcuacgaggcauguucacucugagaaaacugagagccaagugccuuagaauggagcucugcuguaacuucuuacauuauccacacccagaauaaucacugccccugccacagaacauuuaaaaacaugcucugacaucaguguugcagcaugacccaggaaaaaguccagcauuagaauugugugugccccaggcaugaaacagcucuggcuauuaagcaagggugaaaaggacuguccaucugcucugacuacuguaagaucacccccacaccaagggaucucuuagcccauagugaaggugcuuauucagaacacagucaaacuugcccagccagccaggcuucacccaacagcuuucccauuugacucaggaaauggguggaggaagcaaugguuacguuuggguaagaaauagcuuuuaauuaacccagcaggucucgagaguguuagggcacccaugucuuccucccaagguggugaucagagaagacuucucugguccuuggauuauacucaucaucccuaaaucagcccugaaggagggaauagaagccacucuuaccugcugagccaauucucgagugggugcuag

SEQ ID NO: 152613 - RNA, 283 nt, Homo sapiens
uaggggaugcaaagaaauuaaagcuugagucauggaaaagguggagcugagcuguagucuccgagcaaacagaaucuggugccuacuaacaaaagccucagagcuuacaacccuccucccuuuagggaaaccagcugcuucuagaugaucugggaaaucaaucaagaggccacucuaacucuauacggcugaaaguuguaaugggggaggacagaauuccauuucuccagucucaccucgaugacgccuucgggcuccaucccaucggggccauugucucugg

SEQ ID NO: 152614 - RNA, 56 nt, Homo sapiens
agaggcuggcauugaggcuaacccccaacacggugcaucucagaugccucaauagg

SEQ ID NO: 152615 - RNA, 65 nt, Homo sapiens
uagcaacccagaauguaaaaaagaaaaaacuagggggaaaaaaccaggucuacagugauagagca

SEQ ID NO: 152616 - RNA, 47 nt, Homo sapiens
aaacauaaaucagagugagugaguaaaauuauaaaggccaggcagca

SEQ ID NO: 152617 - RNA, 36 nt, Homo sapiens
cuggucaggucucaccugugccaaggggggcaggaa

SEQ ID NO: 152618 - RNA, 46 nt, Homo sapiens
cagccagacauagcgguggagaccugugcccuugggaggccccgag

SEQ ID NO: 152619 - RNA, 54 nt, Homo sapiens
gucuugauucagggaagcucuacaccuugguccugacagacccugaugcuccca

SEQ ID NO: 152620 - RNA, 61 nt, Homo sapiens
acacagcacccaaaaaaggccauagucuuuuguuuaccuagauguauuuuaaccucuuuac

SEQ ID NO: 152621 - RNA, 42 nt, Homo sapiens
ugcccaccacggcugaggaacaugguuuucgagucggugguc

SEQ ID NO: 152622 - RNA, 63 nt, Homo sapiens
cgcccucuccccgucgggugguuugggcgguuccgggcccggcgucucucaccccgcuggucu

SEQ ID NO: 152623 - RNA, 45 nt, Homo sapiens
gagagguuguggcgcaggcuguucugccagcgcugugugugcucg

SEQ ID NO: 152624 - RNA, 46 nt, Homo sapiens
cagcaucuucucggccgagugcuggauugccauggcggucagcgag

SEQ ID NO: 152625 - RNA, 42 nt, Homo sapiens
uucuuuuuugcucuauacauuuguauaaaauucugugcagac

SEQ ID NO: 152626 - RNA, 86 nt, Homo sapiens
ggggaagagcagaccacuguggaauaucaguggagcacuggcuucauaaaugccaacaagagauggaagaguuuucuauaaacaga

SEQ ID NO: 152627 - RNA, 80 nt, Homo sapiens
uaauuacagacagccuuuuaacuucuccccagcccacuguuauguccaaauacaaugagcccucuuguuaccuggcacau

SEQ ID NO: 152628 - RNA, 62 nt, Homo sapiens
ggccaggaguugugcauuuauuuggguguugugagcaaagaagggaguggcaccaaguaguc

SEQ ID NO: 152629 - RNA, 53 nt, Homo sapiens
augcugggcacgcuucuccucagguuggguagcacacgcaagcuacacguggu

SEQ ID NO: 152630 - RNA, 71 nt, Homo sapiens
uuagcuaagucagugagaaaggaucuaauuacuacuguugguuugacugcgugaucuuaacagagauaagu

SEQ ID NO: 152631 - RNA, 65 nt, Homo sapiens
guaauaaagucaccccuguucacuaucucauuuaaaccaaaacuuaauaccuaaacuauggacau

SEQ ID NO: 152632 - RNA, 61 nt, Homo sapiens
ugauaaaaauucuuguuuuaguuaagaccccucuggcuguguggagaauggaggaggauag

SEQ ID NO: 152633 - RNA, 47 nt, Homo sapiens
ucuuuugcacauaaugagguugaggugccugggagacauauguagca

SEQ ID NO: 152634 - RNA, 52 nt, Homo sapiens
ucugaagaggaccucuuuuugcaaguauaugaagaucuaauacaagaacuag

SEQ ID NO: 152635 - RNA, 55 nt, Homo sapiens
uuuguuacaucucuuaaugcuauuuaugugauuuacuuuaaaacuuuuaguagau

SEQ ID NO: 152636 - RNA, 64 nt, Homo sapiens
gacggcacuguuugcaagugacagggaucugccuaaauauggcuacagcagaaagacaguacag

SEQ ID NO: 152637 - RNA, 53 nt, Homo sapiens
aacccugaguaugacacacacugagcuagcuggggaggccuuucaguguuucu

SEQ ID NO: 152638 - RNA, 48 nt, Homo sapiens
gacagcauaaagacggaacacaacaaauccuuccugaagugaauuagg

SEQ ID NO: 152639 - RNA, 49 nt, Homo sapiens
aagauacaauguauacugugguacaaugacagccauuguuucauauguu

SEQ ID NO: 152640 - RNA, 46 nt, Homo sapiens
uucuaacuggagcucagaguaagaaauaaagauuacaucacaaucc

SEQ ID NO: 152641 - RNA, 40 nt, Homo sapiens
agguguguaugugugugugugauacauacauacaucaagu

SEQ ID NO: 152642 - RNA, 62 nt, Homo sapiens
ucuguaucaaaaauugacagcucuuguaaccaaucuauaacuuaucucaacucacccuugca

SEQ ID NO: 152643 - RNA, 51 nt, Homo sapiens
ugggaauauaacugaacauuuauugcuuuuuacauaugcugaaauacggag

SEQ ID NO: 152644 - RNA, 69 nt, Homo sapiens
aaggagggcagguuuuuguggggcaugugcuaaguucacuuuggauaugaguuuugaguauggugagag

SEQ ID NO: 152645 - RNA, 31 nt, Homo sapiens
cacuuuguaccccacaaauauagacaauuau

SEQ ID NO: 152646 - RNA, 40 nt, Homo sapiens
ggagaaagcuuucagucuuucaccauugaguagcuguggg

SEQ ID NO: 152647 - RNA, 45 nt, Homo sapiens
ucaagucaagauuucaagugcuuacagaucuagaagaauaacaca

SEQ ID NO: 152648 - RNA, 41 nt, Homo sapiens
ucagccaagugucauaaugacccaacaagacagcauuuugu

SEQ ID NO: 152649 - RNA, 49 nt, Homo sapiens
auuuguuccagaucauggaggacuuguauagucaggcugcacaguugac

SEQ ID NO: 152650 - RNA, 44 nt, Homo sapiens
auggaaaacaucacuuaggcaaguaaaaguccccuuuuucugga

SEQ ID NO: 152651 - RNA, 44 nt, Homo sapiens
cauucugaaucaggucaguaaaaauguuuauucucuggccuuca

SEQ ID NO: 152652 - RNA, 68 nt, Homo sapiens
uguucauuugguggaaauucuuauuacuuacaugaaugaguuugaauuuaguggcaaggaagaaaaaa

SEQ ID NO: 152653 - RNA, 45 nt, Homo sapiens
cucccuccaccuccuccucggcccccccucgcuucccuccuccca

SEQ ID NO: 152654 - RNA, 38 nt, Homo sapiens
ucuuuguaguugucuccuguuuucuaucucccaggccc

SEQ ID NO: 152655 - RNA, 44 nt, Homo sapiens
cuucuagauugagauuguucuguaguuuuuccuacauuaggaaa

SEQ ID NO: 152656 - RNA, 49 nt, Homo sapiens
uauauugacuuuaauacauugaauuugagcuuggaacgguuuuauuauu

SEQ ID NO: 152657 - RNA, 52 nt, Homo sapiens
gauacuguguuggaaaugcugugcuuuuuuauuucuuuguaauugagguuua

SEQ ID NO: 152658 - RNA, 46 nt, Homo sapiens
cuguggcugccuugccuguaacucagcaaaugacagaaaugagcau

SEQ ID NO: 152659 - RNA, 46 nt, Homo sapiens
agcccaguacuucucagagugaagaaaaagcuccugaauugcccaa

SEQ ID NO: 152660 - RNA, 45 nt, Homo sapiens
aaucagaaaagagaauccaguuguuguggcugaaaaaauucagag

SEQ ID NO: 152661 - RNA, 45 nt, Homo sapiens
cauugaugcuauauuguauuauguaaauaauaaaagccauguaca

SEQ ID NO: 152662 - RNA, 26 nt, Homo sapiens
ucaaacaaguucuugcauacagcuaa

SEQ ID NO: 152663 - RNA, 54 nt, Homo sapiens
auaacauucauugaaaagucguugagcuaaaaauguggcuaagagguuuggaga

SEQ ID NO: 152664 - RNA, 68 nt, Homo sapiens
uguauaaauugaagauugaaaaacaccuguuauacuucgaaauuguuaagagguugucagugauccua

SEQ ID NO: 152665 - RNA, 99 nt, Homo sapiens
aguuguucuuucuguuuucuuauucuauauaacccuaguuaguccuuucauuuccucauagugagaaacuaguacaaaaaggauagaaaaggcaaucuu

SEQ ID NO: 152666 - RNA, 43 nt, Homo sapiens
uguuuuuaguaaggcuccuaaagaauuuacuuuucuuuuagaa

SEQ ID NO: 152667 - RNA, 53 nt, Homo sapiens
auuuuuaauggaauguagaauuaaaguguuuuuuuuuuccuguaaggacaagg

SEQ ID NO: 152668 - RNA, 42 nt, Homo sapiens
uuuccuuucucacaacaacuuacacaguuguucugagaauua

SEQ ID NO: 152669 - RNA, 47 nt, Homo sapiens
cucauagcgaaguucuacauaaaagggauucuuaaaaucaacugaaa

SEQ ID NO: 152670 - RNA, 49 nt, Homo sapiens
ugcccacuuuuuagagucagucaguugaauaacguauaacaacuauaag

SEQ ID NO: 152671 - RNA, 47 nt, Homo sapiens
ugugaggcaaguacuuaaaauuuucaugcugguuacuuaaaaggcau

SEQ ID NO: 152672 - RNA, 43 nt, Homo sapiens
agaugugcugcucuucccgguaaaaagugagaagaauuuagag

SEQ ID NO: 152673 - RNA, 48 nt, Homo sapiens
aauagaaucuguaaauucuuacaugguguuuaucuggauauucugugu

SEQ ID NO: 152674 - RNA, 44 nt, Homo sapiens
agaaaugagccuagccccggacauaaggaaaugaacaauuagaa

SEQ ID NO: 152675 - RNA, 49 nt, Homo sapiens
aaaauuuguuaaaucagacaaaauaguagggacugaaaacuagugucag

SEQ ID NO: 152676 - RNA, 54 nt, Homo sapiens
auuugcugugggcaaauccccuaauccuucucacguuguuucuucaccugaaaa

SEQ ID NO: 152677 - RNA, 48 nt, Homo sapiens
ccuguucagauuuggcuugugaaucauagaauaaaagcauacuagaau

SEQ ID NO: 152678 - RNA, 48 nt, Homo sapiens
uuuauugcauuccuaggaugugcaaggcacuguacugguugcugugag

SEQ ID NO: 152679 - RNA, 46 nt, Homo sapiens
ugccugaaagaguugaaauuuaagacaauccacauugagcccauga

SEQ ID NO: 152680 - RNA, 53 nt, Homo sapiens
uaaaugaaacgcccuaacccugcuuccccucaaaccaaaccaaaccaaaccaa

SEQ ID NO: 152681 - RNA, 89 nt, Homo sapiens
auacauauauauauacacacacacauacacacgcacauauauauaugcuagguauauauauauagguauauacauauacguguguauau

SEQ ID NO: 152682 - RNA, 48 nt, Homo sapiens
augauugcagccucagaaacaaaagauucccacucccuuucagagcag

SEQ ID NO: 152683 - RNA, 44 nt, Homo sapiens
ggaaguaccuuuaugacuagaaucuuauucacuguuuggcagaa

SEQ ID NO: 152684 - RNA, 42 nt, Homo sapiens
cuuaugaagaauuccugagauuaauaggccuuuuagacuuag

SEQ ID NO: 152685 - RNA, 42 nt, Homo sapiens
cacuccccugcuuuccuccaaccucagaauggaaauagucgu

SEQ ID NO: 152686 - RNA, 26 nt, Homo sapiens
augcacauagaacauauucuagaaga

SEQ ID NO: 152687 - RNA, 68 nt, Homo sapiens
auaccuuugaaaaggacuuuucccggggccucaaugugagggucauugaccaagacacggccaaaauu

SEQ ID NO: 152688 - RNA, 42 nt, Homo sapiens
gccaucugucagacacagauuacauuuguuauuuuuuuucua

SEQ ID NO: 152689 - RNA, 45 nt, Homo sapiens
gagcugagguuggaauucuuacccggaauauugugauccaaggag

SEQ ID NO: 152690 - RNA, 42 nt, Homo sapiens
ucaguccaucuuucuuauguggaauugaaacacaugggucag

SEQ ID NO: 152691 - RNA, 49 nt, Homo sapiens
uccugccuuuucugagcauuccacgauuuuucugucugaaggaagccua

SEQ ID NO: 152692 - RNA, 46 nt, Homo sapiens
cagggcuguuucaacuuucuggauugcucaucccaacaauaaucug

SEQ ID NO: 152693 - RNA, 46 nt, Homo sapiens
uccauuggguauauuuuauaacaacaggguccauucaaauuuuaag

SEQ ID NO: 152694 - RNA, 48 nt, Homo sapiens
guucaggauauauagagagcauuccauuuauacauaccuauugcgcau

SEQ ID NO: 152695 - RNA, 40 nt, Homo sapiens
cucuuuuaagucacacucaagcuauacuuugccaaagcaa

SEQ ID NO: 152696 - RNA, 28 nt, Homo sapiens
agugaucucuuaaaagaacaaaaaagaa

SEQ ID NO: 152697 - RNA, 48 nt, Homo sapiens
ggcucauugcuuuuaaaaauaaugauaauggagcuugggucagaggag

SEQ ID NO: 152698 - RNA, 73 nt, Homo sapiens
ugauggaagcuucccaagugaugaagguuccagccaagagguaucugaaucucucuuuguuggggagagcagg

SEQ ID NO: 152699 - RNA, 81 nt, Homo sapiens
aauuacggcuuucaggguggucagaacaaguauguaggcacuggaggaauagaccagaagccucgaacauuacccaggaac

SEQ ID NO: 152700 - RNA, 28 nt, Homo sapiens
aacuguuuuuuuucuuccuucuugagcc

SEQ ID NO: 152701 - RNA, 47 nt, Homo sapiens
guuuuuccucaauguguguuguugguuuucagaaauaacuacuggaa

SEQ ID NO: 152702 - RNA, 46 nt, Homo sapiens
aauuagaggcuuucagauuuaugaugggcccauucaucucacaagg

SEQ ID NO: 152703 - RNA, 46 nt, Homo sapiens
ugacauucaagucauaccuugauagggaaaaugacuucaagugaug

SEQ ID NO: 152704 - RNA, 46 nt, Homo sapiens
ggaaagccuggucccugguuugaagauugugagauggauggugaua

SEQ ID NO: 152705 - RNA, 42 nt, Homo sapiens
uaaaugugucuaaguggaaugcagugaucugcagugggaccu

SEQ ID NO: 152706 - RNA, 47 nt, Homo sapiens
ugguggauggaagagauugcagaauggagguaccagcugcccaggau

SEQ ID NO: 152707 - RNA, 82 nt, Homo sapiens
gcuaugggauuucucauuuccaugagcaaaaauaaaaaauacuaaaaaaaaaaaguaauacuugccuaagucccagaaggga

SEQ ID NO: 152708 - RNA, 54 nt, Homo sapiens
aaaauauagaaaaacauaaagaaaauggaaauaaucuacaguucuccuaaccaa

SEQ ID NO: 152709 - RNA, 47 nt, Homo sapiens
caugguagaacauggcauugcguguuuggggaaaggcaagaaguuca

SEQ ID NO: 152710 - RNA, 46 nt, Homo sapiens
ccaugcucacuggacucugucaaggcuguggcacucggcagguaaa

SEQ ID NO: 152711 - RNA, 44 nt, Homo sapiens
auucuaccugcuaauacuguuaccuuggagauuaggauuucaac

SEQ ID NO: 152712 - RNA, 42 nt, Homo sapiens
augaauuacuucuggcuauagucacugguuugucaucacauu

SEQ ID NO: 152713 - RNA, 92 nt, Homo sapiens
agcguuccauuccgcuugacggaaaaaacgguuuuuccucuugcugaugucagucgcauugaagaguauuuaaaaacaggcaucccuccaag

SEQ ID NO: 152714 - RNA, 26 nt, Homo sapiens
acuggcagugacuucuagggagacug

SEQ ID NO: 152715 - RNA, 46 nt, Homo sapiens
gaagagaccuggaacugcuaaagcaagcuucaaaagcacauuagag

SEQ ID NO: 152716 - RNA, 46 nt, Homo sapiens
aacuuauuuaauuuauggcauuuuaaaaugacacuguuaacccaac

SEQ ID NO: 152717 - RNA, 47 nt, Homo sapiens
uggggcccuguuucugggcagccuuugaggauuuucuaugauauuga

SEQ ID NO: 152718 - RNA, 48 nt, Homo sapiens
auuaaaaagcaugcugugaugcccagcuucccuuuccacagggugcau

SEQ ID NO: 152719 - RNA, 29 nt, Homo sapiens
uuuuuuuuuuuuguauauugaugaaugag

SEQ ID NO: 152720 - RNA, 47 nt, Homo sapiens
aagaguugcuauuuugcacaggagagagaaggcucuggaaagugcug

SEQ ID NO: 152721 - RNA, 43 nt, Homo sapiens
uccaacacucacuacagugaucuuauuguuuuggacuguugcc

SEQ ID NO: 152722 - RNA, 51 nt, Homo sapiens
gaguuaaucacauuguaguuuuuaaauuucuacagccuagagcucaguagu

SEQ ID NO: 152723 - RNA, 33 nt, Homo sapiens
cauauuuuacagugguccaaaggaacaugaaaa

SEQ ID NO: 152724 - RNA, 51 nt, Homo sapiens
uaggagcagucauuuucaaaacugugcaaauuggcuccucucuuuaacaga

SEQ ID NO: 152725 - RNA, 42 nt, Homo sapiens
cagccucucagucuaugugcagauggcugguuuuaaugaugu

SEQ ID NO: 152726 - RNA, 46 nt, Homo sapiens
gaaggccugagaauuacaucagguuaguacagaucacauugaagaa

SEQ ID NO: 152727 - RNA, 46 nt, Homo sapiens
gaaguagcaaaccaauugcucagcaagaugaccagaccuaggaggu

SEQ ID NO: 152728 - RNA, 45 nt, Homo sapiens
augaacacugguuuccuccacauauguuccgugugccuagguggg

SEQ ID NO: 152729 - RNA, 46 nt, Homo sapiens
gccaauuggaggggguuugguuugugacgugaugggauucugcgaa

SEQ ID NO: 152730 - RNA, 45 nt, Homo sapiens
ccucucuugcaguuuccucucccagcgccucgggggcguuuucag

SEQ ID NO: 152731 - RNA, 43 nt, Homo sapiens
ucguccgaggccagggcagggcgagccgaaccuccgcagccac

SEQ ID NO: 152732 - RNA, 44 nt, Homo sapiens
uggcagcgcgcccagcccgcucucccuccuccauccuggagugg

SEQ ID NO: 152733 - RNA, 53 nt, Homo sapiens
ugugggaaagucuauggaaaauccucccaucucaaagcccauuacagagugca

SEQ ID NO: 152734 - RNA, 46 nt, Homo sapiens
aaggaaacuugggaacaauucccacagaaagggcacagcgacucau

SEQ ID NO: 152735 - RNA, 46 nt, Homo sapiens
ccacuagugcuguuuuuggcagucuuaaggcuagugcauugguaaa

SEQ ID NO: 152736 - RNA, 60 nt, Homo sapiens
aggaagauugagcauaacucacuuuauccugaaacaggaagggauuauuaagccuuauag

SEQ ID NO: 152737 - RNA, 42 nt, Homo sapiens
guugaacucauggaaauaguagaauggugauugcaggaguag

SEQ ID NO: 152738 - RNA, 46 nt, Homo sapiens
aucuucuacuaaacauugggcaucuaugcacguuucagaccacagu

SEQ ID NO: 152739 - RNA, 62 nt, Homo sapiens
aguucugugauggagcaaaauccuuugagaagugagccagcccuaguuccuccaaaagauga

SEQ ID NO: 152740 - RNA, 46 nt, Homo sapiens
auuaaucuuccccaucuucuagaagaagaaguugaauucagcacug

SEQ ID NO: 152741 - RNA, 42 nt, Homo sapiens
ugagacggaagcauaaauaugaggcaccugaugaaaacacgg

SEQ ID NO: 152742 - RNA, 43 nt, Homo sapiens
cucugcauccgagauauuuauguugugucuauggaaauaggaa

SEQ ID NO: 152743 - RNA, 43 nt, Homo sapiens
agccagcggccucccuuccucagggcuccuuuguaacacagug

SEQ ID NO: 152744 - RNA, 46 nt, Homo sapiens
uguagauauauuuuauuuauauauuuauuuauauuuauauauagau

SEQ ID NO: 152745 - RNA, 37 nt, Homo sapiens
cagcccauuucuccagaacaaacaucauagucaaugc

SEQ ID NO: 152746 - RNA, 28 nt, Homo sapiens
caaguggguggcuggacauggacuuggg

SEQ ID NO: 152747 - RNA, 74 nt, Homo sapiens
gugaucauuucaaaaauuaucccugagugcagaacucaaaauugacaguaaaggaugagauccacuugacagug

SEQ ID NO: 152748 - RNA, 46 nt, Homo sapiens
gugaaaaguugaacauuacuaacgaagucuaaucauaucuuuaaaa

SEQ ID NO: 152749 - RNA, 66 nt, Homo sapiens
aagauuugauaaaguggaaaucgggauaagaauccucauucuggacagcuacuaggcuagaaucac

SEQ ID NO: 152750 - RNA, 46 nt, Homo sapiens
ccagcagcuuaaguccuaaaacuucccuggacuaagcuuacccuag

SEQ ID NO: 152751 - RNA, 45 nt, Homo sapiens
accuugucauauaccaucaauaaaguacccugugcucagccaaaa

SEQ ID NO: 152752 - RNA, 42 nt, Homo sapiens
gcccccucaagggcauccugggcuacacugagcaccaggugg

SEQ ID NO: 152753 - RNA, 37 nt, Homo sapiens
ccucgggcggcguuuggaaaccgcucgggucucccgu

SEQ ID NO: 152754 - RNA, 48 nt, Homo sapiens
cuuggcaguaacagcuucaugaaauccaguguagcuuuguucccugga

SEQ ID NO: 152755 - RNA, 70 nt, Homo sapiens
uucugcuccaggagagguaucaaauugauaagacuuaacaagaacuccuagaguagaacaugaccauaag

SEQ ID NO: 152756 - RNA, 47 nt, Homo sapiens
acgcuguuguggaaaugugauggggaugaagacuguguugacggcag

SEQ ID NO: 152757 - RNA, 50 nt, Homo sapiens
ucccauaaaguuucaggggguuaauuaacccuugacauagaaacuacaag

SEQ ID NO: 152758 - RNA, 46 nt, Homo sapiens
uguguucccagccgauggaagugugauggagauccugacugcgaag

SEQ ID NO: 152759 - RNA, 50 nt, Homo sapiens
aauccagugcggcucuggcgagugcauccauaagaaguggcgaugugaug

SEQ ID NO: 152760 - RNA, 46 nt, Homo sapiens
gugcagaaguggagaaugcauagauaucagcaaaguauguaaccag

SEQ ID NO: 152761 - RNA, 68 nt, Homo sapiens
aaagaccuaguuauaggcuacgagugugacugugcagcuggguuugaacugauagauaggaaaaccug

SEQ ID NO: 152762 - RNA, 42 nt, Homo sapiens
cugauuucccucccagauauugaugaaugccaaaauccagga

SEQ ID NO: 152763 - RNA, 46 nt, Homo sapiens
ggauucgauagacguccacuggugacagcggauauccaguggccua

SEQ ID NO: 152764 - RNA, 45 nt, Homo sapiens
gcuuuggaugugguuaccgaguaucuguaacccuugaauuucuag

SEQ ID NO: 152765 - RNA, 46 nt, Homo sapiens
uuucacuuuggcauuugcuucuguuccuuguaucuguggaagucaa

SEQ ID NO: 152766 - RNA, 48 nt, Homo sapiens
aaagacuaacucuucaguuaagaacacuguagaaaugguagaccaacu

SEQ ID NO: 152767 - RNA, 89 nt, Homo sapiens
cuauuacguaaucuaacuggaauaauuuccuagaauucuuacuagugaaaucuuacccaaguaaaacaauuuauuauuuugaauccaaa

SEQ ID NO: 152768 - RNA, 35 nt, Homo sapiens
ugguggcaaaaacuugcaaaaagcagauauacuuu

SEQ ID NO: 152769 - RNA, 45 nt, Homo sapiens
cucacuguaaaaaucucaaugcaaaaacacugagacaggagugag

SEQ ID NO: 152770 - RNA, 47 nt, Homo sapiens
cgauuuaaaagcauguaaugccucaggaguccggcauauacaaccaa

SEQ ID NO: 152771 - RNA, 47 nt, Homo sapiens
cuauauccaaaugucuaauuaugcuguuuuuuuaaagggggggguag

SEQ ID NO: 152772 - RNA, 52 nt, Homo sapiens
ucauuacaagcaacaagaaauuauuucugaccauggcuagaguccuggagau

SEQ ID NO: 152773 - RNA, 27 nt, Homo sapiens
guguacuuuaacauauucuuuuggaua

SEQ ID NO: 152774 - RNA, 32 nt, Homo sapiens
uuuaaaagugguauucagaagguaacaucuga

SEQ ID NO: 152775 - RNA, 35 nt, Homo sapiens
gucaaucugcacaauuuuguacauacaugaauccc

SEQ ID NO: 152776 - RNA, 46 nt, Homo sapiens
caacagacaggcacaucuguugagcaaacuguaauugcccaaagcc

SEQ ID NO: 152777 - RNA, 64 nt, Homo sapiens
ccauauuaccaucuugaugucauucuuuauggcacaaacccauccuaaacuuugucccuagacc

SEQ ID NO: 152778 - RNA, 52 nt, Homo sapiens
cuugacauugcuguggaaguaauguauuugcauauuguuugaauauacagcu

SEQ ID NO: 152779 - RNA, 23 nt, Homo sapiens
agcaaugaaauagauuuucuagg

SEQ ID NO: 152780 - RNA, 93 nt, Homo sapiens
caaaggauguugggaaaguacagaacauaaaacauaacaguccugugaggaguggccauagagggcaaaggaugcagaaaauaauuuugagau

SEQ ID NO: 152781 - RNA, 41 nt, Homo sapiens
uuugaaagucucccccauuuccaacugcaaguguauuuuug

SEQ ID NO: 152782 - RNA, 45 nt, Homo sapiens
cgccaugucuacaccuuaagccgcggcucccgaagcaccuagaac

SEQ ID NO: 152783 - RNA, 47 nt, Homo sapiens
ucguaucuuugugaucgggguuucuugauaccauuucugugccauuu

SEQ ID NO: 152784 - RNA, 41 nt, Homo sapiens
gugcuuagauaguacaaauaguaaaugugucaguuuaaaga

SEQ ID NO: 152785 - RNA, 28 nt, Homo sapiens
agaaagaaagaaagaaaggaaagaaaga

SEQ ID NO: 152786 - RNA, 49 nt, Homo sapiens
uuuagaaagguaauauauuaugcaauaaauugcauuuucacuuagaggc

SEQ ID NO: 152787 - RNA, 30 nt, Homo sapiens
cuagauucggacuuguuaagagcaagaugg

SEQ ID NO: 152788 - RNA, 62 nt, Homo sapiens
ugauuaagaauacauugacuuauacauccaguaaguucaguaaaccccaagcaguaugaaua

SEQ ID NO: 152789 - RNA, 42 nt, Homo sapiens
uaccucauggucuaguauauguauaauugcaauuacagaggu

SEQ ID NO: 152790 - RNA, 66 nt, Homo sapiens
uuuaucagcaauggauguuagaauuuguuaaauacuuuuaggugccuauuuagaugauuguuaagu

SEQ ID NO: 152791 - RNA, 27 nt, Homo sapiens
ucaauuucugugaaaaagccuauuggg

SEQ ID NO: 152792 - RNA, 44 nt, Homo sapiens
ugguauauuuggcauacaauaaacugcauauaguuaacuuuuaa

SEQ ID NO: 152793 - RNA, 45 nt, Homo sapiens
agacggaguauauuaggcuugccugauuaaaauuguucaugagag

SEQ ID NO: 152794 - RNA, 48 nt, Homo sapiens
ugugagugggaaaaaaauaucuaaaaccacugugaauuguaagaaugu

SEQ ID NO: 152795 - RNA, 45 nt, Homo sapiens
cuuuuaauuaccgcuuaacacuuugaacaggauccuuugucaaaa

SEQ ID NO: 152796 - RNA, 53 nt, Homo sapiens
cuaauaaauaagcaaacaugacuagugcauagaaaaacugugugaggcagaga

SEQ ID NO: 152797 - RNA, 47 nt, Homo sapiens
cucgucuuucugacaccagaauugagauuuucuuaaucugagguauu

SEQ ID NO: 152798 - RNA, 41 nt, Homo sapiens
aagaaucauuaggaagcccaaacagcuucacaguuccggcu

SEQ ID NO: 152799 - RNA, 24 nt, Homo sapiens
agagaacagaccaaacuaaccaca

SEQ ID NO: 152800 - RNA, 48 nt, Homo sapiens
uugcuacuucaauacacagaaaguugaauucacauauccaccacaaaa

SEQ ID NO: 152801 - RNA, 38 nt, Homo sapiens
cgaaacuguugcuccucagcaacauucuagauggaguu

SEQ ID NO: 152802 - RNA, 45 nt, Homo sapiens
uaugacaccaaaggggaaacucuguagcagcuaauacuugaagua

SEQ ID NO: 152803 - RNA, 48 nt, Homo sapiens
aaagcaguuggagagacacugaaaagggcagaaaaaauggguauugac

SEQ ID NO: 152804 - RNA, 34 nt, Homo sapiens
aauuuucacuugauauuugcaagguguauauagg

SEQ ID NO: 152805 - RNA, 37 nt, Homo sapiens
uauggggagacuguauuauauauuuaauuuuuguaug

SEQ ID NO: 152806 - RNA, 107 nt, Homo sapiens
agcaucuaguacugauucaauaaauuuugaagggcagaguagauauuuugaauaguugugccagagaugaaaauaaagucauuguagaauauagaaagaaacaagga

SEQ ID NO: 152807 - RNA, 58 nt, Homo sapiens
guaugauuuugguauaaagaguuggaagagcuuguugggaaauugugaagcagaugga

SEQ ID NO: 152808 - RNA, 49 nt, Homo sapiens
aaaggaauaagguagugcaguugacagguuauuuaaaggguucccagcu

SEQ ID NO: 152809 - RNA, 53 nt, Homo sapiens
guauuggacuacuuaaaaaaugguacaaaauaaaauauaauaaauauaacaua

SEQ ID NO: 152810 - RNA, 30 nt, Homo sapiens
aauugaacagcgugugcacaugaaguguua

SEQ ID NO: 152811 - RNA, 45 nt, Homo sapiens
aucaagguuuuugaacucagcaugagacccagugucuuuuucuag

SEQ ID NO: 152812 - RNA, 50 nt, Homo sapiens
ugaguuaccagaguaacuaaauacuagacugcuguauuuguuggaugugc

SEQ ID NO: 152813 - RNA, 64 nt, Homo sapiens
gguaagugacuuguacaaugacauagaacaucagaauuaggacugucgaacuccagccuccaca

SEQ ID NO: 152814 - RNA, 51 nt, Homo sapiens
ccugacccauuguuaagaaagggagaaaguccagggacaguagcccauauu

SEQ ID NO: 152815 - RNA, 42 nt, Homo sapiens
agcauuucuaaaucaggaaguuuguucuugguuuccggucau

SEQ ID NO: 152816 - RNA, 48 nt, Homo sapiens
ggaucaaucuucccugccuuaugggguuuugugaggauuaaaggagau

SEQ ID NO: 152817 - RNA, 46 nt, Homo sapiens
guucaaaaauauguacugcaguaaauaaaaaaacuaucaaccuauu

SEQ ID NO: 152818 - RNA, 43 nt, Homo sapiens
aacuugaaacguguguauauuucacuuucuuucugguuaagau

SEQ ID NO: 152819 - RNA, 46 nt, Homo sapiens
gugugugugugugugugugugugugugugugugugugcuugugauu

SEQ ID NO: 152820 - RNA, 62 nt, Homo sapiens
acuaaaggagagagagggagagaaagggagaaagugagggagggagggggaacaaagggagg

SEQ ID NO: 152821 - RNA, 25 nt, Homo sapiens
uguaaccaugcuucaucaucacagu

SEQ ID NO: 152822 - RNA, 47 nt, Homo sapiens
ugucucuauugcagcuauugcuuuuaaaauacaaagggaacacagca

SEQ ID NO: 152823 - RNA, 48 nt, Homo sapiens
uuuuaaccagauuugaacagaagaauggccacuuggcccagguagaag

SEQ ID NO: 152824 - RNA, 43 nt, Homo sapiens
cggccuuucggucgcacaugguuaccauggagaaaggggcugg

SEQ ID NO: 152825 - RNA, 42 nt, Homo sapiens
cucugacuuccagaagccaauguccgacagccucuggcccag

SEQ ID NO: 152826 - RNA, 54 nt, Homo sapiens
ggcugugagcuguggacaacucuuagcauauagacaggcacuguccguauuucu

SEQ ID NO: 152827 - RNA, 60 nt, Homo sapiens
gccguuccuuguacaagcucuggaaauggugcuguuggucaauguaggguggcacauaga

SEQ ID NO: 152828 - RNA, 50 nt, Homo sapiens
ucaaggcugaaaaaagcaagaaaaagaaggaagaggaggaagaugaggaa

SEQ ID NO: 152829 - RNA, 45 nt, Homo sapiens
augaagaagaagaugaugaugaugaauaaguugguuguagcgcag

SEQ ID NO: 152830 - RNA, 54 nt, Homo sapiens
agucaguguugcaagauguguuuucuccauucuuagcacuuugugaaagauuga

SEQ ID NO: 152831 - RNA, 46 nt, Homo sapiens
ugugcauucccauaguauguuuuaaaaauuuacacuacuaauucau

SEQ ID NO: 152832 - RNA, 68 nt, Homo sapiens
ggaacuuugaaagcuauuggacuuguuugccucuuugugcauauuuuaauaguaucgacaaauuauag

SEQ ID NO: 152833 - RNA, 81 nt, Homo sapiens
cucuaccucuuuuucuuucuuucugcuaucacuucuguuuccaucuucuaauuugcuguuucaauauuuguaguuuuuaac

SEQ ID NO: 152834 - RNA, 60 nt, Homo sapiens
gcuauaccauauguacuauagccaaauaaaaguucauuuuuuuccucauguugcuagaua

SEQ ID NO: 152835 - RNA, 48 nt, Homo sapiens
gucugaccucaggaguguaguuaaacagcccagcauccuguuauuuca

SEQ ID NO: 152836 - RNA, 52 nt, Homo sapiens
gccucuuuuuuuguauaaauuuagcucuacggauuugcacaggcaaaacaaa

SEQ ID NO: 152837 - RNA, 55 nt, Homo sapiens
cauaaggggcaaggggcagggagaggaaagccuggugccuagaaacaugaaauaa

SEQ ID NO: 152838 - RNA, 50 nt, Homo sapiens
aaguucuuauuuuuuuuuuuaaacaguuuucagcuauugauaagcuugga

SEQ ID NO: 152839 - RNA, 32 nt, Homo sapiens
guguauguguauguguguguacauauacgcau

SEQ ID NO: 152840 - RNA, 45 nt, Homo sapiens
uaaaauguaccuuauaugagaaugcuggguugcaguggcaaauua

SEQ ID NO: 152841 - RNA, 76 nt, Homo sapiens
aacagucagagauuucuguaucauuuaaauuaaaacuaggagaauaaguagaaauuauccaaguuaagaggggaug

SEQ ID NO: 152842 - RNA, 39 nt, Homo sapiens
acucagggaauuggaagaauuuuagagugacugggacau

SEQ ID NO: 152843 - RNA, 28 nt, Homo sapiens
aaaacuacuguagggagagcaacuggga

SEQ ID NO: 152844 - RNA, 45 nt, Homo sapiens
uacuguuuuacagaaguuuagauaaaaggugugaaaaaaagugac

SEQ ID NO: 152845 - RNA, 41 nt, Homo sapiens
ggacagcucaucaugaugcagagggacaggucaggcccaca

SEQ ID NO: 152846 - RNA, 46 nt, Homo sapiens
agagaagaguauuuuaugauuuggaaaggagaaauuaaguccauaa

SEQ ID NO: 152847 - RNA, 40 nt, Homo sapiens
guacuuuuuaaucuuauuauuaaacuaaccccuguggugg

SEQ ID NO: 152848 - RNA, 41 nt, Homo sapiens
ugacugugcugagaacauguauauugacaugaugcucugga

SEQ ID NO: 152849 - RNA, 41 nt, Homo sapiens
cuguuaaagucucaaucagcugacccauuuuugaaccuuga

SEQ ID NO: 152850 - RNA, 56 nt, Homo sapiens
uuugaauuauggcagaugagcuaauguuuuuuuucucuacauaguccuggauauaa

SEQ ID NO: 152851 - RNA, 58 nt, Homo sapiens
gccauuuuuaaacaucauuaagccacaacugcagaagcucagugagauaacagaagag

SEQ ID NO: 152852 - RNA, 47 nt, Homo sapiens
cagcaauauggucagccggaaagaggaggacacagcccaagcagagg

SEQ ID NO: 152853 - RNA, 49 nt, Homo sapiens
uuuauuggcuuggucaugaaguaacagaaauggucacacugaucaugaa

SEQ ID NO: 152854 - RNA, 45 nt, Homo sapiens
ggucauguuguuugcaaccagagauaguuugaacucuuccuuuuc

SEQ ID NO: 152855 - RNA, 57 nt, Homo sapiens
ugauaagcuuuaucugguugaggauguugccuucuguauaguuugucuuuuacaaaa

SEQ ID NO: 152856 - RNA, 71 nt, Homo sapiens
uaaaagaagaagaggaguauuagguuagaaguuguucagcugcuucaccuugcauugaacuguucugagag

SEQ ID NO: 152857 - RNA, 43 nt, Homo sapiens
cuaaaagggucuuuucaagcucuaacaaagucacuaacaaaug

SEQ ID NO: 152858 - RNA, 40 nt, Homo sapiens
ugcuucaagagucuggcuccugcuacuuuuaucugucagg

SEQ ID NO: 152859 - RNA, 53 nt, Homo sapiens
guaggugguucagauccugcguaauggcagcaugaggacuuaaaaggugguuu

SEQ ID NO: 152860 - RNA, 38 nt, Homo sapiens
ucagagcacugagcugccaucugggcuauucuggggua

SEQ ID NO: 152861 - RNA, 65 nt, Homo sapiens
cuguuaccccucuccaucuuaccaaguugaaaaggggaauauuuggccacauaccccucugguuu

SEQ ID NO: 152862 - RNA, 29 nt, Homo sapiens
gcauggcaguucuggauagaagugcaggu

SEQ ID NO: 152863 - RNA, 46 nt, Homo sapiens
ccuucuauguucgagcccacaaagggucaacacuuucucagugguc

SEQ ID NO: 152864 - RNA, 58 nt, Homo sapiens
agagacagcgccaauggcgaggaugacucuuaagcacauagugggguuuagaaaucuu

SEQ ID NO: 152865 - RNA, 46 nt, Homo sapiens
gaaguuucuccaagaaauccuccucauuuccgacucauauccaaag

SEQ ID NO: 152866 - RNA, 46 nt, Homo sapiens
agauaccaaggaaaaccacaaagaggugcauucuccucacagugag

SEQ ID NO: 152867 - RNA, 75 nt, Homo sapiens
auuucucacauaaccccucacauuccugagaucaaugauaguauccgagcucacugugaggagaaugcaccucuu

SEQ ID NO: 152868 - RNA, 91 nt, Homo sapiens
ucagcauaugacuagaacauuccaugacuuggaaggaaaugcaguuaaacgggacucuggaauauggaucaauggguuugauuauacugga

SEQ ID NO: 152869 - RNA, 62 nt, Homo sapiens
ccuuguuugcaguggaacauuuuuuccauauagcuccaauccugcuaauccgaagccaaaga

SEQ ID NO: 152870 - RNA, 56 nt, Homo sapiens
aagagcacaaaaaaaaccaugcuaacuuuaacuuugguaugugcaauuacauuccu

SEQ ID NO: 152871 - RNA, 65 nt, Homo sapiens
aagcagaagaaauggugaaugaauggccaugcaucuuguaaauuugguaucguaagaaacuguag

SEQ ID NO: 152872 - RNA, 73 nt, Homo sapiens
uuuucuucauuuuuuauaugaauaugaauuuagccauacuagauucugugaaauaguguuacguguacuuuau

SEQ ID NO: 152873 - RNA, 78 nt, Homo sapiens
cccuauccucgggagaagugguucugaaaucccaccugauguugugcuggcauccauuuuggcuggcuguacaaugau

SEQ ID NO: 152874 - RNA, 44 nt, Homo sapiens
acuucucccgaggauagggguaaacaucucaaauacugcccaga

SEQ ID NO: 152875 - RNA, 96 nt, Homo sapiens
uuaaaucucaaaaacuguaagaucaaauuuuauaauaggaaaucaugaggaauacaagaagggggcaaaggugcaguacaagaccaacuggagaua

SEQ ID NO: 152876 - RNA, 46 nt, Homo sapiens
uaaccacuucuaugucuccguuugucuguauggaacugcaacugua

SEQ ID NO: 152877 - RNA, 49 nt, Homo sapiens
aguggagaggaaauggagaaaggcaggggauggaccuuauuugagaaau

SEQ ID NO: 152878 - RNA, 42 nt, Homo sapiens
uggauacauuuaucacaccaaguaugacacagcggacagaau

SEQ ID NO: 152879 - RNA, 46 nt, Homo sapiens
cguaaccauugacaauauaccuggaauguucccaaaaucccuguag

SEQ ID NO: 152880 - RNA, 47 nt, Homo sapiens
agcuuucagguauggaguuuagccaaaauaaugagcuccaaaaccua

SEQ ID NO: 152881 - RNA, 42 nt, Homo sapiens
gugcagauuaaaccauaaggcugguuuuucucuggauaggag

SEQ ID NO: 152882 - RNA, 45 nt, Homo sapiens
uugcuagauguuuuaauauucaagaguguguugugugcugagaug

SEQ ID NO: 152883 - RNA, 25 nt, Homo sapiens
uuacccaaauuucuaacagggcagg

SEQ ID NO: 152884 - RNA, 50 nt, Homo sapiens
gagauuauaacuugccuaagguuucacaguuguuuaauggcagaguguga

SEQ ID NO: 152885 - RNA, 42 nt, Homo sapiens
uuggaauacaaguucuuucccuccuacaccugcugccucuag

SEQ ID NO: 152886 - RNA, 45 nt, Homo sapiens
gaagccuugcaucaugcugucauauuucucuuuaauggugcugag

SEQ ID NO: 152887 - RNA, 55 nt, Homo sapiens
gcagcuuuuaugauuuuggcaggaaaacaagcaagaaaggagugggugcaguggg

SEQ ID NO: 152888 - RNA, 59 nt, Homo sapiens
agaggaacugauauagcuaagaucugcuucaaaauaaucaagaaguugggaggguagug

SEQ ID NO: 152889 - RNA, 42 nt, Homo sapiens
ugggagauacucaaggaaaaugaguacaucucaaagaggugg

SEQ ID NO: 152890 - RNA, 53 nt, Homo sapiens
aaauauuuuaauaaauggaaguucaauuuaggggauucccauucauuugacaa

SEQ ID NO: 152891 - RNA, 46 nt, Homo sapiens
gauuaucuugaacacauaaccuccauuggccccaggacuacaggaa

SEQ ID NO: 152892 - RNA, 49 nt, Homo sapiens
ggcuugccuguccccgguuaagcucguggugcagauugggguugccagg

SEQ ID NO: 152893 - RNA, 85 nt, Homo sapiens
gcggccgcgccaccgccggagagggaggcccgagcgcaggagccucugguggaugggugcagcggcggcgggaggacgcggaaga

SEQ ID NO: 152894 - RNA, 54 nt, Homo sapiens
aguagucauuuagcaguagaugugcauuauuaugagaaaacaguucuauaaguc

SEQ ID NO: 152895 - RNA, 48 nt, Homo sapiens
cucuuuaauuaauacucuugguauuuguggugaugggaggaugcuguu

SEQ ID NO: 152896 - RNA, 42 nt, Homo sapiens
guucuuccacacugguuaucauggcuuccacugcaugaagau

SEQ ID NO: 152897 - RNA, 46 nt, Homo sapiens
ggaaaaacuaucgagugcauuagccauauuggucuugcuguuggga

SEQ ID NO: 152898 - RNA, 41 nt, Homo sapiens
ugaucaauccaagcuguauggugcggaggcaagcagaggaa

SEQ ID NO: 152899 - RNA, 45 nt, Homo sapiens
ccagaucccaaaacaacuauuuuaggaagcaaagagaucccgggu

SEQ ID NO: 152900 - RNA, 41 nt, Homo sapiens
ugaaaccagagaacaaauucuggccaacgauugcccggauu

SEQ ID NO: 152901 - RNA, 46 nt, Homo sapiens
gccuguggcagggacccucaugguggagcccacugagucggaggac

SEQ ID NO: 152902 - RNA, 29 nt, Homo sapiens
guccuccaaucauugucacaaucagggca

SEQ ID NO: 152903 - RNA, 46 nt, Homo sapiens
gaauaggaccaaauaaccagaagugcugguuaaaaugcuccccaga

SEQ ID NO: 152904 - RNA, 46 nt, Homo sapiens
acagcuaccacucugaaacaaacauuguccgguacaugaagaaacu

SEQ ID NO: 152905 - RNA, 89 nt, Homo sapiens
ugagcuccuuaccaagaagauaagcaggaguuaucuagaccaagauggcacaagagggaaaggaagauggguccgaguguucuagacac

SEQ ID NO: 152906 - RNA, 41 nt, Homo sapiens
ggcugccauguuugcaaucuaccaugguucccaugggcugg

SEQ ID NO: 152907 - RNA, 45 nt, Homo sapiens
uguucauuuauucaccaccuccugagcagugagcacaccagaaau

SEQ ID NO: 152908 - RNA, 60 nt, Homo sapiens
gaaagaaguguaucgucuugcucuucaaaccagggagcaacacauucggagagacaaggc

SEQ ID NO: 152909 - RNA, 63 nt, Homo sapiens
uuuugcuguccgagaaagcuuggugagaaugaugccuggaagaaugguggggguaacaaggua

SEQ ID NO: 152910 - RNA, 84 nt, Homo sapiens
cugugcuacugaccuuuuagcuuugugcaucuugaggccaccuggagaauuugggguagacaucgcccugggcagcucccagag

SEQ ID NO: 152911 - RNA, 45 nt, Homo sapiens
ggaguccucacugagcugaaguuacccugugaaauggacuucagu

SEQ ID NO: 152912 - RNA, 46 nt, Homo sapiens
ggaucacccaguauacuccauaccagccugaggugucucaggggag

SEQ ID NO: 152913 - RNA, 45 nt, Homo sapiens
ugaaauccuugcaacucugcaugccauuucaagcaaaaaccagau

SEQ ID NO: 152914 - RNA, 66 nt, Homo sapiens
ugaggagagcgguaaccccugagggucaggaaggacugaaugaggcgugguauuaauuggcugagc

SEQ ID NO: 152915 - RNA, 126 nt, Homo sapiens
guuuuccgacaaauucaugagaauuagugaaauuucccagggauggaguguggggaagaaagaaaagccaggauauaaggaaauaaaacaugcagaaggagagaggcagggcagucugagaugaag

SEQ ID NO: 152916 - RNA, 47 nt, Homo sapiens
gaagacuggguaggaagagucuuacaguacagaacagaucuaagaga

SEQ ID NO: 152917 - RNA, 37 nt, Homo sapiens
uguccugcucaagugaauccugcauuccccauccaca

SEQ ID NO: 152918 - RNA, 36 nt, Homo sapiens
auucaaacccaggcagcccagcuccacuguccacac

SEQ ID NO: 152919 - RNA, 26 nt, Homo sapiens
gggguauuuuuauguggguauuugac

SEQ ID NO: 152920 - RNA, 49 nt, Homo sapiens
gaggggccaagagcgcggcugacccuugcgggccggggcaggggacggu

SEQ ID NO: 152921 - RNA, 41 nt, Homo sapiens
agggggaaggauggagaagucaaguugugaggguaccaaga

SEQ ID NO: 152922 - RNA, 41 nt, Homo sapiens
agaggguggccgccgagagccgccgcuaccaucgcgacaaa

SEQ ID NO: 152923 - RNA, 45 nt, Homo sapiens
gcccuugaggggucuaggaaagagaagcugaugccugcagggaga

SEQ ID NO: 152924 - RNA, 45 nt, Homo sapiens; identical to SEQ ID NO: 139495

SEQ ID NO: 152925 - RNA, 46 nt, Homo sapiens; identical to SEQ ID NO: 139496

SEQ ID NO: 152926 - RNA, 45 nt, Homo sapiens
gagauuuuuugaucacugugagaaguuuuuaacugaaguagaaaa

SEQ ID NO: 152927 - RNA, 42 nt, Homo sapiens
uaauucaaguagccuuuuucaccuguucauuugaccuggcaa

SEQ ID NO: 152928 - RNA, 45 nt, Homo sapiens
uuguuucaggauaucuuucagcacuuggacaaagcaguugaacag

SEQ ID NO: 152929 - RNA, 107 nt, Homo sapiens
gguguagacaguggagcagcugggcugugugguguagacaaaggaccagacaguggagcagcugggcugugugguguagacaguggagcagcugggcuguguggugu

SEQ ID NO: 152930 - RNA, 72 nt, Homo sapiens
agacaguagacaguggagcagcugggcugugugguguagacaguggagcagcugggcugugugguguagaca

SEQ ID NO: 152931 - RNA, 106 nt, Homo sapiens
guguagacaguggagcagcugggcugugugguguagacaguggagcagcugggcugugugguguagacaguggagcagcugggcugugugguguagacaguggagc

SEQ ID NO: 152932 - RNA, 185 nt, Homo sapiens
agcugggcugugugguguagacaguggagcagcugggcugugugguguagacaguggagcagcugggcugugugguguagacaguggagcagcugggcugugugguguagacaguggagcagcugggcugugugguguagacaguggagcagcugggcugugugguguagacaguggagcagcug

SEQ ID NO: 152933 - RNA, 155 nt, Homo sapiens
ggcugugugguguagacaguggagcagcugggcugugugguguagacaguggagcagcugggcugugugguguagacaguggagcagcugggcugugugguguagacaguggagcagcugggcugugugguguagacagacaguggagcagcugg

SEQ ID NO: 152934 - RNA, 121 nt, Homo sapiens
gcugugugguguagacaguggagcagcugggcugugugguguagacaguggagcagcugggcugugugguguagacaguggagcagcugggcugugugguguagacaguggagcagcuggg

SEQ ID NO: 152935 - RNA, 49 nt, Homo sapiens
ugggcugugugguguagacaguggagcagcugggcugugugguguagac

SEQ ID NO: 152936 - RNA, 69 nt, Homo sapiens
ggcgacuucccgagcuguuugggcauccccucccugugccauagucuggaaacucggcaguaagcuggg

SEQ ID NO: 152937 - RNA, 52 nt, Homo sapiens
ucauuuuaguucuugauuuauguuaagcuguuggauuggugcuucuccaaau

SEQ ID NO: 152938 - RNA, 47 nt, Homo sapiens
auaugggaauuauaugaguuguguaaagcuguauuugauauuccugg

SEQ ID NO: 152939 - RNA, 38 nt, Homo sapiens
cuuuauacaguccuggcauauaccuuuaauggcuucug

SEQ ID NO: 152940 - RNA, 47 nt, Homo sapiens
ggaaccccuaacagcguacaauuacaaaaaacaaaugcaucggaagu

SEQ ID NO: 152941 - RNA, 47 nt, Homo sapiens
ucgaaccugauauuugugcuuuaccacugugaaaaugcuaagacucc

SEQ ID NO: 152942 - RNA, 87 nt, Homo sapiens
aaacaaaucuauuuagagaaacagcuggcccugcaaauguuuacagaaaugaaauucuuccuacuuauauaagaaaucucacacuga

SEQ ID NO: 152943 - RNA, 45 nt, Homo sapiens
agcccaaagaaaacaguucccagacgcucauauacugcguugcca

SEQ ID NO: 152944 - RNA, 42 nt, Homo sapiens
caaaagcccacguauguggugauggagaagaugaccgggaag

SEQ ID NO: 152945 - RNA, 47 nt, Homo sapiens
ugcacuaacaguacaaugcuuguuaaugguuaauauaggcagggcga

SEQ ID NO: 152946 - RNA, 66 nt, Homo sapiens
caauuaauuuuaucaaaccuaacugugacagcugugauuugacacguuuuaauugcucagguuaaa

SEQ ID NO: 152947 - RNA, 46 nt, Homo sapiens
uacgcaguuuucauguccuugccuuaaagagcucucuagucuaacg

SEQ ID NO: 152948 - RNA, 58 nt, Homo sapiens
uuuuauauccaagaaaaugauaacuuugaagaugcccaguucacucuaguuucaauua

SEQ ID NO: 152949 - RNA, 49 nt, Homo sapiens
ugcuucauuucuguaaaacacuuguuuuucuuucccaggucuuuuguuu

SEQ ID NO: 152950 - RNA, 46 nt, Homo sapiens
uggggccuggaugccccuuggaggcuuuauaauaaaauuauuaauc

SEQ ID NO: 152951 - RNA, 78 nt, Homo sapiens
uauccucccacauacaaugugaaggacaugcuugugccgacugcagucuggagcgggggucacgacuggcuugcagau

SEQ ID NO: 152952 - RNA, 46 nt, Homo sapiens
uguuguguaugucaguaguucauuccuuuuuauuucugaggaucug

SEQ ID NO: 152953 - RNA, 27 nt, Homo sapiens
uuuucuucuguguggauuuaaugagag

SEQ ID NO: 152954 - RNA, 46 nt, Homo sapiens
ggccaagaacaaguguauuaugugggucauucucaaggcaccacua

SEQ ID NO: 152955 - RNA, 42 nt, Homo sapiens
uguggacaggccaagcgcugugcccugugugaaucaucaggu

SEQ ID NO: 152956 - RNA, 45 nt, Homo sapiens
gaggaauaccuaguugagacagaagauggauauauucugugccuu

SEQ ID NO: 152957 - RNA, 50 nt, Homo sapiens
acuucugaagaacaaaucagccuggucaccagcuuuucggaacagcagag

SEQ ID NO: 152958 - RNA, 30 nt, Homo sapiens
auuuuaaaaggaggaauuuauuuucaacag

SEQ ID NO: 152959 - RNA, 46 nt, Homo sapiens
ugaggucaccaagaauucccuggagaaaauccuuccacagcugaaa

SEQ ID NO: 152960 - RNA, 42 nt, Homo sapiens
agucuagucacuuggggaaacuacgccugggucuacuaucac

SEQ ID NO: 152961 - RNA, 46 nt, Homo sapiens
cccagaauucuccucuggacuggcaauugcgauguaccaucuggau

SEQ ID NO: 152962 - RNA, 48 nt, Homo sapiens
ucgcugaguuccuggagacggaauguuaucagacaccauucaauaagg

SEQ ID NO: 152963 - RNA, 42 nt, Homo sapiens
ugcaacaugguuuagaggguuuguccauaagcaaaaaaucaa

SEQ ID NO: 152964 - RNA, 43 nt, Homo sapiens
accucaguauuuggagcaacuaaggaaaauucaugagacagau

SEQ ID NO: 152965 - RNA, 45 nt, Homo sapiens
cucuuucagcacaacagucugugaauccagaauaugcacacagcc

SEQ ID NO: 152966 - RNA, 47 nt, Homo sapiens
cuugaaauguauauguuuuuccugaauugguuagcccguaaguaaaa

SEQ ID NO: 152967 - RNA, 46 nt, Homo sapiens
aagcaaugcacuuuugcuagcaauuucuucuuucucuuguucugau

SEQ ID NO: 152968 - RNA, 45 nt, Homo sapiens
cuuccugggggucaggaagagaugcaauauauaagugagcaauuu

SEQ ID NO: 152969 - RNA, 31 nt, Homo sapiens
ccaaacuaugaaugaguucuucagaaaauau

SEQ ID NO: 152970 - RNA, 61 nt, Homo sapiens
acacuuuuuuauucuuuaagaguuagucaauuaaguaauuacuauguucaauuaaaaaggc

SEQ ID NO: 152971 - RNA, 45 nt, Homo sapiens
ugaucauuuucuguugacacuucacaagagucaaggacuacagau

SEQ ID NO: 152972 - RNA, 45 nt, Homo sapiens
uugggaaucuuaacugucacuggugugguacaaccaggguguuuc

SEQ ID NO: 152973 - RNA, 45 nt, Homo sapiens
ggugacuauguuaauguuuaugcugaggaaaaccuauacccagaa

SEQ ID NO: 152974 - RNA, 94 nt, Homo sapiens
gaaguuaaaaauuuugaaaagucucaguccugauuaagagcaggaaaaauaauggaaacagaaauaggcguacuuuaaaugugcaaaaacugga

SEQ ID NO: 152975 - RNA, 60 nt, Homo sapiens
cgaaugggggugggggcaaggguaagggugagaugcuugggaugagaguguaagggguau

SEQ ID NO: 152976 - RNA, 40 nt, Homo sapiens
cucggcgcccgcgguccauggaccggaaccucgggccgac

SEQ ID NO: 152977 - RNA, 41 nt, Homo sapiens
ugacaucgcugacaaacacuucacaaguuggggagggggaa

SEQ ID NO: 152978 - RNA, 63 nt, Homo sapiens
ggggacggggggugcggguucagggaaagugggagaaugaaaucagccuaucaggcuuuccaa

SEQ ID NO: 152979 - RNA, 46 nt, Homo sapiens
guacccuugggucauuuguguucuggguguggcaggcccaaaagca

SEQ ID NO: 152980 - RNA, 39 nt, Homo sapiens
uaaacauuuuuuuauaacccuugacuguaaccaagaggu

SEQ ID NO: 152981 - RNA, 43 nt, Homo sapiens
acuuaagagaaaagccaagacagaauuuugucagaaaaacuag

SEQ ID NO: 152982 - RNA, 44 nt, Homo sapiens
gaaaaaaaaauuauuguguugucuuuucaauaaaaaugcaagag

SEQ ID NO: 152983 - RNA, 46 nt, Homo sapiens
ucacagguuguaggucauaaagaaggucuggauguuauggagagag

SEQ ID NO: 152984 - RNA, 43 nt, Homo sapiens
cuuuaacauuacuuauauuaccuugcaaaagagaaugaagugu

SEQ ID NO: 152985 - RNA, 48 nt, Homo sapiens
cagacagaaaugcaaagaucaaacugugcaaauauuaaaaaaaugcac

SEQ ID NO: 152986 - RNA, 47 nt, Homo sapiens
cacugacauaauuugauuacauacuaaauaagaggauauguuaauau

SEQ ID NO: 152987 - RNA, 46 nt, Homo sapiens
ugauuaucugaacaaaugagauuuugugguguuuucuuuaacccau

SEQ ID NO: 152988 - RNA, 26 nt, Homo sapiens
cggagagugaaaacuugcugaagaaa

SEQ ID NO: 152989 - RNA, 25 nt, Homo sapiens
gggagaguggcugcacacagcgcuu

SEQ ID NO: 152990 - RNA, 53 nt, Homo sapiens
caucuuucacggccugagaagacucaaaggagccacccagagucugaacagga

SEQ ID NO: 152991 - RNA, 40 nt, Homo sapiens
ugcucauuuugguguuaguggagaggucgcuguucacagc

SEQ ID NO: 152992 - RNA, 46 nt, Homo sapiens
uucaugaacuugcccauuucagcagcaaccccucgggccuauagca

SEQ ID NO: 152993 - RNA, 46 nt, Homo sapiens
gccuucuuaaagugugguaccaaaucugaacauuaucguccagcug

SEQ ID NO: 152994 - RNA, 38 nt, Homo sapiens
cccuuggacacaccaauucaagaaaguggaaccuaucu

SEQ ID NO: 152995 - RNA, 41 nt, Homo sapiens
ggucaugguccuggagguggcaagaaggaugacaaggacaa

SEQ ID NO: 152996 - RNA, 72 nt, Homo sapiens
ucuucucauggaggaagaauucauuagaaaucaggaacaaaugaaaccauuagaagaaaagcaagaggagga

SEQ ID NO: 152997 - RNA, 45 nt, Homo sapiens
acgccauugggacaaaaagauaagacuccaauucugguggugaga

SEQ ID NO: 152998 - RNA, 46 nt, Homo sapiens
aacuuuggauccagcacuuaucagaccaggccgcauugacaggaag

SEQ ID NO: 152999 - RNA, 48 nt, Homo sapiens
gccuuaagagaacguagaaugaaaguaacaaaugaagacuucaaaaaa

SEQ ID NO: 153000 - RNA, 48 nt, Homo sapiens
ucaucuuuuuauaugugucuucgguucuagacuucagcuuuuggaaau

SEQ ID NO: 153001 - RNA, 58 nt, Homo sapiens
uuugugucugagaccacaccccaguagcagguuacgccaugucaccgagccccauuga

SEQ ID NO: 153002 - RNA, 45 nt, Homo sapiens
gccagccgggaaggggcgggacgaacccaacaugaaccccaagcu

SEQ ID NO: 153003 - RNA, 71 nt, Homo sapiens
auuagugguauucagguuagucuggguccaagugaaguuacauaggaagguguguggggagacaaggagac

SEQ ID NO: 153004 - RNA, 46 nt, Homo sapiens
aacuugacuugcgucacacgaucauuccugcaaaaucaccagagaa

SEQ ID NO: 153005 - RNA, 48 nt, Homo sapiens
gaugcucugauuguccaggcucuagaguuagugacagaggcagcuucu

SEQ ID NO: 153006 - RNA, 46 nt, Homo sapiens
cuaccugcgugugaucaucuggaacaccaaggacguuaucuuggac

SEQ ID NO: 153007 - RNA, 41 nt, Homo sapiens
uuagggaaaacuucagauguggguggauguuuuccccaaga

SEQ ID NO: 153008 - RNA, 47 nt, Homo sapiens
uguagagugcuugaugaauuguagagcccugagcccuagagauuagu

SEQ ID NO: 153009 - RNA, 45 nt, Homo sapiens
ucacauccucaggacucaggggcuggucccugagcacguggaaac

SEQ ID NO: 153010 - RNA, 53 nt, Homo sapiens
uuccauugcagaagccaacaaaauccugcaccagcaccucggggccccugaag

SEQ ID NO: 153011 - RNA, 46 nt, Homo sapiens
gcugcuucaaaaugucgccagauucaaaggcuucccacaacccauc

SEQ ID NO: 153012 - RNA, 69 nt, Homo sapiens
cagaaccuuuaguuuguccagaagaacugcaaaagaagugguucucaaccuuauuugacugaagaauuc

SEQ ID NO: 153013 - RNA, 41 nt, Homo sapiens
aaaaauaacacugggcaaaaaagucauugaagaccgagauc

SEQ ID NO: 153014 - RNA, 44 nt, Homo sapiens
uggucucaaauccuucucaguacagccucccaccaagcaaucac

SEQ ID NO: 153015 - RNA, 46 nt, Homo sapiens
ggaagccugucgucggccagugcaccaucgagcgccuggaccgcuu

SEQ ID NO: 153016 - RNA, 54 nt, Homo sapiens
ucuuugguccauugaggcuacccucugguuguuaaagaugugagagcaucagau

SEQ ID NO: 153017 - RNA, 46 nt, Homo sapiens
gauggcuccaaccuucccauucuucccccucaaagggcgccaaauc

SEQ ID NO: 153018 - RNA, 46 nt, Homo sapiens
ggacaucacacccaaacuucucuggcacccaguaaugaauggagac

SEQ ID NO: 153019 - RNA, 46 nt, Homo sapiens
cauaugcucauaucuguuuccuccaucggagcaaaaccacugagau

SEQ ID NO: 153020 - RNA, 33 nt, Homo sapiens
gagaaaauguaccacacucauagacggcgaagg

SEQ ID NO: 153021 - RNA, 45 nt, Homo sapiens
gaaugggaagaugaugcauggucuuaugacauaaaucgagcggug

SEQ ID NO: 153022 - RNA, 55 nt, Homo sapiens
uggucuagguuuaaaugcauauaaaauuuugauaaaauuuuauaaccuucaaaaa

SEQ ID NO: 153023 - RNA, 48 nt, Homo sapiens
caacaaguaguaguauuaucuccacuuugcaaaugaggaaacugagau

SEQ ID NO: 153024 - RNA, 47 nt, Homo sapiens
agaagauagcccauaacaaagguagucagugccugagcucacaagau

SEQ ID NO: 153025 - RNA, 46 nt, Homo sapiens
acccaccacacuggcaaaucucuacccuuuccaugguugccaugau

SEQ ID NO: 153026 - RNA, 46 nt, Homo sapiens
gcuuuccuauggcuuaugcaaaucaucuucucaguggauucaucag

SEQ ID NO: 153027 - RNA, 50 nt, Homo sapiens
caugucaugugaccccaagccuuaaggucccuuaggauaacaguuccuuu

SEQ ID NO: 153028 - RNA, 50 nt, Homo sapiens
uucacaugugcuugcucaugaauacuuuuuucuuacuguccugccccagu

SEQ ID NO: 153029 - RNA, 46 nt, Homo sapiens
ggagaaaaacaacgggccaaaggugccuguggaguugcgagugaac

SEQ ID NO: 153030 - RNA, 47 nt, Homo sapiens
acaaggcaaugccuuucuuccuuucauucuagugaauguuggggaaa

SEQ ID NO: 153031 - RNA, 88 nt, Homo sapiens
cagcuuucaaucaaggacaccuccuuagaugucuuugugacauuaauauaaacauggcauugugaaugcuuugcuuucuggcaugaau

SEQ ID NO: 153032 - RNA, 45 nt, Homo sapiens
ccugaauuugaaccuugguucuaccauguauaacauugggcaagu

SEQ ID NO: 153033 - RNA, 46 nt, Homo sapiens
ccacacuggcagaaauugaggacuggcuugauaaauuaaugcagcu

SEQ ID NO: 153034 - RNA, 46 nt, Homo sapiens
aacgucacaguucucgauacucagauccgaaagcugcgguccaggu

SEQ ID NO: 153035 - RNA, 35 nt, Homo sapiens
acagggaaguuccgaaagaaaagcauauugaaugc

SEQ ID NO: 153036 - RNA, 57 nt, Homo sapiens
ccugcaaaccagcuggcugaauuguggcugaagcugauagaugaaguuauagaagac

SEQ ID NO: 153037 - RNA, 47 nt, Homo sapiens
uccaucccuucaguuugguuucauuguacugacaaccucagcuggca

SEQ ID NO: 153038 - RNA, 24 nt, Homo sapiens
cacugaaccuuaugucugcucaua

SEQ ID NO: 153039 - RNA, 48 nt, Homo sapiens
ggcuuuguuccaacguuuggaccuuguuaccugaaucuuuauggaagc

SEQ ID NO: 153040 - RNA, 40 nt, Homo sapiens
ucaucacccauuacaguguaaaaguguggaagauagagau

SEQ ID NO: 153041 - RNA, 30 nt, Homo sapiens
caaugaaggcaaggaaaaguccuugaaaug

SEQ ID NO: 153042 - RNA, 45 nt, Homo sapiens
ucagugugugaaaaaauaaaacuaacaauauaugacuggugaguu

SEQ ID NO: 153043 - RNA, 55 nt, Homo sapiens
caaaugcucuaucaaccuuaucucuugcuuuuuuacauuaaucuaauguuagaag

SEQ ID NO: 153044 - RNA, 38 nt, Homo sapiens
aauguuagcagggaaggccugcccauguggcugcggua

SEQ ID NO: 153045 - RNA, 52 nt, Homo sapiens
caaugacuagaagucugccacuauuguauuaugaaauauauucagcaagaga

SEQ ID NO: 153046 - RNA, 45 nt, Homo sapiens
aaagucagcauguuuguccugggaaccggagaugagccuccugug

SEQ ID NO: 153047 - RNA, 30 nt, Homo sapiens
uagagagucuuguuugaguuacacgaggac

SEQ ID NO: 153048 - RNA, 44 nt, Homo sapiens
gacucuguuagauguuaaauuucuugguuaugauaaugguguug

SEQ ID NO: 153049 - RNA, 50 nt, Homo sapiens
aacauaaggccuguggucaaaguucacgucuguggccagacacaccgaac

SEQ ID NO: 153050 - RNA, 71 nt, Homo sapiens
caccugaggauccuaaggaucccacgugcugggaaagguuggguaaccaucccccuucugugcugcagauc

SEQ ID NO: 153051 - RNA, 46 nt, Homo sapiens
guugggacggugucggaagcucagcuugcucggaggcucaccaaag

SEQ ID NO: 153052 - RNA, 47 nt, Homo sapiens
cuaaccugggguagggguaaagcaaagacauggaggaaguggggugc

SEQ ID NO: 153053 - RNA, 46 nt, Homo sapiens
uuaaggaauucuuucuuagagcuuuuauaugaagaugacaaaaggu

SEQ ID NO: 153054 - RNA, 46 nt, Homo sapiens
cacauccaaaugaccugagcgggcccagcgugccaggcaugggagg

SEQ ID NO: 153055 - RNA, 38 nt, Homo sapiens
ggcucuaggcauuucggaggucacagauuaugcaacag

SEQ ID NO: 153056 - RNA, 354 nt, Homo sapiens
acaucuugcugggcgcgguggcucacgccuguaaucccagcacuuugggaggcugaggcgggcggaucuugaggucaggagauccagaccauccuggcuaacauggugaaaccccaucucuacuaaaaauacaaaaaauuagccaggcaugguggcacgugccuguagucccaucuacuugggaggcugaggcagaagaaucgcucgaauccaggaggccgagguugcagugagccaagaucgcgccacugcacuccagccugggcaacagagcaagacuccaucucaaaaaaaaaaaaauuaaaaaaauaaguacaucuuaauauuuucugaugcaagaccagaauucucuuu

SEQ ID NO: 153057 - RNA, 51 nt, Homo sapiens
cuauaauauucuagcauuuuuauagcauuaguaauagaaaagaaaaaagac

SEQ ID NO: 153058 - RNA, 44 nt, Homo sapiens
cagacacacuucauaguguggaguggggcaggguaugguaaacu

SEQ ID NO: 153059 - RNA, 42 nt, Homo sapiens
ugccagcaauaucccuaaaacgaaauuuggcaagccggaucc

SEQ ID NO: 153060 - RNA, 48 nt, Homo sapiens
caaauguuacugaauagaauggaugagaaaaccauguggggaauuuua

SEQ ID NO: 153061 - RNA, 47 nt, Homo sapiens
cugauaucuaucuauugaucgauucuagcucuugauuagccgcuuug

SEQ ID NO: 153062 - RNA, 45 nt, Homo sapiens
agacuacgacacguaugccgugcaguacuccugccgccuccugaa

SEQ ID NO: 153063 - RNA, 24 nt, Homo sapiens
guggcauccuccagaggacugaga

SEQ ID NO: 153064 - RNA, 41 nt, Homo sapiens
auuucgucaucugcaaagugaaacgaucauagaaccuaccu

SEQ ID NO: 153065 - RNA, 48 nt, Homo sapiens
gccaauguuaauauaauauuuggacaggagagggcucucuugcuccag

SEQ ID NO: 153066 - RNA, 274 nt, Homo sapiens
uuguaacacugauuuuauuuauaauggccugugugacuuuuuuuacuaguuuaugaguuucuagaaaugagaaagauugucauauaucuguguucucagagccuagcauggugcugugcaccuauacuuagaacugccugcuuuuucuuuagcaguccuuaagcucgcuaagacucaauuucuucauguguaaaauggucuugauuccuuuuagaauuguucagaaguugaaacgagauaauucauuaagcaguuugcauaguacuuggcacau

SEQ ID NO: 153067 - RNA, 60 nt, Homo sapiens
auaggggugaggugcauaccuggccuucauacuggucaagcuuauuguggaaacucaaau

SEQ ID NO: 153068 - RNA, 79 nt, Homo sapiens
uuucauuuuaugguaguugagaggaaacuggcugagaauuuagauaugaacuuaaagugacuuacaggaguuuuaagaa

SEQ ID NO: 153069 - RNA, 54 nt, Homo sapiens
agcuucccaaagucucaaagaacuuuucagccucaguuuuuuacauuuuuagca

SEQ ID NO: 153070 - RNA, 43 nt, Homo sapiens
auuccuauggaaugaggaggacgaaauggacaugacuugguaa

SEQ ID NO: 153071 - RNA, 45 nt, Homo sapiens
acaaaguucguaaaugacuauauuuuauacuaugguggcaaaaaa

SEQ ID NO: 153072 - RNA, 47 nt, Homo sapiens
ugggucggauggagcggccagcgaauaaagaaaugggagagugggag

SEQ ID NO: 153073 - RNA, 46 nt, Homo sapiens
gacaccuggcaucuccguuuuugaguuucuccccgcucuugucagu

SEQ ID NO: 153074 - RNA, 76 nt, Homo sapiens
ggaaagaaggaaacgacgacuccgggggcgaacuuggcacacagggaggaagggaaagggugugugaggagggcug

SEQ ID NO: 153075 - RNA, 47 nt, Homo sapiens
ccaaauagacuguggcagaaccuggacuagaacucaugauucaccau

SEQ ID NO: 153076 - RNA, 42 nt, Homo sapiens
gcuuauagaugugagagccaccaaacagcugggccacaauaa

SEQ ID NO: 153077 - RNA, 45 nt, Homo sapiens
cucacugcuugcucuguaggauuuuuguguucuaacaccccaguu

SEQ ID NO: 153078 - RNA, 60 nt, Homo sapiens
ggacacaguggggauggcuugucucugcucugcaaugucuggggccucugcugggaagau

SEQ ID NO: 153079 - RNA, 57 nt, Homo sapiens
cugaggcuuuuauuggaauuuugucacaguucagugccucccuccacccaauccuau

SEQ ID NO: 153080 - RNA, 45 nt, Homo sapiens
agagauuggcaaauuguguggguaacuggagugugggcaagguag

SEQ ID NO: 153081 - RNA, 45 nt, Homo sapiens
aauaacaaucuugucauucaucccaaacuugcauucaggcaugcc

SEQ ID NO: 153082 - RNA, 1092 nt, Homo sapiens
ucucggaauucuguggguagccaaagucuagaaucucugcaaaaagaagggaaccaucagccccuggacagagcuucuucauuccagccccuacuugggccuacacaucugaccggcacagcucccaaagcccaugugggaucauccgcaagaaagucuucuagcuuuguagcauuuauucugugauuugugcuuuacaggaaaacaauucaaauguuugauuuuuuucaaauagagaaaucaaggccaggugcaguggcucaugccuguaaucccaacacuucgggaggccaaggugggagaaucacuugagcccaggaguucaagaccagccugggcaacauagcgagacccagcucuacaaaaaguaguaaaaaugagccaagcaugguggcaugugccuauggucccagcuacucaggaggcuaaggcuggaggauugcuugagccuaggaggucgaggcuucaguaagcugcaauugcaccacugcacucagcauaggugacaagagcaagacccugucucaaaaaaaaaaaaaaaagaaaagaaaucaauagaagagucacauggccaguggguggcaagucaagaagcuuugagcuguuuucuccagaaaauagacauugggaagguggaaguauucaccuucucuuagaucacacucuacagaggaacagagauaacagugcaccccaagaggcuuguaauaucucacucucccccaggcucugaagcagcugcugagauggaaaacuggguggacaguuagugaacuaagguccaagccacaaaggaaagaggaugaauacaggagguucagccaccaaaccugagucagguuccuagccccuuggaagaucaccugcuggccuauuucuguguucuacuucagaccagccuucaggucuggaugugaacuggccuucugaggggcauagagauccuagcccaagagaccaaauacucaggaaagaaaguucagaguguaccagagccucggaccuacacccaccuucaggccaggcccagccugguuuuuucccacccuacgcccgcugccgugccagcccgccagccucaccauccagcag

SEQ ID NO: 153083 - RNA, 46 nt, Homo sapiens
aucauggcggcagaucagucuccgcggcccaucgcucugagaacag

SEQ ID NO: 153084 - RNA, 42 nt, Homo sapiens
gcccggccacucuccggaucccaagauguccgcccgcccccu

SEQ ID NO: 153085 - RNA, 69 nt, Homo sapiens
ccagcguuggaaggcgccuugcaaaguauuaacagcacuaucaaacuuuaauugcguaguucggaacca

SEQ ID NO: 153086 - RNA, 47 nt, Homo sapiens
cgggccguuccgcuggcaugccuggacacucacccgggaaccggguc

SEQ ID NO: 153087 - RNA, 45 nt, Homo sapiens
cacagcaguguccaguuguucaaccauugcuggagccuccgagcc

SEQ ID NO: 153088 - RNA, 73 nt, Homo sapiens
uguugcuguuccauuuucgucaauaaaaauuuggaguauauauugcuuuuuucaagcaaauguugaagucuac

SEQ ID NO: 153089 - RNA, 33 nt, Homo sapiens
uuuaaagacuccuuuuuucucuccaauuuuucu

SEQ ID NO: 153090 - RNA, 46 nt, Homo sapiens
ucgaaucuuuauuuuucugaagaucuuccacacagagauuaguaga

SEQ ID NO: 153091 - RNA, 41 nt, Homo sapiens
gucuuacaucugguguaaaucuuuugaauucagccauccag

SEQ ID NO: 153092 - RNA, 18 nt, Homo sapiens
aagaucauuuguaccugu

SEQ ID NO: 153093 - RNA, 46 nt, Homo sapiens
uuaggaggaacuucaagagcaacaucagacuucagucuucucaaua

SEQ ID NO: 153094 - RNA, 26 nt, Homo sapiens
augcugaauggauacagcaaggcugc

SEQ ID NO: 153095 - RNA, 45 nt, Homo sapiens
agcgggacugcccagaccuuuuaggaugucagaacuucuagaggg

SEQ ID NO: 153096 - RNA, 43 nt, Homo sapiens
ccgcgcuccccgcggggcagccgaaccccggaggaaggggcgg

SEQ ID NO: 153097 - RNA, 46 nt, Homo sapiens
aacagauguagcuuuaaaguucagaauacaacaguuaagacucagu

SEQ ID NO: 153098 - RNA, 45 nt, Homo sapiens
gugacauugugcaaguguuaaauugugugccuuuuguuccugaag

SEQ ID NO: 153099 - RNA, 53 nt, Homo sapiens
aaauugccagaauaaugaaauuuuaaaaaugaagacauacaaaacauaaguac

SEQ ID NO: 153100 - RNA, 47 nt, Homo sapiens
uuaccuugucauggacuggugauagauggcuuaugggccaucagcag

SEQ ID NO: 153101 - RNA, 46 nt, Homo sapiens
acaugaaguugacaaauacagaaaauuauuucagaguaaacagcag

SEQ ID NO: 153102 - RNA, 46 nt, Homo sapiens
gugcuuaagaaaaugaacaaaacacagacuaaaucugaagaccaga

SEQ ID NO: 153103 - RNA, 46 nt, Homo sapiens
aacuagcaguuuccccuaacuauaaugcuacguuuaugggcuucaa

SEQ ID NO: 153104 - RNA, 46 nt, Homo sapiens
agaaaaagaaaugacuuugauaucucaaaggaauaauaugcuucaa

SEQ ID NO: 153105 - RNA, 27 nt, Homo sapiens
uuaccuguugaauccuccaaccaagga

SEQ ID NO: 153106 - RNA, 46 nt, Homo sapiens
caaaauuuagguucuuuuuauaugcagaguccacuuuuaaauucag

SEQ ID NO: 153107 - RNA, 41 nt, Homo sapiens
aagaaaagcaacauugcauagaaaguguaaagaaaaggcaa

SEQ ID NO: 153108 - RNA, 41 nt, Homo sapiens
gugguagaguauuugacaaucaggauacuugggcuggucau

SEQ ID NO: 153109 - RNA, 46 nt, Homo sapiens
uuauauucucugaugaucccuuugcacagaacuaugcuuaucucau

SEQ ID NO: 153110 - RNA, 46 nt, Homo sapiens
accaccugacaccagcggcuugcaucaaaaaggccucaagagaaac

SEQ ID NO: 153111 - RNA, 43 nt, Homo sapiens
uauuaucuucugugccuggggaugggaaaaugcaggcagguaa

SEQ ID NO: 153112 - RNA, 46 nt, Homo sapiens
aaaauuccuugagaaguucgccuacgaucagucuugcuaguagaaa

SEQ ID NO: 153113 - RNA, 36 nt, Homo sapiens
uggcacuauaaaaucaaaaacacuaauucuguggaa

SEQ ID NO: 153114 - RNA, 45 nt, Homo sapiens
ucuuuagcuuucucauuucugagacagcauagucauccagcuuga

SEQ ID NO: 153115 - RNA, 43 nt, Homo sapiens
uucugaaguuuagauguugcuugauaaaccuuugcugcagcag

SEQ ID NO: 153116 - RNA, 46 nt, Homo sapiens
ccugguucuaagccuuugugauucucuuacaucucauugacccaua

SEQ ID NO: 153117 - RNA, 42 nt, Homo sapiens
guuuaaaaaugagaaucgaggcuaauuaauguugauuugaca

SEQ ID NO: 153118 - RNA, 46 nt, Homo sapiens
auccuauauuacuagucaaaauuaguuacauucugaucuaggaaag

SEQ ID NO: 153119 - RNA, 45 nt, Homo sapiens
cuuaggaauccagcuuguacacacuguuuaaaaacccucagggac

SEQ ID NO: 153120 - RNA, 46 nt, Homo sapiens; identical to SEQ ID NO: 65661

SEQ ID NO: 153121 - RNA, 41 nt, Homo sapiens; identical to SEQ ID NO: 65662

SEQ ID NO: 153122 - RNA, 43 nt, Homo sapiens
uagaaugauuucuugugguugauuguaaaagguguauugaaga

SEQ ID NO: 153123 - RNA, 42 nt, Homo sapiens
cuuuaguagaaagucuaauuacaguaaaaauggcagcugaga

SEQ ID NO: 153124 - RNA, 42 nt, Homo sapiens
agucugggaaaggcugaggacaaccaaagcaucagugcugag

SEQ ID NO: 153125 - RNA, 46 nt, Homo sapiens
agacacguaugauacaagcauugacucacucgaagagaauuuggac

SEQ ID NO: 153126 - RNA, 41 nt, Homo sapiens
gggggaucaucaccaggcagacuuugaaaaacaugcuggac

SEQ ID NO: 153127 - RNA, 42 nt, Homo sapiens
uuggaugcuucaaaagugacuucagaaaaggaagcugcacaa

SEQ ID NO: 153128 - RNA, 46 nt, Homo sapiens
gacaccgugguagaugaacagccaaaguuuauggaauggugugcug

SEQ ID NO: 153129 - RNA, 45 nt, Homo sapiens
agccaacaccaagagcaaggaacaaaucagauaaacugaaagaga

SEQ ID NO: 153130 - RNA, 41 nt, Homo sapiens
agucauccuccagcaaaccugcccacuccagccaguacccg

SEQ ID NO: 153131 - RNA, 43 nt, Homo sapiens
gguggaggagcuuaguaaguggugcuacaauugcugugcaaag

SEQ ID NO: 153132 - RNA, 86 nt, Homo sapiens
ggugggggacguauuuggguaccaggguaacgggaggccuacguaauaaacugcagagaucccaucaguaaggucugauugcggcc

SEQ ID NO: 153133 - RNA, 55 nt, Homo sapiens
uucacuccaugguagugccugaaguggccuaaauauucuacccuuuucccuggag

SEQ ID NO: 153134 - RNA, 45 nt, Homo sapiens
uugauugucccaaaaagggauccuguuccccaucuaaggaaggag

SEQ ID NO: 153135 - RNA, 25 nt, Homo sapiens
caacuuguuuucacucaaaauuugg

SEQ ID NO: 153136 - RNA, 43 nt, Homo sapiens
agcuucacacuacugggacagcuauucggccgccgacuugcag

SEQ ID NO: 153137 - RNA, 34 nt, Homo sapiens
auuaguaaauggguguuaagaaaaguuguuuuua

SEQ ID NO: 153138 - RNA, 91 nt, Homo sapiens
aaaggagcuggcuucaagaucgaccaguuauuguuagcgacauggaccuagcuaguuccuaauaugaguacugaguugguaaaagcagaug

SEQ ID NO: 153139 - RNA, 44 nt, Homo sapiens
uuuuuccuuugaauuaccaguuuggggacuggagggaauuagau

SEQ ID NO: 153140 - RNA, 337 nt, Homo sapiens
guuugaaguuuguguuuuauaccccccccuuuuuuuuugagaccgagucucacucugucacccaggcuaaagugcaguggcaugaucucugcucacugcaaccuccaccucccagguucaagcaauucuugugccucagccucccaaguagcuaggauuacaggcgcaugucacaacgcccggcuaauuuuugcauuuuuaguagagacaggguuuuaccauguugaccaggcuggucucgaacuccugaccucaagugaugcaccugccucugccucccagagugcugggauuacaggcgugaggcccugcgcccggccguguuuuacagcuuuuu

SEQ ID NO: 153141 - RNA, 46 nt, Homo sapiens
ccugaaacccugcucuauugcaauucccuauuauauucugcaucag

SEQ ID NO: 153142 - RNA, 70 nt, Homo sapiens
cuuuuccccugcugccucacuccccacccccacuugccagguguuugagccauuucuacaccaaagcaaa

SEQ ID NO: 153143 - RNA, 24 nt, Homo sapiens
agucgugaauggaggccaguuaag

SEQ ID NO: 153144 - RNA, 46 nt, Homo sapiens
uuugggagcaucggagagggucucccaguccagaguuggggguguu

SEQ ID NO: 153145 - RNA, 52 nt, Homo sapiens
ugcagcgaucauuuaugcuugguuuuuaugauuuuuaguuuugauggaucuu

SEQ ID NO: 153146 - RNA, 39 nt, Homo sapiens
uuggcaccaccugaaucuguagguagaauuguguugagg

SEQ ID NO: 153147 - RNA, 45 nt, Homo sapiens
gcguuugaccuuuucaacuugguucucuccuacaagaggcuggag

SEQ ID NO: 153148 - RNA, 47 nt, Homo sapiens
gccucuggguuuaucuaggccuacccugugucucaggcccagcccag

SEQ ID NO: 153149 - RNA, 58 nt, Homo sapiens
cagcaagguucuucuuugugacugaauaagcuccuuccucuggacugcuggacaaccu

SEQ ID NO: 153150 - RNA, 56 nt, Homo sapiens
uucaaaauaaacucucagauaaacucucaaauuuucaaaaacauggacauaagaag

SEQ ID NO: 153151 - RNA, 46 nt, Homo sapiens
cugccugggccucaacgucuuguuccucacuuugaaugaggguaag

SEQ ID NO: 153152 - RNA, 50 nt, Homo sapiens
cugauucaagggucaucuggggacauggcaugaguaaagguacugggaug

SEQ ID NO: 153153 - RNA, 47 nt, Homo sapiens
gcccugcugggcuaccuucaggagguuugccgggcacggcugccuga

SEQ ID NO: 153154 - RNA, 160 nt, Homo sapiens
ccugccccagcccuggaaucagcuuaucuccauguuuccugguuucccuucagaaacccagaucuggguucagauugugcucauggcuucugugguucauccauguuuaaaaaaacaacaaccagaacuccccaagugagucuguuucacaucccaggua

SEQ ID NO: 153155 - RNA, 42 nt, Homo sapiens
gaggcugagccagaugaagaguuuaaagaugcgauugaggug

SEQ ID NO: 153156 - RNA, 70 nt, Homo sapiens
caggccaugcaggcauuugacuuucugauggcuaaaagauugcuccaaaacuuugauauaugauuguaga

SEQ ID NO: 153157 - RNA, 42 nt, Homo sapiens
cuguguguucugguguugagugaguucuagggucugugcccu

SEQ ID NO: 153158 - RNA, 45 nt, Homo sapiens
agaaguauuacucugguccagcaaauaauuugucuauuucuacaa

SEQ ID NO: 153159 - RNA, 73 nt, Homo sapiens
ccuaugggccccacaucccagaaaccucauucucugucucuccucuccccuuacacccccuuguugucuucua

SEQ ID NO: 153160 - RNA, 50 nt, Homo sapiens
ccuggagucaaucaccagccgcaauuuuaaucuuuuucuuauuuccuugg

SEQ ID NO: 153161 - RNA, 56 nt, Homo sapiens
uuuccuuuuauaaaauauaaaauauuuccuauacauauuguaaauaaaaaacacag

SEQ ID NO: 153162 - RNA, 59 nt, Homo sapiens
cugccucuuguccaauggagugggaggccaggugaguggagcagagguccugaagcccu

SEQ ID NO: 153163 - RNA, 47 nt, Homo sapiens
ccugguugaccacagaaguguccguaaacauuuggucaggguaggag

SEQ ID NO: 153164 - RNA, 40 nt, Homo sapiens
cacagcaguagcaauaacuuauugggauaaaagggagaag

SEQ ID NO: 153165 - RNA, 45 nt, Homo sapiens
agcagguugggcagccgcaugcgcuuguagcccaccguguggcag

SEQ ID NO: 153166 - RNA, 51 nt, Homo sapiens
agauaugguaaauaauagguagauguaguauguauauaaauauaauuagau

SEQ ID NO: 153167 - RNA, 55 nt, Homo sapiens
ggcaaauuguauucaauugccaaauuaaucaugaucauauaggagauaaauuugc

SEQ ID NO: 153168 - RNA, 30 nt, Homo sapiens
agaaaacauuaauuaaccguuucaaagagg

SEQ ID NO: 153169 - RNA, 62 nt, Homo sapiens
auuucgcaaggagugaaaaauacgaaggacgcacaacggaccuggccucggggcaaaguggg

SEQ ID NO: 153170 - RNA, 44 nt, Homo sapiens
ucugcauagaaaagucuguauuguuccugagugagggaguuagg

SEQ ID NO: 153171 - RNA, 42 nt, Homo sapiens
ccaaagucauacacacacaagggaccugcauucuuaguauca

SEQ ID NO: 153172 - RNA, 66 nt, Homo sapiens
agaaggauguuggugagggauagacaaugggagacugccaucauuucaguguuuuccacacuuagg

SEQ ID NO: 153173 - RNA, 36 nt, Homo sapiens
uucucuggaguggagacuuguccuaccuguggccau

SEQ ID NO: 153174 - RNA, 48 nt, Homo sapiens
uacgacaguagguggcauccauuacccugucuaaggcaaccuccuucc

SEQ ID NO: 153175 - RNA, 46 nt, Homo sapiens
gauagauaugaucauucuaggucagcacauuaauuaggcauggaug

SEQ ID NO: 153176 - RNA, 47 nt, Homo sapiens
gauaaagucuuaugcuagguaauagacuuagaauaaaaggacuagaa

SEQ ID NO: 153177 - RNA, 43 nt, Homo sapiens
cugauaggcuuaggguucugguugcuaggaaauggguaaagga

SEQ ID NO: 153178 - RNA, 41 nt, Homo sapiens
ggauguagugcucuggagugugagcagcucggggaguggag

SEQ ID NO: 153179 - RNA, 42 nt, Homo sapiens
uaguugucagggucaccucguccuugucucuccaccccggcu

SEQ ID NO: 153180 - RNA, 56 nt, Homo sapiens
ugaaguguuggcugggggggcgcuauucauggagaauccccuccuuaauucugcaa

SEQ ID NO: 153181 - RNA, 55 nt, Homo sapiens
ugacugcagaagccagagaaaugcaagcuagguaaagcaccaacaguaaaaguga

SEQ ID NO: 153182 - RNA, 38 nt, Homo sapiens
uguauagguuuuagguaguuaucuaaaauugucccuga

SEQ ID NO: 153183 - RNA, 22 nt, Homo sapiens
gguugggugggcuggccagagu

SEQ ID NO: 153184 - RNA, 40 nt, Homo sapiens
ucauuuguucuuccaguucgacauucuguacccuguggaa

SEQ ID NO: 153185 - RNA, 98 nt, Homo sapiens
aaauucucuuuauaaaugaauuuuguguucuuuaguucuccuuaaaagaacuuuugaauuauaaaaauaaaaucuuuaccugucgaauuguugcugca

SEQ ID NO: 153186 - RNA, 47 nt, Homo sapiens
uuuguugguugugccaaacacuuuauuugggaaaggaaagcccagau

SEQ ID NO: 153187 - RNA, 46 nt, Homo sapiens
uuucuggagcagugugcugcguaguucggccugaguuugugcagcu

SEQ ID NO: 153188 - RNA, 46 nt, Homo sapiens
cugauuggaggauagagccagcugucugacacacaaauggucuuuu

SEQ ID NO: 153189 - RNA, 60 nt, Homo sapiens
aaauccagauagauucugguuagauacaucuuggcauccugauuuagacaaaacaaaaca

SEQ ID NO: 153190 - RNA, 46 nt, Homo sapiens
uugcacaaguggcaaaaauucgguuucagcagaaagugauggaaaa

SEQ ID NO: 153191 - RNA, 37 nt, Homo sapiens
uuagucuugugagguuucugcuuuuuuucauuugcuu

SEQ ID NO: 153192 - RNA, 48 nt, Homo sapiens
cuuauagcugcacagaaacaaaagguuguggaaaaagaagcugagaca

SEQ ID NO: 153193 - RNA, 42 nt, Homo sapiens; identical to SEQ ID NO: 65754

SEQ ID NO: 153194 - RNA, 45 nt, Homo sapiens
aaaaguaaauguucuggugggauccccaaacguguuaguaggccg

SEQ ID NO: 153195 - RNA, 311 nt, Homo sapiens
caccuaaguggucauauacauguuguuuuguuuuguuuuguuuugagacagggucucccucuguugcccaggcuggagugcaguggcaugaucauaggucacugcagccuugaacuccugggcucaagugauucuccugccuuagccucccaaguagcuaggaguacagguacacacccccacaucuggcuaauuuuuuuauuuuuuguagagaugggccuuugccguguugcccaggcuggucucaaacuccuggccucaugcaauccuccaauauaaguuaaaaauagaaacauaguuuauggcuuuac

SEQ ID NO: 153196 - RNA, 46 nt, Homo sapiens
ggucauaauaaauuucacauaaccgguacaggcacaaauagugaaa

SEQ ID NO: 153197 - RNA, 47 nt, Homo sapiens
gauucaagggcagcuuugagucuuagaguacuuguaugcauaaaauc

SEQ ID NO: 153198 - RNA, 43 nt, Homo sapiens
uauugcuuaagcagauggugguauuuacuuaaaugcagaaguu

SEQ ID NO: 153199 - RNA, 62 nt, Homo sapiens
caggcuaucauaucauguugccuuucauuacuacguucagaucugugcaggugagugauucc

SEQ ID NO: 153200 - RNA, 45 nt, Homo sapiens
ggugggguugguggcuguccugcucuacgccuccauccacaagau

SEQ ID NO: 153201 - RNA, 48 nt, Homo sapiens
ggcugggcuucuucucaguuagugccuuccacccgggagcgacccuug

SEQ ID NO: 153202 - RNA, 46 nt, Homo sapiens
cuccagacauauucaaccuuggggcuugggccuuccuuauccuugu

SEQ ID NO: 153203 - RNA, 23 nt, Homo sapiens
ucacguuccagcuauaccaucca

SEQ ID NO: 153204 - RNA, 43 nt, Homo sapiens
uguuggaaaagauccucaugggguaccuaaucccuaggcaugg

SEQ ID NO: 153205 - RNA, 67 nt, Homo sapiens
uccccuucucuuugacagcuggguguuugcgcacaagcagccaacccacgugagagaagaaaaagcc

SEQ ID NO: 153206 - RNA, 44 nt, Homo sapiens
auaaggacgauauccgaagaggugggcagcacuguucaccagcc

SEQ ID NO: 153207 - RNA, 49 nt, Homo sapiens
auguggugaaguugaugugccagcgguacucacuggcagaguagucaua

SEQ ID NO: 153208 - RNA, 42 nt, Homo sapiens
gcgcccugcugcggucgccgcgagccucggccucugucuccu

SEQ ID NO: 153209 - RNA, 49 nt, Homo sapiens
ggggcaaagugcgaggaguugacuggcgcgggcggucccgcguggaggu

SEQ ID NO: 153210 - RNA, 53 nt, Homo sapiens
gcagcggauaaaagggggcugaggaaauaccggacacggucacccguugccag

SEQ ID NO: 153211 - RNA, 48 nt, Homo sapiens
aagugaucccggcauccgagagccaagaugccggcccacuugcugcag

SEQ ID NO: 153212 - RNA, 41 nt, Homo sapiens
uugggaauguggauuguaauuuggggacuugagucuccaac

SEQ ID NO: 153213 - RNA, 41 nt, Homo sapiens
cucuagcuccuauaccaccaccaccaccauuacagcgccuc

SEQ ID NO: 153214 - RNA, 108 nt, Homo sapiens
uggagacgaugccccucuacuuggaagacgacauucgcccugauauaaaagaugauauauaugaccccaccuacaaggauaaggaaggcccaagccccaagguugaau

SEQ ID NO: 153215 - RNA, 61 nt, Homo sapiens
augucuggagaaacaucauccuuaugucucugcuacacuugggagcccuguaugggaucac

SEQ ID NO: 153216 - RNA, 43 nt, Homo sapiens
uugcuucaggccuagugggcugggaagaaccuggggguacuga

SEQ ID NO: 153217 - RNA, 61 nt, Homo sapiens
gaagcucccgugcaacccaagucacacagguguguguugcucuguuacucuacauuccagg

SEQ ID NO: 153218 - RNA, 31 nt, Homo sapiens
acagcuugaagaauaucccaccauugucuag

SEQ ID NO: 153219 - RNA, 45 nt, Homo sapiens
ugcccugggcauaacagcaggagcucaucgucuguggagccaccg

SEQ ID NO: 153220 - RNA, 46 nt, Homo sapiens
uuuguaagagcgguggcuccacagacgaugagcuccugcuguuaug

SEQ ID NO: 153221 - RNA, 75 nt, Homo sapiens
ucuaugaaugggcucgugaccaccgugcccaccacaaguuuucagaaacacaugcugauccucauaauucccgac

SEQ ID NO: 153222 - RNA, 45 nt, Homo sapiens
gcugucaaagagaaggggaguacgcuagacuugucugaccuagaa

SEQ ID NO: 153223 - RNA, 49 nt, Homo sapiens
acggauagaaauuuuuacaacuauguguggggagagacagugcaaacag

SEQ ID NO: 153224 - RNA, 46 nt, Homo sapiens
agcgugggcaggaugaagcacaucaucagcaagccagguuuguagu

SEQ ID NO: 153225 - RNA, 46 nt, Homo sapiens
cuggcuggugaacagugcugcccaccucuucggauaucguccuuau

SEQ ID NO: 153226 - RNA, 48 nt, Homo sapiens
cuugucauaaggacgauauccgaagaggugggcagcacuguucaccag

SEQ ID NO: 153227 - RNA, 62 nt, Homo sapiens
cagaaaaacuagauaaaucuguuuuuuauggcuacuuuguaucucaguuuuuccacuauaaa

SEQ ID NO: 153228 - RNA, 43 nt, Homo sapiens
guuagcuagcaggguaccucacaccugggagaaacucgcuauu

SEQ ID NO: 153229 - RNA, 70 nt, Homo sapiens
ccacaacuaccaccacuccuuucccuaugacuacucugccagugaguaccgcuggcacaucaacuucacc

SEQ ID NO: 153230 - RNA, 86 nt, Homo sapiens
uaggccagaccgagggcggccaugcaaucaaugaagaauguggugaaguugaugugccagcgguacucacuggcagaguagucaua

SEQ ID NO: 153231 - RNA, 51 nt, Homo sapiens
uguaguuuccaucuccgguucuuuuaauccuggccaagauggcggccuugg

SEQ ID NO: 153232 - RNA, 32 nt, Homo sapiens
caggauuaaaagaaccggagauggaaacuaca

SEQ ID NO: 153233 - RNA, 51 nt, Homo sapiens
acaucaucaucuuuagcauccugguagcauuauucaguaguuaauaaacag

SEQ ID NO: 153234 - RNA, 47 nt, Homo sapiens
ugaugauguuaacccauuccaguacaguauucuuuuaaaauucaaaa

SEQ ID NO: 153235 - RNA, 61 nt, Homo sapiens
gacaaugggccuagaagagagagaggauaagagaagaaauaauaucagcuuagcaucauaa

SEQ ID NO: 153236 - RNA, 44 nt, Homo sapiens
cuaucgcccuccuuucccuuauugccucccaggcaagcagcugg

SEQ ID NO: 153237 - RNA, 44 nt, Homo sapiens
gcuuuggaagcuggacacugagcaaagacugaccagcugcuugc

SEQ ID NO: 153238 - RNA, 50 nt, Homo sapiens
aucuucuggguaguccccuguugauuaucuucagcccaggcuuuugcuag

SEQ ID NO: 153239 - RNA, 47 nt, Homo sapiens
ucauuugacacaaagcuucuaaagcagguaaauugucgggggagaga

SEQ ID NO: 153240 - RNA, 39 nt, Homo sapiens
uaauucaaugccgcaacauauaguugaggccgaggauaa

SEQ ID NO: 153241 - RNA, 44 nt, Homo sapiens
gauuucuuaguucauauaucaagaagucuugaaguuggguguuu

SEQ ID NO: 153242 - RNA, 48 nt, Homo sapiens
aacauccaaaaaaagggaaggauuuaaggaggugaagucgggucaaaa

SEQ ID NO: 153243 - RNA, 65 nt, Homo sapiens
ggggcuugagaagguuacugagugaguuauugggagucuuaauaaaauaaacuagauauuagguc

SEQ ID NO: 153244 - RNA, 99 nt, Homo sapiens
agagaaagaucuggucaaagaaaagggacagacaggguagagccaggaaucaagaaucaggguagugaagagauuccuaacccugccccccaggcaguu

SEQ ID NO: 153245 - RNA, 70 nt, Homo sapiens
gccuggggggcaggguuaggaaucucuucacuacccugauucuugauuccuggcucuacccugucugucc

SEQ ID NO: 153246 - RNA, 59 nt, Homo sapiens
uagcucuacuuucaaaagagaagcagugguucagugacccugagcauucugugugcagg

SEQ ID NO: 153247 - RNA, 39 nt, Homo sapiens
cugccacacugauggcucaagacaaggcuggcaaacccu

SEQ ID NO: 153248 - RNA, 55 nt, Homo sapiens
uaggaggaaacaguucucacugggaagaagcaagggcaagaacccaagugccuca

SEQ ID NO: 153249 - RNA, 94 nt, Homo sapiens
ggauuugagauaccacaaacccugcugaacacagugucuguucagcaaacuaaccagcauucccuacagccuagggcagacaauaguauagaag

SEQ ID NO: 153250 - RNA, 50 nt, Homo sapiens
aaaggaucuaagggaagaucacuguaguuuaguucuguugaccugugcac

SEQ ID NO: 153251 - RNA, 61 nt, Homo sapiens
aggaacacgauuuucaagauucuaaagcucaauucaagugacacauuaaugauaaacucag

SEQ ID NO: 153252 - RNA, 86 nt, Homo sapiens
auuaucaguaucacgauuugcaggauucccuucugggcuucauucuggaaacuuuuguuagggcugcuuuucuuaagugcccacau

SEQ ID NO: 153253 - RNA, 57 nt, Homo sapiens
uuucuccuugguuugcuaguaucuuggguguauucucuguaaguguagcucaaauag

SEQ ID NO: 153254 - RNA, 47 nt, Homo sapiens
guaggucaguauuauuauccccauuuuaacagaaggaaaacugaggc

SEQ ID NO: 153255 - RNA, 47 nt, Homo sapiens
guccgugugucccagaugcugucauuagucuauaugguucuccaaga

SEQ ID NO: 153256 - RNA, 49 nt, Homo sapiens
aaguaacuacuauaucccacauaaaaagggaaaaaaucccacccaauca

SEQ ID NO: 153257 - RNA, 46 nt, Homo sapiens
cugccagccaggcccgggcaggccggcccuuuagcggaggggacug

SEQ ID NO: 153258 - RNA, 46 nt, Homo sapiens; identical to SEQ ID NO: 153202

SEQ ID NO: 153259 - RNA, 35 nt, Homo sapiens
guugcuucaggccuagugggcugggaagaaccugg

SEQ ID NO: 153260 - RNA, 51 nt, Homo sapiens
aauaucucucuuccuuccuuuugcuccacaggacaacuuuggaagccuuca

SEQ ID NO: 153261 - RNA, 39 nt, Homo sapiens
aaaagauccucaugggguaccuaaucccuaggcaugggg

SEQ ID NO: 153262 - RNA, 41 nt, Homo sapiens
ucugccagugaguaccgcuggcacaucaacuucaccacauu

SEQ ID NO: 153263 - RNA, 46 nt, Homo sapiens
aagaauguggugaaguugaugugccagcgguacucacuggcagagu

SEQ ID NO: 153264 - RNA, 27 nt, Homo sapiens
acagguuaaugacuguggcaacuccca

SEQ ID NO: 153265 - RNA, 48 nt, Homo sapiens
acacagacacugccaccaaacaauacucaaauuccuccaacucagugu

SEQ ID NO: 153266 - RNA, 45 nt, Homo sapiens
aaauagagaggauggcuauuugauagaguuauaguugaauucgaa

SEQ ID NO: 153267 - RNA, 38 nt, Homo sapiens
gagggaaacagagagaaauagauuggaaagcuaggaua

SEQ ID NO: 153268 - RNA, 47 nt, Homo sapiens
uuccacagagcaacugauagcuuauugaauuuuggugacuaugucag

SEQ ID NO: 153269 - RNA, 35 nt, Homo sapiens
auggggaaggaggaggaagagagagagcugaacua

SEQ ID NO: 153270 - RNA, 56 nt, Homo sapiens
ggggaggggcggcaggcggggcugggggcggcgggcccgggccugagggucccgcc

SEQ ID NO: 153271 - RNA, 41 nt, Homo sapiens
gggcgccaggaggcuucgcuggaggggcugggccaaggaga

SEQ ID NO: 153272 - RNA, 44 nt, Homo sapiens
gaucacaugccuuucugcaucaaaugcaaacuccauggugagag

SEQ ID NO: 153273 - RNA, 43 nt, Homo sapiens
uuccuggggaggcccagacuaacaagacccccaaagggagcca

SEQ ID NO: 153274 - RNA, 23 nt, Homo sapiens
ccucuuucuauucuuggaacucc

SEQ ID NO: 153275 - RNA, 46 nt, Homo sapiens
uuguagccuuggcugcgcaaugaaucugugauacacuggcgugggg

SEQ ID NO: 153276 - RNA, 35 nt, Homo sapiens
uccuaaucucuaccucagacuucucuccugagugc

SEQ ID NO: 153277 - RNA, 45 nt, Homo sapiens
acagggacaucaaaaaguugggagaaggguauggaguggggguaa

SEQ ID NO: 153278 - RNA, 45 nt, Homo sapiens
gagcaccgaugggccugggcugcucacaugugggucuguggagac

SEQ ID NO: 153279 - RNA, 50 nt, Homo sapiens
ccugcagagcccugccugggagaaagagaaaggguuugggcagaugaaug

SEQ ID NO: 153280 - RNA, 146 nt, Homo sapiens
cccaggcuggcccguucccaagcucuugacaaagaggucaccacauggggcuggggaagaggaccagauaggauguggcaauugggaggguaccccaaguccagaagcagggaugaaacaagaaugcaccaggagaaggugagggu

SEQ ID NO: 153281 - RNA, 69 nt, Homo sapiens
cucauacucuugagaaugaccaaggagaguggggaggcugauucacaagggccacacaggaagggagag

SEQ ID NO: 153282 - RNA, 43 nt, Homo sapiens
cuccgcucuacuacuccgagcuccgccgcgccggcccccagcc

SEQ ID NO: 153283 - RNA, 45 nt, Homo sapiens
ccuucaagauacgauugaggucuggaaagcggcuccagcggaggc

SEQ ID NO: 153284 - RNA, 45 nt, Homo sapiens
aauggcauugaaggacugauucacccacugccagaacaccacggu

SEQ ID NO: 153285 - RNA, 46 nt, Homo sapiens
uguucccucccugcaccccaccccauccuuggagauaggcccuagg

SEQ ID NO: 153286 - RNA, 41 nt, Homo sapiens
agcacaggagggguuaugugcucugaucuuugaaaccagag

SEQ ID NO: 153287 - RNA, 42 nt, Homo sapiens
gucacaccuguagccuggcuggcaggcagguggacaugaggc

SEQ ID NO: 153288 - RNA, 42 nt, Homo sapiens
uaaaggggaaugcuugcucugccucuguggcuuuuuguuugg

SEQ ID NO: 153289 - RNA, 32 nt, Homo sapiens
gaggaaauagaagucaacugcaauaaggccga

SEQ ID NO: 153290 - RNA, 42 nt, Homo sapiens
ggcggccggcccggccggccagccuggguuuauugcuucgag

SEQ ID NO: 153291 - RNA, 43 nt, Homo sapiens
cgggaguuggcagaggaggucccagcuccccucggcgguccgg

SEQ ID NO: 153292 - RNA, 42 nt, Homo sapiens
cucacggaccagccggccagcagccaggacugcucggaggac

SEQ ID NO: 153293 - RNA, 46 nt, Homo sapiens
auuggaaaagcgcuuucuauaccagaaguaccugucccccgccgau

SEQ ID NO: 153294 - RNA, 43 nt, Homo sapiens
uauggguaggguagaguugaagugauugggaagggauggagaa

SEQ ID NO: 153295 - RNA, 52 nt, Homo sapiens
cuggaaggcccuggcggccggagagggcagaggcgagcagaggcauagggga

SEQ ID NO: 153296 - RNA, 39 nt, Homo sapiens
cggcaguggcuccuggccccggguccuggcggccgcagu

SEQ ID NO: 153297 - RNA, 40 nt, Homo sapiens
agugagaaagcagaugcugagauugcuuuucuagggcaug

SEQ ID NO: 153298 - RNA, 38 nt, Homo sapiens
agcacgggauaaagugugaagcagcuggagggaggccg

SEQ ID NO: 153299 - RNA, 42 nt, Homo sapiens
aaagacuagaagcccagagcacaggcagccagcaggcagcag

SEQ ID NO: 153300 - RNA, 64 nt, Homo sapiens
guuuacccaaugccugggugcccagucaccauggaauucugcuagcacugcucauaggccagau

SEQ ID NO: 153301 - RNA, 15 nt, Homo sapiens
gcaugugugugugug

SEQ ID NO: 153302 - RNA, 57 nt, Homo sapiens
cucccuccagccucagcuggcugaaccucgccgcuccaaccaccagcuuccucagcg

SEQ ID NO: 153303 - RNA, 46 nt, Homo sapiens
cauggcugcaagguggggccuggccgagugcugcccacucccacug

SEQ ID NO: 153304 - RNA, 42 nt, Homo sapiens
aacagaaguacuugggggugugccggcucccagggccagggc

SEQ ID NO: 153305 - RNA, 49 nt, Homo sapiens
aggggaacagugcuuugccagcaucccaucucucuaucggggccggaau

SEQ ID NO: 153306 - RNA, 46 nt, Homo sapiens
cugggcugcuguguguggcaugugguucauaccgacggggaaaggc

SEQ ID NO: 153307 - RNA, 46 nt, Homo sapiens
uccuggaacguaugcccagggaggaggcuacagagauugagcagac

SEQ ID NO: 153308 - RNA, 70 nt, Homo sapiens
gggcagcuugguaaggaugaagaugacaagguccauccucagacugauggaaucaugaacgagcaucuua

SEQ ID NO: 153309 - RNA, 58 nt, Homo sapiens
auagggagaccauuuuucaagcggaccaggacucauauagaccccucagcucccagaa

SEQ ID NO: 153310 - RNA, 23 nt, Homo sapiens
cagaugugguaccaacaggucac

SEQ ID NO: 153311 - RNA, 42 nt, Homo sapiens
ugcaucaucaaaaguacuugcaaagauuccuaggagggaaga

SEQ ID NO: 153312 - RNA, 26 nt, Homo sapiens
aacugaaauccaagaauguuuuagac

SEQ ID NO: 153313 - RNA, 723 nt, Homo sapiens
aagguguaagugacaucucuuuggaggaagacccaacagaagugaugauguuucuggguccuaaagaauuaauaaggucaggcacaguggcucacgcccguaauuccagcacucugggaggccaaagugggcggaucauuugagcucaggaguucgagaccagcuugggcaacauggccaaaccucaucucuacaaaaaauacggaaauuauggccggauguggugguucacgccuguaaucccagcauguugggaggccgagugggcggaucccuugaggccaggaguucgagaccagccuagccaacaugaugaaaccaccccaucgcuacuaaaaauacaaaaaaauuagccaggugugguggugcgcacccguaauuccagcuacucuggaggcugaggcaggagaaucgcuugaacccgggagauggagguugcagugaacugagaucacaccacugcauuccagccugggugacagagugagugagacugugucucagacaaaaaaauaaauaagccgugcaucauggcacaugccuguagucccagcuacuugugguggcugaggccagaggaucgcuugagccagcgagguagacgcagcagugagccgagaucaugccagugcacuccagcuugggcgacagagcgagacccugucucaaaaaaacuggaaaaaaaaaaaaaaaaaagaauuaauaggcguuugcugagugaag

SEQ ID NO: 153314 - RNA, 77 nt, Homo sapiens
uauaacuaugucagguacuauucuaggugccaggauggaagcgagaauaaaaaggucccuuuucucaaggagcaaug

SEQ ID NO: 153315 - RNA, 46 nt, Homo sapiens
ggaagguucacuauuuauucccagacggcaaggaaauggcugaaga

SEQ ID NO: 153316 - RNA, 50 nt, Homo sapiens
ggggugguugucgucccuccaggccaccuuggugcauuauuaugcauuag

SEQ ID NO: 153317 - RNA, 85 nt, Homo sapiens
ugauucagcagaaaagagcagagacccucucuucacucucauccugaugcuugcuucucaucccgaugcuugcuucucuccccag

SEQ ID NO: 153318 - RNA, 50 nt, Homo sapiens
gugcccugggagccaugggccaguggcagcuugaaguaggagacccagcg

SEQ ID NO: 153319 - RNA, 46 nt, Homo sapiens
aaaccuccccuauccuaaggaugucuauagugucucuguggaccag

SEQ ID NO: 153320 - RNA, 56 nt, Homo sapiens
agcguggaaggcacccugugugcuuguguaugagcgggguguagggugggguuuga

SEQ ID NO: 153321 - RNA, 43 nt, Homo sapiens
cccuuugugguccccuagaggggaggcaaacugcagggguuga

SEQ ID NO: 153322 - RNA, 59 nt, Homo sapiens
cagaagccaaaggagguugugguggccgagucugagcuacagaaggaacuaaagaaggu

SEQ ID NO: 153323 - RNA, 44 nt, Homo sapiens
ccuuauaccuccaccacagggggugccgugagacuucaaggcuu

SEQ ID NO: 153324 - RNA, 376 nt, Homo sapiens
caagggaaaaguuuuaaaaaugcagaaaccggccaggcgcaguggcucacgucuuaaucccagcacuuugggaggacgagacgggcggcucaccugaggucaauaguucaagaccagccuggccaacauggugaaacccugucucuacuaaaaacacaaaaauuagccggccaugguggcgcaugccuguaauuccagcuacucgggaggcugaggcaggagaaucgcuucaaccugggaggcggagguugcagugagccaagaucaugccacugcacucuagcuugggcaacagagcaagacuccgucucaaaacaaaacaaaacaaaaaaacaaaaacaaaaaacaaaacagaaaccuuggaaguagaacacag

SEQ ID NO: 153325 - RNA, 41 nt, Homo sapiens
ucguggggcuccucccacuccaugacacauuuccuguccag

SEQ ID NO: 153326 - RNA, 57 nt, Homo sapiens
ccuccuggcaggugucugagguucugggaaagcagccugcuuugggcuguguguuua

SEQ ID NO: 153327 - RNA, 48 nt, Homo sapiens
gacaauugaguuguugauuucuagacacugggcuggggacccugguga

SEQ ID NO: 153328 - RNA, 47 nt, Homo sapiens
cccagcucagaagggaaggaguuaaggcagaaaggugucuugagggu

SEQ ID NO: 153329 - RNA, 24 nt, Homo sapiens
gcuuggggcagugagggggacgca

SEQ ID NO: 153330 - RNA, 51 nt, Homo sapiens
aacguggaaauauacagaagucaaagagagcguguagugagaagggucuug

SEQ ID NO: 153331 - RNA, 390 nt, Homo sapiens
agucccaugggaauguauuaggauuaguggggacuguuguguacuggacaacccaugccuuuauuuuuuuuuugucuuuaauuuuaauuucuuuuuauugagacagggucuugcucugucaccccggcuggagugcagaggaacgaucacagcucacugcagccuugaccucugggcucaagugaucuuccuaccucagccucccaaguagcggggaacacagaugugcgccaucaugcccagcuaauuuuuuaauauuuuguagagacaaggucucacuguauugcucaggcugguuucgaacuccuagacucaagcaguccucccacuuuugccucccaaagugcugggauuuuaggaaugaaccaccaugcucaacccauuccuuua

SEQ ID NO: 153332 - RNA, 26 nt, Homo sapiens
uucaguccaccuggacagaagcauug

SEQ ID NO: 153333 - RNA, 46 nt, Homo sapiens
ggcucaauagucaacaaaauggguugugugcauguaguaaaggaag

SEQ ID NO: 153334 - RNA, 68 nt, Homo sapiens
ugggagucagcucuaacauuuaccuuuacccaguccaguguguggguuuuccccuuucaguagaaugu

SEQ ID NO: 153335 - RNA, 43 nt, Homo sapiens
uuuuaaaauuuaauucuuuucucuaaguccagagcacuaagca

SEQ ID NO: 153336 - RNA, 45 nt, Homo sapiens
cuugacagagugggaaaagucgugccucauguucuauugaucaaa

SEQ ID NO: 153337 - RNA, 42 nt, Homo sapiens
auaccucuguguaucuguauuaaugcugguugauugggacac

SEQ ID NO: 153338 - RNA, 45 nt, Homo sapiens
uuguuucucuugacuaaauaccuaagagcgaaagugcucagccac

SEQ ID NO: 153339 - RNA, 47 nt, Homo sapiens
aagacugucaaccucaaggcacaaacaguccaguaaacacagagugc

SEQ ID NO: 153340 - RNA, 45 nt, Homo sapiens
uugguaaggcccuuagccuagggccuaggaggccuuuucauacua

SEQ ID NO: 153341 - RNA, 46 nt, Homo sapiens
acugcauuugcugacaguggcccuugagucagccccuguagcccag

SEQ ID NO: 153342 - RNA, 46 nt, Homo sapiens
augcuuccuacuguuugagagcaugcgagagcaccucaaguuccaa

SEQ ID NO: 153343 - RNA, 45 nt, Homo sapiens
gaggcccacugccaggcuaaaguccucaacagccucacccagcaa

SEQ ID NO: 153344 - RNA, 81 nt, Homo sapiens
cucggcuggacaagaagaugauuggagaguuugugagugaccgcaaaaacauugaccuguuggagagcuuugugaggugag

SEQ ID NO: 153345 - RNA, 33 nt, Homo sapiens
cccccuccauucugcauggaguccauuccaaag

SEQ ID NO: 153346 - RNA, 45 nt, Homo sapiens
cugaaaggugugaauggaggcaaggacuuugagcaagacauccug

SEQ ID NO: 153347 - RNA, 63 nt, Homo sapiens
agcgauguguuugacaaucucaucaucucucuaugcaaauucacagcucucagcagugaggug

SEQ ID NO: 153348 - RNA, 47 nt, Homo sapiens
aaccugcccaguguauuuggaagcaacccuaaagcccauauugcagc

SEQ ID NO: 153349 - RNA, 46 nt, Homo sapiens
cuggaagaauaucauggaggccaugcugcagcucuuccgagcccaa

SEQ ID NO: 153350 - RNA, 43 nt, Homo sapiens
gugggguugcuacgccuggccauucggcuucuccggagagaag

SEQ ID NO: 153351 - RNA, 40 nt, Homo sapiens
agcaauuuaaagcaacagacaucuccagggaacuaugcug

SEQ ID NO: 153352 - RNA, 46 nt, Homo sapiens
uacacugaccauggcaggccgggcaagauacaccgaucagccacag

SEQ ID NO: 153353 - RNA, 45 nt, Homo sapiens
gaccccaugcccauggagccucaaggccaaaagccucucgccuca

SEQ ID NO: 153354 - RNA, 84 nt, Homo sapiens
gccagcagcagcuccccaggaucaccaguggccucaagccccagcaggcugagccccacccccgacgggccuccacccuuggcu

SEQ ID NO: 153355 - RNA, 43 nt, Homo sapiens
aucgaggccaccucaccagugccccuccuggccacaccccgcc

SEQ ID NO: 153356 - RNA, 46 nt, Homo sapiens
gucuggaugguauuauugaauaugaugauuucaaauugaacuccuc

SEQ ID NO: 153357 - RNA, 47 nt, Homo sapiens
cuugaggaaguaaggcugagcugagcccuggcaaugggaaaggugcc

SEQ ID NO: 153358 - RNA, 42 nt, Homo sapiens
gccuuccuuagagccagugauggcuccuucucccugccccug

SEQ ID NO: 153359 - RNA, 39 nt, Homo sapiens
gccauuguguuccggacaccccccuaucacaagaugaag

SEQ ID NO: 153360 - RNA, 41 nt, Homo sapiens
aaggaagaggugcagcggaagcggaggaaggccuugcccac

SEQ ID NO: 153361 - RNA, 42 nt, Homo sapiens
gggcuacggaggagcuggaggaggugaggggguacugaugga

SEQ ID NO: 153362 - RNA, 41 nt, Homo sapiens
ggaucugcugguggacaguggggcugaaguggaggccacag

SEQ ID NO: 153363 - RNA, 42 nt, Homo sapiens
gacagugcguacgggagccagucaguggagcaggaggcagag

SEQ ID NO: 153364 - RNA, 58 nt, Homo sapiens
ggacaaauaaaggauucucaugggaaggggaggaccccuccuucccaacuuauggcag

SEQ ID NO: 153365 - RNA, 47 nt, Homo sapiens
uccccuccuuccuccccaagggcuuacucuuucucuugcuggaggug

SEQ ID NO: 153366 - RNA, 68 nt, Homo sapiens
gaggcaaaggugugguggcugaaaugaguauggggugggggaccaagggaggcaggccuagcugggac

SEQ ID NO: 153367 - RNA, 41 nt, Homo sapiens
gcccaccgaugggguucagggcccucgaaugaggugugaug

SEQ ID NO: 153368 - RNA, 77 nt, Homo sapiens
cuugguguguuugugcuuuagggcuuacgauucagaguguguguuugaguugggguguaggcuggauguuuaugugu

SEQ ID NO: 153369 - RNA, 30 nt, Homo sapiens
gaggguuuacuagcgggguucaggagguag

SEQ ID NO: 153370 - RNA, 46 nt, Homo sapiens
ucugucucugggcugacagguggcuuugcgaguagagcagcugggg

SEQ ID NO: 153371 - RNA, 43 nt, Homo sapiens
uucagugaaauccugccccagcccugugaucugggccccuaau

SEQ ID NO: 153372 - RNA, 59 nt, Homo sapiens
cgcacuggcccacaggcagagccgggcucaaagggccugggauagagaugggugugggg

SEQ ID NO: 153373 - RNA, 41 nt, Homo sapiens
ucguuggcucagggggauaccugguccuccccccgggaagu

SEQ ID NO: 153374 - RNA, 48 nt, Homo sapiens
agcaugugccuuuucauuacacacauacuuguuaugacugugagagug

SEQ ID NO: 153375 - RNA, 27 nt, Homo sapiens
cucuuuguguguuccuguuugaugaug

SEQ ID NO: 153376 - RNA, 23 nt, Homo sapiens
ggggggaggggacgguguguguc

SEQ ID NO: 153377 - RNA, 44 nt, Homo sapiens
cagccgggccuuacguguggcucaaggggcggugggcgagagag

SEQ ID NO: 153378 - RNA, 45 nt, Homo sapiens
ggagccguccggaggggagcaagagcccggagccgucagguaccg

SEQ ID NO: 153379 - RNA, 79 nt, Homo sapiens
gagggcaggagcaguccucacucugaauggcugcagaguuaauguucccagcccaguccccuuucgggggccuugggag

SEQ ID NO: 153380 - RNA, 45 nt, Homo sapiens
ggcccucauguucaccagggaacaggaccacaccggccacuggag

SEQ ID NO: 153381 - RNA, 47 nt, Homo sapiens
ccauccuaggcugggcuggccccacccucacccccacccccagggug

SEQ ID NO: 153382 - RNA, 46 nt, Homo sapiens
ggugauggccugaggccugggguugaccacuaacuggcuccugaca

SEQ ID NO: 153383 - RNA, 87 nt, Homo sapiens
ccugugugugagugcguguguggauaugagugugugugcacaugcgagugccguguggcccugggacccugggcccagaaaggacga

SEQ ID NO: 153384 - RNA, 45 nt, Homo sapiens
gccucccuggacaccuuuaagaagaugugggucuccaaaaaggaa

SEQ ID NO: 153385 - RNA, 45 nt, Homo sapiens
ggcuccugagugaagugaagaaacuagcuccaaaagaugugaaga

SEQ ID NO: 153386 - RNA, 45 nt, Homo sapiens
agccuguuaccuauccauaaacccccaaaaggaugagacgcuaga

SEQ ID NO: 153387 - RNA, 41 nt, Homo sapiens
gcaggagcccuugaaggcgacaucuucauuggccccaaagc

SEQ ID NO: 153388 - RNA, 46 nt, Homo sapiens
caggcagcaggaaaaggcuugccccagcuacgggugcagcugcaaa

SEQ ID NO: 153389 - RNA, 47 nt, Homo sapiens
uaaaaauaaaauacccaggaaaaucaucucuuaaaaauauccagggu

SEQ ID NO: 153390 - RNA, 41 nt, Homo sapiens
agccgcuguaggcccaccgagccccgagcuccggccccagc

SEQ ID NO: 153391 - RNA, 45 nt, Homo sapiens
uccaauucuccgccauggcggccgcgggcagggggccggggcagg

SEQ ID NO: 153392 - RNA, 24 nt, Homo sapiens
ccggcggcuucuccacgugcaggg

SEQ ID NO: 153393 - RNA, 42 nt, Homo sapiens
guuuuuuaauugcuaaacagugacucauucugacuggucccc

SEQ ID NO: 153394 - RNA, 34 nt, Homo sapiens
cacacgcacacacgcacacacacacccugcggag

SEQ ID NO: 153395 - RNA, 39 nt, Homo sapiens
agagagguuaaguaauuuguccacagucacacagcuugu

SEQ ID NO: 153396 - RNA, 41 nt, Homo sapiens
cugggaaggccguugagugcuugcgcuuuuccgccccagag

SEQ ID NO: 153397 - RNA, 46 nt, Homo sapiens
gggaggcgaggaagguagaagggcaggucucuggaugcauaacucc

SEQ ID NO: 153398 - RNA, 44 nt, Homo sapiens
gcagguggacuagaguggggaaugaggcagagagauugguuagg

SEQ ID NO: 153399 - RNA, 346 nt, Homo sapiens
gaaaaagaaaagaaaggagauggccaggugcgguggcucacaccuguaaucccagcacuuucggaggccgaggcaggcaaucaccugagaucaggaguucaagaccagccuggccaacauggcaaaaccccucuaccaaaauuacaaaaauuagccaggcgugguggcacgugccuguaaucccaguuauucaggaggcugaggcaggagaaucucuugaacuugggaggcagagguugcagugagccgagaucgcaccauugcacuccagccuggcaacagagugagacucugucucaaaaaaaaaaaaaagaaaagaaaagaaaggagaaaugugcaggcagaa

SEQ ID NO: 153400 - RNA, 56 nt, Homo sapiens
auuuacaaaagcggugguaggggggcgcgggaugugcuuguagaauacaaaagagg

SEQ ID NO: 153401 - RNA, 42 nt, Homo sapiens
gguuuggacuaaagcccugcggcgcaaggcggcagguucccg

SEQ ID NO: 153402 - RNA, 42 nt, Homo sapiens
gguggggcgacgagagccaccguccccgucugcacgccaagu

SEQ ID NO: 153403 - RNA, 42 nt, Homo sapiens
ggcggcugcgcagcggugggcgagaaugaggagacggugauc

SEQ ID NO: 153404 - RNA, 42 nt, Homo sapiens
gugagcgaacggacccgggucaagcugcggguguacgggcag

SEQ ID NO: 153405 - RNA, 42 nt, Homo sapiens
ugccgcaguucugcacgaugcgcagcuccaucggguccaggg

SEQ ID NO: 153406 - RNA, 46 nt, Homo sapiens
cuggggcacgaucucuccgaagaugacgauaccgaugguggagacu

SEQ ID NO: 153407 - RNA, 46 nt, Homo sapiens
accggguaggaagcggggaaggucaucaucaugaaaaacuugguga

SEQ ID NO: 153408 - RNA, 45 nt, Homo sapiens
ggaggagcugaacaucauccaaggggcgcuggagcuccgcaccaa

SEQ ID NO: 153409 - RNA, 41 nt, Homo sapiens
cuggaggccaucuuuggcagggcuucugaagggcaaugcaa

SEQ ID NO: 153410 - RNA, 42 nt, Homo sapiens
auugggcagcuggagaaugaucugaggaacaccaagagugag

SEQ ID NO: 153411 - RNA, 38 nt, Homo sapiens
agaaagaggaggaggaggaggaggcaucuaagguagcc

SEQ ID NO: 153412 - RNA, 46 nt, Homo sapiens
agaaauauuagaggagacaguaauaucuacuaagaaaaccgagaaa

SEQ ID NO: 153413 - RNA, 61 nt, Homo sapiens
aacugaaauuaaaacuauucaugcuacccagccauuacccagcuaaauaaucuuacucuag

SEQ ID NO: 153414 - RNA, 60 nt, Homo sapiens
auaccuaaaacauaagaucacugccagagauaaacuaaugguccacacccaauuccacuc

SEQ ID NO: 153415 - RNA, 56 nt, Homo sapiens
auuagaugcauguugaccaugucuaugauucguguaauuacuuaucccugcccauu

SEQ ID NO: 153416 - RNA, 44 nt, Homo sapiens
uaaauaucccaaacugugaugaagccgaccuuagauuuaguagu

SEQ ID NO: 153417 - RNA, 102 nt, Homo sapiens
cuagccuaggucauaaagaggcguugcuuucacucuccuaugccuuuuacgagugcuaaguguaggauauuuugucaccagaacacaaugcuaccgccccaa

SEQ ID NO: 153418 - RNA, 33 nt, Homo sapiens
gcugaagaguugccccgucucuguuccaugucu

SEQ ID NO: 153419 - RNA, 41 nt, Homo sapiens
ucgaagcggccucugaagcggcccaggcugcgcuccggcuc

SEQ ID NO: 153420 - RNA, 46 nt, Homo sapiens
augaggugguauuuuggggugaaggugcuauuucugcaggcaagau

SEQ ID NO: 153421 - RNA, 52 nt, Homo sapiens
ccaccagccagucugucccagggacacagggggagcucugggucugcaggga

SEQ ID NO: 153422 - RNA, 33 nt, Homo sapiens
caucugaggggaccuggggugcaaggagggaag

SEQ ID NO: 153423 - RNA, 48 nt, Homo sapiens
ugcccuuauagaacuugugcugcugaucacuugggcagagggagguca

SEQ ID NO: 153424 - RNA, 52 nt, Homo sapiens
aggagggccaguguuccuagugugggccaggaacaggacagggagaccuugu

SEQ ID NO: 153425 - RNA, 55 nt, Homo sapiens
gaggcuuccagaagcggaugucuucuagaaagaaaaauugugugaaggcugaaaa

SEQ ID NO: 153426 - RNA, 41 nt, Homo sapiens
guccuagaacucaguggccuuagagaaugggguccccugca

SEQ ID NO: 153427 - RNA, 59 nt, Homo sapiens
guccuuguuucagagggugggucaggugguuggggugagaacuugcucacggugcaccc

SEQ ID NO: 153428 - RNA, 47 nt, Homo sapiens
guaugcuugcuacuucaacccccuauuuggugaauuucugcacagac

SEQ ID NO: 153429 - RNA, 59 nt, Homo sapiens
aggcccucgggagcuguuccuuguuuugauuucuguuguggugcagccagcugcucaga

SEQ ID NO: 153430 - RNA, 50 nt, Homo sapiens
gagcagcguauuuuacaggcauuuauauccauugcuuuccucagcaaggc

SEQ ID NO: 153431 - RNA, 71 nt, Homo sapiens
ggagggggccuagggcucugacccaucuggaggaaaaccagaucggacuaaaaaaggaaaaagaaaaacaa

SEQ ID NO: 153432 - RNA, 44 nt, Homo sapiens
agugacugucagguaaagaaccuucaauguagcuaucuuccagg

SEQ ID NO: 153433 - RNA, 52 nt, Homo sapiens
auuauuuuuuaauuaaugcacuuuaaauaagguagaauggaaaaaacccaga

SEQ ID NO: 153434 - RNA, 48 nt, Homo sapiens
cccagccggcuucccccaaggacucccccuucgcugggaguggauuuc

SEQ ID NO: 153435 - RNA, 95 nt, Homo sapiens
gacaacaguaaaugaggugcugggugggccuccuuccuugugagugcccagggaucacagucuagaugcacuaaauggcucccagucauccugca

SEQ ID NO: 153436 - RNA, 90 nt, Homo sapiens
ggaauuguaaauugaaaagauacaaguacuacuauguagcuguuagacuggugaaacccaugcuugcuggcaaccccaaaugcuggugag

SEQ ID NO: 153437 - RNA, 50 nt, Homo sapiens
auagcaacagauguaucacucuggugugcaguguugaugggggggugguu

SEQ ID NO: 153438 - RNA, 43 nt, Homo sapiens
ugaaaugugacacuucugauacuuucauuuucaggcccagaau

SEQ ID NO: 153439 - RNA, 27 nt, Homo sapiens
uauuuucaggauuuauuccuauuuaau

SEQ ID NO: 153440 - RNA, 46 nt, Homo sapiens
uguagauauaguucuuuuaaaauaaauucccugcauaugaucuuug

SEQ ID NO: 153441 - RNA, 46 nt, Homo sapiens
uuagaugcauugaacuacuuacaugauaauaagaucauccacagag

SEQ ID NO: 153442 - RNA, 46 nt, Homo sapiens
augggaucuuuagcagguuuuuuugggagaugguagaaagagaugg

SEQ ID NO: 153443 - RNA, 46 nt, Homo sapiens
aucccagaaggcagagaaggaaaaaggaggggaaugagggggggaa

SEQ ID NO: 153444 - RNA, 36 nt, Homo sapiens
ggcaaaccacuggguuauuucucacuuaagggccug

SEQ ID NO: 153445 - RNA, 63 nt, Homo sapiens
aaacaucuuuuuuguauugacuggcacccugaagcccacaggccuggcuucuacguaucgaag

SEQ ID NO: 153446 - RNA, 96 nt, Homo sapiens
ugaaguuacauguaccucucgucuugaaaaucugacagacuuggaaauuucuaucaacuuuaguuuuuaaaaauuauguaagcacacaagauuuau

SEQ ID NO: 153447 - RNA, 46 nt, Homo sapiens
aaaucuuucuucaauuuuagcaaaucuucauuuucuccauuuccag

SEQ ID NO: 153448 - RNA, 43 nt, Homo sapiens
uguguggggcugggggcggggcggcgggaaggggucggggcaa

SEQ ID NO: 153449 - RNA, 45 nt, Homo sapiens
ucggucggcggcgagggggaagggaggaacgccgggcacuggaag

SEQ ID NO: 153450 - RNA, 38 nt, Homo sapiens
gagagguuugacugguuccauggggaggaaaccacugc

SEQ ID NO: 153451 - RNA, 49 nt, Homo sapiens
aauacucaaccaacauucauagauaaaguuauggaucauacauagaaag

SEQ ID NO: 153452 - RNA, 63 nt, Homo sapiens
gcaaauacggcagcauucucaaagguggguucugggaucccagccaucauggguacugcuuga

SEQ ID NO: 153453 - RNA, 34 nt, Homo sapiens
auguuuuagcaaauugcccccaaaggacccauua

SEQ ID NO: 153454 - RNA, 86 nt, Homo sapiens
aaguaaaaugugcugagaaagaggaaugagagaacagagaaaagaaaaagagauagagaaguaaaaauauaaaugcaagguacuau

SEQ ID NO: 153455 - RNA, 93 nt, Homo sapiens
uucugugaaggaggcaucacuaucccccuuuuacaggugaggcaaacugugcuuagugaaguuaaguaaacuauccagauucacauauuguag

SEQ ID NO: 153456 - RNA, 47 nt, Homo sapiens; identical to SEQ ID NO: 66119

SEQ ID NO: 153457 - RNA, 46 nt, Homo sapiens
ucacagaaggcuugagacagcuccagugaauuuuccacagccccag

SEQ ID NO: 153458 - RNA, 34 nt, Homo sapiens
ucuucaggguugcauccaaguuccagggauggua

SEQ ID NO: 153459 - RNA, 42 nt, Homo sapiens
ugaaucugacgcucucaauguccaggcucggcugcggcgugg

SEQ ID NO: 153460 - RNA, 46 nt, Homo sapiens
auucaggcuuuguguuuaacacaguaugauuuucuccuggacccga

SEQ ID NO: 153461 - RNA, 43 nt, Homo sapiens
guuuacuggaaacauuguuuuuauagcacauugugacaaaaaa

SEQ ID NO: 153462 - RNA, 43 nt, Homo sapiens
caaggaaucuucaauaaucagcugauuucucaucagaaacuuu

SEQ ID NO: 153463 - RNA, 45 nt, Homo sapiens
aaccaagaauucuaugacuggcaaacuguccuucaaagugagaga

SEQ ID NO: 153464 - RNA, 45 nt, Homo sapiens
uuacacaggguacuuagaguaaucugaaucauagagacagaaagu

SEQ ID NO: 153465 - RNA, 33 nt, Homo sapiens
auuuucaguuuugcgagaugaaaugaguuccgg

SEQ ID NO: 153466 - RNA, 26 nt, Homo sapiens
aaaaucugaauuucuuauuacuauug

SEQ ID NO: 153467 - RNA, 45 nt, Homo sapiens
uggaugauggugccaugcagugacaggaaacacugaaaaggucau

SEQ ID NO: 153468 - RNA, 29 nt, Homo sapiens
gaaaguuguaccaguuuguauuucugcua

SEQ ID NO: 153469 - RNA, 53 nt, Homo sapiens
cacucccucauaaaacaaacaaaaacacugaaaaagcuccaggucaaaaagag

SEQ ID NO: 153470 - RNA, 36 nt, Homo sapiens
auuguacuaugagcccugucauuagcaaaacucacu

SEQ ID NO: 153471 - RNA, 44 nt, Homo sapiens
cuuuugauguaguuuuaaggugauuaagcagagacaguccccag

SEQ ID NO: 153472 - RNA, 49 nt, Homo sapiens
agagcugccugaauuuccucauaaguagaguugucacucuccuucuuaa

SEQ ID NO: 153473 - RNA, 44 nt, Homo sapiens
ggaauaaacuuagaaaccaggaucuaaagcuuucucugcauuac

SEQ ID NO: 153474 - RNA, 41 nt, Homo sapiens
caaugcaaagcuucaacacccccuuggaguaacaugggaca

SEQ ID NO: 153475 - RNA, 24 nt, Homo sapiens
uugguuagaccaucuccaggagag

SEQ ID NO: 153476 - RNA, 42 nt, Homo sapiens
ucaguguguuucuuuauuacuguagugcagacagcagugcuu

SEQ ID NO: 153477 - RNA, 28 nt, Homo sapiens
uuuuuaucccuaaaaaaagauauuggaa

SEQ ID NO: 153478 - RNA, 42 nt, Homo sapiens
uaaucagcuuacaaggguuuaaaaacaucaggugaaccaugu

SEQ ID NO: 153479 - RNA, 48 nt, Homo sapiens
gaaucucugaaguaaggauguauaaaucaugacauugauuuaauuagu

SEQ ID NO: 153480 - RNA, 47 nt, Homo sapiens
cagagcucagaacauuguuuggaguccuuugaucuaccgguucucuu

SEQ ID NO: 153481 - RNA, 98 nt, Homo sapiens
ggagucuguucaacucucugcuguauugccucuuaaaguagguuuucuuaaaacauaaaucuuucauaacuuuauauauuuauaguaacuuaauccaa

SEQ ID NO: 153482 - RNA, 89 nt, Homo sapiens
aagauuuuauguacuacuuuuucuuaauuucagauauuauccagaguuuuucuuggcagauggauguauuaaaaaaauagcuuuccagu

SEQ ID NO: 153483 - RNA, 40 nt, Homo sapiens
ugcaaauuuaaaccaagauuuaucaguaaaagaaaaaaau

SEQ ID NO: 153484 - RNA, 47 nt, Homo sapiens
aauuucaguuuuaaugaaagcugaacuuaauaggaaagcuagcucuu

SEQ ID NO: 153485 - RNA, 28 nt, Homo sapiens
uuuccuuuaaggugauagagaguucagu

SEQ ID NO: 153486 - RNA, 42 nt, Homo sapiens
uuugauuaaugaccuacaaaaagacaucgaaggcaguaggaa

SEQ ID NO: 153487 - RNA, 46 nt, Homo sapiens
aaaagcugaaauucagaauuuauuggacaaggugaaaacugcagau

SEQ ID NO: 153488 - RNA, 45 nt, Homo sapiens
aagagaacauuuaaggaggguauggaugaguuaagaacacugaga

SEQ ID NO: 153489 - RNA, 44 nt, Homo sapiens
agauaaacucaaagaaacaacaacaaaauuaacacaagcaaagg

SEQ ID NO: 153490 - RNA, 47 nt, Homo sapiens
aaaacaaaagacaaaauauaugaaaugaaggcuuucagacuugagac

SEQ ID NO: 153491 - RNA, 84 nt, Homo sapiens
uuuaccuucuaaaaccaugaauuuuuuaguaauucaaguguucuauuacuugucugcagagaaaagguuugcuagggaaaaaau

SEQ ID NO: 153492 - RNA, 50 nt, Homo sapiens
gaagaggcacgccaagaaaaagaagcaaugguaaugaaauauguaagagg

SEQ ID NO: 153493 - RNA, 145 nt, Homo sapiens
cguggaaaauagcaaccauauuagccgaaguaaaaggaacaggaaaggguaaaggcaaaugcuagggauauuguaccauuuuucuauaauuuuaaauuuuuucuuucauuuuaaaauuucauggcacaaguccugggaauguugu

SEQ ID NO: 153494 - RNA, 100 nt, Homo sapiens
ggacucauagccugauguauuuccuuuuauguaaguuuauucuuaugcaugugacuccuguacugcauguaguagaacauacucuguuauguucaaaaua

SEQ ID NO: 153495 - RNA, 69 nt, Homo sapiens
aagacaauuuaagagaagaacuaaagaaaagaacagaaacugagaagcagcauaugaacacaauuaaac

SEQ ID NO: 153496 - RNA, 84 nt, Homo sapiens
aaauaacaagucauaaaauuccacaacuuuuucuuaaaaucugcauucuaaauucauugguuuaaaacauuaaaauuuagagaa

SEQ ID NO: 153497 - RNA, 46 nt, Homo sapiens
acacugauaaaacuuuaugucaaccuaaugagcauaauaaucgaau

SEQ ID NO: 153498 - RNA, 59 nt, Homo sapiens
uuugguuuaaagugguuuuuaauuuugauguuucaauuucuuagauguaaaacgaagau

SEQ ID NO: 153499 - RNA, 47 nt, Homo sapiens
aacuucaccuaauauucccaucuugauuuuguuuagaggaaaaaguc

SEQ ID NO: 153500 - RNA, 96 nt, Homo sapiens
uguccuuuuuaggcugggucucugcaaacuuuuuagcaucaaacugggccaucuucucacacaguuucaguucccccaagacagcccggaacuggg

SEQ ID NO: 153501 - RNA, 73 nt, Homo sapiens
gcgcuuaaauucauccaacacaaagguacucuugggcaggugagcgaagggguccuuggccuugggcucagca

SEQ ID NO: 153502 - RNA, 50 nt, Homo sapiens
acaagauugaggagucuguucuaaaguucuuugcuccuugaugucgaagu

SEQ ID NO: 153503 - RNA, 46 nt, Homo sapiens
cauggaaguuuucaugauacccaagcauguugcugaaacugaugca

SEQ ID NO: 153504 - RNA, 82 nt, Homo sapiens
ugaagauauacucacacuggguccauuuuacgggucccaguaacauuugacugagggaaaacaaguaagcucgacuguuguu

SEQ ID NO: 153505 - RNA, 37 nt, Homo sapiens
guaugguguccccuuguguuauuuuucuuccucuugg

SEQ ID NO: 153506 - RNA, 59 nt, Homo sapiens
agaaacuuuagaaagucugucuuuagaccagcacuccaaaaaaauaagcaaguacacag

SEQ ID NO: 153507 - RNA, 45 nt, Homo sapiens
gauacaaggaaaaaaucacuucuuucugcugccuuagcuaaauca

SEQ ID NO: 153508 - RNA, 46 nt, Homo sapiens
ugaaccaggaaccgaucucguagaaccuucaccaaaacacacaccc

SEQ ID NO: 153509 - RNA, 42 nt, Homo sapiens
ggugacauuacuauucacuucaaauauuugaaagaaggagaa

SEQ ID NO: 153510 - RNA, 46 nt, Homo sapiens
accgucaaacaugggaaucaucagaaauucuuuaucguaauaagcu

SEQ ID NO: 153511 - RNA, 42 nt, Homo sapiens
aaaguagagagcuggauucugaauuugaagacuuggcaagug

SEQ ID NO: 153512 - RNA, 50 nt, Homo sapiens
gagauugcaguuaaaagcuguuuauuacuaaagugaaggccaguuaucag

SEQ ID NO: 153513 - RNA, 43 nt, Homo sapiens
aguaugguuagaaggacguaguagaacuuaaagcuagauaaau

SEQ ID NO: 153514 - RNA, 34 nt, Homo sapiens
cauuuuuauaucgcuuugauucauuuauaugggu

SEQ ID NO: 153515 - RNA, 46 nt, Homo sapiens
cugauggguaugcugggcacgucaucauugaaacuguggcuccaaa

SEQ ID NO: 153516 - RNA, 46 nt, Homo sapiens
auucuuuugggaaaacaagaaaagaauauauuaaggcggugacauu

SEQ ID NO: 153517 - RNA, 42 nt, Homo sapiens
uaugaguaugagaacaggaaacugaguaugagguguaaggca

SEQ ID NO: 153518 - RNA, 45 nt, Homo sapiens
aaugucaguuuuuaugaaaacucagguuuaguucaauuugauaau

SEQ ID NO: 153519 - RNA, 93 nt, Homo sapiens
acaggcccaccauauuuccagcuucugcuugauacuguagccucuggccucuacuaauaccaccucuuccucccccugcccuuccuuccagcc

SEQ ID NO: 153520 - RNA, 37 nt, Homo sapiens
auauguauuuuaaguguuaguaaaauaaugcacauuu

SEQ ID NO: 153521 - RNA, 29 nt, Homo sapiens
ugaagugguuccuuguggaagggaagaag

SEQ ID NO: 153522 - RNA, 28 nt, Homo sapiens
uaagcauuuacuucacugaucuccaaaa

SEQ ID NO: 153523 - RNA, 46 nt, Homo sapiens
ucaagaagaucaucaagcgcaagcacacccuaccgaauuacaagau

SEQ ID NO: 153524 - RNA, 42 nt, Homo sapiens
gggcgacuguggcuuuccgggagagcaagacggaccggccug

SEQ ID NO: 153525 - RNA, 46 nt, Homo sapiens
aaaagggacgcaccauauuaaccgguggagaaucgccaccaagcag

SEQ ID NO: 153526 - RNA, 56 nt, Homo sapiens
aacccuacaaaacaaaaacaaaccgcauacacguucaccgagaaagggagagggaa

SEQ ID NO: 153527 - RNA, 81 nt, Homo sapiens
aagcgacccucgucuaaagaggcagcugagugagagacacagagagaaggagaaagagggagggagagagagaaagagaga

SEQ ID NO: 153528 - RNA, 66 nt, Homo sapiens
uaagugggcauguaaaauauuuuauggacaggaagggaaagaguuauuucuaacauagacuccagu

SEQ ID NO: 153529 - RNA, 105 nt, Homo sapiens
gccacugcccauuggagaggcauacacguuucaugagcagucacaucuaaaguccaggucaaggaauacuuggcucaaaaacugagcagaaacuugcuaugugua

SEQ ID NO: 153530 - RNA, 59 nt, Homo sapiens
aguacacacagaaugucuugaggauaauugugggauggaauaaaucuuaacucuagagg

SEQ ID NO: 153531 - RNA, 72 nt, Homo sapiens
acagccuuauacgaugaaaauggaauuuaaauucuggaauagagauggaaaacauuuacccaucgagcugcu

SEQ ID NO: 153532 - RNA, 57 nt, Homo sapiens
uaacuauuuuuaagucacagacucugauuaugauguaaauuacaaucuucagauugu

SEQ ID NO: 153533 - RNA, 30 nt, Homo sapiens
acaggugaguacggcuuauggaggguuggu

SEQ ID NO: 153534 - RNA, 53 nt, Homo sapiens
aaguaggcgcccaauaaauaggugaagaaagaaaaaaaauuaaaaaaaaggaa

SEQ ID NO: 153535 - RNA, 46 nt, Homo sapiens
agaugccggccuauuuucagaggccggaaaaugcccucaaacgcgc

SEQ ID NO: 153536 - RNA, 46 nt, Homo sapiens
gagacgaaggggaaccagcguaaggucccacgcgccucgccagcag

SEQ ID NO: 153537 - RNA, 42 nt, Homo sapiens
cgugaccuccccgcggcggcccugcugccgcccaggccccgg

SEQ ID NO: 153538 - RNA, 45 nt, Homo sapiens
uguggaagcauuuuucuugaaugauauaacugagcaauauuuaga

SEQ ID NO: 153539 - RNA, 40 nt, Homo sapiens
ugcauugggggauuuuugcucuauuuuuaacagaagcaua

SEQ ID NO: 153540 - RNA, 49 nt, Homo sapiens
gaauuuagaugucuuucccuaguccaucaagaagucauuuuuguaacag

SEQ ID NO: 153541 - RNA, 41 nt, Homo sapiens
auuauuucaagccuucaaugcuugaagauccuugggcuggc

SEQ ID NO: 153542 - RNA, 1011 nt, Homo sapiens
auucggcuacuccccagggcagcagcagacccacccccagguaauaauaauagccagcguuugccgagcucuuacuuuauggcaggcacgguacuaauauucccuuuacguggauuauuuugucuaauccucucugagguacuauuguuagcccaauuuugcagaugagcgaacugaggcuuagagaaguugagugacuuccggaagauuauccgaaagaguggcagagccguacguucuguuuucgagcccucgugcuuuuaaccaauacacugccacccguacacagauuuuccuaauucuccauuuccuccuguuugccaaaggccuugccaguuuguuucaagaaauaguucuuuuucuuuuuuuuuuuuuuuuuuuuaucuuucuuucgagcuacacuggcuucugcuccaacuucccugaaaagaaaaucggugguaguggaaguuuuccauuccuuuagugagaguaaauacaaaagacagagagaguaucucuagcaugucugggauuucugugguuuacaacuugcaacuacgugguuuuccaacuugcuguauucuacaccaacccccuaccccuuuugagccuggagcuaaggaguaaagaaaauguucaugagcuagaaagguucuagaaacuuuaaaacuauaguauuguuuucuccugaaaaaagugaaaauuucgagggaaaauugaauauaauuacuugauuucaucacugcuuguauuuaauuacugcaaaguuacuacauuagacacaaaaguauuugagaugacaguggucauggaauuauaaauaaaugagaauaacgaauugcuuuaaguacuuuuuuuaaaaaauaggaacacuugauuaaaggaagcauggacuuuguaauugaacauuauuuagguucaagucacaacuuuuaagcagcaaugugauucccgcuaaccuuuagcuaaaggaagaaguaccaauuaucuuuacuaaguguuuuuuuaacugauuuuuuuucuaaaggg

SEQ ID NO: 153543 - RNA, 1010 nt, Homo sapiens
aacccuuuagaaaaaaaaucaguuaaaaaaacacuuaguaaagauaauugguacuucuuccuuuagcuaaagguuagcgggaaucacauugcugcuuaaaaguugugacuugaaccuaaauaauguucaauuacaaaguccaugcuuccuuuaaucaaguguuccuauuuuuuaaaaaaaguacuuaaagcaauucguuauucucauuuauuuauaauuccaugaccacugucaucucaaauacuuuugugucuaauguaguaacuuugcaguaauuaaauacaagcagugaugaaaucaaguaauuauauucaauuuucccucgaaauuuucacuuuuuucaggagaaaacaauacuauaguuuuaaaguuucuagaaccuuucuagcucaugaacauuuucuuuacuccuuagcuccaggcucaaaagggguaggggguugguguagaauacagcaaguuggaaaaccacguaguugcaaguuguaaaccacagaaaucccagacaugcuagagauacucucucugucuuuuguauuuacucucacuaaaggaauggaaaacuuccacuaccaccgauuuucuuuucagggaaguuggagcagaagccaguguagcucgaaagaaagauaaaaaaaaaaaaaaaaaaaagaaaaagaacuauuucuugaaacaaacuggcaaggccuuuggcaaacaggaggaaauggagaauuaggaaaaucuguguacggguggcaguguauugguuaaaagcacgagggcucgaaaacagaacguacggcucugccacucuuucggauaaucuuccggaagucacucaacuucucuaagccucaguucgcucaucugcaaaauugggcuaacaauaguaccucagagaggauuagacaaaauaauccacguaaagggaauauuaguaccgugccugccauaaaguaagagcucggcaaacgcuggcuauuauuauuaccugggggugggucugcugcugcccuggggaguagccg

SEQ ID NO: 153544 - RNA, 45 nt, Homo sapiens
acucacuaaacauuuacuuuccgcgauguauuucugagcuugugg

SEQ ID NO: 153545 - RNA, 49 nt, Homo sapiens
gagggcugcagacaugcaagacccuuagcagaggagaaagcaaagcaga

SEQ ID NO: 153546 - RNA, 49 nt, Homo sapiens
uggugagaaguugguauacauagcaccuuauuuacaugauggacuugag

SEQ ID NO: 153547 - RNA, 47 nt, Homo sapiens
auacauucaucuguuccuuugauccucacaacaccccugugagguag

SEQ ID NO: 153548 - RNA, 50 nt, Homo sapiens
ugaguuucccacuuuauaaaugaggaaccugaguuauggaaugcuggaaa

SEQ ID NO: 153549 - RNA, 44 nt, Homo sapiens
cacauuaggguuacuuuacccauugaauuucacaauaccacauc

SEQ ID NO: 153550 - RNA, 47 nt, Homo sapiens
gcaguggaaauguaagagauuaagguacaaauacagguugugcuuau

SEQ ID NO: 153551 - RNA, 45 nt, Homo sapiens
cauuucuggcuggaaggccacaggggaaugagaguuacaggaagg

SEQ ID NO: 153552 - RNA, 45 nt, Homo sapiens
auuaucguuucuucugccuccccacugaugagagaaaggccacaa

SEQ ID NO: 153553 - RNA, 55 nt, Homo sapiens
gaaaggccaccucuguagaccacgcaccaucaacuggcuucacagccaggcagcu

SEQ ID NO: 153554 - RNA, 45 nt, Homo sapiens
aaaugugguucagaaaagaacccaguaagguugaaccucgaagau

SEQ ID NO: 153555 - RNA, 43 nt, Homo sapiens
ugguuggauagcauaagaccacaaaaagaaggagacuucagaa

SEQ ID NO: 153556 - RNA, 48 nt, Homo sapiens
agccucuagugaaaaucuggcaugaaaugaggacuaaugcccccccaa

SEQ ID NO: 153557 - RNA, 45 nt, Homo sapiens
gagaaugagaaugagggagagaaugagagaaagagagacaaugag

SEQ ID NO: 153558 - RNA, 72 nt, Homo sapiens
uagaaaaaaaccacucauaugcucaccacccaaacacacccuaaggaugaaggcaucuuugcuuaauuuaug

SEQ ID NO: 153559 - RNA, 49 nt, Homo sapiens
ucggggcgcuuuaaucugcacacacgcucaggggaguguugcggugcag

SEQ ID NO: 153560 - RNA, 36 nt, Homo sapiens
caacuacagcugugcccaccagagguuuuguugcaa

SEQ ID NO: 153561 - RNA, 53 nt, Homo sapiens
guaaagacaacuaagucaguucagggggcuggagucuggugggagagcagguu

SEQ ID NO: 153562 - RNA, 41 nt, Homo sapiens
acaauucuuugugagcuuccuguuuccuacuuacagcugaa

SEQ ID NO: 153563 - RNA, 47 nt, Homo sapiens
cgucuguuuugucauugauaagcuaauucuguaaaccucagggcagc

SEQ ID NO: 153564 - RNA, 49 nt, Homo sapiens
uccguggcuucaccuaaaggcuugguggcagggacuggugagagaggga

SEQ ID NO: 153565 - RNA, 48 nt, Homo sapiens
ugggaaagucugauucuuaguugacugccgggaagauggggcuugcga

SEQ ID NO: 153566 - RNA, 48 nt, Homo sapiens
ccaguaguguuauuucagaaucuccgaaggaaaugugccuccgugaua

SEQ ID NO: 153567 - RNA, 44 nt, Homo sapiens
uuauguauuagacuggacuaggaaagguuuacagaucuaaauaa

SEQ ID NO: 153568 - RNA, 47 nt, Homo sapiens
ugcgaagccugcguauugguuguucacagaaagcccaccaggugguc

SEQ ID NO: 153569 - RNA, 47 nt, Homo sapiens
uguucucuaggguuugguuagagacagacaauccuccaaagacccag

SEQ ID NO: 153570 - RNA, 46 nt, Homo sapiens
ccuacagaaaaaacacaucauuguuaccguuguuucuggcauuaag

SEQ ID NO: 153571 - RNA, 42 nt, Homo sapiens
aagaugucaaccagguauucaucaagagauauauuaaugggg

SEQ ID NO: 153572 - RNA, 42 nt, Homo sapiens
gaaaaacuucaugauuaacuuuuuucacguguauuugggcuu

SEQ ID NO: 153573 - RNA, 44 nt, Homo sapiens
aagcagagguggagaugggaacgugcacgggcuugguguguacu

SEQ ID NO: 153574 - RNA, 47 nt, Homo sapiens
gguagcccugaucugauuaaaugaguuagcucauuggauuugacuga

SEQ ID NO: 153575 - RNA, 46 nt, Homo sapiens
aagagaaauauguucuuaaauuuaaaaucucugaauuuucuccuua

SEQ ID NO: 153576 - RNA, 25 nt, Homo sapiens
aacgagaccaaguaauaaagcagaa

SEQ ID NO: 153577 - RNA, 48 nt, Homo sapiens
caagaaaaugcccccgaguuugugaaggugaaaggcaaucucaggaga

SEQ ID NO: 153578 - RNA, 34 nt, Homo sapiens
aucucagggcaaaagccccuggagaauauuucag

SEQ ID NO: 153579 - RNA, 95 nt, Homo sapiens
uugcaguuccuauucgccaaaugaagggcagugccccgcacguaaguuggaaugauggaccuguguucagagacuuaacagaaccaacaagcaaa

SEQ ID NO: 153580 - RNA, 57 nt, Homo sapiens
gaaugucuaaugauaaugcauaucauuagaauccaagcuuugaaaauuucugauuaa

SEQ ID NO: 153581 - RNA, 46 nt, Homo sapiens
acugugucacuuuaugggguuggugcuugccacacuucuuacagaa

SEQ ID NO: 153582 - RNA, 45 nt, Homo sapiens
acacgagccgauccaucauccgcaauguaaaaggccccgugcgcg

SEQ ID NO: 153583 - RNA, 42 nt, Homo sapiens
agccuaucaagcuggccagggucaccaagguccugggcagga

SEQ ID NO: 153584 - RNA, 37 nt, Homo sapiens
gugucgcggucauccccgugcugcagagaacacuuca

SEQ ID NO: 153585 - RNA, 41 nt, Homo sapiens
uuaucauuggaaauuuccauuagcagauggcuaaugacaaa

SEQ ID NO: 153586 - RNA, 54 nt, Homo sapiens
guugaagauuuagaaaauuggaaacuggagaaacuaaaccauauggcugguuug

SEQ ID NO: 153587 - RNA, 47 nt, Homo sapiens
augaguaaauaggaagaaaggauguaguuuauaacauguacauagug

SEQ ID NO: 153588 - RNA, 51 nt, Homo sapiens
gggggucguugaaugauuugcuuucgguggggggaugggaaggcugggaag

SEQ ID NO: 153589 - RNA, 39 nt, Homo sapiens
guuuuuuaaaaauuaucuuggaggggucguuuagcaaag

SEQ ID NO: 153590 - RNA, 39 nt, Homo sapiens
aaagucaccaguaccaaccuggguagcgaagagcagaga

SEQ ID NO: 153591 - RNA, 39 nt, Homo sapiens
ggcagcggggaagggaaaaggaugggagggggaugccga

SEQ ID NO: 153592 - RNA, 53 nt, Homo sapiens
ggccgcgccgucgccugcucggcugcgggaugcuugcucccaaggucccaggc

SEQ ID NO: 153593 - RNA, 51 nt, Homo sapiens
cucuagcccacgccgggcgcccgcgggaccgccgcgccuuucgcggcgcgc

SEQ ID NO: 153594 - RNA, 41 nt, Homo sapiens
ggccgaggcggaggagggggcggugaggcuggcuggguugg

SEQ ID NO: 153595 - RNA, 45 nt, Homo sapiens
uuauucaucgaucaccguuuaaaacucggaaggaaacccgcccag

SEQ ID NO: 153596 - RNA, 52 nt, Homo sapiens
gacauugacagguuagagaguuagcacuaauaacguuagucauauuagagag

SEQ ID NO: 153597 - RNA, 58 nt, Homo sapiens
acaguagcagccaacucacgggagcaccugggcaacgcuaguggacuuuuuuguagug

SEQ ID NO: 153598 - RNA, 45 nt, Homo sapiens
uuuuuuugcucuugacaaacgaauguuagguaugaccuaugauga

SEQ ID NO: 153599 - RNA, 25 nt, Homo sapiens
guuucagcuggaaacacucgggcuu

SEQ ID NO: 153600 - RNA, 46 nt, Homo sapiens
gugagcagagugccaggaugacagccauggacaaugccagcaagaa

SEQ ID NO: 153601 - RNA, 45 nt, Homo sapiens
aagaaaagcccaucuuuucccuuaauaccguugcaagugcuggua

SEQ ID NO: 153602 - RNA, 47 nt, Homo sapiens
uucuggauaugaauuugaugaaggcuccaucaucuuuaauaaauuca

SEQ ID NO: 153603 - RNA, 46 nt, Homo sapiens
ggacucauucugaccaguuucugguggcauucaaagaagugggaag

SEQ ID NO: 153604 - RNA, 48 nt, Homo sapiens
acuaacagcagcugggaaagaaguuaugcuuguuggaauuggugacaa

SEQ ID NO: 153605 - RNA, 53 nt, Homo sapiens
gaucgaggacuguguggugcuauucauuccuccauugcuaaacagaugaaaag

SEQ ID NO: 153606 - RNA, 358 nt, Homo sapiens
uagcuaguuuugccuuccuuuuauuaguacuauuucuauuuuuuuuuuuuggagauggagccucauucuaucacccaggcuggagugcaguggcgccaucucggcucacugcaagcuccgccucccggguucacgccguucuccugccucagccucccgaguagcugggacuacaggcgcccgccaccacgcucggcuaauuuuuuguauuuuuaguggagacgggguuucaccguguuagccaagauggucuugaucuccugaccucgugauccgcccaccucagccucccaaagugcugggauuacaggcgugagccaccgugcccggcuauuaguacuaguucuaauauuaagac

SEQ ID NO: 153607 - RNA, 42 nt, Homo sapiens
gauuuuuuaauauugaaccagcuuugcauaccuggaguaaau

SEQ ID NO: 153608 - RNA, 102 nt, Homo sapiens
uguaguugaauucucaguuguauagauugucccacuuguuaaccacucagcagacauuagcugagugcuuccacuccacccggugguacuuggaaagugccc

SEQ ID NO: 153609 - RNA, 92 nt, Homo sapiens
auuaguugaaauaaauagguuuuucauuaagcaaauaacugauaguaauauacgagauuuucagaaugauaucugaugugaauuagccacau

SEQ ID NO: 153610 - RNA, 92 nt, Homo sapiens
uucccugcucuuaacaguguggaggauuucuaaggcgcuacagugcuaaacuagauuuucguauccuaauuuauaugaagggaccauaaagc

SEQ ID NO: 153611 - RNA, 53 nt, Homo sapiens
uccggguagggggaccugggcugggggaagugcauauuagaaggcccgggaau

SEQ ID NO: 153612 - RNA, 50 nt, Homo sapiens
ccguaacccugcaaggucaugaaauugcccccagguccugggggaggagu

SEQ ID NO: 153613 - RNA, 50 nt, Homo sapiens
gagggugguuuuggugcagaagggaccguacagaucugucugagggcggg

SEQ ID NO: 153614 - RNA, 50 nt, Homo sapiens
gugguuagugccucuggauccaggaucuggggaccacccgucaucuuggc

SEQ ID NO: 153615 - RNA, 56 nt, Homo sapiens
ugaggcaaggcuuggaucaugccugcaaucuacuuggaaaucuauuuuuaaaaaau

SEQ ID NO: 153616 - RNA, 38 nt, Homo sapiens
cuuuuauucaacaaauauuuacuaaguaucuacuguga

SEQ ID NO: 153617 - RNA, 37 nt, Homo sapiens
uuccuuuacuuaauucuuuuuuaucuucugugaccuc

SEQ ID NO: 153618 - RNA, 37 nt, Homo sapiens
cuuuaauuggggauagaagauaaggaaaaaaggugaa

SEQ ID NO: 153619 - RNA, 37 nt, Homo sapiens
gacgggucucucggccccucccuuuccacaggccccg

SEQ ID NO: 153620 - RNA, 45 nt, Homo sapiens
accuggagccgccucggggcucaaccgggaggcagcggggugcag

SEQ ID NO: 153621 - RNA, 73 nt, Homo sapiens
uccuuagggaugcagggcgaggaagggcggguggagcugcgaacccacggggaccuggaggaccucuuggccc

SEQ ID NO: 153622 - RNA, 49 nt, Homo sapiens
uuuccgguugucuccucuuauucgacccccuuucaaaauugcugacuug

SEQ ID NO: 153623 - RNA, 36 nt, Homo sapiens
gcuuggcuggcggauuccacaaacucaugaugaaaa

SEQ ID NO: 153624 - RNA, 31 nt, Homo sapiens
cucaauuccuuucugcagugaguuuuaaauu

SEQ ID NO: 153625 - RNA, 43 nt, Homo sapiens
uuugcuucuuggucccauggcuucugcagcccacgucgggagg

SEQ ID NO: 153626 - RNA, 17 nt, Homo sapiens
cggaacacccuggggac

SEQ ID NO: 153627 - RNA, 46 nt, Homo sapiens
uuguuccauagaucuggcuggagcccaaaguucugcagcuggcggg

SEQ ID NO: 153628 - RNA, 57 nt, Homo sapiens
auauagauaaacagguuguuggggguagaaaaguuuggauaucagaucagaaaaguu

SEQ ID NO: 153629 - RNA, 42 nt, Homo sapiens
caccuuucucuguggcgucgcccacgaugaucuugccgccac

SEQ ID NO: 153630 - RNA, 45 nt, Homo sapiens
gucuuucucuaccagagaaguggguggggcaauggcagcuccgcc

SEQ ID NO: 153631 - RNA, 45 nt, Homo sapiens
cuccucucucgcucauaaucuucaucuucaucagaaucuggaucu

SEQ ID NO: 153632 - RNA, 62 nt, Homo sapiens
auugaccucuuccaauguuaaagccuaucaacauaguaauaguucaaucauuucaauagucu

SEQ ID NO: 153633 - RNA, 30 nt, Homo sapiens
uggcgcuucacuacuuucucauaaucauua

SEQ ID NO: 153634 - RNA, 45 nt, Homo sapiens
ugcgguggaguguccacaauuugccggucaucugaggagccaccu

SEQ ID NO: 153635 - RNA, 47 nt, Homo sapiens
ugagugagagcugccuucuucaccugaagcugagacugcagaaguuu

SEQ ID NO: 153636 - RNA, 46 nt, Homo sapiens
cccggccgacucugcccaugagccgcgccggcggcagagcggagcc

SEQ ID NO: 153637 - RNA, 46 nt, Homo sapiens
caggagcucuugcugucuuucccaaccugcucaucaacuccaaaac

SEQ ID NO: 153638 - RNA, 46 nt, Homo sapiens
agcuucugaauugccaacugugacuccugcacuaagacccauaggg

SEQ ID NO: 153639 - RNA, 46 nt, Homo sapiens
acuuucaauccucugcugcuacaagaauccugcaccccaguuagau

SEQ ID NO: 153640 - RNA, 45 nt, Homo sapiens
ugcuugggcacucgcuaacauugcuucugggacaucagaauaaac

SEQ ID NO: 153641 - RNA, 45 nt, Homo sapiens
aaaugcaagcucauuuccugauguugcugcuucuccgcuggagaa

SEQ ID NO: 153642 - RNA, 42 nt, Homo sapiens
uuauuacauuaguauauuacguuauuuauuaugauccuaguu

SEQ ID NO: 153643 - RNA, 39 nt, Homo sapiens
uuaguguuuuuggcagccgaauguguuguaguaccagua

SEQ ID NO: 153644 - RNA, 18 nt, Homo sapiens
cuugauuguaaaacucuc

SEQ ID NO: 153645 - RNA, 48 nt, Homo sapiens
cacagacuggguuuuucucuaccaucuauuaagccugccaaauguuua

SEQ ID NO: 153646 - RNA, 35 nt, Homo sapiens
uguaaaguggugcuuuauacguuuacucuuccaag

SEQ ID NO: 153647 - RNA, 54 nt, Homo sapiens
uacagcacaagcugcuuuuauuacuccuugguguaacaggaaaaacacugcggu

SEQ ID NO: 153648 - RNA, 55 nt, Homo sapiens
aacaauaaauaccacugugcugauauauuuggugauacauuuagcaaggccgaau

SEQ ID NO: 153649 - RNA, 42 nt, Homo sapiens
auugaaauaagagcagccuaaacuaggacaggucauggaaug

SEQ ID NO: 153650 - RNA, 46 nt, Homo sapiens
cuguuucuaguagggaccaucugacagagauaggaccuugaugcau

SEQ ID NO: 153651 - RNA, 46 nt, Homo sapiens
gucuuggaccaguauucaauguggggaaauaaauuuggaguauugc

SEQ ID NO: 153652 - RNA, 43 nt, Homo sapiens
gcuuuugguuuuaguggcuaaauuuguaaugaaaaauuuagaa

SEQ ID NO: 153653 - RNA, 45 nt, Homo sapiens
acauugccacuuuaagucuguucauacuguggaaagguucuuagu

SEQ ID NO: 153654 - RNA, 54 nt, Homo sapiens
aaaaagaacuuaacauauuuuagaguuuauaaugacauuugaagacaacaagug

SEQ ID NO: 153655 - RNA, 37 nt, Homo sapiens
cugauguaauggacuuugguaacauaugugcugacgg

SEQ ID NO: 153656 - RNA, 33 nt, Homo sapiens
uuuuuuuuuuuguagucuuauuuagcugugggc

SEQ ID NO: 153657 - RNA, 51 nt, Homo sapiens
ucaaaugugaggggaacccauuugacaucuuuacagaacuagucaaaagau

SEQ ID NO: 153658 - RNA, 54 nt, Homo sapiens
gcuuuacagccaaauaaucaggaugcucacccucacuaggaagccaggaaagua

SEQ ID NO: 153659 - RNA, 42 nt, Homo sapiens
ccugggugcaaaauugugugaguauauguacucuuacgugca

SEQ ID NO: 153660 - RNA, 42 nt, Homo sapiens
uuuggaauugggauugauuauuuuaaugagaacacugaggcc

SEQ ID NO: 153661 - RNA, 38 nt, Homo sapiens
accuggggaacauuagcacuuaaaagcagugaucaugg

SEQ ID NO: 153662 - RNA, 31 nt, Homo sapiens
ucuuuccuuauguuuuuuggaauuaacacuu

SEQ ID NO: 153663 - RNA, 55 nt, Homo sapiens
cuuuuuccccaggggaagaggggcguguagguguaguugauugaaauuagagcuu

SEQ ID NO: 153664 - RNA, 59 nt, Homo sapiens
gaucagauaagagacaauggcagcaguccaggggagaaaagaugcuaucuuggaccaga

SEQ ID NO: 153665 - RNA, 52 nt, Homo sapiens
cuucgaagguuugaagcaaaggagagauacuacuugacaaguuuuuaaagga

SEQ ID NO: 153666 - RNA, 51 nt, Homo sapiens
auuuuuggugagaaggagggacguccaagggaaaguccaaguggcuaauuc

SEQ ID NO: 153667 - RNA, 106 nt, Homo sapiens
gguugcagggcgugacacggaagaugcgccccgugccccggugucacuuucucaaggggugcuguggccuuccgcaucuuuacccccuaacagagcugucuauugg

SEQ ID NO: 153668 - RNA, 57 nt, Homo sapiens
gugagcgcgggcgggcggcggggagggcggggagggagcgcgggaaggugcgggcga

SEQ ID NO: 153669 - RNA, 57 nt, Homo sapiens
guggguguggguggugggagcgcggcugcgucucuggcgcggggaccucggagcgag

SEQ ID NO: 153670 - RNA, 75 nt, Homo sapiens
uccgcgccaccgccgccgcccaggccaucgccacccuccgcagccauguccaccagguccguguccucguccucc

SEQ ID NO: 153671 - RNA, 41 nt, Homo sapiens
ccggcucgcggugcccgggccgccgaacauccugcgguagg

SEQ ID NO: 153672 - RNA, 71 nt, Homo sapiens
gagcuacgugacuacguccacccgcaccuacagccugggcagcgcgcugcgccccagcaccagccgcagcc

SEQ ID NO: 153673 - RNA, 41 nt, Homo sapiens
cgcuccucugccgugcgccugcggagcagcgugcccggggu

SEQ ID NO: 153674 - RNA, 45 nt, Homo sapiens
gucggccagcgagaaguccaccgaguccugcaggagccgcacccc

SEQ ID NO: 153675 - RNA, 42 nt, Homo sapiens
uucaagaacacccgcaccaacgagaagguggagcugcaggag

SEQ ID NO: 153676 - RNA, 103 nt, Homo sapiens
ccaccucgacgcgggcuuugucguugguuagcugguccaccugccggcgcagcucccgcaucuccuccucguagaggucccccaggcgcgacuugccuuggcc

SEQ ID NO: 153677 - RNA, 46 nt, Homo sapiens
caagggccaaggcaagucgcgccugggggaccucuacgaggaggag

SEQ ID NO: 153678 - RNA, 46 nt, Homo sapiens
cgagguggagcgcgacaaccuggccgaggacaucaugcgccuccgg

SEQ ID NO: 153679 - RNA, 46 nt, Homo sapiens
ccugucugaaagauugcaggguguuuucggcuuccucucucugaag

SEQ ID NO: 153680 - RNA, 45 nt, Homo sapiens
auaggauguugacaaugcgucucuggcacgucuugaccuugaacg

SEQ ID NO: 153681 - RNA, 47 nt, Homo sapiens
aaaaggcaaucucuucuugcaaagauuccacuuugcguucaagguca

SEQ ID NO: 153682 - RNA, 45 nt, Homo sapiens
gaaauccaggagcugcaggcucagauucaggaacagcauguccaa

SEQ ID NO: 153683 - RNA, 43 nt, Homo sapiens
cgauuuggacaugcuguuccugaaucugagccugcagcuccug

SEQ ID NO: 153684 - RNA, 71 nt, Homo sapiens
cugaccucacggcugcccugcgugacguacgucagcaauaugaaaguguggcugccaagaaccugcaggag

SEQ ID NO: 153685 - RNA, 41 nt, Homo sapiens
cacaauaugagcaagaagucaaagccagcuuugcauuggag

SEQ ID NO: 153686 - RNA, 48 nt, Homo sapiens
cugaccucucugaggcugccaaccggaacaaugacgcccugcgccagg

SEQ ID NO: 153687 - RNA, 46 nt, Homo sapiens
cuuugccuggcgcagggcgucauuguuccgguuggcagccucagag

SEQ ID NO: 153688 - RNA, 111 nt, Homo sapiens
cagaaugagucccuggaacgccagaugcgugaaauggaagagaacuuugccguugaagcugcuaacuaccaagacacuauuggccgccugcaggaugagauucagaauaug

SEQ ID NO: 153689 - RNA, 46 nt, Homo sapiens
ccuucgugaauaccaagaccugcucaauguuaagauggcccuugac

SEQ ID NO: 153690 - RNA, 45 nt, Homo sapiens
ggauuucucugccucuuccaaacuuuuccucccugaaccugaggg

SEQ ID NO: 153691 - RNA, 54 nt, Homo sapiens
gaugaccuugaauaaaaauugcacacacucagugcagcaauauauuaccagcaa

SEQ ID NO: 153692 - RNA, 97 nt, Homo sapiens
aacagcuuucaagugccuuucugcaguuuuucaggagcgcaagauagauuuggaauaggaauaagcucuaguucuuaacaaccgacacuccuacaag

SEQ ID NO: 153693 - RNA, 42 nt, Homo sapiens
gucugggacaucaggaacacuuacugcagugcaccugccgac

SEQ ID NO: 153694 - RNA, 46 nt, Homo sapiens
ugggaucuggacaucaguccauauagccuguacuucgccagcgggu

SEQ ID NO: 153695 - RNA, 44 nt, Homo sapiens
uugggagacgagccauggaaggccuggagccacagaguucaguu

SEQ ID NO: 153696 - RNA, 69 nt, Homo sapiens
aaaaccaggaaagaccauagguucucuaagugagcagccgccguuugcugcucuuagaaaacucacaga

SEQ ID NO: 153697 - RNA, 63 nt, Homo sapiens
cuaaaaagauuuuuuaaaaaagcuucuauauucuuuaaaauuuucuuugugacccccacaacu

SEQ ID NO: 153698 - RNA, 44 nt, Homo sapiens
ugagcacuguaccuuacaaaagccaacaguuucuuggcacagag

SEQ ID NO: 153699 - RNA, 41 nt, Homo sapiens
cuuuuuccuaacuuaguuaacuauuaaaaaaaauuuugaaa

SEQ ID NO: 153700 - RNA, 45 nt, Homo sapiens
cuacaaaugcauaaggaacacauagacgacuuccuuuuaggauaa

SEQ ID NO: 153701 - RNA, 29 nt, Homo sapiens
auuugaauucguuguccuugaagaaaagg

SEQ ID NO: 153702 - RNA, 46 nt, Homo sapiens
agaaaaacaauuuuuguccugucuuucuugcaagauuauuaugcaa

SEQ ID NO: 153703 - RNA, 83 nt, Homo sapiens
aaacuguuugccugaagaaugugucugaaacauaauauaucacugcaugucugugcuguagaccuguuaauuuuaucugugag

SEQ ID NO: 153704 - RNA, 60 nt, Homo sapiens
ccacccccgugagguaagaagcaguggggcagaguuuuucuguggccucacucacaugcu

SEQ ID NO: 153705 - RNA, 45 nt, Homo sapiens
ucagugaggcguuugcuggagggagcuuuccaucauucggccgcg

SEQ ID NO: 153706 - RNA, 46 nt, Homo sapiens; identical to SEQ ID NO: 66471

SEQ ID NO: 153707 - RNA, 37 nt, Homo sapiens
ccuccaaaguuuccuccgcgacccauaaaauugccag

SEQ ID NO: 153708 - RNA, 39 nt, Homo sapiens
cugccaagcuggaucuugaugggggacuucagcccuagu

SEQ ID NO: 153709 - RNA, 44 nt, Homo sapiens
cuagagcgcuggagugaucauagcaacuugagguaugcucuaag

SEQ ID NO: 153710 - RNA, 45 nt, Homo sapiens
agcucggugcuuuccugccucuaguauguaaguugcagcugcugc

SEQ ID NO: 153711 - RNA, 45 nt, Homo sapiens; identical to SEQ ID NO: 66478

SEQ ID NO: 153712 - RNA, 49 nt, Homo sapiens
gaaauuguaaaacuagaaauaauucagaaaacgcaucuuuaagagcgag

SEQ ID NO: 153713 - RNA, 45 nt, Homo sapiens
ucccggugcaggcucugguccccauacaccgucuugcugacagcu

SEQ ID NO: 153714 - RNA, 46 nt, Homo sapiens
guuaaauggauauucacauucagcaucugccccauggccagcaacu

SEQ ID NO: 153715 - RNA, 46 nt, Homo sapiens
cacaaguuauauaugcaauuauucccaggguguaagguuuugagac

SEQ ID NO: 153716 - RNA, 46 nt, Homo sapiens
uuacagagaaauggaacaccgacaauacacuaggcaccaagauuac

SEQ ID NO: 153717 - RNA, 57 nt, Homo sapiens
cuccaguauggagaugaaaccaagcagcucaggaugccgaaugaaaucacaagugca

SEQ ID NO: 153718 - RNA, 46 nt, Homo sapiens
gugccuuuccacagcagcucaccaugaaaaugcuggaaucgcccag

SEQ ID NO: 153719 - RNA, 111 nt, Homo sapiens
ggguuuuuuuuuacccacuauauugcauuuagaguguuuuuuuguuuuuuguuuuuuguuuuuuguuuuuuguuugguccaucauaucccuuucauagaguuuauaccaaa

SEQ ID NO: 153720 - RNA, 32 nt, Homo sapiens
acuugauuauggagcucaaggcugaugagguu

SEQ ID NO: 153721 - RNA, 51 nt, Homo sapiens
cccacauccuuaccucugugagucuccccuucauauucacccagcccccuu

SEQ ID NO: 153722 - RNA, 26 nt, Homo sapiens
agggccuuggguggcccuucugcuga

SEQ ID NO: 153723 - RNA, 45 nt, Homo sapiens
cuugucaccaucucccucagacagaccaguccgacgcguggccau

SEQ ID NO: 153724 - RNA, 45 nt, Homo sapiens
uggcugccaagaagaccugucgccuuuguuuuuaagucuccagaa

SEQ ID NO: 153725 - RNA, 40 nt, Homo sapiens
gagacuuaaaaacaaaggcgacaggucuucuuggcagcca

SEQ ID NO: 153726 - RNA, 32 nt, Homo sapiens
uacguuaaaauuuuuuuuuguuuguuuugcuc

SEQ ID NO: 153727 - RNA, 43 nt, Homo sapiens
ggggaggggaaggagguggagugggaggagguggauccaggga

SEQ ID NO: 153728 - RNA, 60 nt, Homo sapiens
uuguccccgcuccccugucccccauaaagaaacaggaccucagguggugggcgggcgggg

SEQ ID NO: 153729 - RNA, 23 nt, Homo sapiens
ccuccgcuucaauucgagggaag

SEQ ID NO: 153730 - RNA, 32 nt, Homo sapiens
acggcugggcgccggcgggacgcugcaggagc

SEQ ID NO: 153731 - RNA, 48 nt, Homo sapiens
uccugcucagcagggcuggcucuucaugucguuucuaagcgccagcgc

SEQ ID NO: 153732 - RNA, 49 nt, Homo sapiens
gagcaauuuuuagaagaggaaggaaaagcuguguuaaacuucucugcau

SEQ ID NO: 153733 - RNA, 42 nt, Homo sapiens
agguagcugacaaagugcugaaugcaauuaaaagauaccaag

SEQ ID NO: 153734 - RNA, 46 nt, Homo sapiens
uguaauugagggguuggcuucugaugguggccucuuuguuccugca

SEQ ID NO: 153735 - RNA, 46 nt, Homo sapiens
gagaauggaguaagugauuuucaaaaagcacaaauaauuggcaguc

SEQ ID NO: 153736 - RNA, 31 nt, Homo sapiens
auggacagcuaaugacagaauuauuuaaucg

SEQ ID NO: 153737 - RNA, 46 nt, Homo sapiens
cucuaguugagaaacuucagcaggauuuuguagcugacuggugcuc

SEQ ID NO: 153738 - RNA, 46 nt, Homo sapiens
cuccuccucgaccgcuucgcccggaggcgcggggcgcgcgcccaga

SEQ ID NO: 153739 - RNA, 46 nt, Homo sapiens
cugcaaguucugcucccgcgacuuauugcucugcagcaucacguug

SEQ ID NO: 153740 - RNA, 57 nt, Homo sapiens
aauuuaagagaccugaaagauauguuuccgcuuccaauuuauaguuaauugcauugu

SEQ ID NO: 153741 - RNA, 44 nt, Homo sapiens
auuucuauuucacaaggguaacuguuuuauccacacuggcagca

SEQ ID NO: 153742 - RNA, 48 nt, Homo sapiens
aaguuucccaaaccacuucuuaugauccaguggauauucaaaagagag

SEQ ID NO: 153743 - RNA, 42 nt, Homo sapiens
cucccccggccgugcgggaccguuggggccgagcgccgcugc

SEQ ID NO: 153744 - RNA, 72 nt, Homo sapiens
uccggagcugaggggugcucgcggugggacggagccgcgcguuggacugaaguaggggcgcccuacacgggg

SEQ ID NO: 153745 - RNA, 41 nt, Homo sapiens
cgaaaaggucuuguggagaaugcagggcuggugcuagggug

SEQ ID NO: 153746 - RNA, 45 nt, Homo sapiens
acacacaguggugaaaaauacaccgauccuuucaaacucgguugg

SEQ ID NO: 153747 - RNA, 35 nt, Homo sapiens
agaauacauaugacccagugccaggcaauaugaag

SEQ ID NO: 153748 - RNA, 32 nt, Homo sapiens
uauauaucuguguccauacuuacgucucucaa

SEQ ID NO: 153749 - RNA, 37 nt, Homo sapiens
ucucuccccaguucaguuguaggcuccuuguaauccg

SEQ ID NO: 153750 - RNA, 60 nt, Homo sapiens
ccagauggacugagcccuguuucuucuccuuggcuguggccuuacuaucuuccugccccu

SEQ ID NO: 153751 - RNA, 51 nt, Homo sapiens
caugcgagcuccaaauaaaugcaugcaaagcaaauuagacacaccaaaaag

SEQ ID NO: 153752 - RNA, 40 nt, Homo sapiens
guacccgaagccaugguuuuaugugugcuuugcugggaaa

SEQ ID NO: 153753 - RNA, 45 nt, Homo sapiens
ccagaaaugaaugcuaugaucaugcgacgguucaguuugccugga

SEQ ID NO: 153754 - RNA, 44 nt, Homo sapiens
uuucugaccuuuacuccuacgguaaaucaagacaaaccauuuga

SEQ ID NO: 153755 - RNA, 48 nt, Homo sapiens
uuugccuuuguuaauuuuaaacaaacaaaguaucauuagugaucagcu

SEQ ID NO: 153756 - RNA, 46 nt, Homo sapiens
ccauuacauguuucagugcagcaugguuacuaacgcuaugucagac

SEQ ID NO: 153757 - RNA, 49 nt, Homo sapiens
acuuacacauuuuuaacuuuaugaccagccuaaauauucugggggaagu

SEQ ID NO: 153758 - RNA, 48 nt, Homo sapiens
uuuuucuuuugaaguagauucuuauuacucagucauacugugggacua

SEQ ID NO: 153759 - RNA, 40 nt, Homo sapiens
auuguagaaauuuagaacuauaaagaacaucuaauccaau

SEQ ID NO: 153760 - RNA, 62 nt, Homo sapiens
ugaauucuuuaaauuuuaggagcauuuuuaccugauauuauacuaguucauugaacagagcu

SEQ ID NO: 153761 - RNA, 42 nt, Homo sapiens
gucaucguuuuccuuacuuuuauugagaagcuaaucuugaaa

SEQ ID NO: 153762 - RNA, 45 nt, Homo sapiens
uagguuugcuugugggaaauguacuccaagguucugcagguuuuu

SEQ ID NO: 153763 - RNA, 46 nt, Homo sapiens
augugaugguaaauuuaaauccuccccaaacaauguaacauuagga

SEQ ID NO: 153764 - RNA, 43 nt, Homo sapiens
uuguaaauuuaggacugauauuuuuaaacauaaaauugccaac

SEQ ID NO: 153765 - RNA, 46 nt, Homo sapiens
ggcacaaugaccaggcagauaucucgacacaacucuacuacuucuu

SEQ ID NO: 153766 - RNA, 349 nt, Homo sapiens
auauuauaacaagcuguaaggcugggcacaguggcucacgccucuaauccuagcacuuugggaggcugaggcaggcggauugcuugauccaggaguucaagaccagccugggcaacauagcaagaccucaucucugcaaaaaauacaaaaaauuuagccgggcauggugaugcaugccuguagccccagcuacuugggaggcugaggugggaggauggcuugagccugggagguggagguugcagagagcugagauugugccacugcgcucuagccugggugacagagugagaccccaucuuaaacaaaacacaaggcuucaagaagaaauacugaucaaugaugaagu

SEQ ID NO: 153767 - RNA, 41 nt, Homo sapiens
cuuuuccaaacauuugcacauaccaaggaaaagggagaaag

SEQ ID NO: 153768 - RNA, 37 nt, Homo sapiens
aaguuggggaugacugaacugagcauauaaggaauuu

SEQ ID NO: 153769 - RNA, 94 nt, Homo sapiens
caagugaaacuuaauuuggaacucucugguauauacaacagucaaaggaucagggugaagguggggacaggaggagaaaaauugaaaggcaaac

SEQ ID NO: 153770 - RNA, 59 nt, Homo sapiens
cauuuugcaaaagaauucauaugcuaaaggaaaagauguuucugugacuuaaguaagug

SEQ ID NO: 153771 - RNA, 358 nt, Homo sapiens
caaagaaagaauuggccuuggcugggugcaguggcucaugccuguaaucuuggcacuuugguaggcucaggugggaggaucacuugaggccaggaguucgagaccagccuggccaacauggugaaaccccgucuccuaaaaauacaaaauuuagccaagcaugguggcacacaguuuuaaucccagcuacuugggaggcugaggcaggagacucgcuugaacccgggaggcagagguugcagugagccaagauugagccacugcacuccauccugggcaacagagccagcaaaaaaaaaaaaagaauuagcauuagacauuuagugccuaugacauacaaaacuaugauguacuuaga

SEQ ID NO: 153772 - RNA, 22 nt, Homo sapiens
uuuucauauguaguuggcccuu

SEQ ID NO: 153773 - RNA, 46 nt, Homo sapiens
augaucuuuguaagugagcacaagguuugagaggaagcuagaauag

SEQ ID NO: 153774 - RNA, 42 nt, Homo sapiens
gaauacaucaagaacucacaaaauaauagcaccugcgaauau

SEQ ID NO: 153775 - RNA, 65 nt, Homo sapiens
caugccugagcaauguaacuacaugccccuccucuuccaagcaaacuagccaaaguucuaaagau

SEQ ID NO: 153776 - RNA, 50 nt, Homo sapiens
cuuuaaaaucucuguuggcauuuuuauuggaaugcauugaagcuguagau

SEQ ID NO: 153777 - RNA, 43 nt, Homo sapiens
cuugacugcuagcuggcugcgugggcagaacagggaagggaag

SEQ ID NO: 153778 - RNA, 57 nt, Homo sapiens
uuaccagaaccugacucggguggcagacuacugugaaaacaacuacauacaggugag

SEQ ID NO: 153779 - RNA, 46 nt, Homo sapiens
uuaacgcgagaggaagcgaugcagagggguggaaaauggcagagcu

SEQ ID NO: 153780 - RNA, 40 nt, Homo sapiens
agugucuucuguuugcaguaugugaacuuuauguuugaaa

SEQ ID NO: 153781 - RNA, 103 nt, Homo sapiens
gucgucuggcuccucacucucucaguguaugcucaaagguccggccaaaacucuugauuauccuggcggcggggcaggauugucucgucucacaccagcucug

SEQ ID NO: 153782 - RNA, 49 nt, Homo sapiens; identical to SEQ ID NO: 66605

SEQ ID NO: 153783 - RNA, 48 nt, Homo sapiens
uuugggugauaaauucuuguuguaaaugcaaccuuagaugguuugaag

SEQ ID NO: 153784 - RNA, 47 nt, Homo sapiens
aauaaacuguuauuacaguuucucuacugacuuucaaaaguuuugaa

SEQ ID NO: 153785 - RNA, 50 nt, Homo sapiens
ugcugugucugugugcccccuccuccagggccaccaguggguuucacagg

SEQ ID NO: 153786 - RNA, 54 nt, Homo sapiens; identical to SEQ ID NO: 66609

SEQ ID NO: 153787 - RNA, 45 nt, Homo sapiens
gaguuaguuccuccaucagguuaaucucauaggguuucugcaaau

SEQ ID NO: 153788 - RNA, 1528 nt, Homo sapiens
caaaaaguacacugccucaacacacuuuucuccaggguaagaaguaggcuucugcuguugaauauuaucucucgagucccaguaaaacagaugauuucaucaauuuucccaccgucuucacuguauaaaaguucguaguguuucuggcuuggcacgguggcucaugccucccagcacuuuggaggcugaggcaggcagaucacgaggucaggaguuugagaccagccuggccaacauggugaaaccccaucucuacuacaaaauacaaaaaaauugggcaugguggcgugugcccauaaucccagcuacuugggaggccgaggcaggagaauugcuugaacccaggaggcggaggcugcagugagcugagauugcaccauugcacuccagcucugggcgacagagcaagacuccgucuugggaagaaaaaaaaaaagauuaaaaaauaauucauaguguuuccuaaaaggcagguuuaguuguugaccuaaaguugauacuaaaugauuaaccaagucacagauacacuuuugaauaguuucugaaauacuuugaccuuaacuaggguuaauccucauuauucacauauucuguauuugugaauuugcuuagucacuagaauuuauuuguaacuccggaauuaauacucaagguaguucagcagucauuuguggacguguacaguguggcaaagaguuuaagucaccugacaugcacauucccagcugaggucgaagaaagcaaucucuguccucuuguuuagcucucauacugugaacaaggguccuuuucacagucugccauguuuuucaaguuuuuguugcugauuucacaguuuuaauuggccccuacacauggugcugaagugcugcccaaugcugguggcauugguugugaguauauuaaagaagguauucuuggcugggcacaguagcucauaccuguaaucccagcacuuugggaagccgaagugggcagaucaccugaggucaagaguucaagaccagccugaccaacaggcugaaacccugucucuacuaaaaauacaaaaguuagccaggcauuguggugggugccuguaaucccagcuacucaagaggcugaggcuggagaauuguuugaacccaggaggcagcuguugcagugagcugagauugcaccauugcacuccagccuggacaacaagagugaaacuccauuucacaaaaaaaaaauaaaauaaaauauuuuuaaauggaaacacauaaaacauaacuacuuugaaucagauaaucaauuguauuacucuuguugacaguuauguggcccuuaagaaauauacucuaauacgguaaaucuuagauauuauuaucuuccaucuauuauuuacaauuuuuacaauuuaccaucucucucauaucaugagauucuaaguuuuagaccauguuaauguuucuuuuuugcugguucguguuuucaagauuuggcaaaccaaaugaagguuuuuuuuauuuuucucauacuuauuuuuuucugugcucagcuucag

SEQ ID NO: 153789 - RNA, 49 nt, Homo sapiens
auaagauugucauucagaaauaccauacugugaauggccacaacuguga

SEQ ID NO: 153790 - RNA, 61 nt, Homo sapiens
aagagauggcuagugcuucauccagccaaagaggucgaagugguucuggaaacuuuggugg

SEQ ID NO: 153791 - RNA, 48 nt, Homo sapiens
auggcucuaauggauuugguaaugauggaagcaauuuuggagguggug

SEQ ID NO: 153792 - RNA, 28 nt, Homo sapiens
cucuggccccuauggcgguggaggccag

SEQ ID NO: 153793 - RNA, 79 nt, Homo sapiens
acaaagcuuagcaggagaggagagccagagaagugacagggaagccacagguuacaacagauuugugaacucagccaag

SEQ ID NO: 153794 - RNA, 46 nt, Homo sapiens
uguguuugugacuaauuguauaacagguuauuuuaguuucuguucu

SEQ ID NO: 153795 - RNA, 46 nt, Homo sapiens
accugccguuuaucucuaggaggauuugcugagcucaugggaagua

SEQ ID NO: 153796 - RNA, 46 nt, Homo sapiens
auuagagguuacguuguguggcacacagcagguugacuuggcagau

SEQ ID NO: 153797 - RNA, 43 nt, Homo sapiens
gaacaaagaugaauauauugguuuaaugacagaauggcauuuu

SEQ ID NO: 153798 - RNA, 44 nt, Homo sapiens
caccaggaagcaggaacuggaaggggaagcugugcucuccagcg

SEQ ID NO: 153799 - RNA, 44 nt, Homo sapiens
ccuuguuggagaccccgcaggaaccuaugcaggucacccggaug

SEQ ID NO: 153800 - RNA, 59 nt, Homo sapiens
aucucaaagagccuugguguaugugcaaaacggggccaucugcaugggcguugggaaga

SEQ ID NO: 153801 - RNA, 66 nt, Homo sapiens
ucuccuacuccuuagcucacgacccuccuuuuucucccucauucagaccagccucugugagguagg

SEQ ID NO: 153802 - RNA, 32 nt, Homo sapiens
cguccgcgcucgcaccugcugggcuccuuccc

SEQ ID NO: 153803 - RNA, 44 nt, Homo sapiens
gcguccuggccgcagcggcgcgcugccugguccggggugcggac

SEQ ID NO: 153804 - RNA, 68 nt, Homo sapiens
ugccgcuggggagggggugcagcuggggaggggauggaucugggguguggggguaccgcuggggaagg

SEQ ID NO: 153805 - RNA, 67 nt, Homo sapiens
ccccuccccagcugcacccccuccccagcggcacccccacgccccagauccacccccuccccagcug

SEQ ID NO: 153806 - RNA, 107 nt, Homo sapiens
gggagagggugcagcuggggagcgcguggauccggcgaguggggguaccgcuagggagggggugcagcuggggaggggguggaucuggggugugggggugccgcugg

SEQ ID NO: 153807 - RNA, 97 nt, Homo sapiens
ugcagcuggggaggggguggauccggcguguagggguaccgcuggggagugggugcagcuggggaggggguggaucugggguguggggguacugcug

SEQ ID NO: 153808 - RNA, 82 nt, Homo sapiens
ggcguguagggguaccgcuggggagugggugcagcuggggaggggguggaucuggggugugggggugccgcuggggaguggg

SEQ ID NO: 153809 - RNA, 81 nt, Homo sapiens
acuccccagcgguaccccuacacgccggauccacccccuccccagcugcacccuccuccccagcugcauccccacaccccg

SEQ ID NO: 153810 - RNA, 46 nt, Homo sapiens
ucugcuuuucgccccugacuguuuuuucuguuucuggccauggagg

SEQ ID NO: 153811 - RNA, 37 nt, Homo sapiens
uauguaacucgggggaccagaugccuggauuucccag

SEQ ID NO: 153812 - RNA, 42 nt, Homo sapiens
uggcagccugugacugacccugagcucuagccuggagcgaga

SEQ ID NO: 153813 - RNA, 46 nt, Homo sapiens
guggcgcuugggucugcguacacccuggaugaccacgccaggcgcc

SEQ ID NO: 153814 - RNA, 24 nt, Homo sapiens
ggccacugcgaggggguaggagac

SEQ ID NO: 153815 - RNA, 55 nt, Homo sapiens
cuucgaccaagagcaaaagguugggggcugggcaggaagggggcggggaguccac

SEQ ID NO: 153816 - RNA, 42 nt, Homo sapiens
gaacuccaucucguccaugcccucgcccguguaccagugcag

SEQ ID NO: 153817 - RNA, 47 nt, Homo sapiens
ccucggcagacagcuggaccuugcucccaaagccgauuuaguagagg

SEQ ID NO: 153818 - RNA, 45 nt, Homo sapiens
aggcuccgcaggaggcuggugaccucccaccuguccuggccacaa

SEQ ID NO: 153819 - RNA, 46 nt, Homo sapiens
gacuccuagggacagccggcgagaguugggggugcagggccccccc

SEQ ID NO: 153820 - RNA, 42 nt, Homo sapiens
aaugccacucgggguggggccggaagccaugguggggaagga

SEQ ID NO: 153821 - RNA, 24 nt, Homo sapiens
cuccagcggggcacagcccaaggg

SEQ ID NO: 153822 - RNA, 45 nt, Homo sapiens
cuggcauggugggggcaggggugucaccugacaggcaccugggca

SEQ ID NO: 153823 - RNA, 46 nt, Homo sapiens
cagcagcgagcgguacucauugaugaagagguccuugcugccguag

SEQ ID NO: 153824 - RNA, 55 nt, Homo sapiens
ugucccccgcuggggugcccgccuccccccaguccugagcacucgcugggcacac

SEQ ID NO: 153825 - RNA, 78 nt, Homo sapiens
ugucugucuccggaaggaagcuucccccuugguuucuaaaguggacacaucgcccugcccuccccuaggaguaaguuc

SEQ ID NO: 153826 - RNA, 46 nt, Homo sapiens
gccgcuccuccucaaugacagagaaggugccggggggcuccucacg

SEQ ID NO: 153827 - RNA, 41 nt, Homo sapiens
ggcccgucaugcagguugguggagaauuuugggguccagga

SEQ ID NO: 153828 - RNA, 45 nt, Homo sapiens
ugucgcuuguugacgccggcagacaguguaaagggagggcaaagg

SEQ ID NO: 153829 - RNA, 89 nt, Homo sapiens
ggcguguggggucaaggggcagacggggugugggugggcggugccgcaagaagaggggaggguggagcucaggcugcagaggagcgcag

SEQ ID NO: 153830 - RNA, 42 nt, Homo sapiens; identical to SEQ ID NO: 66665

SEQ ID NO: 153831 - RNA, 41 nt, Homo sapiens
gcagugaggcggggcccaggacgggaaggagcaagcugggg

SEQ ID NO: 153832 - RNA, 54 nt, Homo sapiens
ugggggcgucauauugcccuggcuuggcaucccucuuguggcuguaccccuccc

SEQ ID NO: 153833 - RNA, 28 nt, Homo sapiens
gcgggggcggcgguccgagcggcugcgg

SEQ ID NO: 153834 - RNA, 30 nt, Homo sapiens
gccgccaauggcaggccgugucgcgggacg

SEQ ID NO: 153835 - RNA, 42 nt, Homo sapiens
caagcagauccugccacaccagaugaccacggcagggcccgu

SEQ ID NO: 153836 - RNA, 42 nt, Homo sapiens
gugguggccgaccccaugcagccgccaccaaucgcggaggag

SEQ ID NO: 153837 - RNA, 45 nt, Homo sapiens
ccaggagcaggagcugcugcucacggccagcgacgacgccaccau

SEQ ID NO: 153838 - RNA, 43 nt, Homo sapiens
gcuccccacgcaccaugcgcguccuccaggcaccucgcccacg

SEQ ID NO: 153839 - RNA, 49 nt, Homo sapiens
ugcuuauagcaguuacgccuuaggaaggggacaaccaggccccgccaca

SEQ ID NO: 153840 - RNA, 22 nt, Homo sapiens
cagcccccacccucacuggcug

SEQ ID NO: 153841 - RNA, 63 nt, Homo sapiens
agggcuggcuggccgcccagaguggcuucaaacacgaucugauggagaaggaaaggaguuugu

SEQ ID NO: 153842 - RNA, 60 nt, Homo sapiens
gaguggugcugccccacggcccaagcccugggcaccacgacuacgaagggaaagggcuag

SEQ ID NO: 153843 - RNA, 42 nt, Homo sapiens
ugcuccuuugaggacucagacugcggcuucuccccuggaggc

SEQ ID NO: 153844 - RNA, 41 nt, Homo sapiens
accaaucuggggcccauggaggugguaccagaagcugagac

SEQ ID NO: 153845 - RNA, 46 nt, Homo sapiens
gcggggaccugugugugcccccggaacaacugugugacuucgagga

SEQ ID NO: 153846 - RNA, 45 nt, Homo sapiens
cucgggugagccugcugacucugcccuacccugccuugcccugga

SEQ ID NO: 153847 - RNA, 33 nt, Homo sapiens
gcugggcacccccugagccccucugcccucaga

SEQ ID NO: 153848 - RNA, 42 nt, Homo sapiens
agugucgggcgacaugcagaagcaaggcugcgacugugagug

SEQ ID NO: 153849 - RNA, 81 nt, Homo sapiens
cugauccgaguccacucggcuccccgcuccggggcuccggcugcagagagcaaggagaucgugcgcggcuacaagugggcu

SEQ ID NO: 153850 - RNA, 13 nt, Homo sapiens
ccucccggagucc

SEQ ID NO: 153851 - RNA, 45 nt, Homo sapiens
ccagagagcucugggcgcggaccagggugcacuugggggacaggu

SEQ ID NO: 153852 - RNA, 44 nt, Homo sapiens
guguuuaaagugacagacugggcuuugguuacgucgggcuucug

SEQ ID NO: 153853 - RNA, 42 nt, Homo sapiens
cuuggggcuccucuguauagaagaacuggguggggcccggcg

SEQ ID NO: 153854 - RNA, 42 nt, Homo sapiens
cggagcgccggguacgcgggcucccggcgcggcgaugccucg

SEQ ID NO: 153855 - RNA, 45 nt, Homo sapiens
guagucgccacccccaggguggcggccgcccggggccccgccccc

SEQ ID NO: 153856 - RNA, 42 nt, Homo sapiens
guaccucuuugccuuuuuucuucuucuucuucuucuccuuag

SEQ ID NO: 153857 - RNA, 45 nt, Homo sapiens
acugcucuccuuggguccggccuccuccagccccagcccgaagag

SEQ ID NO: 153858 - RNA, 44 nt, Homo sapiens
ucccucgcucucaaagucggggucauccaugacgaaggacagca

SEQ ID NO: 153859 - RNA, 37 nt, Homo sapiens
agggccucugagggugguacagggggcacagaggaug

SEQ ID NO: 153860 - RNA, 80 nt, Homo sapiens
guggggauguacuccuccacgaacggccggcccugcaggcggugccacagcgcugucuugcccguguuccugucuccccg

SEQ ID NO: 153861 - RNA, 88 nt, Homo sapiens
gaaauuaacaagguauuucaguggcuuuagccuccccauggcaucacuaagucaccuccaucaauuaaaguccugcagguacaacuga

SEQ ID NO: 153862 - RNA, 34 nt, Homo sapiens
accaucugcacucugucagccagguacgugagcu

SEQ ID NO: 153863 - RNA, 35 nt, Homo sapiens
uggcuacaggcucucagccucuggagggagaggca

SEQ ID NO: 153864 - RNA, 25 nt, Homo sapiens
cuaaguacagaucauucaagguggc

SEQ ID NO: 153865 - RNA, 45 nt, Homo sapiens
cccuggagccccuggaaaggcaggaccaguggggcccaaagguaa

SEQ ID NO: 153866 - RNA, 39 nt, Homo sapiens
cucgcccuccuacguugcggucacacccuucucccuucg

SEQ ID NO: 153867 - RNA, 36 nt, Homo sapiens
cuggucggccguggagaagcucccgccaccgccguc

SEQ ID NO: 153868 - RNA, 42 nt, Homo sapiens
cgcggccacagcgucugcuccaccuccagcuuguaccugcag

SEQ ID NO: 153869 - RNA, 66 nt, Homo sapiens
augggacccgugcugggaacagaguugguucugugugaagcugggccuugcugggggugcucagga

SEQ ID NO: 153870 - RNA, 53 nt, Homo sapiens
cauucugcaugaagaugggcccgaaauccaaugacaaguguccuuagaagaga

SEQ ID NO: 153871 - RNA, 49 nt, Homo sapiens
uuucuugcuucucaccucgcccccuugcacauugccugacacccucaua

SEQ ID NO: 153872 - RNA, 68 nt, Homo sapiens
gauaaauuauugauuacuuugucuuuaguugucuaaaaauuuauaacuuaaaauucuuuugaauaaau

SEQ ID NO: 153873 - RNA, 45 nt, Homo sapiens
aauccguucaugaaccgucgucuguuucugucucuggcagcugau

SEQ ID NO: 153874 - RNA, 40 nt, Homo sapiens
cgcagcccggcuccccgggaugggguggggacgcggccug

SEQ ID NO: 153875 - RNA, 41 nt, Homo sapiens
cagcuccucagaugucucgggaaaagagagcguccccgugg

SEQ ID NO: 153876 - RNA, 41 nt, Homo sapiens
gcagcuggaggagaagcgcagggccaucgaggcccagaaga

SEQ ID NO: 153877 - RNA, 38 nt, Homo sapiens
auuggggaggaagagucggccaaacugcaggaggacau

SEQ ID NO: 153878 - RNA, 45 nt, Homo sapiens
cgaguugauggucagccucgaggagcagcaauagccuggccagaa

SEQ ID NO: 153879 - RNA, 45 nt, Homo sapiens
aggaacugcugccuucagcccaucccauccuuuauugccacugag

SEQ ID NO: 153880 - RNA, 40 nt, Homo sapiens
caaaacuuggugugaauucaggaugguccuguacacuugu

SEQ ID NO: 153881 - RNA, 84 nt, Homo sapiens
cccgggagugaggccuucacacccaugcuucugugugcaccucucaucguucuuucucuuaagcuauaauccaaggagugguaa

SEQ ID NO: 153882 - RNA, 32 nt, Homo sapiens
aaaguggagaaacauuuuuaacauguggcgau

SEQ ID NO: 153883 - RNA, 34 nt, Homo sapiens
aguugaagaaaucucccagaaaguagaaccagaa

SEQ ID NO: 153884 - RNA, 72 nt, Homo sapiens
acucaugaguggaggacagguaggugcccuggggccccuugggccugaguuuccauguucguuuggcccugg

SEQ ID NO: 153885 - RNA, 42 nt, Homo sapiens
auuaacugccuguguccuucagugucauuauugggccccuau

SEQ ID NO: 153886 - RNA, 45 nt, Homo sapiens
ugcaccugguggacuagggcuggagggcugcagagaggggcucuc

SEQ ID NO: 153887 - RNA, 41 nt, Homo sapiens
caaguauguguaaguucagucauuagaauaaacugccaaaa

SEQ ID NO: 153888 - RNA, 48 nt, Homo sapiens
uggggauuucuuugaugauguucgccugggaggguuuuuaaguagggg

SEQ ID NO: 153889 - RNA, 34 nt, Homo sapiens
cuuguucagauuauugguuuaugaguuuagauug

SEQ ID NO: 153890 - RNA, 44 nt, Homo sapiens
caauauggauguuuuaauuggaaaucgcuuuuggggguaugaug

SEQ ID NO: 153891 - RNA, 120 nt, Homo sapiens
guauuggguucgucuaguuucacuuccgguaccaggucacucuuuaauccuuguugacucaucggaugaugaauucacaaucugauacuaacaugggcuuuugaguucuggaauuauuaa

SEQ ID NO: 153892 - RNA, 48 nt, Homo sapiens
cgcgcauugugcuuaaucauaaugauccccuuugguuaauuccuguuu

SEQ ID NO: 153893 - RNA, 42 nt, Homo sapiens
uguacuuggugcgggccaggugggaggcgcgcacgggcccgc

SEQ ID NO: 153894 - RNA, 35 nt, Homo sapiens
gggcagcacuggggaaagggggccuuggggacagu

SEQ ID NO: 153895 - RNA, 39 nt, Homo sapiens
cuucuacacagagucacccagcucuugcccacagaggcc

SEQ ID NO: 153896 - RNA, 42 nt, Homo sapiens
gcuacacggccugcggggagaagcggcccgccggggauccgg

SEQ ID NO: 153897 - RNA, 37 nt, Homo sapiens
ggucgcggggaggcggcgggccugggccuggggcugg

SEQ ID NO: 153898 - RNA, 47 nt, Homo sapiens
uccugaguggggaggccacugcccuacaacccaggggacagaguggu

SEQ ID NO: 153899 - RNA, 46 nt, Homo sapiens
gcuguuccacaucgauacugccggcugcuuggaggucguccgagag

SEQ ID NO: 153900 - RNA, 45 nt, Homo sapiens
gugggcagcggcgcuggagacacgcucugcaccggaggcuccuga

SEQ ID NO: 153901 - RNA, 47 nt, Homo sapiens
uaaaacguucuuugcuuuucaugucacguucagguaucucaggagau

SEQ ID NO: 153902 - RNA, 45 nt, Homo sapiens
ugcuucaagcuguugccaaauacggggagcaggauugguuuaaaa

SEQ ID NO: 153903 - RNA, 54 nt, Homo sapiens
gccugcagaaauuccagcagcacaacaaagcucugaaacgcaaggaguggacag

SEQ ID NO: 153904 - RNA, 55 nt, Homo sapiens
ggggguaagggccuggccuggaccccaggggccaggagaccugagggcguguggg

SEQ ID NO: 153905 - RNA, 51 nt, Homo sapiens
ucggagcaccccagcaucaacaagcaggaguggagcagggaggaggaggag

SEQ ID NO: 153906 - RNA, 49 nt, Homo sapiens
ucuccagugagcuggagaggcaagcccuggagaagcagggcagggaagc

SEQ ID NO: 153907 - RNA, 48 nt, Homo sapiens
gagaacaggaggcagggggagcccgaguccuuuugugggcucuggagg

SEQ ID NO: 153908 - RNA, 55 nt, Homo sapiens
cagggucugggccuggccuccuugggccugugcagggcuucuggaguggaccauc

SEQ ID NO: 153909 - RNA, 32 nt, Homo sapiens
auggccccucgcgguucuuuagcacgguuagu

SEQ ID NO: 153910 - RNA, 28 nt, Homo sapiens
cagagguggagugcuccacggugaccac

SEQ ID NO: 153911 - RNA, 45 nt, Homo sapiens
ucaccugugguucccuuugguuugcuggaagcgagugagugcagg

SEQ ID NO: 153912 - RNA, 69 nt, Homo sapiens
aagagacugaagaaaagauuuaaauacuaauaaaaaucaguagauaauuucuguagguucugcuggagg

SEQ ID NO: 153913 - RNA, 47 nt, Homo sapiens
cuccugguggacucaacccuguucaacucagagacgggccuccucuc

SEQ ID NO: 153914 - RNA, 47 nt, Homo sapiens
gucacugggaaggagccccagagagccggcugucugacaugauggcu

SEQ ID NO: 153915 - RNA, 51 nt, Homo sapiens
gcuuggauuggacagugacgugcauguugacuuucguccguguuuuaugug

SEQ ID NO: 153916 - RNA, 28 nt, Homo sapiens
cccuccuccaggccugaggguucccagg

SEQ ID NO: 153917 - RNA, 24 nt, Homo sapiens
agcaugcagagagccugggguugg

SEQ ID NO: 153918 - RNA, 37 nt, Homo sapiens
uuugccagaugacaagaacaaaucggugagugcuguc

SEQ ID NO: 153919 - RNA, 46 nt, Homo sapiens
ugugugaccccagggccugcacuuggcuuccuggagcccuccgggc

SEQ ID NO: 153920 - RNA, 42 nt, Homo sapiens
ccagccgccgcagcagccucagcucccacucgcaccagguac

SEQ ID NO: 153921 - RNA, 41 nt, Homo sapiens
uaugaccggagguauuggugugaugcagaguaugacgcaua

SEQ ID NO: 153922 - RNA, 46 nt, Homo sapiens
uuagcaggugccuugugcaaaagacacugaugacaugcagcccugg

SEQ ID NO: 153923 - RNA, 43 nt, Homo sapiens
gugagggugagcagacagguguuuccuagaggcccugagaggc

SEQ ID NO: 153924 - RNA, 42 nt, Homo sapiens
gucagaagggggcccgccccgaggagcaaggcugccguggcu

SEQ ID NO: 153925 - RNA, 46 nt, Homo sapiens
guacgaugccuaccagccucaguacucuuugccguacccaccggag

SEQ ID NO: 153926 - RNA, 48 nt, Homo sapiens
gcuggugccaccccagcaacaggcuucucccccacaacuacccaaagc

SEQ ID NO: 153927 - RNA, 42 nt, Homo sapiens
gcacccuggugccugaugguaauaaggcaaaccauuccaguc

SEQ ID NO: 153928 - RNA, 46 nt, Homo sapiens
aucgaacucucaugagaagaaucaguccuggagagaggcuuuggug

SEQ ID NO: 153929 - RNA, 45 nt, Homo sapiens
ccgguaaaaucucacuuaguugggguaaaaccauuugaggcagau

SEQ ID NO: 153930 - RNA, 45 nt, Homo sapiens
aagugagccccucaauuuggacccuuccuccccgagugaccaguu

SEQ ID NO: 153931 - RNA, 38 nt, Homo sapiens
ucuggcgauguuuuuccaagggggagagacagaaaaug

SEQ ID NO: 153932 - RNA, 45 nt, Homo sapiens
ugaacccccucgcccggggagauagcccagaaaaccguacgcacc

SEQ ID NO: 153933 - RNA, 42 nt, Homo sapiens
gaauugugaaucacugggcaagcccagagcucaggcagaauc

SEQ ID NO: 153934 - RNA, 47 nt, Homo sapiens
aauaaugcagcaguggcuccgacaacuugcccguugcagccggucac

SEQ ID NO: 153935 - RNA, 45 nt, Homo sapiens
caguucaagucacaagauuguuccaaaugaaaguggcauguugcu

SEQ ID NO: 153936 - RNA, 46 nt, Homo sapiens
aacaucuaacuguaugugguugcgauucuaacuuagaagaguugga

SEQ ID NO: 153937 - RNA, 46 nt, Homo sapiens
aaccaaagagcagaguuguuuguuuguaauuucuugauugggcgau

SEQ ID NO: 153938 - RNA, 48 nt, Homo sapiens
gucagcacuguacuccguugcuguuuuuuuauaaacacacucuuggaa

SEQ ID NO: 153939 - RNA, 42 nt, Homo sapiens
ugcgcucguggacaccugccaccgggccaugaggaccaccuu

SEQ ID NO: 153940 - RNA, 49 nt, Homo sapiens
gcaccuggugcccaggcaggacaguggggucaaaguuggagagcagugg

SEQ ID NO: 153941 - RNA, 46 nt, Homo sapiens
uccccgugguguacucuuccuucuccuccuucuacaacaccaagaa

SEQ ID NO: 153942 - RNA, 30 nt, Homo sapiens
ccuggacaugauggguaggccgggccucgg

SEQ ID NO: 153943 - RNA, 39 nt, Homo sapiens
agugccagggcuggggaggggacagggguuugugucgca

SEQ ID NO: 153944 - RNA, 66 nt, Homo sapiens
cagaggucagacugggcugccaaagacggcgggggcugccugcuccugggcgggguggcugcugga

SEQ ID NO: 153945 - RNA, 52 nt, Homo sapiens
aucgcaguuuuaucugugggguuugaguuuuucaugagcagaauguacaccu

SEQ ID NO: 153946 - RNA, 47 nt, Homo sapiens
auuacgagaugcaugugcgagccgccaacaucgugaguggccagggu

SEQ ID NO: 153947 - RNA, 40 nt, Homo sapiens
agacaggagaggccaggggcugagcagcgcgagugaauag

SEQ ID NO: 153948 - RNA, 46 nt, Homo sapiens
gccauguccccaagccaaaggcagucacagggaugaggagcaggac

SEQ ID NO: 153949 - RNA, 41 nt, Homo sapiens
cgggagcacccgagccugcggcuccagacggacgcccgcaa

SEQ ID NO: 153950 - RNA, 59 nt, Homo sapiens
aggggagaggggagagcaggagagaggggagggcaggggagagggcgcggcgggaucag

SEQ ID NO: 153951 - RNA, 45 nt, Homo sapiens
gugccugccugccuggugcaccggaggaggaggagggaggaccag

SEQ ID NO: 153952 - RNA, 46 nt, Homo sapiens
gacuuuuugacagacaaagaggaugagaaggcaaagcccccaagag

SEQ ID NO: 153953 - RNA, 70 nt, Homo sapiens
ccucuuuuggccuugguccugcuuaucuaccaaaggcggggaagucuccacuccugcccugauggcaaag

SEQ ID NO: 153954 - RNA, 41 nt, Homo sapiens
aucaccgcaaacccaagagcuucagcuccuguaaacagcca

SEQ ID NO: 153955 - RNA, 47 nt, Homo sapiens
cacugcauacaacaaacgccauuauuuauuuugauguguuuccaaaa

SEQ ID NO: 153956 - RNA, 49 nt, Homo sapiens
aggauaagugggaucuaccaauugauucuggcaaaacaauuucuaagau

SEQ ID NO: 153957 - RNA, 43 nt, Homo sapiens
uuggcugcauucggcauagcaaacggacaaucugagugagcga

SEQ ID NO: 153958 - RNA, 44 nt, Homo sapiens
ggcccagggccaccaccaggagcaagcccccaaucaccgacaug

SEQ ID NO: 153959 - RNA, 42 nt, Homo sapiens
cauacggaugccguccuccaggaaggugcugaucagacagag

SEQ ID NO: 153960 - RNA, 22 nt, Homo sapiens
aggcccugcggucccucccggc

SEQ ID NO: 153961 - RNA, 28 nt, Homo sapiens
uggggaugcugacuccuccccuggcccu

SEQ ID NO: 153962 - RNA, 112 nt, Homo sapiens
gggggaggagagcauggccgcccguguguccaucgugaaccaguaugggaagugcguuuaugacaaguacgucaaaccaacugagcccgugacggacuauaggacagcgguc

SEQ ID NO: 153963 - RNA, 69 nt, Homo sapiens
cugguuugacgacguggacccagcggauaucgaagcugccauagguccagaggcggccaagauagcgag

SEQ ID NO: 153964 - RNA, 48 nt, Homo sapiens
ggagggcgccaguaccucgcaccaaggccaguggaacagagcacaaua

SEQ ID NO: 153965 - RNA, 48 nt, Homo sapiens
caaaaagaagcccaaaauuauccagcaaaacaaaaaagagaccucgcc

SEQ ID NO: 153966 - RNA, 51 nt, Homo sapiens
ccggguccugucaagacgcucacucggaagaaaaacaagaagaaaaaaagg

SEQ ID NO: 153967 - RNA, 121 nt, Homo sapiens
gagcuggaugcucggagcagcaaggcggcccugggggccccuuccggucccggggcugacgccuggcggcgucuccgggaacccgcgcccuuucaagcgccgcuggcuccuguuucacaga

SEQ ID NO: 153968 - RNA, 48 nt, Homo sapiens
ugaacgugaagaucaaacugugguguaagaacccaagaagcgcagaau

SEQ ID NO: 153969 - RNA, 47 nt, Homo sapiens
ggcggcggggccgggcgcucggggcgucgcgucggccgccgccuggg

SEQ ID NO: 153970 - RNA, 24 nt, Homo sapiens
gauuuccaagaaaaaggaugaaaa

SEQ ID NO: 153971 - RNA, 92 nt, Homo sapiens
ggucucgggcuucuucuccuccgucgccauggcucugacgcuggccgcacaggagacaaggguggagggacccggugacagaggcagucugu

SEQ ID NO: 153972 - RNA, 45 nt, Homo sapiens
uuugucaucugaggcagaaacaagaagguuagaaucugacgacca

SEQ ID NO: 153973 - RNA, 44 nt, Homo sapiens
ccgaugagcgucuucaggcacuggccugaggcggugucccagau

SEQ ID NO: 153974 - RNA, 89 nt, Homo sapiens
cuggcgcaggaccucacucgagcggagcgcccacggggagcgggucgcggggcggcggcggcgaggaggaggcgagaaggaguuggagg

SEQ ID NO: 153975 - RNA, 41 nt, Homo sapiens
gagccaggagccuggccuggcucccaggaccugggaucuca

SEQ ID NO: 153976 - RNA, 46 nt, Homo sapiens
ucccagggugggaccuauuuggaagucauccuucgagcauggccag

SEQ ID NO: 153977 - RNA, 59 nt, Homo sapiens
cccucucuuccucccucccucucucccauccccuuccuuccuucccuuugucccuccau

SEQ ID NO: 153978 - RNA, 47 nt, Homo sapiens
cuguaagaaggggguggugacuguaacuacaguaggguuuuagugau

SEQ ID NO: 153979 - RNA, 58 nt, Homo sapiens
agagagcucaggggaugaggagggaagcagugauucucagggacaccgggagcuucgg

SEQ ID NO: 153980 - RNA, 50 nt, Homo sapiens
gggccccugccuggcugucuaggagaaaagggcaaaagagaggggcucuu

SEQ ID NO: 153981 - RNA, 64 nt, Homo sapiens
uggccaaugagaagaggugucugggaggcuggguguguggccccugccagccucaggagccacg

SEQ ID NO: 153982 - RNA, 45 nt, Homo sapiens
acaaagacaacaggcuuuugcgccacgcggcgaucuuccaaaggc

SEQ ID NO: 153983 - RNA, 46 nt, Homo sapiens
ugcauuucccgaggacuucuccauccuaacaacugugaaagccaag

SEQ ID NO: 153984 - RNA, 44 nt, Homo sapiens
gcguccacaagaaaaaugucaccuugauccucgacuguaaaaag

SEQ ID NO: 153985 - RNA, 42 nt, Homo sapiens
gcuuuguguuuucagaaacauggccucaguggccagggugag

SEQ ID NO: 153986 - RNA, 55 nt, Homo sapiens
uggugauguuuauggugguggauaugcugaugauggugauggugguugugauggu

SEQ ID NO: 153987 - RNA, 42 nt, Homo sapiens
gauggauaggugaaugggugaauggauggauagauggaugga

SEQ ID NO: 153988 - RNA, 74 nt, Homo sapiens
gugacauccagcagcugcucuuugucucggaccaccgggcagcuuaugauuacugugagcacuacagcccugac

SEQ ID NO: 153989 - RNA, 60 nt, Homo sapiens
aguacacggaaggagacggcgagggugagaccuauuacuacgaauaccccuacuacgaag

SEQ ID NO: 153990 - RNA, 59 nt, Homo sapiens
accccgaagaccuagggaaggagcccacccccagcaagaagcccguggaagcugccaaa

SEQ ID NO: 153991 - RNA, 56 nt, Homo sapiens
aagaggacgucggcaucggggacuaugacuacgugcccagugaggacuacuacacg

SEQ ID NO: 153992 - RNA, 84 nt, Homo sapiens
accucaccuauggcgagggggaggagaaccccgaccagcccacagacccaggcgcuggggccgaaauucccaccagcaccgccg

SEQ ID NO: 153993 - RNA, 71 nt, Homo sapiens
agcuccgccuccaggggaaggugcggaugacuuggagggggaguucacugaggaaacgauccggaaccuug

SEQ ID NO: 153994 - RNA, 60 nt, Homo sapiens
acgagaacuacuacgaccccuacuacgaccccaccagcuccccgucggagaucgggccgg

SEQ ID NO: 153995 - RNA, 41 nt, Homo sapiens
gcgagaaaggccaaaagggagaaccagcgauuaucgagccg

SEQ ID NO: 153996 - RNA, 66 nt, Homo sapiens
agcuucguguuggcucauguucccgaguaagcuggcucugugaguguagacguggugucugggcuc

SEQ ID NO: 153997 - RNA, 52 nt, Homo sapiens
ucagcugccuuugucagagacggaaauuggaaaacuggcaucuuggaggcug

SEQ ID NO: 153998 - RNA, 31 nt, Homo sapiens
gggcccuccuggcuuugccaccugccacugg

SEQ ID NO: 153999 - RNA, 47 nt, Homo sapiens
cugguccuuccggcccaccaggaccuccgggagacgauggagaaagg

SEQ ID NO: 154000 - RNA, 45 nt, Homo sapiens
ugcuugggccgaaggggcccccagguccucccggaccucccguaa

SEQ ID NO: 154001 - RNA, 43 nt, Homo sapiens
gugucacggguauggacggccagccggggccaaaaggaaaugu

SEQ ID NO: 154002 - RNA, 45 nt, Homo sapiens
uggccccccaggacagcaggguaauccaggcgcccagguaaguga

SEQ ID NO: 154003 - RNA, 23 nt, Homo sapiens
gggcugggggcaugggggcugga

SEQ ID NO: 154004 - RNA, 45 nt, Homo sapiens
ccaccuggcccccaggguccgauuggcuacccagguccucgagga

SEQ ID NO: 154005 - RNA, 43 nt, Homo sapiens
ggggccgauggcauccguggucugaagggcacaaagggcgaga

SEQ ID NO: 154006 - RNA, 30 nt, Homo sapiens
cggcuuuccuggguuuaaaggagacauggg

SEQ ID NO: 154007 - RNA, 50 nt, Homo sapiens
ggagaucggcccacccggucccaggggagaagauggcccugaaggcccaa

SEQ ID NO: 154008 - RNA, 47 nt, Homo sapiens
acucggagucccaggguuaccaggguauccaggaagacaaggaccaa

SEQ ID NO: 154009 - RNA, 49 nt, Homo sapiens
gcucuauuggauucccuggauuuccuggcgccaauggagagaagggcgg

SEQ ID NO: 154010 - RNA, 41 nt, Homo sapiens
ugaagauuguuugaaacagcucuggucccaguguggggcag

SEQ ID NO: 154011 - RNA, 41 nt, Homo sapiens
ggaccccuggaaagccaggaccgcgggggcagcgaggccca

SEQ ID NO: 154012 - RNA, 42 nt, Homo sapiens
aggguccgaggggugaaagaggcccccggggcaucacuggga

SEQ ID NO: 154013 - RNA, 45 nt, Homo sapiens
aagggcaacuccggaggugacggcccagcuggcccuccuggugaa

SEQ ID NO: 154014 - RNA, 45 nt, Homo sapiens
agggcccuccaggcaaggauggacucccaggacacccuggacaga

SEQ ID NO: 154015 - RNA, 46 nt, Homo sapiens
ccccuggaccccccggugaacaggggcuuccgggccuugcuggaaa

SEQ ID NO: 154016 - RNA, 44 nt, Homo sapiens
gggugacccaggcccugcaggccucccugggaaagauggcccuc

SEQ ID NO: 154017 - RNA, 42 nt, Homo sapiens
gggagaccugggccccagggacccccagggccggcaggagag

SEQ ID NO: 154018 - RNA, 45 nt, Homo sapiens
ucccggguccagcuggcccugugggucccccuggagaagacggag

SEQ ID NO: 154019 - RNA, 33 nt, Homo sapiens
cucaaggccccaucggacagccaggccccucug

SEQ ID NO: 154020 - RNA, 76 nt, Homo sapiens
gcgagccggggccucggggccagcagggccuuuucgggcagaaaggugaugaaggucccagaggcuuuccuggacc

SEQ ID NO: 154021 - RNA, 44 nt, Homo sapiens
ucaggguuugccaggaccuccaggcgagaagggugagacaggag

SEQ ID NO: 154022 - RNA, 46 nt, Homo sapiens
cccacaaggucccccagguggaauaggaaacccuggugcaguggga

SEQ ID NO: 154023 - RNA, 34 nt, Homo sapiens
acacguguguguaccucucuguguguacacagag

SEQ ID NO: 154024 - RNA, 41 nt, Homo sapiens
ccagacgaugccccaccagcaaagccccugccuccuccaag

SEQ ID NO: 154025 - RNA, 46 nt, Homo sapiens
ccuagggcgagccuggcgaagcaggugagccuggccuuccgggaga

SEQ ID NO: 154026 - RNA, 80 nt, Homo sapiens
ggggagagaagggcgagucaggcccuucaggugcugccggacccccuggacccaaaggcccucccggagaugaugguccc

SEQ ID NO: 154027 - RNA, 46 nt, Homo sapiens
gguuuuccuggagauccuggcccccccggagagccuggccccgcgg

SEQ ID NO: 154028 - RNA, 42 nt, Homo sapiens
ggucccccuggugacaaaggagaugauggugaacccgggcag

SEQ ID NO: 154029 - RNA, 45 nt, Homo sapiens
cccccaggccccgcaggccccgaaggcagacagggagagaaaggg

SEQ ID NO: 154030 - RNA, 45 nt, Homo sapiens
caugccguccgcguaguccacguaguucucgccauucccgucguc

SEQ ID NO: 154031 - RNA, 77 nt, Homo sapiens
gacgacgggaauggcgagaacuacguggacuacgcggacggcauggaagagaucuucggcucucucaacucucugaa

SEQ ID NO: 154032 - RNA, 42 nt, Homo sapiens
cagaugaaacggccccugggcacgcagcagaaccccgcccgc

SEQ ID NO: 154033 - RNA, 91 nt, Homo sapiens
cgagggcaacccugugggugugguacagaugaccuuccugcggcugcugagcgccucugcccaccagaacgucaccuaccacugcuaccag

SEQ ID NO: 154034 - RNA, 95 nt, Homo sapiens
agaggagggauugggaucacggggauacccagacugcacucugggcagggagaggagaagcagcccccuccccagggcuguucuacuucuggaaa

SEQ ID NO: 154035 - RNA, 79 nt, Homo sapiens
cgguucuggagaucgacacccccaaaguggagcaggugcccaucguggacaucauguucaaugacuucggugaagcguc

SEQ ID NO: 154036 - RNA, 44 nt, Homo sapiens
cgugcacguccugacccuggacagugaaggcuucucccuccccu

SEQ ID NO: 154037 - RNA, 44 nt, Homo sapiens
agccgcgcccccaccuggagcugaaucacaugaccuagcugcac

SEQ ID NO: 154038 - RNA, 49 nt, Homo sapiens
cuguucgugaauaggucucagggguugggggagggacugccagauuugg

SEQ ID NO: 154039 - RNA, 38 nt, Homo sapiens
uuuuaacaaccuccaacacgauccauuuagaggccaaa

SEQ ID NO: 154040 - RNA, 56 nt, Homo sapiens
auguuaagugugccuggcuuucaaucaugcacggaaacccagucucagucccacgg

SEQ ID NO: 154041 - RNA, 50 nt, Homo sapiens
uggguugcaguaccguucugauuagaaauaggaagucuccccacccccgc

SEQ ID NO: 154042 - RNA, 51 nt, Homo sapiens
aaaauuugauaauuuucuuuuuucuacaugcacuuaagacuaaaacacagg

SEQ ID NO: 154043 - RNA, 46 nt, Homo sapiens
uccgcuuuucuucccgcagagccugaugggagaauguccagggcag

SEQ ID NO: 154044 - RNA, 43 nt, Homo sapiens
guuccugaauguuuguggugcuaauuucuguguuuguuccaag

SEQ ID NO: 154045 - RNA, 74 nt, Homo sapiens
agauggaguaauguacaaugaacuccaugagucucuccagggcugccugcagcacgucuuuuccaaguagccua

SEQ ID NO: 154046 - RNA, 54 nt, Homo sapiens
uggggugagccugcggggcucuggugcuguccccgacccccaccaccaccagaa

SEQ ID NO: 154047 - RNA, 45 nt, Homo sapiens
augugccaaugacugucaccuucaucucuucaaaagaaaagccau

SEQ ID NO: 154048 - RNA, 49 nt, Homo sapiens
augacacauuguacgguuucaaaaaauccgcuagacaugucauaaguuu

SEQ ID NO: 154049 - RNA, 51 nt, Homo sapiens
aauuaacuguaauaguuuuucaauaaaucgaguuggguguuuccaccguaa

SEQ ID NO: 154050 - RNA, 68 nt, Homo sapiens
aggaccugaucucugggccgugugggaacacuggcugccauuucaucacagucaaccuggacucacag

SEQ ID NO: 154051 - RNA, 46 nt, Homo sapiens
caaccacgcaggagaacgagggcagcacgaagccggcaacccccug

SEQ ID NO: 154052 - RNA, 46 nt, Homo sapiens
cagaagcaauccuggacaucuccaagacgauccugccggccccugu

SEQ ID NO: 154053 - RNA, 46 nt, Homo sapiens
aagugcuuuuggucagcugcccagcugugccacagcgggcaccgag

SEQ ID NO: 154054 - RNA, 29 nt, Homo sapiens
ugguuccguggcugcaaggaagggaaaca

SEQ ID NO: 154055 - RNA, 30 nt, Homo sapiens
ccguacuuucuguucaauuuuucuauagau

SEQ ID NO: 154056 - RNA, 93 nt, Homo sapiens
uccucuagggcagggucuguuaguauccucauucucgcauugagaugacugggauguagaaggaacaacuuggccaagaucuaggaguauaaa

SEQ ID NO: 154057 - RNA, 45 nt, Homo sapiens
guagucgcugguccucuccggcggggccguggccuugggcgccac

SEQ ID NO: 154058 - RNA, 27 nt, Homo sapiens
uuccucagccauugugccuggaggaga

SEQ ID NO: 154059 - RNA, 68 nt, Homo sapiens
augcccuugcgguaggccaugugggcggugaaguucaaggccagcuggaggugcguggcugucuguuc

SEQ ID NO: 154060 - RNA, 37 nt, Homo sapiens
gcugaguaaguaacaacgacugaggaugccgcugacc

SEQ ID NO: 154061 - RNA, 44 nt, Homo sapiens
acgggaauccagaacgacgcuguauggaccccucuguagguagc

SEQ ID NO: 154062 - RNA, 41 nt, Homo sapiens
guuccugcuacaaggaacuuaaggacauccuccuccuucau

SEQ ID NO: 154063 - RNA, 40 nt, Homo sapiens
ccucuggccaguauuccuggaggauauaacacugacauca

SEQ ID NO: 154064 - RNA, 45 nt, Homo sapiens
uaacauaagaugccuccgugagaggcugguggucagcccuggggu

SEQ ID NO: 154065 - RNA, 66 nt, Homo sapiens
ucaggcaugaccucccauagguguucacgagaaauggugccacgcaugcgcagaacuucccgagcc

SEQ ID NO: 154066 - RNA, 45 nt, Homo sapiens
gcagugggagcugcagaccagucuuccauggcaggcugagcacuc

SEQ ID NO: 154067 - RNA, 28 nt, Homo sapiens
gaggguacugugaccugcaaccaagaag

SEQ ID NO: 154068 - RNA, 45 nt, Homo sapiens
cauaagcaugcccauuuuacaggcaggaacauugaggaucacaga

SEQ ID NO: 154069 - RNA, 47 nt, Homo sapiens
cuacucugagccccaggaaguguguggugugugugucugcgugugug

SEQ ID NO: 154070 - RNA, 45 nt, Homo sapiens
ccucacccuggcuuggcugcccugggaggggacacugggagucca

SEQ ID NO: 154071 - RNA, 89 nt, Homo sapiens
cucagagucuucuuuuugggccaggggugggugugcgcugguggggguuggaagugagccaucggaaagcccaucggaaagccccagcc

SEQ ID NO: 154072 - RNA, 21 nt, Homo sapiens
aaccagccccaggacgggggg

SEQ ID NO: 154073 - RNA, 47 nt, Homo sapiens
accagaccauagagcuacguggaguacaggggcuguuuaaaccaucu

SEQ ID NO: 154074 - RNA, 36 nt, Homo sapiens
cgccuccauuuuuguguauaaaccacccuauuaagc

SEQ ID NO: 154075 - RNA, 51 nt, Homo sapiens
gucccacagcuggcucuggagccugcuggagcuccggagcuggugcuggag

SEQ ID NO: 154076 - RNA, 47 nt, Homo sapiens
agccucaccaagccccagcuccaacaggcggcucacgccugcccacc

SEQ ID NO: 154077 - RNA, 46 nt, Homo sapiens
ucugggcucucuugggguucaucuccaggguggcaaacuuggaggu

SEQ ID NO: 154078 - RNA, 45 nt, Homo sapiens
uacagauaguccuucauggcaguguccagcaucaccaggucggug

SEQ ID NO: 154079 - RNA, 46 nt, Homo sapiens
aggagacuccgggacgaagcugauguugaucuccuccacgucggag

SEQ ID NO: 154080 - RNA, 46 nt, Homo sapiens
ggcugacgcggaugauacagcagucgcccaccugcugguuguagag

SEQ ID NO: 154081 - RNA, 68 nt, Homo sapiens
aagagcacaagaggaagagagagacccucacugcuggggagucccugccacacucagucccccaccac

SEQ ID NO: 154082 - RNA, 71 nt, Homo sapiens
ugaguguggcagggacuccccagcagugagggucucucucuuccucuugugcucuuacuggggcugguggu

SEQ ID NO: 154083 - RNA, 44 nt, Homo sapiens
uucguuccggccgaaauuugaaaggaggaaaaacgacgcgaucg

SEQ ID NO: 154084 - RNA, 43 nt, Homo sapiens
ucuccugcgggguuccccuucgcuccuaaaaagcgccagucca

SEQ ID NO: 154085 - RNA, 88 nt, Homo sapiens
agaugaugacucaggucacuguaaaaugaaccguuaugauaagaagauugauagucuaaugaaugcgguugguugucugaagucugag

SEQ ID NO: 154086 - RNA, 47 nt, Homo sapiens
gaugcaaaaaggugagcgccagauggccaaaagguuccuggaggaac

SEQ ID NO: 154087 - RNA, 52 nt, Homo sapiens
augcgcucgauguugugccucaacaccguguucucgugcucagucucagcca

SEQ ID NO: 154088 - RNA, 45 nt, Homo sapiens
ugagacugagcacgagaacacgguguugaggcacaacaucgagcg

SEQ ID NO: 154089 - RNA, 42 nt, Homo sapiens
aacaggagaaggagugccucauguccaagcugguggaggcgg

SEQ ID NO: 154090 - RNA, 98 nt, Homo sapiens
ccuguuccggagcgagugguugggaggggggcauuugcggacaggaguggguccccgcaaagagcggaaaggaggugguguguguguccauguuggag

SEQ ID NO: 154091 - RNA, 54 nt, Homo sapiens
cagcauuucaaaccaaccggugccaaaggugaccucaggccggguaacccauga

SEQ ID NO: 154092 - RNA, 45 nt, Homo sapiens
ucagggcucggcaccuagaggcucuccggaggcagcugcaugugg

SEQ ID NO: 154093 - RNA, 351 nt, Homo sapiens
ggccuuggggaaucgaggaauauuuucuuuucuuuuuuuuuugagauggagucucgcacugucgcccagacuggagugcaguggugcgauaucagcucacugcaaccuccgccuccuggguucaagcaauucuccugccucagcuucccgaguagcugggauuacaggccugcaccaccaugccuggcuaauuuuuguauuauuaguagagacagaguuuugccauguuggccaggcuggucucaaacuccugaccucaggugauccaucugccuuggccucccaaagugcugggauuacaggcgugagccaaccaugcccggcccaaggaauguuuucuagaggaggugg

SEQ ID NO: 154094 - RNA, 35 nt, Homo sapiens
aggucaccugcagggguaggggcaggguuguggac

SEQ ID NO: 154095 - RNA, 37 nt, Homo sapiens
cugcgauccugucauugagaggcggccccggcugcag

SEQ ID NO: 154096 - RNA, 37 nt, Homo sapiens
caucacaugagccgggaggaccugaucugugggggcg

SEQ ID NO: 154097 - RNA, 55 nt, Homo sapiens
gaaaguuuuccuucccucuaauacucuugcucucuccuguagccuguacugcgag

SEQ ID NO: 154098 - RNA, 46 nt, Homo sapiens
aagugugcacuggcagcagccugggcggggcugggguggagcccgg

SEQ ID NO: 154099 - RNA, 64 nt, Homo sapiens
agaccccagaacggagcuucaagucagacagaucccugccuuggugggcaguucugccuuccaa

SEQ ID NO: 154100 - RNA, 43 nt, Homo sapiens
gaggaagagggcagcagcccagcuguuuaggguugcuggaggc

SEQ ID NO: 154101 - RNA, 45 nt, Homo sapiens
cagcaaccccuucgaccgaggccugacccgcaaccuggcccacuu

SEQ ID NO: 154102 - RNA, 45 nt, Homo sapiens
ccagguugcgggucaggccucggucgaagggguugcuggggcgcu

SEQ ID NO: 154103 - RNA, 45 nt, Homo sapiens
cucccugcugcucuaccucgcugugucacucauggacccuggcua

SEQ ID NO: 154104 - RNA, 45 nt, Homo sapiens
aggggcauacggaaggguccagcaggcuucagcccagggagguga

SEQ ID NO: 154105 - RNA, 47 nt, Homo sapiens
cugggacccacaugauccuucccaggaacugaccccaaaucuuccua

SEQ ID NO: 154106 - RNA, 44 nt, Homo sapiens
ggaagaugcugggauuaauuagggaucaacgggguaucagacag

SEQ ID NO: 154107 - RNA, 41 nt, Homo sapiens
aucccuggagauccugggauuggcccgaucuccaccagcuc

SEQ ID NO: 154108 - RNA, 27 nt, Homo sapiens
ggaucuggccugggggaggggccagac

SEQ ID NO: 154109 - RNA, 45 nt, Homo sapiens
ccgacaccuuguggccaggaguuuaagagaaaaaggaaagaaaau

SEQ ID NO: 154110 - RNA, 42 nt, Homo sapiens
gaagucaaagcgguugucaucggcgaagagggagucccagau

SEQ ID NO: 154111 - RNA, 76 nt, Homo sapiens
agccgcauauucacagugaaguccccuuccagcaacugcucccggaucagccuaugaaaagcagcagcaaaagcgc

SEQ ID NO: 154112 - RNA, 49 nt, Homo sapiens
cgggcuacuuugagucuuggagcuccuuggcuuucugcaggaucuggca

SEQ ID NO: 154113 - RNA, 44 nt, Homo sapiens
gggcaggagggcugcuggggccugacuccugccagccagucugg

SEQ ID NO: 154114 - RNA, 78 nt, Homo sapiens
ggcaucaaaggaaaagccugguagaagagccaccuggggaagccuuuccuggcccaaagccgggcuuggaagggcagc

SEQ ID NO: 154115 - RNA, 43 nt, Homo sapiens
gaaggggcugaaccaccagcugacaaguccuggagagagggug

SEQ ID NO: 154116 - RNA, 43 nt, Homo sapiens
acagggcuccugaacccccuggacagcccccaccacaugcguc

SEQ ID NO: 154117 - RNA, 42 nt, Homo sapiens
gcggcagcgggcacaggaggaacaggcaaagcgccuggaaga

SEQ ID NO: 154118 - RNA, 45 nt, Homo sapiens
ugaacacggccaaaggauugaguggcgaaaauggaagcaacagag

SEQ ID NO: 154119 - RNA, 41 nt, Homo sapiens
gagggggcucgcgcgccgcggagccggcgagaagguggugc

SEQ ID NO: 154120 - RNA, 46 nt, Homo sapiens
uggcccagccaccagagagagccaaaggaucagcaggaguuaccca

SEQ ID NO: 154121 - RNA, 87 nt, Homo sapiens
ggcaccccuccuguaccagagaugggaaggcuggcccuccagugcucucccagggagcgcgaaggggccgcucucaacaggcccugu

SEQ ID NO: 154122 - RNA, 50 nt, Homo sapiens
agggaggagagccuuauucuuaauccccucucuugaggccgcuccccuag

SEQ ID NO: 154123 - RNA, 47 nt, Homo sapiens
ucugccgaccccugacacgggccccacaggcaucaaguaugaccugg

SEQ ID NO: 154124 - RNA, 46 nt, Homo sapiens
uggugcgcgggaauuugaaccagaaguugcugcaggccaggaagau

SEQ ID NO: 154125 - RNA, 45 nt, Homo sapiens
ugucggagacagugguggaggagagcgaccccaagccggccuuca

SEQ ID NO: 154126 - RNA, 46 nt, Homo sapiens
guuguugagguucagcugccgcagcuuguucucacucaccuccgac

SEQ ID NO: 154127 - RNA, 46 nt, Homo sapiens
guucaccgacaucaaggagaucccgcuguggaucuauagccugaag

SEQ ID NO: 154128 - RNA, 46 nt, Homo sapiens
guagcgguuguucuccgcgcucagguugcccgucaggugcagcucc

SEQ ID NO: 154129 - RNA, 46 nt, Homo sapiens
accaccuguggcagcuugcuuagguugcucuugagccgcagcaccu

SEQ ID NO: 154130 - RNA, 110 nt, Homo sapiens
ugguuguaccacagcuuaaggcaggugaggcggugcaggugcuggaagcugaugaucuccucgauggucuugagguuguuguccuugaggucaaucuccugcagguugug

SEQ ID NO: 154131 - RNA, 45 nt, Homo sapiens
cugccuuaagcugugguacaaccacaucgccuacauccccaucca

SEQ ID NO: 154132 - RNA, 75 nt, Homo sapiens
cggcaguagaagagcuggguggggaucuucucgaucuuguugcgguucagguagaggcgcuccagguuggugagg

SEQ ID NO: 154133 - RNA, 78 nt, Homo sapiens
uggagguucugcaggaggccgaugucggcagggaggaaggucagguuguuguggcugagguccagguagcgcagcuug

SEQ ID NO: 154134 - RNA, 43 nt, Homo sapiens
gucacugcccuccagggugggcgagcugaccaaccugacgcag

SEQ ID NO: 154135 - RNA, 64 nt, Homo sapiens
aggaggaccuguucaacacacugccacccgaggugaaggagcggcuguggagggcugacaagga

SEQ ID NO: 154136 - RNA, 46 nt, Homo sapiens
uuucucccucugagacucacgucccccagggcaagugcuuguggag

SEQ ID NO: 154137 - RNA, 47 nt, Homo sapiens
ccccaggggcugagcugccaccagagguccugggacccucacuuuag

SEQ ID NO: 154138 - RNA, 47 nt, Homo sapiens
uucuccaucucccaccuccuucauccagauaacuuauacauucccaa

SEQ ID NO: 154139 - RNA, 37 nt, Homo sapiens
uuccuggggagggagguuuuuuuguuuguuuuuuggg

SEQ ID NO: 154140 - RNA, 36 nt, Homo sapiens
cccaaaaaacaaacaaaaaaaccucccuccccagga

SEQ ID NO: 154141 - RNA, 68 nt, Homo sapiens
uccccggaugaacggugcuccauucgcaccuccccuccucgugccugcccugccucuccacgcacagu

SEQ ID NO: 154142 - RNA, 44 nt, Homo sapiens
uggcuccuuaacacugugcguggagaggcagggcaggcacgagg

SEQ ID NO: 154143 - RNA, 76 nt, Homo sapiens
guuaaggagccaagaggagccacuucgcccagacuuuguuuccccaccgccugcggcauggguguguccagugcca

SEQ ID NO: 154144 - RNA, 125 nt, Homo sapiens
gguuccaagccgguucccgucccuggcgccuggagugcacacagcccagucggcaccugguggcuggaagccacccugcuuuagaucacucggguccccaccuuagaaggguccccgccuuagau

SEQ ID NO: 154145 - RNA, 51 nt, Homo sapiens
cguuuuagagucucuugucuuaaugauuauguccauccgucuguccgucca

SEQ ID NO: 154146 - RNA, 50 nt, Homo sapiens
cugaacuuguagacucggucacaguaucaaauaaaaucuauaacagaaag

SEQ ID NO: 154147 - RNA, 25 nt, Homo sapiens
accuacauaaucgccauuguuccuu

SEQ ID NO: 154148 - RNA, 46 nt, Homo sapiens
agaggaaaagccuggugaggacagaagagagcagagaggagcuggg

SEQ ID NO: 154149 - RNA, 48 nt, Homo sapiens
uucugaagaucugagaaccauugcugucuuagaugucccacccauggc

SEQ ID NO: 154150 - RNA, 44 nt, Homo sapiens
acagauaauggcacuuaccucuccgagugaggauuccaugagau

SEQ ID NO: 154151 - RNA, 46 nt, Homo sapiens
caguccccacagcagacagcuacuugggcaugaagagccaaggugu

SEQ ID NO: 154152 - RNA, 44 nt, Homo sapiens
gcagguagaugugugucagaaugagugguccacugucucguuca

SEQ ID NO: 154153 - RNA, 46 nt, Homo sapiens
gcaccaccaggcaggccaagguggccagcagagaccaauaggcuag

SEQ ID NO: 154154 - RNA, 28 nt, Homo sapiens
cugggggcgggguuagggcgagcgggcg

SEQ ID NO: 154155 - RNA, 23 nt, Homo sapiens
guccggcucagagcuagccaagu

SEQ ID NO: 154156 - RNA, 42 nt, Homo sapiens
cagagucagauugaggcagaacugaauaaacauuggcggcga

SEQ ID NO: 154157 - RNA, 382 nt, Homo sapiens
auacuuggaggaguggagaggucaaagacugacauguuaaucauagaaucuugggcuauuagaggugauaaggauuugguagaguuucuuuuuuuuuugagauggaguuucgcucugucucccaggcuggagugcaauggcgugaucuuggcucacuggaagcucugucucccggguucacgccauucuccugccucagccucccaaguagcugggacuauaggcgccugccaccacgcccggcuaauuuuuuguguuuuuaguagagacaggauuucaccguguuagccaggauggucucaaucuccugaccucgugauccccccgccucagccucccaaaguacuuggauuacaggcgugagccaccgcacccggccagg

SEQ ID NO: 154158 - RNA, 87 nt, Homo sapiens
uagaauuucuagccugcccagccccucauuuuacauaagaggauugaggccagaggagaaggggagggauuugagcacagguuuggg

SEQ ID NO: 154159 - RNA, 46 nt, Homo sapiens
aauacagacagcaguucgaagagcuuuauaaaacugaagcaccaac

SEQ ID NO: 154160 - RNA, 69 nt, Homo sapiens
agcgccaagugucucgcugguuuguucagugccuucgggaacaguccaugcugcuagaaauuauuuucc

SEQ ID NO: 154161 - RNA, 79 nt, Homo sapiens
uuuauuaugcauacuuugagauggcacccagugacuuacuuguauuaaccaagauguuuaaagagcaaggauuugguag

SEQ ID NO: 154162 - RNA, 76 nt, Homo sapiens
auaucgaguccuugcauaagugugcuuuggaugacagaagagaacugcaucaguuugcgcaggaugggcuuauuug

SEQ ID NO: 154163 - RNA, 42 nt, Homo sapiens
uccuccgucacacucugaacccagaagagacaagcagugugg

SEQ ID NO: 154164 - RNA, 42 nt, Homo sapiens
ugugucuauggacugcucucuuucguucugaccucguuggag

SEQ ID NO: 154165 - RNA, 47 nt, Homo sapiens
ccugcaacugcuccgagcccugguaucagggaaguccacagccaaaa

SEQ ID NO: 154166 - RNA, 41 nt, Homo sapiens
uuucaaucuagguuuuacaucaauaaaacauguucuuaaug

SEQ ID NO: 154167 - RNA, 87 nt, Homo sapiens
ggagguguccuggagccgucugccuuuaagcccaugcaaggucguuuucucugccucaacaagggucuguacccauuauauucccau

SEQ ID NO: 154168 - RNA, 42 nt, Homo sapiens
ugcugguguccgccuggaggaugcuucucaucauugccacca

SEQ ID NO: 154169 - RNA, 44 nt, Homo sapiens
cugacucuguggugcgucgccagcucuuucuugacgugcuugau

SEQ ID NO: 154170 - RNA, 82 nt, Homo sapiens
ggccugggaggccugagacuguagugggucagcagagcucugcugcugccaugccaacccuggcuucucccccuccacucca

SEQ ID NO: 154171 - RNA, 46 nt, Homo sapiens
aacgcagugaggacagugcagagucuggccugccuggaggaggcgg

SEQ ID NO: 154172 - RNA, 42 nt, Homo sapiens
cgccgcagggcaaguccaccucucucuccaaagccagcccug

SEQ ID NO: 154173 - RNA, 46 nt, Homo sapiens
gugggcugaggucaucuggugggccuguuuucgcagaaugcaccaa

SEQ ID NO: 154174 - RNA, 64 nt, Homo sapiens
ucucauccuggucccuaccccugcuccaauccccuggcuccacuucugggauugcagagcugag

SEQ ID NO: 154175 - RNA, 82 nt, Homo sapiens
augacagacagggacgaagcagagaccucuacagacccaagucaccaaguggagccuuuuuuuuucuuauuuuaauuuuaau

SEQ ID NO: 154176 - RNA, 43 nt, Homo sapiens
auuuuuauuuuuuacuuuuugccugagacaagccgaguaugag

SEQ ID NO: 154177 - RNA, 45 nt, Homo sapiens
accuuugucaaggccauggaugacuccagcgucacggugagaggu

SEQ ID NO: 154178 - RNA, 46 nt, Homo sapiens
cauuuuggaaaagacuuccccaagucggagaagcuaagcccagaug

SEQ ID NO: 154179 - RNA, 79 nt, Homo sapiens
uggugccccugcccaugcccaagaagcugcgguucaacaucacccccgagaucaagagcgacaucgagaaggccaagca

SEQ ID NO: 154180 - RNA, 38 nt, Homo sapiens
aggaccucugcagccucgggacuuccugcccguccccg

SEQ ID NO: 154181 - RNA, 51 nt, Homo sapiens
auguguaccacagugacgggacaccccucacugcggaucagaucuuugugc

SEQ ID NO: 154182 - RNA, 35 nt, Homo sapiens
uugagggugguugccaugggccagacagcccuggg

SEQ ID NO: 154183 - RNA, 51 nt, Homo sapiens
aucuggcuaauacugaucacucgggcuaaagggaagaggcugguggguuua

SEQ ID NO: 154184 - RNA, 95 nt, Homo sapiens
aaccgucugugugaugugggaguagggggauaaguguauuggcauauggagugggaguguguaugugugcacgcaugcaccuuugugccugugau

SEQ ID NO: 154185 - RNA, 44 nt, Homo sapiens
uuccuccuccccaggcccugccagcuggcuucuccagcuccaac

SEQ ID NO: 154186 - RNA, 43 nt, Homo sapiens
gguggauuugaggaccaauggcuuuuuuuucccuuuuuacuca

SEQ ID NO: 154187 - RNA, 100 nt, Homo sapiens
gguauuuccaacacgugguaaugaugagucucgccauccagggacucugguggaaacguaggcuuucuucaucaauaucagcugaaggucucaaugugag

SEQ ID NO: 154188 - RNA, 25 nt, Homo sapiens
gcuggucugucguggaccugcagga

SEQ ID NO: 154189 - RNA, 65 nt, Homo sapiens
aauccgugaggccucagauguuaccccagagcagugugaaggugggcuuuuguagcagaguuugc

SEQ ID NO: 154190 - RNA, 53 nt, Homo sapiens
cggcuuggacugaggagcggacccggccgggcgcaggggcuggacuggcggag

SEQ ID NO: 154191 - RNA, 46 nt, Homo sapiens
caaccagaugcugaguggcauuccugagguggaccugggcaucgag

SEQ ID NO: 154192 - RNA, 45 nt, Homo sapiens
acaggugguaugguggauaugaagaaacugaaggaaaggggcaaa

SEQ ID NO: 154193 - RNA, 46 nt, Homo sapiens
cgccggggcgacucggagucagaggaagaugagcaggacucagagg

SEQ ID NO: 154194 - RNA, 46 nt, Homo sapiens
gguauaaauuccguccggcuucagauaaccccuaccuacaacuuuc

SEQ ID NO: 154195 - RNA, 64 nt, Homo sapiens
uuuugaggcaagguuuuggauuuuggaggaagcagccagaugaggcggugagccuccagaaggu

SEQ ID NO: 154196 - RNA, 49 nt, Homo sapiens
ccucaaaagaagucagacauauuuaauccagaaauaguuucguuugagg

SEQ ID NO: 154197 - RNA, 31 nt, Homo sapiens
ucugcuuuugcagagugguucacugcacugu

SEQ ID NO: 154198 - RNA, 62 nt, Homo sapiens
ucaucccucucaaacuagcuccucuucgacugaaccuggccacagcucugaguccuucucug

SEQ ID NO: 154199 - RNA, 32 nt, Homo sapiens
gcauuagucccuauggcugcaucauggggugc

SEQ ID NO: 154200 - RNA, 41 nt, Homo sapiens
cuucgaggaagccaggaagaaggcacugaagcuuggggcca

SEQ ID NO: 154201 - RNA, 98 nt, Homo sapiens
ugccuccccuacucccacccccaacagggacaaaaccgucucugguugggaacuacugcugugagaucuuaggugacaacuaaguuucaucuuguugg

SEQ ID NO: 154202 - RNA, 81 nt, Homo sapiens
auugauuagcaaugucugccaugagugcaggagggagaguaacagugcagugugcugggauugaugaaugaugucuacuac

SEQ ID NO: 154203 - RNA, 41 nt, Homo sapiens
aaacaaguggaaaucgcccagcgggagggggccaaguaugu

SEQ ID NO: 154204 - RNA, 41 nt, Homo sapiens
cccccuaguuuuggaagaggggccuggaaauaugauucuga

SEQ ID NO: 154205 - RNA, 42 nt, Homo sapiens
gaauucuacaaccgguucaagggccgcaaugaccugauggag

SEQ ID NO: 154206 - RNA, 20 nt, Homo sapiens
cgcagcccugcccccgccgc

SEQ ID NO: 154207 - RNA, 45 nt, Homo sapiens
ugagcagugaugaggccuccuccaaaauucugagccaggcaggau

SEQ ID NO: 154208 - RNA, 30 nt, Homo sapiens
ccucuagaaucucaccaucuugggaaugag

SEQ ID NO: 154209 - RNA, 47 nt, Homo sapiens
aucuggauuaaggauccugcuaccucacccacacuugggucccagag

SEQ ID NO: 154210 - RNA, 48 nt, Homo sapiens
aacugggcuuuuaggaaggagaguaaaaagaaggcaggcgcucgagcc

SEQ ID NO: 154211 - RNA, 29 nt, Homo sapiens
cucccucaggaaguguggcgggagagaaa

SEQ ID NO: 154212 - RNA, 29 nt, Homo sapiens
ccggaccccaccagcugguggggaaaugg

SEQ ID NO: 154213 - RNA, 47 nt, Homo sapiens
cuacacgaagacccaggacccagccaaagcccccaacaccccugaca

SEQ ID NO: 154214 - RNA, 54 nt, Homo sapiens
uggccuggaggaaggauggagaagcgaggcaugcccgccugggcucagagggag

SEQ ID NO: 154215 - RNA, 41 nt, Homo sapiens
gagggugggguggcgggugcagacuccuccgcugagccggg

SEQ ID NO: 154216 - RNA, 45 nt, Homo sapiens
cccuaggggucccugugaaggugaccaacgucaaggauggcacca

SEQ ID NO: 154217 - RNA, 94 nt, Homo sapiens
gacuggccugaagucacugugaaauggcauccugugggguggggcgagucaagcagaguugagcaaaaaugaacugaaggaggugguuagugau

SEQ ID NO: 154218 - RNA, 24 nt, Homo sapiens
ugcacuauucugaauguggaaugg

SEQ ID NO: 154219 - RNA, 21 nt, Homo sapiens
uuccacggaggcuggaccuuu

SEQ ID NO: 154220 - RNA, 31 nt, Homo sapiens
cccagccuucacucugcccugguacuuugug

SEQ ID NO: 154221 - RNA, 60 nt, Homo sapiens
gggacagggggcuggggaagccgcggcuggaguagcuuucuccguauuguggcuguucac

SEQ ID NO: 154222 - RNA, 73 nt, Homo sapiens
augucauuaucacauuaucuuuuuaacucuggaggggggcuaauuaagugaaguaaaugaaaucaguggggag

SEQ ID NO: 154223 - RNA, 42 nt, Homo sapiens
ucuccucccagcccugcccgucucaccucugccugcccccgc

SEQ ID NO: 154224 - RNA, 47 nt, Homo sapiens
ccuucucucugcgcagugguuuguaugccgacugucaaaagccccaa

SEQ ID NO: 154225 - RNA, 39 nt, Homo sapiens
cgcacacacacacacacacacacacacacacacgugcgc

SEQ ID NO: 154226 - RNA, 42 nt, Homo sapiens; identical to SEQ ID NO: 67208

SEQ ID NO: 154227 - RNA, 45 nt, Homo sapiens
ccauccuuuaccaugcucauuuagacaucgaggccuucaccaugg

SEQ ID NO: 154228 - RNA, 59 nt, Homo sapiens
aggccagcuguagcggccaaguucccaguuacuccaacagauuccaggaugcucgugau

SEQ ID NO: 154229 - RNA, 46 nt, Homo sapiens
uacaaugauuaggagacuuaaaaggaaacaaaaucucagaguggag

SEQ ID NO: 154230 - RNA, 50 nt, Homo sapiens
cucaccuccauuucuucagcaauaaaauggguauaaugugcaacucacac

SEQ ID NO: 154231 - RNA, 61 nt, Homo sapiens
uacugugacauccccacucaacagauggggaaacagaggcacagagaggggaaggcuaugc

SEQ ID NO: 154232 - RNA, 49 nt, Homo sapiens
cuggcacagcccugagugugaauuuguccgccacugcaucgccaagucc

SEQ ID NO: 154233 - RNA, 29 nt, Homo sapiens
cgggaguccccacugucucucuacaauga

SEQ ID NO: 154234 - RNA, 43 nt, Homo sapiens
aacuccccgggaacaggcugagugguuaaguaacuuuccaagg

SEQ ID NO: 154235 - RNA, 47 nt, Homo sapiens
aaugaggagcuggggccuccucaauuugcagaucccccaaguacagg

SEQ ID NO: 154236 - RNA, 41 nt, Homo sapiens
cggcuggcugccaaggcgggugggggcgaggccgaaaaaaa

SEQ ID NO: 154237 - RNA, 63 nt, Homo sapiens
cggggcuggggcuggucccggccugagacagcuucauggaaggccaggcucccggcccuugcg

SEQ ID NO: 154238 - RNA, 45 nt, Homo sapiens
aggggcgagaggagagcgcugcgauggagaaggaaccagagcagg

SEQ ID NO: 154239 - RNA, 42 nt, Homo sapiens
cagaucaacuuguuuacucucuccacagagccagcaacagau

SEQ ID NO: 154240 - RNA, 54 nt, Homo sapiens
gcagcccccuccaguccuccauagcaaaccgagauaggggaugaguugucccca

SEQ ID NO: 154241 - RNA, 45 nt, Homo sapiens
ccucugaguuaccagcgagaugaugcaguuccgaagccgggauau

SEQ ID NO: 154242 - RNA, 47 nt, Homo sapiens
uauuggggcaauuucauggggcacugugccuugugaaugacagugag

SEQ ID NO: 154243 - RNA, 51 nt, Homo sapiens
gccuucaaagguaagcuggggcgggcugcccugcauuuauuccugggggag

SEQ ID NO: 154244 - RNA, 51 nt, Homo sapiens
cacgcccccgugguucgcacuccuuccauccagcccagucucuugccccau

SEQ ID NO: 154245 - RNA, 46 nt, Homo sapiens
cucccccugggaaggagcagggaagaacuccagggggcugugagug

SEQ ID NO: 154246 - RNA, 78 nt, Homo sapiens
agacaaggaaaucgaugcgggccuggcguggaggguggaagcuuccuggggcaccuuggggaccugguggugcccgaa

SEQ ID NO: 154247 - RNA, 44 nt, Homo sapiens
agguugcuuuauuuauaggaaccucaguucccuaaucuguaaaa

SEQ ID NO: 154248 - RNA, 33 nt, Homo sapiens
ucccaacagucuucuugagccacguggcccugu

SEQ ID NO: 154249 - RNA, 56 nt, Homo sapiens
aucagccagccacaaaagacaaauacaguacgauuccacuuacuugaggucccuag

SEQ ID NO: 154250 - RNA, 64 nt, Homo sapiens
cauuuggaggucucuagaacuuaguagacccggaguguguggcaguuggucaguuuaaggcagg

SEQ ID NO: 154251 - RNA, 38 nt, Homo sapiens
uuguugguaaauggcucugcagugguucugcauuuuau

SEQ ID NO: 154252 - RNA, 50 nt, Homo sapiens
aauaaauauauaaaucacuugugaccucaccauccagagcuaacugcagu

SEQ ID NO: 154253 - RNA, 56 nt, Homo sapiens
agucacuugcugccagagacaggccagccugauuugucuucuucuuuugugcccag

SEQ ID NO: 154254 - RNA, 44 nt, Homo sapiens
gugacagcaccuggaauuuaaguggcucaugcuggugaagagag

SEQ ID NO: 154255 - RNA, 46 nt, Homo sapiens
ccugcuggggaacggaggcuucccuggcugcauaggagucuggaga

SEQ ID NO: 154256 - RNA, 42 nt, Homo sapiens
gggguaugcauguguguugauggauggaaacucggcagguau

SEQ ID NO: 154257 - RNA, 30 nt, Homo sapiens
ugggugguugaauuuacugggaggacauag

SEQ ID NO: 154258 - RNA, 45 nt, Homo sapiens
aaccugccaagcuugaagucugaaaacaaaggaaacgaccccaac

SEQ ID NO: 154259 - RNA, 90 nt, Homo sapiens
aagcuucucuuuuagguagaaggagauguaagaacccgaucaguagccuucuguuuguaauaaucacgaauggugaguugccugggucag

SEQ ID NO: 154260 - RNA, 56 nt, Homo sapiens
gcuuugcugcaugggcaauauaaggucucaaaugucauccccucucugcuuuaacc

SEQ ID NO: 154261 - RNA, 26 nt, Homo sapiens
cacguuccucauuagcagcugcgcag

SEQ ID NO: 154262 - RNA, 44 nt, Homo sapiens
ggccuccaugaagaaguggacuauucugagaaacugaaguucag

SEQ ID NO: 154263 - RNA, 34 nt, Homo sapiens
cucugcagacagugcggacgcuaagcggacucga

SEQ ID NO: 154264 - RNA, 55 nt, Homo sapiens
auauuggaaacuguguucucauugauaccuccaguuccacagacuuuguuccacu

SEQ ID NO: 154265 - RNA, 45 nt, Homo sapiens
gucagagauguccgaggcgguggagcgagcccgaaagcgccggga

SEQ ID NO: 154266 - RNA, 46 nt, Homo sapiens
gcccgggaggagaggcuggccgccugugcugccaaacucaagcagc

SEQ ID NO: 154267 - RNA, 61 nt, Homo sapiens
ccaccacauucccagaagaggcacccacaguguccccagcaguggcacagagcaacagcag

SEQ ID NO: 154268 - RNA, 52 nt, Homo sapiens
uguguucccguggccugaagugcguggcagggauauauggagcagaaagugg

SEQ ID NO: 154269 - RNA, 45 nt, Homo sapiens
ccgccgucccacccccagcgcaccuuuuacccacaccacccccag

SEQ ID NO: 154270 - RNA, 43 nt, Homo sapiens
ggccuuugguugacccugagauuggagcagggcuuucuaaaug

SEQ ID NO: 154271 - RNA, 46 nt, Homo sapiens
cgacucacccccuguguggagcccagagggcuacauggcacugcag

SEQ ID NO: 154272 - RNA, 45 nt, Homo sapiens
gggccuguggggacccgaggaggagccccaccugcuggcagguca

SEQ ID NO: 154273 - RNA, 45 nt, Homo sapiens
ggagcgggcagcccaugccagugcugaccuucccgaagccuccag

SEQ ID NO: 154274 - RNA, 47 nt, Homo sapiens
gguggguucuauggugggcgaaggcuucaucgaaguccugaccaaga

SEQ ID NO: 154275 - RNA, 51 nt, Homo sapiens
cuggagcaaggugacgugaccgugccuggcagcagccugggcacugagauc

SEQ ID NO: 154276 - RNA, 71 nt, Homo sapiens
gcuguggcacccaaggucacaucacacacuggguuugcuucuggggaggauccugcuuuugagcuacgaau

SEQ ID NO: 154277 - RNA, 54 nt, Homo sapiens
ggcagcucucccugugcaggccccagccaacgacuccuggaggaaagcugucac

SEQ ID NO: 154278 - RNA, 79 nt, Homo sapiens
aagagcagccagggagauaguggcguugacuugagugccgagucucgggagucgucugcgaccuccucgcagcgcagcu

SEQ ID NO: 154279 - RNA, 64 nt, Homo sapiens
ccccauaugggacucugaagccagaggagaugagcgggcccggccuggcggaacccaaggccga

SEQ ID NO: 154280 - RNA, 80 nt, Homo sapiens
uuaucaaggauucagaacaaggcucuggacagagcaaggagcacagaccaggacccaucggcaacgagcguucucugaaa

SEQ ID NO: 154281 - RNA, 46 nt, Homo sapiens
cgagcggcugcaaggggcugucgucccgccuguuaacgggguggag

SEQ ID NO: 154282 - RNA, 43 nt, Homo sapiens
aaggaauagaaggaugggagccaagcagucuuccagcggcuag

SEQ ID NO: 154283 - RNA, 46 nt, Homo sapiens
auggagucugcgcgcaaggcuugggaaaacucccccaguuugccgg

SEQ ID NO: 154284 - RNA, 65 nt, Homo sapiens
gugucuuauggcaucucaagacucaucauauucaaaacucgauuuuccucccgguccuucugcuu

SEQ ID NO: 154285 - RNA, 54 nt, Homo sapiens
caugguguuuugcggcucuggccaccacaagucucagugauguaauuccaauag

SEQ ID NO: 154286 - RNA, 55 nt, Homo sapiens
ccgccagagaccuggucccucuaugggccaugugucacugugguguuucagcacu

SEQ ID NO: 154287 - RNA, 70 nt, Homo sapiens
caggagagugguuuugguuuuaaucauuauaauaagaugcucuggauuggggagcuuucuggaaagguag

SEQ ID NO: 154288 - RNA, 42 nt, Homo sapiens
cucccgaaagcuccguugucaaccagcuugcacccguggaua

SEQ ID NO: 154289 - RNA, 101 nt, Homo sapiens
gugacuguggagugacgccuccugugcagugcagauuugcccucccugccuccucccuguccugccgcgcagccagggcgccuucucagcagugcuuccgg

SEQ ID NO: 154290 - RNA, 77 nt, Homo sapiens
aguugaugacaguuuuagcaugagaaucacacagggucccuguccugggcuccucuaaagccaguggaugugcuggg

SEQ ID NO: 154291 - RNA, 63 nt, Homo sapiens
ggaacugucgggugggcagccccuggggaagggacucaagcauaaaggcuugggauaaagagg

SEQ ID NO: 154292 - RNA, 43 nt, Homo sapiens
gagucccuuccccaggggcugcccacccgacaguuccaggcau

SEQ ID NO: 154293 - RNA, 76 nt, Homo sapiens
gccaagccauuccugggugaguucaggccugcgggagccacacauucaucuccaccuggacacuugagccgcaugg

SEQ ID NO: 154294 - RNA, 38 nt, Homo sapiens
gcuguuaagauguacccuucaggugaaccugguaucag

SEQ ID NO: 154295 - RNA, 45 nt, Homo sapiens
aaaaaacacuagaauuuauuuauauguauugauguuguaggucua

SEQ ID NO: 154296 - RNA, 48 nt, Homo sapiens
accaaggagggguuggggcgcugggaggccugaggccugcccucagcc

SEQ ID NO: 154297 - RNA, 43 nt, Homo sapiens
ugggaacagguggagaccagcacuucccuuuccugcugcugag

SEQ ID NO: 154298 - RNA, 63 nt, Homo sapiens
ggcucguugcucagccaccaguggccuugcgguauuguccaccauccacuagagugggaugaa

SEQ ID NO: 154299 - RNA, 38 nt, Homo sapiens
ucucuucugaaaugugacggaccuaagcaggaagucau

SEQ ID NO: 154300 - RNA, 48 nt, Homo sapiens
uggcuagagguguaaugugcagcuuguuuauacgguauuuugggaaac

SEQ ID NO: 154301 - RNA, 44 nt, Homo sapiens
cagugcgcacgcgcgcugcugcccgucuggccccgcaggcucgg

SEQ ID NO: 154302 - RNA, 34 nt, Homo sapiens
ucaggcagacgcccuagaaaagaagggaggagcc

SEQ ID NO: 154303 - RNA, 44 nt, Homo sapiens
ucaaauacauuuaaaacuuaucagugcauuucuuacaggcagaa

SEQ ID NO: 154304 - RNA, 45 nt, Homo sapiens
gaauacaguagcaacgugccuguguggucccugcgccugcugcca

SEQ ID NO: 154305 - RNA, 43 nt, Homo sapiens
cgugcucgugcuggguguugcagcuguccaugccuggcaccug

SEQ ID NO: 154306 - RNA, 38 nt, Homo sapiens
agcucacaaugucuagagguggguacgcuuuuccacgc

SEQ ID NO: 154307 - RNA, 74 nt, Homo sapiens
cuggccuggaaggcacuggacaugauuuggucguggggcccagagcggaagacuagaaucaaguggacguagaa

SEQ ID NO: 154308 - RNA, 45 nt, Homo sapiens
aaucauguccagugccuuccaggccagcuuagagguaaguaagca

SEQ ID NO: 154309 - RNA, 78 nt, Homo sapiens
gugggcaucguggccacuggagaaggaagaugauaguggacccagaguuuucuuacaaacacaucaagugaacauuag

SEQ ID NO: 154310 - RNA, 35 nt, Homo sapiens
aagcagaagguugaugagugagagacagaaagaaa

SEQ ID NO: 154311 - RNA, 44 nt, Homo sapiens
acucagggucagccacuggagguggccuuugggucccaggucac

SEQ ID NO: 154312 - RNA, 45 nt, Homo sapiens
gcaacaggugaccuguuaccccuucaaagaugucaauaacuggug

SEQ ID NO: 154313 - RNA, 51 nt, Homo sapiens
aggcaccagcugguggugagcagcccuccgagaccugugaggcacggggac

SEQ ID NO: 154314 - RNA, 78 nt, Homo sapiens
auguugcagccccccugagcccccauucacaggaggucuccugcuacauugacuauaacaucuccaugcccgcccaga

SEQ ID NO: 154315 - RNA, 45 nt, Homo sapiens
aauugugaacagaggaucugacacagacgucuggaagaccauccu

SEQ ID NO: 154316 - RNA, 42 nt, Homo sapiens
cagcugagcggggcucaccucccugacuggggguaucggcaa

SEQ ID NO: 154317 - RNA, 68 nt, Homo sapiens
uggaaggcaaccaguuuauccccgugcaaguggagcuuucucagggucgaaaucaccucauuugaccg

SEQ ID NO: 154318 - RNA, 46 nt, Homo sapiens
ccuuccaaauccuucugcucccugugguccugcagcacaucagcga

SEQ ID NO: 154319 - RNA, 73 nt, Homo sapiens
ggggaaugggugagguucagaagagaugcccagaugaggcacugcaggaacccagagggagaagucgcggcug

SEQ ID NO: 154320 - RNA, 100 nt, Homo sapiens
ccacugagacguggcugagugaaaucuuccucgucaguggucaaggugugucauccauacagcuccaugccuuugucuuuuuuaaauguaauuaaaaaag

SEQ ID NO: 154321 - RNA, 53 nt, Homo sapiens
ccuggccuccgcugccuucugcccuacugcaugggcucccagccuggccccgc

SEQ ID NO: 154322 - RNA, 46 nt, Homo sapiens
uggcaccgaggaggguccaaugggcggagcuacaagcggaccuuuu

SEQ ID NO: 154323 - RNA, 24 nt, Homo sapiens
agagagagaagcagaggcccagcc

SEQ ID NO: 154324 - RNA, 46 nt, Homo sapiens
guguucgccgugguggccgaaaacgcccaguuccuaagggugcaac

SEQ ID NO: 154325 - RNA, 52 nt, Homo sapiens
gccgcugcagucacaucuguccagagaaauuccuuuugggacuggaggcaga

SEQ ID NO: 154326 - RNA, 47 nt, Homo sapiens
ggaguuagauuaccaaaacccugcuuccugaggauacuuagugcuuu

SEQ ID NO: 154327 - RNA, 52 nt, Homo sapiens
uucaacaaauauggccuggcugucuacuacaagccgggcccugugaaaaguc

SEQ ID NO: 154328 - RNA, 51 nt, Homo sapiens
gagaaccacggaaaggauccuggcugggcuguaugggccuccgcgcaugug

SEQ ID NO: 154329 - RNA, 56 nt, Homo sapiens
cgcugugccugggguggggucgggggagagcacaacagucauuggaguccccugag

SEQ ID NO: 154330 - RNA, 42 nt, Homo sapiens
cucuagggacaaaccaccaaagggcugcccagagaugcuguu

SEQ ID NO: 154331 - RNA, 42 nt, Homo sapiens
aagaucaucuuuguggugggugaguugcgggcaggcgggugg

SEQ ID NO: 154332 - RNA, 49 nt, Homo sapiens
auugauggcuacccgcgggaggugcagcaaggagaagaguuugagcgac

SEQ ID NO: 154333 - RNA, 54 nt, Homo sapiens
ggcgaguuaggaucaggcucgggggagagggcuccuagcagagggaacagcaug

SEQ ID NO: 154334 - RNA, 101 nt, Homo sapiens
ggacagcccacacugcugcuguauguggacgcaggcccugagaccaugacccagcggcucuugaaacguggagagaccagcgggcguguggacgacaauga

SEQ ID NO: 154335 - RNA, 49 nt, Homo sapiens
aacagacucaaugucccccucacccccaccucaaggucaggaugagaac

SEQ ID NO: 154336 - RNA, 44 nt, Homo sapiens
cuuaacaccugaucuggcccaagcugggcucccuuuaagccaag

SEQ ID NO: 154337 - RNA, 48 nt, Homo sapiens
gcagaggggcuccccgggucucucacuguugcaguggccuggccguuc

SEQ ID NO: 154338 - RNA, 50 nt, Homo sapiens
gaguaaggguagguccuguuuggugaagauuagucuguuccaggcauaug

SEQ ID NO: 154339 - RNA, 49 nt, Homo sapiens
cuaguugucagggaggcugcaucuccagagaugugggcgcagggggcca

SEQ ID NO: 154340 - RNA, 46 nt, Homo sapiens
accagccuccugggggauacgguggagaagaucgcauggcagaaag

SEQ ID NO: 154341 - RNA, 43 nt, Homo sapiens
aagauuggggauccaagugccuggauuugggggagaggcagga

SEQ ID NO: 154342 - RNA, 45 nt, Homo sapiens
gguggugaaggcgcugaaggccuuugugcgggacccagcccccac

SEQ ID NO: 154343 - RNA, 47 nt, Homo sapiens
ucccuagaaaggagauuaguuuugguuugggaagaggucugguguug

SEQ ID NO: 154344 - RNA, 42 nt, Homo sapiens
ccccaggccugauggaaguccugcggccuuuccugggcuccu

SEQ ID NO: 154345 - RNA, 43 nt, Homo sapiens
gcuucugaacagcggggccaauaaugaugccccgaugccuucc

SEQ ID NO: 154346 - RNA, 34 nt, Homo sapiens
cucaguuuccagaaauggagggacucaagcugcc

SEQ ID NO: 154347 - RNA, 73 nt, Homo sapiens
gcgccggacagcggcugaguagagccaugagccgauguguuuuggagccucgccccccggggaagcgguggau

SEQ ID NO: 154348 - RNA, 123 nt, Homo sapiens
uuuauaugugaagugggauuaguuguggucccucaucaugggagucgggacagugccucucugggcagaugggcaguaaccagggcugccguuucccugugcuaagcggagcuguuugggcug

SEQ ID NO: 154349 - RNA, 46 nt, Homo sapiens
gcuggggggcagugccaggugagguccugagauggucaggguuggg

SEQ ID NO: 154350 - RNA, 31 nt, Homo sapiens
cccuaugcagagcggccagugagcucuccag

SEQ ID NO: 154351 - RNA, 46 nt, Homo sapiens
uuuuauucaguuucuucaguguguccagcaguuucuguggggugag

SEQ ID NO: 154352 - RNA, 39 nt, Homo sapiens
gaggaaggggagaggggacugaggggaagguaacggggg

SEQ ID NO: 154353 - RNA, 49 nt, Homo sapiens
agagggacggguguugggggugaaagagggggaaggagggugggauggg

SEQ ID NO: 154354 - RNA, 41 nt, Homo sapiens
ggggaaggauggggcgaggggagagaaaugggggugaaggg

SEQ ID NO: 154355 - RNA, 55 nt, Homo sapiens
cccgccccggccagcaguuggcgccggggccgggggcucgggggagucaggccgg

SEQ ID NO: 154356 - RNA, 355 nt, Homo sapiens
guaauauuccaguaucagagaggcccugaaauggaacuccugggucaccuuuuuuuuuuuuuuuugauacagagucucauuuuguugcccaggcuagaguucaguggcaugaucucggcucauugcaaccuccgccuccuggguucaagcaauucuccugucucagccuccugaguagcugggacuacaggugcccaccaccacaccuggcuaauuuuuguaucuuuaguagagaugggguuuuaccauauuggucaaguuggucucgaacucuugaccucaggugauacaucugccucagccugccaaauugcugagauuauaggcgugagccaccaugcccugccugggucac

SEQ ID NO: 154357 - RNA, 45 nt, Homo sapiens
uuuauugagcaaaacaaauaaugcuucuuuccaaagugauuuuaa

SEQ ID NO: 154358 - RNA, 23 nt, Homo sapiens
ucugaagacaugguugauagagc

SEQ ID NO: 154359 - RNA, 78 nt, Homo sapiens
ccggugggucagcugugagugaguguggaugggaggaggugaaccccauggugagagggacuggaccugcgugugugg

SEQ ID NO: 154360 - RNA, 41 nt, Homo sapiens
gcaugugagugugagugugcaugcgugugggcauacacgug

SEQ ID NO: 154361 - RNA, 48 nt, Homo sapiens
augcauuagcucauguugcaauuaugauuauaauuuucugcaaguggg

SEQ ID NO: 154362 - RNA, 45 nt, Homo sapiens
gaagagugacgcagccaagggccccuucagggcaccugaggccag

SEQ ID NO: 154363 - RNA, 46 nt, Homo sapiens
ugaagaccaguauggcguggcucucuucaacagcaugcgccaugag

SEQ ID NO: 154364 - RNA, 28 nt, Homo sapiens
uacauagacggcugagggcagcucugug

SEQ ID NO: 154365 - RNA, 46 nt, Homo sapiens
gccacuggacgagcgcaucgucuucucggggaaccucuuccagcac

SEQ ID NO: 154366 - RNA, 64 nt, Homo sapiens
uguguugggggaggggucgaucagggcaggcucccuugaggagguuaugguucagcuucagcag

SEQ ID NO: 154367 - RNA, 51 nt, Homo sapiens
aagucccagggccccucauauccugcauagaggagaggggaggaguguucc

SEQ ID NO: 154368 - RNA, 52 nt, Homo sapiens
cacgaggcccugaagcagggagggggugaccugaaauggggcuggagggggg

SEQ ID NO: 154369 - RNA, 54 nt, Homo sapiens
ccuggacacugaacugcuuccaggugaucuggccugagggaagcuccugccccc

SEQ ID NO: 154370 - RNA, 44 nt, Homo sapiens
gccuggcagggugggugaccugcgccagauagggaagggguggg

SEQ ID NO: 154371 - RNA, 53 nt, Homo sapiens
augauagugcccaggucuuggggugguugggaggauuucaggagcuaaggagg

SEQ ID NO: 154372 - RNA, 42 nt, Homo sapiens
gcuucacugaggugcgagaugucuucuucaaggaggucacgg

SEQ ID NO: 154373 - RNA, 54 nt, Homo sapiens
aggaccuuggagagcaggaaagcucucucccaauuuugaagcugaggaaacuga

SEQ ID NO: 154374 - RNA, 92 nt, Homo sapiens
ucaugccauagccacgcuugccuggcacgcucucuccuccucugcuuggaacaucugugccucugcccaccuggcuaauucugacucacuuc

SEQ ID NO: 154375 - RNA, 45 nt, Homo sapiens
gaaggggcccaccaaggaggagcugugcaaguccauccagcgggu

SEQ ID NO: 154376 - RNA, 42 nt, Homo sapiens
gcagaucagcaucccguuccugcucaagaagcuggccccuac

SEQ ID NO: 154377 - RNA, 46 nt, Homo sapiens
ccaccccgcccuccacaccaccaccgaggacagugcaggggugcag

SEQ ID NO: 154378 - RNA, 59 nt, Homo sapiens
agaugcaggggcugguuuugggguuuuccugcuugugccaagggcuggacacugcuggg

SEQ ID NO: 154379 - RNA, 28 nt, Homo sapiens
agggaggugaaagcuggugugagcccag

SEQ ID NO: 154380 - RNA, 74 nt, Homo sapiens
gaaggagggggucuucaggcuggagccaggcugggggugcuggguggagagaugagauuuagggggugccucau

SEQ ID NO: 154381 - RNA, 41 nt, Homo sapiens
aaggagcugggugugcucccgcugccccaguuccaggcgcc

SEQ ID NO: 154382 - RNA, 65 nt, Homo sapiens
cgcccugccgggccagggcacccaggcacuacacacacaagcucuuaucucccccuaccggcccu

SEQ ID NO: 154383 - RNA, 129 nt, Homo sapiens
cuccccaccuacacgugaagaagcuaaggcccagaaaggcugaggcuuggccggggcggcgcaacaccgggaaggucucugggaggcagcggcuuuaagagccccauacggggaaagcuuugcacgcgc

SEQ ID NO: 154384 - RNA, 62 nt, Homo sapiens
ggccgaucuugggggccagggcagaaguggcaccgacuucaccuccggugcaccucagguau

SEQ ID NO: 154385 - RNA, 44 nt, Homo sapiens
caugguguccagaggugaaccacagccuugaaaccugcccacca

SEQ ID NO: 154386 - RNA, 46 nt, Homo sapiens
gucaguuucacuguaauccucaggcccuuccagucacccguugccu

SEQ ID NO: 154387 - RNA, 48 nt, Homo sapiens
ucuggcuacuuccuugggcucaguucccugggucaucagccaucaaau

SEQ ID NO: 154388 - RNA, 52 nt, Homo sapiens
ugugucagucuuuauuuggcaaacaaauuuccuucccgauaaggcagccgcg

SEQ ID NO: 154389 - RNA, 80 nt, Homo sapiens
cuccuuccugucaugcucccuccagcccaugacccggggcuaggaggcucacugccuccuguuccagcuccugcugcugc

SEQ ID NO: 154390 - RNA, 29 nt, Homo sapiens
agccccgggucaugggcuggagggagcau

SEQ ID NO: 154391 - RNA, 45 nt, Homo sapiens
gaguggcugucaucgccccucaaaaugggcugugauuuguuccag

SEQ ID NO: 154392 - RNA, 47 nt, Homo sapiens
auggcuggggaaacugaggcucacagcaaugaagugacugccucaag

SEQ ID NO: 154393 - RNA, 42 nt, Homo sapiens
ggugaggacgcagaugccugucgccacgcccuugacaugcag

SEQ ID NO: 154394 - RNA, 63 nt, Homo sapiens
ugggccgaggaaaugggagguaccggcacagaagcagcagcgaguaacccucagccccgacgg

SEQ ID NO: 154395 - RNA, 31 nt, Homo sapiens
gaccugccgagcguggcacugaggcagcggc

SEQ ID NO: 154396 - RNA, 43 nt, Homo sapiens
uggagcccagugaggcagggcugcuuggcagccaccggccugc

SEQ ID NO: 154397 - RNA, 40 nt, Homo sapiens
ccgucagcggggcagccuguccauggccucuggagggguu

SEQ ID NO: 154398 - RNA, 41 nt, Homo sapiens
augccagcccaugaucaugugcccccaaacaccaccaaaug

SEQ ID NO: 154399 - RNA, 47 nt, Homo sapiens
gccauuguuaccaccugggcaguauuaucccauuucacagauaagaa

SEQ ID NO: 154400 - RNA, 37 nt, Homo sapiens
ucugcuaggagguggggcugcagugacgucaguggaa

SEQ ID NO: 154401 - RNA, 44 nt, Homo sapiens
gacacuggagggggaauguggugaggucacaaucuuaaaucagc

SEQ ID NO: 154402 - RNA, 46 nt, Homo sapiens
ccauucuggaagcaagaggagacaggcaagccccagcagagguaga

SEQ ID NO: 154403 - RNA, 42 nt, Homo sapiens
cgccaagagaguucauuuaccuaaacagguacaagcgggcgg

SEQ ID NO: 154404 - RNA, 46 nt, Homo sapiens
agcagaagcggcagaucgagacgcugcagcagcugguggaggugga

SEQ ID NO: 154405 - RNA, 50 nt, Homo sapiens
augaacucgcgggucacgcagcucuacaugcagcuccugcacgagaucau

SEQ ID NO: 154406 - RNA, 42 nt, Homo sapiens
ugugggccaguguggccaggugcugguacuugugcuccaggu

SEQ ID NO: 154407 - RNA, 50 nt, Homo sapiens
aguaccagcaccuggccacacuggcccacaaccaaucagagaucaucgcg

SEQ ID NO: 154408 - RNA, 46 nt, Homo sapiens
gagaucugguugaugaugcgguuguaggugggugguugguagaccc

SEQ ID NO: 154409 - RNA, 89 nt, Homo sapiens
gccccgccccgggucuaccaaccacccaccuacaaccgcaucaucaaccagaucucuaccaacgagauccagagugaccagaaccugaa

SEQ ID NO: 154410 - RNA, 71 nt, Homo sapiens
ggugcugccacccccucugcccacuaugcccacucucaccagccucccaucuuccaccgacaagccgucgg

SEQ ID NO: 154411 - RNA, 25 nt, Homo sapiens
gaaucaucauuucuggaagaagcag

SEQ ID NO: 154412 - RNA, 76 nt, Homo sapiens
aagauggcccaccuggaugaugguuccaggagggccagcucccuuauugcuuugcuuucucuuccuccucuucugg

SEQ ID NO: 154413 - RNA, 43 nt, Homo sapiens
gaugaaaauguuugaggccuaaaaagacuuacuggcucuaaaa

SEQ ID NO: 154414 - RNA, 52 nt, Homo sapiens
ucauccaucagugauguuucugaccuuugccacuggugccuuuaauguguga

SEQ ID NO: 154415 - RNA, 65 nt, Homo sapiens
cuugugccccaucugcuacccugggguggggagcauuggguccugccccaucccuuagagaagag

SEQ ID NO: 154416 - RNA, 46 nt, Homo sapiens
ggaggauggccacgacaccagcuccaucuaccuggugaagccggag

SEQ ID NO: 154417 - RNA, 41 nt, Homo sapiens
agacgccuggauggcucuguuaacuucuucaggaacuggga

SEQ ID NO: 154418 - RNA, 43 nt, Homo sapiens
agcaaacagagccacucuugccuuccuuaguacuaccucuguu

SEQ ID NO: 154419 - RNA, 50 nt, Homo sapiens
aacauugacggcgaauacuggcugggccuggagaacauuuacuggcugac

SEQ ID NO: 154420 - RNA, 45 nt, Homo sapiens
agcgccccagccgcagcuuauaauacucgcucucagguuccaggc

SEQ ID NO: 154421 - RNA, 46 nt, Homo sapiens
acaacggcaagcaguucaccacccuggacagagaucaugaugucua

SEQ ID NO: 154422 - RNA, 27 nt, Homo sapiens
aagaggaacaggcccucauucugaagc

SEQ ID NO: 154423 - RNA, 46 nt, Homo sapiens
cuccguccugguagcggcuccgguaauggcccccgcgguaccagac

SEQ ID NO: 154424 - RNA, 45 nt, Homo sapiens
cugguaccgcgggggccauuaccggagccgcuaccaggacggagu

SEQ ID NO: 154425 - RNA, 48 nt, Homo sapiens
aggaggcucuuacucacucaagaaaguggugaugaugauccgaccgaa

SEQ ID NO: 154426 - RNA, 46 nt, Homo sapiens
aagguguugggguucggucggaucaucaucaccacuuucuugagug

SEQ ID NO: 154427 - RNA, 47 nt, Homo sapiens
ucccuccuacuuuccuucacaccagacagccccucaugucuccagga

SEQ ID NO: 154428 - RNA, 49 nt, Homo sapiens
uaagucucuacaauaaaaacacaacugcaaaguaccuucauaauauaca

SEQ ID NO: 154429 - RNA, 44 nt, Homo sapiens
aaaugaagggauaagugggugauggauggugaaaaguccugaga

SEQ ID NO: 154430 - RNA, 39 nt, Homo sapiens
ucuggccaggagaauuaucucagaacagaagucaucaga

SEQ ID NO: 154431 - RNA, 43 nt, Homo sapiens
ucucaucuccaaacuacacuucccuggagaacaagugccacaa

SEQ ID NO: 154432 - RNA, 56 nt, Homo sapiens
aacaggacucagaaagccaccaugcugcagugcaucaaccaagggguccggugacc

SEQ ID NO: 154433 - RNA, 46 nt, Homo sapiens
uguaaugacacgaaucugcaauaaaagccaucagugcuauuuggau

SEQ ID NO: 154434 - RNA, 47 nt, Homo sapiens
aggagggggaaaggagagcuguaggguaggagaggccaggcacaggg

SEQ ID NO: 154435 - RNA, 60 nt, Homo sapiens
cgggucacggaucacacccgcaggggccuggcggagcaaggugccguucgccgccugcgg

SEQ ID NO: 154436 - RNA, 40 nt, Homo sapiens
gccccagauccgugccuccagcuggaaugguaaacuggga

SEQ ID NO: 154437 - RNA, 90 nt, Homo sapiens
uggauaaaugaaaauauaguuugcuuccguguuaaguugugguugagcuauggagugacccuggagcugccgcaucccacaggccugagc

SEQ ID NO: 154438 - RNA, 42 nt, Homo sapiens
uuacuacauagaauuuauaaaguggauguuaaauggagagag

SEQ ID NO: 154439 - RNA, 45 nt, Homo sapiens
gcuaagucuauuccauguuaacacuguggaaauaaauaugaagau

SEQ ID NO: 154440 - RNA, 381 nt, Homo sapiens
ggaggcucucuguugucugucucugagaucuuugugucugggaaugccuaaagauuuuauuuuuuuuucuuuguuuuuauuuuauuuuauuuuauuuuuuugagacagagucucacccuguugcccaggcuggagugcaauggugcgaucuuggcucacugcaaccuccaccucccaguucaagugauuccccugccucagccucgcgaguagcuaggacuacaggcgcaugucaccaagcccggcuaauuuuuguauuuuuaguagaaacgggguuucaccauguuggccaggaugauccucaaucuccugaccucgugauccacccgccuuggccucccaaagugcgggauuacaagcgugaaccacccugcccagcca

SEQ ID NO: 154441 - RNA, 51 nt, Homo sapiens
aagucacuuagacaucucaccguggaaguuugugagccugcauuaggagau

SEQ ID NO: 154442 - RNA, 61 nt, Homo sapiens
cuuuuaagaugcugucuuacauuaaugagcaucuaauggaaagaagguaugaguugcacug

SEQ ID NO: 154443 - RNA, 46 nt, Homo sapiens
guauuuugggggguuuucaggguucuucaugaacauauccagagau

SEQ ID NO: 154444 - RNA, 46 nt, Homo sapiens
agacuuucagaaacucaccgcagcugacgauaaaacugcucaggua

SEQ ID NO: 154445 - RNA, 27 nt, Homo sapiens
guaugccuauauuuugaggcuagaaca

SEQ ID NO: 154446 - RNA, 32 nt, Homo sapiens
gcauauuuuaaugggaggagguucuuuuucaa

SEQ ID NO: 154447 - RNA, 48 nt, Homo sapiens
caacucaacaucuagugggaugaugacacacagugccuuuuaggaaag

SEQ ID NO: 154448 - RNA, 40 nt, Homo sapiens
cugugguuuccaguugguggccacaguaaaccugugugcu

SEQ ID NO: 154449 - RNA, 46 nt, Homo sapiens
ugcagcucugauuuuggggguaaagauucugucacuaguccagaca

SEQ ID NO: 154450 - RNA, 91 nt, Homo sapiens
ucacaaaagcugaaauuguggugugcuaagagaaucacaaauguaacauaccucuuaucuucuauuuagaggccccagaccuaaagcagga

SEQ ID NO: 154451 - RNA, 46 nt, Homo sapiens
uacagacgucuugggaagugacuuugacccuaauauugaugaagau

SEQ ID NO: 154452 - RNA, 42 nt, Homo sapiens
gugucagaacuuggagcaggaccuucuggcaguaauggaguu

SEQ ID NO: 154453 - RNA, 41 nt, Homo sapiens; identical to SEQ ID NO: 67523

SEQ ID NO: 154454 - RNA, 34 nt, Homo sapiens
uuuacugguucauagaugauguauucuugcugug

SEQ ID NO: 154455 - RNA, 63 nt, Homo sapiens
cuucauuugucuauuucucuaaauuauuuuauuugaaauuuuuuauuagcaacucggagcaga

SEQ ID NO: 154456 - RNA, 46 nt, Homo sapiens
ucuugauuaucaguuuugaaggagaaucuuuauuagucaguagagu

SEQ ID NO: 154457 - RNA, 43 nt, Homo sapiens
uaagguacacauuuuuugggggauacuauuucauaugccuggu

SEQ ID NO: 154458 - RNA, 46 nt, Homo sapiens
uguuggccugcuucauuuguccugcaguugucaauccagaacaaua

SEQ ID NO: 154459 - RNA, 44 nt, Homo sapiens
uuuaacucuaagaauaucagugcuguugagaauauaagccagau

SEQ ID NO: 154460 - RNA, 43 nt, Homo sapiens
uucaggguaauggggaaugaacaaaauaaucggaagaagaaag

SEQ ID NO: 154461 - RNA, 27 nt, Homo sapiens
aauuuaugacgaaaaucaguucugagc

SEQ ID NO: 154462 - RNA, 46 nt, Homo sapiens
aagauuaaauaacuaaacaagucacagagcuggugagugauggagu

SEQ ID NO: 154463 - RNA, 46 nt, Homo sapiens
ucaaaucagaaucuuccaacacuuucuggacgggcuucauaguaga

SEQ ID NO: 154464 - RNA, 46 nt, Homo sapiens
guuucaauaccaaguguaaggggacauacaucaagcaguaccaggu

SEQ ID NO: 154465 - RNA, 42 nt, Homo sapiens
auuaccuucauagaccuugauuguaacaguugguugauuauc

SEQ ID NO: 154466 - RNA, 43 nt, Homo sapiens
accuccaucugaaaacagcaguuacuuaguucccuagccauuu

SEQ ID NO: 154467 - RNA, 115 nt, Homo sapiens
cgagcuaaaaguaauuucauauuggucuacaaggagcagcaacuaguacuaacaaugaguuagguuacuaacucaacugaauuuuaucuauuuuaaaguacugugaacuccuuuu

SEQ ID NO: 154468 - RNA, 46 nt, Homo sapiens
uucucagcaucauuaaccauccuuucgauuucuucaggugucaggc

SEQ ID NO: 154469 - RNA, 18 nt, Homo sapiens
ggacuggugggcaccuug

SEQ ID NO: 154470 - RNA, 45 nt, Homo sapiens
ccccccaccauccccaagaacauuccacacaucaucggcagccau

SEQ ID NO: 154471 - RNA, 32 nt, Homo sapiens
aauccugguaaguagccaaagguuauuuuauu

SEQ ID NO: 154472 - RNA, 36 nt, Homo sapiens
aaaugaaugaaugaaugaaccugcuaauaagaaaca

SEQ ID NO: 154473 - RNA, 74 nt, Homo sapiens
agaugaaacugucugcaguuucugguaauuagacucaaacugucugagaaagucuucagaggaaagauaggggg

SEQ ID NO: 154474 - RNA, 31 nt, Homo sapiens
ugaacugggcuuugaagguuaacuaggaguu

SEQ ID NO: 154475 - RNA, 43 nt, Homo sapiens
guggggaugagauuugcugggcugguagcggcggcugcugcgg

SEQ ID NO: 154476 - RNA, 45 nt, Homo sapiens
acuucugacguaccuugacagcuuuaaacguuuucacauggggac

SEQ ID NO: 154477 - RNA, 39 nt, Homo sapiens
uccauuucugauuccacuuucaaagucuuggauauauuc

SEQ ID NO: 154478 - RNA, 48 nt, Homo sapiens
aguccaguucacaggagguagaauagugguuggcaggggaugagggua

SEQ ID NO: 154479 - RNA, 46 nt, Homo sapiens
caaaucggaaagaaagaagugaaaauuucccuguuugcaagugaug

SEQ ID NO: 154480 - RNA, 42 nt, Homo sapiens
uaccacaaguggauugguaacccagcuccugagagagcugac

SEQ ID NO: 154481 - RNA, 97 nt, Homo sapiens
acccaagcuggacuggaggcuuuauuugaaagcaaucugcuggaugauuugaaaaguguaaugaaaacaaaugacauuguucgauacaggguguaug

SEQ ID NO: 154482 - RNA, 62 nt, Homo sapiens
uguuacugagauucuaaauaaugcugaauuacuaaaacaaauuguuuauugcauugguggag

SEQ ID NO: 154483 - RNA, 45 nt, Homo sapiens
aauucacccugaugauucuguaaaaauccucacucuuucccaggu

SEQ ID NO: 154484 - RNA, 45 nt, Homo sapiens
uuagaaucuugacaguuuuuuuugagagaguuuaaguccuaagau

SEQ ID NO: 154485 - RNA, 59 nt, Homo sapiens
auguuugugaucaaagacuuucaagugaccuuacuacuugaaaagauuaugaaccacug

SEQ ID NO: 154486 - RNA, 68 nt, Homo sapiens
accuguaauuuuuaaaaaggauuacaaucuucccaacccccacaggcauguaaaacuuguauaacauu

SEQ ID NO: 154487 - RNA, 44 nt, Homo sapiens
ccccgggaacugggccgcugggccagccccugcgucggggggca

SEQ ID NO: 154488 - RNA, 77 nt, Homo sapiens
ccacccucgccgcuccgcuggccgggaauuuggcaaggcuuugcccuacgcgguaaacacguaagccuacuggccuc

SEQ ID NO: 154489 - RNA, 46 nt, Homo sapiens
uaguuuuacaauuuuuuuauccaucaaauccgaagucauuuaacaa

SEQ ID NO: 154490 - RNA, 45 nt, Homo sapiens
uucguaguccaaucagcugaaauuaaaucacuugggagggacgca

SEQ ID NO: 154491 - RNA, 40 nt, Homo sapiens
ggaaauuucccuaauguucauuuauuuucuaaauccagac

SEQ ID NO: 154492 - RNA, 50 nt, Homo sapiens
cuuuucuuuuuccauaugucaauugugguguucccagaauguauagcagu

SEQ ID NO: 154493 - RNA, 47 nt, Homo sapiens
gcccuucagcuccgauaccugcagacacugaccaccauugcugcuga

SEQ ID NO: 154494 - RNA, 43 nt, Homo sapiens
auagguuauugcagccgaaggagaaaugaaugcauccagggcu

SEQ ID NO: 154495 - RNA, 27 nt, Homo sapiens
agcgucccgcgaggcccgcgccaaggu

SEQ ID NO: 154496 - RNA, 28 nt, Homo sapiens
uacugaucugaacuagucguaggcugag

SEQ ID NO: 154497 - RNA, 46 nt, Homo sapiens
ucaccguuauaacuuucccaaucucaauauggaugugcauaaaggu

SEQ ID NO: 154498 - RNA, 38 nt, Homo sapiens
aguuugccaauccugacaaagaaucacugaugaagaau

SEQ ID NO: 154499 - RNA, 56 nt, Homo sapiens
guuuuucuuaaaggcgaugcauucacuuuguaaugaaauaaugcaaguaauugcaa

SEQ ID NO: 154500 - RNA, 1540 nt, Homo sapiens
gcugacacagugaguaugaguuucuauauuuauauauauuauagauuuuuuaagguaguuuuuaaaaaucuuuuuuguuuuguuuacugaccaguauaauucaaaccagaucugccuaugacuucacauuuuuaauaauauauugaaguguuuuucaugcaucuuuugaucuuuguauuguucuugggcaaaugagauguguuuuuuuuagagacaggcucucugaagccucuaacuucuagguagucuuccugccucagccuccugagcaccuuggacuacacaugugugccaccacacccagcuaguuuuuguuuguuuguuuuugguagaggcauagaggcaaggucucacuauguugcccaggcuggucucaaacuccuggccucaagugauccgcccgccucggccucccagacugcugggauuauaagcaugagccaccacgccuggcccauuugucuuuuauuuuuauuuauuuauuuauuuauuuuuugagacagagucuugcucuguugcccaggcuggagugcaguggcgcgaucucggcucacugcaagcucugccucccggauucacuccauucuccugccucagccucccaaguagcugggacuacaggcgcccgccacuacgcccagcuaauuuuuuguauuuuuuguagagacgggguuucaccauguuagccaggauggucucgaucuccugaccucgugaucugucugccucggccgcccaaagugcugggauuacaggcgugacccaccacgcccggccuccauuugucuuuuagauaagagaauauaagacccugaaauuguaagauauuugccuguuugucucuaacuaauuuuuagguacuauaauuagucuuucagcauccaaaauuuuguucuuuuauuauuuugcuacauuuuggauccagaaaugugauaucauguguuccuuuaaaaauucuucaaaccauuuuguaauaauuaacauucaaauuugguauuuuuauaacuugagcacuuaaaaauguaggcaauuucuuuacauuguuuaucugcauacuuuaaaagagauugauuucagagugugugauuucgugugucccuugauucaaaauaaagcuuuggaaucaggcaggcuuagauaugagucugugacucuaaacaaguaaguggcaguuucaucaauagaauggagauguucacaccuagcccauggagcuguuuuaaggguuuaaaugaaauauaaaguacuuagcacaauaaaugagcauuauuauuauucuuauuauuguucuuguccaguaccuguauuuacugucucuuuagucucguuaaaaucauacuuuggccauuuguccuuucuauaguugaaaacuuaauauuuuuguagcagggguuaggccaauuauguaaaguagcauauaaacgugguaagauuucaaagauguuacuugcuuuucagaauaucuauucccuaggacauuguagcuauguuuuccuuccuuuuguagcaauuggggcacugaagaugaugagacccagag

SEQ ID NO: 154501 - RNA, 54 nt, Homo sapiens
auauuggaauugcuguuccugauguauacagugcuuguaaaagguuugaagaac

SEQ ID NO: 154502 - RNA, 62 nt, Homo sapiens
uuuugaauccuaacaaaauggcaaccuuaauguagugcugugagaauucuccuuugagauuu

SEQ ID NO: 154503 - RNA, 46 nt, Homo sapiens
uguucagucauucugguuuucaagcagugcuuuaucucauguccuu

SEQ ID NO: 154504 - RNA, 44 nt, Homo sapiens
uagguacucuugagagcaauucaaaucaugcugacaaggauacu

SEQ ID NO: 154505 - RNA, 106 nt, Homo sapiens
ucuucagcggaacacucucugcuccccuagggccugggcugcucacauccaucgcacugaggagggucccauccauugcacugaggagggucccauccauugcacu

SEQ ID NO: 154506 - RNA, 48 nt, Homo sapiens
auugguuuggaaaucaaggagagggcggugacauauuggaccagaaga

SEQ ID NO: 154507 - RNA, 42 nt, Homo sapiens
ucagcugauuacaauaacaaaaggcggaauugaauugugcga

SEQ ID NO: 154508 - RNA, 41 nt, Homo sapiens
ggccagcucggaaucccagcucugccaccuccccugugaga

SEQ ID NO: 154509 - RNA, 42 nt, Homo sapiens
ggaaaguucuuagaaaucagggcuaagcugucauugaucagu

SEQ ID NO: 154510 - RNA, 58 nt, Homo sapiens
guuacauugcaggggaaugggcagcuggaguaggcgagaaacuugaccuuagaggacc

SEQ ID NO: 154511 - RNA, 62 nt, Homo sapiens
gaggcugccagguggaagagucuguauuuuaugcugcggcagugugggguccuggagggccu

SEQ ID NO: 154512 - RNA, 46 nt, Homo sapiens
cgaaagccagugcugucagacaacccuucauuuuagaaaugggaac

SEQ ID NO: 154513 - RNA, 35 nt, Homo sapiens
ucuugucuguugggagugaauauccugagcugaug

SEQ ID NO: 154514 - RNA, 48 nt, Homo sapiens
cacagcagucacuggagcggugguugcuaguguguucugugugcaugg

SEQ ID NO: 154515 - RNA, 66 nt, Homo sapiens
gagacuaauguccugggaaagugccauugcuuacagugacacaggacaccagucaucauaacguau

SEQ ID NO: 154516 - RNA, 45 nt, Homo sapiens; identical to SEQ ID NO: 67613

SEQ ID NO: 154517 - RNA, 58 nt, Homo sapiens
agggaggggcuggcgcagaauguuggagcugcacggaccucuggaguucauuuugaga

SEQ ID NO: 154518 - RNA, 41 nt, Homo sapiens
ccaaccuuauccccaguccccccaccuacaacucagcacau

SEQ ID NO: 154519 - RNA, 46 nt, Homo sapiens
gcuauuacacucguauucugcccucugugccuaaagauugccccac

SEQ ID NO: 154520 - RNA, 47 nt, Homo sapiens
agggcaauugggugacaacucauuugacacugacauaauuaaggaag

SEQ ID NO: 154521 - RNA, 42 nt, Homo sapiens
gccacgcucuggcuacgugagcacaaccgugugugugaccug

SEQ ID NO: 154522 - RNA, 45 nt, Homo sapiens
ugcuguucgguguccaguuccaauaccgcaaccgcauugccaugg

SEQ ID NO: 154523 - RNA, 46 nt, Homo sapiens
ggcucccagaccacugcugugcuucucucucggcagaucggugggg

SEQ ID NO: 154524 - RNA, 46 nt, Homo sapiens
ccuggacugcuucuugaaaagugccauccaaacucuaucuuugggg

SEQ ID NO: 154525 - RNA, 52 nt, Homo sapiens
cugccucaacaccaagaccugucccuacguuuccuuccgugugccggaugcc

SEQ ID NO: 154526 - RNA, 48 nt, Homo sapiens
gaguguugggguugacauuuagaacuuuaagucucacccauuaucugg

SEQ ID NO: 154527 - RNA, 50 nt, Homo sapiens
ccuuguuagcccuucagauuguuaggagugguucucauuuggucugccag

SEQ ID NO: 154528 - RNA, 54 nt, Homo sapiens
uuucuuucugucauucacacauagcuguuuuaauuuagaguccauuuuuauagg

SEQ ID NO: 154529 - RNA, 56 nt, Homo sapiens
ucgaauuaugcacuuaagauuaaugcucuuugcuguauguuauacuccaguugaag

SEQ ID NO: 154530 - RNA, 44 nt, Homo sapiens
gugacagaugaaagggagaugucagugagagccaaguggcugag

SEQ ID NO: 154531 - RNA, 45 nt, Homo sapiens
uaacaucuuugggacagugacagaugaaagggagaugucagugag

SEQ ID NO: 154532 - RNA, 42 nt, Homo sapiens
ucacagaagaaaugggggaugguguugucagcacaaaaggac

SEQ ID NO: 154533 - RNA, 46 nt, Homo sapiens
caagaucacagaagaaaugggggaugguguugucagcacaaaagga

SEQ ID NO: 154534 - RNA, 45 nt, Homo sapiens
uguggcagaugucagcucccaugauggcgucuccugcucggccag

SEQ ID NO: 154535 - RNA, 46 nt, Homo sapiens
gauugagggaggugucugagcaggacaacuugagcagggcaccaag

SEQ ID NO: 154536 - RNA, 46 nt, Homo sapiens
agguauguggccaucugucauccucuacauuaugccaccaucauga

SEQ ID NO: 154537 - RNA, 46 nt, Homo sapiens
cccagcaaggccaggcauagacgcugcgacauagcuguuguauaga

SEQ ID NO: 154538 - RNA, 49 nt, Homo sapiens
guugagauauaccuuaauucugucaagucacuuccuucauucaacacag

SEQ ID NO: 154539 - RNA, 45 nt, Homo sapiens; identical to SEQ ID NO: 67641

SEQ ID NO: 154540 - RNA, 47 nt, Homo sapiens
uuuuaaggcauauacucagcuucuauuuaaaacuauaauuuaaaaua

SEQ ID NO: 154541 - RNA, 47 nt, Homo sapiens
uguaucccuuugcuggcaagggaauacaaggcgucaagaccacagau

SEQ ID NO: 154542 - RNA, 49 nt, Homo sapiens
uuuccuggaagaacuuuucuuuuguuuuagugaaugaagaggcuugaug

SEQ ID NO: 154543 - RNA, 46 nt, Homo sapiens
ucaucugauccuucuucagaaugguaccuacugauaucaucgagga

SEQ ID NO: 154544 - RNA, 46 nt, Homo sapiens
cagugcuggcaaccucauucugaaaacucauguuaugucugaagau

SEQ ID NO: 154545 - RNA, 47 nt, Homo sapiens
aaauggaauggcaguggaaaaugggcauccaguacagcagcaccaaa

SEQ ID NO: 154546 - RNA, 45 nt, Homo sapiens
guuacugauuuaucuggucauagaaagcauuccaguacuggggac

SEQ ID NO: 154547 - RNA, 46 nt, Homo sapiens
cacugcuucccaaggaagugcgacuaagcccaucaguguaucaggu

SEQ ID NO: 154548 - RNA, 55 nt, Homo sapiens
gugauguuaagagaagaguacauuuauuugaaacccagagaaggacaaaagaaga

SEQ ID NO: 154549 - RNA, 73 nt, Homo sapiens
gcaccauaggcuccuguauaaaugccauugauucagagcccaaagaugucauugcuaauucaaaugcuguguu

SEQ ID NO: 154550 - RNA, 46 nt, Homo sapiens
ucauuugaagaccaguugcgaggagcagauaagaagaaagccagau

SEQ ID NO: 154551 - RNA, 46 nt, Homo sapiens
uuccaugccauaugccgaucauuacaguacauuuuccccucgagau

SEQ ID NO: 154552 - RNA, 46 nt, Homo sapiens
acucagauacccuuugaagucccacaguacccacagacaggugagu

SEQ ID NO: 154553 - RNA, 36 nt, Homo sapiens
uaauuuauguaaagcacagugccuggaauagacuca

SEQ ID NO: 154554 - RNA, 46 nt, Homo sapiens
accugagcuauuuccaaaaguauggauagcaaggaaggaagggccu

SEQ ID NO: 154555 - RNA, 41 nt, Homo sapiens
uguuauuggaacacaggaaaaagaauaauucuaugagaggu

SEQ ID NO: 154556 - RNA, 45 nt, Homo sapiens
aauagaaaccuaagcagguaaaaugcugagccucuagcucuguuu

SEQ ID NO: 154557 - RNA, 45 nt, Homo sapiens
agcuaaucucacguaguacugacaguaccuuaagagcucuggaga

SEQ ID NO: 154558 - RNA, 47 nt, Homo sapiens
caaucuguugauuguuuuugaaacagguaucgauuaaggaacaaaaa

SEQ ID NO: 154559 - RNA, 46 nt, Homo sapiens
agcaaggggguuguccacgaggaacaaauuguacauuugcccauuc

SEQ ID NO: 154560 - RNA, 43 nt, Homo sapiens
acucacaacaggaaacaauggaauauuaguuguuucagcacaa

SEQ ID NO: 154561 - RNA, 101 nt, Homo sapiens
uuuuuuaaugcuuuuuaaaauuguuugauuuugguagcagaauuuuaagacagcaauaaauugaugaaaaaauauuuucuuuuucugggcauucuguuaac

SEQ ID NO: 154562 - RNA, 46 nt, Homo sapiens
guuuugcaacgaacaggugacccagcuaacuuaaauagacugaggc

SEQ ID NO: 154563 - RNA, 42 nt, Homo sapiens
ucggaguuaugaagcauuacgcagagaacaugaugcccaaau

SEQ ID NO: 154564 - RNA, 49 nt, Homo sapiens
uuagauauuuccugauguuuacuuuaagaagcacuagacuaggugucac

SEQ ID NO: 154565 - RNA, 41 nt, Homo sapiens
guugaggauuuggcacucuacuuaaaaccacuaaguggagg

SEQ ID NO: 154566 - RNA, 46 nt, Homo sapiens; identical to SEQ ID NO: 67678

SEQ ID NO: 154567 - RNA, 64 nt, Homo sapiens
gguuauccaagggaaacacuuuuuuaaacaacaaaacaaaaaaaccgcccagcaguccaaagua

SEQ ID NO: 154568 - RNA, 46 nt, Homo sapiens
auugcccuaaauaccuagauuucuuguucaccagagagcuuuuguc

SEQ ID NO: 154569 - RNA, 41 nt, Homo sapiens
aacccaaaacuuccagauagauuauccuguuacaaucagaa

SEQ ID NO: 154570 - RNA, 48 nt, Homo sapiens
auuuccauccuucaaaucccaaggcagccguuuaagauaccggcagau

SEQ ID NO: 154571 - RNA, 50 nt, Homo sapiens
uugcaugauaugucuaaaaauuuucaggaaaauggaaucuuuuuuuaaag

SEQ ID NO: 154572 - RNA, 48 nt, Homo sapiens
uugagauuuuugcugggggagggguguuuugugaaagugaugguuauu

SEQ ID NO: 154573 - RNA, 68 nt, Homo sapiens
acagacuuguuauauaaaguuuguauuauucuauuacgcaagucuuucuguagagaugcagcauuugu

SEQ ID NO: 154574 - RNA, 46 nt, Homo sapiens
ggaaagcaaugcuuugcagucuacaguagagagucugacaucagag

SEQ ID NO: 154575 - RNA, 64 nt, Homo sapiens
ugaaauacuugacugcugccaguuaccuucagaugguucacauuguggaaaagugcacagaagc

SEQ ID NO: 154576 - RNA, 26 nt, Homo sapiens
ugcuccacuuuuaugagagaucaguu

SEQ ID NO: 154577 - RNA, 42 nt, Homo sapiens
gagucugauguucugcauuuccaguuugaacagcaaggagau

SEQ ID NO: 154578 - RNA, 51 nt, Homo sapiens
aaaauuuaguauugaacgagguucgaguaugaaaaagagaauagaagguga

SEQ ID NO: 154579 - RNA, 43 nt, Homo sapiens
uaaucacuagcugaaaaaaggaacuggaaacgcgaauguaaga

SEQ ID NO: 154580 - RNA, 42 nt, Homo sapiens
ugccuccagaauaccugugugcugaaccuggcauccgguuuc

SEQ ID NO: 154581 - RNA, 51 nt, Homo sapiens
uccuugacucuaguuuucugagucggugagugagugcaaaguagauuccuc

SEQ ID NO: 154582 - RNA, 40 nt, Homo sapiens
cucuuugguuggagacuauuucuggguucauucaguuguu

SEQ ID NO: 154583 - RNA, 46 nt, Homo sapiens; identical to SEQ ID NO: 67697

SEQ ID NO: 154584 - RNA, 46 nt, Homo sapiens
aaugcuugcauuuaugaagcagaaagaggaauuggagcuaguagua

SEQ ID NO: 154585 - RNA, 70 nt, Homo sapiens
aggagacaaauauacuggagaugauuaugucaagacuccauaauuaacugaaugcugaagaagugugagg

SEQ ID NO: 154586 - RNA, 51 nt, Homo sapiens
gaucuggggaccagggggucuugggcugccuugugauacacagccccagcc

SEQ ID NO: 154587 - RNA, 46 nt, Homo sapiens
ggccagagaccccuuugaggauuuguuacagaaaaccaagcaagac

SEQ ID NO: 154588 - RNA, 25 nt, Homo sapiens
cuggggccggcuuuugcguccggcc

SEQ ID NO: 154589 - RNA, 79 nt, Homo sapiens
agucucacucgcgcccccgggcuuacaggugauugcgggugccugcgaucuaaaaaguaaaaagggccagccgguagcu

SEQ ID NO: 154590 - RNA, 71 nt, Homo sapiens
gcuguuaacauuccuggcagcacaaaaugugccaucugaggaugggguggaggcuggggcuggggggcagu

SEQ ID NO: 154591 - RNA, 27 nt, Homo sapiens
cccuagaguggacgcgcagccgcuggc

SEQ ID NO: 154592 - RNA, 49 nt, Homo sapiens
aagaaaggaagggauuaaguauuuuuccucuaauacuuucuugaagguc

SEQ ID NO: 154593 - RNA, 45 nt, Homo sapiens
gcuguggcacugggaccccaaggcagcugcagcacggaaguggag

SEQ ID NO: 154594 - RNA, 46 nt, Homo sapiens
agaagcaggccguugagaaggugucagaggccugcagccaaaagaa

SEQ ID NO: 154595 - RNA, 41 nt, Homo sapiens
ugccucgcggaugguggcagcggcggcagcggcgacucaga

SEQ ID NO: 154596 - RNA, 40 nt, Homo sapiens
caccuugucauauaccaucaauaaaguacccugugcucag

SEQ ID NO: 154597 - RNA, 44 nt, Homo sapiens
aggggucuuacuccuuggaggccaugugggccaugagguccacc

SEQ ID NO: 154598 - RNA, 24 nt, Homo sapiens
caguagaauuuuuuuuuucccuua

SEQ ID NO: 154599 - RNA, 27 nt, Homo sapiens
acuuuucagugccaaaguauggaaugg

SEQ ID NO: 154600 - RNA, 42 nt, Homo sapiens
ugaacagguacaggggaaauuauuugggggagggaaaaagga

SEQ ID NO: 154601 - RNA, 34 nt, Homo sapiens
aaaaacauugaucgugacccauuaauugauucau

SEQ ID NO: 154602 - RNA, 56 nt, Homo sapiens
aggcaaggugggauggagaaauuuugacuaaaucugaggaagagauuugugugaug

SEQ ID NO: 154603 - RNA, 47 nt, Homo sapiens
gauaugguauguaaaacauuaaaaaauauagauuugguucuuggggg

SEQ ID NO: 154604 - RNA, 344 nt, Homo sapiens
ccuauuucuuuuuuuuuugagacugagucucgcucuguuggccaggcuggagugcaguggugcaaucuuggcuuaccacaaccccagccuuccaguucaagugauucuccugccucagccuccugaguaacugggacuacaggcaugcgccaccaugccuggcuaauuuuuguauuuuugguagagaggggguuuaaccauguugggcaggcuggucucgaacuccugucucaagugaucugcccuccuuggccucccaaagugcugggauuacaggugugagccaccgcgccuggccuauuucuuauuuguccuuucuaauauuagaauguaagcucuacugg

SEQ ID NO: 154605 - RNA, 45 nt, Homo sapiens
guuagaauaaaaugcaaauggcagugugaagcaaagaguuuuaag

SEQ ID NO: 154606 - RNA, 35 nt, Homo sapiens
aauggggguccgcagacauuuuuguaaagggccag

SEQ ID NO: 154607 - RNA, 54 nt, Homo sapiens
uuccaaagugagagaaagauaaaguggugugaaugugugaggggaauaacugaa

SEQ ID NO: 154608 - RNA, 45 nt, Homo sapiens
ggcauauaugggggauggagcaguaaugggagacgagucugcaga

SEQ ID NO: 154609 - RNA, 69 nt, Homo sapiens
aguugaguucaaaguacuuguggcccauucugauagggauaucaaauaaguaguagagguagaucuaag

SEQ ID NO: 154610 - RNA, 29 nt, Homo sapiens
guaacuuuaccaagagacauuuugguaaa

SEQ ID NO: 154611 - RNA, 60 nt, Homo sapiens
uuucagcuguggucuauuacuuuucaagaaauguuggcuaagaagggauguaaagaggug

SEQ ID NO: 154612 - RNA, 57 nt, Homo sapiens
ucaggagagagcuuacagaaaggggaaaauuaaaauugaaaccauuuggagccagaa

SEQ ID NO: 154613 - RNA, 47 nt, Homo sapiens
auaauauuuauagauaaugcugaaaacucccuuuagacaggagagaa

SEQ ID NO: 154614 - RNA, 57 nt, Homo sapiens
cuucaugaaggaaaugggacuucagugaaccuugaaagaugaguuaaaaucuauaua

SEQ ID NO: 154615 - RNA, 37 nt, Homo sapiens
ugaagggguauagguggguguagggguauaugggagg

SEQ ID NO: 154616 - RNA, 56 nt, Homo sapiens
uugacuaguaugacacaucuuccuguuauuugucuuaguuugggauguccagaggg

SEQ ID NO: 154617 - RNA, 46 nt, Homo sapiens
gguuauauuauuguuuuuauuaucuuauaggugcuauacuugguag

SEQ ID NO: 154618 - RNA, 44 nt, Homo sapiens
cuuugcuucuugagaagucauuuaugauggagaagugaaaucau

SEQ ID NO: 154619 - RNA, 32 nt, Homo sapiens
uuccauuuuugaaaagcucaugucauugcuaa

SEQ ID NO: 154620 - RNA, 57 nt, Homo sapiens
agcaauaaacuauuauugcaugggaaaauggacaggaaaucuuaauacacuguagua

SEQ ID NO: 154621 - RNA, 30 nt, Homo sapiens
cuuuuccagccucaaaguuucugagaauaa

SEQ ID NO: 154622 - RNA, 93 nt, Homo sapiens
aguugucuggcccauuccccaguacauagguauucaauaaauguuucuggguuagugcaauacuuaagaaauacaagcauguguuuuaggagu

SEQ ID NO: 154623 - RNA, 73 nt, Homo sapiens
gagccuguuugugauuuucuaaaaaauaaacauguacuuuuuggcagcuguugugagggaguguagagaagag

SEQ ID NO: 154624 - RNA, 86 nt, Homo sapiens
aauguugcucugggagacuuacugcauugccgacagcacagaugugaaggacaugagacuaagagaaaccuugcaaacucuauaaa

SEQ ID NO: 154625 - RNA, 73 nt, Homo sapiens
gaaacuuuugaaaaaguguacaugaagaauguagcccucuccaaaucaaggaucuuuuggaccuggcuaaugg

SEQ ID NO: 154626 - RNA, 48 nt, Homo sapiens
cauaaagucaucaaagugggguacaguaaagaggcuuccaagcauuac

SEQ ID NO: 154627 - RNA, 40 nt, Homo sapiens
aaccaguguucggcuuuauuugaagucuaugcccugcaca

SEQ ID NO: 154628 - RNA, 46 nt, Homo sapiens
gcauaucauaccaaauguuccuaaaaaguaaucuuucaaaaaagua

SEQ ID NO: 154629 - RNA, 60 nt, Homo sapiens
cuccaguauuuucucauguucagauaugaagguaucugagcuguuucucuaucagaagaa

SEQ ID NO: 154630 - RNA, 46 nt, Homo sapiens
uuauaauagcaaugaaacauuuaaaugacaucuaugaggaagagcc

SEQ ID NO: 154631 - RNA, 46 nt, Homo sapiens
uauuugcuuucgaguccaugcuacacaguuggcuugcuuccauuag

SEQ ID NO: 154632 - RNA, 46 nt, Homo sapiens
uuuaaaucgaguaacagcaucgcacccauuuaugacugccguagau

SEQ ID NO: 154633 - RNA, 48 nt, Homo sapiens
acauacuguggaaaaccaaaugaauucauuaaguguaucugccgguga

SEQ ID NO: 154634 - RNA, 45 nt, Homo sapiens
acucuuagaaaaaagagugaagucaagauuuucucaccggcagau

SEQ ID NO: 154635 - RNA, 45 nt, Homo sapiens
ccaaucuacauguaagaccaauaacugcuauuggggucugugcag

SEQ ID NO: 154636 - RNA, 42 nt, Homo sapiens
aggacugcugcagaucaaugacaaaaucgcccuaaaggaaau

SEQ ID NO: 154637 - RNA, 48 nt, Homo sapiens
uguauuaaaaguucggguaggugauugagagaauauuguaucaguccu

SEQ ID NO: 154638 - RNA, 50 nt, Homo sapiens
uagaaaccuuuaauucaaugggcuuuuaacugauuacaaugauauuuagu

SEQ ID NO: 154639 - RNA, 47 nt, Homo sapiens
auuacuauuuguuuaacccuaacuuacacaguuuuucagugcaugcu

SEQ ID NO: 154640 - RNA, 49 nt, Homo sapiens
auggagagaguaacucuguccuuauuaucggaccccgaggaucaggaaa

SEQ ID NO: 154641 - RNA, 54 nt, Homo sapiens
gauuguucucugcccuuuuugucaguucauauauuuuuuuuaauauuaguguuu

SEQ ID NO: 154642 - RNA, 62 nt, Homo sapiens
gauuugaauuuguugaaaugagcagucguaaaucaaagaguaacagcuuaauucacacagag

SEQ ID NO: 154643 - RNA, 58 nt, Homo sapiens
aaagcaguaaaugauugccauaaaaaucaguauaguguuaaccacugaaaagaauuga

SEQ ID NO: 154644 - RNA, 47 nt, Homo sapiens
caucgggguaguaggugaggagcgugacgguccgaguguaagagaga

SEQ ID NO: 154645 - RNA, 46 nt, Homo sapiens
cguugguuccccucuuugaccugguaaaugcaggcuuuuaugcgag

SEQ ID NO: 154646 - RNA, 40 nt, Homo sapiens
cgacccggaagacauuguagcgggagguacaggagcgggg

SEQ ID NO: 154647 - RNA, 46 nt, Homo sapiens; identical to SEQ ID NO: 67811

SEQ ID NO: 154648 - RNA, 45 nt, Homo sapiens; identical to SEQ ID NO: 67812

SEQ ID NO: 154649 - RNA, 45 nt, Homo sapiens
cacucaucccaggcugaaugaaucaggaacuccaaaagugagucg

SEQ ID NO: 154650 - RNA, 38 nt, Homo sapiens
uuugaaguguugaagcugugcuccccuuaaaucguggc

SEQ ID NO: 154651 - RNA, 45 nt, Homo sapiens
ucguugauaaaaaugcaaagucaaauaaaaggugucuugguuuga

SEQ ID NO: 154652 - RNA, 54 nt, Homo sapiens
uugugauugucauuaaaaagugguaaauugcucaauguaauauuuuugugcgcu

SEQ ID NO: 154653 - RNA, 46 nt, Homo sapiens
caaucuugcaagauuuguagaccagcacuacaaagaucgcauagau

SEQ ID NO: 154654 - RNA, 82 nt, Homo sapiens
uguguaaauaagacaaauaaaaacguuaagcggaacaaaucacagagagccacaaagcggauuucacacaugccuagcagac

SEQ ID NO: 154655 - RNA, 23 nt, Homo sapiens
uuaauccgggcuucucauuugau

SEQ ID NO: 154656 - RNA, 45 nt, Homo sapiens
gcaguauuggagauuaguauauaauuaauccagaaaagcagcuua

SEQ ID NO: 154657 - RNA, 82 nt, Homo sapiens
uucuuaggagcaggaccaugcuuaauuaacacuguaucucuaaggucuugacagagggccuguuuauaguggaugcgggaaa

SEQ ID NO: 154658 - RNA, 43 nt, Homo sapiens
caaaacucugcaguucguagacucugcacacauagcacaaugc

SEQ ID NO: 154659 - RNA, 42 nt, Homo sapiens
cagggagggggaaugggugggcuuauaggaaugcugggcuau

SEQ ID NO: 154660 - RNA, 44 nt, Homo sapiens
cucccagcuguacacuucuuggcuuuauuacgcuggacaggcag

SEQ ID NO: 154661 - RNA, 30 nt, Homo sapiens
cacagacucgaaacucuggagaagguguug

SEQ ID NO: 154662 - RNA, 106 nt, Homo sapiens
ugggcuugaaccgcuggagcccccgagggacgcggggguucagagagcaagaggaaggaaccagacugacagggucgccagaggcagucccagcacaaaggcaagc

SEQ ID NO: 154663 - RNA, 162 nt, Homo sapiens
aaggccccugcgcuuagggcugggaauuuagcaaggagcuggguugcuggcggaccgagccaaauccgggugaaacuggcgaggaggaacgcgcaagugccaacaagcagguuugcuguuaggcggggaggccccgagguggagccgcgcccagcggggagu

SEQ ID NO: 154664 - RNA, 42 nt, Homo sapiens
guggcaggggggcaccaucugaggucuugggcugggacauag

SEQ ID NO: 154665 - RNA, 52 nt, Homo sapiens
gccguguaauucucaaacacuguaggaacguaauucuggauagacaaaaugg

SEQ ID NO: 154666 - RNA, 47 nt, Homo sapiens
gccagccagaaauuauccagcaaaucuaucauggauccuaaucagaa

SEQ ID NO: 154667 - RNA, 105 nt, Homo sapiens
auauuucucucuuuauaaaaagcagauauaaaaauaaaucacaaggcugaugggcaaccucugaaacgcggcgcagacgaggaggagagcgagaggagcaggcug

SEQ ID NO: 154668 - RNA, 44 nt, Homo sapiens
aagaagaggauuggaaggccgggcguauaaagccgcgcagagag

SEQ ID NO: 154669 - RNA, 36 nt, Homo sapiens
uuggaaaguaauauuucugcagagguccuacagagg

SEQ ID NO: 154670 - RNA, 45 nt, Homo sapiens
acugccucuucucccauuugaauuggggcuuguucaauuagccua

SEQ ID NO: 154671 - RNA, 46 nt, Homo sapiens
uccguaauagaugcuauuucuugcuguuucugaagcaauaauggca

SEQ ID NO: 154672 - RNA, 46 nt, Homo sapiens
cuaguugcaagagagaauugaugaaacucccacuucgaugcaaggu

SEQ ID NO: 154673 - RNA, 46 nt, Homo sapiens
ucaauucaguuaauggggugacuauaacacuccacauuuuccagag

SEQ ID NO: 154674 - RNA, 43 nt, Homo sapiens
uuccugacuauacugaguaaauaagguaucuugggaaacaucc

SEQ ID NO: 154675 - RNA, 46 nt, Homo sapiens
ccggcuugaucucuuaguuccauucacuauuuuuucagaaucagau

SEQ ID NO: 154676 - RNA, 45 nt, Homo sapiens
agaugaaccugauuaucugacacacauucuguuugauuaagcaaa

SEQ ID NO: 154677 - RNA, 48 nt, Homo sapiens
ggcuuucagugguagacucuacuacuucugaacgucgccuugaagacc

SEQ ID NO: 154678 - RNA, 49 nt, Homo sapiens
acuucucuuguguuggcauucaaguguuugaaaaguuuuuucugaaagc

SEQ ID NO: 154679 - RNA, 48 nt, Homo sapiens
gaauccauaucacaaauuuccucucuaaaguuuacuauuccagaagga

SEQ ID NO: 154680 - RNA, 57 nt, Homo sapiens
uuuguucagaaaucucaguuugagcauucaauuuuacagguguaguauuaucagaaa

SEQ ID NO: 154681 - RNA, 45 nt, Homo sapiens
uccuggggacagaaauccuuuggcugaagugguauuaugcuagau

SEQ ID NO: 154682 - RNA, 46 nt, Homo sapiens
augauauauucugagagccuuuuuuacauuggacacuuuuggagaa

SEQ ID NO: 154683 - RNA, 33 nt, Homo sapiens
uaggcaaaucuauagaggaaaaguaggcauugg

SEQ ID NO: 154684 - RNA, 38 nt, Homo sapiens
acauuuuugggggcuccugccugcaaacuucgguaggu

SEQ ID NO: 154685 - RNA, 45 nt, Homo sapiens
agaucagauucaaacuaagccauuccuugaugcuauucuucacug

SEQ ID NO: 154686 - RNA, 46 nt, Homo sapiens
acuaauagguuauguuuuuaaaucuucaauuugguaaaaaacugaa

SEQ ID NO: 154687 - RNA, 45 nt, Homo sapiens
gaguuaauauugcuaaucaugucaaucacuugacauggaagucag

SEQ ID NO: 154688 - RNA, 50 nt, Homo sapiens
auuagagccaaaacacauaauaacuuuggcaacagggaguugucuagacu

SEQ ID NO: 154689 - RNA, 44 nt, Homo sapiens
aaaucccugaaauuuugcuucaucuuacccacaccgcuaguuua

SEQ ID NO: 154690 - RNA, 65 nt, Homo sapiens
uuuucaggguaauugggauacuucuggcagcgaacugagugaaggggaauuggaaaagcgcagaa

SEQ ID NO: 154691 - RNA, 42 nt, Homo sapiens
aacuagacaaagaucagaaucaaaacacaaaucgccuaagaa

SEQ ID NO: 154692 - RNA, 46 nt, Homo sapiens
uccagaauccgaugcugagcgagagaaggauaaaaaagaaaaagau

SEQ ID NO: 154693 - RNA, 46 nt, Homo sapiens
agaaguuauaaaaagucaaaaaagcauaagaagaaaaguaagaaga

SEQ ID NO: 154694 - RNA, 48 nt, Homo sapiens
gaauccuuucaauaagccugugaaguuaauaggugaacaaacuaaggc

SEQ ID NO: 154695 - RNA, 359 nt, Homo sapiens
ucacuuuaauagguaagguucacugggcacgguggcucacgccuguaaaacaagcacuuugggaggccaaggugugugcugaucaccugaggucaggaguuugaaaccagccuggccaacauggcgaaauccugucucuacuaaaaauacaaaaaaauuaucagggagugguggcgggcaccuguaaucccagccacucaggaggcugaggcaagagaauugcuugaacccaggaggcggagguugcagugagccaagaucaugccacugcacuccagccugggcaacagagcgggacuccuuccccaaaaaaaaaaaaaaaaaaaaaguauuuugaugacaguuucaguuaggcccuu

SEQ ID NO: 154696 - RNA, 41 nt, Homo sapiens
gacuaauaaagaaaacuugaaauuuuucuuguaaagcagau

SEQ ID NO: 154697 - RNA, 95 nt, Homo sapiens
uauaaaaacugcuuuuaaguaaaagaaacuauuaaguuuccaugggaauauaaagauuuguaugugaagacuguuuuguauuuuuagaaaguuuu

SEQ ID NO: 154698 - RNA, 73 nt, Homo sapiens
uuuguaaaagagccagcauuugaggacauaacucuagaaucugaaagaaaacgaauauuuaaagauuuuaugc

SEQ ID NO: 154699 - RNA, 46 nt, Homo sapiens
guuaaaacaagcugcuccuccgauagaauuggaugcugucugggaa

SEQ ID NO: 154700 - RNA, 46 nt, Homo sapiens
uaaaagaucaacuacauuagaugcuggaaauaucaaauuggcuuuc

SEQ ID NO: 154701 - RNA, 36 nt, Homo sapiens
uuuccuaauuuaccguuaugguaguaguugaaaugg

SEQ ID NO: 154702 - RNA, 46 nt, Homo sapiens
caacuauuaguucugauauuagauucacuaauaugcuuggucagcc

SEQ ID NO: 154703 - RNA, 44 nt, Homo sapiens
auccaccuaaaguaacauguuaagaaauuuuuauggaaugagga

SEQ ID NO: 154704 - RNA, 48 nt, Homo sapiens
gacaacuguucccagaucauagacuuaggcuuugugaggacucauaca

SEQ ID NO: 154705 - RNA, 33 nt, Homo sapiens
aguuugcugagagaaaggagacgacagcgaaaa

SEQ ID NO: 154706 - RNA, 44 nt, Homo sapiens
gaacaagcaaagcaguugcgaaagagaaauugggaagccuuaaa

SEQ ID NO: 154707 - RNA, 92 nt, Homo sapiens
uaguuuaaaaauugguuaaaauuaauuuuuauuguauaauuuuuuuuuaacagaaaagcagagcaaauguuuggagagauggaaguuuggaa

SEQ ID NO: 154708 - RNA, 48 nt, Homo sapiens
agugaaaaaaagcaagccuuuaaugccuauaaaguccagacagaaaaa

SEQ ID NO: 154709 - RNA, 46 nt, Homo sapiens
ugggagcaggcuaugaaaaugauuauuaaugauccacgauacaggu

SEQ ID NO: 154710 - RNA, 69 nt, Homo sapiens
uuacucccaaaaaagaagaggaggagagccaaccagcaaagaaaacauacacuuggaauacaaaggaag

SEQ ID NO: 154711 - RNA, 42 nt, Homo sapiens
aacuuuuaggaaacgauuaucuuuauuucuuugucuucagau

SEQ ID NO: 154712 - RNA, 47 nt, Homo sapiens
uggcguauaacaguuuuuugggcucuuauuuucuuguugcuuuagau

SEQ ID NO: 154713 - RNA, 46 nt, Homo sapiens
ucaaacaaaagaaucucgcugggccaaaccuaaagaacuugaggau

SEQ ID NO: 154714 - RNA, 47 nt, Homo sapiens
ucuuuauucuuuagaaaucaauguggacugaacauaaaucaccugau

SEQ ID NO: 154715 - RNA, 44 nt, Homo sapiens
ucuuuauggaauaucaauuagaacuuugucuaaguugauacaag

SEQ ID NO: 154716 - RNA, 43 nt, Homo sapiens
ugaguuaauaaaagacaugaacuaaaaaaaaaaaaaaaaaaga

SEQ ID NO: 154717 - RNA, 40 nt, Homo sapiens
uuauuuuaaaaucugguuuuggugggacuuaaugagagau

SEQ ID NO: 154718 - RNA, 59 nt, Homo sapiens
uacaguuauucuuauuucuguucuaaggauuaucugcuaaaucuuuacauuaauccaua

SEQ ID NO: 154719 - RNA, 45 nt, Homo sapiens
ugugcuuugguaauauacuuaguagagaaggaggaauaagaaaga

SEQ ID NO: 154720 - RNA, 45 nt, Homo sapiens
aaaauacauauuauuuggaccauauuccaagucagccaccacauu

SEQ ID NO: 154721 - RNA, 43 nt, Homo sapiens
aaaaauuuuuaauuacagcacuuuuacauauaauaccaaaguu

SEQ ID NO: 154722 - RNA, 41 nt, Homo sapiens
gcugaaagggaccuuacagguuguuuaagcuuuaaauaaua

SEQ ID NO: 154723 - RNA, 46 nt, Homo sapiens
uucuuuccacagaaagauaaaauaaaacaauuugcuacugccagau

SEQ ID NO: 154724 - RNA, 60 nt, Homo sapiens
cuguuuuuguuuuauuuugcauuuauuuauuuguuuuugccucagguauucuaucaagau

SEQ ID NO: 154725 - RNA, 45 nt, Homo sapiens
uggcaugcauuaugccccaaugggaaugcacccuaugggucagag

SEQ ID NO: 154726 - RNA, 54 nt, Homo sapiens
gcccgacgaugaggccggggacgggagcugagcguggaggccucauggugagug

SEQ ID NO: 154727 - RNA, 46 nt, Homo sapiens
ucggccaucguauuccuccuuuacucagggggacagcuggggugaa

SEQ ID NO: 154728 - RNA, 48 nt, Homo sapiens
uccaccaauuccucuacacagaaucuugagggacaaagauuuucaucg

SEQ ID NO: 154729 - RNA, 48 nt, Homo sapiens
uugcuuuccuaccuaagucccucuuuguauuugcagaguugcaugcug

SEQ ID NO: 154730 - RNA, 45 nt, Homo sapiens
uaacugcuggauucuccuguugcagcuuuucuuggacagugacuu

SEQ ID NO: 154731 - RNA, 54 nt, Homo sapiens
aggcaaaauuaauaccaacaauuugaaaguuuuacuagguucacacauggucag

SEQ ID NO: 154732 - RNA, 46 nt, Homo sapiens
uuaaucccuauguguauaugaaauguaagucauaugcuuuccaaua

SEQ ID NO: 154733 - RNA, 36 nt, Homo sapiens
agaaaaauggaaauaaucaaggaaaauuacugcuga

SEQ ID NO: 154734 - RNA, 52 nt, Homo sapiens
gcagacuuaaguaccuggguuuuuuuuuuuuuaacagaauaguugaaguggg

SEQ ID NO: 154735 - RNA, 38 nt, Homo sapiens
uguuucuuuguuuugguuuuaaagcaagcuuagguuua

SEQ ID NO: 154736 - RNA, 54 nt, Homo sapiens
uaacagaaucaauuuaucuucucuccaccacucuguauucccacgcaccaccaa

SEQ ID NO: 154737 - RNA, 39 nt, Homo sapiens
gcagggagaaaaaaauaacaaugacaaaggccaguguuc

SEQ ID NO: 154738 - RNA, 36 nt, Homo sapiens
aauauugccugcucuguaggacagugguucucaguu

SEQ ID NO: 154739 - RNA, 74 nt, Homo sapiens
ggauggugaacagcaucccuggacugcgcacuggaugcuguuagcaccccucucccaugacacccacaauuaua

SEQ ID NO: 154740 - RNA, 32 nt, Homo sapiens
auaaugcacaggacggacccccaccacaaaga

SEQ ID NO: 154741 - RNA, 23 nt, Homo sapiens
ucauauuaacagauuaaacuagc

SEQ ID NO: 154742 - RNA, 48 nt, Homo sapiens
agcaaauaaaaauuuaaccugugcagacacacaugcuuauggcaaauu

SEQ ID NO: 154743 - RNA, 90 nt, Homo sapiens
guaacuuugaauccagaucccagugagauuaaaagcuauuguuaugugucaaaagaagaacuaaaagaacuuggggaaaaaagcagccaa

SEQ ID NO: 154744 - RNA, 46 nt, Homo sapiens
gucuucuuauucaacacugaaaauaagcuucugcuacagcaaagau

SEQ ID NO: 154745 - RNA, 46 nt, Homo sapiens
aauaaacacugaccaccucaacgagcaacagguucaacuccuggca

SEQ ID NO: 154746 - RNA, 45 nt, Homo sapiens
acuuugccuuccuuagguccccuugggcuugucuagcccuaggag

SEQ ID NO: 154747 - RNA, 42 nt, Homo sapiens
ggucccuuucugacccgggcgaguguucugggacuccagucu

SEQ ID NO: 154748 - RNA, 43 nt, Homo sapiens
cuaguucaagccacccagugaucuugacuuuuauaguuaaaag

SEQ ID NO: 154749 - RNA, 46 nt, Homo sapiens
ggacuugcugucaagcuauccaugauuacagacccguuugcuagga

SEQ ID NO: 154750 - RNA, 53 nt, Homo sapiens
aaguuaggguuuuuacuaucccagcaaccuaggauauaagguuuugccuaggg

SEQ ID NO: 154751 - RNA, 47 nt, Homo sapiens
aaugucuggauaccuucuauguuccugccaaaaguuugucuuauuag

SEQ ID NO: 154752 - RNA, 49 nt, Homo sapiens
ccaggcuggugggagaauggaguagaugaagagggaaauuuaaauuagg

SEQ ID NO: 154753 - RNA, 42 nt, Homo sapiens
uugaugaagggaaaacucagucaagauuaauguucacaguua

SEQ ID NO: 154754 - RNA, 60 nt, Homo sapiens
ggggaaagccuuugggcuuuauugaauagaucacuuggagauacugccuuagguuuggug

SEQ ID NO: 154755 - RNA, 39 nt, Homo sapiens
cuuguuucucagggauagaaacaaaggguaaauucuaag

SEQ ID NO: 154756 - RNA, 95 nt, Homo sapiens
agggguuucuuugcuguuagaaaauuuuaauuuauuauccacaugagacauuuauguguguauauauguguguguuuguguguccaguauuacug

SEQ ID NO: 154757 - RNA, 43 nt, Homo sapiens
ucuuaaacugauccaggacacauagcuguguucucagaggcau

SEQ ID NO: 154758 - RNA, 43 nt, Homo sapiens
uuacuggagacugucuaaguagucugucuaccauagccuguag

SEQ ID NO: 154759 - RNA, 58 nt, Homo sapiens
auaucauuugaaagucaacucccucgucugaucuucagcugaagaaaaaauggucuau

SEQ ID NO: 154760 - RNA, 71 nt, Homo sapiens
uuuagugcuagaagaagaacucuguguuggacuuacuaagaaaaggugauauagcucacugagauagugca

SEQ ID NO: 154761 - RNA, 35 nt, Homo sapiens
uuucuuaaauuacucucuacuggccuaucucuaga

SEQ ID NO: 154762 - RNA, 33 nt, Homo sapiens
cuuuuggaauagucaguuuaauuuuuuuggggg

SEQ ID NO: 154763 - RNA, 25 nt, Homo sapiens
uguaacaguuucccuuugauguaaa

SEQ ID NO: 154764 - RNA, 51 nt, Homo sapiens
gccauaaaaguuuuucuaauuuauauugugaaagagcuguagugcugcauc

SEQ ID NO: 154765 - RNA, 31 nt, Homo sapiens
guacgugggaucugagcacaggucuaagcag

SEQ ID NO: 154766 - RNA, 42 nt, Homo sapiens
ggagucaaaugcaugacaguaucuucaggauucugugggaag

SEQ ID NO: 154767 - RNA, 87 nt, Homo sapiens
uauuggggcaggaacucuucuguuugacgucuacagugggagagacugcacaccugugagcacagggauuccuuuguguagggguuc

SEQ ID NO: 154768 - RNA, 54 nt, Homo sapiens
uauuuugaaacucucacauauuuauugaguacagauuagaaucaaacuguuuag

SEQ ID NO: 154769 - RNA, 66 nt, Homo sapiens
auuucuguuccccacaguaguacuuagcuuagugccuggugcauaguggguguucaauaaauauuu

SEQ ID NO: 154770 - RNA, 50 nt, Homo sapiens
gggcacugugaggacucaaggcaaagggcauggcuacagggaggggugaa

SEQ ID NO: 154771 - RNA, 40 nt, Homo sapiens
uuuacugaugcccagucucuuuuugauaggcugggggaaa

SEQ ID NO: 154772 - RNA, 45 nt, Homo sapiens
uuguuucucuaaacaagagaaaacaguuauaguuccaccucuugu

SEQ ID NO: 154773 - RNA, 45 nt, Homo sapiens
ucagcguuaacuccacuggcaauaauaaauagaaaaagucucuag

SEQ ID NO: 154774 - RNA, 34 nt, Homo sapiens
uguggaauuaucuuacaccaugauagcagcuuuu

SEQ ID NO: 154775 - RNA, 31 nt, Homo sapiens
cauuauuuuuuacacaguuguuacccucuca

SEQ ID NO: 154776 - RNA, 45 nt, Homo sapiens
auaaaaaucugacugugugucuuuuuaaauuuuuguguaagagga

SEQ ID NO: 154777 - RNA, 43 nt, Homo sapiens
aagauuuucauugcuaaaguguuccucuccuguuugaccuuau

SEQ ID NO: 154778 - RNA, 45 nt, Homo sapiens
ccaaauaacuuugccucuuugcgucacaagucccaguuugcucac

SEQ ID NO: 154779 - RNA, 48 nt, Homo sapiens
ggcugccgugcccauauuguggguggggaucucuacccgugaagugag

SEQ ID NO: 154780 - RNA, 43 nt, Homo sapiens
cagugaaaggaugcuccguuggagauguaggcaagguggccag

SEQ ID NO: 154781 - RNA, 47 nt, Homo sapiens
aggcagcagaggaagcccuacccaggauuguugaacugaugggcagg

SEQ ID NO: 154782 - RNA, 39 nt, Homo sapiens
uauuggagacagacccaauucucacuuuuugggagaacu

SEQ ID NO: 154783 - RNA, 34 nt, Homo sapiens
gcguguguguguguguagcauaauauauauauga

SEQ ID NO: 154784 - RNA, 28 nt, Homo sapiens
caaagaaacaaaauauugaaacaugcag

SEQ ID NO: 154785 - RNA, 46 nt, Homo sapiens
aauguccaaauggaugaaaauacacuccaugaaauucuaaaugaag

SEQ ID NO: 154786 - RNA, 42 nt, Homo sapiens
caaagcaaaagucaguguguauugaauuuaacaaguaaugca

SEQ ID NO: 154787 - RNA, 46 nt, Homo sapiens
agguucacucaccuacgcacucacccaccaccucugaaagaaacag

SEQ ID NO: 154788 - RNA, 47 nt, Homo sapiens
uuuauacugaguguaacuuuaggauuucugcuauuaaaugcaugcuc

SEQ ID NO: 154789 - RNA, 31 nt, Homo sapiens
aacuggaagcaugaaucaauaaaacugauua

SEQ ID NO: 154790 - RNA, 616 nt, Homo sapiens
cagccuggaggccaugguaggcggccgggugcuucgcccuggagugcaggugcagcuggaggcagcuccgcccggcugcguggacaucagaaauuucucccgagagcugaaagcuccucucagaugccucgggcugaagcugaccugaagaggggcgggccuggaaucccggggagucugccaggaagcuaauggucuuaagaggcuggggggcagguuggcucucgcaggacugagguggggaagguugggccaccccugggugguguggguaggucaggggucugcauggggacugagugucccugguguuagggacccgagcggcgugguucugcucuuugguaaccagagcuacuaacaagcaaccagcgguccccugagugugucccuggcaccugcucaguccugcgcauccccaccuggcagugggagaggacagggaggagcaggugucaggagucacccucacgcccagcagcacccgcccagcaagggugucauccugaacccugccccagggccgggaggagggcaccccggauccucagcaccugcgucugcucugguuuccuuuucagguucagaguauugaguucacccagaucgaaaugaa

SEQ ID NO: 154791 - RNA, 46 nt, Homo sapiens
agaguggcccccgcaccugagucaaugcccaagaugcuucccacaa

SEQ ID NO: 154792 - RNA, 40 nt, Homo sapiens
auuaaguaggcuucaggguguaaugugauuuauaauccgg

SEQ ID NO: 154793 - RNA, 47 nt, Homo sapiens
agcacuuuccaugcuaaauacauccuucccuuaugcuguuggguuga

SEQ ID NO: 154794 - RNA, 52 nt, Homo sapiens
cacuggccauguacuuaaggguaagguggaugcguccccugccccagggagu

SEQ ID NO: 154795 - RNA, 49 nt, Homo sapiens
caaguagcaccgagugcagacuaaagguggccuaagaccacaauuacuu

SEQ ID NO: 154796 - RNA, 48 nt, Homo sapiens
uauuuaauguaugaguugacacugguugguauaucugguagucuuuua

SEQ ID NO: 154797 - RNA, 54 nt, Homo sapiens
uuaagggcauuuccaaugaguuuuuaaguguaaugaguuuuuaaguguuggggu

SEQ ID NO: 154798 - RNA, 46 nt, Homo sapiens
acccucggggugauaauuuucuauguacauugucuuagaaacccag

SEQ ID NO: 154799 - RNA, 63 nt, Homo sapiens
ugacaguggcuggggaaagcuucagggaggagggggaggaggugaaggugacuuugccaggug

SEQ ID NO: 154800 - RNA, 44 nt, Homo sapiens
agaucuguguguuggagaaaagcuuuggcagcggugguguggag

SEQ ID NO: 154801 - RNA, 48 nt, Homo sapiens
gagcucucuguuaggaggcuuuugaaguaggucaggugagagaugaug

SEQ ID NO: 154802 - RNA, 362 nt, Homo sapiens
ugugguugaugguuaucaagaaaaaguggccgggcgugguggcucacaaguguaaucccagcacuuugggaggcuguggugggcagaucaccugaggucaggaguucaagaccagccuggccaacauggugaaacccccgucucuauuaaaaaguacaaaaauuagccggucgugguggugggcgccuguaaucccagcuacucaggaggcugaggccgagagacuugcuugaaccccgggagguggagguugcagugagcugagaucgggccacuguacuccagccugggugacaggcaagacccugucccaaaaaaaaaaaaaaaaaagaaaaaguguuuucguuuuguuuucagcuugu

SEQ ID NO: 154803 - RNA, 41 nt, Homo sapiens
ccagguguugugugguucuccuccuuggcuuuuuaaauagc

SEQ ID NO: 154804 - RNA, 46 nt, Homo sapiens
agaagagacaucuuccuuauagaagaauuucgaguaauguuugcag

SEQ ID NO: 154805 - RNA, 28 nt, Homo sapiens
uuggaauggugguaauacgaggaaauag

SEQ ID NO: 154806 - RNA, 46 nt, Homo sapiens
uuuugugaaauaaacuuuuguaauagucagaaaaaaaaaaacuuaa

SEQ ID NO: 154807 - RNA, 38 nt, Homo sapiens
cacaguugacgcuaugugauugugcccuguugagccuc

SEQ ID NO: 154808 - RNA, 71 nt, Homo sapiens
ccagugucagcuggauauuuuucauaaacugccuugcuauuuugggcguucuguuuuuguugaggaggaag

SEQ ID NO: 154809 - RNA, 39 nt, Homo sapiens
aaaggugaaccgggugguguguguggguaaguggaugga

SEQ ID NO: 154810 - RNA, 47 nt, Homo sapiens
aaugccaagggugaggguaaaucaugaccaauuaccuggcuuuguag

SEQ ID NO: 154811 - RNA, 55 nt, Homo sapiens
ccuauuucaaggauguggacggacaggagacuacauucagaacuaugugcuuaua

SEQ ID NO: 154812 - RNA, 44 nt, Homo sapiens
ccucgucaguguugugcagcaucccgcaguucaaaggcagccag

SEQ ID NO: 154813 - RNA, 40 nt, Homo sapiens
uuucuggauuguuaacaagaucaaaaagcaaagauauaaa

SEQ ID NO: 154814 - RNA, 44 nt, Homo sapiens
cagcagauuauccagagagggucucaggcuccuuaucagaacug

SEQ ID NO: 154815 - RNA, 117 nt, Homo sapiens
acauugguaaaggauggguaaggcaaagcagaugaauuuccuucccaugagagacagaaauuggggaagccauccagacucaacagccuggugguugucccucuauuacagaagagc

SEQ ID NO: 154816 - RNA, 26 nt, Homo sapiens
ggagucagugggaaauuagaucugaa

SEQ ID NO: 154817 - RNA, 55 nt, Homo sapiens
gaagaccagcccuggagagacugguaggaggggagcucaggcagaacgaagccag

SEQ ID NO: 154818 - RNA, 35 nt, Homo sapiens
uguuguuguuguuuuaaaguuccacaagaggugau

SEQ ID NO: 154819 - RNA, 45 nt, Homo sapiens
cauacaaagagugaguaguauuuuuggaggaauauauuucagaag

SEQ ID NO: 154820 - RNA, 46 nt, Homo sapiens
gguuacauugguuuauguuaggauucaagaagaauuuauguaagug

SEQ ID NO: 154821 - RNA, 42 nt, Homo sapiens
uguauuuuggacucugaauuauauuuaucuuccuaugggcau

SEQ ID NO: 154822 - RNA, 39 nt, Homo sapiens
ugcgauugcacaucaggaaggugggcaguguaaguuggg

SEQ ID NO: 154823 - RNA, 40 nt, Homo sapiens
uuugaggcguguauucugugcuguccugaucaccucccua

SEQ ID NO: 154824 - RNA, 44 nt, Homo sapiens
auuguuccacauccaaauuuuaaaaauucuuuaaaaagaaccag

SEQ ID NO: 154825 - RNA, 47 nt, Homo sapiens
caugguaugugccuuuuugcucuuaacuauaaccugguuguauuagg

SEQ ID NO: 154826 - RNA, 35 nt, Homo sapiens
auugggaguuagagcuucaacauaggaauuuuggg

SEQ ID NO: 154827 - RNA, 33 nt, Homo sapiens
auugacauuuucuuccauuaugaauugaaaucc

SEQ ID NO: 154828 - RNA, 38 nt, Homo sapiens
aaguuuguuugugaaaacucagacuuguaaaggggggu

SEQ ID NO: 154829 - RNA, 50 nt, Homo sapiens
auuuccugguaauauuuguauuacuugagaucaccuaugcugacucauuu

SEQ ID NO: 154830 - RNA, 43 nt, Homo sapiens
uuagcaagaacgccuccccacccccacccaaaucugauuagau

SEQ ID NO: 154831 - RNA, 59 nt, Homo sapiens
uuggacuuggguuagcaaauauuguugaaaccaugaaaaccaaauuauucaucauuggg

SEQ ID NO: 154832 - RNA, 45 nt, Homo sapiens
acuguuuuccaaagugguucuaccauuuugcauuuucaccaacag

SEQ ID NO: 154833 - RNA, 55 nt, Homo sapiens
uaucacauaguggagauugugaggggaggggcaguggccuggggaaauuggaaug

SEQ ID NO: 154834 - RNA, 79 nt, Homo sapiens
ucuuggggugggggguccccaacuaugauuaucuuuaggccuucuucucuugaugagcuuccccagagaggaauccucc

SEQ ID NO: 154835 - RNA, 50 nt, Homo sapiens
cugcccaacucaugagucccugcguugaguauccuggcuccucaggguug

SEQ ID NO: 154836 - RNA, 44 nt, Homo sapiens
aauauucuacugcuugagaaaauucaacaacaggcuuuggcuga

SEQ ID NO: 154837 - RNA, 43 nt, Homo sapiens
aaggcugcuuuuuuuaacaucugaaguuuuucuuuaggggaug

SEQ ID NO: 154838 - RNA, 201 nt, Homo sapiens
guuucuuaaagcuugcaagcuggggacuguagcucacaccuguaauuccagugauucagggggccgaggugggaggauugcuugagacugggaguuugagaacagccugagcagcauagugagaccuugucucuuuaaaaaagaaaggaaggaaaggaaggaguuugcacucaccuggaaacaucuuuaggaaaaaacauu

SEQ ID NO: 154839 - RNA, 31 nt, Homo sapiens
uaaaaucaucaaacaaaauacaaagcccauu

SEQ ID NO: 154840 - RNA, 50 nt, Homo sapiens
uaaaaaauuguuuuaguaauuaagugagaggauaaagucucaaauuaguu

SEQ ID NO: 154841 - RNA, 23 nt, Homo sapiens
cuggcuuuaaacaagagagaaug

SEQ ID NO: 154842 - RNA, 45 nt, Homo sapiens
agguucaguacccaaaaggaucuggauggugguuagcacugagaa

SEQ ID NO: 154843 - RNA, 52 nt, Homo sapiens
gauuuaauauuaacuacaugaaugaaaauagacuugcuauuuagaguggucu

SEQ ID NO: 154844 - RNA, 37 nt, Homo sapiens
gcucagugacacuucucccaggcgguccuucugccag

SEQ ID NO: 154845 - RNA, 42 nt, Homo sapiens
uccccagaggggcaucuucauuguuuucuuucuuuguuccag

SEQ ID NO: 154846 - RNA, 46 nt, Homo sapiens
cagaacguaagaaaauguccacauuaaccuucuagucaccacccag

SEQ ID NO: 154847 - RNA, 40 nt, Homo sapiens
aauguaacagccacaaaaauaaaaccaaacaaauccccua

SEQ ID NO: 154848 - RNA, 46 nt, Homo sapiens
agggcuccagcucacuaauaaugccacggcccaacucaguugcagg

SEQ ID NO: 154849 - RNA, 44 nt, Homo sapiens
gcugagucuuucuaaugggaaagauuugugugguagcuggcaaa

SEQ ID NO: 154850 - RNA, 41 nt, Homo sapiens
aacaccucuugggucuaucagugcugaaaaccagagaccaa

SEQ ID NO: 154851 - RNA, 42 nt, Homo sapiens
agcuuucaagaggggagugcuggagccacucacaaaccugag

SEQ ID NO: 154852 - RNA, 63 nt, Homo sapiens
ggagcucucacgcuguguugguuguauggcuuggccagggcaguuugcccugggcugggggca

SEQ ID NO: 154853 - RNA, 46 nt, Homo sapiens
auagauggcuuaaaugaagcugaguuucauaaaccugauuauggag

SEQ ID NO: 154854 - RNA, 60 nt, Homo sapiens
uuaucuuuugaaccugguuuggggcaauaaacuaacauccagguuauuuagccagaccau

SEQ ID NO: 154855 - RNA, 35 nt, Homo sapiens
aauagguauuaguagguagaacaaggcuguugcag

SEQ ID NO: 154856 - RNA, 71 nt, Homo sapiens
agcaguugagauugcaagauagccgucugucccaggcagacagguuccagcgccagggcgggucggcaggu

SEQ ID NO: 154857 - RNA, 51 nt, Homo sapiens
acugggcuuccagggcguggaggaggguuucagggagggaccuuacggaug

SEQ ID NO: 154858 - RNA, 56 nt, Homo sapiens
uucaugcaugcauuccagaaacacauuugaguguucaccaagugcucagcacuuug

SEQ ID NO: 154859 - RNA, 41 nt, Homo sapiens
uuguaccaucucauaggacugguggccagccgcaagcugug

SEQ ID NO: 154860 - RNA, 61 nt, Homo sapiens
agaugagaaaacugagguuuagggcaguugauacuuuccaaaaucacacagcuggaagggc

SEQ ID NO: 154861 - RNA, 78 nt, Homo sapiens
cuugcacauggccuguucuuccuuaaauguagauggcagucccagcagugugaagaaacugaugugugggucaucccc

SEQ ID NO: 154862 - RNA, 45 nt, Homo sapiens
ugucuggugcaguggacuaagcaggaaaacagagcaugcugaggg

SEQ ID NO: 154863 - RNA, 57 nt, Homo sapiens
acacugggcaucuuaauagcuguuaaaggagcaucauuuguaucuaaugaucugaag

SEQ ID NO: 154864 - RNA, 44 nt, Homo sapiens
cuaaaauuugcguauguucaguaauuuuauuuuaaaaccuguag

SEQ ID NO: 154865 - RNA, 45 nt, Homo sapiens
acucugcuccuggaauuuggugccugccuggacggaacgucagag

SEQ ID NO: 154866 - RNA, 42 nt, Homo sapiens
aaguaaugcucagcuguaaccuuccccuacuccugcccccag

SEQ ID NO: 154867 - RNA, 49 nt, Homo sapiens
auugcaaucaacccacagccuuuagaaaacuugcagacugucucuacug

SEQ ID NO: 154868 - RNA, 34 nt, Homo sapiens
guucuucauuugaauuuaccuuaggcauuuugga

SEQ ID NO: 154869 - RNA, 41 nt, Homo sapiens
gaauuuguguguagaacgugaucuguuuuaagccugagcau

SEQ ID NO: 154870 - RNA, 40 nt, Homo sapiens
ucucuaauucugugacaugcagucuauuccaggacuuaag

SEQ ID NO: 154871 - RNA, 47 nt, Homo sapiens
gccacuuccaaaccugauaucuugauuauacuuuuacagaaauuaau

SEQ ID NO: 154872 - RNA, 46 nt, Homo sapiens
aggugcugaccuggccucaugcccguuguuggcuuaauaucuuucc

SEQ ID NO: 154873 - RNA, 41 nt, Homo sapiens
uuccaguccacucucaagagaacaggauaacuaagacuguu

SEQ ID NO: 154874 - RNA, 44 nt, Homo sapiens
uuauuucuguguuaugguucuuauucauauauuuuuauagcacu

SEQ ID NO: 154875 - RNA, 44 nt, Homo sapiens
ugaaaaugguguguuauuggaagauguuaaaaugcuaauuugag

SEQ ID NO: 154876 - RNA, 51 nt, Homo sapiens
aaaccugcuuuuaaacagugccaguuuucaagcauuccuaucaugugaguu

SEQ ID NO: 154877 - RNA, 63 nt, Homo sapiens
uuugauacccauggcuaauuuaaaucuucccucaucaaacuacacuaaaaauuucagagagug

SEQ ID NO: 154878 - RNA, 47 nt, Homo sapiens
cuugaaaaaaaaaaucucuagauuggguuuuuuauguuaggcauaua

SEQ ID NO: 154879 - RNA, 47 nt, Homo sapiens
gcauuuaacuuacauuuguacuuuauuuuuguauaaaauccauagau

SEQ ID NO: 154880 - RNA, 37 nt, Homo sapiens
aaguguaugaguugcauuuguaaaaaugagacuuuuu

SEQ ID NO: 154881 - RNA, 46 nt, Homo sapiens
auuuaagacugauaauuuuacaauuuauaugcuucacauagcaugu

SEQ ID NO: 154882 - RNA, 55 nt, Homo sapiens
cucuggguaaguauggaaccuguccuuaggagacuuuuugcagaacagucaggaa

SEQ ID NO: 154883 - RNA, 47 nt, Homo sapiens
uuccauaaaagaugaagaugagaauaaauuugugagcagacugauga

SEQ ID NO: 154884 - RNA, 58 nt, Homo sapiens
uuacaagucugaucaggcauugcacaguuuuucagaggccaaaaaauuguguucaaaa

SEQ ID NO: 154885 - RNA, 46 nt, Homo sapiens
agcuaaaaagcugucccgucuuacauauucaucaagauguccagca

SEQ ID NO: 154886 - RNA, 47 nt, Homo sapiens
auuucacugagauuuuaacacaaaaguuuauacaaaguaccaucuaa

SEQ ID NO: 154887 - RNA, 50 nt, Homo sapiens
auuguaaaacgugauggauuuccacuauggguugggcucucaagucauga

SEQ ID NO: 154888 - RNA, 46 nt, Homo sapiens
cuuaugugguuugauaagaccccacugucauauacacauuggagag

SEQ ID NO: 154889 - RNA, 50 nt, Homo sapiens
gagaugaguugacaauuucuaaauuucacuuuguaaaucccuagagaaca

SEQ ID NO: 154890 - RNA, 58 nt, Homo sapiens
aagcuagcuuaagacaaggggaaauuuaggauccccaaaacggggauagagcugaacc

SEQ ID NO: 154891 - RNA, 46 nt, Homo sapiens
uuagucgcugggcugaaacuaaugggcaacucgaagacuguguagu

SEQ ID NO: 154892 - RNA, 41 nt, Homo sapiens
uaucuaaauaaucuguacaaaauaaucccaaagacucugac

SEQ ID NO: 154893 - RNA, 45 nt, Homo sapiens
gcccuaauacucaaccuccaaaaaucaccguuuacugggacgugg

SEQ ID NO: 154894 - RNA, 43 nt, Homo sapiens
acuguauuauuccauuuguaugaaauguccagaauaggcacau

SEQ ID NO: 154895 - RNA, 41 nt, Homo sapiens
ugccuaugaaaagauaaacaaauggacagauaacagagagc

SEQ ID NO: 154896 - RNA, 41 nt, Homo sapiens
gaaaaauauaauguuucuucguuagagaaauacagcccaga

SEQ ID NO: 154897 - RNA, 59 nt, Homo sapiens
auugcuuauguuuuaaaauauacaagauuaauaauaaaugucacuuuauaagguaaaca

SEQ ID NO: 154898 - RNA, 51 nt, Homo sapiens
aagaaguggauuuggaggaacugccaauauauagagugaaaaaagaugaag

SEQ ID NO: 154899 - RNA, 59 nt, Homo sapiens
caaugacaagguacaaagcauagccauugucuucacaaaacuaaagucuaguaggaaau

SEQ ID NO: 154900 - RNA, 42 nt, Homo sapiens
agaaaacgguugugaagauaauugggaaaagaacgagcaguu

SEQ ID NO: 154901 - RNA, 36 nt, Homo sapiens
uauguggaaagguaguacauuuauaugaggcaauag

SEQ ID NO: 154902 - RNA, 36 nt, Homo sapiens
aauagagguaaauguaaccucagccagggcacccuu

SEQ ID NO: 154903 - RNA, 79 nt, Homo sapiens
ggagcagacuucuuuuuucuucuguaauuuuugauacuuuggaaugcaagauuuauuuuggagaggcaagagagaauac

SEQ ID NO: 154904 - RNA, 48 nt, Homo sapiens
ugcagcuaagcuaaguuaccaucugguuuagacuuccuucggagagcg

SEQ ID NO: 154905 - RNA, 75 nt, Homo sapiens
agaggagccuccacccacagcgccaaggauuccccacgauucccggauuucacugcgccuacggugcgcaucagg

SEQ ID NO: 154906 - RNA, 41 nt, Homo sapiens
cguagaguaggcgcacggaggcuuuuuuggccgggugcgcu

SEQ ID NO: 154907 - RNA, 43 nt, Homo sapiens
uuaguucucauguauugccacaaauuagccauguauuacuggu

SEQ ID NO: 154908 - RNA, 53 nt, Homo sapiens
auuuucugaauugaccaagaagguaagagcaucucugacuuuggucacuuuag

SEQ ID NO: 154909 - RNA, 41 nt, Homo sapiens
aagaggaaaauauuugauguuugauagccauuggagacuga

SEQ ID NO: 154910 - RNA, 41 nt, Homo sapiens
uuucacucucucccucuuagaaacucuccucaccuggcuuc

SEQ ID NO: 154911 - RNA, 42 nt, Homo sapiens
cuuuucugguugagcccauuuucaaaaaacugcccaccccag

SEQ ID NO: 154912 - RNA, 54 nt, Homo sapiens
aagaaguuaagaaauuccuugaauuagcgccuggugugucaggugggagugcag

SEQ ID NO: 154913 - RNA, 44 nt, Homo sapiens
ggcuccaucaccaacaaucaccaguuucuuccggauggcagcca

SEQ ID NO: 154914 - RNA, 24 nt, Homo sapiens
gcugggaaagcagggcugauaacu

SEQ ID NO: 154915 - RNA, 44 nt, Homo sapiens
aggugcgggggaagggagguuaccugccuugccaggauccgcgg

SEQ ID NO: 154916 - RNA, 44 nt, Homo sapiens
uuagacuuaguugauacaauaucugaggauuuuuucugguaaua

SEQ ID NO: 154917 - RNA, 25 nt, Homo sapiens
uuaauguaguucauauagaucaaau

SEQ ID NO: 154918 - RNA, 46 nt, Homo sapiens
cucuuauaauguaaugguuucugaguugauuucccgguccccuuuu

SEQ ID NO: 154919 - RNA, 25 nt, Homo sapiens
caaaauuagucgccuucgucgagag

SEQ ID NO: 154920 - RNA, 46 nt, Homo sapiens
uccugaucagcagagacugaucuuugcuggcaagcagcuggaagau

SEQ ID NO: 154921 - RNA, 52 nt, Homo sapiens
gacugagaaucacuugagcuaucugagucacuagaugaggaggaggaagaug

SEQ ID NO: 154922 - RNA, 86 nt, Homo sapiens
ucucucucucuguuuuuccuuuccuucucaucagcuuuaggaggacuuuuucucauuaggaaucuauuuucagguauaggagggau

SEQ ID NO: 154923 - RNA, 44 nt, Homo sapiens
ccaauguggaggagucucacuacgucugaaacgaucccuugauc

SEQ ID NO: 154924 - RNA, 85 nt, Homo sapiens
uuuagacuucucuuuacuucuacuccuuuccugaucuuuuccuuuagaaucagacugcuuuucuuuuucuuuaacauuuucauga

SEQ ID NO: 154925 - RNA, 47 nt, Homo sapiens
uucucuuguucugcuauuauaacuguguuuaccuuuaguuauaucac

SEQ ID NO: 154926 - RNA, 49 nt, Homo sapiens
cuuuacuucuugaucuuccuggugguguucuucucucucggcuucguga

SEQ ID NO: 154927 - RNA, 48 nt, Homo sapiens
uauucuuaauuuuuggagacauuuuaauuucuaguacagcacuaaaug

SEQ ID NO: 154928 - RNA, 46 nt, Homo sapiens
augggcagagucuuuaaguauuugggagauaaggguguaagagaac

SEQ ID NO: 154929 - RNA, 50 nt, Homo sapiens
uucccugccacugccgaguugcgcggaggcggaggcuuggguauguucaa

SEQ ID NO: 154930 - RNA, 41 nt, Homo sapiens
ucauaauugcuucuguaauuuccuucugaguagcagucaua

SEQ ID NO: 154931 - RNA, 46 nt, Homo sapiens
cugucauaccugccacucccauaguccugguucccaccaccucuag

SEQ ID NO: 154932 - RNA, 45 nt, Homo sapiens
uaacaacguugauggggaagugagcauacacagaccucaucuugu

SEQ ID NO: 154933 - RNA, 180 nt, Homo sapiens
ccuccagcuccagcccguccuccuacagccgcggaccccgugcccagggcgcuccgcggaggugggaugcgagcggccuccggaaccagccucgaccaaggcagcgcccgcgaccgccgcuccuucgcgggaucgggccuggcugccccgugaaggagcccaugggggccuccgccuccc

SEQ ID NO: 154934 - RNA, 43 nt, Homo sapiens
gggaacuuccguucuguuccgauugcugagggugugguuuaga

SEQ ID NO: 154935 - RNA, 77 nt, Homo sapiens
ucugaauuauagggacucaugaaaucaaaagacagcaguggauauaaauguuauuauaauugguauuucaaaaccca

SEQ ID NO: 154936 - RNA, 50 nt, Homo sapiens
caccauuuaugugugugccuauaugacuaaaauuaaugggucagaucuga

SEQ ID NO: 154937 - RNA, 50 nt, Homo sapiens
aauugcauagacucuuucagccauuuuaauuaauguguguaguaacacug

SEQ ID NO: 154938 - RNA, 95 nt, Homo sapiens
agaucuguacauuagaaaaacaacaucgaaagaaauugaaguuugcucuaaaagaagcaaaaacucugacaacuucugaacucauuuuauauucu

SEQ ID NO: 154939 - RNA, 43 nt, Homo sapiens
ugcagaaacgaaugcucacucccaauaagcccuggccgcccca

SEQ ID NO: 154940 - RNA, 46 nt, Homo sapiens
ccauugaaacuguauguguacaacacagacacugauaacugucgag

SEQ ID NO: 154941 - RNA, 39 nt, Homo sapiens
agcugaauguuucgccacaaguauucuaacuuguugcag

SEQ ID NO: 154942 - RNA, 45 nt, Homo sapiens
auugucaaguuguuugggaaauaaaagacaucaugauggaaacau

SEQ ID NO: 154943 - RNA, 46 nt, Homo sapiens
agguccagcuguccucaguuaaucccccgucuuugucaccaccagg

SEQ ID NO: 154944 - RNA, 45 nt, Homo sapiens
uacuguauguuacacauuguucaaggcacugaggcacuuuacaac

SEQ ID NO: 154945 - RNA, 45 nt, Homo sapiens
uauugccaccacaaguaaaccagucccucacuucugugccaccaa

SEQ ID NO: 154946 - RNA, 61 nt, Homo sapiens
accaccaggggacuagagauguggcugauaauaacaguauuacugauauuugcaucuuaaa

SEQ ID NO: 154947 - RNA, 54 nt, Homo sapiens
agcucuaacauuaaauuaaauuuuuguguuuuucucuucauauucccagugaag

SEQ ID NO: 154948 - RNA, 47 nt, Homo sapiens
cagcugccacacauuagguggacuucugguacugucacuuagaagug

SEQ ID NO: 154949 - RNA, 37 nt, Homo sapiens
cuuuggaauuggcgugguauauuuaaccacgggagcg

SEQ ID NO: 154950 - RNA, 46 nt, Homo sapiens
cuguaggcauccuguaaauaauuccaaggggaaaacuaaacgagga

SEQ ID NO: 154951 - RNA, 46 nt, Homo sapiens
uggcuugcugccaggcuugcacugccguuccugggggugugcaucu

SEQ ID NO: 154952 - RNA, 92 nt, Homo sapiens
ugcuccuuccguaagaaaaugaaauauucuaugccuaauacucacacgcaacauuucuuguacuuuguaagucguuugcgagaaugcagacc

SEQ ID NO: 154953 - RNA, 50 nt, Homo sapiens
ucuacagcgcgcacuguuaacugaacgucuuuuucuucagccuauacgcg

SEQ ID NO: 154954 - RNA, 71 nt, Homo sapiens
uccuuguaguauuauagcuauacugggaaagcauagauacagcaauaaaguacaguaauuuuacuuuuuuu

SEQ ID NO: 154955 - RNA, 63 nt, Homo sapiens
aaguuauuugcagagagccagagaaugggguagaagaguuacuuauaguuaggacaaaaaugc

SEQ ID NO: 154956 - RNA, 53 nt, Homo sapiens
caaaagcagggguacauuaguaaaugacagugcuuagaccuaagccucacaac

SEQ ID NO: 154957 - RNA, 41 nt, Homo sapiens
cagcccccacaaugaacccagaaaugccccuacugaggguu

SEQ ID NO: 154958 - RNA, 42 nt, Homo sapiens
gugaggagggccaguuauuucacccgcuuaaucaguagcgag

SEQ ID NO: 154959 - RNA, 64 nt, Homo sapiens
aggcccgcgcucuccucgccccugcagggcgcgagccccaccugagucugggugaggcccagag

SEQ ID NO: 154960 - RNA, 37 nt, Homo sapiens
caaucuugucugcacugauacccacgaggggccagag

SEQ ID NO: 154961 - RNA, 58 nt, Homo sapiens
ucuugaacagggucaauaagccaagccuacaacucaaauauuagaauuuaacacaaag

SEQ ID NO: 154962 - RNA, 34 nt, Homo sapiens
aaaccaguuggccaaaggagguaagucuguaugu

SEQ ID NO: 154963 - RNA, 38 nt, Homo sapiens
agaauuacuguauuaaaaaaagucuaauuaaugaccaa

SEQ ID NO: 154964 - RNA, 35 nt, Homo sapiens
cuuagguguaguguuuuuucccuauuuuaagacca

SEQ ID NO: 154965 - RNA, 46 nt, Homo sapiens
ucuuagugugacauaucagcaguuuagaugcagggcucucccgcug

SEQ ID NO: 154966 - RNA, 46 nt, Homo sapiens
gcuccccugguacuccgcgcuggaaacuucaucgccacccugagag

SEQ ID NO: 154967 - RNA, 21 nt, Homo sapiens
cuuucaucuucugaaucggag

SEQ ID NO: 154968 - RNA, 63 nt, Homo sapiens
ccuccauggguagagcgucaagggacccgaggauccgggaccuugaccugguaagaggacgag

SEQ ID NO: 154969 - RNA, 47 nt, Homo sapiens
gggggaauacugacacaggaaaccugcccagaaacuagacuggcaga

SEQ ID NO: 154970 - RNA, 46 nt, Homo sapiens
aguaaaguguaacauaugcaaacauaacaaaaucacuuccauagug

SEQ ID NO: 154971 - RNA, 45 nt, Homo sapiens; identical to SEQ ID NO: 68322

SEQ ID NO: 154972 - RNA, 47 nt, Homo sapiens
ucuaugggaagaccucacaucugagagcucaucugcguuggcauucu

SEQ ID NO: 154973 - RNA, 87 nt, Homo sapiens
aaauguaaagauaauuuugauuuguauuuaucucaucuaaugcuaagggaguucagaccauugcuuuaacuagauuuaaaaaaaagc

SEQ ID NO: 154974 - RNA, 46 nt, Homo sapiens
gcaugacuccuccuugucuuuacuuaugcuauuccucugccuggaa

SEQ ID NO: 154975 - RNA, 37 nt, Homo sapiens
aguaacuuuucugaaacucauuuuagaggggcuuuua

SEQ ID NO: 154976 - RNA, 49 nt, Homo sapiens
gcaaguauuaacaaaaagaaaacuuggauagcaguguuaauauaucaca

SEQ ID NO: 154977 - RNA, 53 nt, Homo sapiens
augaccuaacacacuuaagaguacaggugguagaugaagaaggggaccaacaa

SEQ ID NO: 154978 - RNA, 32 nt, Homo sapiens
agcgcuccuuccaaccaauacucagucagaga

SEQ ID NO: 154979 - RNA, 28 nt, Homo sapiens
ucacgcuaacugguugaaucucuccagc

SEQ ID NO: 154980 - RNA, 39 nt, Homo sapiens
acagcuacauccaggagagaaugcugacaguccugcagg

SEQ ID NO: 154981 - RNA, 45 nt, Homo sapiens
ccuguuguacagcaucuacaacuucaagagucucagcagccaacc

SEQ ID NO: 154982 - RNA, 46 nt, Homo sapiens
cacaaauagcuugacuacaucuagugggcagguucauucuucagau

SEQ ID NO: 154983 - RNA, 49 nt, Homo sapiens
ggcauuaaugccgacggacauuugauaaacacaggacaagcuauggaua

SEQ ID NO: 154984 - RNA, 46 nt, Homo sapiens
cuucagaauuugcagaaucaacaaauauuuuccguugcaccaggau

SEQ ID NO: 154985 - RNA, 41 nt, Homo sapiens
augggcuuagauaaucuuuuauuacucaaaugacugggaau

SEQ ID NO: 154986 - RNA, 43 nt, Homo sapiens
cugguaaauaauuuguaauuuuagugcuucguuauaggggaug

SEQ ID NO: 154987 - RNA, 66 nt, Homo sapiens
ggagccggggugcuuggagcgggggacgccaggcgugggcuggcggcgggaccaggaggaggagga

SEQ ID NO: 154988 - RNA, 51 nt, Homo sapiens
gagggaaagaggaggaggaggaggguuacaggcagcggcgggcgggggcag

SEQ ID NO: 154989 - RNA, 24 nt, Homo sapiens
gcugccacggccgcucauugucuc

SEQ ID NO: 154990 - RNA, 46 nt, Homo sapiens
uggauucggaugaaaccggugauaaaaucagguacaacuccaagag

SEQ ID NO: 154991 - RNA, 38 nt, Homo sapiens
ucuacagaauuuaauacuucugaaucucaugcucaaga

SEQ ID NO: 154992 - RNA, 57 nt, Homo sapiens
uauaugaaaaaaggcuuagaaaugaauauuuugaaagaaagaaauccauggauaaac

SEQ ID NO: 154993 - RNA, 40 nt, Homo sapiens
cacuucccagcacuagguagggagguggguaaaaguaggc

SEQ ID NO: 154994 - RNA, 64 nt, Homo sapiens
uugucugaagcuaugggucucuuuuguuugaugguugcuuucuugauuuuguuugccauguaac

SEQ ID NO: 154995 - RNA, 63 nt, Homo sapiens
ccuaaauaaguuaagagcaugcuugcaguaguuggaaacuuagcuacugaaauaauagcuacu

SEQ ID NO: 154996 - RNA, 133 nt, Homo sapiens
gcagagacauugauacugcugccaaauuuauuggugcaggugcugcaacaguaggaguggcugguucuggugcugguauuggaacagucuuuggcagccuuaucauugguuaugccagguaaucauuucuauc

SEQ ID NO: 154997 - RNA, 41 nt, Homo sapiens
acgguauuuaauggggcccagaauggugugucucagcuaau

SEQ ID NO: 154998 - RNA, 47 nt, Homo sapiens
uuauauauguuguuucuuaauuuucaacacccuuuuaagauguagau

SEQ ID NO: 154999 - RNA, 52 nt, Homo sapiens
acagaccaauuucugcaucaguguuaucucgaccagaggcuaguaggacugg

SEQ ID NO: 155000 - RNA, 49 nt, Homo sapiens
uacggcacuacaauaauggaaaugucaaaagcaguucuuacucucuuug

SEQ ID NO: 155001 - RNA, 43 nt, Homo sapiens
ucucuguuggauuggggucgacgcgaagguuggaguacugcag

SEQ ID NO: 155002 - RNA, 48 nt, Homo sapiens
agagcguccacguuguugaauggggcaaccuucgggcggggcacaccg

SEQ ID NO: 155003 - RNA, 84 nt, Homo sapiens
auccaggaauuggagcuagaaagugagaaggacuagcucaagacauaagaauagggaaacugagcacauugaggguggggggga

SEQ ID NO: 155004 - RNA, 46 nt, Homo sapiens
uucaaaauuauuaaaguuuuaaguguaugcauucuacuggucaaua

SEQ ID NO: 155005 - RNA, 44 nt, Homo sapiens
uucugauuauaugaugauuuucauaaaauauaguaugcugaguu

SEQ ID NO: 155006 - RNA, 48 nt, Homo sapiens
cacuaaauaaaaauagcuguuuaauugaauuggaaucguuccacuugg

SEQ ID NO: 155007 - RNA, 37 nt, Homo sapiens
uuauuauauuuguacuuuggcaagaauccugugaaga

SEQ ID NO: 155008 - RNA, 43 nt, Homo sapiens
acuccuuucaguucucugaccaugcccuuuccugccucagauu

SEQ ID NO: 155009 - RNA, 45 nt, Homo sapiens
uugcugguaguuaauuggauuuaauauuuguauuaaggauuaacu

SEQ ID NO: 155010 - RNA, 56 nt, Homo sapiens
ugacuacuucauuauuaaaaauugauagaauuuuagcuccugagauauuuacaacu

SEQ ID NO: 155011 - RNA, 40 nt, Homo sapiens
uguaguguuacugccauuaaaaaauugcuuuucugcaaau

SEQ ID NO: 155012 - RNA, 98 nt, Homo sapiens
auuccaccaagcuguuuuaaacuacaacuucauggaagaaauuugcuguuuuuguuagaaugggcaaaugaugugcuuccauaaaaaugaaaaaagua

SEQ ID NO: 155013 - RNA, 35 nt, Homo sapiens
ucaagaacuagaguaaaaaccuaaacaugauauuc

SEQ ID NO: 155014 - RNA, 49 nt, Homo sapiens
auuuuacauccagaugcuuugguaauagauuauuagagaaauacaagaa

SEQ ID NO: 155015 - RNA, 46 nt, Homo sapiens
gaaauuccuggaaagaagucuuacuggcucaaacccaaccccaaua

SEQ ID NO: 155016 - RNA, 54 nt, Homo sapiens
cacuuaguacaguagauguuuuuccuguuuuccuucaaaaaugcagcauaagau

SEQ ID NO: 155017 - RNA, 57 nt, Homo sapiens
uggacccccagaaaggacuguuacuccagcccuaucaucaaauguguuaccaagaca

SEQ ID NO: 155018 - RNA, 46 nt, Homo sapiens
ucgucagcgaacugcagcucaaagaaaccuuucuccaacaccagca

SEQ ID NO: 155019 - RNA, 43 nt, Homo sapiens
aucccaauauuauuuaauggcaagcuagaauuauacauuuaag

SEQ ID NO: 155020 - RNA, 45 nt, Homo sapiens
gaaaauauuuuguuagaaguaaaugcaaaaaaugggaaauagauu

SEQ ID NO: 155021 - RNA, 43 nt, Homo sapiens
aaaaaguguauuaucuauuccuguguaacagauugccccaaaa

SEQ ID NO: 155022 - RNA, 188 nt, Homo sapiens
uuuuauuuaaaaauauaaaagggcuaggcaugaugguuuaugccuguaaucccagugcuuugggaggcagaggcaggagaaucacuugaggccaggaguucaagaccagucugggcaacauggugagauccugucucuacaaaaauaacaaaaaauaccaaagaauuucauuuaauuuagcccuaaag

SEQ ID NO: 155023 - RNA, 45 nt, Homo sapiens
ucaugucaauucugagaccacuuuaccuugcuacagguugugaag

SEQ ID NO: 155024 - RNA, 44 nt, Homo sapiens
caugcuccccgaagggcacugggcauggaguaguggguaauggc

SEQ ID NO: 155025 - RNA, 25 nt, Homo sapiens
uuugauaguuuaaaaauaguaacua

SEQ ID NO: 155026 - RNA, 57 nt, Homo sapiens
gauugagaaagaguugaaauuggucaacucagcuuugcugauggugcuuucacagua

SEQ ID NO: 155027 - RNA, 617 nt, Homo sapiens
uggugagugcccaugggagguucuccuguuggugucgugcccaucugugccacaugcccaccucgccgagccacagccucagcuacugcaugggggucuuggucugacguggcucaugggaaacugaggcacagggugacuugucagggucacacggugcuuacgugccagagcagggauuggaauucaacugggcuggcccgggguccauucugagcccugacuccugccgucagcccccgaggugggacugcaguggcugaggcuggggagcaaagcgcugucuguuccauaagccccugucgugugcccuggcuggugccacguccgcuccuuuguugagaaccugcuggccucuguugggagaagggaggagccugggagccugcugugcuggcucguuugauuacagugcccauuucccugagaaaucgccuuuuugaguuuuuaaaaacauauuuacauuuuuaagagagcagagguucguuuuaguggcauugaccucugaggauguaauuuuuuaaaguucugauuuuuuuaaaguucugauuuuuuuuucacucccuuccggcaggcucuaacaagagaagagaucacagaaacgugaggaucaagaa

SEQ ID NO: 155028 - RNA, 613 nt, Homo sapiens
gagccugccggaagggagugaaaaaaaaaucagaacuuuaaaaaaaucagaacuuuaaaaaauuacauccucagaggucaaugccacuaaaacgaaccucugcucucuuaaaaauguaaauauguuuuuaaaaacucaaaaaggcgauuucucagggaaaugggcacuguaaucaaacgagccagcacagcaggcucccaggcuccucccuucucccaacagaggccagcagguucucaacaaaggagcggacguggcaccagccagggcacacgacaggggcuuauggaacagacagcgcuuugcuccccagccucagccacugcagucccaccucgggggcugacggcaggagucagggcucagaauggaccccgggccagcccaguugaauuccaaucccugcucuggcacguaagcaccgugugacccugacaagucacccugugccucaguuucccaugagccacgucagaccaagacccccaugcaguagcugaggcuguggcucggcgaggugggcauguggcacagaugggcacgacaccaacaggagaaccucccaugggcacucaccaugcugcacccguguccgcacagcagccacgggcac

SEQ ID NO: 155029 - RNA, 1146 nt, Homo sapiens
gagugaguccgggaggauuccggcugggguuggggagcacccucggggggauccccguggagugagcccggaaguuuucccgcuggguugggagagugcccucaggggggccuggguccugaguuaaaacaacucugcucacgugcuagccucuuccugcugggaaggcaccucaggcggcccugcccggcaaguauugauggagugccuguagguguggagcccggcaggcaggcugcacgccgcccuccacccggggacggcuucacuggaagccuuaaaauuuggaccucugugcucgcgucuucuguugaguucuugcagcuucuuuuuaggagaggcgcccugagaggcuggguugggagcaggccgugauguacagaaccgcucagaagagccugcuugaccuucagagaaaugcacagucccuacgagcaaaacuggggugcugcucugcaguguuuaaguucacagguccccagcucaggguugaugcgagccaggcggggcagcagcgugagcuccccugggggcgaaggucaggccugugcagccugcaggggcccagaagcugaguugacagugaccgugagguucugcaguagagggaacuugcaguuaacgcaccgaaugccaggcaggccuuuccagaagguacuuccuagaaccgcaucagucccaucagccgcagagcaggccuaacccugaugcggccacugggccccggggcagacgagguggggcaccugccagccaggagcgugcagagacugucaccuccucucacaggcacuugcccggagcagggagccauguggggcuguggagcaggccagggguugguugggcagugcucccacucuguggggucugugccacugccaccccaugcuggugugcccagaguagggagucuugcagccagcagcacugguguugcuggggcugccuggccucacuagugccgcugauguacccagcccuccucccugcccccugugggucuuggucugucggccucucagccucgggugcuugugcaucugggacaguauuuuuggcuuuuagccugguuaagaugccguuuucuuucuccuucgccuccagaaugacaaggguggaccucaggaauuaccucgagggcau

SEQ ID NO: 155030 - RNA, 41 nt, Homo sapiens
ccugggauggagauggggaggcagauaagugugcugggggu

SEQ ID NO: 155031 - RNA, 41 nt, Homo sapiens
ccuauuugcgcaguguugggggagggaagaagacaugggaa

SEQ ID NO: 155032 - RNA, 78 nt, Homo sapiens
ggaugagaggacagagagagagaggagaagggagacaggaaagcaagaggaaggaagaaggaaagcggaaaagaagag

SEQ ID NO: 155033 - RNA, 86 nt, Homo sapiens
guuuuaaaagauaaauguaugcauuuugaaagauaccauagccacugcugguuaauuaaauuagggaaaaucaguuuucuugguuu

SEQ ID NO: 155034 - RNA, 47 nt, Homo sapiens
uccugggaugauuaaaaggcuuuuguuuauaacagaucagggagcgg

SEQ ID NO: 155035 - RNA, 38 nt, Homo sapiens
ucuggaaaguuuacuauucuacuaauguuuuguacaag

SEQ ID NO: 155036 - RNA, 39 nt, Homo sapiens
uauguugaugauuuuuuuuuuaaucacagcagcccccag

SEQ ID NO: 155037 - RNA, 44 nt, Homo sapiens
ggucucugagguauuugggggacucuguauuugcucguuuacgu

SEQ ID NO: 155038 - RNA, 41 nt, Homo sapiens
aucgcaagcggaggagacgcaguagcgcaggcugagcgcua

SEQ ID NO: 155039 - RNA, 49 nt, Homo sapiens
aauaaaacaagagguaucccaagauuaauuuugcuggauagagcaagua

SEQ ID NO: 155040 - RNA, 40 nt, Homo sapiens
auauaguagcuacuccuuggcauuguggcaggccuccauc

SEQ ID NO: 155041 - RNA, 44 nt, Homo sapiens
gguaagcccucuagacaagucccacuguguuaccgcuuggaggc

SEQ ID NO: 155042 - RNA, 20 nt, Homo sapiens
augcugugagugcugugugc

SEQ ID NO: 155043 - RNA, 51 nt, Homo sapiens
gagggcagaacgccugcucucggacagguauugggcgagguggggggagaa

SEQ ID NO: 155044 - RNA, 46 nt, Homo sapiens
uagcuguacugggccccaggugacgaggcaucauagucucagucag

SEQ ID NO: 155045 - RNA, 45 nt, Homo sapiens
cucuuucuuucuccaguucuccuuggucuguaauaggaaugcccc

SEQ ID NO: 155046 - RNA, 46 nt, Homo sapiens
gacacccuguuucaaggggaaaccuuguuuauuguucccaccacug

SEQ ID NO: 155047 - RNA, 61 nt, Homo sapiens
ucuuucaaaugaucuaaaucuugcucuaguucuacuauauuuuccaguuuucuuuuucugc

SEQ ID NO: 155048 - RNA, 45 nt, Homo sapiens
agaaguucagagagugaauggcuuaaaguagcaggugagggcaug

SEQ ID NO: 155049 - RNA, 45 nt, Homo sapiens
cuuucucuugcuccuuuuggaguuguucuugucuuuccuuuucaa

SEQ ID NO: 155050 - RNA, 30 nt, Homo sapiens
caguuuauugaugaaauuuauuuuuagaag

SEQ ID NO: 155051 - RNA, 44 nt, Homo sapiens
aacaugggagggcaggccuuaugaaauguauauacagaccccuu

SEQ ID NO: 155052 - RNA, 74 nt, Homo sapiens
caccgugcuuccacuggggcgguuguaucacccaggagcauuaggaauuguauggaggugggguggggcacuuu

SEQ ID NO: 155053 - RNA, 40 nt, Homo sapiens
acaaagguagaaaagcaguuauuuuuaucaaacguaauug

SEQ ID NO: 155054 - RNA, 46 nt, Homo sapiens
gggacgggagucccggcggcggcagcuccaaguccaucaugaugag

SEQ ID NO: 155055 - RNA, 152 nt, Homo sapiens
aaauccugugagguguagggaggagaagagggaagucagcaaccacaguuccccgacaauccuaacugcccagaccccucccuggucuugccauuguggaccccuucucacacuccagggccaguugaugaaugguaucuuggugugcaggu

SEQ ID NO: 155056 - RNA, 896 nt, Homo sapiens
ucauagccaaagaggcacguagcgauuaggcccaguaccugggggacaggauaggagugaggggguuuagauuagcuggucagguuacucagucucuuaucuucuuguauccaccaccuccagcaccugccccacgcaggaugggacucaagcaccggguugguaagccagggaaaggccaagagagugcauccuaccccacucucccuccuccuauaccucucaacacagggaggccacacuguggcccuacccguagggggcacaauucaagucauacuuuuuuuuuuuuugagacacaguaucacucugucacccaucugucacuggggcuggagugaguggcaugaucuuggcucacugcaaccuuugucuucuggguucaagugauucuccugccucagccuccugaguagcugggacuauaggcgcccaccaccaugcccggcugauuuuuguauuuuuaguggagaugggguuucgccauguuggccaggcuggucuugaacuccugaccucaagugaucugccugccucggccucagccucccaaagugcugggaauacaggcaugagccacugcgcccggccccaauuucuacuacauuugggacaaaguucuugcagaugguagucuagugcguugacaaaggggccgccuguuuguaccucucaccaagguccuugugucugacaagggacuucccuucacagcaaaugaagaccuugggaggcaaaaccaaguccugggccagacuuuccuccaugucugaggacaagugugacuugcugugggucacacgauuucugccagaagcaaaggcagaaauggucccuggcuccucaaacccuucgcucugugcuucagagcugcucccauggccuuuaccccugcg

SEQ ID NO: 155057 - RNA, 45 nt, Homo sapiens
aggagggcacaggcgaggugggaagggaagugacacgggugggcg

SEQ ID NO: 155058 - RNA, 50 nt, Homo sapiens
gauugucugaguaaauuuuggauguuugcauuacuaauaguuugccaaag

SEQ ID NO: 155059 - RNA, 46 nt, Homo sapiens
uuugccauuugacuuguggaagaagacaguguuuggaaugaaaggg

SEQ ID NO: 155060 - RNA, 49 nt, Homo sapiens
gucauuguaugcagaagaaagagccauaaauucuugaagaagauaggaa

SEQ ID NO: 155061 - RNA, 348 nt, Homo sapiens
uuccuuuuuuuuuuuuuuuuuaaaaaaaagaggugggguuuugcuuuguuacccagguuggaguguaguggugugaucauagcucacuguaaccuugaacuccugggcucaagaaccauuguccugaguagcugggauuauagguaugugccaccaugccugguuauuaaaaaauuuggagcagagucuugagguauugcucaggcuggucuugaacaccuggccucaggugguucucccaccucagucuccugagucgcugggauuauaggcacaagccacugugccuggcgagaaaacaaauuucuaguaaaugucaccuuaugcauuaggaaggaagguaagaac

SEQ ID NO: 155062 - RNA, 61 nt, Homo sapiens
augaucucuguauagcccucauuucuccuuccagauaguccuuuguaagauuuggguauag

SEQ ID NO: 155063 - RNA, 46 nt, Homo sapiens
ugaauauguacaucauguacauaucaugggagaauacugccaccuu

SEQ ID NO: 155064 - RNA, 31 nt, Homo sapiens
uuaaucauucuucauuuuagugcuugcagua

SEQ ID NO: 155065 - RNA, 28 nt, Homo sapiens
guuauucugaauggcagaauucauuaca

SEQ ID NO: 155066 - RNA, 47 nt, Homo sapiens
gcuucugacacaaacauaucccuugauuuuuaaauguuuuccuucag

SEQ ID NO: 155067 - RNA, 46 nt, Homo sapiens
gagaacaauuugacagcucauguagaggcuggcauaacaggacaag

SEQ ID NO: 155068 - RNA, 47 nt, Homo sapiens
cuauguggaugcuaaaugcaggguauuauggaucaucaaauggggcu

SEQ ID NO: 155069 - RNA, 46 nt, Homo sapiens
gaacaguugcuuaacuggaugacuaucaaaauggucaacacagauu

SEQ ID NO: 155070 - RNA, 42 nt, Homo sapiens
aguucaguacuguaggaggauggguaucuacucgcgcaucag

SEQ ID NO: 155071 - RNA, 64 nt, Homo sapiens
ucuaccgugauuuuaguccauuuacuuagaugauuucguuuuugcuacucuguuuccuuaggag

SEQ ID NO: 155072 - RNA, 33 nt, Homo sapiens
auuaagauuuuuuuuaagacaagauaaugcuaa

SEQ ID NO: 155073 - RNA, 50 nt, Homo sapiens
uuugugucaugcguuuuuuucucugaagcagagagaauaacccuagucaa

SEQ ID NO: 155074 - RNA, 50 nt, Homo sapiens
aggugccuucucaaauaugucucaucugaauugcaaguucugauuuuuuc

SEQ ID NO: 155075 - RNA, 44 nt, Homo sapiens
uucuuccuucaccaacaugcaaguucuuuccuucccugccagcc

SEQ ID NO: 155076 - RNA, 47 nt, Homo sapiens
augucagucuaaugaagauagacaauuacauaaaugagugaggguag

SEQ ID NO: 155077 - RNA, 41 nt, Homo sapiens
uaaacuuuuuucucuucuuaggucaugcucuuaaaccucag

SEQ ID NO: 155078 - RNA, 46 nt, Homo sapiens
guauuuaaauauuuacuuggauuucauaauuucuaagaagggcuug

SEQ ID NO: 155079 - RNA, 42 nt, Homo sapiens
cagagcaccuuagacuggguagcuuaaauguucuuagacaag

SEQ ID NO: 155080 - RNA, 46 nt, Homo sapiens
gaugcaaacauucaguccaaaucaccgggacaguggauuagugcaa

SEQ ID NO: 155081 - RNA, 28 nt, Homo sapiens
aaaauguuuuuuuuaaucaaggggggga

SEQ ID NO: 155082 - RNA, 63 nt, Homo sapiens
uuccuaaccuucacuuaccaccuuguuaggauugugccacuggaauuuuacaguaguccugag

SEQ ID NO: 155083 - RNA, 222 nt, Homo sapiens
uuauuuaauugcuuuuuaaacacauuugaccaaaagagaggaaaguuaggcuucuaguuuauuauuuaacccaggaaacaugugccuucuuugggaguugggucuuuuucuuucacugcaaaaugaaaucuaacuagcaacaauuuguuguguuguuuccaaauacaggcagcugcuagagaagaaauccuugcuaauggagggagccugucacaucaccau

SEQ ID NO: 155084 - RNA, 178 nt, Homo sapiens
uaaucaagacaggauaugagaaaaaucuuuuuucaagguuuuaaugcuguuuuguuauuacuuaguggucauuuugguaaguaucgaguguugucagaauuuaucacaucaccaauaaaaauuauuacaauaugucuaucuuuguuacuagcaugcuuaugaaaauaaugaggcaacc

SEQ ID NO: 155085 - RNA, 46 nt, Homo sapiens
uuguuuguugcuauaugguagcaccuagaacagugcuuagccccag

SEQ ID NO: 155086 - RNA, 101 nt, Homo sapiens
ucuuuuaaaaucaagaaaugugguuucuguguuuauaaugguaaauaugggggagaagugauucugcaagagggugagagcagcugaaucauauauauaac

SEQ ID NO: 155087 - RNA, 46 nt, Homo sapiens
ugguaaggagaaggaacuagacagcuaaaacaaauuugaaaaaaug

SEQ ID NO: 155088 - RNA, 53 nt, Homo sapiens
cauacugccugguucuauuucuauaacauuuuugaaaugacaaaaucuuaaga

SEQ ID NO: 155089 - RNA, 30 nt, Homo sapiens
aauaucuuuuaggugguagagauugcagga

SEQ ID NO: 155090 - RNA, 50 nt, Homo sapiens
caaauuuucuuauuauuugaagccuuuauguucguuaaaauauuuuaagg

SEQ ID NO: 155091 - RNA, 43 nt, Homo sapiens
gcauauauugaagcauuuuugauuuuguuuuuccagugggcaa

SEQ ID NO: 155092 - RNA, 48 nt, Homo sapiens
gagugauacacguguacauuguuuaagagcauagucuagugugaguag

SEQ ID NO: 155093 - RNA, 46 nt, Homo sapiens
gacuucaaaaugauaaauaauuuuuaacuauuaaaauuggccucaa

SEQ ID NO: 155094 - RNA, 45 nt, Homo sapiens
caacagaucuuugcuuuaagcccuugauauuugaccuaguuggac

SEQ ID NO: 155095 - RNA, 46 nt, Homo sapiens
uuauuucuauaauaucugaaaauggcuucauaaaaguuaagucagg

SEQ ID NO: 155096 - RNA, 30 nt, Homo sapiens
uguuagcacccagacuuuccuuugucauau

SEQ ID NO: 155097 - RNA, 60 nt, Homo sapiens
uuguaugugcuuuuccuuccuacauuuucauuccuacugccccaaccuaguagcccuaag

SEQ ID NO: 155098 - RNA, 47 nt, Homo sapiens
ugaaauacuuuggcucugauacaacuuaacuugaauaauaucuuauc

SEQ ID NO: 155099 - RNA, 41 nt, Homo sapiens
cuugugaucagcaaguacacaccugagucggugcugaggga

SEQ ID NO: 155100 - RNA, 46 nt, Homo sapiens
uuguuaugauaccaaaguccuacacagaagaagaucugcgggaaaa

SEQ ID NO: 155101 - RNA, 44 nt, Homo sapiens
ggaagcaaucuccaaacgcuugucaguuguaucaagaguuccuu

SEQ ID NO: 155102 - RNA, 47 nt, Homo sapiens
aaauggauugaagagggacaagcucagggguaaggaaacuagugaaa

SEQ ID NO: 155103 - RNA, 47 nt, Homo sapiens
gcauauauguauuuuuuaagaaaaccugacaauuuaccaaaaacucu

SEQ ID NO: 155104 - RNA, 47 nt, Homo sapiens
aaccuuuucuaaugauuauuuacauguuaaagagaauauugggcuua

SEQ ID NO: 155105 - RNA, 24 nt, Homo sapiens
gggacucuuagaaacugccugucu

SEQ ID NO: 155106 - RNA, 38 nt, Homo sapiens
gcuucauuucucccaaggaauacaauguauaccaacac

SEQ ID NO: 155107 - RNA, 53 nt, Homo sapiens
gcaaagggaauuugaaaaagaugagaagccacgugacaagucauaucaggaug

SEQ ID NO: 155108 - RNA, 45 nt, Homo sapiens
aaacaaauagacauggacaaugacaggcagcucucuaaagccgag

SEQ ID NO: 155109 - RNA, 47 nt, Homo sapiens
acauugauuuuugagauugaacuuuaugcugugaccaaaggaccacg

SEQ ID NO: 155110 - RNA, 182 nt, Homo sapiens
cauacauagagaaauggauaaacaaaaugaauacaugcauauauggaagccaggcacaguggcucaugccuguaaucccaacacuuugggaggccaaggugguagaaucacuugaggccaggaccagccugagcaacagcaagacccugcucuacaaaaaaaaaaaaaaaaaaaaugaaaug

SEQ ID NO: 155111 - RNA, 45 nt, Homo sapiens
ucauaaaaggccuagacauugcuaugacagauaugugcccuggag

SEQ ID NO: 155112 - RNA, 47 nt, Homo sapiens
gaaugaugguuagagaggacuccaauuuuaaaugcccagcuguauuu

SEQ ID NO: 155113 - RNA, 29 nt, Homo sapiens
aagaagggagaccuacuaaaugcccauua

SEQ ID NO: 155114 - RNA, 42 nt, Homo sapiens
gaaggacacuucccuuuggcagcgacaguugcaagcuaugag

SEQ ID NO: 155115 - RNA, 23 nt, Homo sapiens
uuggacaaaaugucgguccguga

SEQ ID NO: 155116 - RNA, 45 nt, Homo sapiens
gaaucuucgcugcuggccguggaaacagcuagagcagcucguuag

SEQ ID NO: 155117 - RNA, 44 nt, Homo sapiens
aggaaucgccaccuuaaauaagcauaugggcgauuaacagggug

SEQ ID NO: 155118 - RNA, 47 nt, Homo sapiens
guaaauauuuagacguuauuagugacuuuuaaacauuuuucagcgag

SEQ ID NO: 155119 - RNA, 42 nt, Homo sapiens
cuuuaaaaguuuuccaagagauaacuucaccaagauguccag

SEQ ID NO: 155120 - RNA, 84 nt, Homo sapiens
augaugagagccccagcaccagcaguggcaguucagaugcggaccagcgagacccagccgcuccagagccugaagaacaagagg

SEQ ID NO: 155121 - RNA, 153 nt, Homo sapiens
agcuuuacggugauuguacaguuuaaauuuauuaauuuaugcuauaauuaaaaauggaaucuauauucauaaauucuagaauaugugaauucauauugccugagaucuaugaaaccuaauacauuuggcuuucguguguaguuauuuaaucag

SEQ ID NO: 155122 - RNA, 45 nt, Homo sapiens
ggaaaaaguugaaugaaacacaagaaaacucagcaaaaccaaaau

SEQ ID NO: 155123 - RNA, 52 nt, Homo sapiens
ucuuuucccgauaguguaaaaguuugauaaugacguuauuuccagugauuug

SEQ ID NO: 155124 - RNA, 48 nt, Homo sapiens
aggguguccuuguccucuccuagucaccacuugugcaaacagcgaaag

SEQ ID NO: 155125 - RNA, 40 nt, Homo sapiens
aaauacucaguacucugugugacuggaaacauuuuccaaa

SEQ ID NO: 155126 - RNA, 49 nt, Homo sapiens
ucuuuuaaucauuccauucauucuagauacacaguauuacacagaaagg

SEQ ID NO: 155127 - RNA, 49 nt, Homo sapiens
uucaucuaugccuccguccauuucacccucccauuauuacauuaaaaaa

SEQ ID NO: 155128 - RNA, 61 nt, Homo sapiens
guguucuuaaaaggauuucuguuaccccauugccucaaacuacacuuuuuuuuuuuacccu

SEQ ID NO: 155129 - RNA, 45 nt, Homo sapiens
ugugaucauaagauaacugauaguaccucccagcuguguucuuca

SEQ ID NO: 155130 - RNA, 40 nt, Homo sapiens
uguuacgguuauauaguuauauauuuuuucuauuuaacag

SEQ ID NO: 155131 - RNA, 54 nt, Homo sapiens
uguguugguuaaagcucagcugguagucuugaacugcuucuggcaauuucuuag

SEQ ID NO: 155132 - RNA, 40 nt, Homo sapiens
aauacuucuguacauacguacaggcaggagaagaggcuca

SEQ ID NO: 155133 - RNA, 59 nt, Homo sapiens
caggauauuugccuggucuugaagugucuguccaaauauugcuuauugguugcagggaa

SEQ ID NO: 155134 - RNA, 65 nt, Homo sapiens
cuagauucugcaaaaaacguuaauguuauaaaaguuaaagaaaggcggaaaggacccauauuaaa

SEQ ID NO: 155135 - RNA, 55 nt, Homo sapiens
uugaagaagauaccacaaaauagcuuuuaauguucuuucugcuuuuccagcggau

SEQ ID NO: 155136 - RNA, 46 nt, Homo sapiens
aguagcuguagauggcuaggaauuaugucauuuguauuaaacccag

SEQ ID NO: 155137 - RNA, 55 nt, Homo sapiens
caugcuguugugaaaaauguuuuaccuuuuaccuuugucaguuuguaaugagagg

SEQ ID NO: 155138 - RNA, 42 nt, Homo sapiens
ugaugaaguaaaaauguggcuaugaagauuacuaaagacuag

SEQ ID NO: 155139 - RNA, 35 nt, Homo sapiens
uuucguuaacauuuacauuguaaauuauuuggaca

SEQ ID NO: 155140 - RNA, 43 nt, Homo sapiens
agccaacgagcaacaggacaugauuuauuagaaucugaucagu

SEQ ID NO: 155141 - RNA, 69 nt, Homo sapiens
uagggccugagcaaacuaguaggcuguaguugucauuaaccaaggugaaaaacucgagggugaagcagg

SEQ ID NO: 155142 - RNA, 88 nt, Homo sapiens
agagaagaaagaagcuuaggcacucccagcauuaggaggcugaggagagaugagucagcaaaguaauccaggaaggaacgcucaagaa

SEQ ID NO: 155143 - RNA, 42 nt, Homo sapiens
uacauaaccacaccagcuacauaaaguacaaaaagucaucaa

SEQ ID NO: 155144 - RNA, 46 nt, Homo sapiens
ucauauagggaagaguucugaucuguaccuaugguucuuauugaaa

SEQ ID NO: 155145 - RNA, 49 nt, Homo sapiens
uauaugaaauguguguaaguaagcucaugugugccugaauguguguaga

SEQ ID NO: 155146 - RNA, 30 nt, Homo sapiens
ucaugguguuuguggcaguuucuuugccaa

SEQ ID NO: 155147 - RNA, 18 nt, Homo sapiens
gaacaggaggaaaggauu

SEQ ID NO: 155148 - RNA, 59 nt, Homo sapiens
ugaagaggauccaggucugagccuugagccauucuaagauuuaagagcucagggagaaa

SEQ ID NO: 155149 - RNA, 50 nt, Homo sapiens
aaugcauuaguaaauauuuaauacucuuaguuaaaguuaccagggcagca

SEQ ID NO: 155150 - RNA, 43 nt, Homo sapiens
ucuuuuucuauuugugaguucuucauauguuuuggauacaagu

SEQ ID NO: 155151 - RNA, 61 nt, Homo sapiens
ucaucgcuuuacugacucccuaauuccagacuaaaaauauuucuaguuuuccuacagcaau

SEQ ID NO: 155152 - RNA, 67 nt, Homo sapiens
ucuucaacaaacacaacauuuagacagucauggagagccaaccauuacaagucuauacacaaauugg

SEQ ID NO: 155153 - RNA, 46 nt, Homo sapiens
gacuauguauaaucaagccacacaggaaauugcaaaaccuucagaa

SEQ ID NO: 155154 - RNA, 47 nt, Homo sapiens
auauacaaagugagaauauuggagcaaaucaauguauuucaucuugc

SEQ ID NO: 155155 - RNA, 43 nt, Homo sapiens
uuauagacaacuuuccuucucucauaacagaaaguacuucagg

SEQ ID NO: 155156 - RNA, 49 nt, Homo sapiens
uaaguacugaaggccaauuauauguuuaaaaaauuuuguguguuacauu

SEQ ID NO: 155157 - RNA, 39 nt, Homo sapiens
agcagugaauaagaaaucaaaaaagcagacugguaagaa

SEQ ID NO: 155158 - RNA, 46 nt, Homo sapiens
uugcauuuccacuacuuugcacucauuuuaugaguugcacgcauga

SEQ ID NO: 155159 - RNA, 45 nt, Homo sapiens
auaggcauauacuagugucucaaaggcuucacuuggccuugcaga

SEQ ID NO: 155160 - RNA, 50 nt, Homo sapiens
uacuuccuaagugaucucauucuguuguguauuccaucagucccuuaagc

SEQ ID NO: 155161 - RNA, 47 nt, Homo sapiens
gaauucauaucacugcauguaggaaaucauguuguuuuuauuuaaau

SEQ ID NO: 155162 - RNA, 45 nt, Homo sapiens
ccucaucagugcaccuaguacaaugcuuaauccagcacaguccga

SEQ ID NO: 155163 - RNA, 43 nt, Homo sapiens
ucaguggagcagcugcaaaaaauucgugaccugauugccauag

SEQ ID NO: 155164 - RNA, 46 nt, Homo sapiens
gccuuggccagaugauuguggauuaugaaaacccuuuaaagaagau

SEQ ID NO: 155165 - RNA, 73 nt, Homo sapiens
uuuaacaaagaacuacuuagauuuaauuauaaccuauacaacacuaaugauacugcugucucgaauugaagaa

SEQ ID NO: 155166 - RNA, 45 nt, Homo sapiens
gagauucugaaaaaucuggcauuauauuacuucacauuuguagau

SEQ ID NO: 155167 - RNA, 347 nt, Homo sapiens
uaagauggauaagaaaguagggggccugggcacaguggcucaugccuguaauagcacuuugggagacugaggugaguggaucacuugaggucaggaguucgagaccagccugaccaacauggugaaacccugucucuacuaaagaauacaaaaaaaaaaaaaaaauagccaggugugguggcgugcgcauguuuucccagcuacuuggggaggcugaggcacaagaaucacuugaaccugggaggcggaggcugcaguaagccgagaucaugccacuacacucugggacagagugagacucugucuaaaaaaaaaaaaaaaaaggcguaaggggaugagugacagua

SEQ ID NO: 155168 - RNA, 45 nt, Homo sapiens
gcuuuucugcuacuguagguuuuaucagacaguuaugaaagaggg

SEQ ID NO: 155169 - RNA, 45 nt, Homo sapiens
aauagggacauugcuggcgaguagagugccacaggagugauauag

SEQ ID NO: 155170 - RNA, 46 nt, Homo sapiens
cuguugauacuuuugcuuaaaaacgcuuccauguagaaagaaaaug

SEQ ID NO: 155171 - RNA, 42 nt, Homo sapiens
uguuucuuauagucauaaacuuccuguugaaguuaguaaaug

SEQ ID NO: 155172 - RNA, 47 nt, Homo sapiens
aucugcugugaaauucauagucagaaaauucccugcuguagaaaccc

SEQ ID NO: 155173 - RNA, 80 nt, Homo sapiens
uacuuguuugguuaucaaccaacgaaguuguuuauauguuuacauucuuaaacaguaaaauuugugguugugggaaaugg

SEQ ID NO: 155174 - RNA, 41 nt, Homo sapiens
ggcgucggcaugcucacccgccucuacaacaucaagaaggu

SEQ ID NO: 155175 - RNA, 41 nt, Homo sapiens
augggcgcgcucuccuaaggcggaggucgcgggcgggaggg

SEQ ID NO: 155176 - RNA, 42 nt, Homo sapiens
gaccucauagauaccaguugaagcaccacugggcacagcagc

SEQ ID NO: 155177 - RNA, 45 nt, Homo sapiens
caguagacaccacuggguaguuuuugaugaaggacuuguacaggu

SEQ ID NO: 155178 - RNA, 44 nt, Homo sapiens
uccucuuuggguuggucacucugagaucauccuccacuaccugg

SEQ ID NO: 155179 - RNA, 50 nt, Homo sapiens
acagccccaccaccaggucagugaugaagguauuuucagucuccccagaa

SEQ ID NO: 155180 - RNA, 61 nt, Homo sapiens
ugguuguacuuggccaagcgcucagaucagcaaggggcaccagucuugagcugcccagguc

SEQ ID NO: 155181 - RNA, 47 nt, Homo sapiens
ugauuugggccaauuacaugacugcaaggcuagagcugccaacaggg

SEQ ID NO: 155182 - RNA, 47 nt, Homo sapiens
ccucucuuuuuccuuuccucuaucucuuuucuuccuuuccauccauc

SEQ ID NO: 155183 - RNA, 45 nt, Homo sapiens
ggcgugguuugguugggaguuacgucuuuauuuugaauuugugga

SEQ ID NO: 155184 - RNA, 44 nt, Homo sapiens
uuauaccggugaagaaaggauuguuuauguugugcccauacuag

SEQ ID NO: 155185 - RNA, 59 nt, Homo sapiens
aaauccucuucuuauaacauguuuuccuuuucuagggaagcagaugcuacugacagucu

SEQ ID NO: 155186 - RNA, 43 nt, Homo sapiens
ugcugcacuccagcaggaccacuggaauugcucauggaagaag

SEQ ID NO: 155187 - RNA, 37 nt, Homo sapiens
cuuucacaaagaagaaauuucacuuuucaggaauaua

SEQ ID NO: 155188 - RNA, 36 nt, Homo sapiens
aguacacucuuauuuucauuugaugcaugugggaac

SEQ ID NO: 155189 - RNA, 43 nt, Homo sapiens
ugagacacuaaaaauauuuccuuuagcagaaaauucuucaaug

SEQ ID NO: 155190 - RNA, 45 nt, Homo sapiens
uacagcaucaaguauaauaaccaauuagcaacucggacugcacaa

SEQ ID NO: 155191 - RNA, 47 nt, Homo sapiens
agacuuuguuucaggaguuccaagagcagcaaggacuuugggaaugg

SEQ ID NO: 155192 - RNA, 46 nt, Homo sapiens
ugaugggaagaacauguccuccuuauacaauuuuacuggcgagcag

SEQ ID NO: 155193 - RNA, 45 nt, Homo sapiens
ugcauauuucggauuuucuguagcugccacugacauuaauggaga

SEQ ID NO: 155194 - RNA, 46 nt, Homo sapiens
uaaaaaaggaauuguuuauaucuucaauggaagaucaacaggcuug

SEQ ID NO: 155195 - RNA, 46 nt, Homo sapiens
augccaccaagcuuuggcuauucaaugaaaggagccacagauauag

SEQ ID NO: 155196 - RNA, 42 nt, Homo sapiens
guacccuagcauuuuaaaucaagacaauaaaaccugcucacu

SEQ ID NO: 155197 - RNA, 24 nt, Homo sapiens
ccucucagcuuaaauuaaaagaua

SEQ ID NO: 155198 - RNA, 39 nt, Homo sapiens
aagugucauaccugaaugauggacuucuacuucuggcag

SEQ ID NO: 155199 - RNA, 61 nt, Homo sapiens
ucugaauuuagagacaaacucacuccaauuacuauuuuuauggaauaucgguuggauuaua

SEQ ID NO: 155200 - RNA, 66 nt, Homo sapiens
gaacagcugcugauacaacaggcuugcaacccauucuuaaccaguucacgccugcuaacauuaguc

SEQ ID NO: 155201 - RNA, 47 nt, Homo sapiens
acauucuacuugacuguggugaagacaaugucuguaaacccaagcug

SEQ ID NO: 155202 - RNA, 75 nt, Homo sapiens
aaaagaagaucuauauuggggaugacaacccucugacauugauuguuaaggcucagaaucaaggagaaggugccu

SEQ ID NO: 155203 - RNA, 69 nt, Homo sapiens
acgaagcugagcucaucguuuccauuccacugcaggcugauuucaucgggguuguccgaaacaaugaag

SEQ ID NO: 155204 - RNA, 49 nt, Homo sapiens
acuuuccugugcauuuaagacagaaaaccaaacucgccaggugguaugu

SEQ ID NO: 155205 - RNA, 47 nt, Homo sapiens
ugcaccagcagucagagauggauacuucugugaaauuugacuuacaa

SEQ ID NO: 155206 - RNA, 44 nt, Homo sapiens
auguucaucuucuuggaauuaaguguuaaugaaaauaacuauuu

SEQ ID NO: 155207 - RNA, 46 nt, Homo sapiens
cccaguuguaucucacaaaguugaucuugcuguuuuagcugcaguu

SEQ ID NO: 155208 - RNA, 47 nt, Homo sapiens
ugucuuucuuccgauuccaaacugggagcacaaggagaacccugaga

SEQ ID NO: 155209 - RNA, 89 nt, Homo sapiens
auaacacucuguuguauauccuucauuaugauauugauggaccaaugaacugcacuucagauauggagaucaacccuuugagaauuaag

SEQ ID NO: 155210 - RNA, 46 nt, Homo sapiens
accguaauucagccuuuucagcuucaaucugaaggacggccauugu

SEQ ID NO: 155211 - RNA, 46 nt, Homo sapiens
uugcucagugcuugaagauugucugccaaguugggagauuagacag

SEQ ID NO: 155212 - RNA, 45 nt, Homo sapiens
cugcuucauuuaaugucauagaguuuccuuauaagaaucuuccaa

SEQ ID NO: 155213 - RNA, 48 nt, Homo sapiens
gcaggauuguugcuacuggcuguuuugguauuuguaauguacagggua

SEQ ID NO: 155214 - RNA, 48 nt, Homo sapiens
uauucuacacugaugugacaguaauaaugguuuuucuucaacugacag

SEQ ID NO: 155215 - RNA, 42 nt, Homo sapiens
gagaauuauauuugucaaccuucuccuuauaaauaaguucag

SEQ ID NO: 155216 - RNA, 54 nt, Homo sapiens
cuuugagauaguugcuuaugcauauaguaaguauuacauucuuagaguagagca

SEQ ID NO: 155217 - RNA, 44 nt, Homo sapiens
gguaauguguaaaaucagucucggcugucagaauaacuucuaaa

SEQ ID NO: 155218 - RNA, 78 nt, Homo sapiens
uaguuuuauauggcucuguagaguggugaaccuucuagaggaauauaugauuuauucacaguuccucaaggccugggg

SEQ ID NO: 155219 - RNA, 46 nt, Homo sapiens
aggagcacauuuaguugagguauacaagguaggacucuagacaaaa

SEQ ID NO: 155220 - RNA, 45 nt, Homo sapiens
uauuccuuuuauggcaucuaucuugaaaguaaucuuguauuggag

SEQ ID NO: 155221 - RNA, 38 nt, Homo sapiens
uuuuuuuaucaugauuaaauaucaaaaaauugcccuau

SEQ ID NO: 155222 - RNA, 114 nt, Homo sapiens
auuuuuaugaucugauucaguuuuaagaaaacaugaaugaacuagaagauauuaaaaacauuugacauugguaagaaauauugauacugauauugauuuuuauauagguauuua

SEQ ID NO: 155223 - RNA, 40 nt, Homo sapiens
uuucucuuaacgauuaucacuguaauucugaaucugaaag

SEQ ID NO: 155224 - RNA, 79 nt, Homo sapiens
auucucauuaacacuuacauuuccauaaagaaaacucaaguauuaauaaaagagacuuuacuggcuuaagagggcugug

SEQ ID NO: 155225 - RNA, 45 nt, Homo sapiens
agaucuuccuaaguugcaaaauguaaugaugagcuugguggagaa

SEQ ID NO: 155226 - RNA, 24 nt, Homo sapiens
uuuuuguuagcaggaaagagugau

SEQ ID NO: 155227 - RNA, 23 nt, Homo sapiens
uuauuuaccccuaaaugguccau

SEQ ID NO: 155228 - RNA, 54 nt, Homo sapiens
ucauccaaagaauaucaaaaggaggccuaauuaaaaccaaaagaaaaagaaaga

SEQ ID NO: 155229 - RNA, 48 nt, Homo sapiens
aguggaugugggggaaaugaaaacaauuuuacuuccaaacaagaaugu

SEQ ID NO: 155230 - RNA, 51 nt, Homo sapiens
uucacggucccucauggugucucacuccagcagacagaggauugugucgug

SEQ ID NO: 155231 - RNA, 46 nt, Homo sapiens
aaaacuggccauauccacauuaugcagaaacaaucacuguuggcau

SEQ ID NO: 155232 - RNA, 54 nt, Homo sapiens
guauuauuuucuuaauuuucuaguuaguuuucagaaugacauaucuuagugguu

SEQ ID NO: 155233 - RNA, 39 nt, Homo sapiens
ucucuaaauacuguuugaaucagcacuguugcaccaaga

SEQ ID NO: 155234 - RNA, 46 nt, Homo sapiens
uacucuaaguuguguguaauucucuaccuuuuuucuauuugaguaa

SEQ ID NO: 155235 - RNA, 93 nt, Homo sapiens
ggaccaucuuuagucuuaacacaagauaauuuguugccccagucauaaaaguccuccagagaaguguuucucaagcuugaauaauauauagau

SEQ ID NO: 155236 - RNA, 74 nt, Homo sapiens
aaaaauguggcacuucaucucugccaaaaucacugccaucaaaaugcagucacccuagaugaccacugucuacu

SEQ ID NO: 155237 - RNA, 59 nt, Homo sapiens
cauuuuuaaaagauuuuuguuaucacuagccuucugaaacagguguuauguucacaaag

SEQ ID NO: 155238 - RNA, 56 nt, Homo sapiens
aguaugucuuuaaauauauauauauaccugcguuguugcuuaauaauguguuuguu

SEQ ID NO: 155239 - RNA, 45 nt, Homo sapiens
aacucccugacuccgcaaucaaccaagguucccagccuuuuuggu

SEQ ID NO: 155240 - RNA, 44 nt, Homo sapiens
gggcaauaugaacaauuuugagacacuggaagaaugcaagaaca

SEQ ID NO: 155241 - RNA, 66 nt, Homo sapiens
cuuuuuggaagaagauccuggaauaugucgagguuauauuaccagguauuuuuauaacaaucagac

SEQ ID NO: 155242 - RNA, 41 nt, Homo sapiens
uuauaguaggaaguuuuacuuaauaaaauaacuuuucaaua

SEQ ID NO: 155243 - RNA, 64 nt, Homo sapiens
auuuguugcaugauucaauggacauaaucaaaaauuaggaaaauauauacauuauauuugucag

SEQ ID NO: 155244 - RNA, 102 nt, Homo sapiens
aauucaaauucauaguauuacuuuauaaauugugacaauugauaugcauauauucuuuugauuacagauaaugcaaacaggauuauaaagacaacauugcaa

SEQ ID NO: 155245 - RNA, 64 nt, Homo sapiens
auuacucuauugaaaugaaguggcuucaugguuacaauaaauagaaaagauuaauuuuuagaga

SEQ ID NO: 155246 - RNA, 39 nt, Homo sapiens
gucauauuauauuaaacuuuuacucugcauuaauccuac

SEQ ID NO: 155247 - RNA, 63 nt, Homo sapiens
uguaagcugcauaaaauaguagaacuauauaugaaauuuaagauuuuuuuauuauuggaaccu

SEQ ID NO: 155248 - RNA, 90 nt, Homo sapiens
gcaaucaugaaaagauuuuucuucaauauuuucacucgacagugcgaagaauuuauauaugggggaugugaaggaaaucagaaucgauuu

SEQ ID NO: 155249 - RNA, 44 nt, Homo sapiens
aauaauauauuauggguggagugcaauuaauaaaauuaucuaau

SEQ ID NO: 155250 - RNA, 45 nt, Homo sapiens
aauaaaguuugaauaaauacaucuucugggccugaaucuguggaa

SEQ ID NO: 155251 - RNA, 49 nt, Homo sapiens
aaauguuguaaaaacaacucccuaugacauuugaugcuacccuuuggcu

SEQ ID NO: 155252 - RNA, 33 nt, Homo sapiens
acucccuaaacugcggaauaaugaacugggaaa

SEQ ID NO: 155253 - RNA, 39 nt, Homo sapiens
agguaucucuggggagaaaggagcaaugggauaaggaag

SEQ ID NO: 155254 - RNA, 46 nt, Homo sapiens
agaauacugccaucuuaacaguauuaagucuuaugauccacagaca

SEQ ID NO: 155255 - RNA, 47 nt, Homo sapiens
uuaagccacacagucugugauauuuuguuacagcaacccuaauagac

SEQ ID NO: 155256 - RNA, 42 nt, Homo sapiens
agcugcauucacagcaaggagaauuuucaaaaucaccccauc

SEQ ID NO: 155257 - RNA, 44 nt, Homo sapiens
acaauaaacagugaugccugaugcugcagccaaaguugccggga

SEQ ID NO: 155258 - RNA, 34 nt, Homo sapiens
acuguugccuuagcccuugguuaaagacuuaggc

SEQ ID NO: 155259 - RNA, 37 nt, Homo sapiens
agcuugcuccuggugaaggagaaagcagugauuguag

SEQ ID NO: 155260 - RNA, 66 nt, Homo sapiens
auuucacuccaacccaagucuuuucucaucugcuguucugugguccaugaucuacuugcccuguga

SEQ ID NO: 155261 - RNA, 41 nt, Homo sapiens
uuaggagaaucacuauuagguacagaguaggccuccuugag

SEQ ID NO: 155262 - RNA, 193 nt, Homo sapiens
ggguccuguccucccaugccaaaaccuccaagaaaaagguggucucugugcugggggucaggggguuggugaagaaggcggcaaaaggaagaguggugaaaaaauagaaugaacacuaagaauggaauaaaagggaaaaaagcuguauugaagcaaagaaggggcagagggagcccgugagcugagugggcca

SEQ ID NO: 155263 - RNA, 27 nt, Homo sapiens
aaauuuaaaaggagauggaaacuuaga

SEQ ID NO: 155264 - RNA, 50 nt, Homo sapiens
uccccgccuggaagcuucucucuacugcguggggagcugugacuacaggc

SEQ ID NO: 155265 - RNA, 44 nt, Homo sapiens
guguuggcaggaaggugaccucucccagcuucugucugcugggu

SEQ ID NO: 155266 - RNA, 52 nt, Homo sapiens
gugauuggcgauuucaaauggaaaggcaggcacuuuauaggaaagcagaggc

SEQ ID NO: 155267 - RNA, 26 nt, Homo sapiens
cuuuuguuuuuacaggagaugaauaa

SEQ ID NO: 155268 - RNA, 43 nt, Homo sapiens
aagcagacaggguccucgcccuccuggggcuuacagcggaagg

SEQ ID NO: 155269 - RNA, 46 nt, Homo sapiens
ccaccaaauuucacugucccccaguuccagcccuucacacaaaggu

SEQ ID NO: 155270 - RNA, 82 nt, Homo sapiens
ucaaaggucuugccaugcaggugcagaaaggugggguagauccgaaugucauaacgaccacgaggagucagacacugcagcu

SEQ ID NO: 155271 - RNA, 46 nt, Homo sapiens
acucguucauguucagagucaacgaaauguccucguccuuggagaa

SEQ ID NO: 155272 - RNA, 44 nt, Homo sapiens
accaucucauagagggauccugacauguucuuggugagccgacc

SEQ ID NO: 155273 - RNA, 45 nt, Homo sapiens
cucaucccggucacugucacccucauuacuggaggagcuggcaga

SEQ ID NO: 155274 - RNA, 42 nt, Homo sapiens
gcuuagcugccuugaggacgacuuggaugaugagccccuaga

SEQ ID NO: 155275 - RNA, 42 nt, Homo sapiens
uacccauauuaauaaauguuuacuuuuuaucuuggugggugc

SEQ ID NO: 155276 - RNA, 45 nt, Homo sapiens
aguuuuggaaccacagaaugcuuucucuuggcugcaauggcuuau

SEQ ID NO: 155277 - RNA, 47 nt, Homo sapiens
aaguacaggguaacccuaaaugucccaugcuguucuggauacuggau

SEQ ID NO: 155278 - RNA, 46 nt, Homo sapiens
cugaugucuaagaaagauaaguugcuaagaaaauaauacaugggaa

SEQ ID NO: 155279 - RNA, 46 nt, Homo sapiens
ccccucuggagaguuaugaugcccagggugcucucugcuggggaag

SEQ ID NO: 155280 - RNA, 33 nt, Homo sapiens
cacucugucucuuuccucgaaggccaccuggac

SEQ ID NO: 155281 - RNA, 45 nt, Homo sapiens
ccagaggcccugaguaagagacgaacagcagggaacuguccaagg

SEQ ID NO: 155282 - RNA, 76 nt, Homo sapiens
caacaugucuagcagagugugcuaucuacucuugacugggguuuaucuggugggaauagcagaugcuuugauacau

SEQ ID NO: 155283 - RNA, 48 nt, Homo sapiens
uucuucugugauaucccuccucucuuauuacucucucgcucagauaca

SEQ ID NO: 155284 - RNA, 45 nt, Homo sapiens
agaugagucuuuguuccaauaaauggaugacuuggagcuggagga

SEQ ID NO: 155285 - RNA, 47 nt, Homo sapiens
uagugacagcugugcaagaaaaauuaaaugaaauaguagaucagaua

SEQ ID NO: 155286 - RNA, 46 nt, Homo sapiens
aguuuuuucagggccucuuucacauccuuguuccucaggcuauaaa

SEQ ID NO: 155287 - RNA, 31 nt, Homo sapiens
agaaaguuauggcauggcaaaauuauuucag

SEQ ID NO: 155288 - RNA, 24 nt, Homo sapiens
uuauuuugcugcauuguuucaguu

SEQ ID NO: 155289 - RNA, 46 nt, Homo sapiens
auuucauauauugucaucuugcauucacugagaaaccacagugcca

SEQ ID NO: 155290 - RNA, 46 nt, Homo sapiens
uagggucuuuaauacacucuacagcucagauuauccuggccuuaag

SEQ ID NO: 155291 - RNA, 42 nt, Homo sapiens
uuggaggcauagagaucuucauucucacagggauggccuaug

SEQ ID NO: 155292 - RNA, 46 nt, Homo sapiens
cuugucuccuaugcugucaucuugcucucucugagaacacacaguu

SEQ ID NO: 155293 - RNA, 46 nt, Homo sapiens
uguccaggcuacccccaucagaaugccacagagccuccuguucaug

SEQ ID NO: 155294 - RNA, 45 nt, Homo sapiens
uguauauugguguaccuucgacccaugaucaccuucccuauugau

SEQ ID NO: 155295 - RNA, 45 nt, Homo sapiens
cagaaauagugauugaucacauuggggccacagaagagcaggugg

SEQ ID NO: 155296 - RNA, 41 nt, Homo sapiens
ccucugagcuucaaccccucccaggaacaaugagcucaaau

SEQ ID NO: 155297 - RNA, 64 nt, Homo sapiens
ugcuaaaaaauccuuuaaaagguuaaauacuuuaaaagauuaaagcaacauaacuguaaacaua

SEQ ID NO: 155298 - RNA, 34 nt, Homo sapiens
uuuacucagguuggcauuuuaugugucugugucu

SEQ ID NO: 155299 - RNA, 46 nt, Homo sapiens
aaagccaggauuguguuggguugaauauauuuuaaguaucagaggu

SEQ ID NO: 155300 - RNA, 45 nt, Homo sapiens
ucuaccagaacacaacugcaaugacaaucuaugaaaaccuugcgc

SEQ ID NO: 155301 - RNA, 46 nt, Homo sapiens
auguuuuccucaaucaguguguuuuggauauugucagaucccagaa

SEQ ID NO: 155302 - RNA, 49 nt, Homo sapiens
gaaugcagaauuggaggaugagggacuucuguugcaucugaaaucagug

SEQ ID NO: 155303 - RNA, 42 nt, Homo sapiens
uauuaaggaacauuucaaacuuugacagauucagaaggaaug

SEQ ID NO: 155304 - RNA, 41 nt, Homo sapiens
aauucuggucuuggacccuuguuaagugcuucuacccuuua

SEQ ID NO: 155305 - RNA, 71 nt, Homo sapiens
agauguccugaaauacacguaugaggauuucaaaaagggagccucagauacuuaugugacauaccucauaa

SEQ ID NO: 155306 - RNA, 80 nt, Homo sapiens
uuccuuugaaagaaaauagaaaaagauuugcauuugcuagugggaauuugcagaguaucuccuuagcugagagaagaggu

SEQ ID NO: 155307 - RNA, 43 nt, Homo sapiens
cauucgacucugccauuguagugugcaagcagucacagaagau

SEQ ID NO: 155308 - RNA, 64 nt, Homo sapiens
gagggugagguauuugccugaugguugacaaacuuucuggaaagggccagauugccaauauuuu

SEQ ID NO: 155309 - RNA, 44 nt, Homo sapiens
ucccccuccuccagauggauccccuaauauuacaucugucaguc

SEQ ID NO: 155310 - RNA, 78 nt, Homo sapiens
guauuugaauuuuucuaccucguacaacaucagcaucaccacuguguccuguggaaagauggcagcccccacccggaa

SEQ ID NO: 155311 - RNA, 64 nt, Homo sapiens
ucagcaguggagccuggaacaaugcgacccaccuggagagcugcuccucugagaauggcacuga

SEQ ID NO: 155312 - RNA, 41 nt, Homo sapiens
cagccaugaugcagaaucauuucagaugcauaucacacagg

SEQ ID NO: 155313 - RNA, 46 nt, Homo sapiens
ugcagacugggagacagguuuaaugacacagucaugucagagagag

SEQ ID NO: 155314 - RNA, 29 nt, Homo sapiens
uuauuuuuuuacuguggauugaagggaga

SEQ ID NO: 155315 - RNA, 68 nt, Homo sapiens
ccuaggggcuggagcagucacaggaagucaccaagugaauugaagggugguggcuuuggagguucagu

SEQ ID NO: 155316 - RNA, 47 nt, Homo sapiens
aaggcuugaaugagaugauaaauacaacaucugacuugcgacuggac

SEQ ID NO: 155317 - RNA, 54 nt, Homo sapiens
aaugauuuaccuuagaggagccaguuuuauagggaguuguuggauaaucuucac

SEQ ID NO: 155318 - RNA, 42 nt, Homo sapiens
gugguugguucucguuccuuccaccgaagccuuccauggcau

SEQ ID NO: 155319 - RNA, 43 nt, Homo sapiens
caguuugugaaccuggaacuuggaagcugguuuccuccucugg

SEQ ID NO: 155320 - RNA, 45 nt, Homo sapiens
aaaaauuacccauuuuggacuugccuguggaagcaauuagagaga

SEQ ID NO: 155321 - RNA, 44 nt, Homo sapiens
aacguuagauuuuggauuagacuuugggucaacuucaggguagc

SEQ ID NO: 155322 - RNA, 45 nt, Homo sapiens
ucccuggugggucauuggcuccugaguaagauagaugcaugcaau

SEQ ID NO: 155323 - RNA, 52 nt, Homo sapiens
gaagauuuuagagaaaaggugacauguaaagcugaacaaggguugccuguga

SEQ ID NO: 155324 - RNA, 50 nt, Homo sapiens
auuauuuguaauuaaaaaaagaacaacagcaaaaaacccaaagugcagug

SEQ ID NO: 155325 - RNA, 43 nt, Homo sapiens
agugauaauguguguaaacagauggugugguuggcucauugga

SEQ ID NO: 155326 - RNA, 33 nt, Homo sapiens
auaugaggagcagggcauuuuuggaggaagaaa

SEQ ID NO: 155327 - RNA, 71 nt, Homo sapiens
aagaagucagaaggguguuggguuggugaggacagauuguauaccaucuuggcuuuggccgagccaaacag

SEQ ID NO: 155328 - RNA, 42 nt, Homo sapiens
uccgaacagauauaauaagcucauaauaacaguggccauuga

SEQ ID NO: 155329 - RNA, 44 nt, Homo sapiens
augggauuauugaaguauacuucauuauuuaucuucuggcaauu

SEQ ID NO: 155330 - RNA, 42 nt, Homo sapiens
ggauuucuccaugggccuuuuguuuuugcuccugcuggugau

SEQ ID NO: 155331 - RNA, 56 nt, Homo sapiens
aguacucacacuauuuaaauuauuuuuauuucacuaccugaauccccucagcaagu

SEQ ID NO: 155332 - RNA, 42 nt, Homo sapiens
uuugcacuguagugacggcaagagcucacgugauccauuuua

SEQ ID NO: 155333 - RNA, 46 nt, Homo sapiens
agcauuugcucuacccacacgcacaguuggaaagaugcagguuuga

SEQ ID NO: 155334 - RNA, 45 nt, Homo sapiens
gucugcguuaucuucuuagauuggcuccaucucucaggugaggaa

SEQ ID NO: 155335 - RNA, 397 nt, Homo sapiens
guacaacauuuagaauugguacuguuggcugggcacgguggcucacaccuguaaucccagcacuuugggaggccaagacgggcagaucaccugaggucaggaguucgagaccagccuggccaaugcggugaaaccccgucucuacuaaaacaaaacaaaacaaaacaaaacaaaacaaaacaaaacaaaacaaaacaagucgggugugguggcgcacuuuuguaauuccauguacucgggaggcugaggcaggagaaucgcuugaaccugggagguggagauugcagugagccgagaucgcgccauugcacuccagccugggcgacaauagugaaacucugucucaaaaaaaaaaaaaaaaaaaagaauugguacuaucuuagaaaaccuggagcac

SEQ ID NO: 155336 - RNA, 41 nt, Homo sapiens
guacuucccaguuugguuauuaguaacuuuauuugguucug

SEQ ID NO: 155337 - RNA, 91 nt, Homo sapiens
gguucugacuuucuuuugccuguguguguguguaggggugugugugugugugugugugugugugagagagagagagagagaaagagaguaa

SEQ ID NO: 155338 - RNA, 41 nt, Homo sapiens
ucaccauccagauggucagauaccggaauugccacagaaau

SEQ ID NO: 155339 - RNA, 46 nt, Homo sapiens
guguguguguuucugauaaacaaagaaguguggaaguggcugaaug

SEQ ID NO: 155340 - RNA, 41 nt, Homo sapiens
gaaacuuggaaaauagaggaaaaguauaaaauugaaacuaa

SEQ ID NO: 155341 - RNA, 36 nt, Homo sapiens
uguaagaugaugauauaauaaugugccucaugggau

SEQ ID NO: 155342 - RNA, 48 nt, Homo sapiens
caaugugaacccacgguaccuucugcgggagaaaagguggcaugggaa

SEQ ID NO: 155343 - RNA, 43 nt, Homo sapiens
ugagaaugaaugugggucuauccuuccuucugugugaggaaaa

SEQ ID NO: 155344 - RNA, 47 nt, Homo sapiens
ugcuuggcuaguggcagccuugcagaucagcuaguuuugacccacau

SEQ ID NO: 155345 - RNA, 43 nt, Homo sapiens
ggugugggggaccugugaaguggguguucuggggugagugcga

SEQ ID NO: 155346 - RNA, 28 nt, Homo sapiens
accgugugugggauggucuguuaaagaa

SEQ ID NO: 155347 - RNA, 58 nt, Homo sapiens
gggucaucuaaugcaaaccguuuacuuuagagauguugaaaccaaggcgcagagaggg

SEQ ID NO: 155348 - RNA, 38 nt, Homo sapiens
uuuuucaaauaugaaaucagaauucuacccauacuccc

SEQ ID NO: 155349 - RNA, 51 nt, Homo sapiens
gggugauucgggaggaagagugggagagagagagagagagggagaggaugg

SEQ ID NO: 155350 - RNA, 61 nt, Homo sapiens
acaagacuucgaguuaggagaguggguuggacucuuggugcagccuaugugaccuugggcu

SEQ ID NO: 155351 - RNA, 33 nt, Homo sapiens
ugcuuagccuuugcucuucccuggaaccuggcu

SEQ ID NO: 155352 - RNA, 39 nt, Homo sapiens
ugggcuuccuuugaggcacaggggagcugaaugggaggg

SEQ ID NO: 155353 - RNA, 75 nt, Homo sapiens
guaauguuuuuugaaaaccacaaacauggacauauuauggacuggauaccacauuugcaucaggauuuuuuuuuc

SEQ ID NO: 155354 - RNA, 57 nt, Homo sapiens
cuggcuauggcugccuccugucucucgguacauuuucuguggcggucaagaggaguu

SEQ ID NO: 155355 - RNA, 50 nt, Homo sapiens
uaaaaaguuggucuaaagaaaaacauuggguaaauaauuaugugaguaug

SEQ ID NO: 155356 - RNA, 45 nt, Homo sapiens
auuuuagggggucuuaguaaagaaagacccccaaaaguccaugau

SEQ ID NO: 155357 - RNA, 29 nt, Homo sapiens
ugcuaguuguggcugcugcuguuacuugg

SEQ ID NO: 155358 - RNA, 47 nt, Homo sapiens
acuaacacuuccugcuucacugggugguugagaggaucaaauaagau

SEQ ID NO: 155359 - RNA, 115 nt, Homo sapiens
gcgugacccucggcacccaagggucucuccucgcaguuuccccagcagguucugcacaggcucuccugggggccagaaggcaaugugaccuccugcagagaaccugggaguagau

SEQ ID NO: 155360 - RNA, 42 nt, Homo sapiens
ggaaaugaguuauuggcuggggauggaaccugguuucaggga

SEQ ID NO: 155361 - RNA, 42 nt, Homo sapiens
gcggagcggggacgaggcggaccggcuggcggaggaggaggc

SEQ ID NO: 155362 - RNA, 43 nt, Homo sapiens
ccugaggaucggcucagccuugcgggccuuucauucucccgag

SEQ ID NO: 155363 - RNA, 341 nt, Homo sapiens
gcacuuucagggagcucagacaggaguuauuuguuuauuuauuuguuguuguuuuugagauggaguuuugcucuugucacccagacuggcaugcaauggcacaaucucggcucacugcaaccuccgccucccagguucaagcgacuguccugccuuagccucuugaguagcugggauuacagguguccgccaccacaccuggcuaauuuuuguguuuuuaguagagacaggguuucaccauguuggccaggcuggucuugaacuccugaccucaggugauccgcccaccuuggccucccaaagugcugggauuacaugcaugagccaccacgccagcccag

SEQ ID NO: 155364 - RNA, 44 nt, Homo sapiens
cuugacaacaucucugacuuguguucuuagcucagcacauugcc

SEQ ID NO: 155365 - RNA, 616 nt, Homo sapiens
ucaacaacgcggguaagaccccggggcuggagcggacuccccaugugagcgcccacuuccuccaccgcuggggaauuuaagggcuacuccuaggggucagauaggacgccuagaaaucuaaagcccuaguuguuccagcuugaguagcaaguggaggcgagguguacaggaagacucggugccgucgggacaacagucugcccccacuuccuggaaaauuggccagccggguuuuccaaagcgccuguagaacuuucccgagccccuugcucugcgcccucuggcggaggccugagucagggcuuggagucuccaaacaaguaaacucucugcuucuccaaaggaccgcuagagcuuuccuucagccccacggcaaggcaggugccuucucauucugcagcuugggauggcuagguuccccagcugugucuuuccgcagagcuggggaagagagaagccucuucagaagcgcuaggcagcuuccuccucuaggucugcaugggaagaggauaucuggaggaacuugggagggcuggggaagaagaaagccccgccugcacugaguuacuccuaaggguugguuuuucaggcucucuuggggauguguccaaaggcu

SEQ ID NO: 155366 - RNA, 48 nt, Homo sapiens
cuucagucuuaauaucaauucucuguccuuuuaugcagggaagaaaag

SEQ ID NO: 155367 - RNA, 24 nt, Homo sapiens
uuuugcaucauuaccgaaauggug

SEQ ID NO: 155368 - RNA, 40 nt, Homo sapiens
gccacugaggguauagccgaccugcauuuuaaacauagga

SEQ ID NO: 155369 - RNA, 30 nt, Homo sapiens
ucuuuguugcauuauuuuauagcacuagug

SEQ ID NO: 155370 - RNA, 134 nt, Homo sapiens
gagccgaggaaauagcuuauuuuuccggaagguccccuuugggaagacuuauuguugugaccugaaaauguuaauuugaagauguggggcagggacagugacauuucuguagucccagaugcacagaauuaugg

SEQ ID NO: 155371 - RNA, 45 nt, Homo sapiens
cuauacaguguggcgcgcuuuuuuaauaaucauuuaaucuuggga

SEQ ID NO: 155372 - RNA, 42 nt, Homo sapiens
aaaucgugaggugagcgugguccuagcuccuuguggcagagc

SEQ ID NO: 155373 - RNA, 48 nt, Homo sapiens
auagggagucuuucgagcgagcggggaagugugggggaagcagcucag

SEQ ID NO: 155374 - RNA, 25 nt, Homo sapiens
augcauucuugccaucaguuaauuu

SEQ ID NO: 155375 - RNA, 46 nt, Homo sapiens
uucacauggcauuugucugucucugugucaaagcacuggaugaguc

SEQ ID NO: 155376 - RNA, 48 nt, Homo sapiens
gagcaagccuuuucucagaccuuaggcacagccucuccucuuuaccug

SEQ ID NO: 155377 - RNA, 34 nt, Homo sapiens
cuuuugucauuucaaagacaugauguauggggau

SEQ ID NO: 155378 - RNA, 353 nt, Homo sapiens
accaugcuauugaaguucuggaaaucugcuauaaaugggaccagaaagacuuuuuuuuuuuuuuuuuuuuuuugagacaguuucacucuguuggcuaugcugcagugcaguggcacaaaucacggcucacugcagccucuaccuacugggcuccggugauccaucucagccucccaaguagcugggacuacaggugcacaccaccacacugagcuaacuuguuguauuuuuuguagagacgguuuugccauguugcccaggcuggucucaaacuccugggcucaagccauccucccaucucaagccucccaaagugcugggaucauaaguguguaccacgaugcccagcccag

SEQ ID NO: 155379 - RNA, 42 nt, Homo sapiens
acgaggaguacgagacgagguuccugugcaacucuucacagg

SEQ ID NO: 155380 - RNA, 60 nt, Homo sapiens
cccugucgucucacguguucuuaguguccacuccugugggugccgaaggguccgcgcccc

SEQ ID NO: 155381 - RNA, 43 nt, Homo sapiens
ggagcacauuaaagcgcuuucuucgcuagggaccaggcuuuga

SEQ ID NO: 155382 - RNA, 109 nt, Homo sapiens
ggcuuuaauuggaugcuuuccccuugcccacaaguguagcuucucuccaagcgcuuuggaaguuucagccucucuauuaauccuuggugagaaugaaggcgucucaaua

SEQ ID NO: 155383 - RNA, 46 nt, Homo sapiens
ugaguaagcucuugcagacugugugaauauguaugauauuggugau

SEQ ID NO: 155384 - RNA, 59 nt, Homo sapiens
acaaaugcaguuuuuuaaaaagcuuugcaaaccucuuuacugagcuaauuuggguuaua

SEQ ID NO: 155385 - RNA, 45 nt, Homo sapiens
acuguaugguacuauuucuugaagguagcuugcugaaauaauaag

SEQ ID NO: 155386 - RNA, 47 nt, Homo sapiens
gaccuaguaaagguuuucaaaugucuuuuccauuucccguggcugag

SEQ ID NO: 155387 - RNA, 52 nt, Homo sapiens
uguaaauuguagagaaugcuucagguuguuagggauggggugaggagacaag

SEQ ID NO: 155388 - RNA, 50 nt, Homo sapiens
uugaaagagugcaguagggguuaaguguguugacuucgcugucugccagg

SEQ ID NO: 155389 - RNA, 30 nt, Homo sapiens
uuauacauaaauaaguguucucagaacaag

SEQ ID NO: 155390 - RNA, 52 nt, Homo sapiens
uaaaaaugaaaucaaagcacugacaaguuaaauuuuguggaacaguugaguu

SEQ ID NO: 155391 - RNA, 54 nt, Homo sapiens
ggccuauaaccuaacugucucaggaagugucucuacagaaguaguuucugguuu

SEQ ID NO: 155392 - RNA, 44 nt, Homo sapiens
uggaaugauaaagcuugcaauugcaucuaaaccugccccugaga

SEQ ID NO: 155393 - RNA, 41 nt, Homo sapiens
aaauguauagcuauacagcugagugauugaaauagcuucag

SEQ ID NO: 155394 - RNA, 48 nt, Homo sapiens
augaucuugaccaauucaaaaaacauuugugguccaugggccauucag

SEQ ID NO: 155395 - RNA, 18 nt, Homo sapiens
uagcccggaucucuguga

SEQ ID NO: 155396 - RNA, 47 nt, Homo sapiens
aucuuccagaagaacucuuaacagguagaaauuuaacuugcugucua

SEQ ID NO: 155397 - RNA, 46 nt, Homo sapiens
aaguugauaucuccuaaauuauggucacauuucucuagagagacag

SEQ ID NO: 155398 - RNA, 22 nt, Homo sapiens
uaaaucugcaugaaaaguuaau

SEQ ID NO: 155399 - RNA, 34 nt, Homo sapiens
uucuaaucuuuuaagagauuggacccauucaaua

SEQ ID NO: 155400 - RNA, 32 nt, Homo sapiens
gcuacuuugccugcauccuaagauauggauau

SEQ ID NO: 155401 - RNA, 53 nt, Homo sapiens
ugcacacacaccucccccuccuccaaauaaaguaaaaucauauuagccacuuc

SEQ ID NO: 155402 - RNA, 56 nt, Homo sapiens
guagaggauuauaguugugcccuucuacuuuuucagugacauugccucaagggcac

SEQ ID NO: 155403 - RNA, 24 nt, Homo sapiens
uugggaauuacaguugaaugaaug

SEQ ID NO: 155404 - RNA, 45 nt, Homo sapiens
uggagggauugguaaguaucugaauuuuuucuuuuuguauaauua

SEQ ID NO: 155405 - RNA, 140 nt, Homo sapiens
aguggaaacaucuauaguguaagaauucaccuagguuguuuacaguggcaagauaggaaugaagguauuaaaauagcugauuauccuucagguucuaaagguaauaaaacugaaauaggagaauuacaaguacaauguga

SEQ ID NO: 155406 - RNA, 41 nt, Homo sapiens
ggccagguuccaaggaccuggucugaaaaggacuugcggga

SEQ ID NO: 155407 - RNA, 46 nt, Homo sapiens
auugcagggugcuguuuuguuacauuuuacacccguaaagcugcau

SEQ ID NO: 155408 - RNA, 70 nt, Homo sapiens
cacugaaaaccauuuuggggaaaagguaacugcugcaggaauugauguaaaggaagacauaaagggagca

SEQ ID NO: 155409 - RNA, 33 nt, Homo sapiens
uuugacuucuugacucacauucuguuuucuggg

SEQ ID NO: 155410 - RNA, 45 nt, Homo sapiens
ugcacugaaaaugacauccgagucauguucucuucguuuggacag

SEQ ID NO: 155411 - RNA, 67 nt, Homo sapiens
agguugugcauuugugacuuuuacaacaagagccauggcacagacggcuaucaaggcaaugcaccaa

SEQ ID NO: 155412 - RNA, 86 nt, Homo sapiens
gcucaucacccauggugguaaaauuugcugauacacagaaggacaaagaacagaagagaauggcccagcagcuccagcagcagaug

SEQ ID NO: 155413 - RNA, 45 nt, Homo sapiens
ucuguguggggaaaccuugcuggucuaaauacucuuggaccccag

SEQ ID NO: 155414 - RNA, 413 nt, Homo sapiens
uucauauuucuaauaucuuauaagaaaucccaguuuaggccgggcgcugugacucacgccuguaaucccaacacuuugggaggcugaggugaguggaucgccugagguugggaguuugagaccagccuggccagcauggugaaacccugucuauacuaaaaauacaaaaaaauuacaugggugugguggcaggugccuguaaucccagcugcucgggaagcugaggcaggagaauggcuugaaccugggaggcggagguugcacugagcggagguugcagugagccaagaucgcaccauugcacuccagccugggcaauagagcgagacucugucucacaaaaaaaaaaaaaaaaaaaaaaaaagaagaagaaaaaaaaaaaaaaccccaguuuauccuagcuaguauuucuc

SEQ ID NO: 155415 - RNA, 46 nt, Homo sapiens
cagcuccuucagcagacugccuccucugggaaccucaacacccuga

SEQ ID NO: 155416 - RNA, 49 nt, Homo sapiens
agucuugggaguuuggcaucguuucugugaaaacauuuuuuugcuuauu

SEQ ID NO: 155417 - RNA, 46 nt, Homo sapiens; identical to SEQ ID NO: 68996

SEQ ID NO: 155418 - RNA, 32 nt, Homo sapiens
gcucuagcagcaguaauucugucaaccccaua

SEQ ID NO: 155419 - RNA, 28 nt, Homo sapiens
auuccacagauuggaugaagguaauggg

SEQ ID NO: 155420 - RNA, 45 nt, Homo sapiens
cagaaucuucugacacagcagaguauuggugcugcuggaagccag

SEQ ID NO: 155421 - RNA, 42 nt, Homo sapiens
aguguagacugagaaacccugugaagugugaucugcuuuuua

SEQ ID NO: 155422 - RNA, 46 nt, Homo sapiens
uuaucgggucugacacauuugacaagaauguuucuguuaggagguc

SEQ ID NO: 155423 - RNA, 54 nt, Homo sapiens
guccugauugaagacaaacugaggggugaugggacagaguuuggcccaugaguu

SEQ ID NO: 155424 - RNA, 126 nt, Homo sapiens
uagggagugucagaggcacugcauuuuaugcagaaugcucagagaaugucucucuagauugacauuuaagcagagaacugaaggaaguaggaagcaagucaugccugaaucuagagaaagaagagu

SEQ ID NO: 155425 - RNA, 42 nt, Homo sapiens
guccagagggagccaaccuguucaucuaccaccugccccagg

SEQ ID NO: 155426 - RNA, 48 nt, Homo sapiens
gggaggagcugaugauagaucccacccagacuuaagcugcuggugggu

SEQ ID NO: 155427 - RNA, 45 nt, Homo sapiens
cucugggaaaaccuguggauaaaaccaaaugccaaauguuggacg

SEQ ID NO: 155428 - RNA, 50 nt, Homo sapiens
aaugcuuuuccuuuaucuuguuugagcuuuuccuuucuuuccuguuuuga

SEQ ID NO: 155429 - RNA, 46 nt, Homo sapiens
uuaauugcacagacacauggacaaaaagucauuuuguaucugccaa

SEQ ID NO: 155430 - RNA, 46 nt, Homo sapiens
uggaggagcgggcagaagaugggaccaggcgggagccgcaacggga

SEQ ID NO: 155431 - RNA, 381 nt, Homo sapiens
agcgagguggccagauuccugcuuuggcuuuuuuuguuuuguuuucuuuuuuuuuuuuugagacagagucucacucuuucaccaggcuggagugcaguggcgcaaucuuggcucacuccaaucucugccucccagguucaagugauucuugugccucagccucccaggcaucugggacuacaggcgccugcuaccacgcccagcuaauuuuuuguauuuuuaguagagacaggguuucaccauguuagccaggauggucucgaucuccugaccucgugauccgccugccucggccucccaaagugcugggauuacaggcgugagccaccgugcccggcccagauuccuguuuugaaaggaacaugcuggcagcugugggaa

SEQ ID NO: 155432 - RNA, 72 nt, Homo sapiens
acacuugcaaacugagcuaacgcuuaaaaacacagguaucuggcccagccuuggacggugcuguacaggaga

SEQ ID NO: 155433 - RNA, 47 nt, Homo sapiens
ugcuuggcugucaguauuucuaucagcaaaacauuuuaaaacaacau

SEQ ID NO: 155434 - RNA, 50 nt, Homo sapiens
uuuguucuauagauaagauacaaauaaauauuauccacauacuggcugcc

SEQ ID NO: 155435 - RNA, 41 nt, Homo sapiens
cccuuuuccuggcccuuccuuccccacuucuaagccaaaga

SEQ ID NO: 155436 - RNA, 47 nt, Homo sapiens
agaggccuugcccugcugggaccccgggagugagagcagcccaagga

SEQ ID NO: 155437 - RNA, 46 nt, Homo sapiens
ccuggaucugcucccuccuggguucccucaugguggggcucagugg

SEQ ID NO: 155438 - RNA, 78 nt, Homo sapiens
cccuccggagccgggggacugcgacggccugucgccuggacaacaaggaaagcgaguccuggggggcucugcugagcg

SEQ ID NO: 155439 - RNA, 45 nt, Homo sapiens
gucuggagcugcucagaaggaaaaaauacgcagugcucaggagua

SEQ ID NO: 155440 - RNA, 45 nt, Homo sapiens
ccaagguaacgaagcgcagacuccgggcccgggugggcggcauca

SEQ ID NO: 155441 - RNA, 36 nt, Homo sapiens
gcucucuucccuagugggaaggugccugugugugug

SEQ ID NO: 155442 - RNA, 47 nt, Homo sapiens
ucacuugggagugugcacagauggggaaagcuccagggaugaguccu

SEQ ID NO: 155443 - RNA, 45 nt, Homo sapiens
uggagccacauacagccaaggccacaaucaccucugggcaugggg

SEQ ID NO: 155444 - RNA, 41 nt, Homo sapiens
ucccuucccaccacucccuacucccucccaaguacagacaa

SEQ ID NO: 155445 - RNA, 45 nt, Homo sapiens
ucaaguccugcaagcagagguggcgauuuguuaaagggccaaaag

SEQ ID NO: 155446 - RNA, 43 nt, Homo sapiens
uucucaucuggagccaggaggaagccaggacacggaagugaga

SEQ ID NO: 155447 - RNA, 384 nt, Homo sapiens
gcuacuguccaguuuccuaguauuucuuuuuuuuuuuugagacggagucucgcucuguccccccgggcuggagugcaguggcgugaucuuggcucaaugcaagcuccgccuccuggguucacgccauucuccugccucaaccucucgaguagcuaggacuacaggugcccgcuaccacgcccagcuaauuuuuuguauuuuuaguagagacaggguuucaccguguuagccaggauggucucggucuccugaccucgugauccgcccaccucagccucccaaagugcugggauuacagacuugagccaccgcgcccggccuuccuaguauuucuuuaccaaauuguagguuugcgggccagccccaggcucugagagauuggua

SEQ ID NO: 155448 - RNA, 43 nt, Homo sapiens
cccuuaugaauugaggacgaucgacguguucgauggaaacuca

SEQ ID NO: 155449 - RNA, 25 nt, Homo sapiens
uggggcaggcuguuuauagguuacc

SEQ ID NO: 155450 - RNA, 45 nt, Homo sapiens
gauguggacuggaaaacaucuggcuucccuugggcucaagucugg

SEQ ID NO: 155451 - RNA, 41 nt, Homo sapiens
uaacaucccuccuagcgccugaaggccuuuaggcaccuaga

SEQ ID NO: 155452 - RNA, 46 nt, Homo sapiens
uaccugggccucgccccacugccauccccaccacccaaggagucau

SEQ ID NO: 155453 - RNA, 40 nt, Homo sapiens
cccuuagccucucugagcuuccaguuucuccucuagaaaa

SEQ ID NO: 155454 - RNA, 49 nt, Homo sapiens
agccgcccagcacaggccgguggaaagccccccgcugccaggcgcgcac

SEQ ID NO: 155455 - RNA, 45 nt, Homo sapiens
gcguuccacccguuccugcaguuugcgcagcugcuccugggagac

SEQ ID NO: 155456 - RNA, 42 nt, Homo sapiens
auccccuuucccccaggggaggagcugcugaagaugagugag

SEQ ID NO: 155457 - RNA, 46 nt, Homo sapiens
ccacccugguucagagcccagcuucuccuggagagccggacccuca

SEQ ID NO: 155458 - RNA, 75 nt, Homo sapiens
gaaguccugggacccagggaggggaggggccuuugucuagggaagggacugguagggaagggacgagucuaggcu

SEQ ID NO: 155459 - RNA, 50 nt, Homo sapiens
acacauacgaaguaacaaauccuccccagcuuccacaaggcaaagcaucc

SEQ ID NO: 155460 - RNA, 49 nt, Homo sapiens
uucaauacaaacaguccagaaagaaagucaagucccucugggggagggg

SEQ ID NO: 155461 - RNA, 45 nt, Homo sapiens
uaaguggauccgagaugauucuuggcuuuagaacaugggagccag

SEQ ID NO: 155462 - RNA, 40 nt, Homo sapiens
agugaugugauuuuugggagcugcggaaaguugaccguaa

SEQ ID NO: 155463 - RNA, 57 nt, Homo sapiens
uguagccuccuucuaaccaaguggagaggccagguuauggcauccacaagccuagca

SEQ ID NO: 155464 - RNA, 33 nt, Homo sapiens
aaagccgugagaaagugguaagauggcgggagu

SEQ ID NO: 155465 - RNA, 47 nt, Homo sapiens
gagcugacuccuucucuguuucagcccagccugagggcaggguccag

SEQ ID NO: 155466 - RNA, 48 nt, Homo sapiens
gcgacaacagcgaugagcaguguggugggugaccccaacgggggaagg

SEQ ID NO: 155467 - RNA, 45 nt, Homo sapiens
aaugcaggcuggcgcugcgauggugacgcggacugugaugaccag

SEQ ID NO: 155468 - RNA, 1230 nt, Homo sapiens
aauggaauuagguugggcuugaacuaaggagaaggcuuguggagccaaagaggccacuaccggcugggcgcgguggcucaugcuuauaaugccagcacuuugggagaccaagguggguggauugcuugaggucaggaguucaagaccagccuggguaacaugguuaaaccccaucucuacuaaaaauacaaaacuuagcugggugugguggcgcaugccuguaaucccagcuacucgggaggcugaggcaggagaaucgcuugaaccuaggaggcagagguugcagugacccgagacggcgucccuguagcagagugagaugacaucucaaaaaacaagacaauccgggaggugaggggcgccucugccuggccgccccuacugggaagugaggagccccucugcccggccagccgccccauccaggagggaggugggggggucagccccccgcccggucagccaccccguccgggagggaggugggggggucagccccccgcccggccagccgccccguccgggagggagguuggggggucagccccccgcccggccagccgccccguccgggaggugaggggcgccucugcccggccgccccuacugggaagugaggagccccucugccaggccaccaccccgucugggagguguacccaacagcucauugagaacgggccaugaugacaauggcgguuuuguggaauagaaaggagggaaagguggggaaaagauugagaaaucggaugguugccgugucuguguagaaagaaguauacaugggagacuuuucauuuuguucuguacuaagaaaaauucuucugccuugggauccuguugaucugugaccuuacccccaacccugugcucucugaaacaugugcuguguccacucaggguuaaauggauuaagggcggugcaagaugugcuuuguuaaacagaugcuugaaggccgcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugcgagaaacacccaagaaugauaauaaaaaaauuaaaaaauaaaaaaaaauaaaaauaaaaaaauaaaaagaaaaaaaaaaaaagacaaacaggccacuacc

SEQ ID NO: 155469 - RNA, 35 nt, Homo sapiens
auuuauauacucaucauggcaguuuuccagcagau

SEQ ID NO: 155470 - RNA, 46 nt, Homo sapiens
uggggaggacgacugugcagacaacagcgaugaagagaacugugag

SEQ ID NO: 155471 - RNA, 46 nt, Homo sapiens
gcagaggaagcugugcaacggggucaacgacuguggugacaacagc

SEQ ID NO: 155472 - RNA, 93 nt, Homo sapiens
aauguuaacaacgguggcugugcccagaagugccagauggugcggggggcagugcaguguaccugccacacaggcuaccggcucacagaggau

SEQ ID NO: 155473 - RNA, 44 nt, Homo sapiens
gcucggcagccugggagcgggagugggaggacgacagaagggag

SEQ ID NO: 155474 - RNA, 42 nt, Homo sapiens
uguaauaacuggcuguguggccuugggccaguuaaucucugu

SEQ ID NO: 155475 - RNA, 42 nt, Homo sapiens
agaccaagagcauacagagcgcugaccggcugacagggcugg

SEQ ID NO: 155476 - RNA, 41 nt, Homo sapiens
gucuguauggcccucucuucccaccuggccuucugucccug

SEQ ID NO: 155477 - RNA, 150 nt, Homo sapiens
uuuccucucccaccaccuuugucuccugccaagagccaggguguuuguuccccauucccucuggcauagccccugucccugucucucuagcacucucucuuugguugugagagcaugguuuggggcccucuucucuccgucucugccaag

SEQ ID NO: 155478 - RNA, 46 nt, Homo sapiens
gacacgggaacaaaccggauugaagugggcaaccuggacgggucca

SEQ ID NO: 155479 - RNA, 30 nt, Homo sapiens
caggcuccggaauguacaacuccuugucua

SEQ ID NO: 155480 - RNA, 46 nt, Homo sapiens
ucuuuucauuuucuucgcaggaucuacuggguggaugcgcaucugg

SEQ ID NO: 155481 - RNA, 47 nt, Homo sapiens
ucugaaaagucuaagaagcucugccuagaccaaauaugguauaccuc

SEQ ID NO: 155482 - RNA, 58 nt, Homo sapiens
ucccccaggaauuagaaguggcaggagagaacaacaggggcugggaauggaggggaga

SEQ ID NO: 155483 - RNA, 46 nt, Homo sapiens
uuucuugauuggaaagggggaaggaucuuauugcacuugggcuguu

SEQ ID NO: 155484 - RNA, 55 nt, Homo sapiens
ugagcaggauugaaaugcauuccguuguguuucuuggauagaaaaugaugaaagg

SEQ ID NO: 155485 - RNA, 66 nt, Homo sapiens
cuuaaugucugucacacauuguucuagauucagggaauacacuggugaaccagaaaaagacaaagg

SEQ ID NO: 155486 - RNA, 55 nt, Homo sapiens
uuuuaaaaaaguacuucuaucggagaugugaugaaauaugaaugacaggcaugau

SEQ ID NO: 155487 - RNA, 43 nt, Homo sapiens
ggaauuuaaacuaaaaagacaccacacuugggcccauggguug

SEQ ID NO: 155488 - RNA, 46 nt, Homo sapiens
aauuugucacugauuccaaugcagugguucaauugaaaggauuaga

SEQ ID NO: 155489 - RNA, 62 nt, Homo sapiens
gccaaggagcugggcauagagaucugucuuauguacauagagauugagaaaggagaggcugu

SEQ ID NO: 155490 - RNA, 40 nt, Homo sapiens
auagugauauuagauagcuaaaauuggccaguugggaacu

SEQ ID NO: 155491 - RNA, 51 nt, Homo sapiens
gagaaggcuguucgagaugaagccaaacuaauugcuguggagauuuacaga

SEQ ID NO: 155492 - RNA, 45 nt, Homo sapiens
gauauuauuuaaauauuauaugacauuugcaguugaaagaacuag

SEQ ID NO: 155493 - RNA, 46 nt, Homo sapiens
ugaugauggugaugaggugccacaaauagaugcuuaugagcuuuua

SEQ ID NO: 155494 - RNA, 46 nt, Homo sapiens
gaaguacuaauaaaaaaccccaaacuggaagcuggcgauuaugcag

SEQ ID NO: 155495 - RNA, 51 nt, Homo sapiens
aguuugaguucugauucuggcuuuguuucaguuuguuguccugguuaaaga

SEQ ID NO: 155496 - RNA, 73 nt, Homo sapiens
gauuccauuaacuguuaaacauguuguuucuuacuugucccauauacugguguucagcugaaucuggccaagc

SEQ ID NO: 155497 - RNA, 48 nt, Homo sapiens
cucugccuggaaggacugcugcuucaggggcugcaggagauaaggaca

SEQ ID NO: 155498 - RNA, 46 nt, Homo sapiens
uuccaaaacgucagcucagguuguauuagauggccuuguggacaag

SEQ ID NO: 155499 - RNA, 46 nt, Homo sapiens
uuaggaaaguggcaaaaccaagauuuuaauccaggcauucugguuu

SEQ ID NO: 155500 - RNA, 43 nt, Homo sapiens
aggaauuuccaagcauagcacaagugguacagaugaaggagaa

SEQ ID NO: 155501 - RNA, 46 nt, Homo sapiens
ucuaagauuggugauaagaauuggaagauuaggaaagaaggccuag

SEQ ID NO: 155502 - RNA, 45 nt, Homo sapiens
acagaccuuauccuuuguguuccucaucucuacuccugccuagaa

SEQ ID NO: 155503 - RNA, 35 nt, Homo sapiens
aaaacaucuuauaaauugauacauuuaagacugca

SEQ ID NO: 155504 - RNA, 21 nt, Homo sapiens
uaguagaauuaagauuuugau

SEQ ID NO: 155505 - RNA, 46 nt, Homo sapiens
ugaugaaagcacuagaauauuuaaaauugcucuucaccuugcuaag

SEQ ID NO: 155506 - RNA, 41 nt, Homo sapiens
uggaaggaaccaaauccaaaaacucuaagcagagagcaggu

SEQ ID NO: 155507 - RNA, 50 nt, Homo sapiens
ccugaacccaagugaguuaaacucuuucauuuaaauaugagcaguucaug

SEQ ID NO: 155508 - RNA, 87 nt, Homo sapiens
cucaucuacaacacacacauggcagaugagaaauuggagaaggacgagaucaucaaguuguauagcuguaucauuggcaacaugauu

SEQ ID NO: 155509 - RNA, 41 nt, Homo sapiens
ggagagggagggcaaaggucguauuuccacuucaacaggua

SEQ ID NO: 155510 - RNA, 46 nt, Homo sapiens
aaacucucucagcuccgggagucacgggagcagcaccagcauucag

SEQ ID NO: 155511 - RNA, 42 nt, Homo sapiens
ccuccacagcuaacauagacgacuugaaaaaaagacuggaga

SEQ ID NO: 155512 - RNA, 89 nt, Homo sapiens
uuuaguuuacuaaacuagaaguccucauaguuuaaaauggccucagcaggccuaguguauacaaacugguuguauguaucaugccgugg

SEQ ID NO: 155513 - RNA, 45 nt, Homo sapiens
ucgcccugaagggucacuguauucuguaugaaugcauggcaugau

SEQ ID NO: 155514 - RNA, 46 nt, Homo sapiens
uccauaaacagaucuaaaacagcaaucccugaccagugcugugaag

SEQ ID NO: 155515 - RNA, 60 nt, Homo sapiens
cuugguggcucaguuucuuccucuguaaaauggagguaaaagucucuaucccauaagguu

SEQ ID NO: 155516 - RNA, 27 nt, Homo sapiens
cugcagguggugaaccugcccauugug

SEQ ID NO: 155517 - RNA, 45 nt, Homo sapiens
aaccccgacagcagcaccacgggacccuggugcuacacuacagac

SEQ ID NO: 155518 - RNA, 53 nt, Homo sapiens
gcaccuagccauccacccauccaccccuuccccacuccuuccuuggucccucc

SEQ ID NO: 155519 - RNA, 41 nt, Homo sapiens
agcggcggcggcgccgggucgagggcugaguuguccgcgag

SEQ ID NO: 155520 - RNA, 370 nt, Homo sapiens
ucaucggauucaguaccaugauccuaauuugugucacuucauucuuggaaaaaaaaaaauucagccugucgggcgcaguggcucacuccuguaaucccagcacuuugggaggccaaggcagguggaucaccugaggucggaaauucgagaccagccugacuaacguggagaaaccuaaaaauucaaaauuagccgggcgugguggcgcaugccuguaaucccagcuacuugggaggcugaggcaggagaaucacuugaacucgggaggcggagguugcggugagccgagaucacgccguugcacuccagccuaggcaacaagagcgaaacuccgucucaaaaaaaaaaaaaaaaaaaaaucagucuugag

SEQ ID NO: 155521 - RNA, 40 nt, Homo sapiens
aaacauuuugguccucaagcauauuggugaauguugucug

SEQ ID NO: 155522 - RNA, 46 nt, Homo sapiens
ugguagaguuauuuuggaguggaauccgcauuuuuuugcccagugg

SEQ ID NO: 155523 - RNA, 46 nt, Homo sapiens
agcaucugcaugguuuuaacuuccuaucaucuucagagcaagucag

SEQ ID NO: 155524 - RNA, 362 nt, Homo sapiens
gcuuuuuuuuuuuucugacaauauucuuuccuuuuuuuuuugagauggagucucacuuuguuaccuaggcuggagugcaauggcaugaucucggcucacugcaacuuccaccuccuagguucaagcgauucuccugccucagccuuccgaguagcugggauuacaggcgcgugacaccacgcccagcuaauuuuuguauuuuuaguagagacaggguuucaccguguuggccaggcuagucucgaacuccugaccucaggugauccaccugccuuggccucuuaaagugcugggauuacaggugugagcuacugcgccuggcccaacaauauucuugcuguagcuccagggguuuccaggaa

SEQ ID NO: 155525 - RNA, 38 nt, Homo sapiens
uaugagaguaugaaauauuuuuggaagaaaaauucugg

SEQ ID NO: 155526 - RNA, 46 nt, Homo sapiens
uggcuacugagcgccaugaagguugucccagaaaagaaugcugucc

SEQ ID NO: 155527 - RNA, 84 nt, Homo sapiens
uagcuccuggguugacaggaucugaguggacccggacaguacucagucugaacucccgcucugaggcggaauccaugcccccgc

SEQ ID NO: 155528 - RNA, 42 nt, Homo sapiens
agauggagggaauggcuccagccaaaacaacucgggcagcau

SEQ ID NO: 155529 - RNA, 46 nt, Homo sapiens
gcccagcuccagcaggcuggaguugagcagcucugcuaguccgcag

SEQ ID NO: 155530 - RNA, 42 nt, Homo sapiens
gaacugugucacaggaggccuuacaucaggauaugccugagg

SEQ ID NO: 155531 - RNA, 39 nt, Homo sapiens
uucuuuaaucuauauuccgucugcucccggcaccuagau

SEQ ID NO: 155532 - RNA, 46 nt, Homo sapiens
uaggaugucguauaccauaagggcugacagcugucucaaaaaugag

SEQ ID NO: 155533 - RNA, 46 nt, Homo sapiens
ggugucacuguugggcugcugcugcuagguuaggaugacugggaag

SEQ ID NO: 155534 - RNA, 53 nt, Homo sapiens
caauaauucucucauucuaaugggagaaagacaauaaaaaaauaagauaucua

SEQ ID NO: 155535 - RNA, 38 nt, Homo sapiens
gcugcaauuugaaauaggaucaucaaaaaagguuugau

SEQ ID NO: 155536 - RNA, 56 nt, Homo sapiens
agccccuccacucuuccccaaccuccaaacaagaaggcguguuaucgaacugugag

SEQ ID NO: 155537 - RNA, 37 nt, Homo sapiens
caguugaucugcuccgaccacuuuuuuucuuuuccag

SEQ ID NO: 155538 - RNA, 33 nt, Homo sapiens
ccuuccuaggcccucccugauuucuugugauag

SEQ ID NO: 155539 - RNA, 54 nt, Homo sapiens
gaaucuucccucauuucauuaucccguuaugauggagcaggauccagagagcac

SEQ ID NO: 155540 - RNA, 44 nt, Homo sapiens
uucaggugauggggaaguauugcagguaagugaacaguaccucu

SEQ ID NO: 155541 - RNA, 29 nt, Homo sapiens
uguugucauucagauggacagccaacagg

SEQ ID NO: 155542 - RNA, 42 nt, Homo sapiens
aauuuacaguugugggguuggcagguuagcaguguagguuag

SEQ ID NO: 155543 - RNA, 44 nt, Homo sapiens
uaguuccuuuuccacacccuagaaaugacaaacuuaaggaucag

SEQ ID NO: 155544 - RNA, 51 nt, Homo sapiens
agcggggagagccaugggaggaugcgcuaaaggagcagggucagccccagg

SEQ ID NO: 155545 - RNA, 21 nt, Homo sapiens
ugugauuuauuaucugaucuu

SEQ ID NO: 155546 - RNA, 42 nt, Homo sapiens
ccuucccaaauaccccucugagaguuaaucagagaugcacag

SEQ ID NO: 155547 - RNA, 38 nt, Homo sapiens
cgguauuuagcacccuucacuguuccuaaacugucugg

SEQ ID NO: 155548 - RNA, 57 nt, Homo sapiens
uucaguucuuccacuaaauaucccaugcauugaaauuucuuuucccaccccaaccca

SEQ ID NO: 155549 - RNA, 35 nt, Homo sapiens
ucgugcuggguccucuccugucauuucuccuucag

SEQ ID NO: 155550 - RNA, 56 nt, Homo sapiens
guauucaaaugaccuaacauaggauuacguuuucuaauauucuucaccauugacag

SEQ ID NO: 155551 - RNA, 67 nt, Homo sapiens
ugugacagcaucaaggccaugggaucuggccuuuccuaaauaguauguuugauccaacaucaaugcu

SEQ ID NO: 155552 - RNA, 50 nt, Homo sapiens
aggcucuggccuggcaggagagcagacuauaccacaaucuccugacagcc

SEQ ID NO: 155553 - RNA, 49 nt, Homo sapiens
cugccuccaccaccccauacagcaccuccugcuucucuacugccggcag

SEQ ID NO: 155554 - RNA, 46 nt, Homo sapiens
ucugccuugccuccaagaccuccuuacuucaauuuccuguuuccua

SEQ ID NO: 155555 - RNA, 44 nt, Homo sapiens
ugacagcuuccugguaauuacuggaagaacaaaaaacuucugag

SEQ ID NO: 155556 - RNA, 49 nt, Homo sapiens
auuccuuccuaaugcagggaaguuaacugguccaggguacaaaggaaca

SEQ ID NO: 155557 - RNA, 45 nt, Homo sapiens
ucugugggugguugggccccuuggggccaaauguauuucugugua

SEQ ID NO: 155558 - RNA, 45 nt, Homo sapiens
uacguaucuccccaccacuauuaucuaaccacaagccaccccuaa

SEQ ID NO: 155559 - RNA, 49 nt, Homo sapiens
aaguacuugaauggggagaugagggaugaaggggauuuuaguaaacauu

SEQ ID NO: 155560 - RNA, 43 nt, Homo sapiens
gauuuauuuucuugcuuuaacucucuugucaugugcugagugg

SEQ ID NO: 155561 - RNA, 42 nt, Homo sapiens
ccagcagccagaggggcuuuccugaugaaggcauccuggcag

SEQ ID NO: 155562 - RNA, 46 nt, Homo sapiens; identical to SEQ ID NO: 69224

SEQ ID NO: 155563 - RNA, 40 nt, Homo sapiens
guguuaccauacagaaaaaugccaaauuguugccuugaga

SEQ ID NO: 155564 - RNA, 27 nt, Homo sapiens
uaguuggauguacuuguugguccauuu

SEQ ID NO: 155565 - RNA, 81 nt, Homo sapiens
uggaaauauuugacauugggugaauaggagaugucauugugggauguucaucaagucuauuuucuuaucuagauauuugag

SEQ ID NO: 155566 - RNA, 37 nt, Homo sapiens
gcuggcagcucaaggaaugugguucucugcugaggag

SEQ ID NO: 155567 - RNA, 46 nt, Homo sapiens
acucucuaugacucagaaucuuauuuucugucugauucccuucugc

SEQ ID NO: 155568 - RNA, 43 nt, Homo sapiens
agcuuuauucuucaaucuacaaacuucauuaugacucucuccu

SEQ ID NO: 155569 - RNA, 40 nt, Homo sapiens
uuuccagggaguuaauuuaaaagcaaugaaguuaguuagc

SEQ ID NO: 155570 - RNA, 85 nt, Homo sapiens
aacaagcuccuugggcaucucuuggugguacuaaaacccacuuggcaguagacuaaggccuucaaaaauccuccaucucuccagg

SEQ ID NO: 155571 - RNA, 47 nt, Homo sapiens
gccucauaaaccagcccuacaaaugugauagggggaggugcuggcgg

SEQ ID NO: 155572 - RNA, 49 nt, Homo sapiens
aagaacccagagcaaacagugacucauucacccucacugagacccaaga

SEQ ID NO: 155573 - RNA, 44 nt, Homo sapiens
agagaccaugggaggaaaagccacggugcacgucaggcaaagaa

SEQ ID NO: 155574 - RNA, 47 nt, Homo sapiens
cuccuucugcccugggagcuggagccgggugucccaggaggaagugg

SEQ ID NO: 155575 - RNA, 51 nt, Homo sapiens
gaggaagagggucaggguggagaggaagaucagucagugggcacaagacag

SEQ ID NO: 155576 - RNA, 57 nt, Homo sapiens
ucccagauucuugaggacagggacuucggcauuuacuaaugggggacuacugugggg

SEQ ID NO: 155577 - RNA, 46 nt, Homo sapiens
ugggaggagaggggauagucuacagcuaaugagggaaacaccaaag

SEQ ID NO: 155578 - RNA, 45 nt, Homo sapiens
guucgacugggacagggcgccagacccccuccggggcgagcgcgg

SEQ ID NO: 155579 - RNA, 46 nt, Homo sapiens
uuggucacaggggcuagacagugccucugggguagggugcagggug

SEQ ID NO: 155580 - RNA, 42 nt, Homo sapiens
gaugggcccgcgugcgucuguggagcgguguguguguuggcg

SEQ ID NO: 155581 - RNA, 45 nt, Homo sapiens
uggccucacccaccaggucaucugggugaugaggagccagccaca

SEQ ID NO: 155582 - RNA, 46 nt, Homo sapiens
agugucugaacuggggcugccuggcccaccucuguggcccugcuuc

SEQ ID NO: 155583 - RNA, 42 nt, Homo sapiens
gcaagggggcagaaagcaccgauuacagcagaaugggggacc

SEQ ID NO: 155584 - RNA, 28 nt, Homo sapiens
acauuaagauggggcagcugggagguca

SEQ ID NO: 155585 - RNA, 71 nt, Homo sapiens
cugcucguuagcuuuaaucaaucaugcccugccuugucccucucacuccccagccccaccccuaagugccc

SEQ ID NO: 155586 - RNA, 92 nt, Homo sapiens
cugcccgcuucucaggugaggaggcugaggaugcccagggcugcugugaccaggacuaggacuggaaacuugaagguuuucugaucccaagu

SEQ ID NO: 155587 - RNA, 42 nt, Homo sapiens
agggugggccuugaccuccucccaacacuagaaagggcagag

SEQ ID NO: 155588 - RNA, 35 nt, Homo sapiens
gggcagcauuuggucagcucugcccuuucuagugu

SEQ ID NO: 155589 - RNA, 58 nt, Homo sapiens
ccguggcuggagagcugacaaaggcaagccguuccaggacacucucccuggguccuaa

SEQ ID NO: 155590 - RNA, 68 nt, Homo sapiens
cuacaaugcucagugccaggagaccauccgcgucaccaagcccugcacccccaagaccaaagcaaagg

SEQ ID NO: 155591 - RNA, 59 nt, Homo sapiens
ggugcgugugaugggggcacaggcaccaaaguccgccaaggcacccugaagaaggcgcg

SEQ ID NO: 155592 - RNA, 45 nt, Homo sapiens
cccagacccagcgcauccggugcagggugcccugcaacuggaaga

SEQ ID NO: 155593 - RNA, 46 nt, Homo sapiens
augcagcaccgaggcuuccuccuccucacccuccucgcccugcugg

SEQ ID NO: 155594 - RNA, 51 nt, Homo sapiens
accaccgcucggaagauggggccgggagaggccgccgucgcagcgcagagg

SEQ ID NO: 155595 - RNA, 47 nt, Homo sapiens
ggcauaugagagaggaggugggguacccagugagugguuugucugag

SEQ ID NO: 155596 - RNA, 61 nt, Homo sapiens
aacagaguggucggcccaagggaagaguccaaaugucaggggcaaggaagggcugggaagu

SEQ ID NO: 155597 - RNA, 45 nt, Homo sapiens
gucuuggcauggccuaggagaguuugauggugguguuggggccca

SEQ ID NO: 155598 - RNA, 45 nt, Homo sapiens
acucagguacuugguggucucgugggugcuguccaggugaucaug

SEQ ID NO: 155599 - RNA, 95 nt, Homo sapiens
guguagacgccgucugcggccagggggucuuccuucacagucugggagccggaggagaacucgggaaggcagggcacgagggagcccagcaccag

SEQ ID NO: 155600 - RNA, 44 nt, Homo sapiens
ucugcuuugaucacuggcagcugagucaucucucccggggccug

SEQ ID NO: 155601 - RNA, 42 nt, Homo sapiens
uguccuccaucuugaugggcacaagggggcucuggggcgcug

SEQ ID NO: 155602 - RNA, 46 nt, Homo sapiens
caggucauuggagaaguccuccauguucuccguaaagugguccagg

SEQ ID NO: 155603 - RNA, 47 nt, Homo sapiens
acuccaucgcuacuuucauuuuuguuauucuuuuggaaggggaggag

SEQ ID NO: 155604 - RNA, 40 nt, Homo sapiens
ggagagccagugguaggggccaagcucacaggggaagcag

SEQ ID NO: 155605 - RNA, 43 nt, Homo sapiens
gauacagcauuauuuucucucuuugaggaagaauggcccagag

SEQ ID NO: 155606 - RNA, 51 nt, Homo sapiens
aacagaaggaaagccagcuacaaacuuaaaaugugguggguuucucaggaa

SEQ ID NO: 155607 - RNA, 58 nt, Homo sapiens
uuucucuucuccaaaauacgguggguauggggaggguugguuaaguaggcgcacacag

SEQ ID NO: 155608 - RNA, 52 nt, Homo sapiens
gcucuggggccgcgucuccuccccucacuccccaaggggaggggccaguguc

SEQ ID NO: 155609 - RNA, 49 nt, Homo sapiens
uagaguccaacuguuguacguaugucaccuucacuagaaaugucccauc

SEQ ID NO: 155610 - RNA, 43 nt, Homo sapiens
uguugagaaagaugucaugcaaaaggacgacgguggccaacua

SEQ ID NO: 155611 - RNA, 48 nt, Homo sapiens
gagcuugugucccugggcaacugagcagccuccugaaugcuccuuuug

SEQ ID NO: 155612 - RNA, 50 nt, Homo sapiens
gccagcccccaaauagcuauuguuucaaaugguuccccauaauccccaaa

SEQ ID NO: 155613 - RNA, 74 nt, Homo sapiens
gucacuuaaaauuuaaacugaucugguaggaaagcauggccuccaaucaguagguucuacacuuaccucagauc

SEQ ID NO: 155614 - RNA, 74 nt, Homo sapiens
auuuccucuguaauuuuuaauugugugacuuugggcuggauccauagccuuucugccaugcuuuagguguaaga

SEQ ID NO: 155615 - RNA, 49 nt, Homo sapiens
aguuugaauccuagugcagaguccuguggugaggccccuucccacugcc

SEQ ID NO: 155616 - RNA, 41 nt, Homo sapiens
uaauaccuaggaaugcacauuuggguaaaaaaaaaaaagcu

SEQ ID NO: 155617 - RNA, 25 nt, Homo sapiens
auuaaauuaaaaaggaaugguggaa

SEQ ID NO: 155618 - RNA, 42 nt, Homo sapiens
ggguuccccacugaaggacuugguccagcugucuggcaggga

SEQ ID NO: 155619 - RNA, 46 nt, Homo sapiens
cucacccagccagaugggccuugcguaagcuacuucuuggccaaga

SEQ ID NO: 155620 - RNA, 68 nt, Homo sapiens
agcauuagggcuaccugacccaggaggcauggcaucuucuagaagcuggaggagaauaggccagaguc

SEQ ID NO: 155621 - RNA, 102 nt, Homo sapiens
acugcuucuguaagccuccaguagucagggaaugugacugugaugugccauuucuauuguugacagagaaaaaugcuggggauggguggagacccaaggggu

SEQ ID NO: 155622 - RNA, 50 nt, Homo sapiens
gggcuguuugagaauuaaaugagguaauguaugugaaacaaguagaauag

SEQ ID NO: 155623 - RNA, 42 nt, Homo sapiens
ccuucuuguuacauugucacagaguuucuucuuuuauugggu

SEQ ID NO: 155624 - RNA, 45 nt, Homo sapiens
ugggagaccagagggacaggugccacucagggccagaggagccac

SEQ ID NO: 155625 - RNA, 45 nt, Homo sapiens
acagaccggccuuccuuuggaggaaaguguggccuggacugaggg

SEQ ID NO: 155626 - RNA, 45 nt, Homo sapiens
caaggccugugcccagacagugcuggccgugcucuacuacgagga

SEQ ID NO: 155627 - RNA, 27 nt, Homo sapiens
guuuuaaugucuuucuccucugcuagc

SEQ ID NO: 155628 - RNA, 40 nt, Homo sapiens
caggaaagcgaggcaguaagaguccagguucugggauuau

SEQ ID NO: 155629 - RNA, 35 nt, Homo sapiens
ccucucccuugcccugugucuugucucagagcccc

SEQ ID NO: 155630 - RNA, 61 nt, Homo sapiens
ccugugaggggagaagaggcuggggccuaacagggaggggucgcagagagaagggagggga

SEQ ID NO: 155631 - RNA, 35 nt, Homo sapiens
cgggggucucgggcuugggagagggccugggggcg

SEQ ID NO: 155632 - RNA, 74 nt, Homo sapiens
uucuuagcucgaggagagacacaaaacuggaacaacagaaagaaggcgcucuggggaaaaggacuuggccaugg

SEQ ID NO: 155633 - RNA, 90 nt, Homo sapiens
gguaaaaucuggaucaggacaagcugugggcacauggacagugacuggcaugaaauaaucauucuuuucccaggugagggcugugguaag

SEQ ID NO: 155634 - RNA, 59 nt, Homo sapiens
cagcaagugucugccaagaugguuucagaacagaugagguaaacgaggggaagaggcug

SEQ ID NO: 155635 - RNA, 81 nt, Homo sapiens
gucagagcauuuucaggugccagacagccaugugcagacaccuagcaggcaucugggacagugaggcugagcaggggaggu

SEQ ID NO: 155636 - RNA, 51 nt, Homo sapiens
gauuuggguggcggaaggggauugaggagaggagauuaagaagaggugaag

SEQ ID NO: 155637 - RNA, 48 nt, Homo sapiens
ugaggcagggauucagugcacaugauugauuaagaaaugagaagggga

SEQ ID NO: 155638 - RNA, 55 nt, Homo sapiens
cauugcuucucuuuuacgccuauuauucaacauuucucaaaauagcugucguuaa

SEQ ID NO: 155639 - RNA, 39 nt, Homo sapiens
auaaucgagauguguuugcauucgugcgugugugugugu

SEQ ID NO: 155640 - RNA, 33 nt, Homo sapiens
cucuuuccagugcuggacuguuccagcccuccu

SEQ ID NO: 155641 - RNA, 43 nt, Homo sapiens
ggaaaaugccaaaggcugggcaugcucugacucggcacucaga

SEQ ID NO: 155642 - RNA, 64 nt, Homo sapiens
ugaccucuugacucaggagccguguaccagauucauuccaaaccaagauacagaaaaccugaga

SEQ ID NO: 155643 - RNA, 44 nt, Homo sapiens
ugucagaguuauguguauuuccauuuagcaucgagugcccaaag

SEQ ID NO: 155644 - RNA, 43 nt, Homo sapiens
auagcauuuucuuaaaggaaacugaauaggauauguuggugag

SEQ ID NO: 155645 - RNA, 80 nt, Homo sapiens
ccucaggaugggaaaagacuuucuaagcauaaaaaucaugaagacgagccaaagaaaggucaguagaguugacucuaaaa

SEQ ID NO: 155646 - RNA, 46 nt, Homo sapiens
aaaaaaagaauaacccaaccaccaccaaaaaacaaacuccauguag

SEQ ID NO: 155647 - RNA, 89 nt, Homo sapiens
gaccaagguagagaaggagaaaaagggaugauucaauggcaugagcucagaggaacagggauuuuuauucucugcuucagaauaaugau

SEQ ID NO: 155648 - RNA, 41 nt, Homo sapiens
agcagagugagccagcuugaggagugucacagguggugaga

SEQ ID NO: 155649 - RNA, 72 nt, Homo sapiens
guggccuguggaucauaaaugguaauuggguuuuugaguucccaucucuaggaccauuuaaugguuuggaga

SEQ ID NO: 155650 - RNA, 86 nt, Homo sapiens
ccaauaaguaagaaaauuugccugagauuuuaacaaaguugccugaggaaagggauuugggaagaaauauaaacauguugguacuu

SEQ ID NO: 155651 - RNA, 103 nt, Homo sapiens
gaacagcgcuuuauccugccgugccccaugcuguagcuuucucuucuccucagccuucuuggagccuauuuugaugaacaugaaugauaauacaggccaugaa

SEQ ID NO: 155652 - RNA, 58 nt, Homo sapiens
gcaauuuccaaauauuaugcauucacaauauucuggugcccagaaauaccccguuucu

SEQ ID NO: 155653 - RNA, 50 nt, Homo sapiens
uauucaguuacuguuucuuuacacacauauauucaccaccaccaugcccc

SEQ ID NO: 155654 - RNA, 47 nt, Homo sapiens
uauuggaauuucacuuuggaauuuauucucuugaacaaagguuuauu

SEQ ID NO: 155655 - RNA, 50 nt, Homo sapiens
uucacugacuugcuucaaauggugccaacuuuuuccuuucuucauagaaa

SEQ ID NO: 155656 - RNA, 75 nt, Homo sapiens
aagcaacagaagcccagagcccugagaugugcuugcugccuguuaaauguauccccuauuccacauucuccagag

SEQ ID NO: 155657 - RNA, 50 nt, Homo sapiens
gauuccaagcaguugauugcugcuggaggaugaugaguuuaugggagcug

SEQ ID NO: 155658 - RNA, 46 nt, Homo sapiens
uaggauuuuugaaaggugaaugagaguuuuccacuggaccaaagcu

SEQ ID NO: 155659 - RNA, 68 nt, Homo sapiens
aaucagauaaauuguaaucuuguacaucaugaaaaaauagacuguaaggucuagugguaacacagagg

SEQ ID NO: 155660 - RNA, 50 nt, Homo sapiens
uucuugcccaugaucaaucuguuuguuaugcuguuugacugcuugcagau

SEQ ID NO: 155661 - RNA, 42 nt, Homo sapiens
gccagaccuggaagaacaaagagcaucaucucucugacagag

SEQ ID NO: 155662 - RNA, 30 nt, Homo sapiens
aguuaacaaauucugggacucuacaaauug

SEQ ID NO: 155663 - RNA, 46 nt, Homo sapiens
gcaaccaugguauacaacaaaaauacauuucuuuggugauugaaau

SEQ ID NO: 155664 - RNA, 48 nt, Homo sapiens
uuugacacuugaagaaauggagaucgauuugauuuguuuauaagcaga

SEQ ID NO: 155665 - RNA, 65 nt, Homo sapiens
uuuugaaaaucugaccuugucauuucaauaguuauuaacaugacuaaauauuaucuuaauuaaga

SEQ ID NO: 155666 - RNA, 47 nt, Homo sapiens
agucaugaauaugaacaagucuacacgggcucacuaucugaagaaaa

SEQ ID NO: 155667 - RNA, 47 nt, Homo sapiens
uaaaaucuaccuauaaauaaaaacaacacuauaauaaaacauuaaau

SEQ ID NO: 155668 - RNA, 32 nt, Homo sapiens
uggugguucugucucaauguugaguuuacuaa

SEQ ID NO: 155669 - RNA, 44 nt, Homo sapiens
aaagaaaaaaagggaggugguucuaucuuaucaauaaaauuguu

SEQ ID NO: 155670 - RNA, 40 nt, Homo sapiens
auaggagccccagcuucugccuuaagagugugugcuggcu

SEQ ID NO: 155671 - RNA, 46 nt, Homo sapiens
gccagaguggacaucccagugucuaguacaugcucugcccucugaa

SEQ ID NO: 155672 - RNA, 34 nt, Homo sapiens
gaucuuauuaaaauacaaaucagauaauguugcu

SEQ ID NO: 155673 - RNA, 45 nt, Homo sapiens
agccugcuuccucuaaaccccgaccugagcuuucauccaagggaa

SEQ ID NO: 155674 - RNA, 46 nt, Homo sapiens
aaugcaucuagucaauguguaaauguacauagcaggcacaagauag

SEQ ID NO: 155675 - RNA, 106 nt, Homo sapiens
gcaguuuuccaguagacugagaagaaaaggaaaauacccuacuugaguuucaaaagaaccagaguuggagacauacuauauacuuacaauaaacuuaauguaaacu

SEQ ID NO: 155676 - RNA, 47 nt, Homo sapiens
auccaaaggggcuauucugaacauuucaucuggcaguggcaugcucc

SEQ ID NO: 155677 - RNA, 46 nt, Homo sapiens
gagcuauuuuuaguugauugaauuaugucucauuuacugaccaagc

SEQ ID NO: 155678 - RNA, 32 nt, Homo sapiens
uaaguaaaaauucucagcacuguggcuagaga

SEQ ID NO: 155679 - RNA, 70 nt, Homo sapiens
uuuuauuaaguaccuguugguuaugugcucaguaccguguggaauauuuugagggaaagugggcuauuau

SEQ ID NO: 155680 - RNA, 49 nt, Homo sapiens
uugggaaguaaauucagacaaagaacaaugagaaaguggguuaaggaaa

SEQ ID NO: 155681 - RNA, 48 nt, Homo sapiens
guaggacagagauuuguagaagggcuauuuucucuacugucacuuugg

SEQ ID NO: 155682 - RNA, 52 nt, Homo sapiens
gaugugggagauuuuccaaacccucuagaacuauagccuagggccaacugac

SEQ ID NO: 155683 - RNA, 47 nt, Homo sapiens
acaacuacugcacagaaggccagaaauauuagcuguaugcccaaaga

SEQ ID NO: 155684 - RNA, 42 nt, Homo sapiens
aaauggugggaaguuuucagaagcuaugacugaaccugacac

SEQ ID NO: 155685 - RNA, 46 nt, Homo sapiens
caagauuguugccaaaaguaugagaaauauauacaaacacuaagaa

SEQ ID NO: 155686 - RNA, 42 nt, Homo sapiens
agucccucugggcugcucuaacaaaauaccuuagauugggua

SEQ ID NO: 155687 - RNA, 83 nt, Homo sapiens
auucugaacugaaaaaacugaacugaaauuuuaguucaaguucuuugggaauaagggucacacugauuguguguggcccuaga

SEQ ID NO: 155688 - RNA, 30 nt, Homo sapiens
ccaguuucauccgaugguuuuacuuuuuaa

SEQ ID NO: 155689 - RNA, 61 nt, Homo sapiens
ccugagaccaaagaaauuguaggucaccaccagauaaaaugguagugauguggccagaaaa

SEQ ID NO: 155690 - RNA, 47 nt, Homo sapiens
ucaguagcaauggcuguuuggagcccugggguaacuuaaaagaagau

SEQ ID NO: 155691 - RNA, 58 nt, Homo sapiens
uucugaucacaguugacuagugaccauucagauagaaaauggcuugacgggagcagug

SEQ ID NO: 155692 - RNA, 43 nt, Homo sapiens
auaagauucaguuuaagugagguaaacuaauuauaaguggacc

SEQ ID NO: 155693 - RNA, 57 nt, Homo sapiens
acuuaaauguugugauaagcauuguacggggaauauggaaguauaaagcaaugggug

SEQ ID NO: 155694 - RNA, 67 nt, Homo sapiens
guccagcugccugugguucacacgcuggcucuucuguuuacuaccugaguucccuggguaugggccu

SEQ ID NO: 155695 - RNA, 46 nt, Homo sapiens
uaugaguauccugaauacuuuuuggauguuccugacuuggacaaug

SEQ ID NO: 155696 - RNA, 51 nt, Homo sapiens
uuaaugaaggaagagacauuuaaguuggacuuuuaaggauagauuuuggac

SEQ ID NO: 155697 - RNA, 46 nt, Homo sapiens
cuggucauacguaauaaaaguaggguacuuugggcuugggcacaaa

SEQ ID NO: 155698 - RNA, 48 nt, Homo sapiens
uugggauauguuaagcuuaagaggguggugagaaagccauguaggaau

SEQ ID NO: 155699 - RNA, 43 nt, Homo sapiens
cuuagugugucaguagaacugacaaaagcccugugaaucugga

SEQ ID NO: 155700 - RNA, 36 nt, Homo sapiens
gacuuuagagauuuuuccuaaucuaacucucaugaa

SEQ ID NO: 155701 - RNA, 44 nt, Homo sapiens
agauauuuaugauaaaauuaaaacaggcuuggcuggucuugaaa

SEQ ID NO: 155702 - RNA, 22 nt, Homo sapiens
augcagaagagugaauuugguu

SEQ ID NO: 155703 - RNA, 172 nt, Homo sapiens
uuggcucuuacucugagugagagggaaaucucuggagguuugugaagagguggguaucauggucugaccuacguuaaauaggaaaagccgggaacgauggugugugccuauagucccagcuacuaaggaggcuuaagcccaggcuugagaccccaucucuuaaaagaaaaaa

SEQ ID NO: 155704 - RNA, 44 nt, Homo sapiens
ccuauggcuagaacugaggagcaacggggagaguaguuggaggu

SEQ ID NO: 155705 - RNA, 48 nt, Homo sapiens
cucugagaagguaacauuugcucaaggacccaccagagacaagggaug

SEQ ID NO: 155706 - RNA, 103 nt, Homo sapiens
auagacaagcauguacauuauuaaaauacacuaccuaguguauuagaaggugguaaguacaaugggauaaaauaaagcagggaagggcaugaggagugcuggg

SEQ ID NO: 155707 - RNA, 45 nt, Homo sapiens
auggcaauggcccuccaggaaaggagccagccuaagggaaaagag

SEQ ID NO: 155708 - RNA, 58 nt, Homo sapiens
cuuuauuuacucauuuaacaaacauugagcagaaugaccucugcuuuaugccagacau

SEQ ID NO: 155709 - RNA, 43 nt, Homo sapiens
aaaucaacguuguuauaugaaaauuucuucaagagugguuugu

SEQ ID NO: 155710 - RNA, 54 nt, Homo sapiens
ggcacuacuuaguauguauuucuugaauuuauucaaucaaaacauuuauugagc

SEQ ID NO: 155711 - RNA, 86 nt, Homo sapiens
agguaaaauagcacucugcaagaaugaguugcuuucucuuugaugcuuuguuuauauuuauuagagcagcaauuggguuuacacau

SEQ ID NO: 155712 - RNA, 41 nt, Homo sapiens
cauccacagggauucuuaaaacaugcuguucguuuucugca

SEQ ID NO: 155713 - RNA, 48 nt, Homo sapiens
ccacaaauuaaguagcuaguccuauuuguuaucuuggaccauacaacc

SEQ ID NO: 155714 - RNA, 54 nt, Homo sapiens
cucuccuaaguaauuguaacacacaggaggaaauauaaacuuguuauaggacca

SEQ ID NO: 155715 - RNA, 42 nt, Homo sapiens
gacuaaugaagcagcugcuuuguucucugccugccaccuguc

SEQ ID NO: 155716 - RNA, 53 nt, Homo sapiens
aaaaauaauaacaguaaacccuuuacauguuaacacuacacauuuugagggaa

SEQ ID NO: 155717 - RNA, 52 nt, Homo sapiens
uuguuuacauaggauaccacuaucaauguuuaucacauuauaaauugaaacu

SEQ ID NO: 155718 - RNA, 40 nt, Homo sapiens
acuugcaaauuaaaaaggaaauaauaguaacuuuuauagu

SEQ ID NO: 155719 - RNA, 62 nt, Homo sapiens
gcagcaccuacuugcuuuuauuaggaccucuucacuugcuuaaguaauggacuuggcacuga

SEQ ID NO: 155720 - RNA, 50 nt, Homo sapiens
aaaaaaaacagacaaauaaauaauugcagccuauauugaaugccacaaag

SEQ ID NO: 155721 - RNA, 118 nt, Homo sapiens
guaaagacacugaauugaccuuuauuaaaaggcauggguuuuuauccuuguuaaaauuuuugaaaaauguuuuucugggcauaauaugaauuuaauaggagaggugauaucagcagac

SEQ ID NO: 155722 - RNA, 52 nt, Homo sapiens
aguuagcaaagcauggaaugaagguuguccuuaucagcagaucaaaggauaa

SEQ ID NO: 155723 - RNA, 44 nt, Homo sapiens
guugucacagguaguacugauggaauuggaaaaucauaugcaga

SEQ ID NO: 155724 - RNA, 51 nt, Homo sapiens
auugguggguuaagguaggcauauuuuuaguucugaacauauuggcaaaua

SEQ ID NO: 155725 - RNA, 45 nt, Homo sapiens
aagaacgggaccaggcgaaugcguuagaaggcuguuaacaguagu

SEQ ID NO: 155726 - RNA, 23 nt, Homo sapiens
auggaggaaguugcugcuguuuu

SEQ ID NO: 155727 - RNA, 46 nt, Homo sapiens
acuuguaaaggauaguaaauucacuuuugcauuuuagauaguagcu

SEQ ID NO: 155728 - RNA, 112 nt, Homo sapiens
aagacuuugccauuacuuggauggcauaccagcugcaauggaggaaguauacagauguauauuggaggauguauuuauauuuuaauguguagcuaucugcugucaagaauua

SEQ ID NO: 155729 - RNA, 61 nt, Homo sapiens
cuuuuaggagugagaaguggucauacgugguauguauuagacaggucuuauggauuauuga

SEQ ID NO: 155730 - RNA, 46 nt, Homo sapiens
augaaauauccuguaggacauaaaaaaacuugagcucuuauucuga

SEQ ID NO: 155731 - RNA, 349 nt, Homo sapiens
acaugggguaagaguguuccaggcaggcugagccucguggcugaugccuguaaucucagcacguuuggaggcugaggugggcagaucaccaggucaggagaucgagaccauccuggcuaacauggugaaaccccaucucuacuaaaaauacaaaaacauuggcugggcaugguggcacgugccuguagucccagcuacucgggaggcuaagccaggagaaucgcuugaaccugggaggcagagguugcagugagcuaagaucgcaccacugcacuccagccugggugacagagcgagacuccaucucaaaaaagaaaaagaauguuccaggcagaggaaaaagcaagug

SEQ ID NO: 155732 - RNA, 68 nt, Homo sapiens
uaguaaauagguaguugggguggggauauuuuagauaggguggucaggaagcccucucugaagacaug

SEQ ID NO: 155733 - RNA, 55 nt, Homo sapiens
gagaccauuuuuaaauuucagaucuuucgccaguuguagagacuguuuugggccc

SEQ ID NO: 155734 - RNA, 49 nt, Homo sapiens
cagaacugucuuuacuuugggucugccuauugaagaaaaggucauuaag

SEQ ID NO: 155735 - RNA, 46 nt, Homo sapiens
gaguuuucuaugaauguuauuagggauugauucuaugucccaaaag

SEQ ID NO: 155736 - RNA, 51 nt, Homo sapiens
cauauuuguagcugaguagcuuuucaaccugcuucuuaccuaugugaaguu

SEQ ID NO: 155737 - RNA, 47 nt, Homo sapiens
uuaauuuaaaaaauccucugacuuuuuaacaaacccguagauuaaau

SEQ ID NO: 155738 - RNA, 47 nt, Homo sapiens
agaugcuauauuuuauagucuacagaaaaguguggugccucagcaau

SEQ ID NO: 155739 - RNA, 28 nt, Homo sapiens
aggagacuggugaugguaaaccaggcau

SEQ ID NO: 155740 - RNA, 40 nt, Homo sapiens
caaacuacugauuauguugaugacacuuaauucccaagga

SEQ ID NO: 155741 - RNA, 48 nt, Homo sapiens
uaguagguuuuggugguuguugcauguuggccucacucugccugaggu

SEQ ID NO: 155742 - RNA, 46 nt, Homo sapiens
ugaaauuugaacuggaacacuggaacagcagaggaucauaguauca

SEQ ID NO: 155743 - RNA, 47 nt, Homo sapiens
aggauuuuuaaaauggaggacgaaggucagguugaggaaauagggaa

SEQ ID NO: 155744 - RNA, 33 nt, Homo sapiens
uaaaaggaauucucgcuaaacuguucuggaguc

SEQ ID NO: 155745 - RNA, 62 nt, Homo sapiens
guuugaauauuggcccugugcuaaggaugcagagcauucuguuaacauguuugggcagagga

SEQ ID NO: 155746 - RNA, 50 nt, Homo sapiens
uggggaguggggaaugaggcgggggucggcccggggcucggagaaugggc

SEQ ID NO: 155747 - RNA, 69 nt, Homo sapiens
ccuucagaaacacacauuucuuaaaaggaaagugcagcuucaagauauuguguaaauacugagccaaga

SEQ ID NO: 155748 - RNA, 41 nt, Homo sapiens
cauuucuccaaagaugauaugcaaacagccaacaagcauau

SEQ ID NO: 155749 - RNA, 49 nt, Homo sapiens
accuagaagacauuaaacauacaugaagccuuuaauuaauguaguuuga

SEQ ID NO: 155750 - RNA, 60 nt, Homo sapiens
uuaauccugaagaguagaaggcugugugacaauagaggcagaguuaugcagccacaagcc

SEQ ID NO: 155751 - RNA, 65 nt, Homo sapiens
aaacacagaaagggacauagaggacagaagugacaagugacgaaaauaagagaguuaaagaaaaa

SEQ ID NO: 155752 - RNA, 94 nt, Homo sapiens
aacuugagugccaggccaaacaggucaguaguagaaaaauuuugucacagaacugacgacaaaauuggaaggagcagcaagaggaauacaucac

SEQ ID NO: 155753 - RNA, 337 nt, Homo sapiens
uuaggccaggcacaguggcucaugccuguaaucccagcacuuugguggacaaggcaggaggaucauuugagcccaggaguuugagccagccugggcaacauagcgagacccuaucucuacaaaaaaauuaaaaugcucacacacaccuguagucucagcuacuugagagauugagguggaaggaucgcuugagcccagaaaguugagguugcaguaagcuaugaucaugccacugcacuccagccugggcaacagagugagacccugucucaaaaagaaaaaaaaauucgccugcauaaauaaagaucacaaagcaaaaauauaaaaacacaggaga

SEQ ID NO: 155754 - RNA, 381 nt, Homo sapiens
acagcacugauacaaaaauaaaagaaaaccggucgggcccgguggcucacaccuguaaucccagcacuuuggaaggccaaggcagguggaucacuugaggacagggguucaagaccagccuggccaacauggugaaaccccaucucuacuaaaaauacaaaaaucagccgggugcgguggcacgcaccuguaaucccagcuacuugagagagugaggcaggagaaucagugcuaacccaggaggcggagguugcagugagccaagaucgcgccacugcacuccagccugggugacagagugagacucugucucaauaaauaaugaaugaaugaaugaaugaaugagugaaugaaugaaaaccauaggaaaaagcagcaaaa

SEQ ID NO: 155755 - RNA, 71 nt, Homo sapiens
caauuucagaaaacgucagcaaaauucuacuaccugaaggaacuuucuacagguagcccaaccaggaaaau

SEQ ID NO: 155756 - RNA, 40 nt, Homo sapiens
cugugguacagugcccaacucagcauuagcaguaucaucu

SEQ ID NO: 155757 - RNA, 46 nt, Homo sapiens
auguuucuacuaaguuggaguugucuuuauaaaaucaaaauacaga

SEQ ID NO: 155758 - RNA, 104 nt, Homo sapiens
uuuguagauuauuuuuguauauauuuacagaauauaugauaagcagaggguaucaauaucauuuaaagagcaccuacaaaucaauaugaaacauacaguauuuc

SEQ ID NO: 155759 - RNA, 45 nt, Homo sapiens
aaaggagaucauaagaaaacuccugggaaaaaaguagaaacaggu

SEQ ID NO: 155760 - RNA, 53 nt, Homo sapiens
uuucaacaggcauggccuuuggaaggcuuugggggugcacuagagaugaaagg

SEQ ID NO: 155761 - RNA, 61 nt, Homo sapiens
gcaaugguucugaugagauggagaauucagaugaaaccaaaaugucagaagaaauacuggc

SEQ ID NO: 155762 - RNA, 32 nt, Homo sapiens
uguuuucuucuuuaacaaucauuauauuguag

SEQ ID NO: 155763 - RNA, 48 nt, Homo sapiens
uuuccgugcuguagucauuuaagagaaggccacauggcaagaccaaga

SEQ ID NO: 155764 - RNA, 42 nt, Homo sapiens
uggaucugaaagccaaaaugccagaugaccaugcacgaaaag

SEQ ID NO: 155765 - RNA, 46 nt, Homo sapiens
cccaaaccccugacuguuccauaacugacuucagaaaaagccacac

SEQ ID NO: 155766 - RNA, 46 nt, Homo sapiens
auaguuuacauugccagugggaccagccuguacgcuaucaucgugg

SEQ ID NO: 155767 - RNA, 48 nt, Homo sapiens
cugauucaggaggagcaaaucuuaagaaauaucauucaugagacucag

SEQ ID NO: 155768 - RNA, 35 nt, Homo sapiens
acuacucuuuguuucaugagucaugcuaguugcca

SEQ ID NO: 155769 - RNA, 99 nt, Homo sapiens
caaacguucuacacagagcacacuucucugcugaugcugcugucgugguccaugcagcucuggaugacagugacuucuucaccagcuauuacacuuugg

SEQ ID NO: 155770 - RNA, 52 nt, Homo sapiens
agugauaauuguguaauauacuuuccauuuccauuaaggaaaaaauauguag

SEQ ID NO: 155771 - RNA, 79 nt, Homo sapiens
aguagaaugugccaugcgagcacuucacuucucuuccagguaagauuccuccucuucuggaccugauuuuccacauucc

SEQ ID NO: 155772 - RNA, 46 nt, Homo sapiens
gagacacaggacuggaacagagacauaauaaagaagacccagacug

SEQ ID NO: 155773 - RNA, 23 nt, Homo sapiens
ucucaugaaggaaagugaaggcu

SEQ ID NO: 155774 - RNA, 48 nt, Homo sapiens
uccuucaggguuuccccuuugugagggugucgaguagccucaccggcc

SEQ ID NO: 155775 - RNA, 45 nt, Homo sapiens
uucagauucuaggagauaaguuuccaugcacuuugguggcacaga

SEQ ID NO: 155776 - RNA, 40 nt, Homo sapiens
guaaccggggaucaccauggcggccucauugguggggaag

SEQ ID NO: 155777 - RNA, 46 nt, Homo sapiens
uaaugagacaagaagcaacaguuaacuaccucaaagaauuagaggu

SEQ ID NO: 155778 - RNA, 57 nt, Homo sapiens
agcaaaaaguauggggcaacaagagacaaugaaaaagauaagcagaagaaaauaauc

SEQ ID NO: 155779 - RNA, 46 nt, Homo sapiens
ugcuuggccccuggcuguugggcuccgcgcggccccgcccccagcc

SEQ ID NO: 155780 - RNA, 60 nt, Homo sapiens
auaauuuuaccacuuuuugucuuuauaagcauauuuguaaacucagaacugagcagaagu

SEQ ID NO: 155781 - RNA, 42 nt, Homo sapiens
augcaggugucuucauuaccauuaccucuacacugcagaaga

SEQ ID NO: 155782 - RNA, 46 nt, Homo sapiens
auuauuguauaaguuagccaauagaauuuuuagguuaaaacaacag

SEQ ID NO: 155783 - RNA, 46 nt, Homo sapiens
ucauuggauugccggggaugucccuuuaaacagacugcugccuuca

SEQ ID NO: 155784 - RNA, 42 nt, Homo sapiens
aggggaaguagagguggccgagguuggggcacacgaggaaau

SEQ ID NO: 155785 - RNA, 35 nt, Homo sapiens
cucuaagucuaaacagucaaaaaugcagaagucau

SEQ ID NO: 155786 - RNA, 46 nt, Homo sapiens
augcaacauuaaacaguaagcacuuaaagaaaaauaugccucuugu

SEQ ID NO: 155787 - RNA, 46 nt, Homo sapiens
ucaccacccaagaaaucuucagcaggaccaaaaagagaugccaggc

SEQ ID NO: 155788 - RNA, 42 nt, Homo sapiens
accaguugggccgaaaacuuccagauuucuuaacagccaaac

SEQ ID NO: 155789 - RNA, 45 nt, Homo sapiens
uaccuugacuaccccaguggaaggucuugauauacaguuggaggu

SEQ ID NO: 155790 - RNA, 62 nt, Homo sapiens
auacuucaaggagaggacauuguuagagaacgagcaauuaaauuccuuucuacaaaacuuaa

SEQ ID NO: 155791 - RNA, 57 nt, Homo sapiens
ugcagaauuuaaccuagugaacaaugcccuauuaaguauauuuaaaauggaugcaaa

SEQ ID NO: 155792 - RNA, 42 nt, Homo sapiens
augccuaucaagugauauuggauggugugaaaggugguacua

SEQ ID NO: 155793 - RNA, 45 nt, Homo sapiens
auacggauguucugcuguacauguggauagaguguguaggucggu

SEQ ID NO: 155794 - RNA, 37 nt, Homo sapiens
gacuuuucugagcugaacgaaaaaaaaaaaauuucau

SEQ ID NO: 155795 - RNA, 359 nt, Homo sapiens
ugugaggcccggcuugguggcucacgccuguaauccgagcacuuugggaggccgaggcgggcggaucacgaggucaggaguucgagaccagccugacccacauggugaaacccugucucuacuaaaaauacaaaaauuagccgggcguggugacacgcgcuuguaauccuagcuacucaggaggcugaggugggaggauugcuugaacccgggaggcagagguugcggugagccgagaucgcuucacugcacuccagccugggagacaaagcaagaccccgucucaaaaaaaaaaaaaaagguuuuuuuuaaaaauuuauucuuuuuaaugaaacauguuugaagaaaauaaaacaggg

SEQ ID NO: 155796 - RNA, 64 nt, Homo sapiens
cgagcgcuggagauacagauggaaagguccgcgcucucccagaauguacaguuaggagggagug

SEQ ID NO: 155797 - RNA, 60 nt, Homo sapiens
ucgguggagcucagugcuuccaagauuagaucgggaguuuucuucaugaggucaagaugu

SEQ ID NO: 155798 - RNA, 85 nt, Homo sapiens
agaccuucccugcaggaaucucaucucgacggcuugugguggaucaccacgagcuaccauaaucccaucgcuggccuccaggauu

SEQ ID NO: 155799 - RNA, 35 nt, Homo sapiens
gugagcauccuucugcuucacuuggagagaaauua

SEQ ID NO: 155800 - RNA, 45 nt, Homo sapiens
ccacauuaauuccagacuuaaucguuuucuucagcaucucuagca

SEQ ID NO: 155801 - RNA, 53 nt, Homo sapiens
gggaugaggaaacaagaagggggccuauccaguugggaccacaauacaaaauu

SEQ ID NO: 155802 - RNA, 79 nt, Homo sapiens
gcgcauggacaguuuugaguggaggaguacccucauguggcucauauuuugacaggaucaucuggcugcuguguugaga

SEQ ID NO: 155803 - RNA, 40 nt, Homo sapiens
uaaguaggaaggugcucaaggaggccugcgaggagagugg

SEQ ID NO: 155804 - RNA, 49 nt, Homo sapiens
cuugagucagaagggagucuggaagcagaauuccuucuuuucccgggaa

SEQ ID NO: 155805 - RNA, 46 nt, Homo sapiens
guugccugcuuuaaugucuggauaagaacuugccuguaauugguag

SEQ ID NO: 155806 - RNA, 42 nt, Homo sapiens
auuuuuggcccaucguucaacccaggaacucugcuugucaga

SEQ ID NO: 155807 - RNA, 32 nt, Homo sapiens
gagcagaaggcacugcuacaaggaggcaaguu

SEQ ID NO: 155808 - RNA, 44 nt, Homo sapiens
gaauuuaccuucucuguauauaugugcauaaagugugguguaaa

SEQ ID NO: 155809 - RNA, 48 nt, Homo sapiens
cugugggagaugcaccccauucuugggcccccccucauucccuuuccg

SEQ ID NO: 155810 - RNA, 76 nt, Homo sapiens
ugucagggaccagccggccaacgcccacccgcaaaggugucuaaaaacuucagcuuuucacccaccugccccuuuc

SEQ ID NO: 155811 - RNA, 39 nt, Homo sapiens
gccacccccuccuacgccccggcgcgggcgcagccaguc

SEQ ID NO: 155812 - RNA, 59 nt, Homo sapiens
gcuaacauuaaaagacuaaaggaaacagacucagaagucucuaauuuaaaagaauggga

SEQ ID NO: 155813 - RNA, 41 nt, Homo sapiens
augaccacuguuauuguuacuuugacuuuucagagcacacc

SEQ ID NO: 155814 - RNA, 46 nt, Homo sapiens
uuuugcaaagcaaccuaagagcuaaagauguaauuuuucuugcaau

SEQ ID NO: 155815 - RNA, 28 nt, Homo sapiens
aauggaaaugaaagagauuggcaaaggg

SEQ ID NO: 155816 - RNA, 49 nt, Homo sapiens
agacccugaguucccacucagacccacucagccaaaucucauggaagac

SEQ ID NO: 155817 - RNA, 61 nt, Homo sapiens
caaaaggguuuaaacugauucauaauaaauaucuguacuucuucgaucuucaccuuuugug

SEQ ID NO: 155818 - RNA, 48 nt, Homo sapiens
uaguaaacuauuuaucuguguuuuugaaauauuaaacccuggaucagu

SEQ ID NO: 155819 - RNA, 51 nt, Homo sapiens
ccaggguuaauagggccuggucccugggaggaaauuugaauggguccauuu

SEQ ID NO: 155820 - RNA, 53 nt, Homo sapiens
aaaaacuacacauauguauuccugaucgccaaccuuucccccaccagcuaagg

SEQ ID NO: 155821 - RNA, 46 nt, Homo sapiens
auugggguguaacaccuacaccauuaucuuggaaagaaacaaccgu

SEQ ID NO: 155822 - RNA, 40 nt, Homo sapiens
agaagaaaaagcuagugaucaacaguggcaauggagcugu

SEQ ID NO: 155823 - RNA, 67 nt, Homo sapiens
cugguuguuaagugcugguuguuaguuguuaaaguagagaaaaccccuagcacagugcuuggcacac

SEQ ID NO: 155824 - RNA, 39 nt, Homo sapiens
gaccaagacacauuccaccccaguggggggucccauacc

SEQ ID NO: 155825 - RNA, 46 nt, Homo sapiens
uugaaugguuugugguucugccuuugacaaacugaucauaguggaa

SEQ ID NO: 155826 - RNA, 142 nt, Homo sapiens
uucaucaauggaacuauucuugggguagacacuaaucauaugaaaagacaaaugcucauucccuaagauagccugaaucucauuuaaaauguagaaaaccccuuuuuaguaaagagacaucuucuacaguaaccacugagaa

SEQ ID NO: 155827 - RNA, 46 nt, Homo sapiens
ccccagcaacccuacugaugaugacgugagcagcggcuccuccagu

SEQ ID NO: 155828 - RNA, 49 nt, Homo sapiens
uccucacauccaacaccucccaguaugacacauauugcuucaaugcuuc

SEQ ID NO: 155829 - RNA, 23 nt, Homo sapiens
gagacacucagaaauaagauccu

SEQ ID NO: 155830 - RNA, 47 nt, Homo sapiens
ggucuggaauugacuauuggauuuuauauuaaaaauugcucuuucau

SEQ ID NO: 155831 - RNA, 33 nt, Homo sapiens
acucugccucgugccgcugagccuggcgcagau

SEQ ID NO: 155832 - RNA, 61 nt, Homo sapiens
caggugcgggcauucuaugugaacgugcugaaugaggaacagaggaaacgucugugugaga

SEQ ID NO: 155833 - RNA, 45 nt, Homo sapiens
gcauccaauauucuggagaagugcggagauucaacacugccaaug

SEQ ID NO: 155834 - RNA, 50 nt, Homo sapiens
gaugcaguguuugaauugagcccaaguccaaaugacacaauuuuucaagu

SEQ ID NO: 155835 - RNA, 43 nt, Homo sapiens
cuuugcaguucugcuguggcccuggaggagcaggucuagcuag

SEQ ID NO: 155836 - RNA, 49 nt, Homo sapiens
aggaccuccugcuugguaaaggugcuccccaggugcugcuaacugggcg

SEQ ID NO: 155837 - RNA, 40 nt, Homo sapiens
guaggccuaaagacguugggcucccccugcgugggcagag

SEQ ID NO: 155838 - RNA, 239 nt, Homo sapiens
guuuacaggugccuuuuaacaaggucauguuauuaaguuuuauaacuuuauccaaaguggugagccacaccauggugaaauggacaaauaauauaauacaagucauagagagacuguccuguccccugaguaccugaggacacaggugcagccuuucuugcucucauucucugcauuuugccaagaguuggagaaguugggccgguugcuugggugggaaaggcuuucccacucacgca

SEQ ID NO: 155839 - RNA, 45 nt, Homo sapiens
aaguguggucugggauauauugaguagaaucacuccucuugguga

SEQ ID NO: 155840 - RNA, 46 nt, Homo sapiens
cuccuggacuuuuuacauccaggucaugacauuuaaucaggcagaa

SEQ ID NO: 155841 - RNA, 112 nt, Homo sapiens
auuuuguuggcuaccaucugaggaccuuggagcguaucccaaucucauuaucacuuccaacauccaauagugucuuuccaauaucauuucuuuuaacuuuuuaagucaucca

SEQ ID NO: 155842 - RNA, 46 nt, Homo sapiens
caugaauggauauggaucacauacuuucaagcugguuaaugcaaau

SEQ ID NO: 155843 - RNA, 38 nt, Homo sapiens
uuaaaauuuuucuguuuguuauuuucuacaagugaaau

SEQ ID NO: 155844 - RNA, 102 nt, Homo sapiens
guugagauuugucaaggguuucuggggcaucacuaaaaguuucaggcaauggcccauccugucagauuuuaguacuuuggacacaggaaauuaaaaaagagg

SEQ ID NO: 155845 - RNA, 56 nt, Homo sapiens
uuuuuuuuuuaauugaaaagagauguugcaaauagcugguguacauuucuugagau

SEQ ID NO: 155846 - RNA, 49 nt, Homo sapiens
auucugccuagugcucuugcucaaaacucagguucgugaacugggguau

SEQ ID NO: 155847 - RNA, 42 nt, Homo sapiens
gcacgcuauggcugacagccgggaucccgccagcgaccagau

SEQ ID NO: 155848 - RNA, 64 nt, Homo sapiens
agauguugggaaaggccacuuugcucgcaggggugaggggaaggauagagaaucuauuuuuaau

SEQ ID NO: 155849 - RNA, 50 nt, Homo sapiens
aagaacagagagacaaagaacaaaaaagauaugaaacugaagcggaagaa

SEQ ID NO: 155850 - RNA, 52 nt, Homo sapiens
augaagcagcaaaggaauuucaggagaaacacaagaaggaaguagggaagcu

SEQ ID NO: 155851 - RNA, 71 nt, Homo sapiens
ucuguugguugucuuuuguagcuauuuaaugaaguucaggaaaaggccauugaggagcagaugguggcagc

SEQ ID NO: 155852 - RNA, 49 nt, Homo sapiens
ugcucccgagaugaacacauguuagcauuuagcuguguuugcugcaucu

SEQ ID NO: 155853 - RNA, 70 nt, Homo sapiens
ccugaagcggcuggagauguauucacggaauaugguggacuaucaccucaucauggacaugaucccggcc

SEQ ID NO: 155854 - RNA, 25 nt, Homo sapiens
gcuuugugcauacagauuguuugaa

SEQ ID NO: 155855 - RNA, 24 nt, Homo sapiens
cgcucacugaugaggaugaggcug

SEQ ID NO: 155856 - RNA, 43 nt, Homo sapiens
cucacugaguaauuggcuguagaaacuuccuuuucaggcaaug

SEQ ID NO: 155857 - RNA, 57 nt, Homo sapiens
agcauggauguauuuaugcauuucuauaucacuuuuccuuuucauauacauaguaau

SEQ ID NO: 155858 - RNA, 46 nt, Homo sapiens
ucccgugccccccacccagaaugcccuuccagaagugcuugcuguu

SEQ ID NO: 155859 - RNA, 69 nt, Homo sapiens
ucugcuccucacuuggcuuuggagaaggccauacugcagucauccugugguucugaaucgaaccuuuug

SEQ ID NO: 155860 - RNA, 44 nt, Homo sapiens
uucuucuguccagccucagugcucggggugagaggacaguaggc

SEQ ID NO: 155861 - RNA, 42 nt, Homo sapiens
agauaguauuuuuaugaacagcuuuuaauggaaggcuugaag

SEQ ID NO: 155862 - RNA, 42 nt, Homo sapiens
agcaccacugcugagaauaagaccacgacgacagccagauug

SEQ ID NO: 155863 - RNA, 35 nt, Homo sapiens
auuggguugucuuuuuuauuaaugauuuguaaggg

SEQ ID NO: 155864 - RNA, 67 nt, Homo sapiens
acuuuuuuuaaaauuugaaauauuuaauuuuuuaauuagaaauauuuaguguuggcuauugaaaaau

SEQ ID NO: 155865 - RNA, 46 nt, Homo sapiens
aagcugggccaggcugaacuaguugugauugaugaagcugccgcca

SEQ ID NO: 155866 - RNA, 62 nt, Homo sapiens
auuuuugcccugccaggaaaaaguagaaaggaggaaugagaggagagaaggaaacagggaga

SEQ ID NO: 155867 - RNA, 93 nt, Homo sapiens
gguuauucagguuuccuauaagauaccucuucauugcuuuucaaaccacuuuaaaauuagcaggaagcccugaagaaacugaagagguuguuu

SEQ ID NO: 155868 - RNA, 179 nt, Homo sapiens
gaaggaaaacauuucccugaaauacccugccucgggccuugcuccuucuugaauuuguaaucaaauacucucucauauuaccagaguucuuuugucuccagugugagcacagaggaggugaccuuacuuuaugagacuccauuuguguaccuuucaggccucucuuugggcucaagauu

SEQ ID NO: 155869 - RNA, 45 nt, Homo sapiens
uacauuucugcucacuuuugcucgauucccccagcugggaggagg

SEQ ID NO: 155870 - RNA, 63 nt, Homo sapiens
caugucuuuuagacaauggugguguuguaugcuaaaccuguuccagauuuucagacucuucua

SEQ ID NO: 155871 - RNA, 48 nt, Homo sapiens
cuguaguguacaaaugggaauguacaggaagcaguugcauguguauaa

SEQ ID NO: 155872 - RNA, 21 nt, Homo sapiens
uccgguguccuaggccuggca

SEQ ID NO: 155873 - RNA, 43 nt, Homo sapiens
uacaaugggaagaaagaaaaaguugcaaagagggauagggcau

SEQ ID NO: 155874 - RNA, 46 nt, Homo sapiens
cuuaggaugcuaggaaaaauguggaaaagugaaagauuuuaauaag

SEQ ID NO: 155875 - RNA, 46 nt, Homo sapiens
aggaacauuugccaguuguacuccaguuuggcaagaauuucaacuc

SEQ ID NO: 155876 - RNA, 33 nt, Homo sapiens
uuuuuuauuuuauugcuuauaauuuauuaagaa

SEQ ID NO: 155877 - RNA, 60 nt, Homo sapiens
acauacacuuaaccaaaacuauucaaaaugaaaaccggauuucaaauaaccagacaccaa

SEQ ID NO: 155878 - RNA, 1410 nt, Homo sapiens
ucaccugaaauuugccuaaaaaaaaaaauacaaauaauucuuugauuuuagauacaaagaaaacaagucuaaacaucaauuuucuguuccauauaggaaauaguuucagucaagaaaucugcuaugucaaaaacuuuuucgcauucuucauaauauucaauaaagucaauucuauuuuuucuuuuuuuuugagauggagucuugcucuguugcccaggcuggagugcaguggcacgaucucugcucacugcaaccuccaccuccuggguucaagugauucuccugccucagccuccugaguagcugggacuacaggcgucugucaccacgcccagcuaauuuuuguauuuuuaguagagacaggguuucaccuuauuggccaggcuggucucaaacuccugaccucaugauacgcccaccucggccucccaaagugcugagcuuacaggugugaggcaccacacccggccagucaauucuauuuuuaugggaugauuauaugguuuguugaguaagcacuuuuguuucucuuuaugaauccuacauuuggguacaguauuucauggcuaaugaucauuguaaauugaaaagaaauacaauaaagcucaaguccauuuuuucuugguugguagcucuggugaaaagaucuuuagggagacauuuagugauaaaagaauauuugguuuuacuuagcuugauauaauagacauauccuaaacaauuguuuaaaaauagcauuuucgggccgggcgcggugguucaugccuguaaucccagcacuuugggaggccgaggcagacggaucacaaggucaggagauggagaccauccuggcuaacacggugaaacccaucucuacuaaaaauacaaaaaauuagcugggcgugguggcaggcaacuguagucccagcuacucgggagguugaggcaggagaauggcgugaacccgggagguggagcuugcagugagccgagauugugccacugcacuccagccugggcaacagagcgagacuccgucucaaaaaaaaaaaaaaaaaaaaaaaauagcauuuucaauguucuagggaaauuugcuaucuuaaaacacugcaggagauauucagaagaauaucuuuaaaaaaguuacaguuugaauaacuuuagaaaaguuaaaaaucaucccuuaaauugucuuauaaauuuggauuuuaguccauuauucaaaaauuacugaaaaugaauguaguaugcuacauauuacuacacuaaaguguuacauugauaaaacuaaaaugaaaguuucagcauuuuaaauuuccucucaguuaaauuaaaaaaaaaaacagaccugaaaacaaauuacuaaaacauuuguaagaaaggcgaauucaacuuacaagcaggcauugaagacacuucagcuguuac

SEQ ID NO: 155879 - RNA, 4036 nt, Homo sapiens
caaucuaaggacaaaucaucagguaauuaaauuaauuaaggccuauauuuuaaaguccuuuaacuugauauaaauaucguauuuuagugacuuauuuaaaaccuaaaauaauuucugguuaacuuuggaauauguuuauguuauuaaugaguuauuaguuuuuuucuucuaauagugugaacugaguaaagacaaagggacaguuaucaguaaugauagcuguuccuuucacccaauuauaugcuauguuaaguuuuuuaaaguagcauaagucaggaugagaauagcuuuuacuauuugguuccuuaguuacuguuaauuagugguaauaauaugcagaaccacaaauauaucaccuuuaugucuuuagagucauuucuuuuuuuugaagaagaagaauuuggauuauuuuaauuauuuuuauauacagaaaacucaacaguguauguuuaacccaguuuggugucaaguucuuuagccuuugccuuuuccugcuugacaauucaagccacagacuugagacccaggacauugccuccccagugacaguggauuucguuuugucugucguaauugguucugauagcuuccaccagcugaaccuaagcuccauuguccucugaguuaaucuguguaaaggcgacaguggugcgggucuucuuguggauuagacaucccagucuugccuuccccuugauaaugcgguaagggacccccauuuuaugacacaaggcaggcaggaagacagccaccucgaugggauccacauagugugcagucaccaccagcugagccuucuuguucuccuccaagguggagaugguguuaacuccugcucggaggacaaguggucucuuaguggggacauccccuuugccugcagcuuucuuuucagcccgggccaauagccucugcuuauuuucuugcuuugucuuuggucuguacuugugggccagcuuaagcagcuaaguagcuauuuggcggugcagggccugggugaacugguuaauuguaggaggcacuuucagcugcuuacagaggauggcuuugugccacugcaaccugauauagcggggccauuucacaaagugagugagguccauauuggguggauguccuguccaaugccagaauucuuaggccuuuucucaaacaggggauucaccacuuucuuucuuucuuuuuuuuuuuuuuuuuuuugagauggagucuugcuguguugcccaggcuagagugcaauggugcgaucucggcucaccacaaccuccgccuccuggguucaagccauucugccucaggcucccagguagcugggacuacaggcaugugccaccacuccggcuaauuuuuguauuuuuaguagaggugggguuucaccaugcuggccaggcuggucucgaacuccugaccucaagugauccgcuugucucggccucccaaugugcugggaguacagacgugagccaccacgcccaaccaggauucaccacuuucuuggccuccuguuucuucaugacaccaagggccagagccaccuccuuccucuuggccuuuccuuuuggcaucuuggguggcaggaagagauucuuuauagucauuucuaaagucuaauuuauagagcauuuuacucuuaaauaacuccuggauuauuacugcugucauauuuucuacucuuaaaagauuuucuuacuacaaaauuaauagauuacauagaaaacuauguauuuauuaaaauuuuaaaagggagacagagucucgcuuuguugcccagacuagucuugagcuccuggacucaaguaauucuuuggccucagccucuugcauagcugggauuauaggcaugcaccaccacucccagcuucauuagauuuuauuuuaugaacuucaaggaaauacuuagaguagauuuggaauuuugauuaaguaaaaaauuaaauguaucugguacucucaauaggauaauucauuuauuuauuuauuuuuaauuagagacagugucucacuauguuuuccagacuggucucaaacucuugggcucaauggauccucccgccuuggccucccagaguucugggauuacaggugugagccacugugccuggccuggaauucauuuuguaccaacuuuagcuuggaauuacuggaaaugcuaauaggaagaaaugacuaugauuuuuuuacucucuagacaugauuuacuaauauauaucagcuggcuggacaugguggcucaugcuuagaauugcagcauuuugggaggcugaggcagaaggauugcuugagcucaggaguuggagaccagccugagcaacauacuuagaaccuauuucuacaaaaaacuugaaaaaaauuucaccaggcauauugguaugugccugagguuucagcuacaugggaggaguucaaggauacagugaaauacuacacuuuugccuggauaacagcaaaauucugucucuuaaaaaaauaaagcugggcgcgguggcucaccccuguaaucccagcacuuugggaggccgaggugggcagaucaccugaggucaggaguucgagaccagccuggccaacguggugaaacccugucucuacuaaaaauacaaaaauuagccaggcauauuggcgcacgcuuauagucccagccacucaggaggcugaggaaggagaauugcuugaacccgggaggcagagguugcagugagccuagaucacaccacugcacuccagccugggcgacagagcaagacucugucucaaauaaacaaauaaauccgggugcgguggcucacgccuauaaucccagcacuucaggaggccaaggcggguggaucaccugagguugggaguucaagaccagcccugccaacauggagaaaccccgucucuacuaaaaauacaaaauuagcugggcguaguggcgcaugccuguaaucccagcuacuugggaggcugaggcaggagaaucacuugaacccaggaggcggagguuguggugagcugagaucgagccauugcacuccagccugggcaacaagagugaaacucugucucaaaaaaauaaauaaauaaaaauaaaaauuaggucggguguggugaucauacauguaauuucagcacuuugggaggcugaggcaggaggauuacuugagcccuggaguuccagaccagccuaggcaacauagggagacccccuuucuacaaaaaauuaauaaaacuagccgggugugguggcaugugucuguggucccagcuacucggaaggcugaggcaagagaauugcuaaacacccagguguuugagggugcagugagcugugauugcaccaccacacuccagccuagacaacagagugagagcucaugucuaaauaaauaacuauacaaacaaacagcuuauuucauguggacauguauuaaugauuccaucguacuagacuaugaguuuuuaaggauagggacuaugucucagacaguguuuuuaucuucaguguauaaaaccguucgguauacauuaguguugugaaaauacugaacucgcaacucuucagcuugaacauugcaaaacuccuucauuuaaacaaaauuugaccaggcugggcacgugggcuuaugccuguaaucccagcacuucgggaggucaaggugggcagauugcuugagcccaggaguuugagaccagccugggcaacauggcgaaaccccaucuguacaagaaauauaaaaauuagcagggcauggugaugcacgccuguagucccagcuacuugggagccugcggugggaggauugauugagucugggaguuggaggcugcagugaggcguaauugugccacugcauucuacccugggcgacagaggagaccccgucucaaagaacagaaaaagaaaacuuggccaaugggaaggagacuuuuaauaacuuuaaaaaacacuuaaauuguuucauaagaauaaaauaauuuuaaggacugcuagguacauugacuuuggauuuuuuuucuauuuuuggaacagggcaucuauguacuucaggacaac

SEQ ID NO: 155880 - RNA, 76 nt, Homo sapiens
uuucuucacaauucacucuuuuuugugccuuuauagagggugcucgagaggaagaccucgaugcuguggaagcgca

SEQ ID NO: 155881 - RNA, 46 nt, Homo sapiens
gacugaaauacugucucccuuuaacuuuuugcauacauacugguuu

SEQ ID NO: 155882 - RNA, 42 nt, Homo sapiens
aaaaauguuguaucagguggcuuccccaucaucagagaccaa

SEQ ID NO: 155883 - RNA, 41 nt, Homo sapiens
guuggacagucgcuauuggagaauaacaaaugcuaagggug

SEQ ID NO: 155884 - RNA, 44 nt, Homo sapiens
gaauacacaagcuguaccacauucucuacaacaucaggauacau

SEQ ID NO: 155885 - RNA, 47 nt, Homo sapiens
agauuuugagaaaguaucuugggggucaugugaauuuguugagagaa

SEQ ID NO: 155886 - RNA, 80 nt, Homo sapiens
guguugaaucuuuggaaaaugcccucuagcuucuggaaugacccugauggauggguuuaaguuuggaaagauggacauga

SEQ ID NO: 155887 - RNA, 73 nt, Homo sapiens
augccagaaacuguauuuccaguacugggaauuugcugcuuugcauaacagaauuccuuuuuugacuggccca

SEQ ID NO: 155888 - RNA, 47 nt, Homo sapiens
caaguuuugauguguuuucaugaacgcguaguucaaaauagugucag

SEQ ID NO: 155889 - RNA, 40 nt, Homo sapiens
cuaaaguucaaagagcauugagguguguuuuggcaggcag

SEQ ID NO: 155890 - RNA, 33 nt, Homo sapiens
ggagaauuguucugcuuuuucguccucuaccag

SEQ ID NO: 155891 - RNA, 45 nt, Homo sapiens
ccugaugaauaugaagagauggaagaagaggaggaggaggaagag

SEQ ID NO: 155892 - RNA, 52 nt, Homo sapiens
gauuucucaauaauguaaauaacuaaauuguucucugcauauagcaggaaaa

SEQ ID NO: 155893 - RNA, 44 nt, Homo sapiens
cauaccuuuguuuuaaaauauuuuauacuuacaaaaaucuagaa

SEQ ID NO: 155894 - RNA, 44 nt, Homo sapiens
uaugacuccacccauagcaaauuccauggcaccgucaaggcuga

SEQ ID NO: 155895 - RNA, 46 nt, Homo sapiens
cccagugggcuuaaauccccgucuguuaccauccccaaccauucau

SEQ ID NO: 155896 - RNA, 43 nt, Homo sapiens
gggucuuccgcuagguacucuucuaggccgucgagcagcagaa

SEQ ID NO: 155897 - RNA, 46 nt, Homo sapiens
guuguaaucagcugaggccaugucaggagacggagccacggagcag

SEQ ID NO: 155898 - RNA, 59 nt, Homo sapiens
acccgacguuuuagaaaaacuugacaguguuucuuuuaccccgccaaauauacuguacc

SEQ ID NO: 155899 - RNA, 53 nt, Homo sapiens
cacauuucguuuucauuuuuccagcuacauaaacauugcagguauaaguugaa

SEQ ID NO: 155900 - RNA, 46 nt, Homo sapiens
uaugagugacaacuaaauauuuuaaaauucacacuuuuagguuaga

SEQ ID NO: 155901 - RNA, 69 nt, Homo sapiens
uagugugaaagaggaagcuaaauaguuaugaaaaaugccauuaaauguguuuuucgaucuaaguccugg

SEQ ID NO: 155902 - RNA, 62 nt, Homo sapiens
guucccuagcuuauaacguggaagauguuauuggagguuggcagagaugaggcaaaauagga

SEQ ID NO: 155903 - RNA, 41 nt, Homo sapiens
uacuguaucaaaacuguuuaccccuuuucugaucuaguauu

SEQ ID NO: 155904 - RNA, 40 nt, Homo sapiens
ucucuuaaguagucucaccauucuucuccccuggggcugu

SEQ ID NO: 155905 - RNA, 43 nt, Homo sapiens
uuagaaguaacaguaucgccaauuuuagucaaggugcauauau

SEQ ID NO: 155906 - RNA, 52 nt, Homo sapiens
guuuuguuuuguuggacaguugguaauggugugagaauugggcuaaaaaagg

SEQ ID NO: 155907 - RNA, 33 nt, Homo sapiens
agcuuacaucgucuuaaaucuuucagucuacca

SEQ ID NO: 155908 - RNA, 47 nt, Homo sapiens; identical to SEQ ID NO: 69706

SEQ ID NO: 155909 - RNA, 64 nt, Homo sapiens
uuaaugugucaauaacaauuggcaccaaguagucauuuucagguuauuaauauaaauuaaugau

SEQ ID NO: 155910 - RNA, 37 nt, Homo sapiens
acacauuagacuuaaauucaaacgcaccagaaaugaa

SEQ ID NO: 155911 - RNA, 48 nt, Homo sapiens
ucauaaggaauuuuuuuacugaagcauguuuuuuauugguggcugaag

SEQ ID NO: 155912 - RNA, 36 nt, Homo sapiens
aaucuuuguaauuuuggauuuuaagaaauuuauaag

SEQ ID NO: 155913 - RNA, 46 nt, Homo sapiens
aguaauuuuuacaucuguuucuggguuaggaauuaggaguguuauu

SEQ ID NO: 155914 - RNA, 54 nt, Homo sapiens
aaaaauaaaaaugaaagaggggcacaauaucuagcucuguauuuaaaaauauua

SEQ ID NO: 155915 - RNA, 54 nt, Homo sapiens
aguuacuuuucaagguaguuugcacacauuuuuuuucuaaucuuuuugaaagcu

SEQ ID NO: 155916 - RNA, 48 nt, Homo sapiens
ugggauauccuuuccccuuaaacuaugugcuccaaaagcuacacucag

SEQ ID NO: 155917 - RNA, 76 nt, Homo sapiens
ccaugccaccuuccuaccuguaagggacugagaaaaguugcguccgucugaguagagcagaaugggggaauccuga

SEQ ID NO: 155918 - RNA, 62 nt, Homo sapiens
ucuggaggaaugcaccuucuuccuacgccucagagaguuuccacaauaaucuuugaagggaa

SEQ ID NO: 155919 - RNA, 103 nt, Homo sapiens
gagcuuaaagagccaauuagauggaaaauaugaaagggauaucugagacacaaauugauagugugaaaaugugucuacuugaaguucuagaaguagaggaacu

SEQ ID NO: 155920 - RNA, 84 nt, Homo sapiens
ugauugaaggcuucaacagauucaagaugcucauugaaucccaagcaguaauuuuaaaaauucacaacuggacacaugaggaug

SEQ ID NO: 155921 - RNA, 74 nt, Homo sapiens
aaacuauagaaaacuaaaguuuuuuuucuuaaaucacauaaaugguuggaaacaaaaagauaaaugaccuucaa

SEQ ID NO: 155922 - RNA, 67 nt, Homo sapiens
ugcugaaagaaaauagcugucaacuugaaaguucuguacccagagucauguuaauaaaauaccauug

SEQ ID NO: 155923 - RNA, 43 nt, Homo sapiens
guuaaauaguuuugacaauauuauacaucuaauuucuguaugc

SEQ ID NO: 155924 - RNA, 33 nt, Homo sapiens
uguugacucgcuuguuuucugaguaagcagaau

SEQ ID NO: 155925 - RNA, 52 nt, Homo sapiens
aauuaggucacuucaacaacaaaauagaaauaaacuauccauauaggauuga

SEQ ID NO: 155926 - RNA, 49 nt, Homo sapiens
cugugaguuuuauagaaugaggaaaugggcuauuucuaaaauuaugcuu

SEQ ID NO: 155927 - RNA, 23 nt, Homo sapiens
uuuccuuguuaacucuaguuugc

SEQ ID NO: 155928 - RNA, 88 nt, Homo sapiens
gcauagaugauaguaaagucuuuuuucuugucucuauuuuugcauccacccguaucacccugccaaccauaauuauguuuaacaaccu

SEQ ID NO: 155929 - RNA, 345 nt, Homo sapiens
accucucuauucuguugcuuuuauuuuuauuuuauuuuuuuagauggagucucuugccugggcuggagugcaguggugugauaucagcucacugcaaccucugccucccggguucaagugauucuccugccucagccucccgaguagcugggauuacaggcgccggccacuauguccagcuaauuuuuuguauuuuuaguagacacgggguuucacucuguuggccaggcuggucucgaacuccugaccuugugacuugcccaccuuggccucccaaagugcugggauuacaggcgugagccaccaugcccggccugcuuuuauuuuuauaggauagauccuagg

SEQ ID NO: 155930 - RNA, 62 nt, Homo sapiens
uuugcugccuacaccugcuacacagcugucaugguagagaagggucaauuucuacuacuuua

SEQ ID NO: 155931 - RNA, 45 nt, Homo sapiens
aguauguauaagacagauguaguaaaauguuaauaauaauugaau

SEQ ID NO: 155932 - RNA, 33 nt, Homo sapiens
uugcauaugcagauuaugaagagguaaguaaaa

SEQ ID NO: 155933 - RNA, 46 nt, Homo sapiens
gaugccaaaugaacaguuauuaguugucagcuuauacuauauuuau

SEQ ID NO: 155934 - RNA, 25 nt, Homo sapiens
acgguuuacagcauucaaagaagag

SEQ ID NO: 155935 - RNA, 45 nt, Homo sapiens
uuccggacccaguuguagcuccuucuauagugccuguucugaaag

SEQ ID NO: 155936 - RNA, 37 nt, Homo sapiens
aagacgaugggacggugcugcucuccacgguuacagc

SEQ ID NO: 155937 - RNA, 2936 nt, Homo sapiens
gaaaucugguguauguugucaacuauccaaaagguuuguuaccauuugguuuuuguaaucaugcugaaguguguucaggugugugucucauccauggaucuuagccucuuuugguggcagaaugucuccugaaacuuaaguauuuccuugaacuucaguguuagacaaguuuggaagaccacgagucuaaauuuauggaaacuggggauuguagaucauuuuaaaagagaaaacaauguauuuaaaaaauaucugaauaaacuuugccaaguugaugauaaauuucaggaaucacuaagaauguuuuguacauaaaucauuguuguaaauagauucuucugaagugcuucaguguuuggauuugaucauuguccuuuugguguuacaucauucauucagcaaaucugaguucauuuuuucccuuaaaugagcaaacaguuggaguagccaaaucuugaauuagugcaguuccaauuacaauuucgagguucuggucuuauccuucucucugccucuuaucaaugauguucuaaaucuaagaaaaggaagcaugaaguuuaagaagugugccaaggaaauaccuaauuucagcauuuugaaguagugugcuguuaguagucgaucugucuguguguuccuuuuauuauaacuugguauugcaacaaaguccaucaaauuuggucaguaugcaagacacccuuuuacaugucuaggaaaacuuuagggcuaggcacggugacucaugccuguaaucccagcacuuugggaggccgaggcagguggaucaccugagaucaggaguuugagaugagccuggccaacaugaugaaaccccaucucuaucaaaaacacaaaaucucuggaugugguggugggugccuguaauacuagcuacucaggaggcagacgcaggagaaucgcuugaaccgggaggcagagguugcagugagcagagauugugccauugcacuccagccugggcaacaagagcgaaacuccgucucaaaacaaaaaaaaacgaaaacaaaaauuggcgugguggcgggggccuguagucccagcuagucuggaggcugaggcaggagaaucgcuugaaccugggaggcggagauuacuuuaagcugaggucgcgccgcuacacuccaaccugugacagagcaagacuucgucucaaaaaaaaaaaaaauugauaauguaaacucgggguuuuuaguaugcuguuucuucagccaguggguauagauuaauauuuacucaaauuuaaaaugucaggcucggugcaauggcucacaccuguaaucccagcacuuugggaggcugaggcaagcagaucaccugagguccgaaguucaagaccacccuagccaacauggugaaacccugucucuacuaaaaauucaaaaauuagccaggcguggugguucgcgccuguagucucaguuauuugggaggcugaggcaggagaauugcuugaaccgggagguggagauugcaguaagcugagaucgugccacugcucucuggccuggcagcagagcgagacaccgucucaaaaaaaauuuuuuaaaugucauuuaauuuaucuccccaggcuggacaugguggcucacaucuguaaucccagcuacucgggaggcugaggcaggagaaucacuugaacccgggaggcagagguugcagagaggggagauugcgccacugcacuccagccuaggugacagaaugagacuccgucucaaaaaaaaaaaauuaucuccccuucucuucuaaauaaccuaagguugagguuauuugggggguuuuuuuguuguuguuuguuuguuuguuuuuugagacagucucacucugucgcccaggcuggagugcaguggcacgaucuuggcucacugcaaccuccgccucccagguucaagcaauucucugccucagccucaugaguagcugggauuacaggugccugccaccacgccuggcuaauuuuuguauuuuuauuuauuuauuuuuauuuguuuauuuauuuuuuagacgaagucucgcccuugucgcccaggcuggagugcaguggcacgaucuuggcucacugcaaccuccgccucuuggguucaagcgauucuccugccucagccucccaaguagcugggauuacaggcaccugccaccacgcccggcuaauuuuuucuuuauuuuuaguauagacggcguuucaccaucuuggccaggcuggucuugaacuccugaccuugugauccaccugccucagacucccaaagugcugggauuacaagugugagccaccgcgcccagccaguuauguuuuuuuaaguaagccaaacuuuugguuucuuuuucuuuuuugaaauuagagauggaggcucucgcucuguugcccaggcauauugcaguggcuauucauaggcacacugcagccucaaacuccuggacucaagucguccuuccuccucagccuccugaguugcuggaacuuacaggcauacacaccacuguaccugguuuucuguuuuauuacaaaaguuguguauuuguuguugaauguuuaggaaagauaaaaguuaaaucuucaucaggauauacaaguugcugauauuuaaagucaaagugaaguagaauuauuuuuguuuugauaaaccuuuugagagggagagauuguaauccggaaaugcuacaaaaaacaaacuuggaaaucacugaauuugcaccagaaaagcaccucagacacuaaacuuaagccuuuauucuguccucuagagcaaacaucacuucuugccaaguuuucagugucuuauucuucuuagagucuucuuuuugcuucucauuucuagauguaggagguaguguuuuuaaagaagugcuaagugaagauuucuaaaagguuucugcucguuuuauuuagauaacaaaagaaaaauggaugagac

SEQ ID NO: 155938 - RNA, 41 nt, Homo sapiens
agugaaaguaaugucacagcgacauaugauagauggacgau

SEQ ID NO: 155939 - RNA, 46 nt, Homo sapiens
ucagcguucauauauccaaugccgaaccuaagcacaauagcaauag

SEQ ID NO: 155940 - RNA, 45 nt, Homo sapiens
cagucaggcccaucggguaauaaccaaaaccaaggcaacaugcag

SEQ ID NO: 155941 - RNA, 43 nt, Homo sapiens
cagcaauugguuggggaucagcauccaaugcagggucgggcag

SEQ ID NO: 155942 - RNA, 40 nt, Homo sapiens
uguagacagugggguugugguugguugguauagaauggug

SEQ ID NO: 155943 - RNA, 52 nt, Homo sapiens; identical to SEQ ID NO: 69757

SEQ ID NO: 155944 - RNA, 48 nt, Homo sapiens
aacugcuguuugccugauugguaaaccaacacacuacaauugauauca

SEQ ID NO: 155945 - RNA, 46 nt, Homo sapiens
accccaccauauggauuuuuuuccuuaagaaaaucuccuuuuagga

SEQ ID NO: 155946 - RNA, 46 nt, Homo sapiens
cucauacacaaaaguacaauaugaagccuucauuuaaucucugcag

SEQ ID NO: 155947 - RNA, 46 nt, Homo sapiens
gaagaagcacuucauugaaaguagugcuguaaauauucugccauag

SEQ ID NO: 155948 - RNA, 44 nt, Homo sapiens
uauauaugauauuauguuagaauucugcuccuacuuaggacuag

SEQ ID NO: 155949 - RNA, 46 nt, Homo sapiens
ugugaugaacagugugguaucccuacucuugauccuggaaccagac

SEQ ID NO: 155950 - RNA, 46 nt, Homo sapiens
guuuuccuuaauuaagaaaguauccuaguccuaaaucauaccagua

SEQ ID NO: 155951 - RNA, 60 nt, Homo sapiens
uuagauuaaauuugggauaugauuaauaucuguaauacuuaaaaauaacuaauucaagca

SEQ ID NO: 155952 - RNA, 63 nt, Homo sapiens
acauuauuugaaauaguuguugaauacaguauuuccguuuuaguuuuucagaaagaggacaga

SEQ ID NO: 155953 - RNA, 129 nt, Homo sapiens
acaugagagaaauucugaaggugauccaugggggcuguagugugucuaaggagccacuggaccucauggaggaaaaccuguggcucuugugggauugccaagauggaugaggugagggaggggucuuca

SEQ ID NO: 155954 - RNA, 43 nt, Homo sapiens
caguuuguuuucuuuuuuuaauuuugcuuauaauaccaacucu

SEQ ID NO: 155955 - RNA, 49 nt, Homo sapiens
aagcacagauaggaagauaugaaagacaaaaagauaccugauuagaaau

SEQ ID NO: 155956 - RNA, 33 nt, Homo sapiens
auuucugacgacauaguacuuuuagacugauga

SEQ ID NO: 155957 - RNA, 44 nt, Homo sapiens
ccaguggcgaaucucaucuuugucuaacuucccguccuuguuca

SEQ ID NO: 155958 - RNA, 45 nt, Homo sapiens
gcuuucacuugucauuauauuucauccuuauaacaauucuacaag

SEQ ID NO: 155959 - RNA, 47 nt, Homo sapiens
cagaaaggcagugaacuccucccgaguagcugucaggucaccauuga

SEQ ID NO: 155960 - RNA, 47 nt, Homo sapiens
cguccggggugagcuggucgaaggucuuggaguccuccuugcccagg

SEQ ID NO: 155961 - RNA, 46 nt, Homo sapiens
gguuguccucagggggccgcucgcccagcuccgagucgggccgcac

SEQ ID NO: 155962 - RNA, 46 nt, Homo sapiens
uccugaaauuguggaucacccaccuaugcuuuaagacaugcuuuau

SEQ ID NO: 155963 - RNA, 22 nt, Homo sapiens
uuuguuuuuccaaagaaaauau

SEQ ID NO: 155964 - RNA, 44 nt, Homo sapiens
ccuucacugcagaaaaagccaccuggcgcuauaacuggcagcaa

SEQ ID NO: 155965 - RNA, 48 nt, Homo sapiens
ggccaaugguggcagagucuacauagaacuaugcuucgugguguucug

SEQ ID NO: 155966 - RNA, 41 nt, Homo sapiens
ccucagaggugacauugugauugcaaaaagcccaagugauc

SEQ ID NO: 155967 - RNA, 32 nt, Homo sapiens
uuaacauuaacugagugcugacaaaagaaaau

SEQ ID NO: 155968 - RNA, 44 nt, Homo sapiens
aaccuuagaguuauccuuacucuccucuuucacccuacauccaa

SEQ ID NO: 155969 - RNA, 31 nt, Homo sapiens
uuggacaaguguagaagucuacuaauaagau

SEQ ID NO: 155970 - RNA, 44 nt, Homo sapiens
ucuaucagucguuuguuuuuacuaaauagaagcaaaaaaagacu

SEQ ID NO: 155971 - RNA, 71 nt, Homo sapiens
caggcaaguuuagggaaagcuucaugaagagauggaauguagaaaccacugauccugguucaaugggaugg

SEQ ID NO: 155972 - RNA, 71 nt, Homo sapiens
ugauauuuaguaaaaguuauugugcaagaaauaaaagcaaaaaugcaauauuaggauuuguaucuauucua

SEQ ID NO: 155973 - RNA, 37 nt, Homo sapiens
cauuccaucaaaaauauuccuauuuuaaguaaaaaac

SEQ ID NO: 155974 - RNA, 33 nt, Homo sapiens
uuaaaccagacgauucccuaacauggaagacag

SEQ ID NO: 155975 - RNA, 46 nt, Homo sapiens
ucauuugaugacaauucuugcaaagucuuaaaaccugugugacgag

SEQ ID NO: 155976 - RNA, 44 nt, Homo sapiens
uguaaauucaguucuguuacaaucaaaguuccaucagauauucu

SEQ ID NO: 155977 - RNA, 48 nt, Homo sapiens
cucuccuccgcccggcuucgggcaagaugcgaguccacacaggccaca

SEQ ID NO: 155978 - RNA, 94 nt, Homo sapiens
aggugcuuaugcccaaaaugaaacagaauucuauucgggcauaagaugugcuuauauauacaaaacaaagaacaacaaagugacuccugguggc

SEQ ID NO: 155979 - RNA, 41 nt, Homo sapiens
guggaggccugcugggaacaggaauacuaaaaggaaguaug

SEQ ID NO: 155980 - RNA, 54 nt, Homo sapiens
ugcguaacucucaguuugugcuuaacuccauuugacaugaggugacagaagaga

SEQ ID NO: 155981 - RNA, 53 nt, Homo sapiens
uuaacuugcauguuguaaaugcguuuuauguuuaaauaaagaggaaaauuuuu

SEQ ID NO: 155982 - RNA, 50 nt, Homo sapiens
caugcaguaacugacaaccuaaagugaagaaacggcuaggugcuuaggug

SEQ ID NO: 155983 - RNA, 44 nt, Homo sapiens
uuaguaugauccagcaacucccagaagguuaagagugauuaaaa

SEQ ID NO: 155984 - RNA, 48 nt, Homo sapiens
aauuaacugcucccagccccagaugcauuuucccuuccuaaugacaga

SEQ ID NO: 155985 - RNA, 126 nt, Homo sapiens
aagaaucuaaauagauuuucaaucauccuuauuaccucuaggcaaguuaaaaauauaagugucauguacaggcaaagcaacuuuuucuucuucucuuagcaguuaagugcuuuugaaaaaucagua

SEQ ID NO: 155986 - RNA, 44 nt, Homo sapiens
ccugccuaagauucuucacuguaccucugccaaaucugcuacag

SEQ ID NO: 155987 - RNA, 42 nt, Homo sapiens
gacaaucuuugguguucuaaggaaaaggcugccauguuggag

SEQ ID NO: 155988 - RNA, 43 nt, Homo sapiens
uggacuuggaaccaaaaggaaucaggaaugcacaucaggcagu

SEQ ID NO: 155989 - RNA, 28 nt, Homo sapiens
aguauaugauaaagaaggcagaggaaua

SEQ ID NO: 155990 - RNA, 44 nt, Homo sapiens
gguuucuaauucugcagagacacccguuucagccacaucuaaaa

SEQ ID NO: 155991 - RNA, 47 nt, Homo sapiens
uacgaccuagacggggaagagagcuauggcaaguaccugcggcggga

SEQ ID NO: 155992 - RNA, 54 nt, Homo sapiens
ccacaggcgcugcucccagggggaggggagccagguuggcagccugcugagccu

SEQ ID NO: 155993 - RNA, 52 nt, Homo sapiens
ucugaaguucuucugcaugaguuucuucugccaccugugucaaggcuacuuc

SEQ ID NO: 155994 - RNA, 129 nt, Homo sapiens
ucauaaaacacuacagggagguaugcaaguugaauucuauuuuaacuguauaugaacuuuaacgaauugguguauguuuauguuuaacauaagcuuuccucuucuagugggcuggugcuuuagucaaag

SEQ ID NO: 155995 - RNA, 46 nt, Homo sapiens
agcuguaaucugccugcagaaugaaaaggaucagaaguuguuagag

SEQ ID NO: 155996 - RNA, 45 nt, Homo sapiens
ugaaaaaauuacccaacaagaagagaaauacgaagcuauuaucca

SEQ ID NO: 155997 - RNA, 46 nt, Homo sapiens
uugugaaaaagaugaagcuauucagacugcccuaaaagaauuuaaa

SEQ ID NO: 155998 - RNA, 44 nt, Homo sapiens
aucuuagugauaaguugaaaaguacaaugcagcaacaagaacgg

SEQ ID NO: 155999 - RNA, 44 nt, Homo sapiens
uagaugaaaggcucaagucaaugagcgauagguuggccagcaga

SEQ ID NO: 156000 - RNA, 45 nt, Homo sapiens
ccuuggacaccccauagaugguccugggucucugaauacagagau

SEQ ID NO: 156001 - RNA, 45 nt, Homo sapiens
gauaggauuuaaaacaggagugagaacugcaucaaagauggccag

SEQ ID NO: 156002 - RNA, 42 nt, Homo sapiens
ugcggagcgggaguccgggggugcgcacgugggggcggccgc

SEQ ID NO: 156003 - RNA, 42 nt, Homo sapiens
cuccaccacucugcgucgagaagccgggucaugccgggauac

SEQ ID NO: 156004 - RNA, 49 nt, Homo sapiens
ucaggcaaagaucgaggagcaggcagugggaagggcucuugaacagcug

SEQ ID NO: 156005 - RNA, 63 nt, Homo sapiens
cugaggaucagagagcuguagcugccuggcaaacucuuccuggcugaucauucgacuccggcc

SEQ ID NO: 156006 - RNA, 49 nt, Homo sapiens
cuuccaggcuccugcccccauccagagcugcuagugcaagggccacauc

SEQ ID NO: 156007 - RNA, 54 nt, Homo sapiens
gagggagaggccuuggcuggauccugccuggcacagcucagcaugcaaagcugu

SEQ ID NO: 156008 - RNA, 52 nt, Homo sapiens
ccacucuaugggaaacucuucagcaccuaccugcgccccccacacaccucuc

SEQ ID NO: 156009 - RNA, 56 nt, Homo sapiens
gggaggugccucgagagguguguggggggcgcagguaggugcugaagaguuuccca

SEQ ID NO: 156010 - RNA, 28 nt, Homo sapiens
ggggaggccccuagcgcugcccugagga

SEQ ID NO: 156011 - RNA, 42 nt, Homo sapiens
auaagcgaucauguuucuccaguauuaccucaacgagcaggg

SEQ ID NO: 156012 - RNA, 46 nt, Homo sapiens
ugggacaacagaccugcucagcccauccugcucgguucuccccaga

SEQ ID NO: 156013 - RNA, 48 nt, Homo sapiens
gagggucccuuaaacugaugucuuuucugccaccuguuaccccucgga

SEQ ID NO: 156014 - RNA, 84 nt, Homo sapiens
augcuugugugaggcaaucaugguggcaucacccauaaagggaacacauuugacuuuuuuuucucauauuuuaaauuacuacaa

SEQ ID NO: 156015 - RNA, 63 nt, Homo sapiens
gggcgccagccccggcagcgcgaacccugcgcgcgccgcggcucugaaacaguuaccggcuag

SEQ ID NO: 156016 - RNA, 42 nt, Homo sapiens
ugcacgcacuucgcccaacuagaaccgugggacacucaccag

SEQ ID NO: 156017 - RNA, 139 nt, Homo sapiens
ggaccagagggguuagcuagguagcucuucauucugaaggaaagaagucacacaagauuggcauuguuuugucuuuuuguuuuuuguuuuuuucucucuuaaaaaauauauucaccuauuggugaugcacuuucuagga

SEQ ID NO: 156018 - RNA, 48 nt, Homo sapiens
uugaaauguguuauuuuucaaguuaucuuuuguauugcagucaaaagu

SEQ ID NO: 156019 - RNA, 46 nt, Homo sapiens
uggcucuuugcaguaguaauuugguaugugggaagguguaugacaa

SEQ ID NO: 156020 - RNA, 370 nt, Homo sapiens
aaugaaccauucccggcugggcacgguggcucacgccuguuaaucccagcacugugggaggccgaggugggcaaaucaucugaggucaggaguuugagaccagccugaccaacguggugagacccccgucucuacuaaaaauacaaaaaaaaaauuagcugggcaugguggcacaugucuguagucccagcuacucgugaggcugaggcaggagaaucgcuugaaccugggaggcggagguugcagugagcugagaucgcacuacugcacuccaggcuggacaacagggcgagcgagacccugucucaaaaaaaaaaaaaaaaaaaguuaacuguucucuaaucuuucuugugugaaauaugagggcaga

SEQ ID NO: 156021 - RNA, 52 nt, Homo sapiens
auccaggaaagaacuugguuugguagauauccaugaauuccuggagggaagg

SEQ ID NO: 156022 - RNA, 61 nt, Homo sapiens
ucucuaauauaucuagcauuuauuucuuuuugcauuuuuguacucauguuuccuugccuaa

SEQ ID NO: 156023 - RNA, 48 nt, Homo sapiens
gcaaagugcuuccaacuuucaguuagcuggguuaauggcaggaugagg

SEQ ID NO: 156024 - RNA, 52 nt, Homo sapiens
gacaaaaucaaagguacuuuuauguaaucuguugcauacaucauagcuguag

SEQ ID NO: 156025 - RNA, 60 nt, Homo sapiens
ugauaaccaaaacuuaagaauggcaacaugagauuaaaaaaaaaaaaaaguauaggccaa

SEQ ID NO: 156026 - RNA, 45 nt, Homo sapiens
cuuuuacugucauuaucagcagcaauaguguguaaaggagacuac

SEQ ID NO: 156027 - RNA, 46 nt, Homo sapiens
aaagcucgaaaugcuuaucucaauaauuccaauuaugaagaaggag

SEQ ID NO: 156028 - RNA, 63 nt, Homo sapiens
gcuaggaauuaucuccaaaauugccguguuuucauuugugauuuuccauauugauguucucac

SEQ ID NO: 156029 - RNA, 100 nt, Homo sapiens
agaccgaaacucaaugcuacgauugaccagcauuggcucugaugaggacgaagagacagaaaccuaucaggagaaggugcacaugacuuggacaaaagac

SEQ ID NO: 156030 - RNA, 39 nt, Homo sapiens
cuggcacuuccauggaggacguaggccuuuuaagaaaac

SEQ ID NO: 156031 - RNA, 48 nt, Homo sapiens
uguucugauguugagggaauauuugcuuuuucuguaaugacugcagau

SEQ ID NO: 156032 - RNA, 60 nt, Homo sapiens
gaaaaagcaaauauucccucaacaucagaacaaugcucaagucuuucaagccacgucuga

SEQ ID NO: 156033 - RNA, 42 nt, Homo sapiens
aaugaauugguaaaagggaugcuagaaauucaacugaagaaa

SEQ ID NO: 156034 - RNA, 44 nt, Homo sapiens
cagaagucaugguucaauguugacacugugaggauaacaacuag

SEQ ID NO: 156035 - RNA, 62 nt, Homo sapiens
aaauuucuucaacaggucaaugccaaucuguaugccauuuuaguaaaguagguaaggagagu

SEQ ID NO: 156036 - RNA, 46 nt, Homo sapiens
agaguggcacuauuuaugacuaauaaauugaaauucaaaaacagcc

SEQ ID NO: 156037 - RNA, 67 nt, Homo sapiens
aacagaaaaaaagacuuaagauccuauccgcuuugccauccucagugggccuggagguugaagcaag

SEQ ID NO: 156038 - RNA, 49 nt, Homo sapiens
guaaaggucagccugccuaggaauucugccacauuuacacacaccccug

SEQ ID NO: 156039 - RNA, 55 nt, Homo sapiens
ugcuaaaucaagaacuguugcagcaucuccuuucaauaaauuaaaugguugagaa

SEQ ID NO: 156040 - RNA, 43 nt, Homo sapiens
uuauuuuuguuuccaguacagagcaaaacaacaacaaaaaaac

SEQ ID NO: 156041 - RNA, 46 nt, Homo sapiens
cuuggguuaugguauaguuucuuuguguuugucguaauaugcacau

SEQ ID NO: 156042 - RNA, 60 nt, Homo sapiens
gacccaaauacauagggaccaggcgcugcuuucucauguucacaaaagcaguccuccacc

SEQ ID NO: 156043 - RNA, 45 nt, Homo sapiens
agaauggaguucagugguggaggacugcuuuugugaacaugagaa

SEQ ID NO: 156044 - RNA, 56 nt, Homo sapiens
uggcugaaauggccauaagugccugaaugggucgccaggccaucauacacaccauc

SEQ ID NO: 156045 - RNA, 46 nt, Homo sapiens
uacuuggacaagcaagugccugauaccagcgugcaagagacagacc

SEQ ID NO: 156046 - RNA, 45 nt, Homo sapiens
agagcgagucucccuggccacugccccggucacuucgaccccuaa

SEQ ID NO: 156047 - RNA, 46 nt, Homo sapiens
ggucaucaagaaauuccuguucaugaugaugaagaaaugacuugag

SEQ ID NO: 156048 - RNA, 50 nt, Homo sapiens
aaauaggugugaaugaauaaaucucucccggaaccauaacuuuauaggaa

SEQ ID NO: 156049 - RNA, 45 nt, Homo sapiens
gcugucgacuccacccgaagauaaauaagugacaacagguucggu

SEQ ID NO: 156050 - RNA, 48 nt, Homo sapiens
uauuuaucuucggguggagucgacagcugcaccuggggaaggggaagg

SEQ ID NO: 156051 - RNA, 44 nt, Homo sapiens
aaggaaaugccugggccgggccuaggcgcucugcggaaaaccug

SEQ ID NO: 156052 - RNA, 45 nt, Homo sapiens
uugcaaucgacaauucuuaugcaguuaugucaaguuuuuguccug

SEQ ID NO: 156053 - RNA, 51 nt, Homo sapiens
ggcuuauaaaguuccuugaaaacagagauaccuaugucaguuucuuugcug

SEQ ID NO: 156054 - RNA, 43 nt, Homo sapiens
gagaaauuagguguguaauaaucaucaguucagcacuugcgag

SEQ ID NO: 156055 - RNA, 47 nt, Homo sapiens
agaagcuuuacccaguucaguucugcauucauccacuguacuaacga

SEQ ID NO: 156056 - RNA, 45 nt, Homo sapiens
uuaaggaucugaacaggaguuagguaggaaaguauuacaugcuau

SEQ ID NO: 156057 - RNA, 60 nt, Homo sapiens
uuaugcuuuuuuuccccccaagaacacaaauccacuuuuauuuacuuuucauuagcuuaa

SEQ ID NO: 156058 - RNA, 62 nt, Homo sapiens
auuugaacucaagucaucaagagaggcuaugaugaaguagaaaggaaggaaggagaaguuuu

SEQ ID NO: 156059 - RNA, 43 nt, Homo sapiens
aguugugauaccuaccugcauaguaaguagaaagcuuuccaga

SEQ ID NO: 156060 - RNA, 23 nt, Homo sapiens
acugaucugauuuaugccuauug

SEQ ID NO: 156061 - RNA, 241 nt, Homo sapiens
auggggcuauaguucugacaguggaagaaggaagaucugaauggaucugugaaauauuuugaaggaagguuuuuuguuuguuuugcuuugguuugguuuuuuuuggagacgggucucacuauguugccuaggcugguaucgaacuccugggcucaagugacccucccgccucagccucccaaagugcugggauuacaggugugagccacugugcccugccugaaagaagauuugagaaaac

SEQ ID NO: 156062 - RNA, 91 nt, Homo sapiens
uuggugauuuguuagaaggaaggagaaaggagucaaaauaacucccauguuuccagucugagagaauuuugccagucauuucaaaugugau

SEQ ID NO: 156063 - RNA, 77 nt, Homo sapiens
gagauuuagauguguugacuuggaccuagcaguggcugaccgaggagccaaauacaaagaaauuaaagaagaccugg

SEQ ID NO: 156064 - RNA, 47 nt, Homo sapiens
cagaguguuuauauguguacuuaauuugucuuugucuagaaaauggu

SEQ ID NO: 156065 - RNA, 69 nt, Homo sapiens
aggaauaugagauugaauguagcuuuaacuuucuggagaaagagaaguauaagugaacuuguagcuuau

SEQ ID NO: 156066 - RNA, 46 nt, Homo sapiens
gcuguguugacuuguugccucuaguaaagucacuacuuaaaagcaa

SEQ ID NO: 156067 - RNA, 50 nt, Homo sapiens
aaaacaucccugaacuguauaauuuacaaaaaaaaaaagucucgucugag

SEQ ID NO: 156068 - RNA, 48 nt, Homo sapiens
aaugaaaucccagcaaucugcuucacauugaaguggaaaaauauccaa

SEQ ID NO: 156069 - RNA, 56 nt, Homo sapiens
accuuuagcauuuauucguuuaaugacuacugauacgaaucucaagcagauuucuu

SEQ ID NO: 156070 - RNA, 115 nt, Homo sapiens
uaguuucaaaguauuaaguaauauuacaucagauauuuuucacauuuuucucugggucagaucauugacuaaacaguaucuucaaaaaucaaacuucaauaaaucagacuucaga

SEQ ID NO: 156071 - RNA, 45 nt, Homo sapiens
agaugcaauuuuuucauagaaaaauucacccaggccacaaaugag

SEQ ID NO: 156072 - RNA, 45 nt, Homo sapiens
gucuccauauaagguaggugcuuaaaaggaagagaauuuugguag

SEQ ID NO: 156073 - RNA, 42 nt, Homo sapiens
uuauuuacauagcagauucuauuauaucucuuuaaucugcca

SEQ ID NO: 156074 - RNA, 41 nt, Homo sapiens
ugcagguugaagaugacagcgaugcagagaccuauggagaa

SEQ ID NO: 156075 - RNA, 46 nt, Homo sapiens
gcucugcagguaugaauuccaguugcaugcauacuguuuagugcuc

SEQ ID NO: 156076 - RNA, 45 nt, Homo sapiens
uuuuggccaauuauggguuuauaagcacuuuucuucaagguggga

SEQ ID NO: 156077 - RNA, 368 nt, Homo sapiens
cuuguuuguauaaauaaauagacaacugagaaaaaauauuguugguuccuuaggugugcaaucauaaacuuuucuagauauugccaaauugcuuuccacgguaaagaugagagaguuccugguguucgucaucucugcaaauagcuaguacuguuggacuuuuaaauugugaccaguugauugaaugguaucuaguguaguuaauucaacagauauuuaaguacccauuguuccagcuauuggcuuagaggcuggacauagaguggugaacagaacagauauagacaccugucucacagaguugacuuucuagaggguagagacaaacaagaagaguauauaaaauguuaaaugcuauaauugcuuag

SEQ ID NO: 156078 - RNA, 49 nt, Homo sapiens
ucuuacugagaauauaacauuugagcaaagaucugaggagggugaggga

SEQ ID NO: 156079 - RNA, 32 nt, Homo sapiens
acagcuguauguucagaagagccucagaugga

SEQ ID NO: 156080 - RNA, 366 nt, Homo sapiens
aaaacaugauaggaugucaaaacucaaaaucuguuguucuuuuuuuccuucaggauagaguuucgcccuuguugcucaggcuggagcguaauggugcaaucuuggcucacugcaagcuccaccuccuggguucaagcgauucuccggccccagccuccaaguagcggggauuacaggcaugcaccaccacacccggcuaauuuuuguauuuuuauuagaaacgggguuucaacauguuggccaggcuggucucaaaccccugaccucaggugauccaccugccucggccucccaaagugcugggauuacaggcgugagccacugugcccggcccaaagcucaaaaucuuaaguugugcacgccaac

SEQ ID NO: 156081 - RNA, 54 nt, Homo sapiens
uucaguguggaaggauuaguuggucugcuuugucuuuuggcuacuguugcaaac

SEQ ID NO: 156082 - RNA, 42 nt, Homo sapiens
aauuacuuccccugcuggacagcaguauauccugaaaggaag

SEQ ID NO: 156083 - RNA, 48 nt, Homo sapiens
cuuuuccuuaaguuagaugaaauccauauuagcuguauaaaagaauag

SEQ ID NO: 156084 - RNA, 39 nt, Homo sapiens
uucucucccaaggugcucacucuugaguaucucuuguca

SEQ ID NO: 156085 - RNA, 29 nt, Homo sapiens
ccaaucacuuuuugaaagcuuaguaaaua

SEQ ID NO: 156086 - RNA, 54 nt, Homo sapiens
ucuuuccaaguugucucugaaauuuuucucagucauuuauaauacaaugucaac

SEQ ID NO: 156087 - RNA, 47 nt, Homo sapiens
uuaauggaaaaacauugacuuaaguacuggccuguacaguuccaaau

SEQ ID NO: 156088 - RNA, 35 nt, Homo sapiens
accccguuuggcuuuucucuuccucaugcugggag

SEQ ID NO: 156089 - RNA, 38 nt, Homo sapiens
gaaauugugaaacugcugacaaccagccacaccucaua

SEQ ID NO: 156090 - RNA, 49 nt, Homo sapiens
acauuuauaugccucagcggauaacagucagcauacuuaccauggaggg

SEQ ID NO: 156091 - RNA, 58 nt, Homo sapiens
aucuggacugauuuuagacccagggcuacugcauuaaaggcccuuccugccugggagc

SEQ ID NO: 156092 - RNA, 42 nt, Homo sapiens
aucgcccaauaccuucauuugcggagaaggcauaauuaagag

SEQ ID NO: 156093 - RNA, 91 nt, Homo sapiens
uuugagagauaccaauuugucuuucuaaaguuagaauugccuugcuagauuucccuuugcuguauaacaucacuguuaucuaauguuuuua

SEQ ID NO: 156094 - RNA, 71 nt, Homo sapiens
aacauacguuuguucuuucccuuaaacuuaacaguucuaugaaguagauaguguuacaucuuauuuuacag

SEQ ID NO: 156095 - RNA, 41 nt, Homo sapiens
uuaugaucuugacgucuccuaagauauuauuuguccauuuu

SEQ ID NO: 156096 - RNA, 23 nt, Homo sapiens
guucauagcucaucagcuaguaa

SEQ ID NO: 156097 - RNA, 47 nt, Homo sapiens
guauuuuuuuuugugcagaaacauauuucauguccauuggguugaau

SEQ ID NO: 156098 - RNA, 38 nt, Homo sapiens
uagauuuuucauguuuguauuuagaaaucuggaagaug

SEQ ID NO: 156099 - RNA, 34 nt, Homo sapiens
guaaggauuuuuaaaagccuucuuuaaauugugu

SEQ ID NO: 156100 - RNA, 49 nt, Homo sapiens
aaacccacuuccccacugcagucagcaggagaccauuuggaagaagaac

SEQ ID NO: 156101 - RNA, 24 nt, Homo sapiens
aguuuuguuuucaucauaaauagc

SEQ ID NO: 156102 - RNA, 50 nt, Homo sapiens
uacagacacguggccaugggcucauuaaccuccauuaagauguauauucu

SEQ ID NO: 156103 - RNA, 45 nt, Homo sapiens
agaugaauaucaaucaaaaguaauauaguauaaucuaaggugggg

SEQ ID NO: 156104 - RNA, 65 nt, Homo sapiens
gcuuaaaucauuuaaaaacggcaaagaauuauauagacuaugagguaccuugcuguguaggagga

SEQ ID NO: 156105 - RNA, 48 nt, Homo sapiens
uuuggaagacuuacgaugcauguauacaaacgaauagcagauaaugau

SEQ ID NO: 156106 - RNA, 89 nt, Homo sapiens
uuuucuccuuuauaugacuuucucugaguugggcaaagaagaagcugacacaccguauguuguuagagucuuuuaucuggucaggggaa

SEQ ID NO: 156107 - RNA, 45 nt, Homo sapiens
augguuauuuaauguaauuauuacuucaaauccuuuggucacugu

SEQ ID NO: 156108 - RNA, 81 nt, Homo sapiens
auauuuguggucuugaucauaccuauuaaaauaaugccaaacaccaaauaugaauuuuaugauguacacuuugugcuuggc

SEQ ID NO: 156109 - RNA, 46 nt, Homo sapiens
gaauuuccucaacacuaacuucacugggauaaucagcagcguaacu

SEQ ID NO: 156110 - RNA, 34 nt, Homo sapiens
uuaacggagaugacuuaaguuggcagcaguaauc

SEQ ID NO: 156111 - RNA, 47 nt, Homo sapiens
cacaaaugcuaaggcagaauuuugagggugggagagaagaaaaggga

SEQ ID NO: 156112 - RNA, 59 nt, Homo sapiens
uggaaaacaaacacugcagacuugagauucaguugccgaucaaggcucuggcauucaga

SEQ ID NO: 156113 - RNA, 46 nt, Homo sapiens
ccuguuuucuucaagccugagguuuuauauacaaacucccugaaua

SEQ ID NO: 156114 - RNA, 44 nt, Homo sapiens
ccuacuggcaauggcuacuuaggauugaucuaagggccaaagug

SEQ ID NO: 156115 - RNA, 48 nt, Homo sapiens
augaccucccuuucuuuaugugcucacugaggaucugaggggacccug

SEQ ID NO: 156116 - RNA, 62 nt, Homo sapiens
agcaagagauauuuugggggucuuuuuguuuuaacuauugucaggagauugggcuaaagaga

SEQ ID NO: 156117 - RNA, 67 nt, Homo sapiens
ccuuuaucgugguuauagucagcucauuuccauuccacuauuucccauaaugcuucugagagccacu

SEQ ID NO: 156118 - RNA, 41 nt, Homo sapiens
uauguucggacccaagcaaguuagcuaaaccaaaccaacuc

SEQ ID NO: 156119 - RNA, 61 nt, Homo sapiens
gagaaagucuuuuccuaguauuuaacagaacccaagugaacagaggagaaaugagauugcc

SEQ ID NO: 156120 - RNA, 50 nt, Homo sapiens
gggugaggccaaaucagguccagcaaaagucaguagggacauugcagaag

SEQ ID NO: 156121 - RNA, 54 nt, Homo sapiens
ccuccuccuccucacaauccaucucuucuuaaguugauagugacuaugucaguc

SEQ ID NO: 156122 - RNA, 52 nt, Homo sapiens
ggaccagaaucuccuuucggaaugaauguucauggaagaggcuccucugagg

SEQ ID NO: 156123 - RNA, 105 nt, Homo sapiens
aggugcacccagcauguccuaggaaugcagccccaggaagucccagaccuaaaacaaccagauucuuacuuggcuuaaaccuagaggccagaagaacccccagcu

SEQ ID NO: 156124 - RNA, 64 nt, Homo sapiens
cccaagaaauucacuaccaugauggucacacucaacugcccugaacuacagccaccuaccaaga

SEQ ID NO: 156125 - RNA, 54 nt, Homo sapiens
ccaucaucaaccgcuucuguuacggccagugcaacucuuucuacauccccaggc

SEQ ID NO: 156126 - RNA, 58 nt, Homo sapiens
ggggaggaggugcuggaguccagccaagaggcccugcaugugacggagcgcaaauacc

SEQ ID NO: 156127 - RNA, 45 nt, Homo sapiens
gagcccugcuucuccucuuggggacccugcugccggcugcugaag

SEQ ID NO: 156128 - RNA, 69 nt, Homo sapiens
gcucuggccgcggccgcacucagcgccacgcgucgaaagcgcaggccccgaggacccgccgcacugaca

SEQ ID NO: 156129 - RNA, 46 nt, Homo sapiens
guucaagcugacaucauacccaguccaacagacaccagcugccguc

SEQ ID NO: 156130 - RNA, 44 nt, Homo sapiens
auucgcgacaucaucaauagacgauguggaaacaauccauugau

SEQ ID NO: 156131 - RNA, 43 nt, Homo sapiens
gaauacuuugcaaaugcuccucaacccauuuuuaaaggaagau

SEQ ID NO: 156132 - RNA, 78 nt, Homo sapiens
agaagaagucaaacgauugcaaaagagucuagggguuccaggagaugccucauauaccugugaaacugcaggcuauuu

SEQ ID NO: 156133 - RNA, 50 nt, Homo sapiens
aauaguuugcaauaaaugagugcucugcucuuuauuauauugagaacauu

SEQ ID NO: 156134 - RNA, 50 nt, Homo sapiens
ggagcauuuuucuucauuuaguagaaugaauauuccugaaagacuaaggu

SEQ ID NO: 156135 - RNA, 47 nt, Homo sapiens
cauguuauuccuaauagggguccuuauccuuauaaucaacccaaacg

SEQ ID NO: 156136 - RNA, 48 nt, Homo sapiens
uuccaguaagaaguggaaaagggaagaaaaggaaagaugcggaugugg

SEQ ID NO: 156137 - RNA, 42 nt, Homo sapiens
ggagaugaauuuggagcaggcauacauuuuuacggggugagg

SEQ ID NO: 156138 - RNA, 46 nt, Homo sapiens
ggagcagaggauguguaugaaacuuuuaauauaauaaugaggagaa

SEQ ID NO: 156139 - RNA, 41 nt, Homo sapiens
gaguucgugcagauguuaccauaaaucucaaugucagagau

SEQ ID NO: 156140 - RNA, 43 nt, Homo sapiens
auguaaacuauacugcauuaaagcuguaaaaaauggaggaggu

SEQ ID NO: 156141 - RNA, 51 nt, Homo sapiens
ugaaauuccuuuagcuaagaaaagucuuucauucugguaauuguagcagcu

SEQ ID NO: 156142 - RNA, 42 nt, Homo sapiens
aauuuccuggugcccagaaguuaacuuuagaagcuagaaaag

SEQ ID NO: 156143 - RNA, 48 nt, Homo sapiens
cugauuccaaagaccauuaccauugguuuguuucucaucuuugaucua

SEQ ID NO: 156144 - RNA, 47 nt, Homo sapiens
ugagauguguggcacuuuaucuguuuuagugaaaaggaaacuaaggu

SEQ ID NO: 156145 - RNA, 86 nt, Homo sapiens
uuuuggacaugcuuaaauucuauacugguuuugaaauuaaugaccaaacuggaaaugcucugacagagaaugagaugaccacaauu

SEQ ID NO: 156146 - RNA, 48 nt, Homo sapiens
uguuucccuuuauauagugcugagugcaaauaaauuauuauaauaagu

SEQ ID NO: 156147 - RNA, 46 nt, Homo sapiens
augaugaaaagauggauccagaagcaagagaacaguauguuggcag

SEQ ID NO: 156148 - RNA, 48 nt, Homo sapiens
gauguuuaacuuaauuuuaguaauauaaaaugaauaagguaguaucua

SEQ ID NO: 156149 - RNA, 46 nt, Homo sapiens
acagcagcuuaucucccucccaauguggaugggcuuacagcuggua

SEQ ID NO: 156150 - RNA, 54 nt, Homo sapiens
uugauacuuaauuuuuucuaucuagacucuuaagaaaaaugauuauaagaacug

SEQ ID NO: 156151 - RNA, 46 nt, Homo sapiens
cuuccaggcuugggcaaaugaauauaauauaugauggugccauuua

SEQ ID NO: 156152 - RNA, 75 nt, Homo sapiens
aguuuauauuuguaguuuuacaugaauaaaaaaaguuaccaaagucaagacagaugcuuacauuauaauuucaau

SEQ ID NO: 156153 - RNA, 45 nt, Homo sapiens
uaaaguuuugugacauugcaugcucagugaaacuauguaagagau

SEQ ID NO: 156154 - RNA, 45 nt, Homo sapiens
uauauuuuuauaacagguuauugaagauauauaugaaaaagagau

SEQ ID NO: 156155 - RNA, 41 nt, Homo sapiens
cugacaagacaccuccaaauagaccuaucuaaaaacagagu

SEQ ID NO: 156156 - RNA, 46 nt, Homo sapiens
cagcccaagaagaucguggccccuacggugucccaaaucaaugcgg

SEQ ID NO: 156157 - RNA, 53 nt, Homo sapiens
aguguugugcuuguaugauucugagacuuuauuugcguaagugauacuacuau

SEQ ID NO: 156158 - RNA, 47 nt, Homo sapiens
uauugagaauguggauaaaugaacaauuguaaguuuugcaucauaaa

SEQ ID NO: 156159 - RNA, 50 nt, Homo sapiens
uugaaaaauauaaauccaugauggcuguacaaauaauuuagccucauuca

SEQ ID NO: 156160 - RNA, 47 nt, Homo sapiens
augguuucacaggcauuugcuuguccugcauaguaaggagguagaau

SEQ ID NO: 156161 - RNA, 46 nt, Homo sapiens
uuugaaugcucaguuuguggcaaaacauucagacaggcuccucacu

SEQ ID NO: 156162 - RNA, 56 nt, Homo sapiens
ugucuuguguacuaaaucuuuucgacagucaacucacuuaaaaauccaccaacuua

SEQ ID NO: 156163 - RNA, 43 nt, Homo sapiens
auuacacccgugcucuaagucugaucccauguauagcaugaaa

SEQ ID NO: 156164 - RNA, 59 nt, Homo sapiens
uggaggccaagcaagaaaagucaauguauggaguguauaauacuuuuaccacagaggaa

SEQ ID NO: 156165 - RNA, 42 nt, Homo sapiens
ucauagucugccuuuuaaauguaguauuugucagcgucacuu

SEQ ID NO: 156166 - RNA, 82 nt, Homo sapiens
uguggaauuuaagaacaguauggagcucaucagaguauaucauugaagaauaugauggcugaaaacaauuuaaaaaugcuaa

SEQ ID NO: 156167 - RNA, 75 nt, Homo sapiens
cauugauuuuugacaacagcuuguggugguagacaauccaggagaccuuuuccccauuuuacagaugagaacucu

SEQ ID NO: 156168 - RNA, 40 nt, Homo sapiens
uaugcuugucuuuugggaauuucacaacaaagugaaaagg

SEQ ID NO: 156169 - RNA, 31 nt, Homo sapiens
guuuuaaucagagguaguuguggugugugau

SEQ ID NO: 156170 - RNA, 78 nt, Homo sapiens
gugcuuuuccacguggugggaggcaagugacaacaguuauccaaucuuagugcuaacaauggaugauuaaccguagcu

SEQ ID NO: 156171 - RNA, 25 nt, Homo sapiens
gucaggauaaauucuggauugaacc

SEQ ID NO: 156172 - RNA, 28 nt, Homo sapiens
cgaguggggcagaagcagccgccggaga

SEQ ID NO: 156173 - RNA, 35 nt, Homo sapiens
uccucccucccgauuccgccgcggcccccaaagac

SEQ ID NO: 156174 - RNA, 36 nt, Homo sapiens
agucuuugggggccgcggcggaaucgggagggagga

SEQ ID NO: 156175 - RNA, 27 nt, Homo sapiens
gugugugugugugugugugugugugug

SEQ ID NO: 156176 - RNA, 42 nt, Homo sapiens
ccuuccuuuuccaggggcagccuuaguucccauggcccugaa

SEQ ID NO: 156177 - RNA, 613 nt, Homo sapiens
gggaacaaagcugaccuggccaacaaacguaugguggaguaugaaguaagguggcccguggaguuccucucuaacacuuccucuguuccugggaccucuuuuuuuccaaaccagcccucucugaaaacgucaacagaggacauucauugucucauuccccaguucuacaccaaguuaaauacagcaacacugugacccuaaugacagccaggagauuuucaaaggagucaggagaaaacuccagagcagaggguuagggagguaccagcuguggggguaccagugugaaaacaggaaggagggagcaauuaaauuugugguaagggacuauucaagugucacaacccaaaagcccccaacuaacuuacccucuccccuauaauuaagcuuucugacauuuguguguuggacugaguggacauggggucaucuugagggaguugucauuaaauuaugcaucuaggcuagcuggcucaaagggguauuaauuaaggggagggaaccuaggauuuugccuagcuguugugcugcaugggaguggaaaggcaauacucguucccacccuacauucugagcacuaauacaucccacuccuugcaggaggcccaggcau

SEQ ID NO: 156178 - RNA, 51 nt, Homo sapiens
caauuggagcugaccuuuaaccaccaauaauuuuauguuaaacauuuugau

SEQ ID NO: 156179 - RNA, 64 nt, Homo sapiens
auuugguugacuuugugucacuuuuuacuagggcuaauugucuaaugucucuuuccacuagugu

SEQ ID NO: 156180 - RNA, 43 nt, Homo sapiens
aaauucgcggcuuauuugucuguguguagauuuuugaguucag

SEQ ID NO: 156181 - RNA, 43 nt, Homo sapiens
cgaaugacgguaacuuuuauugguaucuuucaaaaaguuugga

SEQ ID NO: 156182 - RNA, 42 nt, Homo sapiens
auguguagggcuuugcuuuaaugccaaaccaaguaaggaaga

SEQ ID NO: 156183 - RNA, 50 nt, Homo sapiens
gaucauuagcuguauuagaaaaaaaggccgaaaaagaguaugggaaaagu

SEQ ID NO: 156184 - RNA, 42 nt, Homo sapiens
uuuuuaaagauaaauauuauauaaaaaugauucuucugguga

SEQ ID NO: 156185 - RNA, 46 nt, Homo sapiens
caaucacacaugugcauuggaaugcugggcuaauagaaacagccaa

SEQ ID NO: 156186 - RNA, 352 nt, Homo sapiens
uggcuuugggaugaggcuggugguauuauuauuacuauuauuuugagacagaaucuugcucugucucccaggcuggagugcaauggcgugaucuuggcuugcugcaaccuuugccucccagguucaaucaauucccguaccucagccucccaaguagcugggacuacaggugcgcaccaucaugcccagcuaauuuuuguauuuucaguagcgacgggguuucaccauguucgucaggcuggucuugaacuccugaccucgugauccacccaccccggccucccaaagugcugggauuacaggcgugagccagugcaccccgccgcuggugguguuauuaacccucuuuaca

SEQ ID NO: 156187 - RNA, 46 nt, Homo sapiens
augauaguaauauucauaaagcuuaucuuugcuucuacauuaagag

SEQ ID NO: 156188 - RNA, 53 nt, Homo sapiens
augggaguaaacuuagacucuuuugucccugaaaguaaaacuagaaucagugg

SEQ ID NO: 156189 - RNA, 87 nt, Homo sapiens
cccgagaugacucaagugguggaugguuaccacuuggagggaguggacuaagcagcgucacugucuucaaagucccucaucaggaag

SEQ ID NO: 156190 - RNA, 48 nt, Homo sapiens
agcuaguaaaaauaaaccugagauucagaaagaacagaaacuuuuauu

SEQ ID NO: 156191 - RNA, 42 nt, Homo sapiens
cucauuuauaauaaggucacuccaacauuucaccacuggaag

SEQ ID NO: 156192 - RNA, 61 nt, Homo sapiens
uaagacgcagccuuccucauuaaaaauuaagaagucaaaacgaagaaaagaggauggugaa

SEQ ID NO: 156193 - RNA, 61 nt, Homo sapiens
cguucucgcugcguauacugccaggaaagguuuaaucaugaagaaaauguuaggggaaaau

SEQ ID NO: 156194 - RNA, 49 nt, Homo sapiens
ucugugcagagagcauguuguaucauuguaugucagacucagagggaga

SEQ ID NO: 156195 - RNA, 46 nt, Homo sapiens
gcuuuuggcaagcaauauggaaucuugccugguaucauugagccca

SEQ ID NO: 156196 - RNA, 46 nt, Homo sapiens
uugcagaaggaaaccauuucugguuauuuggcuauaaaaagucagc

SEQ ID NO: 156197 - RNA, 50 nt, Homo sapiens
guuugaauuuauuaggacacgaacuaaaaauaaaagugcacuaggggaca

SEQ ID NO: 156198 - RNA, 45 nt, Homo sapiens
uauuuaacucaucuaguuaauaauguuuuuauuccaugcgaauga

SEQ ID NO: 156199 - RNA, 46 nt, Homo sapiens
cucuuuggcuacaauuuauauugaguuauaucuguacauucuggua

SEQ ID NO: 156200 - RNA, 39 nt, Homo sapiens
gaaguuuuuuaguuguuuuuugugguauucaaccagcaa

SEQ ID NO: 156201 - RNA, 53 nt, Homo sapiens
uuucagcuuaauccucagugcuuauuauuuacauaacaauaacuuuuuaucag

SEQ ID NO: 156202 - RNA, 45 nt, Homo sapiens
auauaucacacuuaagcuuguguuagcuuuuuucuuuugccccag

SEQ ID NO: 156203 - RNA, 44 nt, Homo sapiens
gggcuauuuauguggugaccaccucuaccagggaaaccaggaau

SEQ ID NO: 156204 - RNA, 52 nt, Homo sapiens
gaauuguaaaaugguuauuuaccuaaugugucuuguuggcuugcugaaagau

SEQ ID NO: 156205 - RNA, 86 nt, Homo sapiens
ccaugagguguuuugcaaugagacaaacaugaagaaugaauuucuuuaagagagaaacacaaccggaggugauuuauauaaaccaa

SEQ ID NO: 156206 - RNA, 46 nt, Homo sapiens
ucuccagccuugagguucacaaaccaacucaucaggacaccccaag

SEQ ID NO: 156207 - RNA, 41 nt, Homo sapiens
gugaguucaaagaugucaaacacgcuguugucuccgccaga

SEQ ID NO: 156208 - RNA, 46 nt, Homo sapiens
gccgcccgcaaggggucugggcgccgacuggugaagggccccgacc

SEQ ID NO: 156209 - RNA, 50 nt, Homo sapiens
ucagguuggcauccucgaugcggaaagcugggcuggaagggucggggccc

SEQ ID NO: 156210 - RNA, 60 nt, Homo sapiens
gcagaugaagaagacccggggcacgcugcuggcccuggagcggaaagaccacucuggcca

SEQ ID NO: 156211 - RNA, 45 nt, Homo sapiens
ccacagacaccacgugcugcuuuccuuggacggucaggcugaggu

SEQ ID NO: 156212 - RNA, 47 nt, Homo sapiens
uguuugugcaggaagacagggcccagcuguacaucgacugugaaaag

SEQ ID NO: 156213 - RNA, 46 nt, Homo sapiens
uugacgccccccuuugcgaugcggagucuggcgaugcuggccaggu

SEQ ID NO: 156214 - RNA, 48 nt, Homo sapiens
ucaccagagaccuggccagcaucgccagacuccgcaucgcaaaggggg

SEQ ID NO: 156215 - RNA, 45 nt, Homo sapiens
agggggugcugcagaaugugagguuugucuuuggaaccacaccag

SEQ ID NO: 156216 - RNA, 45 nt, Homo sapiens
cuggaaccauucaccacguuguugucaagggugaggaggacacug

SEQ ID NO: 156217 - RNA, 52 nt, Homo sapiens
acguggugaaugguuccagcccugccauccgcacuaacuacauuggccacaa

SEQ ID NO: 156218 - RNA, 46 nt, Homo sapiens
gggccugcgcaccauugugaccacgcugcaggacagcauccgcaaa

SEQ ID NO: 156219 - RNA, 45 nt, Homo sapiens
cuuugcggaugcuguccugcagcguggucacaauggugcgcaggc

SEQ ID NO: 156220 - RNA, 47 nt, Homo sapiens
uuauuucuguacugaacuccguugugauagcauaggggaggccgccu

SEQ ID NO: 156221 - RNA, 57 nt, Homo sapiens
ugagcugaggcggccuccccuaugcuaucacaacggaguucaguacagaaauaacga

SEQ ID NO: 156222 - RNA, 52 nt, Homo sapiens
cucaguuaccaucugcaaaaagguguccugccccaucaugcccugcuccaau

SEQ ID NO: 156223 - RNA, 56 nt, Homo sapiens
gauggcuggucuccaugguccgaguggaccuccuguucuacgagcuguggcaaugg

SEQ ID NO: 156224 - RNA, 49 nt, Homo sapiens
guagaacaggagguccacucggaccauggagaccagccaucguccgcag

SEQ ID NO: 156225 - RNA, 52 nt, Homo sapiens
aauucagcagcgcggccgcuccugcgauagccucaacaaccgaugugagggc

SEQ ID NO: 156226 - RNA, 45 nt, Homo sapiens
aucucuugucacacuccugaauguggcagguccgugucuggaccg

SEQ ID NO: 156227 - RNA, 46 nt, Homo sapiens
ugucacagaacaagaugaccacggggaccaguggcuccagccacca

SEQ ID NO: 156228 - RNA, 71 nt, Homo sapiens
gccacugguccccguggucaucuuguucugugacauguggugauggugugaucacaaggauccggcucugc

SEQ ID NO: 156229 - RNA, 45 nt, Homo sapiens
aggguuucccguucaucugggggcugggagaguugcagagccgga

SEQ ID NO: 156230 - RNA, 80 nt, Homo sapiens
aacucucccagcccccagaugaacgggaaacccugugaaggcgaagcgcgggagaccaaagccugcaagaaagacgccug

SEQ ID NO: 156231 - RNA, 65 nt, Homo sapiens
ccuuggucaccaugggacaucuguucugucaccuguggaggagggguacagaaacguagucgucu

SEQ ID NO: 156232 - RNA, 54 nt, Homo sapiens
cugcaacaaccccacaccccaguuuggaggcaaggacugcguuggugauguaac

SEQ ID NO: 156233 - RNA, 45 nt, Homo sapiens
uacacuucacgccggcaaagcagggauuggacaggcauccaucug

SEQ ID NO: 156234 - RNA, 49 nt, Homo sapiens
gugcuugucccccugguuacaguggaaauggcauccagugcacagaugu

SEQ ID NO: 156235 - RNA, 46 nt, Homo sapiens
cucaucaacaucugugcacuggaugccauuuccacuguaaccaggg

SEQ ID NO: 156236 - RNA, 88 nt, Homo sapiens
caaagaagugccugaugccugcuucaaccacaauggagagcaccggugugagaacacggaccccggcuacaacugccugcccugcccc

SEQ ID NO: 156237 - RNA, 46 nt, Homo sapiens
ugagccggugaagcguggggggcagggcaggcaguuguagccgggg

SEQ ID NO: 156238 - RNA, 46 nt, Homo sapiens
aagccccguaaccccugcacggaugggacccacgacugcaacaaga

SEQ ID NO: 156239 - RNA, 46 nt, Homo sapiens
cgcuauaguggcccagguaguugcacuuggcguucuuguugcaguc

SEQ ID NO: 156240 - RNA, 51 nt, Homo sapiens
gagugcaagccuggcuacgcuggcaauggcaucaucugcggggaggacaca

SEQ ID NO: 156241 - RNA, 45 nt, Homo sapiens
gccauccaggucuguguccuccccgcagaugaugccauugccagc

SEQ ID NO: 156242 - RNA, 91 nt, Homo sapiens
uugccccaaccuucccaacucagggcaggaagacuaugacaaggauggaauuggugaugccugugaugaugacgaugacaaugauaaaauu

SEQ ID NO: 156243 - RNA, 52 nt, Homo sapiens
caccaauuccauccuugucauagucuuccugcccugaguugggaagguuggg

SEQ ID NO: 156244 - RNA, 42 nt, Homo sapiens
gagugaucaauuagccuauccacuagguagaaaguauugcug

SEQ ID NO: 156245 - RNA, 81 nt, Homo sapiens
uguccauuccauuacaacccagcucaguaugacuaugacagagaugaugugggagaccgcugugacaacugucccuacaac

SEQ ID NO: 156246 - RNA, 29 nt, Homo sapiens
ugaucuggguugugguuguagggacaguu

SEQ ID NO: 156247 - RNA, 70 nt, Homo sapiens
cacaacccagaucaggcagacacagacaacaauggggaaggagacgccugugcugcagacauugauggag

SEQ ID NO: 156248 - RNA, 55 nt, Homo sapiens
gaacgggacaacugccaguacgucuacaauguggaccagagagacacugauaugg

SEQ ID NO: 156249 - RNA, 46 nt, Homo sapiens
uuguugucacagguaucuccaaugcggucugagucagaguccagcu

SEQ ID NO: 156250 - RNA, 45 nt, Homo sapiens
gacucugacucagaccgcauuggagauaccugugacaacaaucag

SEQ ID NO: 156251 - RNA, 46 nt, Homo sapiens
uccugaugacaaggacaacugcagacucgugcccaaucccgaccag

SEQ ID NO: 156252 - RNA, 84 nt, Homo sapiens
gaggugaugccugcaaagaugauuuugaccaugacagugugccagacaucgaugacaucuguccugagaauguugacaucagug

SEQ ID NO: 156253 - RNA, 125 nt, Homo sapiens
agaccgauuuccgccgauuccagaugauuccucuggaccccaaagggacaucccaaaaugacccuaacuggguuguacgccaucaggguaaagaacucguccagacugucaacugugauccugga

SEQ ID NO: 156254 - RNA, 45 nt, Homo sapiens
augcuguggacuucaguggcaccuucuucaucaacaccgaaaggg

SEQ ID NO: 156255 - RNA, 47 nt, Homo sapiens
ggaagcaagucacccaguccuacugggacaccaaccccacgagggcu

SEQ ID NO: 156256 - RNA, 71 nt, Homo sapiens
ccuuucugugaaaguuguaaacuccaccacagggccuggcgagcaccugcggaacgcccuguggcacacag

SEQ ID NO: 156257 - RNA, 44 nt, Homo sapiens
ccgccuacagauggcgucucagccacaggccaaagacggguuuc

SEQ ID NO: 156258 - RNA, 46 nt, Homo sapiens
ucauggcugacucaggacccaucuaugauaaaaccuaugcuggugg

SEQ ID NO: 156259 - RNA, 48 nt, Homo sapiens
caacccuagucuaccaccagcauagguuuuaucauagauggguccuga

SEQ ID NO: 156260 - RNA, 58 nt, Homo sapiens
guuccagaaggugcaauaccagcauugguuuaugaucagucuuucaaucaacaauuug

SEQ ID NO: 156261 - RNA, 82 nt, Homo sapiens
aucaaauuguugauugaaagacugaucauaaaccaaugcugguauugcaccuucuggaacuaugggcuugagaaaaccccca

SEQ ID NO: 156262 - RNA, 47 nt, Homo sapiens
ugaggcaggucgcacguucuaggaguccacacugaugcaagcacaga

SEQ ID NO: 156263 - RNA, 102 nt, Homo sapiens
ggaucacuucuccuuggcuuccuucuuuucugugcuugcaucaguguggacuccuagaacgugcgaccugccucaagaaaaugcaguuuucaaaaacagacu

SEQ ID NO: 156264 - RNA, 47 nt, Homo sapiens
uacuugcuucaguugggaaggugcccauuccacucugccuuugucac

SEQ ID NO: 156265 - RNA, 47 nt, Homo sapiens
gaguccacugcucagagauggccucacaauagcacccugcucuguga

SEQ ID NO: 156266 - RNA, 82 nt, Homo sapiens
agcagaggccaaagcacuaaggggagggcgcauacccgagacgauuguaugaagaaaauauggaggaacuguuacauguucg

SEQ ID NO: 156267 - RNA, 93 nt, Homo sapiens
guacuaagucauuuucaggggauugaaagacuauugcuggauuucaugaugcugacuggcguuagcugauuaacccauguaaauaggcacuua

SEQ ID NO: 156268 - RNA, 57 nt, Homo sapiens
gccagcacugccuuacacugguuugauucugauucccuaauucuggccacugcaggu

SEQ ID NO: 156269 - RNA, 67 nt, Homo sapiens
auucuagauguagcuugugcagauguagcaggaaaauaggaaaaccuaccaucucagugagcaccag

SEQ ID NO: 156270 - RNA, 57 nt, Homo sapiens
cugccucccaaaggaggggcagccgugcuuauauuuuuaugguuacaauggcacaaa

SEQ ID NO: 156271 - RNA, 55 nt, Homo sapiens
aaucuacauuccaaaagagagaauuagaaaacuccaugauaauucaggaaaaaag

SEQ ID NO: 156272 - RNA, 44 nt, Homo sapiens
uuuacgauguaaaauauuuauuuuuuacuuauucuggaagaucu

SEQ ID NO: 156273 - RNA, 84 nt, Homo sapiens
cugccuggaaauuuaggcuucauacggaaaguguuugagagcaaguaguugacauuuaucagcaaaucucuugcaagaacagca

SEQ ID NO: 156274 - RNA, 46 nt, Homo sapiens
uuuuucucuguuuuaucuuuucaaguggaauuaguugguuauccau

SEQ ID NO: 156275 - RNA, 56 nt, Homo sapiens
ugaaacuuacauacaaauauuaccucauuuguugugugacugaguaaagaauuuuu

SEQ ID NO: 156276 - RNA, 99 nt, Homo sapiens
gaaagaguuuaagugucuaacaaacuuaaagcuacuguaguaccuaaaaagucaguguuguacauagcauaaaaacucugcagagaaguauucccaaua

SEQ ID NO: 156277 - RNA, 46 nt, Homo sapiens
uaacauuucaaugcuauuuccuuauugggaauacuucucugcagag

SEQ ID NO: 156278 - RNA, 56 nt, Homo sapiens
ccauugcuuuauuuuuauaaauuauuuucucauugccauuggaauagauaucucag

SEQ ID NO: 156279 - RNA, 46 nt, Homo sapiens
auuuccugauaaauuauuuaaauagcauaucuacacaaucugagau

SEQ ID NO: 156280 - RNA, 50 nt, Homo sapiens
acugccuguagaguuaguauuucuauuuuuauauaauguuugcacacuga

SEQ ID NO: 156281 - RNA, 63 nt, Homo sapiens
uuuuuuuuuuuuuugcuuuugaccucccauuuuuacuauuugccaauaccuuuuucuaggaau

SEQ ID NO: 156282 - RNA, 46 nt, Homo sapiens
guuguauauuacuguuucuuauguacaaggaacaacaauaaaucau

SEQ ID NO: 156283 - RNA, 47 nt, Homo sapiens
uggccuggauggcguuaaguaguuugaaauuauuguauggggaacca

SEQ ID NO: 156284 - RNA, 34 nt, Homo sapiens
aggugacuccacugucaacuggaguugcagggau

SEQ ID NO: 156285 - RNA, 43 nt, Homo sapiens
acagaauuacuuucccauagucaaaacaaaacaaacauccugg

SEQ ID NO: 156286 - RNA, 43 nt, Homo sapiens
gcaacgugaaauccugcaugagauucagagaaggaaagaagag

SEQ ID NO: 156287 - RNA, 39 nt, Homo sapiens
acauaauuacuguaauuuaucaaaugagggagggaagag

SEQ ID NO: 156288 - RNA, 83 nt, Homo sapiens
uugucccuuaaaaugggacugauaaugccuuucuuucugucuuguauaauuaccuccacagauaaguguacugcccuauguga

SEQ ID NO: 156289 - RNA, 46 nt, Homo sapiens
augaacaacuuggaaaauuagucuacaaugcuuuggaaacagccac

SEQ ID NO: 156290 - RNA, 24 nt, Homo sapiens
agaucuugguggcuauaaaucucu

SEQ ID NO: 156291 - RNA, 50 nt, Homo sapiens
aaaaaaaucaaaaaacaauacuauuuuguuuggaugguuguauguuuaug

SEQ ID NO: 156292 - RNA, 42 nt, Homo sapiens
uucugaaggacaagauuauguugagacuguuauuccuagcaa

SEQ ID NO: 156293 - RNA, 43 nt, Homo sapiens
cccagauuauuguauuaaguccauauacaguacaugucaucuu

SEQ ID NO: 156294 - RNA, 45 nt, Homo sapiens
cggcugcaccaugagaacauugugcgcuacuacaacgccuggauc

SEQ ID NO: 156295 - RNA, 40 nt, Homo sapiens
uacgaaggggagaggguacaaagaaaggaauagaagaagg

SEQ ID NO: 156296 - RNA, 44 nt, Homo sapiens
uccuuaaauggugguugggaguccaacagguggagguugagggc

SEQ ID NO: 156297 - RNA, 49 nt, Homo sapiens
uuggcugucggaagaccagcauacugucugacuggucgaaacugugagg

SEQ ID NO: 156298 - RNA, 47 nt, Homo sapiens
uuaauggugagaauaaccacuggggccaaguuagaaggugagacuag

SEQ ID NO: 156299 - RNA, 46 nt, Homo sapiens
cagaaaggaucuuuguucucaaccaacucagagauguauguaucag

SEQ ID NO: 156300 - RNA, 60 nt, Homo sapiens
cuuaccuggagaaauugcuagguuauaguugcuuuuuaaaaaauuauucugagauuuacu

SEQ ID NO: 156301 - RNA, 51 nt, Homo sapiens
ggaggagucagagcugcaugaagugcugcaccacacgcugaccaacgugga

SEQ ID NO: 156302 - RNA, 59 nt, Homo sapiens
ugggaaggccuaccgcaccaugauggcccagaucuucucgcagcgcaucuccccugcca

SEQ ID NO: 156303 - RNA, 46 nt, Homo sapiens
ccaguuuguggcuuucaucaaacgaaggcaaagggcuguaccugaa

SEQ ID NO: 156304 - RNA, 45 nt, Homo sapiens
ucauucuuuuuaagguuaagucuuucgagaaggaaaggcagacag

SEQ ID NO: 156305 - RNA, 46 nt, Homo sapiens
agaaacuuugcaagaggagcugaagcuuuuuaacgaaacagccaaa

SEQ ID NO: 156306 - RNA, 45 nt, Homo sapiens
augguaggaaauggucagggugaugucugccucucaccuguaacu

SEQ ID NO: 156307 - RNA, 49 nt, Homo sapiens
gagggacaauuccuaaaaccagugcauagaaauaaaaucuaaaauagaa

SEQ ID NO: 156308 - RNA, 46 nt, Homo sapiens
ucaaguaaaugauuuaacaacagcccuuaaggaaauggagcagcua

SEQ ID NO: 156309 - RNA, 49 nt, Homo sapiens
gacucggucagcaucuuucgcucguccuccaguccuaugucuggcuacg

SEQ ID NO: 156310 - RNA, 46 nt, Homo sapiens
cggcccgcccggaccgcggccucauaguaggccaggggcugagcuc

SEQ ID NO: 156311 - RNA, 26 nt, Homo sapiens
acguacuccuucuccagcuacauagg

SEQ ID NO: 156312 - RNA, 46 nt, Homo sapiens
ggucguugagaaugggauggcccaagaacugaagguggacucgaau

SEQ ID NO: 156313 - RNA, 109 nt, Homo sapiens
ccgggccgggcacacugugcccuuuuuccccuccucggccuguacguugugccgccucccgcuucccuaacacuucuccgccugcaccucggccccuccggccacccgg

SEQ ID NO: 156314 - RNA, 49 nt, Homo sapiens
cuguuuguauuucucacuuaagcuuuuuuuggcucuaaaugaagugaca

SEQ ID NO: 156315 - RNA, 50 nt, Homo sapiens
gcacguaacagauuuuucguuuucugcaaguauaauaaccuuaacaaaug

SEQ ID NO: 156316 - RNA, 96 nt, Homo sapiens
guggugugggagcacggaaaagggagagcuuauuugaugcuuuuggugauggauuuguggagaagaccgcauuugagguggacguugguuggagag

SEQ ID NO: 156317 - RNA, 48 nt, Homo sapiens
uucaguaaguuugaauuuuaucaguuaauugcuaacugauuggucuac

SEQ ID NO: 156318 - RNA, 47 nt, Homo sapiens
agaaaaguuuucuucaaaaauggauggggugucuucagaggcuaaug

SEQ ID NO: 156319 - RNA, 48 nt, Homo sapiens
auuuaaugcagcuaaaaauauuauauucuaucagagaaagauauuuuu

SEQ ID NO: 156320 - RNA, 42 nt, Homo sapiens
uuugucuaaaauugacaucacaaccugguggcuuguuugcag

SEQ ID NO: 156321 - RNA, 44 nt, Homo sapiens
aguccucuucaggaccucagaggugggaaugaaagaguucaggu

SEQ ID NO: 156322 - RNA, 46 nt, Homo sapiens
ccuuaggaauccaaugcuuugagaaauaagaaaaacucucgucgag

SEQ ID NO: 156323 - RNA, 41 nt, Homo sapiens
ucuaggguauuccagacggagucucauaugaaaauagugag

SEQ ID NO: 156324 - RNA, 46 nt, Homo sapiens
auaguuuucaauuauagaacauacccgugaaaggaaacaugcaaau

SEQ ID NO: 156325 - RNA, 42 nt, Homo sapiens
cucucaaauaugagagaggagaaaaauuugcuaaagcaugac

SEQ ID NO: 156326 - RNA, 49 nt, Homo sapiens
aauccagaugcuaugucuucucucacagagaaaacuauuuauuccggag

SEQ ID NO: 156327 - RNA, 44 nt, Homo sapiens
aaagccuuaagcuaaaaaaugacaagaccauuguauuuucagag

SEQ ID NO: 156328 - RNA, 49 nt, Homo sapiens
ugcuacuaauagaacuacuaaugaaaucaucaaauuucauagugcugcu

SEQ ID NO: 156329 - RNA, 64 nt, Homo sapiens
gaaguuauucaaaccaguaccaaaggacaguuagacuguguuauaacacugcacaaagaucaag

SEQ ID NO: 156330 - RNA, 61 nt, Homo sapiens
auauucauaaggagaaaaaaaucagaaaaaaugagauuaaguuuagugauacgacacaaga

SEQ ID NO: 156331 - RNA, 45 nt, Homo sapiens
guugauauaaauaagaaccugugggaaaaaaugagacacugcucu

SEQ ID NO: 156332 - RNA, 37 nt, Homo sapiens
ccaugaguacugccccaauucuagauuagguuagagg

SEQ ID NO: 156333 - RNA, 40 nt, Homo sapiens
cucuguagcacugaaaagagacaacagugaaaccugauac

SEQ ID NO: 156334 - RNA, 31 nt, Homo sapiens
cugggucgaaccaccaauaauacgagcauuc

SEQ ID NO: 156335 - RNA, 29 nt, Homo sapiens
uaauaagagaugaccaaugaucaagaggg

SEQ ID NO: 156336 - RNA, 42 nt, Homo sapiens
accuucgccgccgagccacucucugguucucuuccauguggc

SEQ ID NO: 156337 - RNA, 58 nt, Homo sapiens
cccacagggacaggaguggccugguuacugaauaggguaguggaaaaaaacccaggag

SEQ ID NO: 156338 - RNA, 45 nt, Homo sapiens
aacuuccucaagaagugaaauccccagguccacuuugaaggagag

SEQ ID NO: 156339 - RNA, 45 nt, Homo sapiens
ugucuugacccauggccguguccacuugcuacugaguaaggggca

SEQ ID NO: 156340 - RNA, 50 nt, Homo sapiens
cguaaacuuuucagucucucuaaagaaaaugaugucugccaguauguugu

SEQ ID NO: 156341 - RNA, 48 nt, Homo sapiens
gcagcacaaacagcggcguauugcucugaagcagccgcauauuaagaa

SEQ ID NO: 156342 - RNA, 44 nt, Homo sapiens
agaaugaaggaggcuaagaagcaccagggacaaaucgugaagag

SEQ ID NO: 156343 - RNA, 65 nt, Homo sapiens
gcugcuaggcauugaggagaaggcagcggacaaagaggugagaacgguggcgaggaaggcugauc

SEQ ID NO: 156344 - RNA, 41 nt, Homo sapiens
agcagagggaguaacgggcuuggugugauggacaccgcgcu

SEQ ID NO: 156345 - RNA, 42 nt, Homo sapiens
ggagagaauucuccugauucugugcucauuuuaucuagaaga

SEQ ID NO: 156346 - RNA, 50 nt, Homo sapiens
aagcaggacuucucaaucuuaguucucuugacacuuuggaccggguaauu

SEQ ID NO: 156347 - RNA, 368 nt, Homo sapiens
cccuuauggcuaacacauucaagaaucuuuauuuauuuauuuauuuauuuuuuuuuuuuuuuuuuugagacggagucuugcucugucacccaggcuggagugcaauggcacgaucucggcucacugcaaccucugccuuccagauucaggaaauucugccucagccucccaaguagcugggcuuacaggugggcaccaccacgccgagcuaauuuuuguauuuuuaguagaaacgagguuucaccuuuuuggccaggcuggucuugaacuccugaccucaggugauccacccaccucggccucccaaagugcuaggauuauaggcgugagccacugugccugaccucaagaaucuuaauacaggaaaa

SEQ ID NO: 156348 - RNA, 33 nt, Homo sapiens
ggcccucaggaaaucauuuccauuucguggcgg

SEQ ID NO: 156349 - RNA, 44 nt, Homo sapiens
ggggccagccccgcccucccuggccuuggggauugagggcagcc

SEQ ID NO: 156350 - RNA, 36 nt, Homo sapiens
agcguuccccaagcucuuucucaccccugugccaag

SEQ ID NO: 156351 - RNA, 97 nt, Homo sapiens
aggggagcucccugacugcaaaugaguuccagaaggaaaugaaggaaaaaggagaaccgcagacaaaugcucauaagggaugaggcaugaggagcag

SEQ ID NO: 156352 - RNA, 46 nt, Homo sapiens
gaacaggaugcagugacugaugauaagaagggccccggugagaagg

SEQ ID NO: 156353 - RNA, 43 nt, Homo sapiens
aguggguuccccauagaacaggccugagacuggagagaggagu

SEQ ID NO: 156354 - RNA, 62 nt, Homo sapiens
uucaggguuaguaucuggggguggguuaucccaggugaggagcaggacugcugugagagaga

SEQ ID NO: 156355 - RNA, 41 nt, Homo sapiens
gaagaguggcuuagcuauuuacccgcucuuuggggacaggg

SEQ ID NO: 156356 - RNA, 41 nt, Homo sapiens
ccggcagcaccuccugcacuauaagcuucccaauuccacgc

SEQ ID NO: 156357 - RNA, 28 nt, Homo sapiens
aaauugggcuuuguggaagaagugggga

SEQ ID NO: 156358 - RNA, 46 nt, Homo sapiens
agcccgagccagucugcuggccucccaggcucugcaccgaggggag

SEQ ID NO: 156359 - RNA, 32 nt, Homo sapiens
agaaggugcccagcaagccuugcuauaaagag

SEQ ID NO: 156360 - RNA, 42 nt, Homo sapiens
cugaggagcagaggccaggaggacccucugcuaaugucacca

SEQ ID NO: 156361 - RNA, 35 nt, Homo sapiens
ucauuauuauuucagacacugcauagccuguguuu

SEQ ID NO: 156362 - RNA, 26 nt, Homo sapiens
uccugagaguuuuaucaccuauagau

SEQ ID NO: 156363 - RNA, 42 nt, Homo sapiens
gggcgcggccggggcggagccggcgaggagcccuagggaaag

SEQ ID NO: 156364 - RNA, 41 nt, Homo sapiens
ucgccuuucuugguucuagaaccuucaguaggcuuuucugg

SEQ ID NO: 156365 - RNA, 73 nt, Homo sapiens
gugagcuguaggaguggggacuugguaaacaaaggaccggugguguguaagugcagaaaugagggaggggaaa

SEQ ID NO: 156366 - RNA, 28 nt, Homo sapiens
auucauuagacgcauagaaaagaaccau

SEQ ID NO: 156367 - RNA, 48 nt, Homo sapiens
agagcagaggguuucugcugucuccagacugucuaccaaagagaaggc

SEQ ID NO: 156368 - RNA, 52 nt, Homo sapiens
uagaugacuucuuucaccuccaaaauucccuuaguuucuaugaaaauauugg

SEQ ID NO: 156369 - RNA, 45 nt, Homo sapiens
cgauggcaccaccgagggccccuucaaccagggcuacggggaggg

SEQ ID NO: 156370 - RNA, 46 nt, Homo sapiens
cugaagcccaagcugaucgaggcaguggacaacaugcugagcaaca

SEQ ID NO: 156371 - RNA, 24 nt, Homo sapiens
aggcuagucauggagaauuuguuc

SEQ ID NO: 156372 - RNA, 37 nt, Homo sapiens
caggaggaaacaggaaaggcgguucuguuccacuggg

SEQ ID NO: 156373 - RNA, 43 nt, Homo sapiens
accucugggguuuucugguaaccaguuacauucuccaagaggu

SEQ ID NO: 156374 - RNA, 44 nt, Homo sapiens
ugcagacaagggcuggaggugggaaaccugcugaagagaaugac

SEQ ID NO: 156375 - RNA, 41 nt, Homo sapiens
cuuagacguggagaggauauggaguugagggggcagccuag

SEQ ID NO: 156376 - RNA, 46 nt, Homo sapiens
gguccggagcccaccacagacuccuucaucgccgugauguauggag

SEQ ID NO: 156377 - RNA, 23 nt, Homo sapiens
gaaugcaguugugggagaucauu

SEQ ID NO: 156378 - RNA, 35 nt, Homo sapiens
caaaguaugauaaaaauuuuuaauaaaaugcuuga

SEQ ID NO: 156379 - RNA, 44 nt, Homo sapiens
guaauaauuuaaaauagaaauggaugccagaaagaaaacaaagu

SEQ ID NO: 156380 - RNA, 42 nt, Homo sapiens
uccacgaguuccacucgccugcgcuggaggacgccgacuucg

SEQ ID NO: 156381 - RNA, 47 nt, Homo sapiens
aggaugacuguguuacagggaauuuucagaguaguagcaauuucaag

SEQ ID NO: 156382 - RNA, 48 nt, Homo sapiens
guuauauaggggaaggacugccccaggauuuucuccucugaauuguga

SEQ ID NO: 156383 - RNA, 48 nt, Homo sapiens
uaaauacugcaucauaauauuucagacuugaaauggacagaguauaag

SEQ ID NO: 156384 - RNA, 41 nt, Homo sapiens
aagaaaucauugccauggguuaguacaaaaugcacagggga

SEQ ID NO: 156385 - RNA, 43 nt, Homo sapiens
guccaaaauggaguaaggaaugggaagauuugcaguuaaagau

SEQ ID NO: 156386 - RNA, 32 nt, Homo sapiens
aauuaugaaagacaaguuuuaagaccuucaug

SEQ ID NO: 156387 - RNA, 36 nt, Homo sapiens
auuaugccuuccccccccccccauuugcauuuagac

SEQ ID NO: 156388 - RNA, 98 nt, Homo sapiens
uaaccagcagcccagcucacuuuguaaugauagaaaggguaaaauuaaaacuuacauaaccaacuuugaaauuaaaaauguauguguaaaucugauuu

SEQ ID NO: 156389 - RNA, 43 nt, Homo sapiens
ugaagaauguguuucaaggaggaagugauugugucaagagauc

SEQ ID NO: 156390 - RNA, 45 nt, Homo sapiens
ucagauguaugauaggaaagagaagaggaauuaaggaugaugcca

SEQ ID NO: 156391 - RNA, 35 nt, Homo sapiens
caccauuaaguacuguguuuacuguagaacuuuug

SEQ ID NO: 156392 - RNA, 49 nt, Homo sapiens
cuuguuugguuuguugugccuaauguuucaaugaaugaaagagaaggac

SEQ ID NO: 156393 - RNA, 45 nt, Homo sapiens
gcaauagagagacugucaagcaugagaaggaaaggguccagaaag

SEQ ID NO: 156394 - RNA, 43 nt, Homo sapiens
uauuuaaaaauuauuuuggaauauuuagcaacuugccuugaac

SEQ ID NO: 156395 - RNA, 52 nt, Homo sapiens
ggaaaaacuuaaggaaaaaagaggcuugucugggaaauaucaaacaucauca

SEQ ID NO: 156396 - RNA, 44 nt, Homo sapiens
aaaagcgcugauuguuacaaugaaaucuauaacuucaagguaag

SEQ ID NO: 156397 - RNA, 47 nt, Homo sapiens
uggggaauuaucuuuuguuaacaaagauuucuucuuuuguaguugau

SEQ ID NO: 156398 - RNA, 56 nt, Homo sapiens
uucaauaccuuauguuuggagaaaggauggucuuugaguaucucaguuuaggguac

SEQ ID NO: 156399 - RNA, 44 nt, Homo sapiens
auguuucacagaauccaguguccccggguuggauaagaaagaua

SEQ ID NO: 156400 - RNA, 48 nt, Homo sapiens
gaacuuucagugccugacuugagauguaaacuugauguacaaacggag

SEQ ID NO: 156401 - RNA, 45 nt, Homo sapiens
ucguuuuucagugcgggaccggcaaccguagcugcugccgaccgg

SEQ ID NO: 156402 - RNA, 46 nt, Homo sapiens
gcugguccccuuguguuuuguugucucacauuuagauaucagccau

SEQ ID NO: 156403 - RNA, 80 nt, Homo sapiens
gaauuuagagugaaucugggaaauguagucaccagguaacccagcagggccauauacuugggcuuggaggugagguuaga

SEQ ID NO: 156404 - RNA, 48 nt, Homo sapiens
caguaguaaguaaugacuuucucucagauucaaguaacaucaggucaa

SEQ ID NO: 156405 - RNA, 59 nt, Homo sapiens
gcagggaagugaaggcaaagaacugucucagaaacaagucucuaggaagucugcuugag

SEQ ID NO: 156406 - RNA, 44 nt, Homo sapiens
aguaugguuccuuaacauuugucuaaaucuauuuaaaaccucca

SEQ ID NO: 156407 - RNA, 42 nt, Homo sapiens
gcuuccuuuuuucagucauucguguuaauccucauaucauua

SEQ ID NO: 156408 - RNA, 46 nt, Homo sapiens
uuucucuucuccugauucugaagaaucaauggcuacuacuucuaac

SEQ ID NO: 156409 - RNA, 44 nt, Homo sapiens
ggaaaaagggagugggcagcagugcggcaucaauggauguuuga

SEQ ID NO: 156410 - RNA, 46 nt, Homo sapiens
ucugaacuuccacauaagcugucugaagggcugcacgggcuugcag

SEQ ID NO: 156411 - RNA, 45 nt, Homo sapiens
uccuucuuuuauuuuuucucucaagacuugggaguucaggagaag

SEQ ID NO: 156412 - RNA, 64 nt, Homo sapiens
uagcggcagaaaugccggaagagcagaagugguaucagugaaauaaaagacucuuaaaggccag

SEQ ID NO: 156413 - RNA, 64 nt, Homo sapiens
ucuccuggcuguucaagucuuuugccaaaugcaucaaagguauuauauggucagaggauaauug

SEQ ID NO: 156414 - RNA, 45 nt, Homo sapiens
uuucagcccuuucaccuguucggagggaggcagcccgagguguca

SEQ ID NO: 156415 - RNA, 49 nt, Homo sapiens
cuuugccuguaccuuccucacugaagaagcuauacacagaaggagcucu

SEQ ID NO: 156416 - RNA, 34 nt, Homo sapiens
aagugaggaaaaaaaagacaccgaaaagcagcac

SEQ ID NO: 156417 - RNA, 74 nt, Homo sapiens
gguguacuccaguuuugcucuucaaacuaaugugccggguuagaucccucugaagugaggcaggaaagccaagc

SEQ ID NO: 156418 - RNA, 22 nt, Homo sapiens
cgcaguuuggauauguaaggac

SEQ ID NO: 156419 - RNA, 45 nt, Homo sapiens
uuugagauauucuuuggaucuugcuuuugagacaaugauuuagug

SEQ ID NO: 156420 - RNA, 55 nt, Homo sapiens
uuaucacuuguaaauccuucagaaggaccucuauauguggcaacuguaccaaguu

SEQ ID NO: 156421 - RNA, 46 nt, Homo sapiens
uuccaguuuccguuacuguuguucauaugccaacuggaaaagccac

SEQ ID NO: 156422 - RNA, 46 nt, Homo sapiens
uggggucgucugucaucagaguuuauuucuugguugcuauuggaag

SEQ ID NO: 156423 - RNA, 67 nt, Homo sapiens
uuuauuaacugaaugaguuccuugucaaaauaaucuucuuccucuuccucuccuuuuccaucaucuu

SEQ ID NO: 156424 - RNA, 67 nt, Homo sapiens
cucuuuccugggcaucaacguuaucuuugugcaacuggccagaaaugugcuuugcauaugcagaaag

SEQ ID NO: 156425 - RNA, 46 nt, Homo sapiens
cgauguggcauaauaugcauuuucguucucguaccauagugaccag

SEQ ID NO: 156426 - RNA, 56 nt, Homo sapiens
cuuacuccaucaggccgccgagagccaggcgagggagcucccugacgccucagacg

SEQ ID NO: 156427 - RNA, 28 nt, Homo sapiens
aucguacauccccgaguguagaggaaag

SEQ ID NO: 156428 - RNA, 41 nt, Homo sapiens
agugaagauaucuugcuguccacgccuuaaaauucuucgcc

SEQ ID NO: 156429 - RNA, 68 nt, Homo sapiens
uaaacuacugucucacaaaucuugaagacuucuucagauccuccucaaauauaugccccuaaccagcu

SEQ ID NO: 156430 - RNA, 49 nt, Homo sapiens
gaauuaguugagacacuggauguguuaguuguguagguguuuuggggag

SEQ ID NO: 156431 - RNA, 58 nt, Homo sapiens
uaccugacucagugggagagcugcaagucaucgaacucaaccucaaccagaaucaggu

SEQ ID NO: 156432 - RNA, 46 nt, Homo sapiens
auuaccuccccaacuuuguagccuacggcaccuggaugugauggau

SEQ ID NO: 156433 - RNA, 35 nt, Homo sapiens
cacagcacggcaagccucccuaccuguugcuagga

SEQ ID NO: 156434 - RNA, 41 nt, Homo sapiens
gccugcccgacgcucacggcuccgggggcccauggccagaa

SEQ ID NO: 156435 - RNA, 44 nt, Homo sapiens
cacguuucuacaagccuuccagucaaaagggaaaccuugccuaa

SEQ ID NO: 156436 - RNA, 49 nt, Homo sapiens
guaccauacaauuuacugacugaaauacaucauauugcucauacuaaga

SEQ ID NO: 156437 - RNA, 52 nt, Homo sapiens
uggauccauuaguucucauaccaugaagaaauuaauagcccagaagccagau

SEQ ID NO: 156438 - RNA, 77 nt, Homo sapiens
guuuccagauguuucaaacuauucaucagcuuacuaguagcccugaagauauucuaaugguaagacaugaaggaauu

SEQ ID NO: 156439 - RNA, 39 nt, Homo sapiens
gauucugugcauuugaccuagugcuacuaggugguucag

SEQ ID NO: 156440 - RNA, 75 nt, Homo sapiens
ugucauaaaagaauuugcagaugacggcgucaaguaccuggaacuaaggagcacacccagaagagaaaaugcuac

SEQ ID NO: 156441 - RNA, 46 nt, Homo sapiens
gguauaaaacaguccaaacaagaaaacuuggacauugauguuaggu

SEQ ID NO: 156442 - RNA, 24 nt, Homo sapiens
auugucuuuuucaucugugucaua

SEQ ID NO: 156443 - RNA, 55 nt, Homo sapiens
guccaacagacacuccauucuguggaugaaggccuguucugcccuggaugaccag

SEQ ID NO: 156444 - RNA, 48 nt, Homo sapiens
uagucccagacuauaugcacuauaauguaauucauuacauacaaugga

SEQ ID NO: 156445 - RNA, 68 nt, Homo sapiens
aaguagccguuucacauucaauuagaauucuguggcuggaauaagaucagggagagcaguaggaagau

SEQ ID NO: 156446 - RNA, 45 nt, Homo sapiens
gaguagcaugagaacuugaggaauaguaugauaugggcugugcag

SEQ ID NO: 156447 - RNA, 59 nt, Homo sapiens
ccgcgaccccuucccagcuucccguccgcuccgccgcagcgauugucucgguggguuga

SEQ ID NO: 156448 - RNA, 46 nt, Homo sapiens
cugggugauccccaucucuccauaucacaugucaacuacuuccuag

SEQ ID NO: 156449 - RNA, 46 nt, Homo sapiens
uuuucccucugugaugguuguaguagaacaaauuaaaagucaaaag

SEQ ID NO: 156450 - RNA, 46 nt, Homo sapiens
auugcagauggcugaaucuuccucccugccagaauagugguagaga

SEQ ID NO: 156451 - RNA, 25 nt, Homo sapiens
ugagucuccaggucaugcugcugau

SEQ ID NO: 156452 - RNA, 41 nt, Homo sapiens
gccuugcuuuacugaauuguaaauugaaauucuuuccucag

SEQ ID NO: 156453 - RNA, 46 nt, Homo sapiens
aagguauugcuagaugaugacaaccuucucccucuguugcacuuga

SEQ ID NO: 156454 - RNA, 164 nt, Homo sapiens
acuagcaggaacagaauuagugggaaagcaaggugugguggcacacaccuguaaucccagcuaguccagagccugagcaggaggaucccuuaagcccaggauuucaaauccauccugggcaacauaguaagacccccaucucauaaaaaaaaaaaaaaaaauua

SEQ ID NO: 156455 - RNA, 50 nt, Homo sapiens
guggauaaucuucaguacuaucuccaggucugugcuaagagaugaguaga

SEQ ID NO: 156456 - RNA, 48 nt, Homo sapiens
aauccuguaggugaccaagucagucaguagacggaauguggccaugag

SEQ ID NO: 156457 - RNA, 389 nt, Homo sapiens
auuuuaaaacauuuuuuaagaauguguaaagcggcggggcaugguggcucaugccuguaaucccagcacuuugggaggccgaggugggcggaucacaaggucaggaguucaagaccagccuggccaacauggugaaaacccgucucuacuaaaaauacagaagaaaaaaaaaauaauaggugugguggcucgcgccuguaaucccagcuacuugggaggccugaggcaggagaauugcuuggacccaggaggcagagguugcagugagccaagaucauuccacugcacuccagccugggcaacagagcaagauucugucuugggggagcagauaaaaaaaaaaagaauguguaaagcaaaacuaaaaaggcauguuaaacgggaccuaa

SEQ ID NO: 156458 - RNA, 83 nt, Homo sapiens
gucuucacuccuguucaagauucucuccaguguucggaaucaucagaucaacucagauuuggcucaacuacuguuacgacuag

SEQ ID NO: 156459 - RNA, 42 nt, Homo sapiens
agucuacugaguuacccaaggguugcuccuaccugcccagag

SEQ ID NO: 156460 - RNA, 50 nt, Homo sapiens
agcauagcaauacauaaccuagcaaaggacuuaacaccuaucucacuguc

SEQ ID NO: 156461 - RNA, 63 nt, Homo sapiens
ccaagguuguaacagaagauucaaaacaucccauucuagccacacacaaauaaauaucugcgg

SEQ ID NO: 156462 - RNA, 41 nt, Homo sapiens
ccugcauggcuucucauucucuaaagcaggggucaacaagg

SEQ ID NO: 156463 - RNA, 45 nt, Homo sapiens
aaagauacuuggucuuacugguuuuauucccugcuaucguggaga

SEQ ID NO: 156464 - RNA, 43 nt, Homo sapiens
ugugcugaccuuguagaaauauuuaacaaauauacguccagug

SEQ ID NO: 156465 - RNA, 49 nt, Homo sapiens
uuugguuugggagaguugggcugugggagugaguagaugugguguggug

SEQ ID NO: 156466 - RNA, 24 nt, Homo sapiens
uuuauggaugaggaaacaaguuug

SEQ ID NO: 156467 - RNA, 45 nt, Homo sapiens
gcuuggccccuaugaagcaguaacaccucuuacaaaggcagcaga

SEQ ID NO: 156468 - RNA, 46 nt, Homo sapiens
ggagucuggggaacuguacuacagcauugaaaaagaaggccaaaga

SEQ ID NO: 156469 - RNA, 91 nt, Homo sapiens
aaaauauucauaguaaugccuuguuuuuguauuguauauguguguggggguggggggguguguaucuauagcuauaguauguguguguguu

SEQ ID NO: 156470 - RNA, 46 nt, Homo sapiens
caccagaugauaaauccuucagccgugucgugccccgagugccaga

SEQ ID NO: 156471 - RNA, 29 nt, Homo sapiens
aagggaauggaggagaggggaguagagag

SEQ ID NO: 156472 - RNA, 54 nt, Homo sapiens
cuuuacuuguuaucccacgcuccccacucccugcaugagauuuugguggugggu

SEQ ID NO: 156473 - RNA, 68 nt, Homo sapiens
aguaaauauuucaccucugccaguuuccaaguuggaauuggaguggggauuauucggagaaauuacug

SEQ ID NO: 156474 - RNA, 41 nt, Homo sapiens
gagggguaaagagaggaaggaaagaaaggguggagggaagu

SEQ ID NO: 156475 - RNA, 22 nt, Homo sapiens
uucuugucuccaccuaaauuau

SEQ ID NO: 156476 - RNA, 53 nt, Homo sapiens
acuugaccaggaguugcagcagccccaaacucaggagaaaacaaguaauucau

SEQ ID NO: 156477 - RNA, 46 nt, Homo sapiens
ccagaaauagaaccaugugcugagaauagauuagacaccaaggaag

SEQ ID NO: 156478 - RNA, 46 nt, Homo sapiens
agccaucucccagaguugauguuucuugugaaccuuuggagggagu

SEQ ID NO: 156479 - RNA, 46 nt, Homo sapiens
gauuaguauugauuccccucaaaaguuggcaauacuugaccaagaa

SEQ ID NO: 156480 - RNA, 46 nt, Homo sapiens
aaucccugagacaccuugugaaagucaaggagaggaacucaaagaa

SEQ ID NO: 156481 - RNA, 46 nt, Homo sapiens
gucaccagcuacucgaucugaggcacuuucuaguguguuagaucag

SEQ ID NO: 156482 - RNA, 46 nt, Homo sapiens
aaaugucuguaguguaauuguucuuagugguuuuggaacaugagua

SEQ ID NO: 156483 - RNA, 347 nt, Homo sapiens
uuucucaggcugggcacggugucucacaccuguaaucccaauacuuugggaggccaaggugggcagaucaccugaggucaggaguuugagaccagccuggccaccauggugaaaccccaucucuacuaaaaauauaaaaaauuaacugggugugguggcgggugccuguaaucccagcuacucaggaggcugaggcaggagaaucacuugaaccugggaggcggagguugcagugagccaagguggcaccacugcgucgcagccuggacaacagagcgagacccugucucaaaaaaaaaaaagcuuucucccugauuguaaacagucaauauuuauuguagaaaguu

SEQ ID NO: 156484 - RNA, 39 nt, Homo sapiens
uaauacugguaugaaacauguuuucuggcauuuggaguu

SEQ ID NO: 156485 - RNA, 42 nt, Homo sapiens
gggaaugucaguggaaucugcuccugcuguggaggaagagaa

SEQ ID NO: 156486 - RNA, 45 nt, Homo sapiens
aucagucaggucauugagcaguuaccucagccaaacaggacaagc

SEQ ID NO: 156487 - RNA, 45 nt, Homo sapiens
uacuccuugccugauaauugaagauucucagccugaaagccaggu

SEQ ID NO: 156488 - RNA, 42 nt, Homo sapiens
uuuggggggagguagaggcgccagaaggacguggcggggggg

SEQ ID NO: 156489 - RNA, 41 nt, Homo sapiens
gggggcgggguggcaagcauggcggcggugacggggaaggg

SEQ ID NO: 156490 - RNA, 42 nt, Homo sapiens
agccccagccccggaguugucuccauggcaacgccgugaggc

SEQ ID NO: 156491 - RNA, 41 nt, Homo sapiens
uuguuucugaauuuguauuagaaugcucggaagauccagau

SEQ ID NO: 156492 - RNA, 47 nt, Homo sapiens
aauguccuauggcccauaggaccuuucucucccaacccugcuuaguu

SEQ ID NO: 156493 - RNA, 42 nt, Homo sapiens
cucuguccuugcugccuuguuccucagggaccucugggacaa

SEQ ID NO: 156494 - RNA, 42 nt, Homo sapiens
guucacuuuccucucuggcuucuguucugucugggagccucu

SEQ ID NO: 156495 - RNA, 44 nt, Homo sapiens
cccucagcuuuugucgcguccucuuccuccucaucugaagggug

SEQ ID NO: 156496 - RNA, 27 nt, Homo sapiens
uugccugucuccucugucuggggagcu

SEQ ID NO: 156497 - RNA, 47 nt, Homo sapiens
uugaagcccuugucuucuuccagugaggaggugggugagaugguacc

SEQ ID NO: 156498 - RNA, 42 nt, Homo sapiens
ccccagguaaguacuucccauuuccugaagguguagagugag

SEQ ID NO: 156499 - RNA, 27 nt, Homo sapiens
cuuuaucuuuugguuccagggccuugu

SEQ ID NO: 156500 - RNA, 61 nt, Homo sapiens
ggcuuugucugucuguucuaggucucuguccuucauuucagcgaccguguccuccggagcc

SEQ ID NO: 156501 - RNA, 42 nt, Homo sapiens
ugguugagaggcaugggggccaauccccagcugcuccaagug

SEQ ID NO: 156502 - RNA, 39 nt, Homo sapiens
aguggguccugccagggcugcauagcugaagguuggagu

SEQ ID NO: 156503 - RNA, 65 nt, Homo sapiens
cccucccccauccucucccuguuaacuuugguuugagacaccucacaggaauggaugauggggag

SEQ ID NO: 156504 - RNA, 45 nt, Homo sapiens
cugagggaagcaguagaacaguauagcagugggauacccccagga

SEQ ID NO: 156505 - RNA, 49 nt, Homo sapiens
cguggggaggagcagaacacagcagcacggggaggguggagcuaggaag

SEQ ID NO: 156506 - RNA, 46 nt, Homo sapiens
aacuugguuuauuguuagaguuggagguggcuccguuacagcagcu

SEQ ID NO: 156507 - RNA, 45 nt, Homo sapiens
ccaugagagagcccagaacagugggagggcuagaauaugccccuc

SEQ ID NO: 156508 - RNA, 74 nt, Homo sapiens
guucuuggaaucauccuguuaauuuuucacucugauggagugucaggaggaguuuauauaaaggggcuaugccc

SEQ ID NO: 156509 - RNA, 42 nt, Homo sapiens
cugcaagagacuugcaccugaguaugaagcugcagcuaccag

SEQ ID NO: 156510 - RNA, 56 nt, Homo sapiens
augauaugaggauauugaugaaaauguaaccaaauggucaacuguaaacuugguau

SEQ ID NO: 156511 - RNA, 46 nt, Homo sapiens
agagauggugaagaagcaggugcuuaugauggaccuaggacugcug

SEQ ID NO: 156512 - RNA, 29 nt, Homo sapiens
gaaacugggugacuagggacaaggguggc

SEQ ID NO: 156513 - RNA, 32 nt, Homo sapiens
gcaggaccagcuucagugccucucaggacuga

SEQ ID NO: 156514 - RNA, 73 nt, Homo sapiens
agccagcaacuugagggauaacuaccgauuugcacauacgaauguugagucucuggugaacgaguaugaugau

SEQ ID NO: 156515 - RNA, 47 nt, Homo sapiens
gaggacaagacuguggcauauacagagcaaaaaaugaccaguggcaa

SEQ ID NO: 156516 - RNA, 28 nt, Homo sapiens
caguuuugguaucugcccucacaugaca

SEQ ID NO: 156517 - RNA, 46 nt, Homo sapiens
ugauguggacuaugaaaagaacgcuaaagguuccaacuacuggaga

SEQ ID NO: 156518 - RNA, 34 nt, Homo sapiens
ccaauguauagacagucccuucuaacuaucuugu

SEQ ID NO: 156519 - RNA, 46 nt, Homo sapiens
aacuuugcuguagcuagccgcaaaaccuuuagccaugaacuuucug

SEQ ID NO: 156520 - RNA, 46 nt, Homo sapiens
cugcuggagagauuccuguuguugcuaucagaacugcuaaaggaga

SEQ ID NO: 156521 - RNA, 387 nt, Homo sapiens
cugucauuuuucucaauuuaaauauagguacuuuagaccaggcgugguggcucacgccuguaaucccagcacuuugggaggccaaggcagguggaucgccuaaggucgggaguucgagaccagccugaccaacauagagaaaccccgucucuacuaaaaaugcaaaaaaauuagccaggcacgguggugcaugccugcaaucccagcuacucaggaggcugaggcaggagaaucgcuugaaccugggaggcggagguugcggugaaccaggaucgugccauugcacucuggccugggcaacaagagcgaaacucugucucaaaaaaagaaauaaauaaagaaaaauaaauacauauagguacuuuaaggauuaugauccuuaaugaa

SEQ ID NO: 156522 - RNA, 75 nt, Homo sapiens
aggcucuggagagguuccugcaggauuacuuugauggcaaucugaagagauaccugaagucugaaccuaucccag

SEQ ID NO: 156523 - RNA, 93 nt, Homo sapiens
acaucuuuaauacaaucuguaaaugugauuuggguuuccaugacuuauuuucugugguaacacaucaaauuagagagggauugggucuaggaa

SEQ ID NO: 156524 - RNA, 80 nt, Homo sapiens
guagugguagcagagaauuuugaugaaauagugaauaaugaaaauaaagaugugcugauugaauuuuaugccccuuggug

SEQ ID NO: 156525 - RNA, 91 nt, Homo sapiens
uggucacuguaagaaccuggagcccaaguauaaagaacuuggcgagaagguaagugugaacccuauucugaggauaacauuugagcgggag

SEQ ID NO: 156526 - RNA, 45 nt, Homo sapiens
ucagcaaagacccaaauaucgucauagccaagauggaugccacag

SEQ ID NO: 156527 - RNA, 57 nt, Homo sapiens
gagaagcuacaaaccccccuguaauucaagaagaaaaacccaagaagaagaagaagg

SEQ ID NO: 156528 - RNA, 51 nt, Homo sapiens
agccaaacaccacuuuguaaaaggacucuuccaucagagaugggaaaacca

SEQ ID NO: 156529 - RNA, 87 nt, Homo sapiens
gaauccuguuaaauuuucucuaaacuguuucuuagcugcacuguuuauggaaauaccaggaccaguuuauguuugugguuuugggaa

SEQ ID NO: 156530 - RNA, 54 nt, Homo sapiens
gggguauuuucuaauuuuuuuuguacauuuggaacagugacaauaaaugagacc

SEQ ID NO: 156531 - RNA, 67 nt, Homo sapiens
agaguucggcgaggaacuccagaauacaagguaaggacaggacccagccuggcuuuccagcucuacu

SEQ ID NO: 156532 - RNA, 64 nt, Homo sapiens
ugggacagaugaagaccaggguaggagguggaacuggaucuuuuauuacaacauuuaagagugg

SEQ ID NO: 156533 - RNA, 70 nt, Homo sapiens
caacgcuuccucaggugagggggaacagguagccggcaagaaaggguuuguggaaagugggggagggaaa

SEQ ID NO: 156534 - RNA, 49 nt, Homo sapiens
gucuuagucuuacuuacggacuggcucccggacgaguggcggcggcagg

SEQ ID NO: 156535 - RNA, 43 nt, Homo sapiens
ugcucccucgcccucaccucgcucacacacccugagcucgcac

SEQ ID NO: 156536 - RNA, 66 nt, Homo sapiens
cccgucaucucggcgcuuucccuuaaccgagucgcucugcuuuuucauauucuucuggcgggcgag

SEQ ID NO: 156537 - RNA, 44 nt, Homo sapiens
cucccugcccuugcccuuaaggucagacccagggacgcucagaa

SEQ ID NO: 156538 - RNA, 47 nt, Homo sapiens
ggauuaaaaccugggguagccucugugcuccuuucuucuaugcccug

SEQ ID NO: 156539 - RNA, 46 nt, Homo sapiens
ucaaagaaccaccgcugaucccagcagacaguguggcaccagcccu

SEQ ID NO: 156540 - RNA, 47 nt, Homo sapiens
cuaggaguacaaugucaggggaaccccaguuugugaaaaggacuuag

SEQ ID NO: 156541 - RNA, 43 nt, Homo sapiens
acaaauauccuccagucuaaguccuuuucacaaacugggguuc

SEQ ID NO: 156542 - RNA, 50 nt, Homo sapiens
agggccuuagcuuuuagaccuguucuaccuccucaccaaauauaauggca

SEQ ID NO: 156543 - RNA, 44 nt, Homo sapiens
uccagggcaaagggguggggcugcgaggccagcugaccaagaaa

SEQ ID NO: 156544 - RNA, 47 nt, Homo sapiens
uagcacaguugccuagcacauuguggguacucaauaaaagguaacag

SEQ ID NO: 156545 - RNA, 45 nt, Homo sapiens
gcuguaaaccuugacaauccacagggguccaaauaccucagccag

SEQ ID NO: 156546 - RNA, 45 nt, Homo sapiens
cuucuuacccacuuguuaucuuagaaaacuuagccuacuccugcc

SEQ ID NO: 156547 - RNA, 48 nt, Homo sapiens
agcagcuugaggagccagaagcugguuaggagggagaaagaaaaacag

SEQ ID NO: 156548 - RNA, 62 nt, Homo sapiens
ugaggugguuaaggauaucgguggggugggcuggagcggugucggguuaggucugagagaag

SEQ ID NO: 156549 - RNA, 42 nt, Homo sapiens
uccgccgcaccgcugucauguuuccguggcuucuccggaggc

SEQ ID NO: 156550 - RNA, 46 nt, Homo sapiens
ccuccuccugccaacgggaucagaaccccgucuuggagcgcuggcu

SEQ ID NO: 156551 - RNA, 46 nt, Homo sapiens
ugcccauguguucccgcaaacugcguucugcugcugcucgagauau

SEQ ID NO: 156552 - RNA, 51 nt, Homo sapiens
acagcaaagcccaaaggaagcaaaauuucccgccaaaagcugcuuccaaau

SEQ ID NO: 156553 - RNA, 51 nt, Homo sapiens
cagcaaagcccaaaggaagcaaaauuucccgccaaaagcugcuuccaaauu

SEQ ID NO: 156554 - RNA, 72 nt, Homo sapiens
cgaaugaaagauuuuacguguuagcuugguuugaagccaagaacgguauagugaauaagaaacucaggcgac

SEQ ID NO: 156555 - RNA, 46 nt, Homo sapiens
ccuaucagaaaagaauucuaacaaugaaguggcguguaagaagacu

SEQ ID NO: 156556 - RNA, 45 nt, Homo sapiens
guaagauuucgaagucguaaagacuguauuggauucuguauuucu

SEQ ID NO: 156557 - RNA, 45 nt, Homo sapiens
aauggcauggucauuagugaagauaccguuuacaaaguuaccaca

SEQ ID NO: 156558 - RNA, 38 nt, Homo sapiens
aaguuauuaaauuucuugaauauauuauaguuugacua

SEQ ID NO: 156559 - RNA, 47 nt, Homo sapiens
uuagcuugaauaucauuaaccaucuggucauaaauuaacugccagaa

SEQ ID NO: 156560 - RNA, 72 nt, Homo sapiens
aauuuacacuggauuauauucagucuuuucuuagucuauaauuguaaccacucuccccuucacaaagucaga

SEQ ID NO: 156561 - RNA, 106 nt, Homo sapiens
ccaucuucuuuagguugcugggucuggaagagaguugcgggaaaggggagagagaaaaaaacuagugaaaaauagugauuuuugcuaugcuauuaugucauuaaag

SEQ ID NO: 156562 - RNA, 49 nt, Homo sapiens
agacccagcaaccuaaagaagauggaguuuauguuuuucauccccauag

SEQ ID NO: 156563 - RNA, 25 nt, Homo sapiens
aucagaacuuguaaucaagacagua

SEQ ID NO: 156564 - RNA, 48 nt, Homo sapiens
uaugcauauauauuuguuagguauauauguuuauguguauucugaugu

SEQ ID NO: 156565 - RNA, 22 nt, Homo sapiens
aaaccaauuucuaaauaauuuu

SEQ ID NO: 156566 - RNA, 152 nt, Homo sapiens
uucaacaugcagaggaguuacuugaucgaauuaaaaaaaacgucauucugacugcagaauagagaacuuggcagaucccuaacuaguccccuuuccuuggucuccauuucuuuuugucaguucuccugugaagccagccugaacuuccucaa

SEQ ID NO: 156567 - RNA, 30 nt, Homo sapiens
ggggauauaaugaaaaaaaguuugaguuau

SEQ ID NO: 156568 - RNA, 37 nt, Homo sapiens
ucaagaaaaauauuucugguguggagaaaaaggaguc

SEQ ID NO: 156569 - RNA, 48 nt, Homo sapiens
uugagagaguuaaaucagcaauucaagcgguuauugacucgaauggga

SEQ ID NO: 156570 - RNA, 46 nt, Homo sapiens
ucgucaggaauuucuucgacaagaagaccagcuucaggacuauagg

SEQ ID NO: 156571 - RNA, 44 nt, Homo sapiens
ucauuguacauuuacuuaaauauauguauuuuaacguaacagua

SEQ ID NO: 156572 - RNA, 56 nt, Homo sapiens
cagaaagucaccaucuuuaucuguuuugcugcuguucacuuucuccugauggcacc

SEQ ID NO: 156573 - RNA, 30 nt, Homo sapiens
auuuaguuuucaguguggacagcagaugaa

SEQ ID NO: 156574 - RNA, 103 nt, Homo sapiens
ucaaaugauggaaaggaauuggauauaaacaaucaaguaguaccuaaaaauauuccaaaaguagcugagaauguugcagauaagaaugaagaacccucaagca

SEQ ID NO: 156575 - RNA, 55 nt, Homo sapiens
aacaaaucaaaagagguggugaugcagggaugccuggaauagaagagaaugaccu

SEQ ID NO: 156576 - RNA, 64 nt, Homo sapiens
aaggaagccuccuauuucaguuucucaacaugaaagucaucaagcaaucucccaucuuccaacu

SEQ ID NO: 156577 - RNA, 115 nt, Homo sapiens
aaccccgguacuucaaaacagaauccuuccaguccucuucagcguuuaauuccaggcucaaacuuggacagugaacccagaauucaaacagauauacuaaagcaggcuaccaagg

SEQ ID NO: 156578 - RNA, 95 nt, Homo sapiens; identical to SEQ ID NO: 70733

SEQ ID NO: 156579 - RNA, 46 nt, Homo sapiens
uauaaccaugaaacccaccucuaaguuuuuugguugaauuugugua

SEQ ID NO: 156580 - RNA, 61 nt, Homo sapiens
aaaacuuuuauaauaguggaauuuguaaaucuguaaauuauuuuaauuuuuaaaaauuuug

SEQ ID NO: 156581 - RNA, 49 nt, Homo sapiens
ccuuagcuguuuuuaaaguaauuaaauuuuuauuuaggcucaugacaag

SEQ ID NO: 156582 - RNA, 50 nt, Homo sapiens
aucaauaggggcucuucucugcucucuaguaguaggaguaguuucuuaag

SEQ ID NO: 156583 - RNA, 41 nt, Homo sapiens
uacagaugaugaagaacgagagcuucaaauggauccugcag

SEQ ID NO: 156584 - RNA, 52 nt, Homo sapiens
ccuuuaaguccuaaaggaaugcuucagaaaaccuaaagugcuguaaaaugaa

SEQ ID NO: 156585 - RNA, 48 nt, Homo sapiens
gguucuguugcugcugcgggguaagcgggaaagacaccacacauugcg

SEQ ID NO: 156586 - RNA, 39 nt, Homo sapiens
agggauuuaucuuccuaaugcugguaacgcaguaccaag

SEQ ID NO: 156587 - RNA, 43 nt, Homo sapiens
aggagaguuaaguuuuuaugcacuggcugugauuagaaggggu

SEQ ID NO: 156588 - RNA, 59 nt, Homo sapiens
ucuuuauuuugaaggcaguugaugggaaaccugggugagaggaacaggcaaguuugugc

SEQ ID NO: 156589 - RNA, 94 nt, Homo sapiens
uuaggauggcuucuaaguuucuggcuuggcuaguuagguagaugguaguagcauuacuugugaugaagaauauauuaggaaaaauacgguagga

SEQ ID NO: 156590 - RNA, 42 nt, Homo sapiens
uugcaauauuuuacugaaugcuggauauugugaauaggguag

SEQ ID NO: 156591 - RNA, 38 nt, Homo sapiens
uuuaguuuagaccaaaggaaaggguuugaauugguuag

SEQ ID NO: 156592 - RNA, 47 nt, Homo sapiens
aaagcuucucagcagucaaaucaaauccaaacacaacgcacugccag

SEQ ID NO: 156593 - RNA, 46 nt, Homo sapiens
ccggcuuguugucuucaauuaaaaaauuuauuaaaggaagcacacc

SEQ ID NO: 156594 - RNA, 48 nt, Homo sapiens
aauugaacgugauauagauaacaauuugaucacgucaacaccaagagc

SEQ ID NO: 156595 - RNA, 98 nt, Homo sapiens
aacuuaaagcaacaagggagaaggaauguucuguaaggaaguugagaauauuggagguuaauuuuuuuuguuauuuuuguuuaaaaugacauuuggaa

SEQ ID NO: 156596 - RNA, 90 nt, Homo sapiens
uauauaaugcaauccaguaauaccaacgugaagagacaagcagcaaaauagguuuauuuuaaagucaucaagugaaagauucauauguau

SEQ ID NO: 156597 - RNA, 43 nt, Homo sapiens
guaaaagcaacauuuuuucuuucacuauguuaaauagcaccag

SEQ ID NO: 156598 - RNA, 46 nt, Homo sapiens
aaaucugauuuauagcuauuauuucaucaaacaugucccgccacug

SEQ ID NO: 156599 - RNA, 42 nt, Homo sapiens
auggauuucaucaacauuuuaaugauuuauuaacaaaauuag

SEQ ID NO: 156600 - RNA, 42 nt, Homo sapiens
aacuguguuguccaacuccucauucuguaaagcuuggcaggg

SEQ ID NO: 156601 - RNA, 39 nt, Homo sapiens
cagauugugguaagcacucaaggacagauaggaucccug

SEQ ID NO: 156602 - RNA, 65 nt, Homo sapiens
uaugauguagauauuguuguuauauccuguauuuuauagauagggaaacugagguauacagaaga

SEQ ID NO: 156603 - RNA, 25 nt, Homo sapiens
ccuuucaguacuaucuauauacaau

SEQ ID NO: 156604 - RNA, 47 nt, Homo sapiens
guaggcagcucaggaaaggaaucuuuguaugagaguaaaauuagaag

SEQ ID NO: 156605 - RNA, 35 nt, Homo sapiens
cacaauaauuggauggaugcuaccuggcuggaaga

SEQ ID NO: 156606 - RNA, 43 nt, Homo sapiens
ugcucaaaauugugaaccuaguuacauuucucccugcucccuu

SEQ ID NO: 156607 - RNA, 45 nt, Homo sapiens
auuguguaacuucuauaaacggcuauuuucuuguaacugucagug

SEQ ID NO: 156608 - RNA, 49 nt, Homo sapiens
ucuaaauuaacuuaguuaauaguuacccaccgaauaacuaugccaagca

SEQ ID NO: 156609 - RNA, 49 nt, Homo sapiens
uauauuuaaaugcuacuuaaguuauuauuggaauccaagucucacuaac

SEQ ID NO: 156610 - RNA, 32 nt, Homo sapiens
uuugauguugaaaaacauaaaggaaauugaga

SEQ ID NO: 156611 - RNA, 42 nt, Homo sapiens
ggcggcggcacugccggcggggaccgcugggaaggcgaggac

SEQ ID NO: 156612 - RNA, 70 nt, Homo sapiens
uagcagauucugacagaugugaugagaagaagaaugcauuggagaucuuugcuaaaguugaacaaucccg

SEQ ID NO: 156613 - RNA, 81 nt, Homo sapiens
aguuuuaugaaauuguaaaugugcuucugaaggacccucagacagguugcugucuaaaggacaugcuagcagguuagauga

SEQ ID NO: 156614 - RNA, 46 nt, Homo sapiens
auaaacaacaucagccuacugacauggucauggaaaaccugaagaa

SEQ ID NO: 156615 - RNA, 45 nt, Homo sapiens
gaaaacagcccugcuggacuacaucaaacgcugccguccuggaga

SEQ ID NO: 156616 - RNA, 45 nt, Homo sapiens
gcacauaccuuggcaagaucauacagacagaggaccugucgacag

SEQ ID NO: 156617 - RNA, 41 nt, Homo sapiens
uggaugaauuacaaaggcauuauggugaguaaaagaggcca

SEQ ID NO: 156618 - RNA, 42 nt, Homo sapiens
gggcacccagcgcugccgccugggcccggccgcccuccacgc

SEQ ID NO: 156619 - RNA, 54 nt, Homo sapiens
ugcgagagcgggcaggcgcgcccggugcccggaauacagccgcggugcuggagg

SEQ ID NO: 156620 - RNA, 70 nt, Homo sapiens
gcguguuaaacucauuuuuuggaaugagaauuuaaagaaggauagccucaagaaguaaguguguugaaau

SEQ ID NO: 156621 - RNA, 54 nt, Homo sapiens
agauuaagugacugaaauaacauuucugaaaaaaaauuacugaaccaucagaaa

SEQ ID NO: 156622 - RNA, 94 nt, Homo sapiens
ggugagcaguaacccagcagaagaaaaagucaacuguuguggcuuuaauggacaacaggaguugggaaacuuucugaauaggcagccagugggg

SEQ ID NO: 156623 - RNA, 58 nt, Homo sapiens
uauauaaccuguguagcuguguuuuacauuucauuaucccuuaugauaucuagcauag

SEQ ID NO: 156624 - RNA, 60 nt, Homo sapiens
acucguuuuuacuuguagauuccuuccaaaugauagguauaaaaaugcaaggaaaaugau

SEQ ID NO: 156625 - RNA, 46 nt, Homo sapiens
aaguaguagauuagaauaaaacccuccuaaaggcuuaauuaaauuu

SEQ ID NO: 156626 - RNA, 93 nt, Homo sapiens
guaacuguuccuuuaauguuguaauugaaaacuugguuuagcgucuuuuuuuucuuucucuuuuuuuuucuuaaaaugccaacuaaaauaauu

SEQ ID NO: 156627 - RNA, 51 nt, Homo sapiens
guaaaaaugaacuuuuaaaacucccaccagcuuuuaacaguauaauguuaa

SEQ ID NO: 156628 - RNA, 60 nt, Homo sapiens
auuugacuccccagaaucagcugaaaaagccugcagaauaaugaauggcauaaaaaucag

SEQ ID NO: 156629 - RNA, 64 nt, Homo sapiens
gucauguaauguuugcagaaauaaaaauggagaauggaaagucaaaaggcuguggaacagucag

SEQ ID NO: 156630 - RNA, 169 nt, Homo sapiens
uacucucaaaaguguucuauuguagugaugaauucuuauggccacuuuuuauuuugauaaaugguauugauuuacuucaaauacgagucucuagaguuagcaaugauauuauaacugcauaaggacagguuucugguuuucuuccucuuuccugaagcuucucugauau

SEQ ID NO: 156631 - RNA, 50 nt, Homo sapiens
gcuuuuauuauauuaauaguuauuuguucaaguuuucuuccauccuacgu

SEQ ID NO: 156632 - RNA, 86 nt, Homo sapiens
ucaaauaaaugaauuauuucacuaucuuuugacuuagagcagugcuauuacuacuagguaauaacaagguuuagguaacaagguuu

SEQ ID NO: 156633 - RNA, 78 nt, Homo sapiens
acuaauaccucuuuucauucuagcuaccuuuugacuugacuuggcagaaacuaaaagagaaauucagucaguguggua

SEQ ID NO: 156634 - RNA, 35 nt, Homo sapiens
aggcuccaaaggcaaccagauauuugucagaaaug

SEQ ID NO: 156635 - RNA, 61 nt, Homo sapiens
gcaucgauauggaucgaggauuuuuaucggguccaaugggaagcggaaugagagagagaau

SEQ ID NO: 156636 - RNA, 47 nt, Homo sapiens
aggugguggaauggguagcaugaacagugugacuggaggaaugggga

SEQ ID NO: 156637 - RNA, 67 nt, Homo sapiens
aauuuuauguuuuuauauuauuuaauuauauaaacaaauuaauuucccccuucuuucucaaaaaugu

SEQ ID NO: 156638 - RNA, 93 nt, Homo sapiens
ucuguguaucuuuauuuuagcaauuauuaugcuugauauuauuggaaaauaaaaauaaggaucagaacaacuguccuguuauuggaagcagug

SEQ ID NO: 156639 - RNA, 34 nt, Homo sapiens
gaggugaagaugcugaggugaaagauaagcuagg

SEQ ID NO: 156640 - RNA, 55 nt, Homo sapiens
uagcuauuagugacuagcuuauuuuauuuguaaacaucuaugucuuuugguaaau

SEQ ID NO: 156641 - RNA, 99 nt, Homo sapiens
ucagagcuguaccguggugcgaugacuaguagcauggagcgagauuuuggacguggugauauuggaauaaaucaaggcuuuggagauuccuuugguaga

SEQ ID NO: 156642 - RNA, 37 nt, Homo sapiens
cauauaggcacuaggggauaaggacaggccuggggaa

SEQ ID NO: 156643 - RNA, 57 nt, Homo sapiens
guuugguggucuggaagcaaugaauagcaugggaggauuuggaggaguuggccgaau

SEQ ID NO: 156644 - RNA, 53 nt, Homo sapiens
uguuguggguguuacuagugaauuuugcuuucuugucugauaaauguucaaag

SEQ ID NO: 156645 - RNA, 70 nt, Homo sapiens
guuuggcuuaauauugcuguuauaucuguuucugcacuuuaguuuuuugugauauuguacaucauauagu

SEQ ID NO: 156646 - RNA, 37 nt, Homo sapiens
aaugaaaccuugagcacagcuaacaugaaagagauag

SEQ ID NO: 156647 - RNA, 46 nt, Homo sapiens
guugaacauagguggaguaaugggaaauuuagguccagguggugag

SEQ ID NO: 156648 - RNA, 47 nt, Homo sapiens
cagcaauacauucuaaaauguuugguaaauuuauacacuugaaggaa

SEQ ID NO: 156649 - RNA, 46 nt, Homo sapiens
gaugacaagucuguuccucaugaagaguaccguucacaugauggua

SEQ ID NO: 156650 - RNA, 46 nt, Homo sapiens
uauguucaaugggcaguuuuuauuugauagaccuaugcaugugaaa

SEQ ID NO: 156651 - RNA, 50 nt, Homo sapiens
gcauagcuggaacugugaagcgggcagauauuaaagaagacaaagauggc

SEQ ID NO: 156652 - RNA, 46 nt, Homo sapiens
augguuuuaagaguuuagaaaagauuuuuuguauuuacagaugggg

SEQ ID NO: 156653 - RNA, 49 nt, Homo sapiens
cuugguaaaaauagauaugcaaguuucaaauguacaaaacagguuugag

SEQ ID NO: 156654 - RNA, 35 nt, Homo sapiens
auuugauuaaaugaaugaguuauagguuuauagaa

SEQ ID NO: 156655 - RNA, 46 nt, Homo sapiens
ucaauaauccaaacauuccuccugaagucaucaguaauuugcaggc

SEQ ID NO: 156656 - RNA, 43 nt, Homo sapiens
cacuugacuuucuuuuuauuaguacuguauucccagacugagg

SEQ ID NO: 156657 - RNA, 55 nt, Homo sapiens
uauaauauuggaugcuaaauaucauguuauuguguucuuuuaaguuucagcacau

SEQ ID NO: 156658 - RNA, 95 nt, Homo sapiens
guaucccagauaccuuuauuugagcuugcuuccaaauuauucuaguccuguuugagucugggguuuauuauuaaaaaaguuauuaacaggaaugu

SEQ ID NO: 156659 - RNA, 39 nt, Homo sapiens
uuuguauuguuaaucuuaauaguuugauuacagaccugu

SEQ ID NO: 156660 - RNA, 46 nt, Homo sapiens
ugugguugaauucaaagaugaagaauuuguaaagaaagcccuagaa

SEQ ID NO: 156661 - RNA, 51 nt, Homo sapiens
uuuauuaugcaagauuugaggcucuauaccagcaagucugacacuuauaca

SEQ ID NO: 156662 - RNA, 46 nt, Homo sapiens
guauguuggucugguuuugauuguuggugaauaauaggugcuucuc

SEQ ID NO: 156663 - RNA, 44 nt, Homo sapiens
ugacaugaaauggcaagcuauuaaagaucuaaugagagagaaag

SEQ ID NO: 156664 - RNA, 45 nt, Homo sapiens
ucaaaagacaagaauucgggcgcuggagaaaagaaggguccaaau

SEQ ID NO: 156665 - RNA, 62 nt, Homo sapiens
aacugaggguuuuuguuuguuugacuuuuuuuaauucacagggagaaugaugaaucagcaaa

SEQ ID NO: 156666 - RNA, 59 nt, Homo sapiens
ucauauauagauguggauuuauauacauaacuuuguauuuuaauuaugcuucuaauuaa

SEQ ID NO: 156667 - RNA, 46 nt, Homo sapiens
gacuuguuuugaaaaguaaauugcauuuuaaaauagaaauccaaau

SEQ ID NO: 156668 - RNA, 36 nt, Homo sapiens
auguuauaugcagucaccgugcgaggugcugcugau

SEQ ID NO: 156669 - RNA, 37 nt, Homo sapiens
guaagcaaauauuuaaucuauguaaccccaccuaagu

SEQ ID NO: 156670 - RNA, 78 nt, Homo sapiens
cuacagaacuuacucaucuuauaacugaaaguuugugcccuuagaacauuuccccauccccugcugcccuccaccucu

SEQ ID NO: 156671 - RNA, 49 nt, Homo sapiens
auugagaguuauauuaggguacuauaaaauauuaagcauuggagcaagg

SEQ ID NO: 156672 - RNA, 52 nt, Homo sapiens
cuccaucagauuuucuauucccuucuaaagucucuucaugauuuagcaagac

SEQ ID NO: 156673 - RNA, 41 nt, Homo sapiens
ccuaccuccuuaaaccugaaguugaaaguauguuaauaauu

SEQ ID NO: 156674 - RNA, 47 nt, Homo sapiens
gucaccagugccuauaaagaauuuaguugaccccaauccauaauaau

SEQ ID NO: 156675 - RNA, 50 nt, Homo sapiens
gaagcagcagccgcagcacagcagcagcuccaauggcguuaaaauguauu

SEQ ID NO: 156676 - RNA, 46 nt, Homo sapiens
uuuucaagugcuuuauaaaucgauuauaugguacccaguuggagug

SEQ ID NO: 156677 - RNA, 46 nt, Homo sapiens
aaaaaggaaacuugggcucagaaaguucaagugauuuguccaaggu

SEQ ID NO: 156678 - RNA, 64 nt, Homo sapiens
caacaauugcuugaagguaugugcacagcccauccagaacagagcaagcugcaaaauugcaggc

SEQ ID NO: 156679 - RNA, 47 nt, Homo sapiens
gugcauagaggucugggaggaccaggaaacagccucaguggccagag

SEQ ID NO: 156680 - RNA, 108 nt, Homo sapiens
auccagagaccaaauaauuaaaagaaaaacaaauauagauagguagaacuauauuuucccccaaucagaaucaucauaucauagguacaaucuuucaccaaguaaauu

SEQ ID NO: 156681 - RNA, 79 nt, Homo sapiens
gaagccaguggcuggaaccuauucauuacaaaucaguaguacuccacuuuauaaaaagaaagaacuuaaccaacuagaa

SEQ ID NO: 156682 - RNA, 42 nt, Homo sapiens
aagauggcuucuuuaaaaucaaccaaaaggaagggaucagcu

SEQ ID NO: 156683 - RNA, 45 nt, Homo sapiens
agacagccaucuuugcuuucaauauuucccacgucaguaacaagg

SEQ ID NO: 156684 - RNA, 46 nt, Homo sapiens
gacaauucacucuccccagaggcuuguuacgaguguaagaucaaug

SEQ ID NO: 156685 - RNA, 46 nt, Homo sapiens
guguccuggagauucugcucuggucucgugaagaucaucuccuggc

SEQ ID NO: 156686 - RNA, 45 nt, Homo sapiens
cagcggggauucucacuugaucagaccggcuccagcugugaaggu

SEQ ID NO: 156687 - RNA, 83 nt, Homo sapiens
ucccaaacccugcaauuuuaucugcaaaaacacagaagggaguuaccaguguucaugcccgaaaggcuacauucugcaagagg

SEQ ID NO: 156688 - RNA, 46 nt, Homo sapiens
uaaaacuggguacacuccagauauaacugggacuuccuguguaggu

SEQ ID NO: 156689 - RNA, 52 nt, Homo sapiens
ugucagacugucuaaggcaacucuagagauaucuaggccugucaccaauaug

SEQ ID NO: 156690 - RNA, 42 nt, Homo sapiens
cucuguccccauggccgaggauucaugaccaauggagcaggu

SEQ ID NO: 156691 - RNA, 46 nt, Homo sapiens
aaugcugcugugacggagggagaggcugggguccccacugugagau

SEQ ID NO: 156692 - RNA, 52 nt, Homo sapiens
ugugaacagauuagugauucaaaagcuaaguuaagaaggaaagaugugagag

SEQ ID NO: 156693 - RNA, 42 nt, Homo sapiens
aaccucauuggcacauauaugugcaucuguggacccggguau

SEQ ID NO: 156694 - RNA, 49 nt, Homo sapiens
augucccgugggauaugugcucagagaagaccguaggaugugcaaaggu

SEQ ID NO: 156695 - RNA, 42 nt, Homo sapiens
gguuccuaucgcugcgagugucccuuugguuauauucuagca

SEQ ID NO: 156696 - RNA, 46 nt, Homo sapiens
ccaagcaggaaugcugcugugccuugaagggagaaggcuggggaga

SEQ ID NO: 156697 - RNA, 46 nt, Homo sapiens
uccagaaggguuuuccuuguccuccaguggaagaaggugccaaggu

SEQ ID NO: 156698 - RNA, 23 nt, Homo sapiens
cccaggauacaaggauauuuugu

SEQ ID NO: 156699 - RNA, 46 nt, Homo sapiens
gcauuugcccaccuggauacagucuucaaaaugagaagugugaagg

SEQ ID NO: 156700 - RNA, 59 nt, Homo sapiens
ggaaucuuugcagaaauggccaaugcauuaauacaguggggucuuuccagugccagugc

SEQ ID NO: 156701 - RNA, 46 nt, Homo sapiens
ugcaaucaugguuucauccuuucucacaacaaugacuguauaggug

SEQ ID NO: 156702 - RNA, 46 nt, Homo sapiens
ccacacugguuuuaaaacaaaugaugaccaaaccaugugcuugggu

SEQ ID NO: 156703 - RNA, 46 nt, Homo sapiens
acuguaagcccggcuaccgcuucaccuccacaggacagugcaaugg

SEQ ID NO: 156704 - RNA, 42 nt, Homo sapiens
caaauucuggcaauaaauaaagcugcuguacacaucuauguu

SEQ ID NO: 156705 - RNA, 45 nt, Homo sapiens
ugguguuguacauucuauggguuuggaaaaauuuauaaugacaug

SEQ ID NO: 156706 - RNA, 46 nt, Homo sapiens
guccagugggauucuucuauaaugacaaguuguugguuugugaagg

SEQ ID NO: 156707 - RNA, 49 nt, Homo sapiens
agaagaaguuugugcuacagaaacuacuaugcugacaaccagaccugug

SEQ ID NO: 156708 - RNA, 46 nt, Homo sapiens
cguuggcaacuacaccuguaucuguccuccagacuacaugcaagug

SEQ ID NO: 156709 - RNA, 45 nt, Homo sapiens
ccgcuguccaaccggcuacuaccugaaugaagauacacgagugug

SEQ ID NO: 156710 - RNA, 45 nt, Homo sapiens
gauauugaugagugccaggagcuaccagggcugugccaaggagga

SEQ ID NO: 156711 - RNA, 45 nt, Homo sapiens
guccuggaggggaagguuuccgaccaaauccuaucaccguuauau

SEQ ID NO: 156712 - RNA, 43 nt, Homo sapiens
cacugaaauaaauguuucuggguaaaauacuuggaugaaagaa

SEQ ID NO: 156713 - RNA, 42 nt, Homo sapiens
ccugcugcuguucucuggguaaagccugggguacuccuugug

SEQ ID NO: 156714 - RNA, 47 nt, Homo sapiens
gauauucgaccucgaggagacaauggagauacagccugcagcaauga

SEQ ID NO: 156715 - RNA, 58 nt, Homo sapiens
ccaaccacgugcaucagugggaacugugucaacacuccaggcagcuauaucugugacu

SEQ ID NO: 156716 - RNA, 45 nt, Homo sapiens
uccuuccuaccccugcccugcucguggucaccagaguacugggua

SEQ ID NO: 156717 - RNA, 49 nt, Homo sapiens
cucccuuccgaacaucugugucuuuggaacuugccacaaccucccuggc

SEQ ID NO: 156718 - RNA, 68 nt, Homo sapiens
accaggaggauaccgcugugaaugcgacaugggcuucgugcccagugcugacgggaaagccugugaag

SEQ ID NO: 156719 - RNA, 54 nt, Homo sapiens
ugaugagugcucugagaaccugaaucucuguggcaauggccagugccucaaugc

SEQ ID NO: 156720 - RNA, 45 nt, Homo sapiens
uguuccaauggaacccauaugugcagccagcaugcagacugcaag

SEQ ID NO: 156721 - RNA, 49 nt, Homo sapiens
aacaugcuguauguaccaauacagcaggaagcuucaaauguagcugcag

SEQ ID NO: 156722 - RNA, 54 nt, Homo sapiens
cauuuaucugccacugugauaugggcuacuccggcaaaaaaggaaaaacuggcu

SEQ ID NO: 156723 - RNA, 41 nt, Homo sapiens
uacaggugcuuguguuaugauggauucauggcaucugaaga

SEQ ID NO: 156724 - RNA, 46 nt, Homo sapiens
cagcuaugaauguagcugucagccgggauuugcacuaaugccugac

SEQ ID NO: 156725 - RNA, 42 nt, Homo sapiens
aaugugagcugagugcacaccugugccccaauggccguugcg

SEQ ID NO: 156726 - RNA, 48 nt, Homo sapiens
gauccucuccuaugccgaggugguguuugccauaacacagagggaagu

SEQ ID NO: 156727 - RNA, 49 nt, Homo sapiens
ccucuguggcagaggccagugugugaacaccccuggggacuuugaaugc

SEQ ID NO: 156728 - RNA, 46 nt, Homo sapiens
ugacagcggcuuugcucuugauucugaagaaaggaacugcacaggu

SEQ ID NO: 156729 - RNA, 54 nt, Homo sapiens
augagaaauacuccugaguacgaggagcuguguccgagaggacccggauuugcc

SEQ ID NO: 156730 - RNA, 45 nt, Homo sapiens
ccgcauggacgccugcugcugcuccgucggggcagccugggguac

SEQ ID NO: 156731 - RNA, 45 nt, Homo sapiens
uauagaugaaugugaaguguucccaggaguguguaaaaauggccu

SEQ ID NO: 156732 - RNA, 44 nt, Homo sapiens
ucccauaugugguaaaggguacucaagaauuaaaggaacacaau

SEQ ID NO: 156733 - RNA, 48 nt, Homo sapiens
caagggcacuugcuggcagacugucauugaugggcgaugugagaucaa

SEQ ID NO: 156734 - RNA, 48 nt, Homo sapiens
ucuuuuauuugugaauguucuucugaaaguacuuuggauccaacaaaa

SEQ ID NO: 156735 - RNA, 88 nt, Homo sapiens
uuaaugaauguguacugaacagucuccuuugugacaauggacaauguagaaauacuccuggaaguuuugucuguaccugccccaaggg

SEQ ID NO: 156736 - RNA, 82 nt, Homo sapiens
ugugaaaaccuucgugggaccuauaaauguauaugcaauucaggauaugaaguggauucaacugggaaaaacugcguuggug

SEQ ID NO: 156737 - RNA, 45 nt, Homo sapiens
ggaauaucaggcacucugcagcagugggccaggaaugacgucagc

SEQ ID NO: 156738 - RNA, 50 nt, Homo sapiens
cucauggaucccucaugucacugucuccauggcacuacgcggaguuagcu

SEQ ID NO: 156739 - RNA, 40 nt, Homo sapiens
cauuuggggaaccuugccagccguguccugcacagaauuc

SEQ ID NO: 156740 - RNA, 58 nt, Homo sapiens
gcggagcacaugcuaugguggauacaagagaggccaguguaucaaaccuuuguuuggu

SEQ ID NO: 156741 - RNA, 22 nt, Homo sapiens
cuuuaccuggacagaauagugu

SEQ ID NO: 156742 - RNA, 46 nt, Homo sapiens
uugcaaaccuggauuccagcuggcaucagauggacguuauugcaaa

SEQ ID NO: 156743 - RNA, 41 nt, Homo sapiens
ucagauauggaugaaugcagcauaaggaacaugugccuuaa

SEQ ID NO: 156744 - RNA, 45 nt, Homo sapiens
augaguguuuacagaauggccggaucugcaauaauggacgcugca

SEQ ID NO: 156745 - RNA, 33 nt, Homo sapiens
ccuauugucauucugaaagacagugucauaaaa

SEQ ID NO: 156746 - RNA, 49 nt, Homo sapiens
cagugccgagcuggauaucagagcacacucacgcggacagaaugccgag

SEQ ID NO: 156747 - RNA, 72 nt, Homo sapiens
caagcugugcucuguuccuaugguaauuccugggagaccagaauauccucccccaccccuuggccccauucc

SEQ ID NO: 156748 - RNA, 42 nt, Homo sapiens
aaugucccccugguuuuuacaccucuccagaugguaccagau

SEQ ID NO: 156749 - RNA, 46 nt, Homo sapiens
guauccgcguuguggaaaauagauugaaaagcagcgcaagaaguga

SEQ ID NO: 156750 - RNA, 45 nt, Homo sapiens
gauguuuauuagaggauguccuugggaucaacaccugcagaagag

SEQ ID NO: 156751 - RNA, 50 nt, Homo sapiens
gcucugucagggaggaaauugcauuaauacuguugggucuuuugagugca

SEQ ID NO: 156752 - RNA, 46 nt, Homo sapiens
ccaaaauaaauuaggauuuguuucacaguuuuaaauauccccagau

SEQ ID NO: 156753 - RNA, 46 nt, Homo sapiens
ucugcugugccacagucggccgagccuggggccaccccugugagau

SEQ ID NO: 156754 - RNA, 45 nt, Homo sapiens
ggcgucugaaugguucaugauuugaccacuugaaugccaucagag

SEQ ID NO: 156755 - RNA, 41 nt, Homo sapiens
uuuuccccugggaugguguagagaaaaauugucuuugagau

SEQ ID NO: 156756 - RNA, 25 nt, Homo sapiens
accuaagauagagagaaugguuugc

SEQ ID NO: 156757 - RNA, 45 nt, Homo sapiens
ggcuccgucaacauuuguugaagucuuuuggaaaaauccaaagga

SEQ ID NO: 156758 - RNA, 32 nt, Homo sapiens
aaaaauauuuaccuaaaagucucuuucucucu

SEQ ID NO: 156759 - RNA, 42 nt, Homo sapiens
cuuggcauaauguuguagcauguaguuuauuccuuuuuauug

SEQ ID NO: 156760 - RNA, 62 nt, Homo sapiens
gcugcaaaaaacaugauuuuauucuuuuuuauggcagaguaguauuccauggugugugugug

SEQ ID NO: 156761 - RNA, 43 nt, Homo sapiens
aaaaaugccccuuuguauguauaaauuagugggaagacugguc

SEQ ID NO: 156762 - RNA, 62 nt, Homo sapiens
ucuccuuauuuuacagcuguuugugaaaguggcugucucaauggaggaagguguguggcccc

SEQ ID NO: 156763 - RNA, 42 nt, Homo sapiens
caccagggugacuuuagacauuuuauuguuguccuuccagag

SEQ ID NO: 156764 - RNA, 51 nt, Homo sapiens
ugagagcuuuguauacuuuucuggccagagagcaugccaggucugcaugca

SEQ ID NO: 156765 - RNA, 45 nt, Homo sapiens
gcacuugcccaucuggucagauagcuccuuccuguggcuccagau

SEQ ID NO: 156766 - RNA, 40 nt, Homo sapiens
guaaguauagcugagaaauaaaggaaagaugagugaaaaa

SEQ ID NO: 156767 - RNA, 31 nt, Homo sapiens
uuccuuuaagagaaauuugucugcaguuguu

SEQ ID NO: 156768 - RNA, 61 nt, Homo sapiens
cggugcgcuucagggcgcagcggcggccgcagaccgagccccgggcgcggcaagaggcggc

SEQ ID NO: 156769 - RNA, 46 nt, Homo sapiens
agcucccaagaggagggcagcuuguaacuuacaaaggcuguuagag

SEQ ID NO: 156770 - RNA, 45 nt, Homo sapiens
augcgcaaauauuauuugauuugccuccaacagauuuugcaggau

SEQ ID NO: 156771 - RNA, 54 nt, Homo sapiens
ugggcauuuucucacuucccuauaggugacaugcuucguuauauucaggagagu

SEQ ID NO: 156772 - RNA, 89 nt, Homo sapiens
uaccaaaaugaugaucuaaaauauuccauuuuaaugacuguggaaaguauaauguuuaaacuauacuuaaaaucacuucaucuaccaga

SEQ ID NO: 156773 - RNA, 112 nt, Homo sapiens
auauuuacaguauuuucuucgcuaaguguuuuagaauaugacaaaauuuagcuggggaauaugccauguuuccuuacuauauguagcugucaucauuccgaaagaacuuaua

SEQ ID NO: 156774 - RNA, 113 nt, Homo sapiens
cuuauauuuggcaaccguugaugauucuugcuugauccagucuuuacuauggugguugugaaauuauaauucuuccaacuuccucccucuauuuaucccaguuggcacuaagc

SEQ ID NO: 156775 - RNA, 62 nt, Homo sapiens
aaguuuacaacaaaaggauuagaauccacuguuugggauagguaggguacuugcagucaguu

SEQ ID NO: 156776 - RNA, 45 nt, Homo sapiens
aguggcugaaagaucaagaaacugauauuaaacagcaaguugaaa

SEQ ID NO: 156777 - RNA, 42 nt, Homo sapiens
gagaaauacaaaucaagacuuauguaaucaaaugagacaaau

SEQ ID NO: 156778 - RNA, 41 nt, Homo sapiens
ggaaaaggaauguggguaguauacuccuuuuccuccugggu

SEQ ID NO: 156779 - RNA, 44 nt, Homo sapiens
aagccuauagaguuaaaaaaccauuuuuaaaaggcucaauaaag

SEQ ID NO: 156780 - RNA, 86 nt, Homo sapiens
agaguugcugaguaucacagcaaauagcucuacacauuuacguguguuugauccacaucaaaauguccacaguuaugaucccaagu

SEQ ID NO: 156781 - RNA, 71 nt, Homo sapiens
uacuccaugaauugucucauuuccuaaccaacugcagagggcuagggcaaggguugggaaagacaguaucc

SEQ ID NO: 156782 - RNA, 61 nt, Homo sapiens
ucacagcacugcuauccagaaggaagcaaagaagaaaauaucagaacuggauuauaugaug

SEQ ID NO: 156783 - RNA, 46 nt, Homo sapiens
uggcucagcuacaguuccagcugcagcaagcacagaaggcacaugc

SEQ ID NO: 156784 - RNA, 48 nt, Homo sapiens
cgugaaacaacuggaaaggaaucaagaagcaaucaaguuagaaaagac

SEQ ID NO: 156785 - RNA, 46 nt, Homo sapiens
uauuguccuuacaaaagaauuuggaugccacagucaccgcacuuaa

SEQ ID NO: 156786 - RNA, 42 nt, Homo sapiens
augaaaaggaugguuugacucucagccuucgagaaucacaga

SEQ ID NO: 156787 - RNA, 46 nt, Homo sapiens
gguuguagucacaguuugaaaaacacugcuuuaaaugacuauaaau

SEQ ID NO: 156788 - RNA, 45 nt, Homo sapiens
gaauucugagaugaaaugcuaguaucaaaaaacaaaaaucccaaa

SEQ ID NO: 156789 - RNA, 42 nt, Homo sapiens
auaaagugacauauaaaccuuaucagucuucugcccagaaua

SEQ ID NO: 156790 - RNA, 75 nt, Homo sapiens
acauccuguguaccauccugaagaagguggagaugaagguggaagugguuauaguccuccaaguaaaugugaaca

SEQ ID NO: 156791 - RNA, 39 nt, Homo sapiens
aucauccugagcaauuggagaugagcuggaaugagcaaa

SEQ ID NO: 156792 - RNA, 35 nt, Homo sapiens
cuccucuccagagcuccaguauucggacugcagcg

SEQ ID NO: 156793 - RNA, 47 nt, Homo sapiens
gaucuucguuaaaaaaaaaaaaagccuucugauauaaauccuaaaau

SEQ ID NO: 156794 - RNA, 84 nt, Homo sapiens
gcugcugcuguucucaucaccuggccagagugcaucuggcuacucacauucccugugggaugccuaauugucaauuccccaagg

SEQ ID NO: 156795 - RNA, 42 nt, Homo sapiens
uuagacuuuggcaguguggcacuaccagugcaaaaugaagau

SEQ ID NO: 156796 - RNA, 48 nt, Homo sapiens
gagaauacagagcacaggcagcacugccaccuccaaagccccacuuua

SEQ ID NO: 156797 - RNA, 23 nt, Homo sapiens
cggagggguguggagaugggagc

SEQ ID NO: 156798 - RNA, 367 nt, Homo sapiens
aaagaaagcuauuuauguaaagaaguauguagcauaauaauaauaauaaucagcugggugcaguggcucgcaccuguaaucccagcacuuugggaggaucccuugaguccaggaguuugagaccagccuggacaacauagugagacccugucucuacaaaaaaaacaaaaaacaaaaagccagguguaguggugcacaccuguagucccagcuacgugggaggcugagguuggaggauugcuugggcccaggagauggaggcugcagugagccaugauggcuccacugcacuccagccugggagacagaaccaggcccuguuuuuaaaaauaauaauaaugguaacaacaccuuccaucuguauugc

SEQ ID NO: 156799 - RNA, 47 nt, Homo sapiens
guggugcggggacccgaggcgccucguacccggccgggcugacgcgg

SEQ ID NO: 156800 - RNA, 60 nt, Homo sapiens
aaauccccaccgaaaagucccccgugcugcgcgcggagggacacauggugugcgagugag

SEQ ID NO: 156801 - RNA, 57 nt, Homo sapiens
uguaauaaagguuuguagucuuuguguaauuuauuaaagcauugugccuaaaauaga

SEQ ID NO: 156802 - RNA, 59 nt, Homo sapiens
acauucagcuaauuguuacagaaucguugcccccauuaaucuuaggcuguagaauguag

SEQ ID NO: 156803 - RNA, 44 nt, Homo sapiens
uagguaaagcagcagcaaaacaaaugguuccuacuccuguuuuu

SEQ ID NO: 156804 - RNA, 43 nt, Homo sapiens
uaccuaggauugccaagcgaguuucguguguuuuuuugguuuu

SEQ ID NO: 156805 - RNA, 50 nt, Homo sapiens
ucaaccaguuaccaaagcauguuucuaccauuuuguguucuuuucugcag

SEQ ID NO: 156806 - RNA, 49 nt, Homo sapiens
gagagggauugggcuauuuaucuugcgaaguugggaaguugaugaggug

SEQ ID NO: 156807 - RNA, 41 nt, Homo sapiens
uaguaaugucugguuuaccucuagcacuacccuuaucccag

SEQ ID NO: 156808 - RNA, 56 nt, Homo sapiens
ugcuuuaauuauuauuuuuucucuaauuuuaaguuaugugcacagugcccugaaga

SEQ ID NO: 156809 - RNA, 46 nt, Homo sapiens
uauguacuauauaugaaauacgugacuguuuauaaucuuaucaaaa

SEQ ID NO: 156810 - RNA, 45 nt, Homo sapiens
cauacagauucauaauuuuuuucugagguaauuaauaauugccag

SEQ ID NO: 156811 - RNA, 48 nt, Homo sapiens
uuuuugcuuuauuuuggaaguuaauaguuauuuuuuuucuaugacaaa

SEQ ID NO: 156812 - RNA, 31 nt, Homo sapiens
auagacauaugauaacucuuaucaacagacu

SEQ ID NO: 156813 - RNA, 46 nt, Homo sapiens
aaagcugucgaagaagcugaaagacucucugaaagccuuaaauuaa

SEQ ID NO: 156814 - RNA, 46 nt, Homo sapiens
gauaugaagaagcugaaguccggaaaaaacuugaggaaaaagacag

SEQ ID NO: 156815 - RNA, 45 nt, Homo sapiens
uuuggagaauguuuuggauuccaaagacaaaacccaaaagguauu

SEQ ID NO: 156816 - RNA, 334 nt, Homo sapiens
aaaaaucgaggccaggcgcaguggcucauuccuguaaucccagcacuuugggaggcucaggaaggaggauugcuugagcccaggaguucaagaccagccuagguaacauggugaaaccccugucucuacaaaaaauacaaaaauuagcuggguguggugguggaugcccuuagucccaucugcucaggagguugaggugggagaauuguucgagcccgggagguugaggcugcagugagccacgaucacaccacuguacugcagccuaugacagugagacccugucucaaauccaaaccaguaauauggaaauuauccauagguggcguugaug

SEQ ID NO: 156817 - RNA, 48 nt, Homo sapiens
uagguaugugcauguauaaggaucuuuuguguuuauuucagcauugcu

SEQ ID NO: 156818 - RNA, 46 nt, Homo sapiens
cccaguauacaacaaaugcuaaggucacuccacccccacgacgcca

SEQ ID NO: 156819 - RNA, 74 nt, Homo sapiens
ucaagagagacuuggaucaaauuugaauuuuguccuguaggcacaaggaaccauuaaagaauuuuaaacuugag

SEQ ID NO: 156820 - RNA, 48 nt, Homo sapiens
agcuaugcuguaguccuggugagagaggagguugacauggucuuagcc

SEQ ID NO: 156821 - RNA, 45 nt, Homo sapiens
cucuagauugaucguacuaaaaaaccagcagucaaauugccugaa

SEQ ID NO: 156822 - RNA, 41 nt, Homo sapiens
gaaaaaaacaaacaagaaaaagaacuucgggaaaggcagca

SEQ ID NO: 156823 - RNA, 45 nt, Homo sapiens
aaaagcaaaagaagaaauggagaagaaagaaagugaacaggccaa

SEQ ID NO: 156824 - RNA, 69 nt, Homo sapiens
gcauuuuuuacuauuggucuguaucuuaauuucuucuuucucuugaauacuucaaauuuuuugaagcac

SEQ ID NO: 156825 - RNA, 48 nt, Homo sapiens
uucucaauacccaaccugagaugcuggcuacaauauaugagcauucug

SEQ ID NO: 156826 - RNA, 46 nt, Homo sapiens
aaaucuucagcagcuuauauccucuuuuauacuucauugggaccac

SEQ ID NO: 156827 - RNA, 45 nt, Homo sapiens
uuacagguaccauuuauuucaaaacaacuuuuuuagucugcucca

SEQ ID NO: 156828 - RNA, 47 nt, Homo sapiens
uuuuuuuccuuuucacuguuauggccuuuucacauuucuaaauccca

SEQ ID NO: 156829 - RNA, 37 nt, Homo sapiens
uuguaacuacuuauauguugugcccauugacuaucau

SEQ ID NO: 156830 - RNA, 45 nt, Homo sapiens
gacauucuacgggcagcacuuaaguauagcaacaagaagacugga

SEQ ID NO: 156831 - RNA, 24 nt, Homo sapiens
guaucuuaccagggacuaggggga

SEQ ID NO: 156832 - RNA, 49 nt, Homo sapiens
gaaaauuuuccagugggcacuuaauggugcccuugaagaacuuccuaau

SEQ ID NO: 156833 - RNA, 46 nt, Homo sapiens
ucagguaaauaaaauugaaauucacuaugccaagacugccaaaaag

SEQ ID NO: 156834 - RNA, 24 nt, Homo sapiens
cugccagguucagagcugccagua

SEQ ID NO: 156835 - RNA, 46 nt, Homo sapiens
guuuaagaagaaugaccagguauuugacaucaaugcugaaguugac

SEQ ID NO: 156836 - RNA, 45 nt, Homo sapiens
ucugcccuucccuggccggguuccaguuuacacagugggacagug

SEQ ID NO: 156837 - RNA, 45 nt, Homo sapiens
gagaaccucucgaguugccagaguuagguuguguagaaaugacag

SEQ ID NO: 156838 - RNA, 36 nt, Homo sapiens
agcagggguguuucuguccacucuccacugccagga

SEQ ID NO: 156839 - RNA, 46 nt, Homo sapiens
cuucuagccucuugcugcacaugugugugauucacccugucccugu

SEQ ID NO: 156840 - RNA, 46 nt, Homo sapiens
uuacacagaacuauugagcagaacauaaacaaccucaaugucuccg

SEQ ID NO: 156841 - RNA, 77 nt, Homo sapiens
aggaauuuugugccgucauucccuagccuugaacaugaggacaugccugugaggauuuggcucuugacaaguguuuu

SEQ ID NO: 156842 - RNA, 45 nt, Homo sapiens
uacauuuuggacaugguaugugugacuuacgggagagacucaggu

SEQ ID NO: 156843 - RNA, 49 nt, Homo sapiens
ggcuccgccagggguucagggaagaucuuuaggcagauacuagggaacg

SEQ ID NO: 156844 - RNA, 58 nt, Homo sapiens
uaugcucagcucgggucuuggcccugcggcugacagcagaggccggugcggggggagg

SEQ ID NO: 156845 - RNA, 55 nt, Homo sapiens
ccguuacggcgcucaggcgucucgacgcgcgcgauuuaaaaccagcucaggagac

SEQ ID NO: 156846 - RNA, 44 nt, Homo sapiens
uucaccuagaaagagcaggcagaaaucaagaugagcauggacac

SEQ ID NO: 156847 - RNA, 44 nt, Homo sapiens
gaacaggccaggaacuauggaacaggucucucuggccuaauuag

SEQ ID NO: 156848 - RNA, 42 nt, Homo sapiens
ucugccagcuaugaugacacagugaagcuguaccgggaggaa

SEQ ID NO: 156849 - RNA, 45 nt, Homo sapiens
ggcuugggccccaucuggcaaccuccuggccacuugcagccgaga

SEQ ID NO: 156850 - RNA, 46 nt, Homo sapiens
uggccucugccagcuuugaugcuaccacuugcauuuggaagaagaa

SEQ ID NO: 156851 - RNA, 52 nt, Homo sapiens
gcagcaccaucccagcccuggggccugcugacuggugaggaacagugggcgg

SEQ ID NO: 156852 - RNA, 35 nt, Homo sapiens
ugagacccugacuccgggucuuugcucuagcagua

SEQ ID NO: 156853 - RNA, 48 nt, Homo sapiens
cugccugcagacuguuugggucaggagugguuagagcaaugggcagau

SEQ ID NO: 156854 - RNA, 43 nt, Homo sapiens
acacgcuuucagccagugccacagugauuuggguaugcccuag

SEQ ID NO: 156855 - RNA, 45 nt, Homo sapiens
uaccccacagaggaagaggagcaggcgcuggagcugcucucagag

SEQ ID NO: 156856 - RNA, 42 nt, Homo sapiens
gcuccucucgcacccagaggagcuccuuuccccagcaggccu

SEQ ID NO: 156857 - RNA, 34 nt, Homo sapiens
agaaccggagguccacugguuuucuauaauguac

SEQ ID NO: 156858 - RNA, 46 nt, Homo sapiens
uagauccagauggccaaccuguccuuguuaaguuacuugcuucuug

SEQ ID NO: 156859 - RNA, 48 nt, Homo sapiens
uccaaucucuuccaaccuuuaaggugauagauaguuugagcaagacug

SEQ ID NO: 156860 - RNA, 50 nt, Homo sapiens
ccuuuggccagauugacuggggauguccggacagaugccugcaugggugg

SEQ ID NO: 156861 - RNA, 48 nt, Homo sapiens
aauccuguuuucacacaggaaguuucuaggucuuucuagaacagcuag

SEQ ID NO: 156862 - RNA, 73 nt, Homo sapiens
uucauacauuugaucacacagccuacacccagccccgagugugcaucacgguaaaagagcugagggcucucuu

SEQ ID NO: 156863 - RNA, 37 nt, Homo sapiens
ggcggccggcucggaaaaguccugugcccagaaggga

SEQ ID NO: 156864 - RNA, 62 nt, Homo sapiens
gguucugccuggccuuaagugaggguguugaaagugggagacaggaccugccaaaggggaag

SEQ ID NO: 156865 - RNA, 61 nt, Homo sapiens
gcuggaguugggaaugcgggagccccagucucugcccaccugucacguggcagcuggaagg

SEQ ID NO: 156866 - RNA, 64 nt, Homo sapiens
uucagcuggcaucuugccugaaauauccacgcucucagccacuacacuaauggaacacagaugc

SEQ ID NO: 156867 - RNA, 50 nt, Homo sapiens
ccugaaacgaagacgcuucauuaggguuacugguuugagaauuaagauca

SEQ ID NO: 156868 - RNA, 51 nt, Homo sapiens
cgcccggggccgggaugcagggcgcgcggacagaaacgagacagacagcuc

SEQ ID NO: 156869 - RNA, 31 nt, Homo sapiens
gccuccugcaaggaggggaagagcacgauca

SEQ ID NO: 156870 - RNA, 42 nt, Homo sapiens
ggaacagguagggcaagaucuccacagggccacccuggaggg

SEQ ID NO: 156871 - RNA, 26 nt, Homo sapiens
agagcacgggucccguggccacguug

SEQ ID NO: 156872 - RNA, 51 nt, Homo sapiens
ccgugacaggcgcuccccgagcuaccccaagaugugcgaagggcaccugcc

SEQ ID NO: 156873 - RNA, 43 nt, Homo sapiens
auaaccccuugccauggcuuugacucugcuuccguagagcuag

SEQ ID NO: 156874 - RNA, 59 nt, Homo sapiens
ggggcguuucuuuaccaguuugcaaaggccccccaggacaugcugucucucccccuguc

SEQ ID NO: 156875 - RNA, 39 nt, Homo sapiens
cugcaaugugauccuggugaaggaggagaacacaaggua

SEQ ID NO: 156876 - RNA, 41 nt, Homo sapiens
aucagaaagggaccacaccccagacccauguacuaggaaca

SEQ ID NO: 156877 - RNA, 46 nt, Homo sapiens
gucccuggagcagcacaucccccccugccaggaugucccacagaag

SEQ ID NO: 156878 - RNA, 93 nt, Homo sapiens
aaggagugcuaugaggcugcagcagggcacagccuccagucuucacucuccuccuuaaggaaggguuccaggcaaagcucaugcucuagaagc

SEQ ID NO: 156879 - RNA, 59 nt, Homo sapiens
acacuguuccagggaaacggaggguaaacgagauaugcgcggcugcaaggaggaaggaa

SEQ ID NO: 156880 - RNA, 47 nt, Homo sapiens
cuuuggcccugggcaggaaaggacuagguuugcuccagaagcugacg

SEQ ID NO: 156881 - RNA, 58 nt, Homo sapiens
gucgaggugauauuaacaggacucacugagggauuggacagugggaacaggggcagug

SEQ ID NO: 156882 - RNA, 45 nt, Homo sapiens
agccugugcaaaggccuugagcagcgggcugagcaggcggcagag

SEQ ID NO: 156883 - RNA, 40 nt, Homo sapiens
agcaagggccccaaagggcuggcaggcuuggcucagacuu

SEQ ID NO: 156884 - RNA, 47 nt, Homo sapiens
cauucagggaaggcaccaugugguaaggaauaguggccagaauugga

SEQ ID NO: 156885 - RNA, 47 nt, Homo sapiens
cagccuuuugacaguggcacaguuggugcuuguguaagauagcaggg

SEQ ID NO: 156886 - RNA, 37 nt, Homo sapiens
aagagguuugucagacaauaggauagauguuaggagg

SEQ ID NO: 156887 - RNA, 46 nt, Homo sapiens
cgacggucagcccuguccagggaaauucucacuaaagagagacacc

SEQ ID NO: 156888 - RNA, 42 nt, Homo sapiens
cuuugguacauucauguguggacugagaggaggcuccagugu

SEQ ID NO: 156889 - RNA, 45 nt, Homo sapiens
uuaguucacauucccaaggaaggaugucaucuuuucaagccagau

SEQ ID NO: 156890 - RNA, 73 nt, Homo sapiens
aauaaggaugguuugcauggaaauuggagcccauggguggugcuaggcgaggugagggcuuccccaggaauuc

SEQ ID NO: 156891 - RNA, 28 nt, Homo sapiens
uuucucaagauuuagaauguucuagcuc

SEQ ID NO: 156892 - RNA, 41 nt, Homo sapiens
gugugugucuucaaggagcggagugagcgcagcagccgaga

SEQ ID NO: 156893 - RNA, 47 nt, Homo sapiens
uucauuuauuguuuauguaaauguuuguuaaaaauaaaucccaugga

SEQ ID NO: 156894 - RNA, 45 nt, Homo sapiens
uauguggaaugaauuuuuucauguuauguugaauauuccagauug

SEQ ID NO: 156895 - RNA, 51 nt, Homo sapiens
cuuuggcacuuacaugaaagugaaaaaugaaggaggagaguguaagccuga

SEQ ID NO: 156896 - RNA, 46 nt, Homo sapiens
cugguuuucaguguguugagaugcucagcaacaaaccauggaacua

SEQ ID NO: 156897 - RNA, 46 nt, Homo sapiens
auucauggagacauuaaaccagacaauuucauacuuggaaacgggc

SEQ ID NO: 156898 - RNA, 46 nt, Homo sapiens
ugcugcacaacuugcgucuacaccauuccacaagcuuccaguggag

SEQ ID NO: 156899 - RNA, 46 nt, Homo sapiens
accacagccuaaaaauaaacccacaggagccaggaccuuuggagaa

SEQ ID NO: 156900 - RNA, 48 nt, Homo sapiens
augcuauuuuuuauucuguugcagaaaauguaaggucaucuggggcuu

SEQ ID NO: 156901 - RNA, 40 nt, Homo sapiens
uucaucucacuauagugacuuacugccuaguauuugaaaa

SEQ ID NO: 156902 - RNA, 69 nt, Homo sapiens
gauuuaggagaaugauuaacaccuugcugauauguggcagggacucgugaccugggacuugaguacaaa

SEQ ID NO: 156903 - RNA, 65 nt, Homo sapiens
auuagacucaggaggacuugaaauguaaagcuaagagcuuaauucuuucuugaaggaaauggaaa

SEQ ID NO: 156904 - RNA, 46 nt, Homo sapiens
ccuacacuuccugauauuucugaugacaaagaugaauggcaaucuc

SEQ ID NO: 156905 - RNA, 44 nt, Homo sapiens
ucugauauauucuaagcacagcaaagggaccaauguggggaggu

SEQ ID NO: 156906 - RNA, 30 nt, Homo sapiens
uacuauuggaguuaugggguugaaauuuca

SEQ ID NO: 156907 - RNA, 44 nt, Homo sapiens
cccagaaauacaaucaacggagaaagcaugagcaaugggguacu

SEQ ID NO: 156908 - RNA, 45 nt, Homo sapiens
gagcagguuguuauguauugcaaggagaagcuuauucguggggaa

SEQ ID NO: 156909 - RNA, 33 nt, Homo sapiens
uuguuguaaauaauguauuuucccccauuguag

SEQ ID NO: 156910 - RNA, 109 nt, Homo sapiens
gccucucucucaggaacuucaaaaauacuauuucaacagauagcagaugccaucaagugacaucuaucaguuuucugccaccaaccaauaaauguaacugcauccuucc

SEQ ID NO: 156911 - RNA, 42 nt, Homo sapiens
uuguguaucucuuauguuuccagguucacucuagcgccaaac

SEQ ID NO: 156912 - RNA, 73 nt, Homo sapiens
guacauugccugggcggggcaucuggaagcccaaggagagcugcagcaugccagugcuguccuucagagagga

SEQ ID NO: 156913 - RNA, 91 nt, Homo sapiens
caguggguagaagagaauuuuccugagaauaaagaauacuugauaacuuuacuagaacauuuaaugaaggaauuuuuagauaagaagaaau

SEQ ID NO: 156914 - RNA, 44 nt, Homo sapiens
uaccuuucucucuucuaggaugcuugaagcccacaugcagagcu

SEQ ID NO: 156915 - RNA, 26 nt, Homo sapiens
gucucagccaugcuccugggaagcaa

SEQ ID NO: 156916 - RNA, 66 nt, Homo sapiens
uuguuaaaugcagucaaaacaaaaauccauuugcucuaagacuuuuucuguaaccuucaaccuagc

SEQ ID NO: 156917 - RNA, 44 nt, Homo sapiens
cugccggccagcguccucuggccauggacaccccggaaaauguc

SEQ ID NO: 156918 - RNA, 59 nt, Homo sapiens
uuccuguucaguucccucugcgcgccagaggguggcaccccaggcacuccagaggugga

SEQ ID NO: 156919 - RNA, 42 nt, Homo sapiens
cacccgcugggccgccacucucggggauuuugguggcaaagc

SEQ ID NO: 156920 - RNA, 39 nt, Homo sapiens
cccccgacucuuguuuuucaaaguguucacagggucgcg

SEQ ID NO: 156921 - RNA, 51 nt, Homo sapiens
cuucaagaaggcugcuggagcuccugccaucacuucugcauuccagacaga

SEQ ID NO: 156922 - RNA, 42 nt, Homo sapiens
gcaguagcuagagggacagguuuccuuccaggaaggauucga

SEQ ID NO: 156923 - RNA, 84 nt, Homo sapiens
aaauguguacuguuagaaguggcuuccgcuuacuggauuaacuaauacuuuauaggcuuuucaggaggccacaucacuagcagu

SEQ ID NO: 156924 - RNA, 42 nt, Homo sapiens
ggauccuggcagccgguggcggaaccugcccagcgggccuag

SEQ ID NO: 156925 - RNA, 66 nt, Homo sapiens
cuugguggguaagcgggagagcacaacauguuaaacaggacgcgguacuggccuucgugagacuug

SEQ ID NO: 156926 - RNA, 32 nt, Homo sapiens
ugaaccguaguuuggacaguuucggggugcug

SEQ ID NO: 156927 - RNA, 102 nt, Homo sapiens
ugccgaggaagguauaaaugagucaugaaagcaagauugaaucgaaaaguguaauugcauuauuagcguagaguaaugguagcagaauucaagugaguaugg

SEQ ID NO: 156928 - RNA, 46 nt, Homo sapiens
aauccaggaguuugagaaagggcaggauuagaugaguucaagaagu

SEQ ID NO: 156929 - RNA, 46 nt, Homo sapiens
ugugggagauagggauacagauaauguggagagcuuugauugccag

SEQ ID NO: 156930 - RNA, 42 nt, Homo sapiens
ucaugguggcaucacaggcaucaauguuuguagaacacauaa

SEQ ID NO: 156931 - RNA, 46 nt, Homo sapiens
cagugaauggaaucucaaaaggaaucauuaagcaguuucuuggcua

SEQ ID NO: 156932 - RNA, 45 nt, Homo sapiens
agcuuuucugauuaucagaucuuucaggagcucaucaaaggaaaa

SEQ ID NO: 156933 - RNA, 46 nt, Homo sapiens
aaaacucaauguuccugacugguacccaaaugagcaagcugcggag

SEQ ID NO: 156934 - RNA, 15 nt, Homo sapiens
guuggggaucuuggu

SEQ ID NO: 156935 - RNA, 361 nt, Homo sapiens
aguucugcuuaaaaguacuucucccaauuagaguggccuggccgggcgugguggcccaugccuguaaucccagcacuuugggaagccgaggugugcagaugacuugcggucaggaguuuaagaccaaccuggccaacauggugaaaccccaucucuacuaaauauacacacacaaaaaaauuagcugggugugguggcaugugccuguggucccagcuacucaggaagcugaggcaguagaaucacuugaauccaggagguggagguugcagggaaccaagauugcaccacugcacuccagccugggugacagagugagacuccaucuaaaaaaaaaaaagagagagagaguggccuguaa

SEQ ID NO: 156936 - RNA, 24 nt, Homo sapiens
uuuuaaugauaaugcaucuagcug

SEQ ID NO: 156937 - RNA, 39 nt, Homo sapiens
uuuuucuuccuauuccccuucacaauuggucugggguag

SEQ ID NO: 156938 - RNA, 45 nt, Homo sapiens
gaucggauaacaaacuguaucgucuucagacuccucagagucccu

SEQ ID NO: 156939 - RNA, 48 nt, Homo sapiens
gcccauggaagugucuacaagucugaguucauagaccucucugaaaaa

SEQ ID NO: 156940 - RNA, 42 nt, Homo sapiens
aguacggagauccguauuacagcuaccucaaccucaacaccg

SEQ ID NO: 156941 - RNA, 47 nt, Homo sapiens
auuguguuguggauaacaucaaagugugcaguaaugacacugggagu

SEQ ID NO: 156942 - RNA, 82 nt, Homo sapiens
gcaucacuaugagagugccucggaacccaacuaucggagauaaauuugccagucgccaugggcagaagggcauuuuaagcag

SEQ ID NO: 156943 - RNA, 81 nt, Homo sapiens
cuacacccugcucucagcaggcagugagugucacacaccuguuaauccaucuugagcaggacaguacuauacaaauagaau

SEQ ID NO: 156944 - RNA, 46 nt, Homo sapiens
auaugcgccgcuuccugcagugcgcugagcaggugcagccgccacg

SEQ ID NO: 156945 - RNA, 46 nt, Homo sapiens
cccuggacaugggcccggcuuuccuggauaucaggacuuccaauaa

SEQ ID NO: 156946 - RNA, 40 nt, Homo sapiens
aggcaauggagaugaaaauacuggcuuuauuauugaaaac

SEQ ID NO: 156947 - RNA, 43 nt, Homo sapiens
gucauauucacuggggaggguuugaauauagggcugccagaag

SEQ ID NO: 156948 - RNA, 46 nt, Homo sapiens
agaaguaggcguacugucgagcuguguuuuuauacuggcugaagac

SEQ ID NO: 156949 - RNA, 44 nt, Homo sapiens
aaaaccacuguggaucacaaacucugcguuggaucgagugccau

SEQ ID NO: 156950 - RNA, 50 nt, Homo sapiens
gcgggacucacgaccuucccaggaagcagccgcggggguuucagcggccg

SEQ ID NO: 156951 - RNA, 47 nt, Homo sapiens
agggcggagcgggagacgaggagaucgaggcgacagcggcuggagcc

SEQ ID NO: 156952 - RNA, 77 nt, Homo sapiens
uggcucaggagggcuaaaagcacggagcagaauuccauggcggagaagagaaaggacgcaaguucauccugcggggg

SEQ ID NO: 156953 - RNA, 42 nt, Homo sapiens
gaagcccaggaugagcauccauagguaguccaccaaaggacc

SEQ ID NO: 156954 - RNA, 46 nt, Homo sapiens
agggagaaaccaauaguugcaccaacaauacaauggguuccagaaa

SEQ ID NO: 156955 - RNA, 46 nt, Homo sapiens
uuuccugagaaaaaugcauuuauccucacuguaacucaguccuaug

SEQ ID NO: 156956 - RNA, 50 nt, Homo sapiens
cuguuacugagggauuggccugcaagagugugugugugcacgugcacaga

SEQ ID NO: 156957 - RNA, 44 nt, Homo sapiens
caaaugcugugaagagaaauaaagaaggguaagaggagagugau

SEQ ID NO: 156958 - RNA, 42 nt, Homo sapiens; identical to SEQ ID NO: 71239

SEQ ID NO: 156959 - RNA, 42 nt, Homo sapiens
guucucuccuccaccacagccuggaggggcacaguggcaggc

SEQ ID NO: 156960 - RNA, 52 nt, Homo sapiens
aacugcuauuaccucauccuauuuguauuauuugggguccuguaaaugcuag

SEQ ID NO: 156961 - RNA, 48 nt, Homo sapiens
aggguauagcuggccugagaaggcagugcaagccccagagacuguugu

SEQ ID NO: 156962 - RNA, 46 nt, Homo sapiens
ggucgucuagcuuuuauauucaaaccuaguuuugcauuuguuacuc

SEQ ID NO: 156963 - RNA, 52 nt, Homo sapiens
gagagugaauaggagacuggagauauguucagagucuugaaagggugucaag

SEQ ID NO: 156964 - RNA, 44 nt, Homo sapiens
gauaaacauuuucuauuuggucucauauaacucuuaaaauuuaa

SEQ ID NO: 156965 - RNA, 43 nt, Homo sapiens
ucuugugaaacuuguuauuugccuucaugcuggaaucauaguu

SEQ ID NO: 156966 - RNA, 51 nt, Homo sapiens
aguugccuuuagaaagggaaaguucacucuucguuuaugauuagaaggaag

SEQ ID NO: 156967 - RNA, 118 nt, Homo sapiens
cauucuguagguguuucuucagcaccugcagugugccaggcgcuaggagacacagugaugagcacacagugagucuuuaccuuucuggagcuaauuguuugguguauauauagaaagu

SEQ ID NO: 156968 - RNA, 23 nt, Homo sapiens
cacaaccguaaaugggacccaaa

SEQ ID NO: 156969 - RNA, 45 nt, Homo sapiens
gcaguuaacagaucaaggaaaugguaaauguauagacuuuaugaa

SEQ ID NO: 156970 - RNA, 46 nt, Homo sapiens
gaagcuggaucguccacaacaggagaacugucaagaaaaccugugg

SEQ ID NO: 156971 - RNA, 46 nt, Homo sapiens
cuaaaagguccaucagcauuaaacuccagcccagaccaccuaauac

SEQ ID NO: 156972 - RNA, 46 nt, Homo sapiens
gccuuaucuaaaauccaagaauaauugccagaaucaaccaccuucu

SEQ ID NO: 156973 - RNA, 52 nt, Homo sapiens
ugcuagauuuauguauagacagucucuguaaggaucacaaggcaaaaaaaaa

SEQ ID NO: 156974 - RNA, 42 nt, Homo sapiens
guaccuugcagccaagggaaaacugaagagccaaaacaccaa

SEQ ID NO: 156975 - RNA, 27 nt, Homo sapiens
gccaggaggcggggucuggccgaagcc

SEQ ID NO: 156976 - RNA, 32 nt, Homo sapiens
caccuaguuguaaggaagauuaaagucauacu

SEQ ID NO: 156977 - RNA, 41 nt, Homo sapiens
agacaugaauagcuauuugaaugugaacagcagacgaagaa

SEQ ID NO: 156978 - RNA, 36 nt, Homo sapiens
augugcuaggcaccauuccaagucgcuggggaaaga

SEQ ID NO: 156979 - RNA, 42 nt, Homo sapiens
uguaaacaguccauugaauuaagcccuagcggagcccagcgg

SEQ ID NO: 156980 - RNA, 42 nt, Homo sapiens
cccgggcccccccugccucaucccuccguccggcccugggac

SEQ ID NO: 156981 - RNA, 46 nt, Homo sapiens
gaggcuggugagggcccagaauucagccagcgccagcuccacguuc

SEQ ID NO: 156982 - RNA, 47 nt, Homo sapiens
aaaacagcacaaaucucaaguguggauauccacauggaagcccugau

SEQ ID NO: 156983 - RNA, 52 nt, Homo sapiens
auaacccccaccucuugugaagcuguuuagugcuagugagauggguuguggc

SEQ ID NO: 156984 - RNA, 49 nt, Homo sapiens
guugaugcggcagaaacaaucaagagauggcaacagcaggucacugggg

SEQ ID NO: 156985 - RNA, 47 nt, Homo sapiens
caggaugaaguucauucuccucaggcuggcauucaaggcucuuggca

SEQ ID NO: 156986 - RNA, 66 nt, Homo sapiens
cugccaguguggcaauucaucuuccccuccugggggacugacaguucuccccucauuguuacugac

SEQ ID NO: 156987 - RNA, 57 nt, Homo sapiens
cagccuacagugagcaacacuuacugcacugaccagacaaggaaaugggggcccaga

SEQ ID NO: 156988 - RNA, 27 nt, Homo sapiens
ggcgcuuucuguagcuaugaacaggaa

SEQ ID NO: 156989 - RNA, 67 nt, Homo sapiens
gaggaaaaaaaaaaaagaaaagaaaaggaaaaaaauaaagcaaaacuaaaaagaagcggggaaaccc

SEQ ID NO: 156990 - RNA, 42 nt, Homo sapiens
uaggcuggagccucacuagggauguuacagugugggcugcag

SEQ ID NO: 156991 - RNA, 40 nt, Homo sapiens
gcaccagagagcugcuggcagccugagacccagugaagac

SEQ ID NO: 156992 - RNA, 45 nt, Homo sapiens
accaaccuagaguaagugccaccagcgcccccagaugucggggga

SEQ ID NO: 156993 - RNA, 41 nt, Homo sapiens
ugugaacuuggccuaugaaauacuugagccagaacccacag

SEQ ID NO: 156994 - RNA, 48 nt, Homo sapiens
auauucuucccauuaaaaaaauguuaaagacuuuuuuauuagucauau

SEQ ID NO: 156995 - RNA, 67 nt, Homo sapiens
gaggcgugugcaugaccuaucucuggaagucuguauauaacgaauuggccaguuugguugccugugg

SEQ ID NO: 156996 - RNA, 26 nt, Homo sapiens
uucccucuucucuuuccuuucuggau

SEQ ID NO: 156997 - RNA, 49 nt, Homo sapiens
ccucuuuaagauuucauuuauuaucugaaaaagggggcaaaauccagag

SEQ ID NO: 156998 - RNA, 45 nt, Homo sapiens
gaggaucaaauucaugugcuugucaaaagccuugaaggugccaau

SEQ ID NO: 156999 - RNA, 35 nt, Homo sapiens
uagccucucucccacagccgauuucccgccgccgc

SEQ ID NO: 157000 - RNA, 46 nt, Homo sapiens
uccaaggcaaccugggaugaggcaaagggacaaaaggccaccagac

SEQ ID NO: 157001 - RNA, 46 nt, Homo sapiens
acacgcauagagaagguauugauguccuuauccagcugguccagga

SEQ ID NO: 157002 - RNA, 45 nt, Homo sapiens
ccccaauuagggcugacaggcugggggcuacuuggcucaucuugg

SEQ ID NO: 157003 - RNA, 46 nt, Homo sapiens
ccagguuggugaggcugccagcaugugcgaugagacgugcaccuac

SEQ ID NO: 157004 - RNA, 47 nt, Homo sapiens
ggaucucuaccccaaugcaugccaacccauagcucccagaggcagag

SEQ ID NO: 157005 - RNA, 45 nt, Homo sapiens
gauucgugaggcaauacugcauuuguuugccagguaucgggagau

SEQ ID NO: 157006 - RNA, 73 nt, Homo sapiens
cagucucauagaaggacagucgcucuucaacuuguucucgaagcuucuccccgaauacacucgugggcaccuc

SEQ ID NO: 157007 - RNA, 52 nt, Homo sapiens
accugaaccauugcuuccuucaugacauccagauucuuucgugguaucucuc

SEQ ID NO: 157008 - RNA, 45 nt, Homo sapiens
uaguaaucucagcagccgcuuccucugccuggucaaagaaaagug

SEQ ID NO: 157009 - RNA, 52 nt, Homo sapiens
uccucuggaguacuacugcuguuuucugaagacgcgagggcaagugcagcca

SEQ ID NO: 157010 - RNA, 84 nt, Homo sapiens
ugcccccauccccacugugaaacacgaccaccuccggacacacgucugauaauaagcagagcaggaauuuacacuaccccaggu

SEQ ID NO: 157011 - RNA, 120 nt, Homo sapiens
gcugucccaaauuagaaggaaaacaugucaugagaaauuaccucagcccauuaaaaaaaaaaaccuaaaaaacacccaccaugcuggucgcaacagaaccaucaugccaaguuccagaca

SEQ ID NO: 157012 - RNA, 52 nt, Homo sapiens
uccuuggguguagacuucuuccucuugggaauacuggugcugccagcggucu

SEQ ID NO: 157013 - RNA, 39 nt, Homo sapiens
uuuucuucuucuuggagcugcucuugccaaccgccucuu

SEQ ID NO: 157014 - RNA, 52 nt, Homo sapiens
ggcugucauugcugccuugccccacccauaggcccuguccauacccauguaa

SEQ ID NO: 157015 - RNA, 43 nt, Homo sapiens
caaggaccacacuccccauacccuucagugcaguguaccaggg

SEQ ID NO: 157016 - RNA, 46 nt, Homo sapiens
gcuguaggugcggacucgagacaugggcggcuacagcaccacaacc

SEQ ID NO: 157017 - RNA, 33 nt, Homo sapiens
gcggcaucuuaaguaggucaugggaggcugucg

SEQ ID NO: 157018 - RNA, 46 nt, Homo sapiens
uggucccuggugagagcuauagugcagaauacgcagucuuugagac

SEQ ID NO: 157019 - RNA, 49 nt, Homo sapiens
ucuggaacaugaggugaggccccagaaacugggggagggcaaggaugaa

SEQ ID NO: 157020 - RNA, 49 nt, Homo sapiens
uuccuggguauaugacucggcacaacaaucuagaccuggugaucauucg

SEQ ID NO: 157021 - RNA, 45 nt, Homo sapiens
cugucccaguggaguuccaggagcaccaccugagugaggugcaga

SEQ ID NO: 157022 - RNA, 37 nt, Homo sapiens
cgccgucaaggagguguucaaggugaguggccucggg

SEQ ID NO: 157023 - RNA, 46 nt, Homo sapiens
gugagaaguuugcgcuguggcagagugugaccugcgggccugugga

SEQ ID NO: 157024 - RNA, 52 nt, Homo sapiens
ccgaagaggugcaggccugggcgcagcgcaaggagcgggaagugcugcagcu

SEQ ID NO: 157025 - RNA, 60 nt, Homo sapiens
gcccccucaggcagccaggucaucugaguaucauuaagaguagugaugggaagauuacag

SEQ ID NO: 157026 - RNA, 45 nt, Homo sapiens
acaggagguggccgcagggcagcugguacaccggcuccuuuuuga

SEQ ID NO: 157027 - RNA, 27 nt, Homo sapiens
ggccacagaaggagagcaggggacuaa

SEQ ID NO: 157028 - RNA, 46 nt, Homo sapiens
cagggauggagugcuggagcaggaaauggucaauccgggccuugag

SEQ ID NO: 157029 - RNA, 39 nt, Homo sapiens
auauauaaauauauauaaauauauaucucuaccauaugu

SEQ ID NO: 157030 - RNA, 40 nt, Homo sapiens
ugccuaggaagaugaugugcugagcaugaaagcagaaaga

SEQ ID NO: 157031 - RNA, 35 nt, Homo sapiens
ccaguccuucuggaggccugggcugcuacuguugg

SEQ ID NO: 157032 - RNA, 44 nt, Homo sapiens
ccugccagaaggagcaggccgacuuccugccccggauagaggaa

SEQ ID NO: 157033 - RNA, 42 nt, Homo sapiens
gcagcugcaggaggaggcggcccggcugaugcggcagcggga

SEQ ID NO: 157034 - RNA, 43 nt, Homo sapiens
guucugagcacugcaggaaacgcaggagggggcugggggucag

SEQ ID NO: 157035 - RNA, 45 nt, Homo sapiens
cucccaccugugggaaacgcaggcccugagagaggcuccgucagu

SEQ ID NO: 157036 - RNA, 39 nt, Homo sapiens
cuucacgguaagcugagcagggucaagguccacagggag

SEQ ID NO: 157037 - RNA, 34 nt, Homo sapiens
gccagggacucagcauuagaacugggcaucuggg

SEQ ID NO: 157038 - RNA, 51 nt, Homo sapiens
agccuacauucuaguaggagagggaagaaacagauguagccaaccacagua

SEQ ID NO: 157039 - RNA, 48 nt, Homo sapiens
cuuuuuuaacugaucaggagcccuaaguagggcugagagccagcgggg

SEQ ID NO: 157040 - RNA, 51 nt, Homo sapiens
aagaccuagauaagaucuuucucuucuuuugcccccacucaaauuagaagu

SEQ ID NO: 157041 - RNA, 44 nt, Homo sapiens
gccuuuaaucuauaacugccuggccacaccaucacuuccccagg

SEQ ID NO: 157042 - RNA, 31 nt, Homo sapiens
cuggggaagugaugguguggccaggcaguua

SEQ ID NO: 157043 - RNA, 42 nt, Homo sapiens
gcggccaguuccucugggguuauguagaugaacuugccccgg

SEQ ID NO: 157044 - RNA, 45 nt, Homo sapiens
augccagggccuggagguggcagcagugggagaggacaggcaggg

SEQ ID NO: 157045 - RNA, 41 nt, Homo sapiens
uaaagauagagucuugaugcaccgucuaccuuguccccaac

SEQ ID NO: 157046 - RNA, 88 nt, Homo sapiens
ggaggagaggaaggcccgcgaggagcaggcccagcgggagcaugaggaguaccugaaacugaaggaggccuuugugguggaggaggaa

SEQ ID NO: 157047 - RNA, 79 nt, Homo sapiens
cggaaacgacucgagucccagcgcgaagcugaguggaagaaggaggaggagcggcuucgccuggaggaggagcagaagg

SEQ ID NO: 157048 - RNA, 42 nt, Homo sapiens
agccgcuccuccuccuucuuccacucagcuucgcgcugggac

SEQ ID NO: 157049 - RNA, 45 nt, Homo sapiens
uugccuucccuagucugucugggcggugggcacacucuagccggg

SEQ ID NO: 157050 - RNA, 81 nt, Homo sapiens
acucaccugucggggaaaauuggagcuaagaaacugcggaagcuggaggagaaacaagcgcgaaaggcccagcgugaggca

SEQ ID NO: 157051 - RNA, 24 nt, Homo sapiens
gcagaugagaacgaggaggaagcu

SEQ ID NO: 157052 - RNA, 45 nt, Homo sapiens
gaggccugccuccagcucucggcuccucaggcuccaggggcccag

SEQ ID NO: 157053 - RNA, 46 nt, Homo sapiens
gccugaggagccgagagcuggaggcaggccucggcgccggagggac

SEQ ID NO: 157054 - RNA, 56 nt, Homo sapiens
ggccccggcugcgagucaggaagaggauaaagccgacuagcagagccgccgcuacc

SEQ ID NO: 157055 - RNA, 45 nt, Homo sapiens
gaugucauggacgcugagcacaggccuugacuggcagacccugcc

SEQ ID NO: 157056 - RNA, 46 nt, Homo sapiens
cugcccuacaugaagaugaucuuuccccucaucaugaucgccauga

SEQ ID NO: 157057 - RNA, 44 nt, Homo sapiens
acugcguaccccccgacacacuacauccggagggugccccagag

SEQ ID NO: 157058 - RNA, 45 nt, Homo sapiens
cgagaacgaaggaacgcagcacagucucccucccugcccacagac

SEQ ID NO: 157059 - RNA, 37 nt, Homo sapiens
cuaagucuaagguagagcugagggcaucaggggaaga

SEQ ID NO: 157060 - RNA, 45 nt, Homo sapiens
cagccaguguuguaauuuaagugaucuagcaccaauuacuguggg

SEQ ID NO: 157061 - RNA, 44 nt, Homo sapiens
gcccuguagcugcuuccauaucaagaaacagaucaagaagagau

SEQ ID NO: 157062 - RNA, 81 nt, Homo sapiens
gaggaggcgguaacauuggauuugagcauguaagguuaaguaggauuuggaaauguggagcuggaaaaaaauuacagaugg

SEQ ID NO: 157063 - RNA, 45 nt, Homo sapiens
cacaguccugcucuuacggagcucacauuucagcuugggaguaaa

SEQ ID NO: 157064 - RNA, 47 nt, Homo sapiens
gaaauggcguaguucacgccuauuuucaugacauuauaggcuuuuag

SEQ ID NO: 157065 - RNA, 30 nt, Homo sapiens
ucugaaaaccugggacacugugguaggcag

SEQ ID NO: 157066 - RNA, 45 nt, Homo sapiens
guaaugagagcuuguagaggugaaauggacaagucuuccguguaa

SEQ ID NO: 157067 - RNA, 79 nt, Homo sapiens
uggcagauguuaaguuuggagucaucgaccuaugagggagauugccagggagcucucucugagaguccacauggaaagc

SEQ ID NO: 157068 - RNA, 29 nt, Homo sapiens
acccuuuaaauuuuuaauuaaguuuucag

SEQ ID NO: 157069 - RNA, 48 nt, Homo sapiens
guggcuagugauggagcaguagggguaaguugggguuggauugucaca

SEQ ID NO: 157070 - RNA, 99 nt, Homo sapiens
agacuguugcaguagacuagacuaggaggaggagaauuugaauuagagcauuggccuuagcaaggggaucaaagagggaaaaagaugagauugguuugu

SEQ ID NO: 157071 - RNA, 355 nt, Homo sapiens
uauacucuuuuuuuuuuugagacagagucucacucugucgcccaggcuggagugcaguggcgcgaucuuggcucacugcaagcucugccuccuggguucacgcuauucuccugccucaaccucccgaguagcugggacuacaggcgcccaccaccacgcccagcuaauuuuuuguaauuuuaguagagacgggguuucacuguguuagccaggauggucucgaucuccugaccucgugauccacccgccuuggccucccaaagugcugggauuacaggcgugagccaccacgcccagccuaugguaugggccucuucauggugugggcugccaugggaagggcaugaccuguagc

SEQ ID NO: 157072 - RNA, 50 nt, Homo sapiens
gacuuaacagagggagagaggguguacccccccguuuucuuuuccuccuu

SEQ ID NO: 157073 - RNA, 335 nt, Homo sapiens
gcaugcucuggauugcuuaucuuuggguuuuuuuuaucuuggugguuaguccauuacuauuuagguuuuucugacaguugcauuaaagccuaaucuuuuuucuacaucuauaucuauauaugauguauaucuauaucuauauagauacauauucuuuuuuaaaaauagauaugaggguguugcuguguuggccagccugaucuugaacucauggccucaagcaguccuccugccucagccuccaaacugcugugauuucaggcaagagccaccaugccugguccacaccuaauuuuaauugauacagauuucuaaucagucaguggcaaggggca

SEQ ID NO: 157074 - RNA, 52 nt, Homo sapiens
aauggauuuuggggaguagggcauggauacaucucuaucaggcaaguacagc

SEQ ID NO: 157075 - RNA, 51 nt, Homo sapiens
uucucgugauggauuauggagucuuaacuagguaugugagaaaaugaaaug

SEQ ID NO: 157076 - RNA, 46 nt, Homo sapiens
auggggccaaagucucauuggaaagggggaauaaacuggagagaug

SEQ ID NO: 157077 - RNA, 53 nt, Homo sapiens
aggcagauccagaagcgagcauguguucagaguggcugauguuaaugaaagag

SEQ ID NO: 157078 - RNA, 67 nt, Homo sapiens
uggaaaaugggaauuuuaggguuuuuuuaucugguugcugagcauaagcagggaggugggacugggu

SEQ ID NO: 157079 - RNA, 50 nt, Homo sapiens
cagaguguaguugggaccauuuauauguuuaugauggggacucaauuuau

SEQ ID NO: 157080 - RNA, 46 nt, Homo sapiens
aauagcagcgauacuguugaaugugaauguucugaaaacuggaaag

SEQ ID NO: 157081 - RNA, 46 nt, Homo sapiens
uguucaguuccuguaccagcuaaccagucauuuuggacucgagagg

SEQ ID NO: 157082 - RNA, 54 nt, Homo sapiens
ucauaagcaaguuuagccaagaauagccacauuguaauguggcugaacaaacau

SEQ ID NO: 157083 - RNA, 46 nt, Homo sapiens
acacccagggugcccuugugcaaggggguuacggccauagcagugu

SEQ ID NO: 157084 - RNA, 46 nt, Homo sapiens
cuuugugcuagacuucuagaaaugugauuucagguucaaaaaguaa

SEQ ID NO: 157085 - RNA, 44 nt, Homo sapiens
ugauaucaagacagacaguuacugaggaugggcgaugaucccug

SEQ ID NO: 157086 - RNA, 46 nt, Homo sapiens
caaugaccauuguguccccaggaaccacagcugcucagaaggccag

SEQ ID NO: 157087 - RNA, 45 nt, Homo sapiens
cauuugguuggaaacucauguuugaaaauuacuacugccaaggag

SEQ ID NO: 157088 - RNA, 90 nt, Homo sapiens
acaaauauuuauugaaugaaucaaagaaucauagcagugaaaaagagagucuauugaaaagaucaaaauagucauugcuucagaaggcag

SEQ ID NO: 157089 - RNA, 38 nt, Homo sapiens
cuuuaauguuaccuauacauuauuaucauuagcugaaa

SEQ ID NO: 157090 - RNA, 46 nt, Homo sapiens
ccaaauaucacuuucuuuguuuaugucaguaauuucaccuggccca

SEQ ID NO: 157091 - RNA, 22 nt, Homo sapiens
gacauggcucggccaggauuca

SEQ ID NO: 157092 - RNA, 27 nt, Homo sapiens
agacuggaaacccucaaagcaucugac

SEQ ID NO: 157093 - RNA, 39 nt, Homo sapiens
gcugaugguugcuggaggaggccaguguagagccaguga

SEQ ID NO: 157094 - RNA, 54 nt, Homo sapiens
ucccucucucacacauacacacacaaacacauacacacaacacuaagugccuag

SEQ ID NO: 157095 - RNA, 57 nt, Homo sapiens
uuggcaaucugcuuuuuuucuaaaaucugauuugcagccaggaaagaauuuucucac

SEQ ID NO: 157096 - RNA, 32 nt, Homo sapiens
aagaccagacguucuagaaaagaccccuccuc

SEQ ID NO: 157097 - RNA, 50 nt, Homo sapiens
cagcagaaggaaaguacuggacuacccguggguaaguccugccauucaag

SEQ ID NO: 157098 - RNA, 50 nt, Homo sapiens
aaacaaaaguaaauacuauaauacaaacuuccuucugaaauaaaaguaga

SEQ ID NO: 157099 - RNA, 92 nt, Homo sapiens
ggauaaaaucaugugacccucaggaagagaaugcccaaggagcuaagaaaagggaggacagguccuggggaaaagcccuccacuccaacaag

SEQ ID NO: 157100 - RNA, 25 nt, Homo sapiens
gcugaaagcacaaagacgcagcucu

SEQ ID NO: 157101 - RNA, 45 nt, Homo sapiens
uccacucauucaccgcuaaagaugaucuaaauuggugcagcccuu

SEQ ID NO: 157102 - RNA, 46 nt, Homo sapiens
accucagguuucauagacgucuuuguacacuaaaaauucugcagca

SEQ ID NO: 157103 - RNA, 44 nt, Homo sapiens
caaauggccaggugaggucaucaaaugcaugcauuugguaguau

SEQ ID NO: 157104 - RNA, 76 nt, Homo sapiens
cugugcccaucacuucuugcugggauuccaagccaccaauuggagagcuuuauuugucauuuugagacauauuuau

SEQ ID NO: 157105 - RNA, 92 nt, Homo sapiens
gccugcuguauuuauccaugggcccgcuguccgccacccaggcuccuccgugcacaccccaucaccuggccccuaccccuuauuacuucccc

SEQ ID NO: 157106 - RNA, 65 nt, Homo sapiens
ggaaaaagucagugggaccagggcuccucaguggacaaauuucuccuucuuacugccaacuggag

SEQ ID NO: 157107 - RNA, 54 nt, Homo sapiens
augugggccaggcuggcccagccaacaagccagagaguggcuuuucuugcugac

SEQ ID NO: 157108 - RNA, 48 nt, Homo sapiens
auaaguaacccuugaaaaucauccagccaaagguuguugcagggaugg

SEQ ID NO: 157109 - RNA, 46 nt, Homo sapiens
uuauagauucccaaaucccaucgcuaggcacucucugacuggcuug

SEQ ID NO: 157110 - RNA, 43 nt, Homo sapiens
gugcuauccugauaagcguuaaguguuauaucauuuuuuuuca

SEQ ID NO: 157111 - RNA, 44 nt, Homo sapiens
ggcagccccauggugguggcuggggacagccucauggugguggc

SEQ ID NO: 157112 - RNA, 45 nt, Homo sapiens
gggccuuggcggcuacaugcugggaagugccaugagcaggcccau

SEQ ID NO: 157113 - RNA, 51 nt, Homo sapiens
caccguuaccccaaccaaguguacuacaggcccauggaugaguacagcaac

SEQ ID NO: 157114 - RNA, 47 nt, Homo sapiens
agauguguaucacccaguacgagagggaaucucaggccuauuaccag

SEQ ID NO: 157115 - RNA, 45 nt, Homo sapiens
ccuuuuagugguggugucucacucuuucuucucucuuugucccgg

SEQ ID NO: 157116 - RNA, 67 nt, Homo sapiens
auugaguucaucaugagccguugcuaaugccaggccaguaaaaguauaacagcaaauaaccauuggu

SEQ ID NO: 157117 - RNA, 99 nt, Homo sapiens
uugccuucuagacacugaaggcaaaucuccuuuguccauuuaccuggaaaccagaaugauuuugacauacaggagagcugcaguugugaaagcaccauc

SEQ ID NO: 157118 - RNA, 45 nt, Homo sapiens
ucaaguucauaguuucuguaauuggcuuuugaaucaaagaauagg

SEQ ID NO: 157119 - RNA, 47 nt, Homo sapiens
gucagugaggccucuuugcaggcuucuagagaugacuggaugugcuu

SEQ ID NO: 157120 - RNA, 33 nt, Homo sapiens
uuuuuuuuuaauauaaggagcaauguggcauca

SEQ ID NO: 157121 - RNA, 43 nt, Homo sapiens
aucugagcacaguuaagguggagccuacaucucaggcuggaag

SEQ ID NO: 157122 - RNA, 84 nt, Homo sapiens
gucucaucuucaguaauacggaugccaugggaguggccaggccagauugaaggugaauauggagcaguagcagaagccucauuc

SEQ ID NO: 157123 - RNA, 133 nt, Homo sapiens
cacacacacacacacacacacaccauuuuaggaagugguucuccuacuggaaaauaugcuacagaaugaaaguuuguaauugaaagaaaaagaauguauucaucugcuucuuggguuuaagcacacaccugaa

SEQ ID NO: 157124 - RNA, 46 nt, Homo sapiens
cucuugguuugguuugaaguuuuucagugaaggaaaaggccugaga

SEQ ID NO: 157125 - RNA, 45 nt, Homo sapiens
guggguugccaugucgcacguccguuagaucuugauuuuacaggu

SEQ ID NO: 157126 - RNA, 67 nt, Homo sapiens
gggaaaaggaaaggacccugaagccaauaucugauucucggcugcaccuucucuuggccacccuggc

SEQ ID NO: 157127 - RNA, 81 nt, Homo sapiens
gcggagaccuccucugaccaaggggcacuaguaugccuugcgcuaucaugacugacuggcccaguaugauucuguugucgc

SEQ ID NO: 157128 - RNA, 47 nt, Homo sapiens
cccuuccaccacccagggcuggcuuuccuauaagccaccuccagggu

SEQ ID NO: 157129 - RNA, 28 nt, Homo sapiens
ggcuacacauggaaaggccucaggaaga

SEQ ID NO: 157130 - RNA, 47 nt, Homo sapiens
ggaugugugacaggcacuccagaggaaagaggaauccggaaauggaa

SEQ ID NO: 157131 - RNA, 46 nt, Homo sapiens
uuguagggggcuguguggcuuuuauccuggauaacaccaucccagg

SEQ ID NO: 157132 - RNA, 71 nt, Homo sapiens
cccucuccuuugggagaaugccucucucuaaaugcuuuugauuucauuagucuaucuuaauagacuaaugc

SEQ ID NO: 157133 - RNA, 36 nt, Homo sapiens
cacuugggauacaucagugaauuaaaaaguggaguu

SEQ ID NO: 157134 - RNA, 68 nt, Homo sapiens
augaauugaacacuaugucaauuuugccauagaagcuucgaguguuauuuuauaacagagacauaaca

SEQ ID NO: 157135 - RNA, 88 nt, Homo sapiens
ggguuuucuuauucuauuuaggaaaagcuguccuaaggcauuuacaucagaauuucauuucaguaucaagaaaugcuaggcaaauuag

SEQ ID NO: 157136 - RNA, 54 nt, Homo sapiens
cucuugagggggaaacaaaacccaauguagacaaacuucuggcaaagcuaagca

SEQ ID NO: 157137 - RNA, 44 nt, Homo sapiens
cuuuauuugcuucgugcuggggaauaguugaaggguuuuugacc

SEQ ID NO: 157138 - RNA, 58 nt, Homo sapiens
accaaaugcucacccugaaaggugcccaggucggaugccaaggucagguucaggcuga

SEQ ID NO: 157139 - RNA, 78 nt, Homo sapiens
cgccucaagguugagaugggcaggacagcuuguggggagugcaccagcacagacagcagcagcccgaggaagggagca

SEQ ID NO: 157140 - RNA, 47 nt, Homo sapiens
aggcaugguugauuuaggguaaacauuguugccaaaauuacugugua

SEQ ID NO: 157141 - RNA, 39 nt, Homo sapiens
ccaguuguuccuaaaauaccuuuccccauuauucccucu

SEQ ID NO: 157142 - RNA, 108 nt, Homo sapiens
uggggcgcaauggugacaucgaagcacauggcuugcagcacgaagggcagcgccaucagggagacacagugcauccuccaggggacuuggugggagcccuggaggagg

SEQ ID NO: 157143 - RNA, 37 nt, Homo sapiens
ccagcugucucuugcucugucagagacaggcugagua

SEQ ID NO: 157144 - RNA, 44 nt, Homo sapiens
cgcagugcccuuccuguuggccgaugccaugugugugggguacg

SEQ ID NO: 157145 - RNA, 40 nt, Homo sapiens
augugggcuauuuuuuaacgacaauaagagagaagaauua

SEQ ID NO: 157146 - RNA, 45 nt, Homo sapiens
ucgcugagacccuggauagcacuggcagucuggacccccagcgau

SEQ ID NO: 157147 - RNA, 90 nt, Homo sapiens
gaucuggauccggaucccuuucagacacuugcauguccuucgucuggggcuuggucucugacucccaaggggcuguguucucuucauaag

SEQ ID NO: 157148 - RNA, 74 nt, Homo sapiens
aggcgccaccuccagcggugagcaggacaaugaggacacugagcucauggcgaucuacacuacggaaaacggca

SEQ ID NO: 157149 - RNA, 45 nt, Homo sapiens
auuauauccaccaucaccuccuccauaacuaccucugcugccacc

SEQ ID NO: 157150 - RNA, 38 nt, Homo sapiens
gggauuaacuccaggaaggaaguaugcauugcuguuaa

SEQ ID NO: 157151 - RNA, 83 nt, Homo sapiens
ucuuccgguaaucauauuccccaucuuccuuucuuaaaucucuugaaaguaguuuccguauggaaucaacauaggauuggcuu

SEQ ID NO: 157152 - RNA, 62 nt, Homo sapiens
gaggcuggaaguucaacagaaggcaaauacgaagacgaggcaaagcacccagcuuucuucac

SEQ ID NO: 157153 - RNA, 28 nt, Homo sapiens
cugaugauuaauacauuuuaaauagugu

SEQ ID NO: 157154 - RNA, 49 nt, Homo sapiens
uguuugugucugugugcauuugggucugcguguaucuguuuccauguga

SEQ ID NO: 157155 - RNA, 46 nt, Homo sapiens
ccauggagaaaccugcuacagauugauguuaaggaaaccauaauag

SEQ ID NO: 157156 - RNA, 45 nt, Homo sapiens
uuuugagcuuugaaaacaauugucuuugggcccugauuggggaaa

SEQ ID NO: 157157 - RNA, 52 nt, Homo sapiens
gcuggaugccacguugaacuggaccccagcagucagcucuccaaugugacag

SEQ ID NO: 157158 - RNA, 57 nt, Homo sapiens
cuauguaaacacugauggugauuacagagcuuacauaagaagguaaggaaggaagau

SEQ ID NO: 157159 - RNA, 47 nt, Homo sapiens
ucguauaaaaauguuguguugcuuaugguuugaucaguagcaaagag

SEQ ID NO: 157160 - RNA, 48 nt, Homo sapiens
gacauaaaauaggauuuucagcuuaguugaaggucaacagugcuuguu

SEQ ID NO: 157161 - RNA, 37 nt, Homo sapiens
aguaguauuaaauuggagacuuuugcaucauacuuag

SEQ ID NO: 157162 - RNA, 31 nt, Homo sapiens
uauguguguaacucuuacagagaugaauccc

SEQ ID NO: 157163 - RNA, 44 nt, Homo sapiens
guggcagaugucagcucccaugauggcgucuccugcucggccag

SEQ ID NO: 157164 - RNA, 30 nt, Homo sapiens
agaccuuaguaaaaucaaagaucagugagu

SEQ ID NO: 157165 - RNA, 38 nt, Homo sapiens
gaaucuuaaccuugaauugaauuuguucauaaggcagg

SEQ ID NO: 157166 - RNA, 57 nt, Homo sapiens
guuaaugucaggggacguacuuuaaaaaaaagucuaauugcaaguuagaugugguua

SEQ ID NO: 157167 - RNA, 67 nt, Homo sapiens
acgcccauggccagguugcggucgcagcgguaggugucgaagcccucagaccgcagggugagcugca

SEQ ID NO: 157168 - RNA, 82 nt, Homo sapiens
gcucugcagguuuacaccgcuggagcuaauaucccagcaggccucguugaugagguccuugagugccuccaacaccuucuug

SEQ ID NO: 157169 - RNA, 54 nt, Homo sapiens
acgccgcuacaggcaggcgggaaggaggaaagucuagcugguuucggcuucagg

SEQ ID NO: 157170 - RNA, 79 nt, Homo sapiens
guagcucuguuuaagggugagaucaugcuugauguuagugggacuuuguggaccuagaaggugugaggagagagagaag

SEQ ID NO: 157171 - RNA, 271 nt, Homo sapiens
uuaucaucuuuaaaaaauguuaaauugcucuccuugguuguuaggacuagaagggacuuuaaagguguuuuuuauuuuuaggaacagggucucaccuuguugcccaggcuggaguguaguggcacagucauagcucacuacagcuuuaaacuccugagcucaagccauccuccuaccucagucuccugaguagcucaggacuacaggccugagccauggcacccggcuugagguaguuauuuuauagaagaggaugccacagcucagagag

SEQ ID NO: 157172 - RNA, 50 nt, Homo sapiens
auauaaaucuuucaaaauguuaaauguuaaaaaggucucagaguaaaugu

SEQ ID NO: 157173 - RNA, 49 nt, Homo sapiens
cagggcagauaaucauccuuuaaacuguuugaaaagauuugaguguuac

SEQ ID NO: 157174 - RNA, 49 nt, Homo sapiens
ugguucagaaaagagacggacacugacucuucacuauuaauuuugccaa

SEQ ID NO: 157175 - RNA, 58 nt, Homo sapiens
gggguaauagugaggcacccccuccccacccccacguaugguccccaccgggcagcuu

SEQ ID NO: 157176 - RNA, 77 nt, Homo sapiens
guagggauggcauugagcccacuaaguugacugaccuuuugaagaaaguuaaacuuuaugguguuauuuugaguagg

SEQ ID NO: 157177 - RNA, 48 nt, Homo sapiens
ggucuccauagggccagcuuggggcuucucuguaaagacuuugcugag

SEQ ID NO: 157178 - RNA, 24 nt, Homo sapiens
uguugagccugccuagaugguugu

SEQ ID NO: 157179 - RNA, 65 nt, Homo sapiens
gcuuccuuuuccgggguaugagcaacugugucuccaagcagaaugccuuuguccacggggugggg

SEQ ID NO: 157180 - RNA, 21 nt, Homo sapiens
uagcaggcucagggauaaccu

SEQ ID NO: 157181 - RNA, 36 nt, Homo sapiens
ugacuuugaauacuugagacuuuucaaguauucaga

SEQ ID NO: 157182 - RNA, 63 nt, Homo sapiens
gauaaucacauauuacuugcuauagaaauaaaugcaggggaggcagaugucauguuaggucau

SEQ ID NO: 157183 - RNA, 51 nt, Homo sapiens
auaaaauggcauuugagcaaggagugaagaaauggagaagcaaagagaaug

SEQ ID NO: 157184 - RNA, 86 nt, Homo sapiens
ggaugaggcguguuuuugaaggucauaugguucaaggaucccucaguuagguaugggaaugcuacaaaaggggcaaaaacggaguc

SEQ ID NO: 157185 - RNA, 44 nt, Homo sapiens
gcauguuuguacugagucuggucaagaagcauuaucgacugcag

SEQ ID NO: 157186 - RNA, 49 nt, Homo sapiens
agaauguaaguaagcucugcuuuauaagauggguucaccuucaucgcag

SEQ ID NO: 157187 - RNA, 73 nt, Homo sapiens
cauacgaguuggggaccagaaaucugggcucagagaacccguccagggagauuugaagccauggguuaucuuc

SEQ ID NO: 157188 - RNA, 43 nt, Homo sapiens
uuugaaaugcugagguuuuauuuuaauaguugacaaccuggga

SEQ ID NO: 157189 - RNA, 46 nt, Homo sapiens
acaaaacugcgggagaggggaggggucaucaaccucaggcugucug

SEQ ID NO: 157190 - RNA, 46 nt, Homo sapiens
uggacuuuguggccccuucaaggccguuuguggucuacugucagua

SEQ ID NO: 157191 - RNA, 73 nt, Homo sapiens
ccagagagcaaccacccagaagaccaggaaacaauggaaacaauuucucaagauccagaacauaaggggccua

SEQ ID NO: 157192 - RNA, 48 nt, Homo sapiens
gguccaaaaauguaaacucauggaaagccaaauugaauuacuucaggg

SEQ ID NO: 157193 - RNA, 46 nt, Homo sapiens
auaguucagcaguuaauugaaaauaguacaacauuccgagacaaga

SEQ ID NO: 157194 - RNA, 48 nt, Homo sapiens
cuuacucaagaugacauaaaagcuuugaaggacaagggcauuaaagga

SEQ ID NO: 157195 - RNA, 42 nt, Homo sapiens
cgcauccgcgacggcgacuucguggugcugaaacgugaagau

SEQ ID NO: 157196 - RNA, 49 nt, Homo sapiens
gguacccaacuguuucuuuuuacucuuucuccaguccuacuucuuaacg

SEQ ID NO: 157197 - RNA, 58 nt, Homo sapiens
ugggaggcugaaaguuuuaucucuguacugucgacaaacaacuuugaucuugaucggu

SEQ ID NO: 157198 - RNA, 71 nt, Homo sapiens
uagacguguauuuuauaagaacaguuuuggauuuacagaaaaacugcacaaaaaauggaugugacacugca

SEQ ID NO: 157199 - RNA, 87 nt, Homo sapiens
uaugguauaccuuaaaaagcgauagagauuagaaacuuaacugcagaauauuugggucuuguaucauagcuguacaacuuugcaagc

SEQ ID NO: 157200 - RNA, 84 nt, Homo sapiens
aauggagaguauagaggcagaggauuuggacgaggaagauuucaaagcuggaaaaggggaagagguggugggaacuucucagga

SEQ ID NO: 157201 - RNA, 35 nt, Homo sapiens
uguucaauuuuuuucacuuaaggaagcaauucacg

SEQ ID NO: 157202 - RNA, 82 nt, Homo sapiens
aacaaaccccacaguuuuugcuuucaacaaagaccccacagucaaugcagucaacauuggaucgauucauaccauauaaagg

SEQ ID NO: 157203 - RNA, 66 nt, Homo sapiens
cacccaaacaauuaaaugauguuuauguuucaaaagcauuuuagacuuuauaucagucaggaaagc

SEQ ID NO: 157204 - RNA, 86 nt, Homo sapiens
uaacuccccagaaaguaguaauucaggaagcagcaaccauccuuauggcuaagagacuaaaagaaguucugagguuaccagaaugu

SEQ ID NO: 157205 - RNA, 62 nt, Homo sapiens
uugauugagaagauucaagcauuugaaaaauuuuucacaaggcauauugauuuguaugacaa

SEQ ID NO: 157206 - RNA, 50 nt, Homo sapiens
aggagaaaaugagagagacugaauaauagauauaucuaagagagguaaag

SEQ ID NO: 157207 - RNA, 45 nt, Homo sapiens
gauacuccaaaugagcaucaugaucacuuacucucugaacaugug

SEQ ID NO: 157208 - RNA, 42 nt, Homo sapiens
aaauaggcaaaagagucuauguguguguaaagucuuguaagc

SEQ ID NO: 157209 - RNA, 46 nt, Homo sapiens
accaaaccaguccacaagcacagggagaugcgugggcugacaucug

SEQ ID NO: 157210 - RNA, 61 nt, Homo sapiens
uggcuuggcacacucacgagucuagguaagaccgaccgaagcucaaacguuugggauaaug

SEQ ID NO: 157211 - RNA, 27 nt, Homo sapiens
cuuacgucuuacuagauguguuuuuuu

SEQ ID NO: 157212 - RNA, 71 nt, Homo sapiens
auuauaaaauguauacugcaguuguuuuggcaaggaaaaaaugaguuagaauccugauuuuacccuccaga

SEQ ID NO: 157213 - RNA, 45 nt, Homo sapiens
cuacuuccccuggauuuggcucuucugaagauuugaaagucccag

SEQ ID NO: 157214 - RNA, 51 nt, Homo sapiens
cuggacaguaacaaaacauauaaagcccgagcccaaaccccgccaccauca

SEQ ID NO: 157215 - RNA, 51 nt, Homo sapiens
uguuagauuuucucucccuuaugguguuacuuaaaauaaucgggauuuuga

SEQ ID NO: 157216 - RNA, 190 nt, Homo sapiens
gagccugugcuuuucucucuuuuuuuuuuuucuuucuguagagaugaggucuugcuguguugccuaguuuggucucgaacuccugagcucaagugagucucccacuuuggccucccaaagugcugggauuauaggugugagccaccaugccuggccagggccuguccuuuuauuugcaagcagugcuuaa

SEQ ID NO: 157217 - RNA, 52 nt, Homo sapiens
gugagggauagugggaagggagaagagaagaacugaugaugagugcaagauc

SEQ ID NO: 157218 - RNA, 55 nt, Homo sapiens
acccccuucccuucuuuacuuuagguauugauguccuccauuuacaucucugugg

SEQ ID NO: 157219 - RNA, 56 nt, Homo sapiens
aaugagcacuuacaguuuguagagaggccucgggggcauccaagagguagcuggaa

SEQ ID NO: 157220 - RNA, 78 nt, Homo sapiens
gguaauacauaaaugaagaauuccucaugaauguugcaaaaaugcaaauuaauuuuaauuacauauuacaauuuaauu

SEQ ID NO: 157221 - RNA, 48 nt, Homo sapiens
aaaaggagucuaugauaaugauggaguucaggccaugcgaccccaaag

SEQ ID NO: 157222 - RNA, 68 nt, Homo sapiens
ccugaauuccugacaaagaacagagaaugcacacagggagagugcacucagaaaugaagguagaaaug

SEQ ID NO: 157223 - RNA, 47 nt, Homo sapiens
caaauuugcaaauagaggaaauauagacaggaaaggccaucaguuca

SEQ ID NO: 157224 - RNA, 46 nt, Homo sapiens
aucaacuuacauuaaacguucaacccuagcaaagauuucuuagaac

SEQ ID NO: 157225 - RNA, 44 nt, Homo sapiens
auuuugauuccuucuucugucuuagaaaguacauauaauagagu

SEQ ID NO: 157226 - RNA, 36 nt, Homo sapiens
gauuccuuuucagauggcuaagauucuuucagggaa

SEQ ID NO: 157227 - RNA, 87 nt, Homo sapiens
auuuugugugugguggggcggugagaacacuuaaauucuacucucugggcaaaucucaagugaagcugcaauuuuaaaucagguggc

SEQ ID NO: 157228 - RNA, 43 nt, Homo sapiens
ugaggauaugcgauuugaacuaaaacccggaagaugugaagaa

SEQ ID NO: 157229 - RNA, 26 nt, Homo sapiens
guguggagaccacagugguuuucuuc

SEQ ID NO: 157230 - RNA, 42 nt, Homo sapiens
uggucagauuaugcugaaguuaaaguucuuguagcacggaag

SEQ ID NO: 157231 - RNA, 35 nt, Homo sapiens
cugcaccuauccuccccuuuggagccagugguccu

SEQ ID NO: 157232 - RNA, 59 nt, Homo sapiens
ugucuccuuauguaccaggccaacagaggagggccuagacuugucagccccagccugaa

SEQ ID NO: 157233 - RNA, 34 nt, Homo sapiens
cacaugccacagugcccagcugcugccccucccu

SEQ ID NO: 157234 - RNA, 68 nt, Homo sapiens
cauaggaucucaacaagcauggaagcagcgaggcaaguuguaauguaagccaaggaugaaaacgucag

SEQ ID NO: 157235 - RNA, 21 nt, Homo sapiens
ucucacaauggucagucagga

SEQ ID NO: 157236 - RNA, 46 nt, Homo sapiens
uggccuuggccagcaaacccagagagugcccauggucauugaucag

SEQ ID NO: 157237 - RNA, 34 nt, Homo sapiens
gaaaaucacuugcccuuaaauugaugugggguga

SEQ ID NO: 157238 - RNA, 48 nt, Homo sapiens
aggcugaguaaacuuaggaaggcuguaguacuauauaguauucuaaug

SEQ ID NO: 157239 - RNA, 32 nt, Homo sapiens
cugacucuugagagugguccugcccuugcccu

SEQ ID NO: 157240 - RNA, 46 nt, Homo sapiens
aaaaggacuuuuggauccuuugccaaauugcuguuuagcuuuagag

SEQ ID NO: 157241 - RNA, 46 nt, Homo sapiens
uuuccucaagagagggauacgccuucgcugcaucaggagcacacag

SEQ ID NO: 157242 - RNA, 42 nt, Homo sapiens
auaaacugagguccguguguauguauuuuaacuaggacccua

SEQ ID NO: 157243 - RNA, 46 nt, Homo sapiens
aggaugaagauguccucuguugguuaguuucucuagacuaagaugg

SEQ ID NO: 157244 - RNA, 70 nt, Homo sapiens
cugggacucgugugccaggagccucagccugauucgaucaacucuggguguaucauucucagcagaugug

SEQ ID NO: 157245 - RNA, 44 nt, Homo sapiens
aaacauucaucuguucagccuuccccuugguucuguacugggac

SEQ ID NO: 157246 - RNA, 81 nt, Homo sapiens
gcagcucugcggaagacuucgaccaccacgggagaguuucucuuggaagugaucgauuagucccgagagaaauaauagugg

SEQ ID NO: 157247 - RNA, 46 nt, Homo sapiens
uugccagcuucagaguugucagauccaggguuacuuuugaaacaag

SEQ ID NO: 157248 - RNA, 46 nt, Homo sapiens
gcaaaccggcuuagccacaaacacugaaagauuaucuacaauucag

SEQ ID NO: 157249 - RNA, 58 nt, Homo sapiens
auaugcuuguucuaacagcguugcuucuuuaucauuguauuuuaugacugucuucaga

SEQ ID NO: 157250 - RNA, 99 nt, Homo sapiens
ucagaucccaauuucaagaaaacaaaagcuauggaaaaaauccuugaggagaaggcccggcaaagagaacggaaagaacaagaacuuacucaggcaaua

SEQ ID NO: 157251 - RNA, 62 nt, Homo sapiens
auguggaagaacugacccugaguaagaugggggaaauuugggaaauuuuaaauuuguucaaa

SEQ ID NO: 157252 - RNA, 46 nt, Homo sapiens
aggguggaugaaaucauuguuucuuugguugagcaccaggugaaau

SEQ ID NO: 157253 - RNA, 45 nt, Homo sapiens
uggaugaggacgaggacaguaagaaacacuucaauuacaacaaga

SEQ ID NO: 157254 - RNA, 46 nt, Homo sapiens
guaggcaaagaaggcuucucugagaugauggcauuagagcugagac

SEQ ID NO: 157255 - RNA, 351 nt, Homo sapiens
ucuucccuagaacuccuuuucaaacucaguaggcaguaaaauaucuuuuuuuuuuuuuuuuuuuuuuugagaccgagucucgcucugucgcccaggcuggaguccaguggccugaucucggcucacugcaagcuccaccucccggguucacaccauucuccugccucagccucccgaguagcugggacuacaggcgcccgccaccacacccggcuaauuuuguuguauuuuuaguagaggcgggguuucaccauguuagccaggauagucucaaucuccugaccucaugauccucccgccucggccucccaaagugaguaaaauaucuuauaaaugaaauaacuccacaag

SEQ ID NO: 157256 - RNA, 47 nt, Homo sapiens
aggaaaggauaaacugaccccuugggaacaauuuuuagagaagaaga

SEQ ID NO: 157257 - RNA, 49 nt, Homo sapiens
ucucuuuuuuuaaugaauuuugugucaucuaaauauuuaaagauccacc

SEQ ID NO: 157258 - RNA, 61 nt, Homo sapiens
ugaucuaaaccauucauuuugcagauaaggaaccagaggcccaaaguuuuagauuuuauuc

SEQ ID NO: 157259 - RNA, 47 nt, Homo sapiens
uuuuauauauuuuuacuuuuaccaaauguuuugagggggggaaauca

SEQ ID NO: 157260 - RNA, 54 nt, Homo sapiens
guggcaguggugguggcugguuagauuuuaaaagcuacuuuuggaauugagugu

SEQ ID NO: 157261 - RNA, 28 nt, Homo sapiens
ggcagauugugauagugaggcugugaau

SEQ ID NO: 157262 - RNA, 36 nt, Homo sapiens
ucauaggauaguuucccagaaauagaguuacuaaga

SEQ ID NO: 157263 - RNA, 48 nt, Homo sapiens
aaccugugguucucucacaagcuguuaaaacuaccagugucaaaaccu

SEQ ID NO: 157264 - RNA, 75 nt, Homo sapiens
cucuugcagguuauucaagaaaaagaaaagaaaggcaaagaaaaugauauggaaauggaaauuaaauggguucca

SEQ ID NO: 157265 - RNA, 45 nt, Homo sapiens
uauaaguaugcuuaauaaguuuuucccacuuuaggacgucuagag

SEQ ID NO: 157266 - RNA, 103 nt, Homo sapiens
ucguugcucugaauuaguacguuuugcuuuuuuuuuugagacaucauugaagcucuguuugccuucaaauuauauaauuuuuucuuauuugagaaucaaauag

SEQ ID NO: 157267 - RNA, 42 nt, Homo sapiens
augauaaaagugacaguggcccugaucuugcaagggguaaag

SEQ ID NO: 157268 - RNA, 46 nt, Homo sapiens
caaguguugguagagcuucaggugaugacgauggaagugaagauga

SEQ ID NO: 157269 - RNA, 59 nt, Homo sapiens
agacagacaugaaaauuugaaucuugaaguuaaacagugauuuugauuaguggugagcc

SEQ ID NO: 157270 - RNA, 39 nt, Homo sapiens
augaaauuagacuuguuaccucuauuuuauguacacuua

SEQ ID NO: 157271 - RNA, 73 nt, Homo sapiens
gcggaggauugugggugugagccccacgugaggcuugguaggacugcggacggugaguggggauggacuggag

SEQ ID NO: 157272 - RNA, 67 nt, Homo sapiens
gagauuguuaacauuaaucucaugugggacaagaagacugggaaauccaaaggauucuguuuccucu

SEQ ID NO: 157273 - RNA, 58 nt, Homo sapiens
gcuaugaagaccagaggagcacaauucuggccauugacaauuuuaaugggaucaagau

SEQ ID NO: 157274 - RNA, 39 nt, Homo sapiens
uuuguugguuuuucaucuucagagcucucagacaaacuu

SEQ ID NO: 157275 - RNA, 42 nt, Homo sapiens
gagagcucugaagaugaaaaaccaacaaaaaagcgcaaaaaa

SEQ ID NO: 157276 - RNA, 55 nt, Homo sapiens
acagcagcaagaacuaggagagagcucagaagucagugcccagggaggggcggaa

SEQ ID NO: 157277 - RNA, 34 nt, Homo sapiens
cagguccucaagcaggagggaggcaagagaagaa

SEQ ID NO: 157278 - RNA, 55 nt, Homo sapiens
cuggaagaaaaaaaauuuaaaugauuacauuuuaggcuccugaauuuuauaacag

SEQ ID NO: 157279 - RNA, 33 nt, Homo sapiens
cuuaauguuuucacacacacacacacacacaca

SEQ ID NO: 157280 - RNA, 39 nt, Homo sapiens
caacucucagagcgucaggaaggcugaggaagaggggug

SEQ ID NO: 157281 - RNA, 58 nt, Homo sapiens
ggcccugugggaggaagaaaaggcccuguggguagaggaaagagcccuccuugagggg

SEQ ID NO: 157282 - RNA, 76 nt, Homo sapiens
agaagcagaacucagacaugcaggcugagcuccaaaagaagcagguauggcugcugguuauaggugaccuuggagc

SEQ ID NO: 157283 - RNA, 46 nt, Homo sapiens
ugaauaucucuccucccguacccgaucccaggcagguaugaauggg

SEQ ID NO: 157284 - RNA, 44 nt, Homo sapiens
guuccuccccaggcaccuaauuauauguuaggacaaaaacuaug

SEQ ID NO: 157285 - RNA, 47 nt, Homo sapiens
ggaaggacuuagguuguaaaguuauuuucacagucucauagcugaag

SEQ ID NO: 157286 - RNA, 37 nt, Homo sapiens
ggacagagggaacaugauauucauagacuaagaggag

SEQ ID NO: 157287 - RNA, 49 nt, Homo sapiens
ucuagaaaugcggucuggucucgccucgccuaccaaucucugcucucua

SEQ ID NO: 157288 - RNA, 32 nt, Homo sapiens
gccuggguugccucagcaacaaagucugcggu

SEQ ID NO: 157289 - RNA, 39 nt, Homo sapiens
gaguuuuuugagccugccauucucaguagcagcuuuggu

SEQ ID NO: 157290 - RNA, 47 nt, Homo sapiens
uuaccucaguuguccaguguuuucccacaugguaccugacgcccgcu

SEQ ID NO: 157291 - RNA, 42 nt, Homo sapiens
ucccuguugauauccagaguaucggagaagucacacaaggug

SEQ ID NO: 157292 - RNA, 45 nt, Homo sapiens
cagcagaaggaauaaaaucccuuaaaaaugggaaacaugcccauc

SEQ ID NO: 157293 - RNA, 40 nt, Homo sapiens
aaugaaaacuugccucguuuguauuagauauucuacuaag

SEQ ID NO: 157294 - RNA, 40 nt, Homo sapiens
uuuuucucaaagaauguucaaaaccaaguuaaaugagugg

SEQ ID NO: 157295 - RNA, 69 nt, Homo sapiens
auuaaugaagagggagcaucaccugaacacugcauucauucugcacuguauugguagcagcaagccaga

SEQ ID NO: 157296 - RNA, 39 nt, Homo sapiens
cuguaucucgaagcaauaauucagaaccaccgcgaagua

SEQ ID NO: 157297 - RNA, 87 nt, Homo sapiens
aaugcaaguauugaaguuuaauuugcaggagaaaacacaguaaguuuucuuucaccugaaguuguuggauaauagagucccaacugg

SEQ ID NO: 157298 - RNA, 50 nt, Homo sapiens
ugacuuuaaugaccaaaauauaauuuauuauuaguuacaaguuaacugau

SEQ ID NO: 157299 - RNA, 46 nt, Homo sapiens
auuuuagcacuugucuguuguguggugaagcagagaugcuaauccu

SEQ ID NO: 157300 - RNA, 42 nt, Homo sapiens
guucaucauuuagccaugcggaaacaggcccagaggagucac

SEQ ID NO: 157301 - RNA, 51 nt, Homo sapiens
cauuuugguuucauguuuaagucugaaguuuuugcuuucugaucuacagau

SEQ ID NO: 157302 - RNA, 44 nt, Homo sapiens
guuaaauaacuugccugaggccacacaguuuugugaaugguaac

SEQ ID NO: 157303 - RNA, 46 nt, Homo sapiens
accaggaggugaagcugcuuggagcuguccucuugggucaccugga

SEQ ID NO: 157304 - RNA, 38 nt, Homo sapiens
cccccgcaguaaucagauugggguccacagcacccaga

SEQ ID NO: 157305 - RNA, 50 nt, Homo sapiens
cgacuuucagcggaaaagagccuuugguaaaccuggaaccaucaagaaac

SEQ ID NO: 157306 - RNA, 59 nt, Homo sapiens
guuuccucauggcugugaugcagagugcagcccagagccucaaggcgucccacagaggg

SEQ ID NO: 157307 - RNA, 56 nt, Homo sapiens
auaggucuauauauauauaggucuauauauauauagguguguauguauauauauau

SEQ ID NO: 157308 - RNA, 45 nt, Homo sapiens
ggucuauauauauauaggucuauauauauauauaggucuauauau

SEQ ID NO: 157309 - RNA, 27 nt, Homo sapiens
cacaaaaaugaaaugcuacaauguuua

SEQ ID NO: 157310 - RNA, 46 nt, Homo sapiens
acacauuugauaaaaucaccuugccuggaaugccccacuggcugcu

SEQ ID NO: 157311 - RNA, 30 nt, Homo sapiens
uguuggacaggacugagcccgguuccagau

SEQ ID NO: 157312 - RNA, 68 nt, Homo sapiens
gaccuagaacugaauuacugcaagguaagauguuaaaacauaucagauaguagcagcaccacaaagaa

SEQ ID NO: 157313 - RNA, 113 nt, Homo sapiens
gugggaccugcuagauuuguggggguguggagagaaugagaagaauagaacgguggucucuuggugguaugagaacagaaucgcagacagaacucucugggccauuugaagaa

SEQ ID NO: 157314 - RNA, 43 nt, Homo sapiens
aucaacuguuauaccuaauuuuuuauagagauggaguuagugg

SEQ ID NO: 157315 - RNA, 48 nt, Homo sapiens
aaggugggaugcugagcaaaacguaucgcucauucagagugccuacca

SEQ ID NO: 157316 - RNA, 30 nt, Homo sapiens
ugaaguuaaggaauauuccuuuugaaggac

SEQ ID NO: 157317 - RNA, 46 nt, Homo sapiens
guggguucauggguggccuucagcgcaauggcagcaccgggcagac

SEQ ID NO: 157318 - RNA, 38 nt, Homo sapiens
accccaacuccuggauuuagugucuucuugacaucaaa

SEQ ID NO: 157319 - RNA, 47 nt, Homo sapiens
agacuuuguggaaaggggaggauuugagcuggacccugauaguggag

SEQ ID NO: 157320 - RNA, 45 nt, Homo sapiens
aagagggugaguauucuuucagguaugaaaucuugugggaaggaa

SEQ ID NO: 157321 - RNA, 48 nt, Homo sapiens
cacauucuuaguauguuauacauguaggucaaguuuuauuucauagga

SEQ ID NO: 157322 - RNA, 46 nt, Homo sapiens
ucuuuuuaaaaagaugcauugcuguuugcucccuuggggucuggau

SEQ ID NO: 157323 - RNA, 48 nt, Homo sapiens
acacacuaacuuuuucuuauaaagauaaauuagaaaacaaagagaagu

SEQ ID NO: 157324 - RNA, 42 nt, Homo sapiens
agcugaugugugaaauuguaggauaagaugacacacugguuu

SEQ ID NO: 157325 - RNA, 34 nt, Homo sapiens
caguaauccuuggaguaacucuguuuccaauauc

SEQ ID NO: 157326 - RNA, 32 nt, Homo sapiens
uguauauauaaagcccuggaggcugugaggaa

SEQ ID NO: 157327 - RNA, 23 nt, Homo sapiens
uuuauuuuuuaaucaucagaagc

SEQ ID NO: 157328 - RNA, 45 nt, Homo sapiens
aguguccuggcacgauucccauuaucugucaaggcaaauguuggu

SEQ ID NO: 157329 - RNA, 64 nt, Homo sapiens
aagaauucaggauauaagauggcuucagaauauauugacuuucaagaauaacauaugacucuca

SEQ ID NO: 157330 - RNA, 46 nt, Homo sapiens
aauuauuguugcaaauaugcauauagacauuuugggaaaugugggu

SEQ ID NO: 157331 - RNA, 48 nt, Homo sapiens
gagucucccaguacgcuucccucugcucagcugcuuugugucugaggg

SEQ ID NO: 157332 - RNA, 37 nt, Homo sapiens
aaugaugcaacucaggguauguggaggauuauggggu

SEQ ID NO: 157333 - RNA, 55 nt, Homo sapiens
uggcagugauaauuaaaauauuuuuuuccauuuagacaguuuauaggcccaaaug

SEQ ID NO: 157334 - RNA, 48 nt, Homo sapiens
guuucaccaacaacuugcagcagcaacaggguguggaaagcagggaga

SEQ ID NO: 157335 - RNA, 60 nt, Homo sapiens
ugaagucaaguagggcaucaaguuagguauuauggaaggcagggaggcaggaugggggca

SEQ ID NO: 157336 - RNA, 49 nt, Homo sapiens
aaagguacucuuggaguagaauauuagggguuagcaaguguaggaaacu

SEQ ID NO: 157337 - RNA, 46 nt, Homo sapiens
ugcaguuuagaaaugagcuggggggaacucauucuauaggggaaua

SEQ ID NO: 157338 - RNA, 50 nt, Homo sapiens
uggagacuaaagugagcuagaguaccuugcaaggggaucaguaugucccg

SEQ ID NO: 157339 - RNA, 45 nt, Homo sapiens
cccagggcagcaugguaaggagggaugagggagcaggugugaguu

SEQ ID NO: 157340 - RNA, 101 nt, Homo sapiens
ugauuuagaaacccaccaaaauuguuuuaauaauauaagcaauagacaauuacuuacuuuuagcuacgauuguuuguuuuucugaucuuuuggggacugua

SEQ ID NO: 157341 - RNA, 46 nt, Homo sapiens
accgaugcgauuuaggagugccaccacgucuggagcaccgggagug

SEQ ID NO: 157342 - RNA, 45 nt, Homo sapiens
uuguucaguuuugcuaccaaguaagucacgugaugaagccuaaug

SEQ ID NO: 157343 - RNA, 75 nt, Homo sapiens
aaguggagauggagcggguguggaacauucguucaagaaguuuggcugugaaaauggaaggaaaagggcuguagc

SEQ ID NO: 157344 - RNA, 40 nt, Homo sapiens
acuguuaaaagggacgggacauuuuuaaguuuuuauuacc

SEQ ID NO: 157345 - RNA, 69 nt, Homo sapiens
gugaaagggcucuggaaaaaugcuacauucuacauaaauaaagauauuaguacaguggauggacuugac

SEQ ID NO: 157346 - RNA, 124 nt, Homo sapiens
uggagggcugggccggucuuuggugcgagcagagagccaaagagaugccugugcuucuugcaucucauguggugagcaggugaagaccaagagcaggcugauaccuggugagcugccuggggaa

SEQ ID NO: 157347 - RNA, 82 nt, Homo sapiens
ggugggcgagguuuaaggugggugguacuaaaguauguuugcucaccaaugggaugguccagugagggaggacaagaugguc

SEQ ID NO: 157348 - RNA, 93 nt, Homo sapiens
aguggaaguugcaaguguaguuaaggcuuugcagaguucuugcuguggaaaggaagaggaaaaggggagcuagcugaagucgguggcauacau

SEQ ID NO: 157349 - RNA, 37 nt, Homo sapiens
aguguguugggcaauuguauuuaaagccacaggaugg

SEQ ID NO: 157350 - RNA, 32 nt, Homo sapiens
auuugcucaagggugguaggaauuaggaagcu

SEQ ID NO: 157351 - RNA, 51 nt, Homo sapiens
uucugugcuuccagaauccguaggcagggaauaggaauacauggacaagua

SEQ ID NO: 157352 - RNA, 45 nt, Homo sapiens
ccuugucggaccgaagacucagcaacuccagccucuguagcauug

SEQ ID NO: 157353 - RNA, 76 nt, Homo sapiens
ucaccugauucaguugucuguacucuguguguuucuauguaugcguacacacacacacacacacacacacauacac

SEQ ID NO: 157354 - RNA, 49 nt, Homo sapiens
cuuccucucccuauuauuuaaaacagguaaaacuaguucaaaugaauaa

SEQ ID NO: 157355 - RNA, 44 nt, Homo sapiens
aacucuugugcuguauugcagcaucuuugcuuauuugucacuaa

SEQ ID NO: 157356 - RNA, 54 nt, Homo sapiens
cuauagcuuaagauaagaauauguaccauuaguggaauaucuacacacaagaua

SEQ ID NO: 157357 - RNA, 50 nt, Homo sapiens
acaggcucuuuucagacaaauauauuuuugcauaauaaucauauugggug

SEQ ID NO: 157358 - RNA, 54 nt, Homo sapiens
acugggaccagguuuccaucaacgugagguagcagccagcuguugagaaacugc

SEQ ID NO: 157359 - RNA, 46 nt, Homo sapiens
agaugucagcacaucaagaauacagagaauaagacaauauaguuaa

SEQ ID NO: 157360 - RNA, 45 nt, Homo sapiens
agggaaccuuggaaaaggaaacaguaguuuuuagauguagaguau

SEQ ID NO: 157361 - RNA, 47 nt, Homo sapiens
acuuuguuucuauuccuaguuugagauuuauuuaaaaaaucauagau

SEQ ID NO: 157362 - RNA, 46 nt, Homo sapiens
cccacugcuggauuaaguaaauauaugugacuuguuuaauuccuac

SEQ ID NO: 157363 - RNA, 50 nt, Homo sapiens
cuuaaauaauuucuugugugguuuuguuuuguuuugaguguaauagaaau

SEQ ID NO: 157364 - RNA, 36 nt, Homo sapiens
auggugaugccugauccagggaggcaguaguuaagg

SEQ ID NO: 157365 - RNA, 94 nt, Homo sapiens
ggugggaagauuguaaguaaccaucaggucuaggaucuggcugugggugugggcggcagagguaggguagaggacaaccucauuagaaaugggg

SEQ ID NO: 157366 - RNA, 81 nt, Homo sapiens
aaggacccaguaagguugaagaguuguuggacuuaggguuccagaaggagugggcgggaaggauaagaaauagcgggugac

SEQ ID NO: 157367 - RNA, 42 nt, Homo sapiens
caguacaacaacaauuuaauaugaaugguugcaaaggcagca

SEQ ID NO: 157368 - RNA, 85 nt, Homo sapiens
aacaauauggagacgggcuugcuguuauccccaaaucuacugacaggcagagagcaggcauauuaaaaagugcccuugaugcuga

SEQ ID NO: 157369 - RNA, 67 nt, Homo sapiens
guaauuaaccagaaaaauugugauaaauaaauguucaaaauauauguauauguaaauugcaaaugga

SEQ ID NO: 157370 - RNA, 58 nt, Homo sapiens
cauuuaaucugccccaaagagauagggaauaucauuaucccuauuuuacacaugagau

SEQ ID NO: 157371 - RNA, 42 nt, Homo sapiens
aauuugaguuuauauaggagaaguagcuaaugaagagcaaaa

SEQ ID NO: 157372 - RNA, 39 nt, Homo sapiens
auauuucugggucuuggaguugaaagaguaccuaacaug

SEQ ID NO: 157373 - RNA, 44 nt, Homo sapiens
aggacggggaagaugaguuugguguucuacauguugaguuuaag

SEQ ID NO: 157374 - RNA, 26 nt, Homo sapiens
aggaguggaacaguagccugacaagc

SEQ ID NO: 157375 - RNA, 52 nt, Homo sapiens
ucauuagccauaugucacuaguggcugcacacuggacauagcaagguuagaa

SEQ ID NO: 157376 - RNA, 47 nt, Homo sapiens
ggggauggccauugagguggaaaacacuaacaaaggggagaggaucu

SEQ ID NO: 157377 - RNA, 60 nt, Homo sapiens
guauggguaaaagauaguauggguagcucuucaaaaguuggagaaauuccuggugaaaua

SEQ ID NO: 157378 - RNA, 83 nt, Homo sapiens
agaccaaggcagccacuguaggaccuggcucaucuccaaggaguaaagggaccagauaccuugugugggggaaacuugauuga

SEQ ID NO: 157379 - RNA, 48 nt, Homo sapiens
agugagaaaaucguauucacagauagaggugccuaucguguaguggaa

SEQ ID NO: 157380 - RNA, 27 nt, Homo sapiens
ucaguuuugccuaucuuaggggguugg

SEQ ID NO: 157381 - RNA, 46 nt, Homo sapiens
ucccccaugaacuagaaaaccacuuacucccagaauucaggucgug

SEQ ID NO: 157382 - RNA, 1036 nt, Homo sapiens
accuguuuggugaaagacucuuggaguguaagugcuccugucuuaccgcaggguugccugggugccugcuguuggugggugacuguggugggaagggcggcuugccuagcugcuuggacaugccacuucaucucugggaugagucuuacagaauggugcaaggauuucaguguauguugcaggcagauucuaauuggaauuuuaaaaucuagccugagagcuguuuuuacccuaaauggaacuggacaaguuaccuuggggacacaugggaggagcagcuaacccauccuuaugggcugugaaaggcuucucuaaggaaguauaguugacauugaaaccugaagacuaaacaggagugagccaggugaaggggacaggagugaagacagaccauuccuggcugagggacagugaaugccaaaccaaugaugccuaaccauucagcugugagagaaugugaggaaaaguagcaagagaugaaggagcaagaagaggcuucaggucagguuacugaaggccuucuaagucagcgaguuccgaauuuauccugagggcaguggggauagcaucaaaggucaggaaucgcguugcaaaaucugucuaaauggcaauggcuguagcucuuccacacgagagaagccagagggaguggaggagugacgcaccagaugaguaauuuauccugcagaaagaagccagugaagcccccuacccugcaguccauagggugcagagagcaucccuguccagauccugcugcccuugggaggcaaagcgaaguuucuggcuucccugugcccaugguggcauguggccgucuuagguacccaaguucacagcugacaaggcugcccaggucuugucucucuauucacuucgcauugcugugagagaagcugggauuacaggugugagccacuguacccagccauaucauuuuguugugugaggaauggcacugcggagauucuaaaguuaacauuaaaauaccuuuauguuuuuuucuuuuugaaaauaggucauuuuaugccaccug

SEQ ID NO: 157383 - RNA, 55 nt, Homo sapiens
ccaucagugaaacgguauaaucggaaucggacacuaacacaaaagcuacggaugg

SEQ ID NO: 157384 - RNA, 64 nt, Homo sapiens
uucuuccuucuuugauuuuccagaaaacagaaaguauuucaaaaacuaauugucagacgucuac

SEQ ID NO: 157385 - RNA, 49 nt, Homo sapiens
aaucucaaguggcugaacugaaugaugaugauaaagaugaugaaauagu

SEQ ID NO: 157386 - RNA, 46 nt, Homo sapiens
uuucagaggaaaaauacacuguuuggucaaguuaaggaaagcagug

SEQ ID NO: 157387 - RNA, 44 nt, Homo sapiens
caucuugcucacagggaaccaaagucacaaaagcccuucagaaa

SEQ ID NO: 157388 - RNA, 48 nt, Homo sapiens
uccugauucagaaaaggaauccuccacuaacgcaccaacaagagagua

SEQ ID NO: 157389 - RNA, 49 nt, Homo sapiens
ucuaugcuuuguagagcuguugaagguuauuuuaggagaaggacagugu

SEQ ID NO: 157390 - RNA, 44 nt, Homo sapiens
accaaggaccccaucuagacaccacagccuuauauagcuuccaa

SEQ ID NO: 157391 - RNA, 65 nt, Homo sapiens
uagacuuccccuugcaucuuguugacuaaaauuuguucacagacccauuccuaagcuaauuacug

SEQ ID NO: 157392 - RNA, 67 nt, Homo sapiens
aagggagauggacacugaguaggcaacugcacgauugcuaaauuugguccaaagaaagguuaguaga

SEQ ID NO: 157393 - RNA, 43 nt, Homo sapiens
uguuugugaugaauagguauugcuuucauaaucagaaaaaaaa

SEQ ID NO: 157394 - RNA, 27 nt, Homo sapiens
uaucucaguagagcaguuaaaaaaaga

SEQ ID NO: 157395 - RNA, 44 nt, Homo sapiens
ugcaaagugaacucuuucauaccauuacauguucuauuuacauc

SEQ ID NO: 157396 - RNA, 45 nt, Homo sapiens
aggcgggucucuucucgugcaucagccgucuuccugagagugcag

SEQ ID NO: 157397 - RNA, 37 nt, Homo sapiens
gaugucugauuuguuugagaacuccuagaaaaaguac

SEQ ID NO: 157398 - RNA, 47 nt, Homo sapiens
acccuacucuuuugcuuugagcuaaauauuguuuaaaauggcauagc

SEQ ID NO: 157399 - RNA, 62 nt, Homo sapiens
uaaggacguacacuuuuauguuuuagaaagagaacucugacaaugcagaaagugagcuggag

SEQ ID NO: 157400 - RNA, 46 nt, Homo sapiens
uagccaaaagaaugcaaugguguaaagauuccaguugaugccagua

SEQ ID NO: 157401 - RNA, 45 nt, Homo sapiens
uuuucaguauuguaagaccaagaagacuucucuacauggcaauag

SEQ ID NO: 157402 - RNA, 51 nt, Homo sapiens
guucagggcaucaaaagaaggaauggaagcagcagucgagaagcagcgagu

SEQ ID NO: 157403 - RNA, 42 nt, Homo sapiens
uucucuccuaccacaccugugugugagguaggguaugguugu

SEQ ID NO: 157404 - RNA, 45 nt, Homo sapiens
agugcuccuggugaaggagaacauaaaaucauggauuacauuaga

SEQ ID NO: 157405 - RNA, 46 nt, Homo sapiens
uuaugcuuggccuugccacacaugaaccgaacuuuaccauuauuag

SEQ ID NO: 157406 - RNA, 37 nt, Homo sapiens
gaaaaaagagauaaauauaguguauuauuucagauau

SEQ ID NO: 157407 - RNA, 46 nt, Homo sapiens
ccuaaugcauaauguuugucucuugcugacagggaaaaugcaauug

SEQ ID NO: 157408 - RNA, 82 nt, Homo sapiens
augucaaucugcaaagaguacagaugaucauguuagcaguuggugaaguugaggauagcauuuuuaaaaagagaaaggauga

SEQ ID NO: 157409 - RNA, 49 nt, Homo sapiens
uggucagugcuuugauuauuuuauaaagguugugcugcuugcucugugg

SEQ ID NO: 157410 - RNA, 48 nt, Homo sapiens
agucuauugggauugaacuaguggcugucauguuuugaaggcaggaag

SEQ ID NO: 157411 - RNA, 42 nt, Homo sapiens
cagaaaucccugcccucauggaguuuacauucucuugggaga

SEQ ID NO: 157412 - RNA, 47 nt, Homo sapiens
ggcauuacaguucuagaaaaggugacgagagauggccucacugacag

SEQ ID NO: 157413 - RNA, 44 nt, Homo sapiens
guagaaccagugggauuggcaaauggauuaaacauagaguguaa

SEQ ID NO: 157414 - RNA, 30 nt, Homo sapiens
agacugaaagauguuuugagcaacccucau

SEQ ID NO: 157415 - RNA, 265 nt, Homo sapiens
cccaugggaggagagaaguggagagauccaaguacugggcccaggggagcaccaacauuaacucauuucugcccaguguuccauuauuggaacgauaagcuugugggaguuauuuauauccuacugcuaaaggucaucaccaagguuugauuuuucacacaaaaaacuugcaaccuccagcauaaauggguuaagaggcuggggaguugaggaacaaagacacauagcaagagggaaggagaucaggugaguguagccuccugga

SEQ ID NO: 157416 - RNA, 72 nt, Homo sapiens
gacugaaaucugacuaauggauuucauagucugcaggucauuggugaccuacacaagagacguuucauugaa

SEQ ID NO: 157417 - RNA, 66 nt, Homo sapiens
agaaucaacgugggcuggacccucuccugugaauuaaauuggcccagaguaguaagccgugcauac

SEQ ID NO: 157418 - RNA, 58 nt, Homo sapiens
uuaacuuacuuguaucuucuccauauugacagccuguuugcuccaggauaaaaccaag

SEQ ID NO: 157419 - RNA, 30 nt, Homo sapiens
gacgacagaaagaaaaaagaaagagaauga

SEQ ID NO: 157420 - RNA, 46 nt, Homo sapiens
ccuaauacgaguuucacaucugauggcuccccgucuccauuaggag

SEQ ID NO: 157421 - RNA, 46 nt, Homo sapiens
ucaguaauuaauguggaggguuagaauagucaguaaauuccaguga

SEQ ID NO: 157422 - RNA, 45 nt, Homo sapiens
uuguagcauuuuuaaagucaaagagccauugauaugaauuagaaa

SEQ ID NO: 157423 - RNA, 46 nt, Homo sapiens
cuaguauaauugacuucuauccugaagauuuugcuauugauuugaa

SEQ ID NO: 157424 - RNA, 70 nt, Homo sapiens
auuuauguauacuccauggaaacuuuugaaaaauaugcuagaaacuuuuauguaguuuaaauacuugaug

SEQ ID NO: 157425 - RNA, 37 nt, Homo sapiens
acuuaguuaagcucuuaccuggguugagcacaucuua

SEQ ID NO: 157426 - RNA, 26 nt, Homo sapiens
uacuuacucuuuuuuuuuaagauaua

SEQ ID NO: 157427 - RNA, 46 nt, Homo sapiens
cuccuguuccuauguuaagggaucugacacagaacacuguagucag

SEQ ID NO: 157428 - RNA, 45 nt, Homo sapiens
auucacccagaacacagcucugaacuugcaaauccauuuuaaaag

SEQ ID NO: 157429 - RNA, 53 nt, Homo sapiens
uccaaggaaaaaugauauuaauacuuugguaucauaaauaguguccucaucuu

SEQ ID NO: 157430 - RNA, 45 nt, Homo sapiens
guccuguaucucuagaaugauacuagcuauguuuuuuccuuggga

SEQ ID NO: 157431 - RNA, 41 nt, Homo sapiens
cccugugaccaauccugucucaucuuaaaccgcagccucuu

SEQ ID NO: 157432 - RNA, 54 nt, Homo sapiens
ugugcauaaccucccucccaccgugaaccgugcaugcgauagguauucuaauag

SEQ ID NO: 157433 - RNA, 48 nt, Homo sapiens
auaacuuuucccucagagaaaguuacaugaagguuauauguaccagga

SEQ ID NO: 157434 - RNA, 46 nt, Homo sapiens
gaauuguuucuuguucuuuuccaguauuaauuuuaaagacccacag

SEQ ID NO: 157435 - RNA, 71 nt, Homo sapiens
aaaacuguguguaauguauguaucuuuacuuacacacacauacacacacacacacacacacacacacacag

SEQ ID NO: 157436 - RNA, 46 nt, Homo sapiens
cccaggauuccuggcgagguccuccuccccuuuuccagcagcaaag

SEQ ID NO: 157437 - RNA, 42 nt, Homo sapiens
aauuucuuuuuagaaggguugugcagcuuaaugaggcauaac

SEQ ID NO: 157438 - RNA, 61 nt, Homo sapiens
uccuaaaacucaauugaauuuuauuauuguaagacucaaaagaaaaacugaucacaguuaa

SEQ ID NO: 157439 - RNA, 41 nt, Homo sapiens
ggccugguggguauccacccagacgagaugaucguggaggg

SEQ ID NO: 157440 - RNA, 140 nt, Homo sapiens
cugguagcuggcugccuagacugcugaccccaguucauccauuuuccucucuccuuuggagaucuuccuuuuaaaggaacucugugcuguuacaggagguaaaauucuuauuuacuuagaagauauaaaccaauugguaa

SEQ ID NO: 157441 - RNA, 45 nt, Homo sapiens
gagaaggaaggaaauacccuuugccaccacccucaggaagauaca

SEQ ID NO: 157442 - RNA, 46 nt, Homo sapiens
guauauuucuacugaucugaucucacuguuuauguugcuuuccaaa

SEQ ID NO: 157443 - RNA, 49 nt, Homo sapiens
ccccaaagucucgacccccacuugcucucucacuuguccucgauccggg

SEQ ID NO: 157444 - RNA, 54 nt, Homo sapiens
acagagggggcccgggacagucuucgcuggaggcagcccgaggcgccccgcgcg

SEQ ID NO: 157445 - RNA, 32 nt, Homo sapiens
gcuuaccucgggcucugcauaguagcugcucc

SEQ ID NO: 157446 - RNA, 41 nt, Homo sapiens
cugccacacagggucugcaaggucuuugguucagcuaagcu

SEQ ID NO: 157447 - RNA, 41 nt, Homo sapiens
accccauccaguucaugagaaucuauauuuaacaagaucug

SEQ ID NO: 157448 - RNA, 46 nt, Homo sapiens
ccuagccuuaaucagguccucagagaauuucuaccauuucagagag

SEQ ID NO: 157449 - RNA, 33 nt, Homo sapiens
uuguugcuguuuugauuuguacugaaaaauggu

SEQ ID NO: 157450 - RNA, 46 nt, Homo sapiens
uaaauugauguugcuggacugucauagaaauuacacccaaagaggu

SEQ ID NO: 157451 - RNA, 54 nt, Homo sapiens
ucugcucagacagaaccccuacaugaaacagaaacaaaaacacuaaaaauaaaa

SEQ ID NO: 157452 - RNA, 47 nt, Homo sapiens
ccacgaggucaaggucugcccagaaggcugccgaccaauaacgcuca

SEQ ID NO: 157453 - RNA, 51 nt, Homo sapiens
acgucacuggaccacugggcaaugauggcaauuuuguaacgaagacacaga

SEQ ID NO: 157454 - RNA, 51 nt, Homo sapiens
gccgaggcucauucuccucccucuaaucacccccucgccaguuagccaugg

SEQ ID NO: 157455 - RNA, 31 nt, Homo sapiens
gcuaaggugcuuugguagcaaagcugggggu

SEQ ID NO: 157456 - RNA, 35 nt, Homo sapiens
acccccagcuuugcuaccaaagcaccuuagcuggc

SEQ ID NO: 157457 - RNA, 46 nt, Homo sapiens
ggaaggggccgcgcacuuguacuccaucuuggcccuggcggcgccc

SEQ ID NO: 157458 - RNA, 46 nt, Homo sapiens
ggcacaggcucgcgauggagaugccuaugagcaagcccgaaugcac

SEQ ID NO: 157459 - RNA, 31 nt, Homo sapiens
gccacauuggcaccgacugugacuccggcaa

SEQ ID NO: 157460 - RNA, 46 nt, Homo sapiens
ggcggcuucugcuccggggugugccacaaccuccccgguaccuucg

SEQ ID NO: 157461 - RNA, 42 nt, Homo sapiens
aggugccagauguuuugcaaccagacugccuguccagccgac

SEQ ID NO: 157462 - RNA, 23 nt, Homo sapiens
cuacccuaacuacgaccuggugg

SEQ ID NO: 157463 - RNA, 73 nt, Homo sapiens
ugcgagaccggcuaccggcuggcggccgaccaacaccggugcgaggacguggaugacugcauacuggagccca

SEQ ID NO: 157464 - RNA, 71 nt, Homo sapiens
aguccugcaacgaccucugcgagcacuucugcguucccaaccccgaccagccgggcuccuacucgugcaug

SEQ ID NO: 157465 - RNA, 54 nt, Homo sapiens
cgguccaggggcacugggccagggaggcgccgggcgcuugggacugcagcgugg

SEQ ID NO: 157466 - RNA, 50 nt, Homo sapiens
ccugggguuccccgcacccgcagagccgcagccggguggcagccagugcg

SEQ ID NO: 157467 - RNA, 38 nt, Homo sapiens
acaggacaguggguguggcuggggugacggggcagggu

SEQ ID NO: 157468 - RNA, 53 nt, Homo sapiens
gccaccgccucugagccggguccggacuucggcgcccugacaguguccccgcg

SEQ ID NO: 157469 - RNA, 46 nt, Homo sapiens
guggcaagcaguucuuuucagcagauuuugcccacuauuccucuga

SEQ ID NO: 157470 - RNA, 49 nt, Homo sapiens
gcagaaaaaccagggcaggacaguuaucgacaaugcauuagaacuuggu

SEQ ID NO: 157471 - RNA, 33 nt, Homo sapiens
uccaaugugaccaauuccggaucagggugugag

SEQ ID NO: 157472 - RNA, 44 nt, Homo sapiens
uuccugaaguggaagcuguguguuggcgugccacgguggggauu

SEQ ID NO: 157473 - RNA, 46 nt, Homo sapiens
ggaccaccaucugggccccccgaugaggaggacaaaggagagaaag

SEQ ID NO: 157474 - RNA, 54 nt, Homo sapiens
gaguggccgagcggcguccgggcgcuggggcggccaaguggcgcgggaagggug

SEQ ID NO: 157475 - RNA, 46 nt, Homo sapiens
cuccugggucaccugugugacgugacagucagcguggaguaucagg

SEQ ID NO: 157476 - RNA, 53 nt, Homo sapiens
ggcagugcuggcugccaccagcaaguuuuuuaaggaaguguuccuuaaugaga

SEQ ID NO: 157477 - RNA, 48 nt, Homo sapiens
gacuuugcuucauuucuugaguuugucuacacugcaaagguacaggug

SEQ ID NO: 157478 - RNA, 62 nt, Homo sapiens
uucucagagucucaggagguggaggugagcaguggcucccaaguuagugcugcuccugcccc

SEQ ID NO: 157479 - RNA, 51 nt, Homo sapiens
caugucuucagauuugccaccgaagaaguccaaggacaaacuagacaagaa

SEQ ID NO: 157480 - RNA, 52 nt, Homo sapiens
gugaugugggggacuacagguguccccaggaccaaagcccggacaggguggg

SEQ ID NO: 157481 - RNA, 51 nt, Homo sapiens
aggcaggugcugaguuggaggaauugucaaagaaagcagggccggaggagg

SEQ ID NO: 157482 - RNA, 63 nt, Homo sapiens
guuagcagcaugguguucauuuuuuacucuauauaauaaguuaaaaauacuugguuuaggaag

SEQ ID NO: 157483 - RNA, 56 nt, Homo sapiens
cuucauacuaguugugacauuaaaaugcuuaugcauuuuaaaaaugccaccuucgg

SEQ ID NO: 157484 - RNA, 80 nt, Homo sapiens
guggucuuuaguguuuaaaaaaaucugcaaaggccuggucucuaccugcacaugccuuauagcaucagcaguagggcuug

SEQ ID NO: 157485 - RNA, 56 nt, Homo sapiens
cagguuaaagccaugauauagcuuuuccaucuaguaagugagcaaaaugaauaaac

SEQ ID NO: 157486 - RNA, 46 nt, Homo sapiens
guauguuucaggacuuuugcccagcggaauucacuguaccagcaua

SEQ ID NO: 157487 - RNA, 46 nt, Homo sapiens
ugcgugcggacggacauucaccgacaaguccacucuucggcggcac

SEQ ID NO: 157488 - RNA, 94 nt, Homo sapiens
uuccuugucauuguagauggcucgcccaagaacgaugacggacacaagacugaacagccugacgaagaguaugugucauccaagcuuucggaua

SEQ ID NO: 157489 - RNA, 43 nt, Homo sapiens
ccugaucugcaugaucucagcuacuuuauugacaaaaaggcag

SEQ ID NO: 157490 - RNA, 45 nt, Homo sapiens
cagcauaugcugcccagcuugagcaguaccagaaagccauugaga

SEQ ID NO: 157491 - RNA, 41 nt, Homo sapiens
ugcaugcuuucuuguauuuccuaaagaaaguaggccgaguu

SEQ ID NO: 157492 - RNA, 42 nt, Homo sapiens
cuauuauuuuucuacccuuguccuuacauuuugucuuagauc

SEQ ID NO: 157493 - RNA, 56 nt, Homo sapiens
uaccuaugugcuucucagugagcacguucuacaucucuuguucucuaauaucccuu

SEQ ID NO: 157494 - RNA, 47 nt, Homo sapiens
acugguuaccuuuaugcuauaaauguuuuuaaauauccuuagcuccu

SEQ ID NO: 157495 - RNA, 60 nt, Homo sapiens
guuucuuguacugagcacaaaguuggguuuuguuuuuugagcagaucugaaaaugacgag

SEQ ID NO: 157496 - RNA, 41 nt, Homo sapiens
uuuuaaauuccaaccucucaaaaagcagagcccgcacugac

SEQ ID NO: 157497 - RNA, 46 nt, Homo sapiens
gguggauuucgacaaggucauugugcccugccaaggcacagcguag

SEQ ID NO: 157498 - RNA, 55 nt, Homo sapiens
ccagaucuacgcugugccuuggcagggcacaaugaccuugucgaaauccaccugu

SEQ ID NO: 157499 - RNA, 48 nt, Homo sapiens
gacccagcccaacuuggacaacugccccuuccaugaccagccacaucu

SEQ ID NO: 157500 - RNA, 46 nt, Homo sapiens
ucauggaaggggcaguuguccaaguugggcugggucuugguacacg

SEQ ID NO: 157501 - RNA, 36 nt, Homo sapiens
uucgcugcucugccaugggaugcaggucaagcuggg

SEQ ID NO: 157502 - RNA, 46 nt, Homo sapiens
ggugucuucaucuggcugaggucuaacucugcaucagcugauagag

SEQ ID NO: 157503 - RNA, 83 nt, Homo sapiens
cuggccgugagccccgcggccggcuccagucccggcaagccgccgcgccuagugggaggccccauggacgccagcguggagga

SEQ ID NO: 157504 - RNA, 64 nt, Homo sapiens
gggccucccacuaggcgcggcggcuugccgggacuggagccggccgcggggcucacggccaggg

SEQ ID NO: 157505 - RNA, 77 nt, Homo sapiens
auaccgaggcgaggccgugagccccgcgaggccggcgacugcgguuuuaucccuuccggccuucgccgccccacccc

SEQ ID NO: 157506 - RNA, 42 nt, Homo sapiens
ggguggucgccgcgacgagacuugggagacacggggucgcag

SEQ ID NO: 157507 - RNA, 53 nt, Homo sapiens
gaaagcccagcauuggccaaagaauagaccucagucacuagcacuucuacacg

SEQ ID NO: 157508 - RNA, 52 nt, Homo sapiens
auacauaguucauaucaauauauguaaggcugauuccugauuaucagccaag

SEQ ID NO: 157509 - RNA, 64 nt, Homo sapiens
ccaucacugcucacuccguacccacucaucuccccggauuuagugagaagugaaauggcccaaa

SEQ ID NO: 157510 - RNA, 48 nt, Homo sapiens
uugcugccaaagacuccagacucaguuucugugcgucugugucgacaa

SEQ ID NO: 157511 - RNA, 52 nt, Homo sapiens
ucggugauggugauguuugauuuaugcauguauaucucucaaauggcauuuu

SEQ ID NO: 157512 - RNA, 46 nt, Homo sapiens
gucauuccauggaugucccauucaaaucuuuguuaagaacaugcua

SEQ ID NO: 157513 - RNA, 47 nt, Homo sapiens
guggaagcgggaggcugaagaugaaaucgaggauguuacuaccaggu

SEQ ID NO: 157514 - RNA, 40 nt, Homo sapiens
gagccacauucccgugggugucagcgcacucaaaggccaa

SEQ ID NO: 157515 - RNA, 47 nt, Homo sapiens
aguggcaugaugcccacaaccauuuauacuccagaacauuccuggca

SEQ ID NO: 157516 - RNA, 33 nt, Homo sapiens
caugcccaggugggcuacauugaacuuaaugag

SEQ ID NO: 157517 - RNA, 24 nt, Homo sapiens
ccaaaucccgcuugucagagcuaa

SEQ ID NO: 157518 - RNA, 130 nt, Homo sapiens
gaguagaaguauaagucaaguacaggcuguucuuucuccucugaauaagaugcucugcaaauucugcaaagguggagggaacaauuuugggauuugggugugaaaacuugucacucaaguaagccuugua

SEQ ID NO: 157519 - RNA, 44 nt, Homo sapiens
aaagagccuaaaccuuccuguaaccaccgucaagacauugcuca

SEQ ID NO: 157520 - RNA, 36 nt, Homo sapiens
acucauucaagagauaauuaaaugugaaaucucuaa

SEQ ID NO: 157521 - RNA, 168 nt, Homo sapiens
ugacaaaguauucauaguaauauuuugaagaugaagaugaugccaccuuucuucagauaaguuauuucuuugcuguuuuuccagcacauacggcacaaaaaauucaagaccaucuuaguccacacucaagcuccgaggugaagcagaacugggcuguagcucaugagg

SEQ ID NO: 157522 - RNA, 43 nt, Homo sapiens
aagucaucuuuuagugaccagaacauacuguaucccagacccc

SEQ ID NO: 157523 - RNA, 111 nt, Homo sapiens
ccuugaggauaggugaaaggaaaugacccaaacugaaacacaaagaaaaaaaggauggaaaauaaaacagagcaggacaggaaauccaggaauguggaacaauacaaaaua

SEQ ID NO: 157524 - RNA, 445 nt, Homo sapiens
guguaacacaggggucuccaaccuccaggccacagaccaguacugguccauggccuguuagaaacugggccacacagcaggaggugaguggcuggugagcaagcauuaccaccugagcucugccuccugucagaucacugguggcauuagauucucauaggaaugcaaaccguauuaugaacugcacauguguggaaucuagguugcaugcuccuuaugagaaucuaaugccugaugaccugagauggaacaguuucaucccgaaaccauccccucugcacugauccguggaaaaauuguuuuccaugaaauuggucccuggugccaaaaagguuggcaaccacuaguguaacauaugaaaauuggaauaccagaagaagaaacaagaaauauuuuuuaaaaucauggccaagaauauuccaauauuagucauagacaccaagcc

SEQ ID NO: 157525 - RNA, 36 nt, Homo sapiens
gaacaaaaaacaaaaacaaaccaacaacaaccaaaa

SEQ ID NO: 157526 - RNA, 45 nt, Homo sapiens
uuuaaaccauagaaaauugaaaccaaagagaaaaucuugaauaca

SEQ ID NO: 157527 - RNA, 30 nt, Homo sapiens
cuaucucagauaaacagcugauggaauuca

SEQ ID NO: 157528 - RNA, 79 nt, Homo sapiens
caaaagauuaaaaacaguagagaaaauaaaaaguaugugaggcagacaacaaaauaauuaagacagaacuaaauaacag

SEQ ID NO: 157529 - RNA, 97 nt, Homo sapiens
gagauguaguuaaagcaauguuuaaagggaaauuuauagcauuaaaugcauaucuuagaaaaaaugaaagauucaauauguauaaucuaaacuaccu

SEQ ID NO: 157530 - RNA, 88 nt, Homo sapiens
uagggcacuagagaaauaacaaauuaaacaaaaggaaggaaauaacuacaauuagagaagaaaugaauaacauuauaaacgggaaaaa

SEQ ID NO: 157531 - RNA, 54 nt, Homo sapiens
ucuuugaaaagcaaacauaaaaauugaagaaaucaacacaauuaauaaaccucu

SEQ ID NO: 157532 - RNA, 41 nt, Homo sapiens
cucuggcacgugccuuccucccugacaccacccagcccgaa

SEQ ID NO: 157533 - RNA, 23 nt, Homo sapiens
aauccagggcuauccuagaagca

SEQ ID NO: 157534 - RNA, 59 nt, Homo sapiens
gggaauauaacugacaaguuugcauauauauauuaagaacagcaaugugguauaaggua

SEQ ID NO: 157535 - RNA, 36 nt, Homo sapiens
uugcugcuuugacccuugggagcucuuucagauugg

SEQ ID NO: 157536 - RNA, 49 nt, Homo sapiens
acacaguaacucauuaucuucagcuuacagaugaggaaauugaagcaca

SEQ ID NO: 157537 - RNA, 33 nt, Homo sapiens
aggaauucuugcagcaggcaaauaaaaaucuga

SEQ ID NO: 157538 - RNA, 23 nt, Homo sapiens
gaugcuaacagcugguggaggcc

SEQ ID NO: 157539 - RNA, 49 nt, Homo sapiens
ggcaauuacaggaaauuguguucgaagaugugggcgugugugggagcac

SEQ ID NO: 157540 - RNA, 46 nt, Homo sapiens
caccaaaugugacauccuuucaccaauauagauuacuucauaccac

SEQ ID NO: 157541 - RNA, 5810 nt, Homo sapiens
uaguuuaauguuguaucuucuuuuaccugugauuaaaaagagaguauuacauuaaaaagagaguauuacuguuccguaggcucauucucucaggauuaacuucccccaaagcaagauucugggugccuuuuaagcaaaugaaacuauguuuuuauuaagaaucuuaauaaaaccaucuuauuuuaaggcucuuuuaaaauaagagcugggcguggugggucagaccuguaaucccagcacuucgggaggcugagguaggaggauggcuugagcccaggaguucaagaccaucuugggcaacauagugagaccccaucucuuuaaagaaagacucuccuagagggaagggguuuaggagagacacauaucugaucuaaaagcaaugacuuacauuuucacaugaaaucuuuuuaaauuccacagaagcaugaaaccagaauuccagauuugauaaugauuaaggacugccaucaaaucccaggaauuaucugggagcaucaauucuguuugaaauugucugcucuguccaaucucaccgcagcuaguccccuacuucugaauucaauuacgaacuuacacauguggcguuaugaccuuccuucugaggaaaccugagaguuagcacccaucccccauauaugccccucaauaaccuacugacaccagaggauccccagcccucaguacucuagcaggaggcacaaugaucacacggcaguggcugccucucacaggcacuacagggcauuuguuuccaacacugcacagacuccacaugcucccacaggccugaugucacaggauggucauguucccucaacagcacaggcauccacacauucuggagucagagugcaguucugacagaaauaugccucuaugcacuguuucuacaggaaacugauguucugaguuuaaaaccuagucacauaccuugcaagaacaaauuucucuggauugguugaggauuguccaauuguccagaugccuuuguuuccuguacuuacuauacuaagcacaaucuuuaaaaaccaggaguuuggccaggcgcgguggcucacaccuguaaucccagcacuuugggaggccgaggcgggcagaccaucugagguugggaguuugagaccagccugaccaacaugaagaaaucccgucucuacuaaaaauauaaaaauuagcugggcgugguggcgcaugccuguaaucccagcuacuugggaggcuaaggcagaagagucacuugaaccugggaggcggagguugcggugagccuugauugugccauugcacuccggcuugggcaacaagagcgaaacuccgucucaaaaaacaaaacaaaacaaacaaaacaaaccaagaguuuguccuuagucucuuuuccuggggaauacagggacaucuaaagguuuaaaccuauaccucuccuuugagaguuagagccagcccaagcaacugaccugaaccacaccucccacccuguaaugcaaaucaagcagcuuagggaguuuaccacagggcuugaaaugaaauguaaauucaacaaauguuugccuucucucugcagaggaguguuaucuuuucuccuaauaauuucugguuucucaaugacugggucuaacacugacuaugguucacccuguugcauauuucuuuagagguccuucacuaggggguucggaaaguuuaacaaacuucucccgccaggcugaggaaggaaaauugcuugaaccugggaggcagagguugcaguaagccaagaucgcaccauugcacuccagcaugggcaacaagagugaaacuccgucucaaaaaaaagcaaacuccuucuuacgaaaggcugaagggcaaucuccaaaaaccaccaacucccauuuccaacagcaauacuacuacuacuaccaccacaggaugaguauccuuaauccaagaugcuccaaaauuuggaacuuuuugagcacucacaugaugcucaaaggaaaugcucacuggagcauucuggauuucagauuuuuggauuagggauguuuaaccaguaauuauaacacaaauauuccaaaauuaaaaacaaaaacaaaaaaccugcaacacuucuagugccaagcauucccgguaaggaauacuuaaccuguauuauaaaaacagagcugcugucuuagcuccccagugacagugacuuccucuuuccccaaggucagcuucacuucuggauacuuuuuuugagguggggucucacugcaucaccuagggggaaugaagcgacgcaaucuuggcucacugcaaccauggucucccagguuccagugauuuuccugccucaaucuccugaguguccgcgacuacaggugugcaccaccacagcuaauuuuuguauuuuuaauagagauggguuuuccccauguuggucagaccuccugaccucuugugaucagguugaacuccugaccucaagugauccacccaccuuggccucccaaagugcugggauuacaggcgugagcuaccacgccccggcuuugauucuuuaguuaugccacauacuccagcuucuccugcugauuccugcuggcuucuccaucaaaaaucaguuuguuuccuccuuuucccucucagcacuuuaagcgugggccugccucuuucuauucucucuucauuuccucccuaaggcuaccucagaccacuaggaacaucuggcuccugaaagguuuagccaggguaaucgccuagcuuccaaauccuaagauucugagccauaaccuguaaugcgguuucgcauuacuguacaucagacagcuacggcagcagaaacagaucaacaaacacucauguuuuacccaacaacauauaccucagccuuuccaucacauuuacaaaguuaaaaaaaaaaaaaaaagaaaugguaguauaaaguacuuauguaccuggaaaacaggcagugguuuuuaaauugucccaugaaaaucaacauuugaauacaacuuuucauuuuaauaaaauuaguuaaguauuuuauauauauauuaaaugucugcaagccuucaaccaaaagccaccuaugucaagggcacuuucaugcccacaaguagacuggauggcaaauuauaucugccugaugagagagaggaagcuugagcauaagaucuacaaauuguguugaugaccaaacaggagucgaaacugauaccaaccaacacugaucuucuaagucauuuuuuaaaggccucugcauuaaguagaaaccgaaacugaugcagccaguaucauuacauuaggauacacgucacaaaaaugaggucaacuggauuugaauucaucagugcaaacaugaaaaguauuugcugggcuaacagcuauguaaaaggaauccuuuaacucaagagcaggccaggcacgguggcucacgccuguaaucccagcacuuugggaagcagaggcgggcggaucaugaggucaggagaucgagaccauccuggcuaacacagugaaaccccgccucuacuaaaaauacaaaaaauuagccgggcguaguggcgggcgccuguagucccagcuacucgggaggcugaggcaggagaauggcgugaacccaggaggcggagcuugcagugaggcgagaucgcgcccugcacuccagccugggcgacagagcgagacuccgucucaaaaaaaaaaaaaaaaacaaaaaacaaaaaacucaagaguaacacuuggaauaaguauccaaaacacaguguuggcugggugugguggcucaugacuguaaucccagcacuuagggaggcugaggugaaaggauugcuuaaacccagaaauuacaggugguaguaagcuaugaucccaccucugcacuccagccuaaggcucugucucaaaaacaaacaaaaaaaacccaucacaccugccuugcauuucacuaccuaaggaguaguaacuggcuuacugguacuucucugacacagaaucacuguuaauauugaauaccuuucauguacaaguucaaugcuaucagucaguccagaacccauagaauuuuugucccugaugauuccugccaccccaucuuaucagcuggaucucaaggucacagaccaagcaaacauccaguugugggaaagggugguaguagaagggcucaguuugugaauauaaucuuucuaggaugcacuucuaacaaaugugcuagcucaacauaucuaugugaauugagauggaaaaacacugcaucuggagacucuagguuacgauguggucuaggggagggccacagggacaacccuuugcugauaucccuauaaucauauuagcaaaugccaaguaccugaaguuccuuaaccaccucuucacuccaaaccugaaacccguccuggcagcaaugaugagcacaaaaggaaggugaagguaaagauucaaaaccuuuucugacuugaaacccuuuacugaacugauauuuucaaagcuuuuuuuuuuuuuuuuuuuugagacggagucucacucugccacccaggcuggacuacuguggugugauuuuggcucacugcaaccuccgacuccuggguucaagugauucuccugccugagccuccugaguagcugggacuacaggcaucugccaccacgccuggcuaauuuuuguauuuuuaguagagaugagguuuccucauguuggccaggacggucuugaucucuugaccuugugauccacccgcuguggccucccaaagugcugggauuacaggcgugagccacugugcccagccuauuuucaaagcuuuaagaacuguguuuugucaauagucaaaucgaaguauaccuuuaauuaaacaauccaaaaugggucacaaaauguguaaaauacuguaaaaauaaucuuuguucagcacauuuuaguuuuaggaaaguuauugccauucuuccuggguguggauaugccagaaggagaaaaacuauaauaauuucaaaaacuaauuauuuacguauugcaagauuccauuugcaugcaauauucucuagaaaagacaaaaaguagauuagugguugccuggggacuauggugauggucgcauaacucuauaaauuuacuacaaaucgcugaauuguacacuuuuaacagaauaauuuuauggaaugaaauuacauaauaaaguugcuuaaaaaaacuauuuggaaugguucucagauuucuacuaagaauuaaguuaucugugaauacaacaauuuaaaucuuaaagcaaccauuaccaugaucauuacuuccuaaucugaucaucacaucauaaaagaauccaagaccuuauuuuauuacagcggcaguguuauuuuucuacccaagagagaaaaaacuggcugggcaucauggcucacgccaguaaucccaguacuuugaguggccuaggcgggcagauuccuugagccaggaguuucagaucagcuugggcaacaaggugaaaccccaucucuucaaaaaaauacacaaauuagccaagcguggugaugcaugucugcaguccuagcuaccugggaggcugaggcaggaggauugcuugagccugggaggcagagguugcaaugagguaagauggugcuacugcacuccagccugggcaacagagugagacuccguucccccaccccccuaaaaaagcuaagcuaaaaacaaguugaugaaauagaaaacaugagagaugauaccacugcaucuaaacucucacaauuccuaacagaaguaugugauaauuguuuaugauaaauaucuuaauuucaauaacucuuccuuagauauagaaaaguacuuacauucaucauaaaauccauaa

SEQ ID NO: 157542 - RNA, 73 nt, Homo sapiens
uauuuugaguggugcuucaaguucuaguaggauaggcugacugagaaagauuucacgagacuuuaagcacagu

SEQ ID NO: 157543 - RNA, 38 nt, Homo sapiens
ggucaagucuguuugccuuagauuuugaugucaccuag

SEQ ID NO: 157544 - RNA, 61 nt, Homo sapiens
auguacuauugagccaaaaaagcuuaccuucugguucaaagaacacaucagaugcaaggau

SEQ ID NO: 157545 - RNA, 2557 nt, Homo sapiens
acuggagaugcaggaccugaaaagaauguuuuugugugccauaaauaauuuagcugcuggaaguuggaaucauucauacagcaauuucugucaggcauuggcauccauuacaaaaauggcagcccuguucaccaauccacgaccuuuggggauauaaaacugcaaugcaaugugauagaaacucuugauagcacuguuuauucaacaagugcuucuagugucacaguaucagggaucauucucagacuggggauauagcucucccugagcacauauccuacuguagagaggcaacgagcaagcaaauaagauauuucuagucaggggccgggcacggugacucaggccugucaucccagcacuuugggaggaugaggcgggcggaucaccugaggucaggaguuugagaccagccuggcuaacauggugaaaccccugucucuacuaaaaauacaaaaaauuagccgggcaugguggcacgugccuguaaucccagcugaggcgggaaaaucgcuugaacacgggaggcggagguugcagugagccgagacugcgccacugcacuccagccugggcaacauagugagacuacguuucaaaaaaaaauggccgggcguggugggucacgccuguaaucccagcacuuugggaggccgagguggguggaucaucaggucaggagaucgagaccauccuggcuaacgcggugaaaccccgucucuacuccacuaaaaauacaaaaaaauuagccggacaugguggugggcaccuguagucccagcuacuccggaggcugagacaggaaaauggcgugaacccgggaggcagagcuugcagugagcagagaucucgcgacugcacuccagccugggcgacagagcaagacuccaacuccaaaaaaaaaaaaaaaaaaggaaagaggcuucuauucucacaggcaauaucaucacccccuacauuuaggaagaaaugcaaguguauuuaaacgugaagccagccgggagcgguggcuuacaccuguaaucccagcacuuugguaggccgaggcaggugcaucaccugaggucaggaguucaagaucagcuuggccaacauggcaaaaccccgucucuacuaaaaauacaaaaauuagccaggcaugguggugggcgccuauaaucccagcuacuugggaggcugaggcaggagaaucacuugaacccacgaggcggagguugcagugagcugagauugugccacugcacucgucugggugacagagcgagacuccaucuccaaaaaaaaaaaaaaaaauccgugaagccagauugggugugguggccaaugccuguagucucaguuacuugaaaggcugaggugggaggaucacuugagcccagagguugagguugcaguuagcaaaaaaaagugaagcuguuuggaaacaaucagaaauagccuccacuccagucuuuuuuuuuuuuuuucuucuugacaaugucuugcucuguugcucaugccugagugcaguggccugaucauagcucacagcagccucgaccucucgggcucaagcaauccucccaccucacccuccggaguagcuggggcuacaggcacaagccacgaugccuaauuuuucuacuuuuuguagagacguaguaucacuauauugcccaggcuggucuggaacuccuggucccaagcgauccucccgccuccgccucccauuuaacuucucuaaagcuguuucuuuagcaugggacaugccucacaggcugguguuaaaaccaaaugaaauacugcaaagugaaagugcuuugaaaaaccgaagacaggcagggcaugguggcucacuccugcaaucccagcacuuaggcaggcgggaggaucacuugaauccgggaguuggagguugcagugagcugugaucgcgccacugcgcuccagccugggcgccagagcgagacagugucucaaaaaaaagaaaagaaaaagaauuauuauugagaguuuuguuguagcugugagcuuagaggaagaagcgagguccaacccaagaaacacuuugggcaccaaauaaaacuggaaacccugaucccaaaacucacacaaaagugagagauaaggaugaaucaagaaacccuuggacaagaucaaaagaagcauuagaggucagucaagaaugucacuuuccuggcaggaaagauucgauguggagaaagccggcccggcgcaguggcucaugccuguaauccuagcacuuugggaggccgaggcaggaggaucacuuaagcuuacaguucgagaccagccugaccaacauagugaccagggucacuucuuggcagggucuccaaaauucuuacugagagacauuuaaugcaccgaagggcuucauauccgacguuuuugcuccgggggucaaccuaaagcaggaagcugcgcagcugagcguccgcacccccggucccucaggaacccagccaagucagccgacauccgcuccugaccucaggcgccuccuggcgggugcugcugcacgcaccugcgggacguggaccuccaggacagcccc

SEQ ID NO: 157546 - RNA, 45 nt, Homo sapiens
cagguggguccugcugggucauaccagauuucaggcagggagauc

SEQ ID NO: 157547 - RNA, 79 nt, Homo sapiens
guuuugugggcagaccagccucucugccuuugacucuacagccuccugcacuccugcaaugugcugugaccacagugcc

SEQ ID NO: 157548 - RNA, 111 nt, Homo sapiens
ucuuuggggacacggccugcuuucauggugucucgguagaacuacugauagagguguccuaccccugcacuacccugggcaucccagcccgccucucugcggagcaaagcu

SEQ ID NO: 157549 - RNA, 90 nt, Homo sapiens
ccaggagagagauuccuucucuugccuaauuccuggcccuggcaguggcccuguccuucugaaaccccaucugucaucucugccugccca

SEQ ID NO: 157550 - RNA, 36 nt, Homo sapiens
caggcuauuuccccauuaguucuuuugaacaggucu

SEQ ID NO: 157551 - RNA, 43 nt, Homo sapiens
agcccgcuuuugcggacccgcccccagucugcgucagggacag

SEQ ID NO: 157552 - RNA, 43 nt, Homo sapiens
ugagccgcgaaugcccuggaccgagggagggagagcccccuag

SEQ ID NO: 157553 - RNA, 49 nt, Homo sapiens
aggccuccaccacguggcuccaucagcauucgcugcagcccugggaggc

SEQ ID NO: 157554 - RNA, 46 nt, Homo sapiens
aaccaagacaacagaaacauuauauuuaguccuggaaugugccagc

SEQ ID NO: 157555 - RNA, 46 nt, Homo sapiens
aaugagcuugaaaaagugguuguugagggcaaugacagccccagca

SEQ ID NO: 157556 - RNA, 43 nt, Homo sapiens
ggggucuuacuccuuggaggccaugugggccaugagguccacc

SEQ ID NO: 157557 - RNA, 41 nt, Homo sapiens
gugcggcggccgccggagcgcuuuggaaggcgcacggggcg

SEQ ID NO: 157558 - RNA, 47 nt, Homo sapiens
cgagucggccggcugggacuugcagguagcgccgcgcggcgggcugu

SEQ ID NO: 157559 - RNA, 23 nt, Homo sapiens
ggucccgggaccgcuugucacgc

SEQ ID NO: 157560 - RNA, 47 nt, Homo sapiens
ugccucgcccgcuugcggcgucagcgagacuucgggcgcugcggcag

SEQ ID NO: 157561 - RNA, 42 nt, Homo sapiens
ugaugacuaauauuuauugaguaccuaccaugagccaagcgc

SEQ ID NO: 157562 - RNA, 46 nt, Homo sapiens
ugccaguucacuacauggccugagacagcacacugccucccagcag

SEQ ID NO: 157563 - RNA, 42 nt, Homo sapiens
acacuagcagggauggaaccuggcuccucucuuuaccaguug

SEQ ID NO: 157564 - RNA, 46 nt, Homo sapiens
uuguggacauucaaaguccuccagaguuuacccuuggacccaccuu

SEQ ID NO: 157565 - RNA, 47 nt, Homo sapiens
gugugcccgcucucuugcuuucugccuauacaaaucccaugcauccu

SEQ ID NO: 157566 - RNA, 67 nt, Homo sapiens
ugcacgccauaauucuguuccacagaacuccagucacaacuaucacuccuucaguucuuugacuaua

SEQ ID NO: 157567 - RNA, 46 nt, Homo sapiens; identical to SEQ ID NO: 72177

SEQ ID NO: 157568 - RNA, 49 nt, Homo sapiens
uugugaccuucacaccgacucaaaaccuuccuuuuagauacuucuggau

SEQ ID NO: 157569 - RNA, 42 nt, Homo sapiens
uuggggcagcaccagaggaagagucugccuauguggcaggag

SEQ ID NO: 157570 - RNA, 58 nt, Homo sapiens
cacaccugccaagcccagcagacccuguguaucacucacuuugguuauuagcucuuua

SEQ ID NO: 157571 - RNA, 41 nt, Homo sapiens
agacggcgggaggcuggugcagaaauuuaaccacagccaca

SEQ ID NO: 157572 - RNA, 93 nt, Homo sapiens
augagagccagacccugaaggaagccaaccugcucaaugcugucaucgugcagcgguuaacauaaccgcccagccagcugccuggccucccuc

SEQ ID NO: 157573 - RNA, 54 nt, Homo sapiens
gccaguggccaugccccauggggaucgccccuccugcccccuugugcacaccca

SEQ ID NO: 157574 - RNA, 47 nt, Homo sapiens
aaaaacaaccaaaaaaauugaaggaauaucaccagcauguuguacgg

SEQ ID NO: 157575 - RNA, 58 nt, Homo sapiens
ggacaagguagugagaggaugcugcugacgcauuaguccugggauucagcugcaguaa

SEQ ID NO: 157576 - RNA, 45 nt, Homo sapiens
auuuaaacaauaaauuugccacuuagauuuucuagcagcaaaguc

SEQ ID NO: 157577 - RNA, 46 nt, Homo sapiens
uccccccgccgggcuacgaugacauguaccugugaaggccucaaga

SEQ ID NO: 157578 - RNA, 47 nt, Homo sapiens
gguggcaugauuguggauccccugagaucuggcuucccaagagcacu

SEQ ID NO: 157579 - RNA, 79 nt, Homo sapiens
uuguagucccccaaucucacuaucaaguucagaaguuuuccaaaauagcaugggaugugagugagucacauuccaaggu

SEQ ID NO: 157580 - RNA, 59 nt, Homo sapiens
cauggaguuagaaaguggagacguaaguggagcagugaguucuugaacugcuacuaguc

SEQ ID NO: 157581 - RNA, 101 nt, Homo sapiens
ugcuucuguagagggauuccagccagcuauccccauccugccacuugaccccaucccuggcccguauguguuuucaacaaaaugaucagugucuuggggug

SEQ ID NO: 157582 - RNA, 101 nt, Homo sapiens
ggaccuacaagaacagugaggagcuucggucucguauugugucuggaaucaucacaccuauccaugagcagugggaaaaggcuaauguaagcaguccccac

SEQ ID NO: 157583 - RNA, 45 nt, Homo sapiens
ugggaaaaagaagagagaacuaauggcaagauaugaggaauaggg

SEQ ID NO: 157584 - RNA, 47 nt, Homo sapiens
guggcagacuugacccugaacuuggaugauuauaucgaugcagaaca

SEQ ID NO: 157585 - RNA, 226 nt, Homo sapiens
gaucaaaguugaugcaucaguucaacaccucaauuaccaugccugagcccuuuugcaaaagagccugggaaguagguguuuuagucucugccuuggaaaggcaauauuccuaaaucagagaagucuccaagccuuaggaagguauuucauauaaacaguccuuauauaugucucuguggacauaugugaauauuucuuuagguugaagacuuuguuacucucccuu

SEQ ID NO: 157586 - RNA, 45 nt, Homo sapiens
cagccgggucccaaugauaagaagucagaacugcugccagcuggg

SEQ ID NO: 157587 - RNA, 64 nt, Homo sapiens
aaauaagcuggaaauacuccaaaucaccaucaacaaguagauguauaaauugcagcauagucau

SEQ ID NO: 157588 - RNA, 41 nt, Homo sapiens
guucauaucuuuugccacuuuuuggaguucccaauuguuau

SEQ ID NO: 157589 - RNA, 30 nt, Homo sapiens
gucucauuauuucaguucugcuucucugau

SEQ ID NO: 157590 - RNA, 42 nt, Homo sapiens
agaggauauuuguguugccucuccagccaucugcuguuucca

SEQ ID NO: 157591 - RNA, 47 nt, Homo sapiens
gccauuggggcucagguugcacuuguccuucugucgcuucugcugag

SEQ ID NO: 157592 - RNA, 112 nt, Homo sapiens
gcuccccagagcacuucucacccaccugaucccgucugaacuccuuaccacccagccucggggugaggggacugacucaguuccgcccucauaccacaguagagccuccacc

SEQ ID NO: 157593 - RNA, 28 nt, Homo sapiens
agucccucacggcacagcuggcacaaca

SEQ ID NO: 157594 - RNA, 96 nt, Homo sapiens
gaguaccggaggccugguccagagcgcccgauuuccccgcuucucccagugcagggucuggggcagauggcagcguugguaaaaccugcgggucgg

SEQ ID NO: 157595 - RNA, 42 nt, Homo sapiens
cucuucacuugacauucagaguccuccauaauuuggccaaac

SEQ ID NO: 157596 - RNA, 46 nt, Homo sapiens
ucugagaagugaggauacuagcucucaagagaccaaggcccaauuc

SEQ ID NO: 157597 - RNA, 87 nt, Homo sapiens
ggguaaaugggauuccuugccacccaagcugucagaacugccacugagcuaaagaugguggggccacaugcugacccagccccacau

SEQ ID NO: 157598 - RNA, 52 nt, Homo sapiens
cugcgggcucagaacgauguggcugcccggcagacgacagagaugcugaagg

SEQ ID NO: 157599 - RNA, 60 nt, Homo sapiens
caaguaauguaguggagguuguuuuuacaaaaacagaaaaauaugccucaccacauagaa

SEQ ID NO: 157600 - RNA, 45 nt, Homo sapiens
cauugacaacaccuacucgugcucgggcaagcugcuggagaggga

SEQ ID NO: 157601 - RNA, 48 nt, Homo sapiens
ggaggcaggguggaggccuuggugauggguuggugagagggaugggaa

SEQ ID NO: 157602 - RNA, 73 nt, Homo sapiens
agucacuggggagacauggcugcuguucugagauagacucuaggggccagauggaugcagggagcccagcgag

SEQ ID NO: 157603 - RNA, 98 nt, Homo sapiens
cugcuguagguguggggugugggccuggccuguuggaggagacugaggaggucucuugguggcuggagcagagggaugaaggggguaaucagagcagg

SEQ ID NO: 157604 - RNA, 87 nt, Homo sapiens
cagcagagaggcugaugagaaucggauaaucgcugguugaugucuuugugaauugugucaaaugcuacauacaguacauuaagagac

SEQ ID NO: 157605 - RNA, 87 nt, Homo sapiens
gcggggccacggggcgggucagggccucgggggcgggucagaccccgaagggggaagggccagggggcguggucagggcugggucag

SEQ ID NO: 157606 - RNA, 42 nt, Homo sapiens
aggggaggccggccagguagccacggaaggcgccaggugaga

SEQ ID NO: 157607 - RNA, 44 nt, Homo sapiens
gcagcaccggguccaaggggaaugcagguggggccaggggugag

SEQ ID NO: 157608 - RNA, 74 nt, Homo sapiens
agccaugaccacaccucagcucggaccucacccccacccgucugugaccuaagccugcuccaccucgccgugac

SEQ ID NO: 157609 - RNA, 45 nt, Homo sapiens
cgcgccccgaggccuaccagguccccgccucauaccagcccgacg

SEQ ID NO: 157610 - RNA, 45 nt, Homo sapiens
gcgugggcuuguugaugaaggugcacccggggcacugccagccca

SEQ ID NO: 157611 - RNA, 48 nt, Homo sapiens
cacugcaucuggcugcccccguccggguuccugggggaccccgggcuu

SEQ ID NO: 157612 - RNA, 45 nt, Homo sapiens
gaggaaauggcccugagccucacccgagcaguggcgggcggggau

SEQ ID NO: 157613 - RNA, 48 nt, Homo sapiens
ggaggcacggucccccccagggggaugggcacagccacgccagaugga

SEQ ID NO: 157614 - RNA, 45 nt, Homo sapiens
cugggauuguggaccccaaguguccccagaagagucccaccuggg

SEQ ID NO: 157615 - RNA, 61 nt, Homo sapiens
gaaagggauuguccuuggacagaggugccugagcaccagcaucaguggaggccgacacugg

SEQ ID NO: 157616 - RNA, 45 nt, Homo sapiens
uugcucacugcuguacucccagcaccgagaacagggcuuggcacc

SEQ ID NO: 157617 - RNA, 51 nt, Homo sapiens
ggaguugggcucuaaagggacccugcuaaaagggagaaguuggggaaacac

SEQ ID NO: 157618 - RNA, 41 nt, Homo sapiens
gucccucagggucgucgcugagagcagugccugcacagucc

SEQ ID NO: 157619 - RNA, 66 nt, Homo sapiens
gccaugggaaccgcuagggaggcguccccagcccgggagccgggaggagcucggugggaggggagc

SEQ ID NO: 157620 - RNA, 43 nt, Homo sapiens
aggaugcgggcagagcgcggggguucuccaggggcuggggcug

SEQ ID NO: 157621 - RNA, 42 nt, Homo sapiens
aggagaaagauggauuuuaacccaaaauuaugagugagcugu

SEQ ID NO: 157622 - RNA, 47 nt, Homo sapiens
ugggugaaaaucacauagcugucuggugccagagccagccuauagua

SEQ ID NO: 157623 - RNA, 32 nt, Homo sapiens
caucugcuggaaaaccagggaauugguccaaa

SEQ ID NO: 157624 - RNA, 25 nt, Homo sapiens
ccaacucucagguucuuuccagcag

SEQ ID NO: 157625 - RNA, 44 nt, Homo sapiens
gaccgacagguuugggaucuggaccggggaguacaaaugcgaga

SEQ ID NO: 157626 - RNA, 42 nt, Homo sapiens
ggcaagggucgcuuccucguccgcaucuguuuccagggagac

SEQ ID NO: 157627 - RNA, 41 nt, Homo sapiens
agcgccgggcucggcggccccgcgggccuggcggcgccgga

SEQ ID NO: 157628 - RNA, 43 nt, Homo sapiens
agaagaugggcugggcccagguggugaagaaucuagccgagaa

SEQ ID NO: 157629 - RNA, 43 nt, Homo sapiens
agccaauuuuccugaggaacccuggcugaggcucagggcuggg

SEQ ID NO: 157630 - RNA, 86 nt, Homo sapiens
caucaaccacuccuggaauggagaugcuggcaaacucgacucucuggggaugcgcacagcugacucagggagggugcgguggccag

SEQ ID NO: 157631 - RNA, 25 nt, Homo sapiens
caacagacugaaaaaugucugagua

SEQ ID NO: 157632 - RNA, 42 nt, Homo sapiens
uagaaguagguguggguauucuucuucaagcugcagggaagg

SEQ ID NO: 157633 - RNA, 42 nt, Homo sapiens
ccugagcaugcuugaagaugugcaugaugaagaugguaaggc

SEQ ID NO: 157634 - RNA, 35 nt, Homo sapiens
ccuguuuguugagaggauucauugcaugugguucu

SEQ ID NO: 157635 - RNA, 46 nt, Homo sapiens
gaucaguguucuaggaacaaguaacagcaagggcaagggcccugag

SEQ ID NO: 157636 - RNA, 47 nt, Homo sapiens
ccacuggcgacuuucaugauucuuggcgacuggcugaaacagaaugg

SEQ ID NO: 157637 - RNA, 54 nt, Homo sapiens
gcucagacagacagcgcaccaccucgcccgcaccgcucgcugucuugccggccu

SEQ ID NO: 157638 - RNA, 25 nt, Homo sapiens
agggggcaagaggaauuacgugcuc

SEQ ID NO: 157639 - RNA, 72 nt, Homo sapiens
gaggaaauugcuuuguauuguauauuacaaugaucaccgacugaaaauauuguuuuacaauaguucuguggg

SEQ ID NO: 157640 - RNA, 42 nt, Homo sapiens
cgguccgccccagcgcagccaaucagcgagcccagccggcac

SEQ ID NO: 157641 - RNA, 44 nt, Homo sapiens
ucaguuuccccugaagagacaggggaacuugcaagcucagucac

SEQ ID NO: 157642 - RNA, 58 nt, Homo sapiens
ccucaguuucugucaagagggaccaagaauagcaccaacuacauuggcuuggcgagga

SEQ ID NO: 157643 - RNA, 24 nt, Homo sapiens
auucaaagagaggccacaggaugu

SEQ ID NO: 157644 - RNA, 30 nt, Homo sapiens
aucuugaagucuggcaaauauguaucaaga

SEQ ID NO: 157645 - RNA, 46 nt, Homo sapiens
uccuucaucauccaaggaugaaaaauugaugaaauccgagggggca

SEQ ID NO: 157646 - RNA, 44 nt, Homo sapiens
aucugugcggaaguggaagucaacugauuuggugaccuggcuca

SEQ ID NO: 157647 - RNA, 85 nt, Homo sapiens
aaacuguuucaucaaauguucuuuucuuuccuugggacagguugaaaggcuuaacaaugguacaucccuuagucacucgggccug

SEQ ID NO: 157648 - RNA, 78 nt, Homo sapiens
cuggauucuuuucucaauuuccaaaucaaagccaauaggcucggugggugguuucacaggugguuucuugggcaagau

SEQ ID NO: 157649 - RNA, 49 nt, Homo sapiens
aaaaauuccagugucuguauacaggagcacuugguuuggggguucaggc

SEQ ID NO: 157650 - RNA, 45 nt, Homo sapiens
ucugguugccagugggcggcugcaggaaagguccugggucaggag

SEQ ID NO: 157651 - RNA, 46 nt, Homo sapiens
ucaucuggaaaacaguuaauaggaagggacuaaaauaggcaacagg

SEQ ID NO: 157652 - RNA, 46 nt, Homo sapiens
uccacccuugcaaaggaggaggggacuuaaacaaugaaagccagac

SEQ ID NO: 157653 - RNA, 53 nt, Homo sapiens
agaaguaacauuaaagaggaaaaaaagaaguacuauucaggccucaugcggaa

SEQ ID NO: 157654 - RNA, 85 nt, Homo sapiens
gagaacucuggcccaggagauggugccuggagggagguaaaguaaggggcucuuuaaaggggaugugccgaggguuaguugugag

SEQ ID NO: 157655 - RNA, 24 nt, Homo sapiens
auuccuucccauccucgcucuucc

SEQ ID NO: 157656 - RNA, 48 nt, Homo sapiens
guuaaguguggcugcagcuggaggaucagcagagaagggaguugugga

SEQ ID NO: 157657 - RNA, 45 nt, Homo sapiens
ucauggggcacgucuucuuaucugggcuucgcugggcugccaccu

SEQ ID NO: 157658 - RNA, 46 nt, Homo sapiens
cuggcuccauuguucucuguaggaagcacugaaggaaaugccugua

SEQ ID NO: 157659 - RNA, 43 nt, Homo sapiens
ugagggaagucagaggacgcacagagagccuggcugccacccc

SEQ ID NO: 157660 - RNA, 43 nt, Homo sapiens
acugggcuggggcuccuggcagggcaagcaccggauguuccuu

SEQ ID NO: 157661 - RNA, 46 nt, Homo sapiens
guagcccacacacugcggagaggccaugaagugcgagccugcaguc

SEQ ID NO: 157662 - RNA, 50 nt, Homo sapiens
cucacccagagcuucacagcccucuggaucuccuucaggucaggcaggca

SEQ ID NO: 157663 - RNA, 44 nt, Homo sapiens
agacacaaaaggaggggcagagaagaggaagaugugguucagug

SEQ ID NO: 157664 - RNA, 41 nt, Homo sapiens
gggccaccucaggcuucaggcucaccaccuucaccugcagg

SEQ ID NO: 157665 - RNA, 40 nt, Homo sapiens
guuucuccaguaaaguaauuacggagaucgggucauuuau

SEQ ID NO: 157666 - RNA, 33 nt, Homo sapiens
acacacacucacacacacccacggcagacacgc

SEQ ID NO: 157667 - RNA, 45 nt, Homo sapiens
aaagucauccaccaagccugccuuggcuacaugggccuuguagua

SEQ ID NO: 157668 - RNA, 48 nt, Homo sapiens
aaaucuugugcugagugggugucucucucaaaggccgggauuguagaa

SEQ ID NO: 157669 - RNA, 35 nt, Homo sapiens
ucagagcaguuggcgcagcucagacccgauggcgu

SEQ ID NO: 157670 - RNA, 42 nt, Homo sapiens
ccuucucauauucaccuugagcuaguaacucuucaccaagcu

SEQ ID NO: 157671 - RNA, 48 nt, Homo sapiens
cucaggaaauauuuguugaaggggaagaguaugcuucuucaguccaag

SEQ ID NO: 157672 - RNA, 45 nt, Homo sapiens
aagccaggggaguauucugacuugcaguuuaaaagcugacaggcc

SEQ ID NO: 157673 - RNA, 46 nt, Homo sapiens
gcucuagcugugaauucagacaaccugaugcugacacuagcuaugu

SEQ ID NO: 157674 - RNA, 29 nt, Homo sapiens
cauguagauuuuaguauaggauauguguc

SEQ ID NO: 157675 - RNA, 597 nt, Homo sapiens
aagacccccgccuuccccuggccaucuuuuuuugcuuuugcuuuugcuuuuuuuuugagacggagucucgcucugucaccaggcuggagugcaguggcaugaucucagcucacugcaaccuccaccucccggguucaagcaauucuccugccucagccucccgaguagcugggauuacaggugcguaccaacacgcccagcuaauuuuuguguuuuuaguagagacaggguuucaccauguuggccaggauggucuugaucucuugagcuugugauccgcuugccucggccuccaaaagugcugggauuacuggugugagccacagugccuggccuuucuuuuucuuuucuuuuuuaaagauggggucucacuguguugcccaggcugaucucaaacgccugagcucaagcgaccugaccaccuuggccucccaaaauugcccaggcugaucucaaacgccugagcucaagcgaccugaccaccuuggccucccaaaguguugggauuacaggugugagucacugcaccuggcuaccaccacccacaaucuuuuaacuuuuuauuuuaaaauguagauucacaggaaguuauaauga

SEQ ID NO: 157676 - RNA, 39 nt, Homo sapiens
guaugguaucaguugucaaccuucgauuuuuauuuagca

SEQ ID NO: 157677 - RNA, 38 nt, Homo sapiens
cuuagugacaucagcuggcaaagagcccugguaacagg

SEQ ID NO: 157678 - RNA, 85 nt, Homo sapiens
gcagaugugagagagcugacacauguccagcuaaugaaaggaggaggaaggcuggucuccgauugagcuuugaagauuaggagga

SEQ ID NO: 157679 - RNA, 83 nt, Homo sapiens
gaaaaagaggagcuuuggaauaucuauuucaaauaaauuugguguauuuaagaaucuggauuguuuauaauuugggcauuugg

SEQ ID NO: 157680 - RNA, 81 nt, Homo sapiens
uugauacaagaguucagccuuucuacucaguuuuauuuuaaugcuucauuuuauuuauguuucuauuuuucuguugccaac

SEQ ID NO: 157681 - RNA, 75 nt, Homo sapiens
caaugaaucugacuugaauugugaguuugggguaguuuugugaugcaauaaauucaugugcauauaacuacguac

SEQ ID NO: 157682 - RNA, 357 nt, Homo sapiens
uguggcacaauaugacaaaugacaucacagagguguuuauuuuuauuuuuauuuuuugagacagagucucagucugucgcccaggcuggagugcaguggcgcgaucucagcucacugcaagcuccaccucccggguucacaccacucuccugccucagccucccgaguagcugggacuacaggcgccagccaccacgccuggcuaauuuuuuuuuuuuuaauguauuuuuaguagagacgggguuucaccauguuagccaggauggccucgaucuccugaucucgugauccgcccaccuuggccucccaaaguguugggauuacaggcgugagccaccgcgccuggccuaagaggug

SEQ ID NO: 157683 - RNA, 85 nt, Homo sapiens
uagacuguguauuuacguucauauauuugugaagaaagacaggaacuauauaguagaaugugaagucucucugaacuguaaucaa

SEQ ID NO: 157684 - RNA, 45 nt, Homo sapiens
guauguacuauguacuauguucuggccacuggacuuggcacuugg

SEQ ID NO: 157685 - RNA, 46 nt, Homo sapiens
aauugucaugucauuauaaggguuucuguugcucacuaaucuguag

SEQ ID NO: 157686 - RNA, 39 nt, Homo sapiens
ugugggaagaucuguuuuagguuuuaaaucagcacuuug

SEQ ID NO: 157687 - RNA, 47 nt, Homo sapiens
uuuuugaaucguaggaaagccauuaacuagcugugugagaaauugau

SEQ ID NO: 157688 - RNA, 41 nt, Homo sapiens
acccucagcacguagugcuguaaugauucuuaaugcauuuc

SEQ ID NO: 157689 - RNA, 57 nt, Homo sapiens
uaacucuuuccuggcuuaaggugcuguagccacuguaucugucucaguuaaguucug

SEQ ID NO: 157690 - RNA, 46 nt, Homo sapiens
gaagccacaguaucacuuaaauaugguuaagacucaaaugcagaaa

SEQ ID NO: 157691 - RNA, 27 nt, Homo sapiens
gucugugacccgucguccuagauuuca

SEQ ID NO: 157692 - RNA, 82 nt, Homo sapiens
ccuuccagaaagcugggccccagauggaagagcuggaaaugugucaacuguucucugaagggcauugagaaaauacugucag

SEQ ID NO: 157693 - RNA, 45 nt, Homo sapiens
acuaaucagacaggacgaccaucaauuucacaaagaaaauguccu

SEQ ID NO: 157694 - RNA, 51 nt, Homo sapiens
ccuagcagaagaaauaacuggucacuaauccuuuggguauagucagagugu

SEQ ID NO: 157695 - RNA, 46 nt, Homo sapiens
ucagagcugguagacaauuauuuccccaagacucuagaaucaagaa

SEQ ID NO: 157696 - RNA, 43 nt, Homo sapiens
guugcucauggaggugcacggaaaugggaagaggcccagucca

SEQ ID NO: 157697 - RNA, 45 nt, Homo sapiens
gaagaacucaacuacuggaaaagacgguacaaugaaaacacagag

SEQ ID NO: 157698 - RNA, 29 nt, Homo sapiens
guaauuuguaaaaaugcugccuuuccucc

SEQ ID NO: 157699 - RNA, 64 nt, Homo sapiens
ucaggccaugucagaaguacagaaggccgucgcugaggcagagcagaaagccuuugaagugauu

SEQ ID NO: 157700 - RNA, 45 nt, Homo sapiens
auuuugcuugugcagaaaauaguuuccagcacauggauugaucug

SEQ ID NO: 157701 - RNA, 46 nt, Homo sapiens
uuuaucaucaggcacacaacuucuguuuccuucucuuguguuaucu

SEQ ID NO: 157702 - RNA, 34 nt, Homo sapiens
uuuuaaaaucuccaguggccauaaaacuagccag

SEQ ID NO: 157703 - RNA, 44 nt, Homo sapiens
acacugaagcucaguuugcaaaccuucugcuguguuaauucugg

SEQ ID NO: 157704 - RNA, 98 nt, Homo sapiens
caugaagcagggggugucugcaccccaugugccuggaacuggccucucuggaaagccagcugcaccaacuggucagugcccuguggggaccaggccca

SEQ ID NO: 157705 - RNA, 36 nt, Homo sapiens
acuugggccugguggaagggcucucagcccagggau

SEQ ID NO: 157706 - RNA, 46 nt, Homo sapiens
uaucuccaugaaaucuucccaaaaaauuccuuuuuggguauuugag

SEQ ID NO: 157707 - RNA, 40 nt, Homo sapiens
cuucaguccugcugcaucugcccccaaaagagggcauccu

SEQ ID NO: 157708 - RNA, 93 nt, Homo sapiens
acaggaccagcuugggccaaucacuguaugggcaggaggugcagccccauggaagaacaugguuacccugauuguaaccauguggaugguagg

SEQ ID NO: 157709 - RNA, 46 nt, Homo sapiens
ccaaaauaaggacuuuauugaaaggaucuuacauguuauggauauc

SEQ ID NO: 157710 - RNA, 46 nt, Homo sapiens
ugaugggaagcucucauuugaggaauuccagaauuacuuugccgau

SEQ ID NO: 157711 - RNA, 42 nt, Homo sapiens
gccccccacugaccucagacucccaucucaccuagcuagaug

SEQ ID NO: 157712 - RNA, 45 nt, Homo sapiens
ccucaagccgggcacccaacccuggaugccaccccccagcgggua

SEQ ID NO: 157713 - RNA, 39 nt, Homo sapiens
ggcggggggccacagggaggggacccugacaauaaagag

SEQ ID NO: 157714 - RNA, 42 nt, Homo sapiens
uuuaagaaugaggggugggcccuacuacaauacaaaaguggg

SEQ ID NO: 157715 - RNA, 79 nt, Homo sapiens
ucagcuuccaaauccuuguccucaguuggcucuggcuccacuucuuuuguuucugaaggcuggguuuccucuguuuggg

SEQ ID NO: 157716 - RNA, 45 nt, Homo sapiens
cuucuucuucuucuuuuucuucuugcucauaguaggaucaaaaau

SEQ ID NO: 157717 - RNA, 43 nt, Homo sapiens
aaguuuuaacgagggcguuauaccaagccaagagaggcuccuc

SEQ ID NO: 157718 - RNA, 80 nt, Homo sapiens
guccccagacauggcugcggcucgagugggcucggcacggacgggaagucagacgggucagccccaggccccggcggcag

SEQ ID NO: 157719 - RNA, 54 nt, Homo sapiens
ccaccgcacuaggcucuugcaucagcgaaaggaaacgacaccccgcccucuccu

SEQ ID NO: 157720 - RNA, 78 nt, Homo sapiens
gguuagaauagacuguuaaggggcaacugagaaagaacagagaagugacagcuagggguugagaggggccagaaaaac

SEQ ID NO: 157721 - RNA, 139 nt, Homo sapiens
ucaguugccccuuaacagucuauucuaaccccuguaaaacagggacuaaaaguacuaaccucauuguaaugagguuuaagagaaggcccagcacuaagccaggcucucaggaaaauucaaacaacaguuccucuuugcc

SEQ ID NO: 157722 - RNA, 45 nt, Homo sapiens
cugucaugggcugaagaaccacuggaccuguaaaccaagcacaca

SEQ ID NO: 157723 - RNA, 63 nt, Homo sapiens
cuccacuacugacuuccaggcuaaggaaggacugacuuagugagcuguuccaagaccacugag

SEQ ID NO: 157724 - RNA, 67 nt, Homo sapiens
auacuguuccaaauguggcagcgggaacagaguacccucuucaagccccggucaugauggagguccc

SEQ ID NO: 157725 - RNA, 55 nt, Homo sapiens
ugacggcugcagcagaggccaaaaacuaagugaucagccccagagagucgauggg

SEQ ID NO: 157726 - RNA, 45 nt, Homo sapiens
ugcccaggccccaccucuccucccuaagagcuaauggcaccaacu

SEQ ID NO: 157727 - RNA, 83 nt, Homo sapiens
ggggccugggcaaggacagcagcuggagggugaaacgcagaccuggcucucaguagcgguagugauccggcuugaaggggcca

SEQ ID NO: 157728 - RNA, 46 nt, Homo sapiens
gggcauguccugugauggccccuucaagccggaucacuaccgcuac

SEQ ID NO: 157729 - RNA, 73 nt, Homo sapiens
ccuuuugaggggggcugggcagccaaaacaacacauuaacugaggcugggugugaggauagaaagaguuaaca

SEQ ID NO: 157730 - RNA, 57 nt, Homo sapiens
cugugcauagaucaauuccagagaagcauuuugguuagcugcuugaguugaagaaug

SEQ ID NO: 157731 - RNA, 44 nt, Homo sapiens
uugaagaaugggcgccgcaucauccugcuggccgagggucggcu

SEQ ID NO: 157732 - RNA, 46 nt, Homo sapiens
ugcuggcugccagggaggagagcugaggagaugguggcaaccugug

SEQ ID NO: 157733 - RNA, 62 nt, Homo sapiens
acguggagaucgaugucaaguggcucaacgagaacgccguggagaaggugaacaucaagccg

SEQ ID NO: 157734 - RNA, 46 nt, Homo sapiens
ccaaggaugaugucaauacagccugugguggugacaaagauguugc

SEQ ID NO: 157735 - RNA, 46 nt, Homo sapiens
agugcguugauggggucaaucucggugaugaugacgcgggcuccga

SEQ ID NO: 157736 - RNA, 47 nt, Homo sapiens
auggcugccgggagucccucauagauggcaucaagcgggccacagau

SEQ ID NO: 157737 - RNA, 47 nt, Homo sapiens
ucaucacaucuguggcccgcuugaugccaucuaugagggacucccgg

SEQ ID NO: 157738 - RNA, 43 nt, Homo sapiens
cuucuucagaggccucguccugagcugcagccacuguagcggg

SEQ ID NO: 157739 - RNA, 44 nt, Homo sapiens
cucaaggugccugccaucaaugucaaugacuccgucaccaaggu

SEQ ID NO: 157740 - RNA, 45 nt, Homo sapiens
caccuugaggaucccauuggccaucaucuuguagagguuguggac

SEQ ID NO: 157741 - RNA, 41 nt, Homo sapiens
augcggcggcugccauugccaaggcuggcauuccggguaag

SEQ ID NO: 157742 - RNA, 92 nt, Homo sapiens
ggcccuggacauugcugagaacgagaugccgggccugaugcguaugcgggagcgguacucggccuccaagccacugaagggcgcccgcaucg

SEQ ID NO: 157743 - RNA, 24 nt, Homo sapiens
ugggccuccuacagggacggcgag

SEQ ID NO: 157744 - RNA, 44 nt, Homo sapiens
ccggggccgccgcgcggucugcgagccgcaaacuggcggcgugc

SEQ ID NO: 157745 - RNA, 37 nt, Homo sapiens
ggggagggagagcaggaauaagggcaguggggagaau

SEQ ID NO: 157746 - RNA, 24 nt, Homo sapiens
gccucccagcuguuuggaucacag

SEQ ID NO: 157747 - RNA, 43 nt, Homo sapiens
ucuuccuccuaccccuggaugcugcccuugaacaggagccugg

SEQ ID NO: 157748 - RNA, 42 nt, Homo sapiens
ccucaucgagcaccccagcauguccguuuacgucaccggcag

SEQ ID NO: 157749 - RNA, 46 nt, Homo sapiens
ggccaagaggcuggggccgggguuggaggcuugaggagcguggcug

SEQ ID NO: 157750 - RNA, 45 nt, Homo sapiens
cacgcgcugagcgccaaggcggugcagcggcagaaccgagcccgc

SEQ ID NO: 157751 - RNA, 44 nt, Homo sapiens
uuuaaaaggccuuuuguuuaccuauauuucuggaggcuccugua

SEQ ID NO: 157752 - RNA, 45 nt, Homo sapiens
uugagugcaucccuguuggguguuuuguguugagacuggcugaaa

SEQ ID NO: 157753 - RNA, 34 nt, Homo sapiens
aagaggucuaaggucggaggaggagucuaaaauc

SEQ ID NO: 157754 - RNA, 59 nt, Homo sapiens
ucuucugccuuuagaucgggccggugucggggcauguaggccagugagacuggagccag

SEQ ID NO: 157755 - RNA, 52 nt, Homo sapiens
ugggaccuaaggagaucuccauaacauuuugcaugugagggaacuggcccag

SEQ ID NO: 157756 - RNA, 63 nt, Homo sapiens
ccauccuuggggguuucaagcuggggggaaggagagguggagggcucugcuugaggggugagg

SEQ ID NO: 157757 - RNA, 52 nt, Homo sapiens
uuagucgggaggccccuggggcuuggagcagggccacugcauggagacuaga

SEQ ID NO: 157758 - RNA, 23 nt, Homo sapiens
augggaucugggccagagggggc

SEQ ID NO: 157759 - RNA, 62 nt, Homo sapiens
gcugugcaucaacuucaccaaugagaaauugcagcaguucuucaaccagcacauguuugugc

SEQ ID NO: 157760 - RNA, 31 nt, Homo sapiens
accccuucccccugccugcugcuccaggugg

SEQ ID NO: 157761 - RNA, 50 nt, Homo sapiens
caggaacgaguccccugcuacccacacgagccuccucagucccugacuuc

SEQ ID NO: 157762 - RNA, 44 nt, Homo sapiens
gcuggcggacgcaagcacgcagcgugggcgacuacagacggaaa

SEQ ID NO: 157763 - RNA, 42 nt, Homo sapiens
ccaaugccgagguggcccaguggaggagcaaguacgaagcag

SEQ ID NO: 157764 - RNA, 91 nt, Homo sapiens
gcugcgcuggacaagaagcagcggcacuuggaacgggcacuggaggaacggcggcggcaggaggaggagaugcagcgggagcuggaggcgg

SEQ ID NO: 157765 - RNA, 46 nt, Homo sapiens
acggccacgaggaggcacuugaagcccuggagacgcucaagcggga

SEQ ID NO: 157766 - RNA, 65 nt, Homo sapiens
agcaacuuugaguuaugggggugcccugguggggccacccuggaaucaggggugaguggagugac

SEQ ID NO: 157767 - RNA, 40 nt, Homo sapiens
ggaacuggagaaaaccaagaaggcgcuggaaggcgagaag

SEQ ID NO: 157768 - RNA, 41 nt, Homo sapiens
agacacgggcccgcaaugaggcgcugcggcucaagaagaag

SEQ ID NO: 157769 - RNA, 25 nt, Homo sapiens
gcgggacgaggagcagcggcuggca

SEQ ID NO: 157770 - RNA, 37 nt, Homo sapiens
gcauucgcagguggggacaggagucccuggggacaga

SEQ ID NO: 157771 - RNA, 45 nt, Homo sapiens
ggcccagcugagcggggagguggaggaggcugcacaggagaggcg

SEQ ID NO: 157772 - RNA, 72 nt, Homo sapiens
auggccgaggagcugaagaaggagcaggacacaagugcacaccuggaacggaugaagaagacgcuggagcag

SEQ ID NO: 157773 - RNA, 42 nt, Homo sapiens; identical to SEQ ID NO: 72488

SEQ ID NO: 157774 - RNA, 26 nt, Homo sapiens
agcuggaugaugcggaggagcgggca

SEQ ID NO: 157775 - RNA, 57 nt, Homo sapiens
ggagugacggccugacccccugggcucuaaagaggaaugucugcuguugcacaucug

SEQ ID NO: 157776 - RNA, 107 nt, Homo sapiens
cugccugagccuggacauggggcccuuccuuguguugccaauuuauuaacagcaaauaaaccaauuaaauggagacuauuaaauaacuuuauuuuaaaaaugacugc

SEQ ID NO: 157777 - RNA, 45 nt, Homo sapiens
ucuauguccauguagggcuccucaauguagcuaacgagagcagag

SEQ ID NO: 157778 - RNA, 45 nt, Homo sapiens
ugcggcugcugcagcggauggagcacagcaagaaguaccccggcu

SEQ ID NO: 157779 - RNA, 45 nt, Homo sapiens
gucagcugccucaacaccagccuggugauccugaugcuggcccga

SEQ ID NO: 157780 - RNA, 42 nt, Homo sapiens
cuguccuuggagccaccagcauccucagacaagaaucuagac

SEQ ID NO: 157781 - RNA, 40 nt, Homo sapiens
uuuccuuuauugaauaauggucuucagaaaaaguaaaacu

SEQ ID NO: 157782 - RNA, 46 nt, Homo sapiens
gggcuuauuaacucgucugcugcaggucaugaagaaggagccagca

SEQ ID NO: 157783 - RNA, 28 nt, Homo sapiens
gcugcagcagggccaggcuugaguguga

SEQ ID NO: 157784 - RNA, 44 nt, Homo sapiens
uacaguuuuugaggcuucuucagagcuucagugaccaccacgag

SEQ ID NO: 157785 - RNA, 105 nt, Homo sapiens
uggccugccucacacgucagccagaacccagcugccccagucaaugaagauuaugcaugagaucauguacaaacuggaagugcucuauguccucugcgugcugcu

SEQ ID NO: 157786 - RNA, 32 nt, Homo sapiens
ggaacuggugagcuacaaguuacaguugccaa

SEQ ID NO: 157787 - RNA, 57 nt, Homo sapiens
uccauaaacauaaaagagaagauguuuaacuugauuggcaaucaaggaaaugcaaau

SEQ ID NO: 157788 - RNA, 53 nt, Homo sapiens
augacaaguaagaagacauucuuacaaacagcaacccucauugaagauauuuu

SEQ ID NO: 157789 - RNA, 44 nt, Homo sapiens
gagaaggagaccuagcauuuuagcauuccuagcagcuuaggagu

SEQ ID NO: 157790 - RNA, 45 nt, Homo sapiens
auuuagcuacagguugcucucuccucccccagcuaagcagcuguc

SEQ ID NO: 157791 - RNA, 46 nt, Homo sapiens
uuguagaaauucuuaugaggccuacgaucucuauccggggacagaa

SEQ ID NO: 157792 - RNA, 45 nt, Homo sapiens
guggaaacuguaaaugucuagaaaugucauauuugcuaaacaggu

SEQ ID NO: 157793 - RNA, 49 nt, Homo sapiens
uuuucauaaaaaguuugaaggauacucaagaaacugauaaagugguugg

SEQ ID NO: 157794 - RNA, 25 nt, Homo sapiens
ccugcuccucucucuugcuugggca

SEQ ID NO: 157795 - RNA, 61 nt, Homo sapiens
ugaggaccgucugggaggggcggagucugggcagaggaggauggaaggaggccaggagaug

SEQ ID NO: 157796 - RNA, 97 nt, Homo sapiens
caauguugucaacauccugaaguugaggcuccggaccuggguuccuggcucgggccggcugcgggcuccgcuggcugcagucuagggaaaagagaag

SEQ ID NO: 157797 - RNA, 55 nt, Homo sapiens
uucccgucuccccuagauguaccccuaucuaccaucacccucaguuccccuuucu

SEQ ID NO: 157798 - RNA, 58 nt, Homo sapiens
aaccauagugagcacucauugaauacugguuauuauuugcugccucucugagggggag

SEQ ID NO: 157799 - RNA, 78 nt, Homo sapiens
agaucuccuacuuccgcgaccccuaucacgugugguaccagggcaacgcgucgcuggggggacaccuaacgcacgugc

SEQ ID NO: 157800 - RNA, 41 nt, Homo sapiens
ugcagcugaaugaucgugguguuggugucugggccuuccag

SEQ ID NO: 157801 - RNA, 89 nt, Homo sapiens
uggaaggcccagacaccaacaccacgaucauucagcugcagcccuugcaggagcccgagagcugggcgcgcacgcagaguggccugcag

SEQ ID NO: 157802 - RNA, 42 nt, Homo sapiens
agcucgguggcgccugggccuuugaagauugcuggguggggg

SEQ ID NO: 157803 - RNA, 45 nt, Homo sapiens
gguggggggugaagugcugggggcugugggaagggaaggacggag

SEQ ID NO: 157804 - RNA, 59 nt, Homo sapiens
aauuggggucuuugagaagaaggaguuaggguugugacggggaaggaguggggcuuuga

SEQ ID NO: 157805 - RNA, 46 nt, Homo sapiens
gagccuuguggcaggcagacacccaggucaccuccggaguggucac

SEQ ID NO: 157806 - RNA, 37 nt, Homo sapiens
uuaauuacucuccagcccccucagaaggggcuggauu

SEQ ID NO: 157807 - RNA, 42 nt, Homo sapiens
aacguguaugcuuugcugaauuagucugauaagugaauguuu

SEQ ID NO: 157808 - RNA, 56 nt, Homo sapiens
aacauucaauacuuccaggugugucagacuugggaugggacgcugauauaauaggg

SEQ ID NO: 157809 - RNA, 45 nt, Homo sapiens
gggaccaggaagugggggaagggaggccaggaagagguggauaca

SEQ ID NO: 157810 - RNA, 66 nt, Homo sapiens
ccucuccccacgucccugcgucucuuacacccccucccacccgaggcuccccagagauagcagaga

SEQ ID NO: 157811 - RNA, 38 nt, Homo sapiens
guggguuccgggagacccgcgggucuggcugcgagagg

SEQ ID NO: 157812 - RNA, 42 nt, Homo sapiens
uguguguguguguguguguguguguguacacaagaaucuuga

SEQ ID NO: 157813 - RNA, 54 nt, Homo sapiens
gucugagggaacccaacucaggggcacccccaguacccagggcucgggacagga

SEQ ID NO: 157814 - RNA, 48 nt, Homo sapiens
aggacaccacacccguaucacugcaaucaccaccuccugguagagcga

SEQ ID NO: 157815 - RNA, 45 nt, Homo sapiens
aagugaaggaggugacucagauguuccccaagguuggaguucuua

SEQ ID NO: 157816 - RNA, 35 nt, Homo sapiens
aacaaagucaccuuugucacucccagugaacugaa

SEQ ID NO: 157817 - RNA, 44 nt, Homo sapiens
uggccugcaggagcugucuagggagggcguguaggggagacgug

SEQ ID NO: 157818 - RNA, 43 nt, Homo sapiens
uagaggacaacagaggcauacauauguuuaaagcgugagugcc

SEQ ID NO: 157819 - RNA, 42 nt, Homo sapiens
guagguuaaucccuauauccugaagaagaacaugauccucau

SEQ ID NO: 157820 - RNA, 34 nt, Homo sapiens
cucccuccucccccucacucuccucugucaaacu

SEQ ID NO: 157821 - RNA, 51 nt, Homo sapiens
agucugagugacuguaacacaucuaccucccagcccaugacaggugcuucg

SEQ ID NO: 157822 - RNA, 295 nt, Homo sapiens
aucugaaaagcauuucuagcuguggcaguuugccauugucucagcuagaggugaagggagaggcagcuuacaggucacuggaguuagaauauaggaccaggaagucaaggagccuugcuaguaaggaacucuacucuugcacuccguuuuuccugggcaguagccaaccagaaugcagguguaucccaagaggagaaaauguguuuguauguuugugggccuugcuggaaagcaagaacugagguuugcagaugaauguguugaugaucucuggaaaugcccugcagaugguaaa

SEQ ID NO: 157823 - RNA, 50 nt, Homo sapiens
gcagggcugaguguaaugggaggaugaggcaggagaguaggugagcccca

SEQ ID NO: 157824 - RNA, 48 nt, Homo sapiens
cuuauuuuggagccuuugaggacaauuuaaaacgauaugugugaagug

SEQ ID NO: 157825 - RNA, 48 nt, Homo sapiens
uaucaggaugcuguauuuggacauuuucaauagcaccuagcauaagcu

SEQ ID NO: 157826 - RNA, 56 nt, Homo sapiens
uggggagcucuucuuucuccaagucuggcauuuucuuccuuggccuccaaaauggg

SEQ ID NO: 157827 - RNA, 42 nt, Homo sapiens
augaauaauaaauuugcaucaaaaacuccuuugaaauuagaa

SEQ ID NO: 157828 - RNA, 45 nt, Homo sapiens
ugggaaguacaugugucguaucauaguucauuuuaugugggagga

SEQ ID NO: 157829 - RNA, 511 nt, Homo sapiens
uugcgguagaguuuuauauagcauuucuucaaauuacauuguucuguucaaugucacuuuguuauaacagugaugaggagaaaaauaacaauucccaucuggggccacugccuguguggaguuugcauguucugucccugucuagguggguuuucucuggguccuccuguuuccuuccacaucccaaagaugugcacagaaggugaauuagcaugucuaaauuguccuuauuggagugggugugggugugagugugccgugccauaauguaugcauagcucacauuauuucaguguuuaauauuggaagucuuuugggucuuuauuuagaaguuuagugauguuuuugugaccagaaauauacuguaggaauauaacucuuguuuaugucacuuagccuaugguaaaauagguuucguaaguuguuaagcuuacaguuacaguuuccaagaaucuaucugugauguuaaaugaagaguuacaauauuuaguguucugcaucaauaaaaggu

SEQ ID NO: 157830 - RNA, 30 nt, Homo sapiens
guuugauccuaaacagaguaguagcuucug

SEQ ID NO: 157831 - RNA, 80 nt, Homo sapiens
cuuugcuagcugcguuauuugccuuucuuauauguaaaagagaucaguauuauguaugagccacuggaaucacugagaga

SEQ ID NO: 157832 - RNA, 36 nt, Homo sapiens
gucuccaugcuugccuuuuagagauauuugcacgcc

SEQ ID NO: 157833 - RNA, 74 nt, Homo sapiens
agaggcaaagaaguuauuguaaacuacuuuucaagaaguuucaaaugaggggaugaucgcuugagggaaaaaca

SEQ ID NO: 157834 - RNA, 47 nt, Homo sapiens
agagggaguggauggcaaaauaaaauaaaauauauaaucccugugac

SEQ ID NO: 157835 - RNA, 44 nt, Homo sapiens
ugugggaacuagggaauaguucucaagaagcucacagucuagug

SEQ ID NO: 157836 - RNA, 38 nt, Homo sapiens
agggaguguuugccuagcuuuucagaauucaagcccau

SEQ ID NO: 157837 - RNA, 46 nt, Homo sapiens
agccagucccgagcaugugguggaucagaacagauuccuggaauag

SEQ ID NO: 157838 - RNA, 43 nt, Homo sapiens
acagcagggagagcgugcccgggcacgacagccuggugcacag

SEQ ID NO: 157839 - RNA, 42 nt, Homo sapiens; identical to SEQ ID NO: 72584

SEQ ID NO: 157840 - RNA, 36 nt, Homo sapiens
cucuacguggacaagucgcggggagauaaacugaag

SEQ ID NO: 157841 - RNA, 47 nt, Homo sapiens
gccggagaacagcagcuggauguggaacacaaccuguucaagcaacg

SEQ ID NO: 157842 - RNA, 46 nt, Homo sapiens
ggugacgguguuugacccugacucccuggacccugaucgcugugag

SEQ ID NO: 157843 - RNA, 59 nt, Homo sapiens
cugggccuucaagaacccagauacuauugagcagugccggcgagagggcuucagccaga

SEQ ID NO: 157844 - RNA, 56 nt, Homo sapiens
gcagaauguuaauaugcuguuggaaauuaucgacuaaagagcauaagugaugcucc

SEQ ID NO: 157845 - RNA, 40 nt, Homo sapiens
ccucaguugagaaugaggagagagggaaggagguguugga

SEQ ID NO: 157846 - RNA, 149 nt, Homo sapiens
gcagcccuagggccucccuggaguccgcggcugugaaugcaaagagagcggucagcaugguugucugugugggaauggacucagucaacagaacauugcaauugcaugggguuugguguugccaggugccugcaaaggugagggaguca

SEQ ID NO: 157847 - RNA, 46 nt, Homo sapiens
gcaccugucauuuggggaggacuauccaggcauugugaacccccug

SEQ ID NO: 157848 - RNA, 46 nt, Homo sapiens
cuuugugaagguggugcccacuguguacaugaagguggacggagag

SEQ ID NO: 157849 - RNA, 44 nt, Homo sapiens
ggcuggacucaucgauucgcucaucuaccacucagcacgagcca

SEQ ID NO: 157850 - RNA, 43 nt, Homo sapiens
ccagccucugccacccuccaccuccucggucagccccagcccc

SEQ ID NO: 157851 - RNA, 44 nt, Homo sapiens
ggcuaucucuucauauugacugcagacagacugaauggacaguu

SEQ ID NO: 157852 - RNA, 50 nt, Homo sapiens
cuucgucuucugcugcugcucggcuggaccagcuucuuuaacagcaagca

SEQ ID NO: 157853 - RNA, 47 nt, Homo sapiens
aaccagacaccuuguuacaccuaguggaugcucuagauugguauaga

SEQ ID NO: 157854 - RNA, 42 nt, Homo sapiens
gauuuagcgcacucuucuaucaggucagugaguugagcugca

SEQ ID NO: 157855 - RNA, 46 nt, Homo sapiens
cuuagugguggggcugggggcugcgugugagguggcacagcaagag

SEQ ID NO: 157856 - RNA, 47 nt, Homo sapiens
ccucaccaacauuuuguguugucacuguuuuuaguuaacuauucaga

SEQ ID NO: 157857 - RNA, 45 nt, Homo sapiens
ucacuggaagcugagggcuuucaggucaccuaccucccagugcag

SEQ ID NO: 157858 - RNA, 46 nt, Homo sapiens
gacccccgggugcuugaugccaugcucccuuaccuaaucaacuacu

SEQ ID NO: 157859 - RNA, 45 nt, Homo sapiens
ugggcauggcggccggggcgcucuucggcaccuuuuccugucuca

SEQ ID NO: 157860 - RNA, 47 nt, Homo sapiens
cugauauuuuuguuaccaaauagcuccaucuugguuuccuccucagg

SEQ ID NO: 157861 - RNA, 109 nt, Homo sapiens
gcuuugaaacaaccuuggaaauaguggagaaaagcaaaaaaaagguggaaaaaauaaacucuugcuucccuuggcaugggaucaguuuugugccccgaauuuaaucagc

SEQ ID NO: 157862 - RNA, 51 nt, Homo sapiens
auuugaucaucuagaaacucucuucccccuucaguggaauaggaaacugag

SEQ ID NO: 157863 - RNA, 32 nt, Homo sapiens
ugacuguggccgcagcugagugcggcugcccc

SEQ ID NO: 157864 - RNA, 35 nt, Homo sapiens
ccccgcagcucaucucuucaucuugguuuugccac

SEQ ID NO: 157865 - RNA, 37 nt, Homo sapiens
cgaucccgacuuucuugguagguuuggccaugucacc

SEQ ID NO: 157866 - RNA, 45 nt, Homo sapiens
ucucucugguccucuuccuccccaucuaccaaaaggggagaugag

SEQ ID NO: 157867 - RNA, 54 nt, Homo sapiens
cgagagagaaugcagucagaggcacacaagaggcacgaggagggccauggaagg

SEQ ID NO: 157868 - RNA, 42 nt, Homo sapiens
ggcucugaaggccaacuaagaaguccucucugacccucaacc

SEQ ID NO: 157869 - RNA, 39 nt, Homo sapiens
cugaacaguuaaggagaggagcagcaacaggcaaaugag

SEQ ID NO: 157870 - RNA, 34 nt, Homo sapiens
gcucgcugggugcguggaacugggccggccgucg

SEQ ID NO: 157871 - RNA, 46 nt, Homo sapiens
cccuggagcugggcaggccagaugccuccuucucagugcaccucau

SEQ ID NO: 157872 - RNA, 24 nt, Homo sapiens
cccagcccucaguguuucuugcau

SEQ ID NO: 157873 - RNA, 49 nt, Homo sapiens
ugcuuuaucuccuuuaauccuuaauagcauuuacacugucccucucucu

SEQ ID NO: 157874 - RNA, 44 nt, Homo sapiens
agcgggccacauccaaugucuucgcaauguuugaccagucccag

SEQ ID NO: 157875 - RNA, 46 nt, Homo sapiens
ucucauagccucucuggucccagugacuuccucaggaucaggaccu

SEQ ID NO: 157876 - RNA, 42 nt, Homo sapiens
ccauguuuggggagaagcugaacggcacggaccccgaggaug

SEQ ID NO: 157877 - RNA, 69 nt, Homo sapiens
acacccugaccggccacugccgcacacccacccagagcacgccacccgccaugggagugugcucaggag

SEQ ID NO: 157878 - RNA, 62 nt, Homo sapiens
cuaaguggccucaguuuccccucgaagcaacgggaccaaucgcaccgccggcaggacaucuu

SEQ ID NO: 157879 - RNA, 44 nt, Homo sapiens
aaaguuuguuuucucccuccgggcgggugggggagggcgcagag

SEQ ID NO: 157880 - RNA, 41 nt, Homo sapiens
gggaguugucagaaaguucgugcgggaguggcugcaggugg

SEQ ID NO: 157881 - RNA, 54 nt, Homo sapiens
agcugugcgugugcgugcuguaugcgucggugaaaacccuaggguuuguaaggc

SEQ ID NO: 157882 - RNA, 44 nt, Homo sapiens
ccaugucggacagugaucuaggugaggacgaaggccuccucucc

SEQ ID NO: 157883 - RNA, 40 nt, Homo sapiens
agaaaggcucuaaaguuacagauccugacucagauuccau

SEQ ID NO: 157884 - RNA, 62 nt, Homo sapiens
cgauggauuuuuuuuuucuuuuuuuucuuuaguguuuuucccuuuguucuugaacacuuuug

SEQ ID NO: 157885 - RNA, 42 nt, Homo sapiens
aauucugguuggcauuuccccauuauguaaaaugggguguug

SEQ ID NO: 157886 - RNA, 46 nt, Homo sapiens
cuggcagauuguucuugaggagacaaaugaagggacuucgacugaa

SEQ ID NO: 157887 - RNA, 49 nt, Homo sapiens
cucugaucuagucacugaagucauccuaggugguaaacucugaaaauag

SEQ ID NO: 157888 - RNA, 46 nt, Homo sapiens
acauacccuaccuuacuucccaguuacuuuguguuuaacuaguccc

SEQ ID NO: 157889 - RNA, 53 nt, Homo sapiens
uccuucccaaccuggcucaaauaugaagcuuucacaucacuuaucuuuggcag

SEQ ID NO: 157890 - RNA, 45 nt, Homo sapiens
uuuguauuccuagugacugucaggaacaacugccuggaaggcagg

SEQ ID NO: 157891 - RNA, 50 nt, Homo sapiens
auacucccugaucagggugaagcggucuccaccuucuacgucacggucac

SEQ ID NO: 157892 - RNA, 44 nt, Homo sapiens
uuuuuguuuuuaauguagaaaugagacaaggguacaaauuggaa

SEQ ID NO: 157893 - RNA, 44 nt, Homo sapiens
auacuaugaaaagcauuaccuugccuauuuuuaauauuauuaaa

SEQ ID NO: 157894 - RNA, 46 nt, Homo sapiens
auccaauugaucauguuagcuucuauuguaagacugcccccaacag

SEQ ID NO: 157895 - RNA, 45 nt, Homo sapiens
cuuccaaaagagguugccagugcuaaacccaaaguauugcuagac

SEQ ID NO: 157896 - RNA, 48 nt, Homo sapiens
gccaggauucaaaagccaggucuaacuuaacuccaaaucuuugaucuc

SEQ ID NO: 157897 - RNA, 51 nt, Homo sapiens
aaucuauucaaguaugugggugagacgcagccaacaggacaaauaaagauu

SEQ ID NO: 157898 - RNA, 47 nt, Homo sapiens
aaguuggaaaucuguaugacauguuccacacucgcaacucuuuacac

SEQ ID NO: 157899 - RNA, 46 nt, Homo sapiens
uauaaaggaacaaauuguaggaccacuugaaucaccugucgaagau

SEQ ID NO: 157900 - RNA, 46 nt, Homo sapiens
ucaguuaugauguuugagcaccuuauuaauucuaauggaauuaagc

SEQ ID NO: 157901 - RNA, 45 nt, Homo sapiens
gacgauuuauuccacuugcucgcccggaggugaaauggacgguau

SEQ ID NO: 157902 - RNA, 63 nt, Homo sapiens
cugcagauaagugaacgagauguucucuguguucagauugcuggacuuugucaugaucucggu

SEQ ID NO: 157903 - RNA, 48 nt, Homo sapiens
uaucuagcaggaugucuaguucacgcacugggugaaaaacaaccagag

SEQ ID NO: 157904 - RNA, 59 nt, Homo sapiens
aaccagaucauuuucuuaccugucaggaaaugcguaaguuaaaaaagcauucauaaucu

SEQ ID NO: 157905 - RNA, 48 nt, Homo sapiens
uccacccucuccucguccgaaucauugauacaccucaauuucaacguc

SEQ ID NO: 157906 - RNA, 45 nt, Homo sapiens
aaugauagacuugcuuauccuauuguaauuuuaguuccuuggggg

SEQ ID NO: 157907 - RNA, 47 nt, Homo sapiens
aggcgcauuacugccuugucuugaugagucucguuuugaaaaucuug

SEQ ID NO: 157908 - RNA, 64 nt, Homo sapiens
ggcuagguuggaaacugggguaggaggaacauuagugguucaggacccaaagauagcuugaaug

SEQ ID NO: 157909 - RNA, 47 nt, Homo sapiens
gcagcuccuugaacacuugccacaucagaggauguucuggggcuuuu

SEQ ID NO: 157910 - RNA, 43 nt, Homo sapiens
gggggcgccgaggaaaggaagacccgaggcgggggagggagcc

SEQ ID NO: 157911 - RNA, 55 nt, Homo sapiens
cugcugaagaacauccgagguagcggcuccggaggggcugaggggcgaagggcgg

SEQ ID NO: 157912 - RNA, 48 nt, Homo sapiens
gagcuccggaggaaaaacggacuuuuuuugaggagaaaagcggaggca

SEQ ID NO: 157913 - RNA, 65 nt, Homo sapiens
uacuccccaugcgagccucuccauaggacugcuugagugucuucacaacauggauuccccaugag

SEQ ID NO: 157914 - RNA, 42 nt, Homo sapiens
gcucaucugugugcuggccaucaucguacccauucccaaguc

SEQ ID NO: 157915 - RNA, 44 nt, Homo sapiens
gugcaugggcugaguguugaccagcaugugggaguugauacgau

SEQ ID NO: 157916 - RNA, 65 nt, Homo sapiens
guugucauuguuuuaggaaaaucgacucugaaaggaacguaaaguaaacucugacgagcaugggg

SEQ ID NO: 157917 - RNA, 55 nt, Homo sapiens
ccucucgaguagcugggaggacaagcaugugccaccacgcccagcuguuguuauu

SEQ ID NO: 157918 - RNA, 44 nt, Homo sapiens
cuggagucucccuuccuuaucagcacaaugaacgccagggcuag

SEQ ID NO: 157919 - RNA, 251 nt, Homo sapiens
gaggaagcccaaggcugcuguuccuucugugaacaagaggcccaagaaagagacuaagaagaagcgguagaagaggaggccugaggagcugggcgggcagggagagggucuuggggacagcccuccugggaaucuacauuguguucccccgcauuccaggcucagggucugaggaggcugugacgcccuaugaccgcagagaucuagacagucguaacaguccccaggcuccagcugggcaauccaccacu

SEQ ID NO: 157920 - RNA, 43 nt, Homo sapiens
ugccugcuucugcuccaucaggugcaggggauuuggcugaagg

SEQ ID NO: 157921 - RNA, 50 nt, Homo sapiens
ucccuucaauucuuucauucccugaccagugagaggguuccugggggaag

SEQ ID NO: 157922 - RNA, 42 nt, Homo sapiens
auagacguuuuagaugcaaacacacaauguauauacacugcg

SEQ ID NO: 157923 - RNA, 66 nt, Homo sapiens
aggcacuucucagaaaaaauaaaaauuacuucgcaaaaaaaaaaaacccuacaacgaauuagagaa

SEQ ID NO: 157924 - RNA, 53 nt, Homo sapiens
uaugggauaagaggugcagcguggcgccuucuucacccagcuuaaugcugcag

SEQ ID NO: 157925 - RNA, 43 nt, Homo sapiens
gaagcacaaaguaccuugcccccuuaagccugaucauguuucc

SEQ ID NO: 157926 - RNA, 46 nt, Homo sapiens
cauaucaucuuggcaaagcccuuuuccuccauccguccaucagcag

SEQ ID NO: 157927 - RNA, 44 nt, Homo sapiens
augacaggccucucacaagcugggcacccugccguggaacccgg

SEQ ID NO: 157928 - RNA, 77 nt, Homo sapiens
cuugggacaggcaaacaaacgcagaugggcuuucuuccuaagaagccaagaagaaggcauuuuguaagaaagcuuag

SEQ ID NO: 157929 - RNA, 45 nt, Homo sapiens
gaacugcacguucucagcacuauaaaagugacuuuaucacaguca

SEQ ID NO: 157930 - RNA, 45 nt, Homo sapiens
agcucagacaucauuugccgugaauacaguggguugcacacagcu

SEQ ID NO: 157931 - RNA, 42 nt, Homo sapiens
uggaauagacagccucuucagcuucuaccacaauaagccaaa

SEQ ID NO: 157932 - RNA, 40 nt, Homo sapiens
uguugcuggaacugugaugcaaugcuagccuagagacaga

SEQ ID NO: 157933 - RNA, 65 nt, Homo sapiens
gucugagacccaccugggagagagcuuccuugccgugcagggauagggcacuaagcaaggcacug

SEQ ID NO: 157934 - RNA, 45 nt, Homo sapiens
uacauguuuauaauacacagguuggaagaagguaggaaauugaau

SEQ ID NO: 157935 - RNA, 45 nt, Homo sapiens
aggaaauucaagauaugaaguagguugugggaaaugcaaggugaa

SEQ ID NO: 157936 - RNA, 42 nt, Homo sapiens
gggagcaucuugggggagauugcucugcaaaagugguaucau

SEQ ID NO: 157937 - RNA, 31 nt, Homo sapiens
ccagaugauugauuugguuuuggccucccca

SEQ ID NO: 157938 - RNA, 43 nt, Homo sapiens
cuucagugucuuaaacacugaugggcaggaaacgccugggugu

SEQ ID NO: 157939 - RNA, 47 nt, Homo sapiens
ugaauaauuuuggcauaucuauguuuaacauuuucucauuggcuuug

SEQ ID NO: 157940 - RNA, 16 nt, Homo sapiens
uauaaguugccccaag

SEQ ID NO: 157941 - RNA, 45 nt, Homo sapiens
acauccuaaacucauaaacuugugacucucugauucuccaucuca

SEQ ID NO: 157942 - RNA, 36 nt, Homo sapiens
cauauauaaucuugcuacucaccugucuuuggcaag

SEQ ID NO: 157943 - RNA, 45 nt, Homo sapiens
uaagagaaaugaagaauuaauuuuuuucuuuuuagaaauuccggg

SEQ ID NO: 157944 - RNA, 53 nt, Homo sapiens
uagguccauauuucuguguaguagaucuaaaagcacacaauaaauaauacauu

SEQ ID NO: 157945 - RNA, 41 nt, Homo sapiens
gugguaaaucuuauuauguagaugaggaaacagguucagga

SEQ ID NO: 157946 - RNA, 44 nt, Homo sapiens
gcggcauuguguaugugaucgacuguggcuuugugaaacuccga

SEQ ID NO: 157947 - RNA, 92 nt, Homo sapiens
guggauuugggugaaaagucacugaaucccuuugcaugagcaguuuaguggaagugggguuggggagggccccugacuguaaugagugcauu

SEQ ID NO: 157948 - RNA, 56 nt, Homo sapiens
aaggacauuucaagaggugccaacagcaagaacagaaacauggaggcugggaagaa

SEQ ID NO: 157949 - RNA, 388 nt, Homo sapiens
cccaguauggggaaagcuaacuaauuauguuuuggaacaaccacuuguucucagccuuccauuuagaaacaggauucuuuuuuuuuuuuuuuuuuuugagacagugucucacucugucgccuagacuagagugcaguggcgcaaucucagcucacuacaaccucugccuccuggguucaguucaagcaauucuugugccucagccuccugaguagcugggauuacaggcaugugccaccaugcccagcuaauuuuguauuuuuaguagagaugggguuucacuauguuggccaggcugguuuugaacuccugaccucaggucaucugcccgccuuggccucccaaagugcugggauuacaggugugagcuaccacaccuggccgagaa

SEQ ID NO: 157950 - RNA, 63 nt, Homo sapiens
ugguaaggaggagagccagaucuguauguggcucagaagucuacgcuuuuaaggaagugacac

SEQ ID NO: 157951 - RNA, 25 nt, Homo sapiens
gaguuggcucacucagcacgcucac

SEQ ID NO: 157952 - RNA, 81 nt, Homo sapiens
gcuguguuaaccaaugaggucugcugccaggugugaacaagcaugucucuacgaaugaacgaaacauuggggaucucugcc

SEQ ID NO: 157953 - RNA, 72 nt, Homo sapiens
cugaaauggguacacacuguaugguuccaacuauguaacauucuggaaaagacaaaacuauggagacaaaac

SEQ ID NO: 157954 - RNA, 59 nt, Homo sapiens
uuggcuauucuauggguuuugacaaaugucugaugacuuguaucaccauuauaguacca

SEQ ID NO: 157955 - RNA, 27 nt, Homo sapiens
aagaaugcaaaagaaaagauccugcca

SEQ ID NO: 157956 - RNA, 45 nt, Homo sapiens
ugauuugagcauggugugguggaaggaagagaaugagcaaauaaa

SEQ ID NO: 157957 - RNA, 46 nt, Homo sapiens
ccaaaacuuucccuuuaucacugagccucccuaauuaagcuaacau

SEQ ID NO: 157958 - RNA, 49 nt, Homo sapiens
ggcgcagguaagcggcggugacugugggcccgagacuccagaaacggcu

SEQ ID NO: 157959 - RNA, 39 nt, Homo sapiens
agggacgagcgcggcggcaggcgaggcggcgugggggag

SEQ ID NO: 157960 - RNA, 36 nt, Homo sapiens
ggccgccagggucaggccgggccguaccugggaauc

SEQ ID NO: 157961 - RNA, 42 nt, Homo sapiens
gccuagcgagccgaucuacuccggcaggcggccccucaccgg

SEQ ID NO: 157962 - RNA, 46 nt, Homo sapiens
aagaaaaggagagaauaucaaacaacagccacuuuaaccccuccgg

SEQ ID NO: 157963 - RNA, 42 nt, Homo sapiens
gccaugucuguccucugcccggcaccggcagggcgcggggga

SEQ ID NO: 157964 - RNA, 42 nt, Homo sapiens
aaauaauaauucagucccccagccuucccucucuggugaagu

SEQ ID NO: 157965 - RNA, 40 nt, Homo sapiens
cguuuccagaaaaacacugcauugggaaccucgaccacaa

SEQ ID NO: 157966 - RNA, 43 nt, Homo sapiens
cuaaacuuuguuucauuacuuacauuaccuacucagcccagcc

SEQ ID NO: 157967 - RNA, 51 nt, Homo sapiens
auuacuugagauagcaagcauaguuaccaacaccacaucuuccagacaaua

SEQ ID NO: 157968 - RNA, 47 nt, Homo sapiens
gcuccaaaguggggggacgggggggaaucuuuuauaucuuaggggau

SEQ ID NO: 157969 - RNA, 72 nt, Homo sapiens
cagcuaucugaaauucccccaccgcaaucagcuaugcuaccgcccaucccaacccauacccaacagacagaa

SEQ ID NO: 157970 - RNA, 37 nt, Homo sapiens
uccagguccaaugucaaaauacucauuucaaacauuu

SEQ ID NO: 157971 - RNA, 48 nt, Homo sapiens
ucccaggcccuaugcuaucaacacagcacauacuguccacaucuagau

SEQ ID NO: 157972 - RNA, 77 nt, Homo sapiens
aaaaaaacaaauucaaggcaauucaauauucagcauuagcuagacuuaugagccauuacugaaauuucuacugacuu

SEQ ID NO: 157973 - RNA, 43 nt, Homo sapiens
ccuauuccauaauuucuauacaacaaaauuauguccuccugcc

SEQ ID NO: 157974 - RNA, 27 nt, Homo sapiens
agagugacuacaaaccucuggccuacg

SEQ ID NO: 157975 - RNA, 27 nt, Homo sapiens
ccaagguguaucuagagaaauaagugg

SEQ ID NO: 157976 - RNA, 55 nt, Homo sapiens
ccagcuucuacagcuguucccccuccugccugaauacugacacagacccuagggu

SEQ ID NO: 157977 - RNA, 46 nt, Homo sapiens
cuucuaguuuucuuuucuucuccuucuugguaucuucuguuuuaau

SEQ ID NO: 157978 - RNA, 33 nt, Homo sapiens
caggaaugaccagcgugagggcugaaagaacug

SEQ ID NO: 157979 - RNA, 46 nt, Homo sapiens
augccggacuucuuuccacuuauguccuggaggaggagaaggaacc

SEQ ID NO: 157980 - RNA, 57 nt, Homo sapiens
auguaacgaguuuccaaaauacaaaucuggugucauuucccucuuuaaaucccaggu

SEQ ID NO: 157981 - RNA, 46 nt, Homo sapiens
cuccuuccuccuuuucauugccugcucucagagcaagcugcccagg

SEQ ID NO: 157982 - RNA, 47 nt, Homo sapiens
auggaggcauuguauguacggaauaccuuggcugucaagcccuccau

SEQ ID NO: 157983 - RNA, 41 nt, Homo sapiens
guucaucauagacuucucaaaaguuuuugguggugcccucu

SEQ ID NO: 157984 - RNA, 51 nt, Homo sapiens
cuuugcauccuucaugaccuuggcaucagccuuagcacuuuucaggucucu

SEQ ID NO: 157985 - RNA, 23 nt, Homo sapiens
gccagggccccaggggcccugac

SEQ ID NO: 157986 - RNA, 46 nt, Homo sapiens
cuguuuauuuuccucucggucuguggcuugaacuuccagcuucauc

SEQ ID NO: 157987 - RNA, 46 nt, Homo sapiens
gggggauuagggugacucagcaauggcccauaucugaggcccaggg

SEQ ID NO: 157988 - RNA, 44 nt, Homo sapiens
ugggacaccccacuucuugcaccugcaaacaaaggagaaauaag

SEQ ID NO: 157989 - RNA, 49 nt, Homo sapiens
gaccacccgagacgaagcgggggcggggcccggagggagucugggaggg

SEQ ID NO: 157990 - RNA, 45 nt, Homo sapiens
uaucuacacacaugcacaccauacccaagaagguuugugggaccc

SEQ ID NO: 157991 - RNA, 46 nt, Homo sapiens
aaggagcuccucccugccucccccaggaugggcccgguuccuagga

SEQ ID NO: 157992 - RNA, 62 nt, Homo sapiens
aacgcccaagaaaaggccacagucccaguuaggauggacaagcuaacacaggcacauuauac

SEQ ID NO: 157993 - RNA, 58 nt, Homo sapiens
caaccucagauucauguguguuuuguuuuuugggcagaaggaaaugugccugcugccu

SEQ ID NO: 157994 - RNA, 35 nt, Homo sapiens
caaaaaugaacaguuauacucggguagaaacaggg

SEQ ID NO: 157995 - RNA, 45 nt, Homo sapiens
caguagugggaaagaggguuguucaugguguccgggcauacugca

SEQ ID NO: 157996 - RNA, 111 nt, Homo sapiens
gaagaagagagugggcccaacacguaggaaacagaaaguguaacuugggaagcaacagcucaagcagggagcaggugacgaggagaggccaagaggaaggacaaagaugaa

SEQ ID NO: 157997 - RNA, 45 nt, Homo sapiens
uggcccucuugcuggacacggcaaugcuugaucuugcccucagcc

SEQ ID NO: 157998 - RNA, 24 nt, Homo sapiens
aaucucugggccaaacagggaaaa

SEQ ID NO: 157999 - RNA, 42 nt, Homo sapiens
aggggucuggaaguugagggccacaagcugacugccacagau

SEQ ID NO: 158000 - RNA, 42 nt, Homo sapiens
cucggccaugaaacagcuggccugaggcaucugagccccgcu

SEQ ID NO: 158001 - RNA, 46 nt, Homo sapiens
aacacaguacaguuuuugccuucauccagagcuggggcauggaggc

SEQ ID NO: 158002 - RNA, 52 nt, Homo sapiens
ucucucuccaaggggcuucggccaugguccuggccccacaagauggaaggau

SEQ ID NO: 158003 - RNA, 42 nt, Homo sapiens
aaagcuacaggacaauguaaacuuuguuucccuggcccagca

SEQ ID NO: 158004 - RNA, 53 nt, Homo sapiens
aaacgcgcaucuggcgugugcaguugagaaacuugguggcacauggguguugg

SEQ ID NO: 158005 - RNA, 51 nt, Homo sapiens
ccugaaauggaaaacccacuagagggauucaacaaagauuugggcaugcaa

SEQ ID NO: 158006 - RNA, 26 nt, Homo sapiens
gcugagaugccagggcaccagcaagg

SEQ ID NO: 158007 - RNA, 65 nt, Homo sapiens
agagccucgaggagcgccuagcaacauuggcuggggagcuaagccaugacagcgccucuccgggc

SEQ ID NO: 158008 - RNA, 43 nt, Homo sapiens
accauggggcugccucaccccagcuggagccugagccucagau

SEQ ID NO: 158009 - RNA, 41 nt, Homo sapiens
ugugugcagacuccgggcgagcggaccagguggagggagag

SEQ ID NO: 158010 - RNA, 42 nt, Homo sapiens
aaucagugauagcaauuguauacuucgcucaccugcaagagc

SEQ ID NO: 158011 - RNA, 45 nt, Homo sapiens
aguagaggugcuuugauagugaggacggagguuugugcccccaag

SEQ ID NO: 158012 - RNA, 42 nt, Homo sapiens
ugcacuaaucaccuugcucucuccuggagcgaagagcugaag

SEQ ID NO: 158013 - RNA, 46 nt, Homo sapiens
caugguggcacucuguaccugcaaggccacucagaggcccccguac

SEQ ID NO: 158014 - RNA, 40 nt, Homo sapiens
ucccucgccccuucagcccugucaccuccuccuuccuaga

SEQ ID NO: 158015 - RNA, 56 nt, Homo sapiens
cagaauuagacagaggaacacagaggggacaggcucaguuaggguggagguguggg

SEQ ID NO: 158016 - RNA, 46 nt, Homo sapiens
gcugagccucaguguuggugccuaguguacaagauuguuaaagaau

SEQ ID NO: 158017 - RNA, 36 nt, Homo sapiens
accaggugcaguccauaugagaugugaaauagagaa

SEQ ID NO: 158018 - RNA, 57 nt, Homo sapiens
ugucuauucuguacuagacccuguagguuuugggguacaguguuaaacaugauagag

SEQ ID NO: 158019 - RNA, 44 nt, Homo sapiens
gagacggaaggcauugucaagaaccauuuucaugagagguggug

SEQ ID NO: 158020 - RNA, 45 nt, Homo sapiens
guaaaaguaaaaugcaugugaauuuaucauauuugcacuaugaag

SEQ ID NO: 158021 - RNA, 70 nt, Homo sapiens
guuuuuuaauuuacuuuuuuuacacuguagcauugagacugcuugauucaagucuggugcuuugccagau

SEQ ID NO: 158022 - RNA, 46 nt, Homo sapiens
aucaaaguucuuggggaaggaucguauaugugggucccuucccuag

SEQ ID NO: 158023 - RNA, 66 nt, Homo sapiens
ugugaagagaguucuuuauaaagccuguagguucuuuuaacuuugguuuaaaauguaagauaggaa

SEQ ID NO: 158024 - RNA, 54 nt, Homo sapiens
ugcuuugcaaguuugacuguaugcagguuuauaucagaaggugagauugaauaa

SEQ ID NO: 158025 - RNA, 47 nt, Homo sapiens
uccugcuuuacgucuggacccuuguggcuccacuuguccucaccagu

SEQ ID NO: 158026 - RNA, 44 nt, Homo sapiens
auacucuugacuuuauccccucuagcauuuaaaacccauuggaa

SEQ ID NO: 158027 - RNA, 60 nt, Homo sapiens
ccuuauuccaccucaugcucugcuuggcuuccuuguacaucaugaugacccugaccagcu

SEQ ID NO: 158028 - RNA, 67 nt, Homo sapiens
ggagugacagcgucauccuuggugauacaacuaccaguggugccagugaugaagaagauggacagcc

SEQ ID NO: 158029 - RNA, 66 nt, Homo sapiens
ugcuagaauuacauagacuaaggucacuguuaaggcauucuuugaauagcaaggaagauaggagug

SEQ ID NO: 158030 - RNA, 41 nt, Homo sapiens
gacuguuugucuuuguucucugccucuuguauucuagguaa

SEQ ID NO: 158031 - RNA, 46 nt, Homo sapiens
uacacuauguaccucaccuggucagccauguccaaugaaccuggua

SEQ ID NO: 158032 - RNA, 46 nt, Homo sapiens
uacaccaaaccagauggcugcacagaaaacaaguucuucaucagua

SEQ ID NO: 158033 - RNA, 46 nt, Homo sapiens
aguaaaaacaaguaaagaucuccgagcggcaguacacaauggguau

SEQ ID NO: 158034 - RNA, 48 nt, Homo sapiens
auccaugaggcugauauaaaugcagauaaagauugugaugugcugguu

SEQ ID NO: 158035 - RNA, 46 nt, Homo sapiens
aguugcuguccuaacaguaagaauuccacggugacucgccucauuu

SEQ ID NO: 158036 - RNA, 41 nt, Homo sapiens
cacaaagagauggcuaaaagcaaauccaaagaaaccacagc

SEQ ID NO: 158037 - RNA, 45 nt, Homo sapiens
cauggacucgcuugggccugaguggcgccugaagcugcccucaau

SEQ ID NO: 158038 - RNA, 39 nt, Homo sapiens
ggagaggccuguaaauaaauucucaaaagucccuuaggg

SEQ ID NO: 158039 - RNA, 45 nt, Homo sapiens
aguagaaaagggaugauccuauuuugauggcuuugaggguggggg

SEQ ID NO: 158040 - RNA, 42 nt, Homo sapiens
uguccugcaggcucaggugagucaaaggauugggaggcacug

SEQ ID NO: 158041 - RNA, 43 nt, Homo sapiens
guggcuggucgaccugccugcccuacucccaggucauccccag

SEQ ID NO: 158042 - RNA, 54 nt, Homo sapiens
ggacaggaccuucugaugaguugaaugagggguguaaaaacaauaagguuuggc

SEQ ID NO: 158043 - RNA, 49 nt, Homo sapiens
ggguaggcugggcuuaggggucagaguggaaaagguggagucggagccg

SEQ ID NO: 158044 - RNA, 31 nt, Homo sapiens
auuucagguaagaagcagagaauaccagcac

SEQ ID NO: 158045 - RNA, 49 nt, Homo sapiens
gcuuaacgauaauuauuauuuuccacauucuauaauuuuccacauucug

SEQ ID NO: 158046 - RNA, 45 nt, Homo sapiens
cuccugauggaugcucuccaggagcgcgucggcgucgguggcggg

SEQ ID NO: 158047 - RNA, 54 nt, Homo sapiens
aaaugucccaaacuuggcuccucggggcauguaaaauugugugugagaggcagg

SEQ ID NO: 158048 - RNA, 55 nt, Homo sapiens
uuguuuuauugcaggcacuguuuucccuggcagggagaggaaaggcagucagcac

SEQ ID NO: 158049 - RNA, 49 nt, Homo sapiens
uuuuuuaacaccugccagggucaagaaaccagguaaauagaagcuucag

SEQ ID NO: 158050 - RNA, 46 nt, Homo sapiens
ccgaaggcagcguggugacgggugcggggaggggaguggggggauc

SEQ ID NO: 158051 - RNA, 42 nt, Homo sapiens
cauucacacaaggcuuuuggaggacccgauacugggggccac

SEQ ID NO: 158052 - RNA, 59 nt, Homo sapiens
ugagcagagacccauggggaugcagagauguccagaggagagugaggaagaaggggcug

SEQ ID NO: 158053 - RNA, 45 nt, Homo sapiens
cccgaacccucacggagcccugcccccuggcuucagagagccgag

SEQ ID NO: 158054 - RNA, 70 nt, Homo sapiens
ucuaugacuugcuugacaccgccaugaucaacaacucucgaaaccucaacauccagcucaaguggaagag

SEQ ID NO: 158055 - RNA, 45 nt, Homo sapiens
cccuuccugcaugcccagcgguacgugaguggcuaugggcugcag

SEQ ID NO: 158056 - RNA, 44 nt, Homo sapiens
cucauuucccaggguaguuccugaaguaccucugaaaagcuaca

SEQ ID NO: 158057 - RNA, 46 nt, Homo sapiens
uuacauccacuaccagccugcccaggaccggcugcaaccccaccuc

SEQ ID NO: 158058 - RNA, 46 nt, Homo sapiens
uugagcgggcgcugcugaaguggaccgaguacacgccagauccuaa

SEQ ID NO: 158059 - RNA, 46 nt, Homo sapiens
ccgugugcuauggcuccuucuacaaucuccucacccgaaccuucca

SEQ ID NO: 158060 - RNA, 40 nt, Homo sapiens
auuuuaaccuaaagaagaaggcauggcagaacuuccuaau

SEQ ID NO: 158061 - RNA, 42 nt, Homo sapiens
acagcuucucccuuucccaaccaauaaaguaaccacuuucag

SEQ ID NO: 158062 - RNA, 47 nt, Homo sapiens
gauucugaguguaacuugcagaagguucugccuaucagugagaaucu

SEQ ID NO: 158063 - RNA, 47 nt, Homo sapiens
uacuuguucuguguuccagaguauaucuuggaaccuccacccugcau

SEQ ID NO: 158064 - RNA, 49 nt, Homo sapiens
gacucgacuggguguagggagguaaggaagaggaggaggaggcaaagau

SEQ ID NO: 158065 - RNA, 45 nt, Homo sapiens
caguuggaaagcugcuaagggccugagcuagggcagcaguaagga

SEQ ID NO: 158066 - RNA, 52 nt, Homo sapiens
gaggucuuaggagguuauguucaggggacugcauuuuauuucuucuguaggc

SEQ ID NO: 158067 - RNA, 42 nt, Homo sapiens
cacaagugagugcagggucugagggcugccgaggggaggguc

SEQ ID NO: 158068 - RNA, 44 nt, Homo sapiens
cuugauguagauucuuccucuggugccccccauccccagggcuc

SEQ ID NO: 158069 - RNA, 33 nt, Homo sapiens
ucccaaugcaauggccugcuuuccucccagcag

SEQ ID NO: 158070 - RNA, 52 nt, Homo sapiens
gcuauuccuauggacagcuaauaguauccaaauaugugaucuuggaggcaug

SEQ ID NO: 158071 - RNA, 46 nt, Homo sapiens
cugagaacucuucaaguagagguaaaucuggaaggggcugccaagu

SEQ ID NO: 158072 - RNA, 43 nt, Homo sapiens
gaagagagaaguugggggaagugaggauguaggcccugccuca

SEQ ID NO: 158073 - RNA, 45 nt, Homo sapiens
gggucgcgguuuugggaagccauccgggcggcguuggcagagaga

SEQ ID NO: 158074 - RNA, 44 nt, Homo sapiens
aaagcugacggaaaaaaggaggcuacugaaaauuggauggaagg

SEQ ID NO: 158075 - RNA, 45 nt, Homo sapiens
cucucgcuagaguuccccaguggcuacccuuacaaugcgcccaca

SEQ ID NO: 158076 - RNA, 42 nt, Homo sapiens
gugauagcagggcgugaggaacuucacugugggcgcauugua

SEQ ID NO: 158077 - RNA, 42 nt, Homo sapiens
auacagggcagaccacuuuuccuucaggauguccaggcauau

SEQ ID NO: 158078 - RNA, 45 nt, Homo sapiens
uaugaugucaggaccauucugcucuccauccagagccuucuagga

SEQ ID NO: 158079 - RNA, 401 nt, Homo sapiens
accuccuccgaccuuugcaucccugguccagcugccucuugcccaccuuaauucauccugggccaggcacaguggcucaugccuguaauccuagcacuuggggaggccgagguggguggaucacaugaggucaggaguuugagaccagccuggccaacauggugaaaccccgucucuacuaaauacaaaaaaaauuaaccggguauggugguaggcaccuguagucccagcuacucaggaggcugaggcaagagaaucacuugaaucuaggaagcagagguugcagugagcagacaucaugcuauugcacuccagcuuggucaacagagugagacuccaucucaaaaauaauaaauaguaaagauuaacucauccugucuccaucacucacugagaccugc

SEQ ID NO: 158080 - RNA, 77 nt, Homo sapiens
gccuccggggagcacgugacggacgaggagaucgaaucucugaugaaagacggcgacaagaacaacgacggccgcau

SEQ ID NO: 158081 - RNA, 69 nt, Homo sapiens
guuuugagcaaaagagaggagacaacaaguuaagcccaaggccuucucacuugucaauugaaggccaag

SEQ ID NO: 158082 - RNA, 42 nt, Homo sapiens
uccacgucauauccaagccaggccaucugggucagaggcuuu

SEQ ID NO: 158083 - RNA, 42 nt, Homo sapiens
guccgcuuccacaaccucaaccauggcaccuccauccgcgaa

SEQ ID NO: 158084 - RNA, 46 nt, Homo sapiens
caccuuggcgauaauuuccuucaucagucuccucuuuacaaaacag

SEQ ID NO: 158085 - RNA, 42 nt, Homo sapiens
uugaaaauaauagugcaaauauuauauggguggcuauggcag

SEQ ID NO: 158086 - RNA, 32 nt, Homo sapiens
ggaaugacaacugaagaaaauagaaaagaagg

SEQ ID NO: 158087 - RNA, 44 nt, Homo sapiens
ggcuccagcuggacucugggaaugucagacauccacaucuccca

SEQ ID NO: 158088 - RNA, 40 nt, Homo sapiens
gagcuguccaaaugccaaggucaaaauacuuucuuugcag

SEQ ID NO: 158089 - RNA, 41 nt, Homo sapiens
cccugccaaggaggacacugaaggccuggcccagauguucc

SEQ ID NO: 158090 - RNA, 46 nt, Homo sapiens
gugguaccaaagaacuggcugaggauguggguggugaccucgaggc

SEQ ID NO: 158091 - RNA, 46 nt, Homo sapiens
aagcucgcccaggcacaguugggcugcuggcccugugcagauggca

SEQ ID NO: 158092 - RNA, 43 nt, Homo sapiens
ucaccucaccgaggaggugggucagcuguugcagcacugcacc

SEQ ID NO: 158093 - RNA, 23 nt, Homo sapiens
cucugauuauucucgaugcccag

SEQ ID NO: 158094 - RNA, 45 nt, Homo sapiens
cagucuuccucccgccccuucuuuggucccuacggaccugggggg

SEQ ID NO: 158095 - RNA, 42 nt, Homo sapiens
cagcagcaggaacagcggcggcggcgcggcucggaucaucua

SEQ ID NO: 158096 - RNA, 46 nt, Homo sapiens
cggcugcagcucacuagaugggcuccucacagagcauggccccuuc

SEQ ID NO: 158097 - RNA, 46 nt, Homo sapiens
uccaagaauagggguuguacuccagggugacaccaucuggcuggac

SEQ ID NO: 158098 - RNA, 45 nt, Homo sapiens
cauuaguugcauaaaacuugucaucggaguaggagaagcccaccc

SEQ ID NO: 158099 - RNA, 50 nt, Homo sapiens
uugaagggccucaaaauugcucugggcgaccuggggauggcagagcaaga

SEQ ID NO: 158100 - RNA, 42 nt, Homo sapiens
uuuccugaccggggagagcuaugcuggcaucuacauccccac

SEQ ID NO: 158101 - RNA, 46 nt, Homo sapiens
cugcucauaggaggagaguccauugcccacagccagccccugugaa

SEQ ID NO: 158102 - RNA, 46 nt, Homo sapiens
uucacaggggcuggcugugggcaauggacucuccuccuaugagcag

SEQ ID NO: 158103 - RNA, 80 nt, Homo sapiens
cuacaggcuuuggucuucucuccagacccacugcugcucucaaaacaaguguaacuucuaugacaacaaagaccuggaau

SEQ ID NO: 158104 - RNA, 44 nt, Homo sapiens
aagucacaguguugggaggcagugaugcuaggauuuggacccag

SEQ ID NO: 158105 - RNA, 46 nt, Homo sapiens
cccuccagcacacggggcauagagauuguagauguugaggccagag

SEQ ID NO: 158106 - RNA, 46 nt, Homo sapiens
caucuacaaucucuaugccccgugugcuggaggggugcccagccau

SEQ ID NO: 158107 - RNA, 47 nt, Homo sapiens
ugguccaggauuugggcaacaucuucacucgccugccacucaagcgg

SEQ ID NO: 158108 - RNA, 36 nt, Homo sapiens
accugaugccacauccgcuugaguggcaggcgagug

SEQ ID NO: 158109 - RNA, 64 nt, Homo sapiens
guugagguagguggaagcagcuguuguguuggugcaggggggguccaugcgcacuuuauccccu

SEQ ID NO: 158110 - RNA, 68 nt, Homo sapiens
aggggauaaagugcgcauggacccccccugcaccaacacaacagcugcuuccaccuaccucaacaacc

SEQ ID NO: 158111 - RNA, 44 nt, Homo sapiens
guaaacuuacaguaccgccgucucuaccgaagcaugaacuccca

SEQ ID NO: 158112 - RNA, 42 nt, Homo sapiens
gauggaggugcagcgccggcccugguuagugaaguacgggga

SEQ ID NO: 158113 - RNA, 47 nt, Homo sapiens
cuaagcaaagugccccugcaggccggguucugccgccaggacugccc

SEQ ID NO: 158114 - RNA, 65 nt, Homo sapiens
uucucugcuuaaagaaugcccuuuaugaugcacugauuccaucccaggaacccaacagagcucag

SEQ ID NO: 158115 - RNA, 42 nt, Homo sapiens
uccauaaucaaucuaucaauuacaguccguccaccaccuccc

SEQ ID NO: 158116 - RNA, 68 nt, Homo sapiens
ccccaaccccucucagccccucuuuucccacauucauagccuguagugcccccucuaacccccagugc

SEQ ID NO: 158117 - RNA, 40 nt, Homo sapiens
agaggggcugagagggguugggguccugaaugacagcugc

SEQ ID NO: 158118 - RNA, 45 nt, Homo sapiens
ugccaaagggcugcgagaggugauugagaagaaccggccugcuga

SEQ ID NO: 158119 - RNA, 46 nt, Homo sapiens
gcacaaaguugaugcccucagguagugggaucugcaccccacgcca

SEQ ID NO: 158120 - RNA, 42 nt, Homo sapiens
gcugaucccauuacaggccccucugaagaccaugcugcagau

SEQ ID NO: 158121 - RNA, 48 nt, Homo sapiens
cauugcccuggucccaccagaccagccugagguccagcuguccagcau

SEQ ID NO: 158122 - RNA, 36 nt, Homo sapiens
aguugcaucuuauaguauuccuucacugccuauaga

SEQ ID NO: 158123 - RNA, 23 nt, Homo sapiens
ccaccugcacaccagugagacca

SEQ ID NO: 158124 - RNA, 49 nt, Homo sapiens
gggcaguggagccccagcugcaggaggaagagcggaugguguauguggc

SEQ ID NO: 158125 - RNA, 45 nt, Homo sapiens
aguaagccgauggauguggggaugcucagaguggguuugaggcaa

SEQ ID NO: 158126 - RNA, 45 nt, Homo sapiens
guguccauccgcacuggucuggagcucucccgggaucccgcugga

SEQ ID NO: 158127 - RNA, 67 nt, Homo sapiens
gucucgggcacgggguggaguuaaucggagggguggagaaacugaaggcucuaaguaugguuuagga

SEQ ID NO: 158128 - RNA, 57 nt, Homo sapiens
ccgagaaaucucagggucucgggagacuggaggcugagugggauggggcguggccaa

SEQ ID NO: 158129 - RNA, 46 nt, Homo sapiens
uuggcauucaguauugguggccuggcaugguagguacuacccaaug

SEQ ID NO: 158130 - RNA, 54 nt, Homo sapiens
gcuaugguuucugccauuggccaugauuucagggagcuggcugaggccggcuga

SEQ ID NO: 158131 - RNA, 45 nt, Homo sapiens
gugagagacaggaauguaaucaaggguugaucagcuaggacagac

SEQ ID NO: 158132 - RNA, 96 nt, Homo sapiens
gaaaagaaguggcgauggcagggaagagccccuggccaugagagagacuggggggagugggaaggaagggaaguuauggggcagggggcacagagc

SEQ ID NO: 158133 - RNA, 89 nt, Homo sapiens
agagggcagccagaacccagaaggagugugugauuaggcacagagcaaggagcaaguagaugaggaggcuagagagguagcgaggacca

SEQ ID NO: 158134 - RNA, 44 nt, Homo sapiens
agugggaucauguauguacccagcucuugguagauucuagaggg

SEQ ID NO: 158135 - RNA, 57 nt, Homo sapiens
agagaaauaagaaaaggaaaaguauuccagucagagaaaucagcauaugccaaggca

SEQ ID NO: 158136 - RNA, 44 nt, Homo sapiens
ggucguugccaaacccagaguauuauacccuccguuaugcagau

SEQ ID NO: 158137 - RNA, 42 nt, Homo sapiens
ugucucggagcauaugcuucucuccucccaaggucucaagac

SEQ ID NO: 158138 - RNA, 46 nt, Homo sapiens
uuuucauuaagagaggggccucuccugaacuuguaggcaaggagug

SEQ ID NO: 158139 - RNA, 46 nt, Homo sapiens
gacaucuguguuugggcugaaaaauugauagcauacaugcauaaua

SEQ ID NO: 158140 - RNA, 53 nt, Homo sapiens
uuucagaguucuuaugagcaucaacuauaauaaugauauagaagugagcaauc

SEQ ID NO: 158141 - RNA, 51 nt, Homo sapiens
uaauaauccucagucaguaguguuuucacucucuucugaaggcauuuaggu

SEQ ID NO: 158142 - RNA, 44 nt, Homo sapiens
uggauuuaaacuccucuaggcaaggugguacuuugcaguguuac

SEQ ID NO: 158143 - RNA, 46 nt, Homo sapiens
ggaugcuucagguauacuuggaaagacaagacuggaucacauaaaa

SEQ ID NO: 158144 - RNA, 344 nt, Homo sapiens
ugcugagaauacuaggcuugaguuuauagccuggcuuuucuauuuuuuuuuugagauggaguuuuacucuugucgcccaggcuggagugcaauggugccaucucggcuaacugcaaccuccaccucccacguucaagcgauucuugugccucagccuccugaguggcugggauuacaggugccugccaccgugcccggcugauuuuuguauuuuuaguagagacgggguuucaccauguuggccaggcugguauugaacuccugaucucaagugacccgcccaccucagccucccaaaguucugagauuacaggcgugagccacggcgcccggccuacagcccc

SEQ ID NO: 158145 - RNA, 42 nt, Homo sapiens
guagcccuuggggaagcggugcuugaucaccgccgcgcggcc

SEQ ID NO: 158146 - RNA, 60 nt, Homo sapiens
cggcugcuccgcucccgggcugcggccagagccucagccuccggggcgggcuccucgcca

SEQ ID NO: 158147 - RNA, 50 nt, Homo sapiens
uggaaagaaagauacauucaaaggggccuucgcuacugcacagcagagau

SEQ ID NO: 158148 - RNA, 104 nt, Homo sapiens
acaauagcuuuuuuuccuuucuuucuugucaucccuuuuauuuucaacaaaacauuuccccuuuucuuucccugggagaaccaguggggagacugcaucagguc

SEQ ID NO: 158149 - RNA, 46 nt, Homo sapiens
ccuucugcaauuuacaaacguggcagagagaacauucuaccuugau

SEQ ID NO: 158150 - RNA, 52 nt, Homo sapiens
gcugggaagugccagagaucagauguccaccccguuagcacuucacaucccu

SEQ ID NO: 158151 - RNA, 49 nt, Homo sapiens
cauuuaaaagaguacuuguuaucuuuuacucagaauuuccagauguuuu

SEQ ID NO: 158152 - RNA, 42 nt, Homo sapiens
aggugaguuaguuauggaggagaugagguggugugggaagag

SEQ ID NO: 158153 - RNA, 45 nt, Homo sapiens
gaggagaaggcgaguaggaaagaaaagaggugagggagcgaggac

SEQ ID NO: 158154 - RNA, 28 nt, Homo sapiens
uggaauauugaaauauuuaaggaauauc

SEQ ID NO: 158155 - RNA, 53 nt, Homo sapiens
uggauaaagggaaguuaauggcucuaaucuuuaaucuucuuagacuuucaaag

SEQ ID NO: 158156 - RNA, 31 nt, Homo sapiens
uuuacagcugagaaauuucuugaaucuguug

SEQ ID NO: 158157 - RNA, 46 nt, Homo sapiens
ggccauuaaagccaacauagugcacuugaugcuuagcagcccagag

SEQ ID NO: 158158 - RNA, 46 nt, Homo sapiens
gaccagaacacgcugacaaguaucugugaaaagguuauugugccua

SEQ ID NO: 158159 - RNA, 45 nt, Homo sapiens
uagcugcugaugaagaagcauuugaagauaauucugaggaguaca

SEQ ID NO: 158160 - RNA, 54 nt, Homo sapiens
uaucuuuuuuuauaacucugaugaugucacuaauuuggaaguaaugauccuuac

SEQ ID NO: 158161 - RNA, 67 nt, Homo sapiens
gccaacccguccuaauuuuaaaaggaagggaaauuuagauuauuuuuaaauguagagagcuaucucg

SEQ ID NO: 158162 - RNA, 41 nt, Homo sapiens
ucaugagaaguuuuucucuccuacaagaagccauaaucccc

SEQ ID NO: 158163 - RNA, 47 nt, Homo sapiens
uagcuguuaguaagguaauagagccaauuuugaaagugggguuccuu

SEQ ID NO: 158164 - RNA, 45 nt, Homo sapiens
ugcuguuguaaauuuugaggaggcuuuguuuuugguguuuacuga

SEQ ID NO: 158165 - RNA, 51 nt, Homo sapiens
agguuuuuuagucuuuauuaauuuguauugcauaaaauauggggcacuagc

SEQ ID NO: 158166 - RNA, 45 nt, Homo sapiens
gguuuuggaaaaaauuauuauuccugaaauucagaagguaucugg

SEQ ID NO: 158167 - RNA, 45 nt, Homo sapiens
gaaugucccccaaugauggacacugaguauaccaaacugugguaa

SEQ ID NO: 158168 - RNA, 35 nt, Homo sapiens
gacugcaaaauuaacaaagcuuauucucuuggggg

SEQ ID NO: 158169 - RNA, 49 nt, Homo sapiens
uuacagucuuugauuggucuuuuugaguuacccgaagaugauaccauuc

SEQ ID NO: 158170 - RNA, 39 nt, Homo sapiens
ugugugggugugcacacaugcaugcacaugugcaguaag

SEQ ID NO: 158171 - RNA, 42 nt, Homo sapiens
gcucuucccagagcuguggcagcucucccguagaagaugggg

SEQ ID NO: 158172 - RNA, 51 nt, Homo sapiens
ccuguugagcaguaacuaaaauaagggaagaugugaguaaggggauggaag

SEQ ID NO: 158173 - RNA, 46 nt, Homo sapiens
ucacgagacccucugagcaacuggacuaucuuuccagaguccaggg

SEQ ID NO: 158174 - RNA, 29 nt, Homo sapiens
uggauguggauucguguuuaccguguaug

SEQ ID NO: 158175 - RNA, 56 nt, Homo sapiens
auggccuuuuuuuuuucuucuucuuuuuuaagacacccauaaagaaaccaggggau

SEQ ID NO: 158176 - RNA, 46 nt, Homo sapiens
gguuucaaagucccgcaggcgcagcccaccaaacccgcacucaagu

SEQ ID NO: 158177 - RNA, 32 nt, Homo sapiens
aggaacgggcaccaacaagaagguggccaagc

SEQ ID NO: 158178 - RNA, 46 nt, Homo sapiens
cagaauauggccaggggaucaauccgauuagccgacuggcccagau

SEQ ID NO: 158179 - RNA, 55 nt, Homo sapiens
gugggggaaggugaagggaaaagcaagaagauuucaaagaaaaaugccgccauag

SEQ ID NO: 158180 - RNA, 55 nt, Homo sapiens
gaguggcccaccccacaugaagaacuuugugaccaagguuucgguuggggaguuu

SEQ ID NO: 158181 - RNA, 42 nt, Homo sapiens
uacaggugaauggaagagaauccgaagaagaaaaucucaaua

SEQ ID NO: 158182 - RNA, 45 nt, Homo sapiens
gaggauccugcagaaugagccccugccagagaggcuggaggugag

SEQ ID NO: 158183 - RNA, 40 nt, Homo sapiens
uaaguacuuugacucauuaaaaacauuuucagcuuuuaaa

SEQ ID NO: 158184 - RNA, 43 nt, Homo sapiens
aucccuggcuccucuauccacuaaauaucaguagguuccccau

SEQ ID NO: 158185 - RNA, 34 nt, Homo sapiens
guuaauuguaaucuauagaaggcauggauuucaa

SEQ ID NO: 158186 - RNA, 49 nt, Homo sapiens
agcaaauuccauugucuccggccucaaaacgguggcaguauuugaggag

SEQ ID NO: 158187 - RNA, 49 nt, Homo sapiens
ucuucugagccuuccucaucauucucuugaaggucuuccugcuccuuug

SEQ ID NO: 158188 - RNA, 46 nt, Homo sapiens
cuagcaccagcacgcgggugacuggagccuggcgggguuuauaaau

SEQ ID NO: 158189 - RNA, 45 nt, Homo sapiens
cacccacagccaggcagguggugauguugcagaacugggccagcu

SEQ ID NO: 158190 - RNA, 42 nt, Homo sapiens
gggccuccagccgcugcgucugugacaaguugccauggagcu

SEQ ID NO: 158191 - RNA, 45 nt, Homo sapiens
gcucaccguuuugacccccucaaugucaaguccacgggcugccac

SEQ ID NO: 158192 - RNA, 46 nt, Homo sapiens
ucugacugcugcaucucuuuuuccuccgccucuagcugcagaacug

SEQ ID NO: 158193 - RNA, 46 nt, Homo sapiens
cccuguggagcaagaucauucauacacuucgagagaacaaucaaau

SEQ ID NO: 158194 - RNA, 46 nt, Homo sapiens
agcugugcaaguacuuccugugccaggaauaccugccuucccagau

SEQ ID NO: 158195 - RNA, 45 nt, Homo sapiens
uccuguucaggaaaguuguguucuacaaagaaaagguuggaagac

SEQ ID NO: 158196 - RNA, 42 nt, Homo sapiens
cuuaaucuucucauacuuaagaacagauggaugauucuccag

SEQ ID NO: 158197 - RNA, 40 nt, Homo sapiens
cuuugggaaaggacuuuuucuguagcugcagagugggcag

SEQ ID NO: 158198 - RNA, 119 nt, Homo sapiens
ucuuaagcacacuucaaggggaaagaaaaaaggaggagagaacauuuguucccgugaagucccuuucuccaaaggacuggggaucaagaaggaagaagaguaagaaggaaaaacaacaa

SEQ ID NO: 158199 - RNA, 95 nt, Homo sapiens
aggaggaggaggaggaggaggaggaagaggaggaggagggggagaaggaagaggagggggaggagaaggaggagaagggggcggggaaggagcga

SEQ ID NO: 158200 - RNA, 78 nt, Homo sapiens
uguuuugguggccauggggagaaugaacuguaggaggccaagaugggagccaggcaugggagccagggaugaggccaa

SEQ ID NO: 158201 - RNA, 48 nt, Homo sapiens
ucccaggugugcaucuuacuggaugagguugcugugauugagauaguu

SEQ ID NO: 158202 - RNA, 96 nt, Homo sapiens
ccagcauuacaguaacuaacucuuucuaaccaaccgugaugccacguaacuuacccuauggacaaaagcaggaaugacuaacacauccuaggaggg

SEQ ID NO: 158203 - RNA, 50 nt, Homo sapiens
cuaucugguagaucacauguagauguacaguguguauauuaagcugaauu

SEQ ID NO: 158204 - RNA, 44 nt, Homo sapiens
cagaggaugugcgcggcugcucggacgcccugcggcggcgggca

SEQ ID NO: 158205 - RNA, 46 nt, Homo sapiens
gcucagccugcacaagguggaucccuuuuaucgauuccggcugauc

SEQ ID NO: 158206 - RNA, 47 nt, Homo sapiens
accuguggacaggggcagugcacagaccaaaauaggucugccugugc

SEQ ID NO: 158207 - RNA, 37 nt, Homo sapiens
ucacuucaucuuaagagccucaguugccuauuuaagu

SEQ ID NO: 158208 - RNA, 42 nt, Homo sapiens
gggcgagaagccucgggcagaugacaugaaaugggcccagaa

SEQ ID NO: 158209 - RNA, 28 nt, Homo sapiens
uugugauuccagccacccaucaucccgu

SEQ ID NO: 158210 - RNA, 46 nt, Homo sapiens
cacugcugccgcugcuaaacauggccuacaaguuccgcacccacag

SEQ ID NO: 158211 - RNA, 33 nt, Homo sapiens
gaagcagcagcggcuagggcggcgguagcugca

SEQ ID NO: 158212 - RNA, 57 nt, Homo sapiens
gugggccgagaaggaggcgcagcagccgcccuggcccgucauggagauggaaaagga

SEQ ID NO: 158213 - RNA, 24 nt, Homo sapiens
ucuuccuuugucucccugggggaa

SEQ ID NO: 158214 - RNA, 48 nt, Homo sapiens
ugagcauaaccguauuuuuaaucuuuaaugcuaaugaauagcauagau

SEQ ID NO: 158215 - RNA, 35 nt, Homo sapiens
uaaacauuguuuucuagcauuuaaacacuuucaaa

SEQ ID NO: 158216 - RNA, 44 nt, Homo sapiens
gaauagcucaugugcuccccuccaucuguaguuuaagagggguu

SEQ ID NO: 158217 - RNA, 82 nt, Homo sapiens
gcuuguuuucucgucuguaaauucuuugauucucugacaccacucacuauauuucauugugaaugauuugauuguuucagau

SEQ ID NO: 158218 - RNA, 49 nt, Homo sapiens
caauugacauuuguuuuuauagcuguuuucauuaugaaauacaaucuaa

SEQ ID NO: 158219 - RNA, 43 nt, Homo sapiens
ucuuguuuagcccugguuugagugaacuaaauuuaggugucug

SEQ ID NO: 158220 - RNA, 48 nt, Homo sapiens
uuuucccgaggggcaugaaauguuuuugauaaauagaguucauuugac

SEQ ID NO: 158221 - RNA, 45 nt, Homo sapiens
uuggaagauguugcuuuugaaaguaggaaauagauggcuuuagaa

SEQ ID NO: 158222 - RNA, 50 nt, Homo sapiens
uuuccuaaguaauuugucuuuaaacuuuuacugguuuggaauuuccugag

SEQ ID NO: 158223 - RNA, 48 nt, Homo sapiens
uguccgccuucugagugauuggcugucagucugccgguagcugaaaag

SEQ ID NO: 158224 - RNA, 55 nt, Homo sapiens
auuaaacuacaucaagaagauaaugacuauaucaacgcuaguuugauaaaaaugg

SEQ ID NO: 158225 - RNA, 43 nt, Homo sapiens
agguaagcagauugucugaauuuucuauuuaaugucaauuuaa

SEQ ID NO: 158226 - RNA, 50 nt, Homo sapiens
ugucccaguuccuccccauuuaugacuaaaaucagcccagaugcuucucg

SEQ ID NO: 158227 - RNA, 31 nt, Homo sapiens
agggaguaguggagagcugcagugacugggg

SEQ ID NO: 158228 - RNA, 80 nt, Homo sapiens
agucccuucagcacagggagugcugacuugucuuguucagguaguaaguucaagaugagcucaggaaagaaagugagagg

SEQ ID NO: 158229 - RNA, 57 nt, Homo sapiens
cugugcccauugccaggugagcuggauugaaaugggccagcugcucagcagacaccc

SEQ ID NO: 158230 - RNA, 44 nt, Homo sapiens
cuccuaaguuuguugggccaaggauggaggcugucugccgucag

SEQ ID NO: 158231 - RNA, 25 nt, Homo sapiens
uuuugggagauggugugggagcaga

SEQ ID NO: 158232 - RNA, 58 nt, Homo sapiens
ucuugccauguaauuagcgccuccaugccaaguggcagaauugcuucaauggugacag

SEQ ID NO: 158233 - RNA, 42 nt, Homo sapiens
cccggagcacgggcccguuguggugcacugcagugcaggcau

SEQ ID NO: 158234 - RNA, 46 nt, Homo sapiens
agugggugaaggaagagacccaggaggauaaagacugccccaucaa

SEQ ID NO: 158235 - RNA, 47 nt, Homo sapiens
aguaggcacuuaugaaacuuucucauacccuuaggugauguaaucag

SEQ ID NO: 158236 - RNA, 52 nt, Homo sapiens
aagccccccucagcugugugcacacugagccaggacagggucuuugagcuuu

SEQ ID NO: 158237 - RNA, 53 nt, Homo sapiens
augaaaaacacggcagcuguagcucccgagcuacucucuugccagcauuuuca

SEQ ID NO: 158238 - RNA, 75 nt, Homo sapiens
auauaguagcauuucaaaauggacguacugguuuaaccuccuauccuuggagagcagcuggcucuccaccuuguu

SEQ ID NO: 158239 - RNA, 60 nt, Homo sapiens
uuacaauggccauggaauaaaccauuuuuacaaaaauaaaaacaaaaaaagcaagguguu

SEQ ID NO: 158240 - RNA, 51 nt, Homo sapiens
aaaucgauggaacauuuccacaguacugaggugacugguauagucugauga

SEQ ID NO: 158241 - RNA, 64 nt, Homo sapiens
cuccuuuuuauaaggaguuuuaaaaauuguuauguauuggaugaaugacuuauuaauggauuau

SEQ ID NO: 158242 - RNA, 35 nt, Homo sapiens
gacaugugagauguaacgugacaggauuuugcauu

SEQ ID NO: 158243 - RNA, 46 nt, Homo sapiens
aaauagcugugacggcaagccagaccaucuguuccagaaguucucu

SEQ ID NO: 158244 - RNA, 42 nt, Homo sapiens
uccuggucucccaucagcgaggaugagucguuggucaagcca

SEQ ID NO: 158245 - RNA, 46 nt, Homo sapiens
gcgaugaccacagacagagcacacgaagggucucucuccagugugg

SEQ ID NO: 158246 - RNA, 46 nt, Homo sapiens
gggcucuggaagagcaccgagcccggggccugaggaagcaaagcgc

SEQ ID NO: 158247 - RNA, 45 nt, Homo sapiens
ucugcuguagcugcugcugcugcagacacaagaucugcucgagga

SEQ ID NO: 158248 - RNA, 49 nt, Homo sapiens
gagugcauccgcgcuccgcugauucaccgccaccuuggugccccguagu

SEQ ID NO: 158249 - RNA, 48 nt, Homo sapiens
uagguacaccacagacuccgcauccggcuucuccuucauguccucuga

SEQ ID NO: 158250 - RNA, 45 nt, Homo sapiens
uuucuuauguuccaggaacucagagaugcugaagaacuccgcaca

SEQ ID NO: 158251 - RNA, 101 nt, Homo sapiens
agaacaucucaucacaucaccaacugaccuaagguuauuuuuaaaaaaccaauaaaaacaaaacaaaacaaaacaaaacaaaacaaaaaaaacaguuccuu

SEQ ID NO: 158252 - RNA, 59 nt, Homo sapiens
uugaccugaaacguuaacuaacgucaaaauccuucuaagccagcguaggucauuuuggu

SEQ ID NO: 158253 - RNA, 42 nt, Homo sapiens
gcuucccucccgaaaggugccaaacaccaccaaaagccccac

SEQ ID NO: 158254 - RNA, 41 nt, Homo sapiens
agggcgaagaucggcaggcggcgcagcccgggcagaaaagg

SEQ ID NO: 158255 - RNA, 45 nt, Homo sapiens
gguaacaccagugaggggaguggaaccaauuaagugaggggcaga

SEQ ID NO: 158256 - RNA, 46 nt, Homo sapiens; identical to SEQ ID NO: 73233

SEQ ID NO: 158257 - RNA, 41 nt, Homo sapiens
cguguucaucaggggagcgcagcuaauuagcauccgggcuc

SEQ ID NO: 158258 - RNA, 56 nt, Homo sapiens
gcuccuacuuuuuaaugaguacgcauuucuccccauuuucuuuuccucuccaagga

SEQ ID NO: 158259 - RNA, 31 nt, Homo sapiens
cuggagggguucaaagauuccaguucuaaua

SEQ ID NO: 158260 - RNA, 44 nt, Homo sapiens
gaucccuuuuuuggagggaugacucgagaugaagaugaugauga

SEQ ID NO: 158261 - RNA, 59 nt, Homo sapiens
guuuccacgauaacuucggcuuugaugaccuaguacaagauuucaauagcaucuucagc

SEQ ID NO: 158262 - RNA, 64 nt, Homo sapiens
gucagagacaccuggugagagacugcgggagggacaggcacuucgagaaucaaugcuuaaguau

SEQ ID NO: 158263 - RNA, 45 nt, Homo sapiens
ggguuucccaggagcgucuuggcccgguucuacagccccagccca

SEQ ID NO: 158264 - RNA, 46 nt, Homo sapiens
ggacugugguggacagugagggccagacagagaccgcaguaaccca

SEQ ID NO: 158265 - RNA, 59 nt, Homo sapiens
cccagcgggagcuucccuugcaaacaccagcagacaccauuuugcagaacucuuaagaa

SEQ ID NO: 158266 - RNA, 100 nt, Homo sapiens
cacaggaggcaaauccagagccuggcuguggggaaagugaccacucugcccugaccccgaucaguuaaggagcugugcaauaaccuuccuaguaccugag

SEQ ID NO: 158267 - RNA, 42 nt, Homo sapiens
gagcuuaaaauugcagauuuuggguggucaguacaugcucca

SEQ ID NO: 158268 - RNA, 52 nt, Homo sapiens
uaauguuuuguuaauagaauaguuuauaugggcaagucuuucugguggacag

SEQ ID NO: 158269 - RNA, 42 nt, Homo sapiens
ggguaaaggaaaguuugguaauguuuauuuggcaagagaaaa

SEQ ID NO: 158270 - RNA, 43 nt, Homo sapiens
auagaaaauaauccugaggaggaacuggcaucaaaacagaaaa

SEQ ID NO: 158271 - RNA, 54 nt, Homo sapiens
gucuccaggccacugaauaacacccaaaagagcaagcagccccugccaucggca

SEQ ID NO: 158272 - RNA, 47 nt, Homo sapiens
uguguccuucaaauucuucccagcgcauuccuuugcaagcacaaaag

SEQ ID NO: 158273 - RNA, 88 nt, Homo sapiens
agacuuggguccuugggucgcaggugggagccgacggguggguagaccgugggggauaucucaguggcggacgaggacggcggggaca

SEQ ID NO: 158274 - RNA, 35 nt, Homo sapiens
gaaaagaaggaagagcgauucaaaaaagccagaau

SEQ ID NO: 158275 - RNA, 39 nt, Homo sapiens
aagcauaaacacaugaaggagccaugugaggaacaggag

SEQ ID NO: 158276 - RNA, 41 nt, Homo sapiens
ugcggcuguguguuuucugagcgagccuugaaagagauaaa

SEQ ID NO: 158277 - RNA, 42 nt, Homo sapiens
cuugagucuacagagguacaugaauagguguagcaauagcaa

SEQ ID NO: 158278 - RNA, 51 nt, Homo sapiens
ggaugaugucaucaugcucaauggcaccaaggaggauguggacgugcugaa

SEQ ID NO: 158279 - RNA, 65 nt, Homo sapiens
caaugaaugagagcucuucuggaaaagcugggaagccuccguguggagccacaaagagguccauc

SEQ ID NO: 158280 - RNA, 51 nt, Homo sapiens
ugaucuuccuucaaaggguuauccaaggcaucuacucaaugaaaaaccaug

SEQ ID NO: 158281 - RNA, 52 nt, Homo sapiens
aaaccggcacggucugauccggaaauauggccucaauaugcgccgccagugu

SEQ ID NO: 158282 - RNA, 53 nt, Homo sapiens
cggccacgcaguccgcgucuucacgugggcaaggggcggggacguuggaggga

SEQ ID NO: 158283 - RNA, 27 nt, Homo sapiens
auuuucuuuuaggcccaccugggucua

SEQ ID NO: 158284 - RNA, 18 nt, Homo sapiens
cucuggcgcacuggggcu

SEQ ID NO: 158285 - RNA, 45 nt, Homo sapiens
ccggacgccauguuguggaaaauaaccgauaaugucaaguacgaa

SEQ ID NO: 158286 - RNA, 45 nt, Homo sapiens
gagcuagaguuucggagagugggagggaagaaggaggcggcgagc

SEQ ID NO: 158287 - RNA, 45 nt, Homo sapiens
cccggguaccuuccgacccugggcaagccccgccgggcggggugc

SEQ ID NO: 158288 - RNA, 42 nt, Homo sapiens
uggagucgccgaauaucagccgccacccuacuuucccccucc

SEQ ID NO: 158289 - RNA, 48 nt, Homo sapiens
gcggggcugcccucgcaccacgggcgcccggccggccuacugccccac

SEQ ID NO: 158290 - RNA, 46 nt, Homo sapiens
gcccgcagggaugccuaccgccgcuccgaccugcugcugccccacg

SEQ ID NO: 158291 - RNA, 28 nt, Homo sapiens
uuaaauaguuuucagcagcugcuaggaa

SEQ ID NO: 158292 - RNA, 45 nt, Homo sapiens
ccuccccugucagaaggagcuggugggggccguaaugaaccccac

SEQ ID NO: 158293 - RNA, 97 nt, Homo sapiens
uagagccaaaucgaaaaauggaggccgguccuugcgggagaaguuggacaagauuggguugaaucuuccggccgggaggcggaaagccgcucaugug

SEQ ID NO: 158294 - RNA, 45 nt, Homo sapiens
uaguaaaccaguggcagaauauuuaaccagaccucaucuuggagg

SEQ ID NO: 158295 - RNA, 43 nt, Homo sapiens
ucacaggcaacuguguaaagaauucacagaacuucucagccaa

SEQ ID NO: 158296 - RNA, 45 nt, Homo sapiens
gaaaauggagaaacacaggaaauaaaauuggaacgaagaaagguu

SEQ ID NO: 158297 - RNA, 46 nt, Homo sapiens
caucagaaugcuucuuuuguucacauuuauuauucuugguccuaga

SEQ ID NO: 158298 - RNA, 73 nt, Homo sapiens
ucuuggauaugaagagcauguugucucuuccucuugcaugagaaaagauggcgucucagaggaaggguugcug

SEQ ID NO: 158299 - RNA, 40 nt, Homo sapiens
cugcauuccaauccucacauugugccuaggcccccugcag

SEQ ID NO: 158300 - RNA, 41 nt, Homo sapiens
ggugcugguacuuucucuagcuuauuuuuuacuccugucuu

SEQ ID NO: 158301 - RNA, 31 nt, Homo sapiens
augcuuguaaucagauaaaugcaaauuuaag

SEQ ID NO: 158302 - RNA, 50 nt, Homo sapiens
agcaaaguguuuacggcaucgugugauaaaacugccaaaaugugggaccu

SEQ ID NO: 158303 - RNA, 70 nt, Homo sapiens
caucuuggaugaaauguccuuuauucccucaccucccacucauuucuaacucagugagaccuuugccccc

SEQ ID NO: 158304 - RNA, 42 nt, Homo sapiens
ucuuucagcgccaaagauaacuucaccuuuaaaugucaucga

SEQ ID NO: 158305 - RNA, 42 nt, Homo sapiens
agaacaaaacuaaaaacuucggaacaguuagaucagcccauc

SEQ ID NO: 158306 - RNA, 45 nt, Homo sapiens
caauggaaacauauuugcauacgcuuccagcuacgacuggucaaa

SEQ ID NO: 158307 - RNA, 45 nt, Homo sapiens
uuuuauaauccccagaaaaaaaauuacauuuuccugcguaaugca

SEQ ID NO: 158308 - RNA, 44 nt, Homo sapiens
acugcuugcaccaaaagccucaauuuaggagcuacuucugggcc

SEQ ID NO: 158309 - RNA, 45 nt, Homo sapiens
agagaauuaaugugcguauugagcacauuaagcacucuaagagcc

SEQ ID NO: 158310 - RNA, 54 nt, Homo sapiens
gagggaagauccugagugaaauugugaaaucaggcccagccucaugugggaggu

SEQ ID NO: 158311 - RNA, 64 nt, Homo sapiens
ggcugagaggcaagcuggaugugcauguuugggaagagggcuccguagaaagugcuguaggggc

SEQ ID NO: 158312 - RNA, 69 nt, Homo sapiens
ggcaaggccagccggcagcacgugaggccagggcagagacgcagugaaccguuccauggcgccccgagc

SEQ ID NO: 158313 - RNA, 86 nt, Homo sapiens
cccugggagaagaguccaugaaccacugccuaacucaagugcugccacggugaagcaccccugccuaguucugaacagacgcagca

SEQ ID NO: 158314 - RNA, 61 nt, Homo sapiens
aggcccucccagaugcacccugucagacagagccuacuguggauucuuuagaaauggcuug

SEQ ID NO: 158315 - RNA, 60 nt, Homo sapiens
cacaaaggccuuggagauugggacuccacacccauuucauugaaaccugcucucccccca

SEQ ID NO: 158316 - RNA, 32 nt, Homo sapiens
uugagggcccugaagaauuugacucuggcaga

SEQ ID NO: 158317 - RNA, 46 nt, Homo sapiens
ucaccugugugggucuggguuuuuuguccgugacaaagguugggac

SEQ ID NO: 158318 - RNA, 58 nt, Homo sapiens
caccuaaggccgcaucuccaguuccacgacagaaacaccaggucaugugcaugggugg

SEQ ID NO: 158319 - RNA, 36 nt, Homo sapiens
ucagccucgucuuggcagcugggccaggaggcaggg

SEQ ID NO: 158320 - RNA, 43 nt, Homo sapiens
guccuuggugcuuucacacaguucuguccgccccuggccccag

SEQ ID NO: 158321 - RNA, 95 nt, Homo sapiens
ggcuagauauggccaggagagcugagugggauuaaggcuugggaagaagccagccugggaagugcccgugaagagggagcagggaggaucauaug

SEQ ID NO: 158322 - RNA, 66 nt, Homo sapiens
caaauggaagcucaguuggcagcaggauggaggggcagggggauuuggaggccacugcauugccgu

SEQ ID NO: 158323 - RNA, 54 nt, Homo sapiens
uguaggggcaggaacuggcucgcacugaugacccauuugacaaaggagccaaau

SEQ ID NO: 158324 - RNA, 45 nt, Homo sapiens
agugcgagccaguuccugccccuacaaggagaaggcuggcagggg

SEQ ID NO: 158325 - RNA, 53 nt, Homo sapiens
uagcaaggccauggggcccacuggggucgggagacgggggggauggaggacag

SEQ ID NO: 158326 - RNA, 47 nt, Homo sapiens
ugccuuuaccaugacauuugcucccacuucacguguuuauguuugcg

SEQ ID NO: 158327 - RNA, 54 nt, Homo sapiens
guaggaagaguucucauuccaaccagcggaagccuguugaguuucaacggggcu

SEQ ID NO: 158328 - RNA, 56 nt, Homo sapiens
ggagagcauucuuuaaauuguggccauucccggcuuaaacuguuuagauccuggau

SEQ ID NO: 158329 - RNA, 46 nt, Homo sapiens
ucagugaaauauaucucagaaauuugccacaaggagagggcuaggg

SEQ ID NO: 158330 - RNA, 28 nt, Homo sapiens
ucucuugguuguuccaaaagcaccaguu

SEQ ID NO: 158331 - RNA, 47 nt, Homo sapiens
cacauggcagccgggaaggguuuggccaaggcuaaagccaguaggac

SEQ ID NO: 158332 - RNA, 44 nt, Homo sapiens
cugccuuuuagaauuuugauaucauuucuuucuagaaggauugu

SEQ ID NO: 158333 - RNA, 36 nt, Homo sapiens
ucguaaauuuuugaccuugcucaguuaguuagaaaa

SEQ ID NO: 158334 - RNA, 74 nt, Homo sapiens
uuuaauuaacuuccaaagugugauuuuugaccauaagcauucuaggaaugaggugcuguguggggauugagaug

SEQ ID NO: 158335 - RNA, 70 nt, Homo sapiens
uccucgccuuuaagcaauaaucuguguauuuagggagccaauggcccagcaagaaguccagcagugccuc

SEQ ID NO: 158336 - RNA, 84 nt, Homo sapiens
aaauaucauggagccaggagaaugaaagaagggccucucaacgucagaaaugagaaugcacuggaggcuggugauuacuucugg

SEQ ID NO: 158337 - RNA, 39 nt, Homo sapiens
guggaccccuuaggucucagucaggugugugugggguug

SEQ ID NO: 158338 - RNA, 113 nt, Homo sapiens
auaauugaggcaauuaucuucaggcaaaugaaucugggcacuguaaucaguccauccugauaacuggggagaaaucggcgucauucacuguagcauugcuuugcguuaaagag

SEQ ID NO: 158339 - RNA, 75 nt, Homo sapiens
uagaccaauuuuacaugucuagucacugaggcuccaguagauugggacuauuucuauaugugcaaagugaagugg

SEQ ID NO: 158340 - RNA, 42 nt, Homo sapiens
ccccuccgggcucgaggcgcgcucgcucucucccucccagaa

SEQ ID NO: 158341 - RNA, 53 nt, Homo sapiens
ugcaaaggaccacucaaccgucaggaaagcucucggcucauagcuuugucuuu

SEQ ID NO: 158342 - RNA, 85 nt, Homo sapiens
gagccuucguucugugcguagagauugcucggagcugucuucccaggagcucccuuacuuucucuucacuucgugcucuguugag

SEQ ID NO: 158343 - RNA, 51 nt, Homo sapiens
aaguggucaggaagguaggugcuucccuuuuucuccucacaaggaggugag

SEQ ID NO: 158344 - RNA, 42 nt, Homo sapiens
uccgaaaucgaguccgagaccgacuucgagaccgagccugag

SEQ ID NO: 158345 - RNA, 41 nt, Homo sapiens
acucaggagccccagagccccagggaaggggaggagcucaa

SEQ ID NO: 158346 - RNA, 45 nt, Homo sapiens
aggagacguccugggcuguuugcgcaggaccucuggaggcccucg

SEQ ID NO: 158347 - RNA, 37 nt, Homo sapiens
cuuuuccuaaaaguaggcucaaauccucacuugcaga

SEQ ID NO: 158348 - RNA, 45 nt, Homo sapiens
uuuccuaccauuaaauccuuuguucguggugggcaaaccgucucc

SEQ ID NO: 158349 - RNA, 41 nt, Homo sapiens
caaagcucaugauaucagaaagaaugaacaaagggguccca

SEQ ID NO: 158350 - RNA, 41 nt, Homo sapiens
uggcaccccguuggcuggguuagccugccgccaucaacaca

SEQ ID NO: 158351 - RNA, 44 nt, Homo sapiens
aaucgcgcuugacggcccgcccaucaaggucuccggagccccag

SEQ ID NO: 158352 - RNA, 30 nt, Homo sapiens
uucggguggccgaaguauaugcccuccagg

SEQ ID NO: 158353 - RNA, 32 nt, Homo sapiens
cucucagaaauugggaucuuggaauucucuag

SEQ ID NO: 158354 - RNA, 46 nt, Homo sapiens
gaaaguucuguaauggcuaacaggauuagaaugacauugucacaaa

SEQ ID NO: 158355 - RNA, 45 nt, Homo sapiens
gcacgcaugucuuccgugcuuguggcaaaaggcccuuuccuggcu

SEQ ID NO: 158356 - RNA, 88 nt, Homo sapiens
gggccauuuacauaaaaugagaaggucugauuaaugacgaacuuuuuuuuuucccagcacuuaauuguaaauuaagauuugcugauga

SEQ ID NO: 158357 - RNA, 95 nt, Homo sapiens
uggcccccaaaagcaacacacauuuuuaaucuguccugccgauagcugagcccuucugucauuuggguccuaauaaaugaauuggccaucugcaa

SEQ ID NO: 158358 - RNA, 55 nt, Homo sapiens
cuaccuauaaauggaaacacauuuaacaguccccagggguauggggcggcugaua

SEQ ID NO: 158359 - RNA, 50 nt, Homo sapiens
cugcucacgucuuagccugauuaccuggccgccucggcucaccugggcac

SEQ ID NO: 158360 - RNA, 43 nt, Homo sapiens
gaagcucgagaagaagcugcuggagcagaggcgaaaggaggag

SEQ ID NO: 158361 - RNA, 51 nt, Homo sapiens
guguucguguguguguguggacacauuuuccuuuucgguugcucuguccuu

SEQ ID NO: 158362 - RNA, 54 nt, Homo sapiens
agcgcaacgaggagaaggcgcagcgugaggccaacaaaaagaucgagaagcagc

SEQ ID NO: 158363 - RNA, 46 nt, Homo sapiens
cugugugugcgcggagcagacgugucccgggccaggccgggccgug

SEQ ID NO: 158364 - RNA, 46 nt, Homo sapiens
auggccuuuccuccuuuuuuuucuuaaggugcuguuuugggggaaa

SEQ ID NO: 158365 - RNA, 46 nt, Homo sapiens
cuugauuucaaaguauaaaucuggaaaagucuagaaucuuuucugu

SEQ ID NO: 158366 - RNA, 45 nt, Homo sapiens
uuguguggaaggagggcaaaaaaacuucacacguggauuaucugu

SEQ ID NO: 158367 - RNA, 39 nt, Homo sapiens
auguguuuuuuccaugaaacauauauguauuuuuacaaa

SEQ ID NO: 158368 - RNA, 44 nt, Homo sapiens
gugaagcagaugaggauccugcauguuaauggguuuaauggaga

SEQ ID NO: 158369 - RNA, 43 nt, Homo sapiens
ucuacuuuaacccugaauucagaaggauugguugggaugcaca

SEQ ID NO: 158370 - RNA, 48 nt, Homo sapiens
auguagagagacugugugggguuugugugacacugcggugccuugcag

SEQ ID NO: 158371 - RNA, 41 nt, Homo sapiens
cuagaugauggcuacaguuucucaucuucccggcuaugucc

SEQ ID NO: 158372 - RNA, 49 nt, Homo sapiens
agcuuucauuaccugugaaguggagccugcuuuuaaugaaugggaauag

SEQ ID NO: 158373 - RNA, 33 nt, Homo sapiens
uuugauucugcacauacaaagcagacagucgca

SEQ ID NO: 158374 - RNA, 45 nt, Homo sapiens
auccccaaacccccgcaccguccccuggaacccacgccaucccca

SEQ ID NO: 158375 - RNA, 22 nt, Homo sapiens
caucccauguggcugaguuaaa

SEQ ID NO: 158376 - RNA, 45 nt, Homo sapiens
accaguucagaguggacuacauccugagugugaugaacgugccug

SEQ ID NO: 158377 - RNA, 40 nt, Homo sapiens
agcguaauaucuggaguguucuauuucauggaccaaacag

SEQ ID NO: 158378 - RNA, 146 nt, Homo sapiens
cgguaggaugcugugggcuuggcuguucguaaagaacgcuuugcuucuguguuguuagggaucagggucgcugcucacgcucuuggcuuugcucucuuugguuaagaugugacugccaucaucuucgugguggccagcagcagcua

SEQ ID NO: 158379 - RNA, 26 nt, Homo sapiens
cucgcugagaaaguccuugcugggaa

SEQ ID NO: 158380 - RNA, 63 nt, Homo sapiens
agcuacucccgagcccggagaggacccacgcgugacccgggccaaguacuucauucgagauga

SEQ ID NO: 158381 - RNA, 52 nt, Homo sapiens
cacugccaguggagaugggcgucacuacugcuacccucauuucaccugcgcu

SEQ ID NO: 158382 - RNA, 81 nt, Homo sapiens
caguuaaucacccaccauagggcaugauuaacaaagcaaccuuucccuucccccgagugauuuugcgaaacccccuuuucc

SEQ ID NO: 158383 - RNA, 76 nt, Homo sapiens
ccacaaaaguucccucucacuuucaguaaaaauaaauaaaacagcagcagcaaacaaauaaaaugaaauaaaagaa

SEQ ID NO: 158384 - RNA, 59 nt, Homo sapiens
acaaaugaaauaaauauuguguugugcagcauuaaaaaaaaucaaaauaaaaauuaaau

SEQ ID NO: 158385 - RNA, 70 nt, Homo sapiens
aguucagacuuaucaccauucuuaugucacuuuagaaucaagggugggggagggagggagggaguuggca

SEQ ID NO: 158386 - RNA, 111 nt, Homo sapiens
gccaucgaggagcacuguacauuuggggaccccaucguuuaaggccaugucacuagaagcgcaguuuaagaaaaggcauggugacccaugaccagaggggauccuaugguu

SEQ ID NO: 158387 - RNA, 46 nt, Homo sapiens
aggcuggcugaggaucgugaccagcaccuauaaggaugggaagggc

SEQ ID NO: 158388 - RNA, 75 nt, Homo sapiens
ggaggcaucuaugccgaauaccaggacaccacauauauaaaccaugucguuucuguggcuggguggggcaucagu

SEQ ID NO: 158389 - RNA, 41 nt, Homo sapiens
uacggcucccucucugggagggagaagaugauggcagaaau

SEQ ID NO: 158390 - RNA, 42 nt, Homo sapiens
uggcuccugugaaggggguaaugaccuguccgugugggacua

SEQ ID NO: 158391 - RNA, 51 nt, Homo sapiens
cugcucucauggcauuuguagcgggagguguggcagacaggacagugccca

SEQ ID NO: 158392 - RNA, 41 nt, Homo sapiens
ccuccacuuccucuucucuacccuugaacccacuccagccu

SEQ ID NO: 158393 - RNA, 29 nt, Homo sapiens
ccgucccuucccacucagggaagcucucc

SEQ ID NO: 158394 - RNA, 70 nt, Homo sapiens
cugugggaagccuugaacucuuugagagggagucaggugacaagaugugcgucugugaaggacugcgggu

SEQ ID NO: 158395 - RNA, 42 nt, Homo sapiens
gaggagguggcaugugguuucauucagagaugagccuugucc

SEQ ID NO: 158396 - RNA, 47 nt, Homo sapiens
gaaagugcauucuggguggagagaacaccaugugcaaaguucaaggg

SEQ ID NO: 158397 - RNA, 40 nt, Homo sapiens
ucugcaagcuuucgagcacauguaauaauacacacugggg

SEQ ID NO: 158398 - RNA, 40 nt, Homo sapiens
auuaccagucuuuucaaaaacaugcucauacuggaaagaa

SEQ ID NO: 158399 - RNA, 41 nt, Homo sapiens
uuccgggucuuccucagucuggauggcauguuggcagccca

SEQ ID NO: 158400 - RNA, 49 nt, Homo sapiens
uuuagccagccuucacaccuuacuacacauaagaggaugcacacuggag

SEQ ID NO: 158401 - RNA, 46 nt, Homo sapiens
aaaacuuuuaagcgacucucaacccuuacuaaacauaaaauaauac

SEQ ID NO: 158402 - RNA, 58 nt, Homo sapiens
caaagcauuucuaugguccucaacccuaagaagacauaagaggauacacacuggagag

SEQ ID NO: 158403 - RNA, 48 nt, Homo sapiens
aagcaauucucaacccuuacuacacauaaaauaauucaugcuggaaag

SEQ ID NO: 158404 - RNA, 46 nt, Homo sapiens
auggucuucaacccuaacuagacauaagaggauacacacuggagag

SEQ ID NO: 158405 - RNA, 46 nt, Homo sapiens
agcgacucucaacccuuacuaaacauaaaauaauacaugcuggaga

SEQ ID NO: 158406 - RNA, 46 nt, Homo sapiens
agccauucuucagcccuugcuaaacauaagagaauucauacuggag

SEQ ID NO: 158407 - RNA, 46 nt, Homo sapiens
uaugguccucaacccuaagaagacauaagaggauacacacuggaga

SEQ ID NO: 158408 - RNA, 46 nt, Homo sapiens
agacaauccuuaacccuuaauaaacauaagauaauucauaguagag

SEQ ID NO: 158409 - RNA, 46 nt, Homo sapiens
ggcaauccucaacccuuacuaaacauaagauaauucauacuggaga

SEQ ID NO: 158410 - RNA, 50 nt, Homo sapiens
cuuuuagccguucuucaacccuugcuaaacauaagagaauucauacugga

SEQ ID NO: 158411 - RNA, 45 nt, Homo sapiens
uguuccaguuccuuucgaaugcaugaaagaauucacacuggagag

SEQ ID NO: 158412 - RNA, 46 nt, Homo sapiens
aguuuuucuaguuccuuucggaugcaugaaaggacucacacuggag

SEQ ID NO: 158413 - RNA, 45 nt, Homo sapiens
gcauucauuucucuuccaagcuaucgaagacauaugauaaugcac

SEQ ID NO: 158414 - RNA, 47 nt, Homo sapiens
gauauuaccaaacuuuucaaauacaugaaaggacucacacuggggaa

SEQ ID NO: 158415 - RNA, 46 nt, Homo sapiens
auacuuuuaugcuaagaucuuacuuuaagcuuuuuaugugaacaaa

SEQ ID NO: 158416 - RNA, 46 nt, Homo sapiens
guauccaugugcaugcucuuagagaccuugaaugguugaggguaaa

SEQ ID NO: 158417 - RNA, 51 nt, Homo sapiens
ugggggcagaggcucuguuacaaauccuggaggugagguugccaggagggg

SEQ ID NO: 158418 - RNA, 47 nt, Homo sapiens
uaacucaucuguugccauaacuuugaagucuguuucacucagucgaa

SEQ ID NO: 158419 - RNA, 58 nt, Homo sapiens
gcugacgggucagagggcaagacgugacccagggccgagagggugagugaccaggaaa

SEQ ID NO: 158420 - RNA, 57 nt, Homo sapiens
uguuuuaaauuuuuaaauuuuuuuuuguguuuaaauuuuuguguuuaaaaauuuuaa

SEQ ID NO: 158421 - RNA, 46 nt, Homo sapiens
cgcugggcggggcaggagggaaaggcaaccgcuucuuccuggccaa

SEQ ID NO: 158422 - RNA, 76 nt, Homo sapiens
cugaagccccacgucgggaucguccacuacgaaggccaccuacaaauagcagguagaacuuccagaauucucccaa

SEQ ID NO: 158423 - RNA, 70 nt, Homo sapiens
gaggccaaauucgccgcuucccgccgccggcugcgcagguaggagcucccgagucgcccgcaggaggacc

SEQ ID NO: 158424 - RNA, 92 nt, Homo sapiens
gaggcgaaggggccccacgcugcagcgggugccggggggaagcgggugagcaggggcugcggcccuggcagggacugucggaguggccgggg

SEQ ID NO: 158425 - RNA, 46 nt, Homo sapiens
ggagcuccagaguugcggagucacccaccugcggcggccgcugcug

SEQ ID NO: 158426 - RNA, 63 nt, Homo sapiens
aucugacuuccacuuccaagggagaaaccgccucccgcacuggcgccccgaggggagagagaa

SEQ ID NO: 158427 - RNA, 62 nt, Homo sapiens
cuaaaagacccuagcagaggagucagggccuccuaucccggagaugcagcugacugaccagg

SEQ ID NO: 158428 - RNA, 40 nt, Homo sapiens
ugggagucggccccagggcaggaggcagggcaggcaggca

SEQ ID NO: 158429 - RNA, 34 nt, Homo sapiens
uuuguaucuugugugugugacccuaguuucugua

SEQ ID NO: 158430 - RNA, 43 nt, Homo sapiens
agugugaggaagccauggucaguugcacagugugcucacugca

SEQ ID NO: 158431 - RNA, 68 nt, Homo sapiens
ccacacccgucccgggacccccgcccccucccacgcgcccuucggaccccgccccggaccccgcccac

SEQ ID NO: 158432 - RNA, 42 nt, Homo sapiens
ucaucugggaccaucugagcaccauguacgacaugcaggcgc

SEQ ID NO: 158433 - RNA, 46 nt, Homo sapiens
ucuuccauucccgaauccagagaggaacuucguccuuccagaagag

SEQ ID NO: 158434 - RNA, 23 nt, Homo sapiens
uggguuuucggugagcgucagcu

SEQ ID NO: 158435 - RNA, 47 nt, Homo sapiens
ucgggccagggaaaaccucggauuagcaagcaauaaaaacaugaccu

SEQ ID NO: 158436 - RNA, 44 nt, Homo sapiens
aagaagccuauuuuacuaguguuuuauaugaacaaaguacugca

SEQ ID NO: 158437 - RNA, 77 nt, Homo sapiens
auaugccagauacagagaauuuguagcgguuauuuuuguaugaucuaguaacuugcaaacagaccaaauggaugaga

SEQ ID NO: 158438 - RNA, 57 nt, Homo sapiens
cauggacgaccccgacugcgacuccaccugggaggaggacgaggaggaugcggagga

SEQ ID NO: 158439 - RNA, 43 nt, Homo sapiens
cggcgcgagggacgcggacgcaggggacgaggacgaggagucg

SEQ ID NO: 158440 - RNA, 59 nt, Homo sapiens
acuccagggcuguuugggcaauggaccaaggcccugaguccccuccuugcugccuguag

SEQ ID NO: 158441 - RNA, 41 nt, Homo sapiens
agcccagcucucugccccauccgcucgagggcuccaggaag

SEQ ID NO: 158442 - RNA, 70 nt, Homo sapiens
agaggagccagggggaugaggcagggggccacggggaagauaggccggagcccuuaagccccaaagagag

SEQ ID NO: 158443 - RNA, 61 nt, Homo sapiens
cggugaucggcacucacagcgcuuccacuccgggcaguuacgugcgcccaugaaaagcaac

SEQ ID NO: 158444 - RNA, 39 nt, Homo sapiens
cucucuggacaugcaaguuauugagcuuuuccauccacu

SEQ ID NO: 158445 - RNA, 46 nt, Homo sapiens
ucguucaucaaguguuuccagauccacacuagguucgauuccagau

SEQ ID NO: 158446 - RNA, 41 nt, Homo sapiens
agucugugcaaacuccagcgccgccucugucucccgcuggc

SEQ ID NO: 158447 - RNA, 35 nt, Homo sapiens
cuccacaccuagaauauaaauacaucugauaaaaa

SEQ ID NO: 158448 - RNA, 55 nt, Homo sapiens
acaagggagaaaaagaguucucuacugcaguaagaaucuugcagucgcaggcuga

SEQ ID NO: 158449 - RNA, 53 nt, Homo sapiens
auuucuaggggguagggaagcaccaccuccccagcaccgcauccuuacaaaau

SEQ ID NO: 158450 - RNA, 33 nt, Homo sapiens
cuccaacuuaucuucauccucaaaccucagagg

SEQ ID NO: 158451 - RNA, 51 nt, Homo sapiens
auauaucaucaauuugacauauucuuaaaacuagagggugugagaagcaca

SEQ ID NO: 158452 - RNA, 42 nt, Homo sapiens
gcugacccacccgggcagcaccgcccaaguccacgugucagu

SEQ ID NO: 158453 - RNA, 72 nt, Homo sapiens
gacuuaacacacgaggcuugcagaagggacaugggggcccccacccuuaacuuuccacuaaaagccacacag

SEQ ID NO: 158454 - RNA, 32 nt, Homo sapiens
aguggggugacggccgugauggagccccaggc

SEQ ID NO: 158455 - RNA, 26 nt, Homo sapiens
aagcuagcccucccaccccgcgaaca

SEQ ID NO: 158456 - RNA, 37 nt, Homo sapiens
aggccuuccaauuggccuacaauuugucauguggauc

SEQ ID NO: 158457 - RNA, 29 nt, Homo sapiens
gcagagagcugggagacgacggcugcccu

SEQ ID NO: 158458 - RNA, 73 nt, Homo sapiens
cugugcagcggacacugcacuaggggaagaaacacgcagcccgcucggggcucaucccagcgugggucuggag

SEQ ID NO: 158459 - RNA, 62 nt, Homo sapiens
ugcagcagggcccucuccugacucagcugcccgaaagccccccugggcgcaccgcacaacgg

SEQ ID NO: 158460 - RNA, 45 nt, Homo sapiens
ggguugggagcuagagguccucauggguagagcucagguccaccc

SEQ ID NO: 158461 - RNA, 46 nt, Homo sapiens
ggcugggcagagucuggagacauuucuggcuguugucugacuggga

SEQ ID NO: 158462 - RNA, 27 nt, Homo sapiens
ucuugaauauucaaaauagucacguag

SEQ ID NO: 158463 - RNA, 48 nt, Homo sapiens
uuuuguuuugaugaacugcagaaaacagguguuuauuuccuaacuuug

SEQ ID NO: 158464 - RNA, 67 nt, Homo sapiens
ucccugggcucccugucguuggcagugaucagcccaaguguggugugucgccuuuuagguggaaaau

SEQ ID NO: 158465 - RNA, 85 nt, Homo sapiens
uccuucaguaaguggucccugcggaccccugcugcgagugguccugugaccggggcuuccaagcagcucaacagauugccccuca

SEQ ID NO: 158466 - RNA, 46 nt, Homo sapiens
caggugugaauugggggucuuggguguauugcagugacccccagcu

SEQ ID NO: 158467 - RNA, 74 nt, Homo sapiens
ugccagcaucuucggccucuuguccgcuuuguuuucagggcccaggggaaucgcuacgugggguuugggaacac

SEQ ID NO: 158468 - RNA, 46 nt, Homo sapiens
cugggccacagccugaacgagaacguccucaagccugcgcaggaga

SEQ ID NO: 158469 - RNA, 91 nt, Homo sapiens
ggggacgugggugugucagggguguuagggggauuguuuguccagcagcugggacucagcgaggccaagccucacaccccaccucuccagc

SEQ ID NO: 158470 - RNA, 46 nt, Homo sapiens
ucuggaccacuuccaaaacagcaacauagaccagagcuucugggag

SEQ ID NO: 158471 - RNA, 39 nt, Homo sapiens
gccuccaccaacaggaacagcaacagcgacggcggggag

SEQ ID NO: 158472 - RNA, 65 nt, Homo sapiens
uucguguuugcacucugcccucgucguuccuccuccuuccauuugacccaagaaucagcaacugc

SEQ ID NO: 158473 - RNA, 49 nt, Homo sapiens
caaaggaauuuuacauuauuaggaggaggaaaggcuguauuuauccgcu

SEQ ID NO: 158474 - RNA, 42 nt, Homo sapiens
ggacaaaggggagugggugccaggcuuggaggcccggcccag

SEQ ID NO: 158475 - RNA, 27 nt, Homo sapiens
agagggcagcuugggcuggggcggggg

SEQ ID NO: 158476 - RNA, 44 nt, Homo sapiens
gcaccaccggauccggcaggcccccaacccuuacucgucggaaa

SEQ ID NO: 158477 - RNA, 40 nt, Homo sapiens
ccagcaucgcacugggccggccugucccgcagccccucug

SEQ ID NO: 158478 - RNA, 41 nt, Homo sapiens
caggacuacgaacagaugguggacuuggucaccacggacga

SEQ ID NO: 158479 - RNA, 46 nt, Homo sapiens
ucaugguccccaucaauggcuccgugaccaagaucuucguggccga

SEQ ID NO: 158480 - RNA, 45 nt, Homo sapiens
cgugcugaagaggaagaggcacgagcuggcguuugugugccgcau

SEQ ID NO: 158481 - RNA, 31 nt, Homo sapiens
cuggacugugggauggccuucgccggggaug

SEQ ID NO: 158482 - RNA, 41 nt, Homo sapiens
gagcccgagcgguaccgccacugcucuuucgugccagagac

SEQ ID NO: 158483 - RNA, 46 nt, Homo sapiens
gcaccaguuucucuaugaggaggaggcggcucagcagcagcuggug

SEQ ID NO: 158484 - RNA, 60 nt, Homo sapiens
uuuguuagaaaaaaccuguuuucuccgcuuuauaaaaacauuugaagccaugcuuuauau

SEQ ID NO: 158485 - RNA, 68 nt, Homo sapiens
ugaacucuuaaggagaguauuaggaacucguccguucagguucuaacuuguugguguuaagugucugg

SEQ ID NO: 158486 - RNA, 129 nt, Homo sapiens
uuucgugugccgaagccaugauuucucaaauucauucaguugugucauacaggaaaaggaagcaaaaauuucagcuuuauuuuuguuuuccggcuuaggcuugguugggaagauuugauggugguuaga

SEQ ID NO: 158487 - RNA, 154 nt, Homo sapiens
uucugucagaugaggguaguggugcuuccccugcguccugcugggagaaaaaaggaggcaguaaaugaaaggugucucaucaccugcuuccuaaauagaagggacaaagaggcugaaaaacaguaauagucuuguuuuaugaaaaugccacccc

SEQ ID NO: 158488 - RNA, 53 nt, Homo sapiens
gacaucccugaagaggauuagcagcuagucuguuaucagucacaggcaguuca

SEQ ID NO: 158489 - RNA, 46 nt, Homo sapiens
cuugaguguagauuuugucucucaucacccuuugcauuaacuuugg

SEQ ID NO: 158490 - RNA, 16 nt, Homo sapiens
gucuuacucuugaccc

SEQ ID NO: 158491 - RNA, 44 nt, Homo sapiens
agucauuguaccacguccuuggguuggacaagaacgcaaccuca

SEQ ID NO: 158492 - RNA, 49 nt, Homo sapiens
aucaccccgacaagaaccccgacaacccggaggccgcggacaaguuuaa

SEQ ID NO: 158493 - RNA, 46 nt, Homo sapiens
agcaggcgcauagagcuguccccgccgugaccugcgguagccguag

SEQ ID NO: 158494 - RNA, 44 nt, Homo sapiens
gcgccuggccacgccaaccuuagaaucaugaacuguagucacag

SEQ ID NO: 158495 - RNA, 78 nt, Homo sapiens
aauaaaucaugguuguggccauucucacgguggugauugugauuagacgacccccgggaagcccagacacucggggcc

SEQ ID NO: 158496 - RNA, 116 nt, Homo sapiens
uggaguuccucccccugccugaccuagaagcagaaccguuuucagcgcucugcccuguuggcuuuaaggcuuugucuuaauuuaaggaaaaagauccucccggguuuuauuucucu

SEQ ID NO: 158497 - RNA, 41 nt, Homo sapiens
gaucaggacgcccccagcaccccugccugcuuuugcuggug

SEQ ID NO: 158498 - RNA, 45 nt, Homo sapiens
ggcccuuucacggcagcugcugcuguauagauuugucuccacuca

SEQ ID NO: 158499 - RNA, 44 nt, Homo sapiens
uguuugugaacuuuccuaguucucuauguuguuagugcagccag

SEQ ID NO: 158500 - RNA, 59 nt, Homo sapiens
cugccauccagggaaggcccuggagccucacgcagucgaggcugcucucaggugcuacg

SEQ ID NO: 158501 - RNA, 49 nt, Homo sapiens
acgcagcaggagugucauucaugcugcuguccccuggugaagugacaag

SEQ ID NO: 158502 - RNA, 31 nt, Homo sapiens
gaccggcccaucugucuguguccacaggugc

SEQ ID NO: 158503 - RNA, 28 nt, Homo sapiens
ggagaauuacagacaggccuggggggca

SEQ ID NO: 158504 - RNA, 41 nt, Homo sapiens
ugagccuugggguagccagggaagggacccggcagggccug

SEQ ID NO: 158505 - RNA, 50 nt, Homo sapiens
ccaaguccugugcugucagugccccgccaccuccagaccacucagcccac

SEQ ID NO: 158506 - RNA, 49 nt, Homo sapiens
cacuugucuguccacccacccagcccaguucuaggucguuccccagcac

SEQ ID NO: 158507 - RNA, 47 nt, Homo sapiens
ggggcagcugccuggagccagaaccgguuuggauguccccccuagac

SEQ ID NO: 158508 - RNA, 56 nt, Homo sapiens
gugcccuggggcuggguggguagggggcugcuugaguguggccccaccuccuggga

SEQ ID NO: 158509 - RNA, 44 nt, Homo sapiens
gaggcuugaacccagaccccagcacugugaugggaguccacggc

SEQ ID NO: 158510 - RNA, 42 nt, Homo sapiens
gcagcaggugcuccgccugcaggugcgugaggaggggcggag

SEQ ID NO: 158511 - RNA, 55 nt, Homo sapiens
ugcggcugaaugcggagaagcugcagcggauggggcuggcccaggaggcccagag

SEQ ID NO: 158512 - RNA, 63 nt, Homo sapiens
cccggcccgugguccuguggagucagcaggacgucugcaaguggcucaagaagcacugucccc

SEQ ID NO: 158513 - RNA, 42 nt, Homo sapiens
auagcaucugcuuccucaucaucuuucucguaggguccacuu

SEQ ID NO: 158514 - RNA, 23 nt, Homo sapiens
cuaggaauaaacagugaugucug

SEQ ID NO: 158515 - RNA, 46 nt, Homo sapiens
uggauccacugcucacgguugaucuccacaccguuggcccgcagcg

SEQ ID NO: 158516 - RNA, 64 nt, Homo sapiens
cccaaaggagaucacucccaaacacagaccagcuggugggcauggggagggggccaggucuuca

SEQ ID NO: 158517 - RNA, 42 nt, Homo sapiens
caggcacauccccugccagccacuuggacuuggcgcccauga

SEQ ID NO: 158518 - RNA, 47 nt, Homo sapiens
uggcccgugcucgaguaagcugcccaaucuucuccuccagccgagag

SEQ ID NO: 158519 - RNA, 49 nt, Homo sapiens
cacugagaagaugggcuccaggcagcacaagggccugggccugcagccc

SEQ ID NO: 158520 - RNA, 45 nt, Homo sapiens
gcugcagcucaaacuuguagaagaaggcccaggcaucccccaggu

SEQ ID NO: 158521 - RNA, 45 nt, Homo sapiens
cuugcugagcaccgcguugugcagguccggguucugcugagccag

SEQ ID NO: 158522 - RNA, 57 nt, Homo sapiens
caggguugagucuggguuccugugaccagcguucuggacuggggucugcccugggaa

SEQ ID NO: 158523 - RNA, 127 nt, Homo sapiens
uucacacacaccccggaaaacuggucagcacaaaguaggggucugcgaaccauucauagcuguuuccagagaugacccgagaauggaguuguuccccuucuuaaaggagacaaaacacaaacgauaa

SEQ ID NO: 158524 - RNA, 118 nt, Homo sapiens
ucgguggcggcucagcgcccuuggggagcacugaguugccgggccugguguggaaaugugaccgguuugugccuggccucgucaguguugaggaccuggaggaaacgcagaucuuggg

SEQ ID NO: 158525 - RNA, 32 nt, Homo sapiens
ggcuggcaguggaucagugggugccugucagc

SEQ ID NO: 158526 - RNA, 47 nt, Homo sapiens
gggcagccccauguugggguccagcccugaggggcauccuucuccca

SEQ ID NO: 158527 - RNA, 51 nt, Homo sapiens
ccagauuuaggaccucagaauccugcacucaagguggcaggacccaauuuc

SEQ ID NO: 158528 - RNA, 51 nt, Homo sapiens
gggccaucacaguccuccuccgaggccuaggccgcccccagcagcacagac

SEQ ID NO: 158529 - RNA, 45 nt, Homo sapiens
gcaggagccguccgcacacacguucgacgacgcgcagcugcagau

SEQ ID NO: 158530 - RNA, 42 nt, Homo sapiens
ggccgaggccaaccagcaugugguagacgagaaggcgaggcu

SEQ ID NO: 158531 - RNA, 99 nt, Homo sapiens
uuugccuuaaaugggcuuaagggacauuuuggaaagugcuuuauaacgaccuuuuuuuuuuuuauuucuucucuaguuuaagaagaaaauaggaaaggg

SEQ ID NO: 158532 - RNA, 50 nt, Homo sapiens
aaagaauuguuuguggcugcaaugggugagaauacacauauauaauugag

SEQ ID NO: 158533 - RNA, 46 nt, Homo sapiens
aauuuaacugcauuugcaaaucaugaaaaaaacacuacuucugcag

SEQ ID NO: 158534 - RNA, 51 nt, Homo sapiens
aauuaaucucauguauuuaguuuauaccaggugaguaagcugagccugcaa

SEQ ID NO: 158535 - RNA, 57 nt, Homo sapiens
uucaaaaguuaaaacagaaguguaaaguucugugcaauuaaaaauaaucagcuuguc

SEQ ID NO: 158536 - RNA, 45 nt, Homo sapiens
auaguuaagcauuuuaucuaggucacagcacaauaagcaagaugg

SEQ ID NO: 158537 - RNA, 118 nt, Homo sapiens
ucaucauucaguagaaauaaaagaugacuuuagaaauauuaaaauacaaaaaucuacacugaggucuuuugaaugcaggaaaaagaauuauaucacacacacacguacacgcacgcau

SEQ ID NO: 158538 - RNA, 52 nt, Homo sapiens
cucccacuccguaucaccugacugugcacaauaucucauugccaccucccag

SEQ ID NO: 158539 - RNA, 125 nt, Homo sapiens
gugaacuuucacuaguuuacuaucuaacaaugaauuugacgauagccacauaccaucuuauagcaauauuuguuaucauaucccuuguuauuuaucauucaccugcucugcuugagccagcuaca

SEQ ID NO: 158540 - RNA, 41 nt, Homo sapiens
aaaugguagcaccaggauuugaaacaaaucagucugaccca

SEQ ID NO: 158541 - RNA, 89 nt, Homo sapiens
aagauucagcagcuaccauuugcagcugagggacagccccucccugcuuagcaaccaauggauaugcauuuauggaacaccugcuaacu

SEQ ID NO: 158542 - RNA, 45 nt, Homo sapiens
auccaaaaagcuuacaguuuaugcaucacuuauucuaacaguaga

SEQ ID NO: 158543 - RNA, 46 nt, Homo sapiens
uuaccucaugucagugaucuucugauauguuaaaaaggguauuuua

SEQ ID NO: 158544 - RNA, 50 nt, Homo sapiens
guuugggacucaaagaaugcucaucugaaauugagggcugaccagcgagg

SEQ ID NO: 158545 - RNA, 46 nt, Homo sapiens
cugguguuucuagguacuacacuuaauuugaaagaaauuauugagg

SEQ ID NO: 158546 - RNA, 43 nt, Homo sapiens
uaggaauguaugagguguguuugagaaauaacauggaggccag

SEQ ID NO: 158547 - RNA, 51 nt, Homo sapiens
aaguguagguuucagagcaguggguagacuaaggguuuggacuaguggauu

SEQ ID NO: 158548 - RNA, 48 nt, Homo sapiens
auccauuuaucauuuauucauucauucaaccaacauguauuuagcaag

SEQ ID NO: 158549 - RNA, 29 nt, Homo sapiens
uggcaucucacauuguagauggcaauuaa

SEQ ID NO: 158550 - RNA, 46 nt, Homo sapiens
agagaagagggaacacgagcgagaaguccuucagaaggcuuuggag

SEQ ID NO: 158551 - RNA, 64 nt, Homo sapiens
aaugcuaaaauauuguauuacauuuccuuuauauugaugggaggaaggggguaaauugcagaaa

SEQ ID NO: 158552 - RNA, 66 nt, Homo sapiens
ggcaugcugcggaggugcgcaggaacaaggaacuccagguugaacugucuggcugaagcaagggag

SEQ ID NO: 158553 - RNA, 50 nt, Homo sapiens
uauaaaaaaaaaaaaacaaaaaaaaucaaaaauuaaaaaaaaucaaugcg

SEQ ID NO: 158554 - RNA, 46 nt, Homo sapiens
augugcuacaaaugugcuuuggcuuuagaaagggauggaugagaag

SEQ ID NO: 158555 - RNA, 53 nt, Homo sapiens
acaccaacaacaaaacacuccaucugugaagcugacgcaguuaagggggcuag

SEQ ID NO: 158556 - RNA, 30 nt, Homo sapiens
acauucuuuuaaaaaaaaaugaaaggaaag

SEQ ID NO: 158557 - RNA, 42 nt, Homo sapiens
gggcgagggccggcgacuguggaucuggagcuggacgcgcug

SEQ ID NO: 158558 - RNA, 42 nt, Homo sapiens
uuagaaagccugggaacaaguuuuauaaaaguucuguaugug

SEQ ID NO: 158559 - RNA, 42 nt, Homo sapiens
uuuuaugacucauuucuuaucagauugaaucaaaaagaaagu

SEQ ID NO: 158560 - RNA, 47 nt, Homo sapiens
ugguuuagaccacuuucuaccuaauugugaaauuuucauagccuaaa

SEQ ID NO: 158561 - RNA, 81 nt, Homo sapiens
aguuaaccuuuacagaaacuaaguaaugaauucagaccagugaucugauugaaauuuccaguuggaauauauugaugucag

SEQ ID NO: 158562 - RNA, 46 nt, Homo sapiens
guuucuuuaagacuuuauauugcuuuucaaacaaagaaagcccuaa

SEQ ID NO: 158563 - RNA, 46 nt, Homo sapiens
aaaugaugguuguaaugucgacgagggccaaauagaaaacuaccaa

SEQ ID NO: 158564 - RNA, 38 nt, Homo sapiens
uaaaggaauaaauaacaucuuuuggguguagcgguugu

SEQ ID NO: 158565 - RNA, 52 nt, Homo sapiens
uauaauacauuugcaacugaauuuacucuccacugaaaggagaaaacugaag

SEQ ID NO: 158566 - RNA, 46 nt, Homo sapiens
cacuaaaaaggcacuugcucauucacacaggagugagaucauuuag

SEQ ID NO: 158567 - RNA, 46 nt, Homo sapiens
cguuaugguguuuguguagacugugcagauaaaucacagccaggag

SEQ ID NO: 158568 - RNA, 47 nt, Homo sapiens
cuauacuccucaaggaugcugcauuuggaccuaauaugaaucgacaa

SEQ ID NO: 158569 - RNA, 45 nt, Homo sapiens
agguaacaaugaaauacucauaauuuugucuguggaacucuggca

SEQ ID NO: 158570 - RNA, 42 nt, Homo sapiens
cucuuguaauuuauauuuuaaaugaaaaaguauuuuagagcu

SEQ ID NO: 158571 - RNA, 52 nt, Homo sapiens
guuguuuaauaauagauaagaaccaagaggaaaaagaaauaagaaaagaugg

SEQ ID NO: 158572 - RNA, 46 nt, Homo sapiens
uuaaauuuggaguacacuagcuauugagaacaauauuuuggguuga

SEQ ID NO: 158573 - RNA, 32 nt, Homo sapiens
ccgccugcuguuuguaaaagcucuuugggaag

SEQ ID NO: 158574 - RNA, 47 nt, Homo sapiens
gcccguuuaaguguaaaaugcagaaguggcucuguccccccagaguu

SEQ ID NO: 158575 - RNA, 56 nt, Homo sapiens
cgcucuuuaaucagugcuuuacuacauuacucagccugaaaaaauaucuuuuccuu

SEQ ID NO: 158576 - RNA, 53 nt, Homo sapiens
gcauagguuuuaucugcuggguuuaauucucaaucccagaaaaaaauauucuu

SEQ ID NO: 158577 - RNA, 42 nt, Homo sapiens
cuaccacaacugcaaauuauucaaaauaaacuuggauacaua

SEQ ID NO: 158578 - RNA, 89 nt, Homo sapiens
cuaccgguccucuccacgugcgaggcuaauagagugaucagaaccaggaaugugagcuggguuccaccuuaggaggggacaaugaggac

SEQ ID NO: 158579 - RNA, 49 nt, Homo sapiens
cucaucugccugagcuagaggccaggcuguuguuaauguuuuuucaguu

SEQ ID NO: 158580 - RNA, 42 nt, Homo sapiens
aguguaaagucauucacaggcaguuggguuguggagcuagaa

SEQ ID NO: 158581 - RNA, 83 nt, Homo sapiens
cauguugccaagugcaaacugauuuauccccagaugaaucccuuuacuguagcagaucccuaaucccuaaauuucagccaauu

SEQ ID NO: 158582 - RNA, 35 nt, Homo sapiens
gaggggaaagcaaaaugagaauaaauuaugucaug

SEQ ID NO: 158583 - RNA, 50 nt, Homo sapiens
aaagcaccuuuucuuucuaagauuuuaguaauccaaaagcuagccuaauu

SEQ ID NO: 158584 - RNA, 41 nt, Homo sapiens
guagaaauacagaucagauggaauggguauuauaggagaau

SEQ ID NO: 158585 - RNA, 46 nt, Homo sapiens
augaccuugguuuuauacauuguagcuuauuuuuuaaaauauagua

SEQ ID NO: 158586 - RNA, 48 nt, Homo sapiens
ggacuuuuguggacaaggugcugcuuuuucucaugacccuguagaauu

SEQ ID NO: 158587 - RNA, 41 nt, Homo sapiens
ugugaacugggcaguacugacauuugugaggcauaggggag

SEQ ID NO: 158588 - RNA, 126 nt, Homo sapiens
gggaaaaauaaagggcaugcaaaaauaggucuggagacuccugaaacuaggaagaauuuuguuaucacuaaagucuuuuauagucagaacaauuuuuuuuucaaaugaacaugguaucauuucaag

SEQ ID NO: 158589 - RNA, 47 nt, Homo sapiens
caaagugcagcauucacuugcaaagguugagagaaaaguggccagaa

SEQ ID NO: 158590 - RNA, 39 nt, Homo sapiens
uuaagaauuugcucaaaagggaacauaacgccaaaagga

SEQ ID NO: 158591 - RNA, 42 nt, Homo sapiens
caugcgcacacgguccuguccuccccacccagaggcacaguc

SEQ ID NO: 158592 - RNA, 30 nt, Homo sapiens
uguuggaaauauaucaagauuuuuugugug

SEQ ID NO: 158593 - RNA, 46 nt, Homo sapiens
acacccccugugaccauuccaggaucggccaaguucacccccaaug

SEQ ID NO: 158594 - RNA, 108 nt, Homo sapiens
ccuccuacuuuccccaucccagauucaagccgaacagaaacuccuugugccaaaacggagacuaaguugaugacgccguugagccgcucagcucccaccacccucuac

SEQ ID NO: 158595 - RNA, 122 nt, Homo sapiens
acucugacuacagugauggagaagaggacuuuuacuacacugagaucaagcucaacacagacucaguggcagacgggcugagcagccuggccccggucucaccuucccagucccuggcuuca

SEQ ID NO: 158596 - RNA, 45 nt, Homo sapiens
agcauuccagacagaggggaaaugcaugugcaagauuucaaggca

SEQ ID NO: 158597 - RNA, 45 nt, Homo sapiens
agcagguauccagaaacacauccgaaccauccaucugggguaagg

SEQ ID NO: 158598 - RNA, 49 nt, Homo sapiens
caaaccuagggaugccuacaauagugugcugaguuauagucaagaggcu

SEQ ID NO: 158599 - RNA, 64 nt, Homo sapiens
aaaggcgaaaaucucugggaaguucucuccaaccauuguggcccacagcaucaauguugagaaa

SEQ ID NO: 158600 - RNA, 51 nt, Homo sapiens
uuauacaguguguauuuuuaguauacaaaauaccaaauguuggcaacagga

SEQ ID NO: 158601 - RNA, 44 nt, Homo sapiens
caaaugcuuuuaaauguagcauuucauuucaucaucccccaaau

SEQ ID NO: 158602 - RNA, 82 nt, Homo sapiens
agaucaguuuuuuccaacugcacgucucaauccaccagaggguugugaaucaauuuaaugagucacucuuuaaucaauaaaa

SEQ ID NO: 158603 - RNA, 56 nt, Homo sapiens
uacccgugaagugggcuucaaaaagggugccccuugggcacucagagagauccgga

SEQ ID NO: 158604 - RNA, 44 nt, Homo sapiens
gagcacguaucaggcaaaaugcuuauugcccugagaauaaugca

SEQ ID NO: 158605 - RNA, 50 nt, Homo sapiens
auuuguaaguuagaaaauuggaccucaggcuugcuucgguaugaacucgc

SEQ ID NO: 158606 - RNA, 45 nt, Homo sapiens
ugucgacuagcccuuugguucgaaguccucccgugcggccgaacg

SEQ ID NO: 158607 - RNA, 85 nt, Homo sapiens
ccaggagcaggauggagcugaguacuaaggguaaguagaagcaggcaagcacagaaagagaagaaagcuuguuccaagcagaggg

SEQ ID NO: 158608 - RNA, 45 nt, Homo sapiens
uaugucauaugacuugauuuaaugcuccuguacguggugucuaug

SEQ ID NO: 158609 - RNA, 42 nt, Homo sapiens
ucaagagaaagaagugcuuuagaaagcaggcugggcagaaga

SEQ ID NO: 158610 - RNA, 49 nt, Homo sapiens
cucugaagccuuaaccuagaaaaaugcaccuuugcacacuaacacauuu

SEQ ID NO: 158611 - RNA, 46 nt, Homo sapiens
aagcauuagggggcaugauauagagauuaauuaauuuugauggagg

SEQ ID NO: 158612 - RNA, 44 nt, Homo sapiens
auuucccaagaucacauccauuauguggaaaccaguucggagcu

SEQ ID NO: 158613 - RNA, 43 nt, Homo sapiens
uauagaauauuagaccagugacuacauuccaucaaucucggua

SEQ ID NO: 158614 - RNA, 45 nt, Homo sapiens
uuccccagacugcaaccaguguuggaaccaaucugcaggaguggg

SEQ ID NO: 158615 - RNA, 46 nt, Homo sapiens
uacugguuuguaucauaugggagugguuuugaauaaguuauacuau

SEQ ID NO: 158616 - RNA, 40 nt, Homo sapiens
uaaccugcaggaugguuugaaaagaauaaaacaguagaag

SEQ ID NO: 158617 - RNA, 45 nt, Homo sapiens
aauaguaccuuggggagaugaauuaacuauuuuagugcccuagga

SEQ ID NO: 158618 - RNA, 24 nt, Homo sapiens
guuuguguagcauauaaaauaaaa

SEQ ID NO: 158619 - RNA, 88 nt, Homo sapiens
ugaaggcacugaugcuggagcugagaggacuggaugauggccuuaacucagaugccauggcaccagguagcugccuccuacuguuggu

SEQ ID NO: 158620 - RNA, 57 nt, Homo sapiens
gagagacguuuguuuugcucauuucugauagacaguggcauuccacaguucgaagcc

SEQ ID NO: 158621 - RNA, 43 nt, Homo sapiens
aguguccugggacugaguuuuggaaaaugguaaagcccaguca

SEQ ID NO: 158622 - RNA, 46 nt, Homo sapiens
gaauaaaggcccaaauuaugcuuaguaauucaacagguugagagcc

SEQ ID NO: 158623 - RNA, 45 nt, Homo sapiens
cacguaagacaguauauguagcuuucaucuaguaagagccuaaua

SEQ ID NO: 158624 - RNA, 53 nt, Homo sapiens
uuuucuguguaauucauaaagaaaaauaaugcugccaauuaaacugugauaua

SEQ ID NO: 158625 - RNA, 43 nt, Homo sapiens
aguaucaauaaguuuacaaaaacuagccaaagcauuauauagu

SEQ ID NO: 158626 - RNA, 49 nt, Homo sapiens
aaguggguugaugaccuuaguuauagaggguuucaaggagaagguaauu

SEQ ID NO: 158627 - RNA, 51 nt, Homo sapiens
uuagcuugugauauguuagauuucaguaaauacauguuagauggcuggaug

SEQ ID NO: 158628 - RNA, 56 nt, Homo sapiens
ccaaaugaucucaucucaagauccuuaauauaauuauaucagcaaagcuacaaaga

SEQ ID NO: 158629 - RNA, 33 nt, Homo sapiens
cauuacgugaugccaaggucagguuuuagaucu

SEQ ID NO: 158630 - RNA, 64 nt, Homo sapiens
aacugaaaaaaacaaucuuucuaccuucaguugcagauaauuuggggaggaauauaauuucaaa

SEQ ID NO: 158631 - RNA, 82 nt, Homo sapiens
uagaaaucugaaagaaguaauugugaaaccuuuggccaguacaaaagcaacagagaagagggcuguguucaagaggccaugg

SEQ ID NO: 158632 - RNA, 48 nt, Homo sapiens
agggguggaacauagcuuucuauggcaguguuuguugaggguuggggu

SEQ ID NO: 158633 - RNA, 72 nt, Homo sapiens
uaagagaaacaccugagagagaaaugggacaggaggggcaaggacaggagggagaugcaugucaguuuaggg

SEQ ID NO: 158634 - RNA, 55 nt, Homo sapiens
guacuuaaaaguacaugaucccacgccaguguuauugugagguucuuaaacagug

SEQ ID NO: 158635 - RNA, 48 nt, Homo sapiens
ucuaaaauuauaggccucuuaguuuucuuuaaccuuuaauugaaaauu

SEQ ID NO: 158636 - RNA, 33 nt, Homo sapiens
ugugucugccccaggaaguugguggagagcaug

SEQ ID NO: 158637 - RNA, 57 nt, Homo sapiens
ggugauguuuuaugugaguaagaauuucuguguuucauuucacagguggggagcauu

SEQ ID NO: 158638 - RNA, 50 nt, Homo sapiens
gaagucugaaauauuuuaugucuuucuauugcauauugaugucauuaaaa

SEQ ID NO: 158639 - RNA, 49 nt, Homo sapiens
cacugaugaauuugaaaaguuguguuucuaguucuuauugccaaaggaa

SEQ ID NO: 158640 - RNA, 52 nt, Homo sapiens
gcuuguccccugugaagaagauccaagcauggaucccuuugguuuaagaaag

SEQ ID NO: 158641 - RNA, 91 nt, Homo sapiens
ucaguauguacaugcaucuugucguuuugguuaaagguaggagaggagucaaguuuuugggacagaagaucuugucuaacauaggaaauaa

SEQ ID NO: 158642 - RNA, 25 nt, Homo sapiens
cacuuuauucauucauugcauuuuu

SEQ ID NO: 158643 - RNA, 57 nt, Homo sapiens
cauggagccuugaggagcaaagaaguaguagagugcugccugggcacugcuccaugg

SEQ ID NO: 158644 - RNA, 45 nt, Homo sapiens
cuuccgcuuucagggagcccacauucuaacacauuccugccaagu

SEQ ID NO: 158645 - RNA, 24 nt, Homo sapiens
gucugccaaccccaauuuauuguc

SEQ ID NO: 158646 - RNA, 32 nt, Homo sapiens
auuacucuuuuaaagacacuguaucugaagag

SEQ ID NO: 158647 - RNA, 46 nt, Homo sapiens
aauuugugauagaaacaauaauaauuuaugcucugugaugaaaaca

SEQ ID NO: 158648 - RNA, 43 nt, Homo sapiens
cugaagcgccgagagauuuuuccguuuguguaucuucaggaga

SEQ ID NO: 158649 - RNA, 46 nt, Homo sapiens
guuugagguuuuuuucccuccucaaaauugcaaaugagaaaaaaag

SEQ ID NO: 158650 - RNA, 62 nt, Homo sapiens
uugucgaugaguuuccaucacaggcgcuugugagagaaccgguaaacccaguacagcaaaau

SEQ ID NO: 158651 - RNA, 57 nt, Homo sapiens
gugccgggaaagggcgcuucuccccagugagguggggaacuugggugaugggaccac

SEQ ID NO: 158652 - RNA, 39 nt, Homo sapiens
gcgcagcgcggcccgcggcucccgggcggcggcggcggc

SEQ ID NO: 158653 - RNA, 45 nt, Homo sapiens
cggcagcgguaggcccggagcgcgcgggcgcagccggccgggaga

SEQ ID NO: 158654 - RNA, 42 nt, Homo sapiens
gaugggguaaaugggagagacagaaugguggcaggaagggga

SEQ ID NO: 158655 - RNA, 25 nt, Homo sapiens
uucacagggagaaugaugaaucagc

SEQ ID NO: 158656 - RNA, 1293 nt, Homo sapiens
gacaugaaauggcaagcuauuaaagaucuaaugagagagaaagguaacuaucucugaaauaacccacuguuggauaaucuucauauaggcaggggagggaacuacacaaacauuuuuauuccucugagccacacagacucaaaaaauugauuuuuauuucuugacaugugaauuaaucuuuuccucuucuuucucuugacacaauuucauuacaagguaguauggauauuuuucuuuuugccauuuuagugggauaguagcgagccagcauaugcaugccaccaagaauuuuguuaaagugauugcuuugucuaguugaaguuuuuauagauuuuaaaagggcuauugcauuaguuaagcaauacauuuagcguguuaagaaugaauaauaaggucugauuauuuauuuuuuuuccaaaagcuguuuuguuacuaucuugguggagucuggaaucuggcuguggaauuuauuuuguuugcauugucaugacugccaugaugcugucuuugcaguucuaaauuaaaauugcauuacugcuguugcaguuuuguuuucagaauaaucugaaaaccuucaucuuauauacaugguugguuuuggggaaaaauaauuuuaauacuugaucuuguaaaaguuaguuuuguuaucucuugaaaaauugaguuucaacaguccugcaaacuauguacuuggcuuugaggcugaucucuucuaauaaauuuuuuuuuuuaaauugcauugguguaucuguuguaaggugacaacuauuugauugguuuuauucauugacuuuauuuagaaaguguguggcuugcugugaagcaugauuuguaaauuuaguuuacugauggcaaacaugauugaagacauucagguagaaagucaccuuaaaacagcuguuguguguaggcugaccaaaguuauuugaaaagugcuaauguugauguuuuuuaauaugauagguuaagggaccauuuguauguauaugugcauuuguucaccaacuauaucaugcuggccaaaauaugaucuguaguaugaauuagguuaauaugguuguuagcuuuuuuuuagagaauguggaugauguacauuucugaaaauuaguuaaauuuacauagccauugauaggagguauguuggucugguuuugauuguuggugaauaauaggugcuucucuguagaguugugcacaggugugcaguaaagcaagauacugguguuuaaauguauuguuucuugguaucuuccuuuuguaugucuuauguaguuggugagguuacauacgugg

SEQ ID NO: 158657 - RNA, 1393 nt, Homo sapiens
agcucuuuaaggaugcggaaggaaaaucaaggguaagugcugugggcaauaaucugcuugagguuuaaaaguuccucagcaguuuacuuuuuguauaauacuuguaccaguuuuuggaaacuuaaguuucauuuuguuuuacuuuauuaugcaagauuugaggcucuauaccagcaagucugacacuuauacaaaccuagcugccuggaagggauggguuuuguaaacacuccaaaggggcauucacuuuuccaaugcucuaagguaauacuucuucuuagccaauaagauuuuagcauaggauuuuuuuuguuguauuuugaugucuucaaggauacuuuaaaagucacugaauugauaauauuccugaguuuuuugagggcuauagcuuaaagguguuaguucagaauguauuuuugaaauuuuacugaaaaguuaaauuugguagccugcaggacuacaugagaggcagugcucugaccaauugguaugaaugacauuuacgauuauauugacguagaaggaauugguugauaguauauuuugauuuuuagcaauaagaaugcaguauacugaagaauacaauggaaaacucuuagcaauguuucauuauguuaguaaaacuaguugggugcaugaugaauaaaaauuuugucauuacauucauaugggacuuugaauggcaaucacagggaauuauuuuuuaaauaacucuccaaauuaauuuauuauuaguuuauagaugauuuuuacauacuuccaacugggugcuguuaaaugugcagccaguuuuaaucuaauagagaacuuguuaaaaauaaaauuaauauuuauucacuauuuugauuuuaauagaguugaaaaauaugucguagacaauacauuuuuugaaaauauuuguaacuacagaaggauaggucuauuggagccuuuaguuauuuccuugaauuccuguugauuuaauuugugcagugacauuaauuuuaacuuaaugaaaagucaccuaaaagugaaaaaugugcuccaagcuuguuacauguuagagucuacuaucuuuaauagauauauuuaaaaauuuagagaaaauuugugguuacuugccuguuauguucuggagguauaaaagaugaagugauucuaccauauuauuaauugccuuaaugauugaaauguuagaacugauuauuaacuucauguacugaucuaaaacuuuuuuucuuuugcauauuuugacaaaucuaccuggauauaggguuguggguaagaaauuuuuucuuuaaguaucuuaagucaaauuaaacuuuggaaaaaaauuagcacauaaacauuuccuauaaauuuuuucccuauuaagugugguugaauucaaagaugaagaauuuguaaagaaagc

SEQ ID NO: 158658 - RNA, 775 nt, Homo sapiens
acucaauaauccaaacauuccuccugaagucaucaguaauuugcaggccgguagacuugguuccacaauuuuuguugccaauguaaguucaagcuuuagucuaaaauuugucauucagauagauagcuaauuugauuaaaugaaugaguuauagguuuauagaacauuuugcuuauuuuuaacuaaaguaagugaaauaguaauuauuguaaacucaaaaucaauugacguauauacauauauauacacacacacacacacgcacaagguuagaguuuaaauacaacuauuuggauuuuuuaaacauggaacugugcaguuuauacacauucaagcaguucuugaaauuauauguguuuugguuuauauugguaaauggauuucuuuuuuuagucuugauauuugugaauaugcaugccauaguugguuuguuauuuguucuaagcaucugaaagucagugaaaacaauacuuuucaaaaucuggauuucucuugguaaaaauagauaugcaaguuucaaauguacaaaacagguuugagcaguugagagaugauuuuggaaauuaaaaaaaauaaggauaaggaacaauguagacguagcuuaaaugauuuuaagcaacugaagauguuuuaaaauuugaacauuaucaauauauuguugaacuagaauuaugguucuuuaugguuuuaagaguuuagaaaagauuuuuuguauuuacagauggggagauggauuuauuagguauguaacuuuauacaauuuuauauuaagcuu

SEQ ID NO: 158659 - RNA, 88 nt, Homo sapiens
gacuucaaaguugguuggaagaagcuaaaggaaguguucagcauagcuggaacugugaagcgggcagauauuaaagaagacaaagaug

SEQ ID NO: 158660 - RNA, 165 nt, Homo sapiens
auggugaguuccuguauaucacuucaaccuccaaccucuucagaucuuuuauuggcucucuucuacauuacaguucuuugugguaauauguuaaccauauuauaaacuuucuugcaauuaggaugacaagucuguuccucaugaagaguaccguucacaugaugg

SEQ ID NO: 158661 - RNA, 1554 nt, Homo sapiens
ggaaauuuagguccagguggugaguauucuaacuuccucuuuucuuuuuaaaugauacauaugcuagcuaauaaagccuccauugauguggucuguaauaauguuuaaaggacucuaauuaauaguuagauauuuacggugucacuucauucugaaaaaggaaugaaaccuugagcacagcuaacaugaaagagauaggcagaagucaggaggguuucuuuggggccagcuauguuguagcuagccuuuuagcauuuuggauuuugaaaugucuugaaggcagaaggagaauauaucaucuaugaacaguauuuauggaguagcugaaaugcuaccauaucauaggcagcuaaaaucuguuuauccauuugggaagguggcuuuucagguaguuauuuggcugcucaccuggaagaacucacaguucauuuuuagagauugguuuuuaaacuuugguguuaggacccuuuuauauuuuaaaauuuguugagaacccgaaaaugcuuuguuuauguaguuauaauuaccaguauuuacuguauuauaaaugaaaaauuagaaauuaaaaaaauuacauauuaaaaaaugauaaacucauuacauguuaacauacauaaaaguuuuaagaaaauaaacuauuuuucaaugcaaaaaagaaauuggugaggagaguggcauuguuuuaccuuuccacacaucuuuuuaauguuuggcuuaauauugcuguuauaucuguuucugcacuuuaguuuuuugugauauuguacaucauauaguguuuggaaaauuacaccuuaaacucaagagaaugaggguaaaacaucaaauaaugucuuaguaguauuuggugacuuaaauaguuuugaccuauugaacccucaagagucccuggaccauacuuugugaauuacuguuuuaauugauggacuaauaaaugcuaucagauuccuauuuugucaagaugcuguagucacacuuuaaauuaugaggcucauuaucauaaucauucugauccaaacaaguuuucucccuuacccuuagacucucacaccuaccuacccucuccuaaauacauacuauuuauauuuugaaaauuuuuacugcucuuuuaacugcgauguuuagagaguccuuacauucuggccugaucucuaaaucugcuguaaugcuauuucugugucuaugcuggaaaaaaaaaaucauugauaguaguauuucuguguuuauuguggaaaaaaaagugaaugauuaccuaguucaagauauucucuaacugaauguuguggguguuacuagugaauuuugcuuucuugucugauaaauguucaaagaaacccuuuugaagauucaugauuagacagcugcuauggcauagcacuuuaaaccaugccuccuguacccuaccgcuucucuaguguuucauugugguuauaccagugguaucuauuuugcuauaaugcauuauaucaucuuuuagucauaaaaauaaaauauacuuaaaguacauacuguguauuuuauuugagguaugggaauggaugguccagguuuugg

SEQ ID NO: 158662 - RNA, 51 nt, Homo sapiens
uugguggucuggaagcaaugaauagcaugggaggauuuggaggaguuggcc

SEQ ID NO: 158663 - RNA, 85 nt, Homo sapiens
gcaucgauauggaucgaggauuuuuaucggguccaaugggaagcggaaugagagagagaauaggcuccaaaggcaaccagauauu

SEQ ID NO: 158664 - RNA, 139 nt, Homo sapiens
ugucagaaauguaagcaaauaaauauuaaggauaauucaaauucuuuuuuuucuuguauauauguuacuaauaccucuuuucauucuagcuaccuuuugacuugacuuggcagaaacuaaaagagaaauucagucagug

SEQ ID NO: 158665 - RNA, 53 nt, Homo sapiens
gcagauuaagugacugaaauaacauuucugaaaaaaaauuacugaaccaucag

SEQ ID NO: 158666 - RNA, 42 nt, Homo sapiens
auaaaucuuauagguguauauauaaauauaaauauauuugaa

SEQ ID NO: 158667 - RNA, 88 nt, Homo sapiens
auaggacaggugacacaaucccuucuagguucuuguuacuuauagccaucuaucuaucuaucuuucaccacuggcuguaauaacaagc

SEQ ID NO: 158668 - RNA, 227 nt, Homo sapiens
cauuuguacagcuucucuccaguaugaauguacuuauguucaguaaguuuugaggaucgguuaaaagcuuugccgcauucuucacauucauaacguuucucuccgguaugaauuaacuuauguucaguaagcuuugaggcuugguuaaaagcucuaacacauuucucacauuuguagggaauuuccccaguaugaauuauauuauguguaguaagggucgaugacug

SEQ ID NO: 158669 - RNA, 41 nt, Homo sapiens
cucaggcaucuuggcuaagugaccgcacaggacccacggca

SEQ ID NO: 158670 - RNA, 45 nt, Homo sapiens
aauuuacugggaucugucaagcuuucauaccagauuuuguccaau

SEQ ID NO: 158671 - RNA, 98 nt, Homo sapiens
aucauuauguuuggugaucacaguuacuuucucagcaaccaaauaagcagaauaaaaacuaacaccgaacuggccaaucauagagauaucugcaccag

SEQ ID NO: 158672 - RNA, 48 nt, Homo sapiens
ccauacguucaccugugucuguccucacugugaaugaucccccugcug

SEQ ID NO: 158673 - RNA, 50 nt, Homo sapiens
acuucuuuaucacauuccuucuccacaaaaagaguaaugggauauccaau

SEQ ID NO: 158674 - RNA, 42 nt, Homo sapiens
ugucaccauccuucuuuucuucuuccucaucagaaccaacau

SEQ ID NO: 158675 - RNA, 49 nt, Homo sapiens
gcagaauucuccguacuccucauuaguaauaucgucgggauuucugguc

SEQ ID NO: 158676 - RNA, 49 nt, Homo sapiens
acauacaauuugauguuguucuuuuucuuucuguuuucaaacaggucaa

SEQ ID NO: 158677 - RNA, 46 nt, Homo sapiens
ccaaauuuuuccugauaacuuucaaaauuuuacuuuguugcaacau

SEQ ID NO: 158678 - RNA, 45 nt, Homo sapiens
gccgcuuccaagcgcuuggagguggaggcgcucaggcucuugugc

SEQ ID NO: 158679 - RNA, 46 nt, Homo sapiens
ggagcagcuuuucgcuuuccucuagauuuugggucggucuuguguu

SEQ ID NO: 158680 - RNA, 24 nt, Homo sapiens
ucguacauagcugucauagucuga

SEQ ID NO: 158681 - RNA, 49 nt, Homo sapiens
uggcccauucuguaaauaaaggcuccacuagguaagucauaaaaccuug

SEQ ID NO: 158682 - RNA, 51 nt, Homo sapiens
auucuucuacuuaagcaaaaauacacugcccaucuaaacucugaggauacu

SEQ ID NO: 158683 - RNA, 28 nt, Homo sapiens
cuuaauaacuguguuuucaagguuaaac

SEQ ID NO: 158684 - RNA, 102 nt, Homo sapiens
uaccauaacgcaguccacgcugcggauguuacucaggccaugcacuguuacuuaaaggaaccuaagguaagagguugacauugauuucaggugaaaaucaua

SEQ ID NO: 158685 - RNA, 51 nt, Homo sapiens
caauaucaacugggaaauuaccagcauaagaaacacaagaaagcacuggau

SEQ ID NO: 158686 - RNA, 82 nt, Homo sapiens
ugaucaaaaggaaagcgaagugcuuaguuaacuacuguggacugcuggcuauuucuucugcccauccagugcacugcugagc

SEQ ID NO: 158687 - RNA, 23 nt, Homo sapiens
agcccugcagccacuguaucugc

SEQ ID NO: 158688 - RNA, 43 nt, Homo sapiens
agucaauggcaaggcaagaggcuggcguggcaggagcaaggug

SEQ ID NO: 158689 - RNA, 49 nt, Homo sapiens
guguugacucaaaagggaucgauaggaguugccaaauauuaauagaaaa

SEQ ID NO: 158690 - RNA, 104 nt, Homo sapiens
caauuaucccucaaaaaacugaauuucagaaagaggagcaaaauccaccccacccccaacccccagaggaaauuuagcauaauuacuaauagaauuuaaaguua

SEQ ID NO: 158691 - RNA, 26 nt, Homo sapiens
agauaggauuugaaaagaucagaaug

SEQ ID NO: 158692 - RNA, 57 nt, Homo sapiens
aaaacaaguugugucagaacuuugccuaaaacacaccggcuuuaagacgaucuccaa

SEQ ID NO: 158693 - RNA, 43 nt, Homo sapiens
aauguuuuaaagaauaugacuuuuuauaaaauggcuguaauca

SEQ ID NO: 158694 - RNA, 40 nt, Homo sapiens
guguuuauagugguguuuuaaagagaauguagaccuguga

SEQ ID NO: 158695 - RNA, 50 nt, Homo sapiens
gaggggaaagagaggagagaaagaaaaagagagugggaacaguaaagaga

SEQ ID NO: 158696 - RNA, 69 nt, Homo sapiens
gccgguagcucuaggucucguaaaccguggagcuccuuuaguauaaggcccuauuaugugccacauuag

SEQ ID NO: 158697 - RNA, 64 nt, Homo sapiens
agucuuaggacucguaggauaaaggaaggucguuucccuccguuugaggcagggaaucaaacaa

SEQ ID NO: 158698 - RNA, 46 nt, Homo sapiens
uugggcuuuccuagugccagucacagagcgacgcuggucucccaga

SEQ ID NO: 158699 - RNA, 42 nt, Homo sapiens
auaaccgcuucccgcacggggaaagucuacccugccugccac

SEQ ID NO: 158700 - RNA, 46 nt, Homo sapiens
ccggggggucacucaguucggcaacaaguacauccagcagacgaag

SEQ ID NO: 158701 - RNA, 46 nt, Homo sapiens
cucuguugcagccagauuucagcgcaugagggaagaauuugauaaa

SEQ ID NO: 158702 - RNA, 46 nt, Homo sapiens; identical to SEQ ID NO: 74107

SEQ ID NO: 158703 - RNA, 354 nt, Homo sapiens
uuguuucugguucagcuucaagaaaaagguaaguuauuuuguuuucaaagguagccaucuaaaaauucuguagaauaauuucaaggauaccucuauuuguguuuucucaaaguuccuugaacuuuuggguuuguuguaaaacuaaagauguauaccaugcuuuuaguuucaaaucuguggcuaggaaaucuaccuugaaagacacaaccaaaauguauuaaugagaauuaucuuuuuucuuacacuuuuuauuaaauguaaaauugguaauuuaaaaaugaaauggaagcagugauuauauaauaacuuauaauaaugaauucuguuuuauuuuagccuuguuugcagucccua

SEQ ID NO: 158704 - RNA, 33 nt, Homo sapiens
gugguagaaaaguuuuuuugguuuuaucucuuu

SEQ ID NO: 158705 - RNA, 5696 nt, Homo sapiens
acuguguuuauggacuagaacuuaauaaagaugaaagaguuucugcgcuugaaguccucccugauagaguugguaaguucuuuuuauaauuugugcauuauauacuuuaaaaaugauauugaacuggaugcuuuuuuuauuuuacauuauuaauacuucacuuuuauuggaacacaagcacccuucuugauaaacauuauauuaaaucaccgaaaaccacaaaaauggauccuaagcaguucaaggaacugugugagggauauagagauguguauuuuccccccaagaaguuugccacguaauaauuuauaauacgguuauuucuaacauuuuugcucacuguucucuggacucugauggguaagguuaucaguagcugaaauauccuauauguuaaucucaucucaucagauacaaaagauaagagaaugcugugccuuuagaaucuuucugugaaaguguaucuuuguguacaacguaaaugauaauuguacuuugagccaaaauuuaaacaaccaaaacguggucuuuauuauacacagagcuugauugaacaauguuuguggaaaugaauggcucuuuuuaaaugucauacagugccaguuuugcccugcaaguguuccuuaaggcauaaggucuaagguaaauaauaauuacugauuuuauuaguagggugggauacacccaaacuaauauuacuuuuuuuugaaguauuuauuuugaaauauuuucuuauuacagugaugcugcucuuguuuaaaauauugguuuauacuuuuagaauugucuuuauaagucuauaccauuaaauaauaaaguuucagcagaucuagacuugggagguaggaauuuugggaucaaauugucacaggaagaaauuaguucagucuccucgcuuuguuuuucuucagacugugccauugugucccugggauauaacgaguuuccuuaggaaguuaauucugccuuaguagcaaguuauuuuguuuuacucuucucuuuagauaucaaaugcuaaauccuugcucaucuguauaaauaugguucaguuuucaaagaaaucuuucuuuaaauuuaaaucuuuauuauuacuccuaaaaguaauauuaagucuuuguuauuuucaacauucucaucuauucuuaagugugacugaucaccugcucuuccucuugaugcacauccuacauuucuucuugaucauggcauuaauccauuucccauauaagaaacuuuaacauauuaaaaaucuuaacagcagaauuuuagucucugccccuucugagacgacagcuagcucacuugaagguuccugcauauugcugcaugaccugugguuguugguccuuuugucaucgaaggauagaaacuguacaaguaucucuggugaugggacuaaggguuccauguuguuuguaguuugguauuaucucuguuuccaacaauaguaauuuuguaaacauucaagcaauauaaaaagaaacccaagagcuuuucuguaaaucagcaauauauaugccuaauucagcuaauaguuguuauuaauuuuaguauucgugguauuagguuggugcaaaaguaauugcgguuuuugacauugaaauugaaaguaauggccaaaacagcaguuacuuuggcaucaaccuacuuuagucuaaaaaauuacuugcucuucacuuacguuuuacgucggaagcaauugcuucaggcaguacauuagaguauaauuaaaauuauguuuuucuuaagcuaaaguuagagaaaaaagucagucagccagaaugcaugugaugucacagagcagugguucccaaagcaaggccuggggacccuuggguucucugaagcccauucaggagauuugcaaggucagaaauauuuucauuuuguuaagcuguaauucgcgcuuuucacucucucuuuuucucaauuacacaguggaguuucccacuaucuauuuggaagauuugcauaacuuagugaacacaauauuuucuuuaugagcagugcaugguaccacaucaugcauuggugaaagagcuauucaaagugcaagacuaacuacuuuuuuuuuaauuguaaaaaaacauagcauaaaauuuacuguccuaaccauuuuuaaguguacaguucaguaguguguuaaguacauucgcauuguugaaacagaucuccagaacuacuucaucuuacaaaucugaaacucucuaccuauuaaacaaaacaaccuaccuuuccucccauucccagccccuggcaaccaccauucuacacucugucucuaugaauuugacuauucuagauaucucauagaaguggaaucacacaguauuuguuuugugaguaacuuauuucacuuagcauaauguccucaaaguugguucauguuguaacgugugacaggauuuccuuuaaggcugaaaagaacauuccauuguaucuauauaccacaguuuguuuaucuguucacccauuaauggacauuuggauugcuucuaccucuugguagaauguaaaauuguaccauguaaaauugugaauagugcuccuguaaacauggauaugcagauauuucuuugagauccugcuuucaguuguuuuggauauaggcacaggagugggauugcuggaucauaugguaauuauaauuuuaauuuuaguaucguaauucuaauuucuuagguagaacuaccauacuguuuuccacagcaguuguaccauuuuccaguccuaccuacaguauacaaggguuccaguucuccaucccuuagucagcaguugcuauuuacuguuuuugucauaguggucauccugaugggugugauacgauaccucauuuuguuuugauuugcauuucucugaugauuagugauauugagcaucuuuuuaugugcuuguuggccacuuguaaaucaucuuuggggaaauaucuacucacauccuuugaccauuuuuuaauuagguuauuuugauuuuuguugaguugugagaguucuuuauauguucuggagacaugaguuuuaauguaacaguaugacagauuuauuaaugguuucagauucugcauuguaacuaaccuuuaaggagcuaacuguugaauucugugguuucauauaaguauaucuagaauuaucugaaagacgauuagaauauucuuuucaguaucauaucuuugagaggcuggauuuuauaccugaacugaaagagcagaucauaacagauugagugcuaaagcagauaugagaaucuacuuguucuuuuuaaaaccuagacauuaggagauuugcaaaaauguaaaauuaagccacucuuaauguauuuugauaggaaauaguuauuuuuaauuuaaaaugcauugauauauagguauuuuuaaauaaauguuucuagauuuguuuuucauuuucugaaguaguaaauauugguaggcauuaucuauguaaacagaugcuuuuuuaggucuguaguaauuuccauuuauguuuuaauuuuuuuuuuagagacaggaucucgcuuugucacccaggcuggaguauaguggugugaucagggcucacugcugucucaacacguugagcucaaacaguccuccugccucagucuccugaguugcugggacuacaggcacucaccacaguacccugcuaauuuuuaacuuuuuguagagaugagaucucauuauguugcccaggcuggucucaaacuccuggccucaagcaauccuccugccuggggcucaaagugcuaggauuauagaugugagucgcugugcccagccaguaauuuuuaagaaugcacauggaguucugagaucuaagucugagaucuacuggcuuuaagaaacuagugggguuuuuuuacugucauacacggggggaauucuguguaauuuuuuauuauuacugcguacuuaaaaccagccauacauguuuaggguuugcugauaaaauuaaauagcaauacauguaucaagaaaaucucacuuuuuuguuucuuuugauguaacagaaauagaaguuuguugaaugaggaaaauaggagagcuaauuguuuguuguuguuguuuuuguuguuguuaagacagggccucacucccguagcccaggcuggagugcaguggcgccaucuugucucacugcagccucgaccucuggguuuaggugauucaccaccugagccuucucaguagcugggacuacaggccugcacugccacaccuggcuaauuuuuuguauuuuuaguagagacgggguuuugucauguugcccaggcuggccucaaacuucugggcucaagugauucgcccgccuuggacucccaaagugcuaggauuacaggcgugagccaccgugcuugucucuaauuguuuguuuguuuguuuguuuguuuuuuaaagauaauuguuuaaauuugguauaaagacaguuaucuaaaauuguggacuggagaagucuuaaaaccaaugggauccuucauaguuuuuccaguauuaaaaagaugaaggugauaauuuucaccacuuuugaaaaauauuaagggcuaggaccguuaaucuaucauuucagagaccugagcucccaaccacaugggguaucugauuaaaucauacaaauacugaccugcuaugaucuagguauaaaacaagaaagggaaggucucugcuuucauggggauguacaagcaacuaacaaguacacaaauaacauaaagugggauaacuuuagaucauggugaauguuauuaagagguaaaauuggguaaugugacugggauuuguggggcuaccuuguuggucaggagaacuccaaaaggaaccggccuucugaagguauggggaagagcuuaucaggcagaggagaguguguccuaaugggagaggaagaagagcagaguagagaacgcaugaacaacaaggaggaagaugggaaaccugagggcagaggcgugaaggcuuuuagggcuugggggcuauggugagcaguuugguuguuuuucaaauuauaaagggaaggcaugggaacauuuuagaucacacaaugugguaucagugacacaacgauuacuuugguugcagugaagaauaagauuguaggagcaagagaguaaaaaccuaugccuuaauaaaaaaauggaaauaagacugaaggaaaacaaacaccaauuucuuuaaaaaaaaaaaacaaaaaaaaaacccucugugccuugaauagcuuuucuaaguuuuaaauaaacguucugugguuauguaagaugcuaauacaggagaagcaaagugaaccguauacaggaacucuacuauuuuuccaguucuucuguaagucugaaauuaucucaaaauuuaacuguuaaguaaacaauaacaaacaguauuuuauaccuugaaugaacaauuaaaacuuuugauuuggguacagaaccaagagcagaugaguccagaaaaauaaaaaaucauauuuuuuucaauuaacugacuugggacaaaauacuucuauucuguugaauccaucucugagcuggggcccaguaguuugucuuugguuuuuguacuuuuuaaagcuuucccagauucugaugcuugcuaauacguugcauggacaaaauuucagguguagccuucuuuaguaaauucagucuucauagucgguaaucagcgaaacacuuugucaacuuuuuuuuuuuuuuuuuaauccccagcg

SEQ ID NO: 158706 - RNA, 46 nt, Homo sapiens
uguagacauaaagacuugauugcuuuccaguuuaaugaaagcuuaa

SEQ ID NO: 158707 - RNA, 47 nt, Homo sapiens
gcuuuguuaagcuuaauugagaagaauuucuugguagaggaagagga

SEQ ID NO: 158708 - RNA, 65 nt, Homo sapiens
uggaugccauuucgaacaucuuucaggcugcugagaaacuaggugaaacugagaaacuuaguaua

SEQ ID NO: 158709 - RNA, 45 nt, Homo sapiens
caggagcucuugcugucuuucccaaccugcucaucaacuccaaaa

SEQ ID NO: 158710 - RNA, 46 nt, Homo sapiens
cuuaguuuggcuccugcaucaugaugauccagaaguauuagcagau

SEQ ID NO: 158711 - RNA, 65 nt, Homo sapiens
caaacuaagguagaaagaauuugcucaacagcaucuaacuggggugcaggauucuuguagcagca

SEQ ID NO: 158712 - RNA, 45 nt, Homo sapiens
uuccuagagcccauacagcuuguucacugaugugagcauggggag

SEQ ID NO: 158713 - RNA, 45 nt, Homo sapiens
ggcacuguaaauuggucuguugaugacauugucaaaggcacaaau

SEQ ID NO: 158714 - RNA, 59 nt, Homo sapiens
aguugcccgacuuaacagauucaagaacaagugaaaagacaguacagaaaugagguguc

SEQ ID NO: 158715 - RNA, 46 nt, Homo sapiens
gcgcauguucaacuuuuuauuguggucuuauaauuaaauguaaaau

SEQ ID NO: 158716 - RNA, 53 nt, Homo sapiens
acaagaauaacauuuaaaggagauuguuucaaaauauuuuugcaaauugagau

SEQ ID NO: 158717 - RNA, 91 nt, Homo sapiens
uauacauucauaucaucauuuuguugauacuugaaugguuauacuucaucaacccagcuuuuuaaaugcuucauuuuacaaccuuguugau

SEQ ID NO: 158718 - RNA, 51 nt, Homo sapiens
uuuaacauuuaugauguauaagagaaaaacauguuagauuauuauucaagu

SEQ ID NO: 158719 - RNA, 49 nt, Homo sapiens
aagcuuuagaauaacaaaagcugucuaucuaucagugguggagagcuga

SEQ ID NO: 158720 - RNA, 361 nt, Homo sapiens
auucuucaaaaauguauuucuuuuuuuuuuuuuuuugggagacaaagucuugcuucuguuacgcaggcuggagugcaguggcacaaucuuggcucacuacaaccucuaccucuggguucaagugauucucgugccucagccucuugaguagcugggauugcagacgugcacgaccaugcccggcuaauuuuuguauuuuuaguagagacgggguuucaccguguuggccagccacgcuggucuugaauuuguggcuucaagugaucugccccccugggggccuaucacagugcugggauuacaggugugagccaccaugucuggccaaaaauguauuuauuagauuuauuccuaaguaauu

SEQ ID NO: 158721 - RNA, 55 nt, Homo sapiens
aaaaaucgaggacaauuuaugauuuaauacuguuaauagaaugcuuuuagaggaa

SEQ ID NO: 158722 - RNA, 46 nt, Homo sapiens
gaggagaacaaguaacucucuuccucuucaaugauugccuagaggu

SEQ ID NO: 158723 - RNA, 49 nt, Homo sapiens
aagcucaaaagcaaauuuuugauguuguuuaugaaguagauggaugccc

SEQ ID NO: 158724 - RNA, 50 nt, Homo sapiens
acauucauaggauuuccucucauugugaauuuucucauguugagcaagau

SEQ ID NO: 158725 - RNA, 45 nt, Homo sapiens
ggaucacugaaggaaguaaugacguaagugcauuauuuucaauuu

SEQ ID NO: 158726 - RNA, 47 nt, Homo sapiens
uguggacggcagagccuuguugaacuucuuauccgaccaguacagag

SEQ ID NO: 158727 - RNA, 44 nt, Homo sapiens
uuucaggcccugaaaaauuauucagccaaguaaucagccacgga

SEQ ID NO: 158728 - RNA, 73 nt, Homo sapiens
uacccucccuuuguaaacuucuuugaaaugagcaaggaaacaauuauuaaaugugaaaaacagaaaccaagau

SEQ ID NO: 158729 - RNA, 45 nt, Homo sapiens
ggaugaucuugaagaccuuauaguuaauugggaugagagcaaaag

SEQ ID NO: 158730 - RNA, 49 nt, Homo sapiens
uuugguagcaucccagauaucuuugauguacacacuaagauaaagguaa

SEQ ID NO: 158731 - RNA, 55 nt, Homo sapiens
agaggaaggacaacgugguggaccuauccuugcaccagaggagauuaagacuauu

SEQ ID NO: 158732 - RNA, 46 nt, Homo sapiens
auacauauacacagguauauaaauggaguacauaaaauagaauaga

SEQ ID NO: 158733 - RNA, 55 nt, Homo sapiens
ugaccauaugucuacauuuauuuagguugucuuugauuucuuucaucaguauacu

SEQ ID NO: 158734 - RNA, 46 nt, Homo sapiens
gcuuuaucaaacugaaaguaauuauguuaauauauuggcaacaauu

SEQ ID NO: 158735 - RNA, 51 nt, Homo sapiens
augacuaaacugagauacagagaaguuaaguaauuucuccagggucauaua

SEQ ID NO: 158736 - RNA, 45 nt, Homo sapiens
aacgacgucguuuaaaagaaacacuugcucagcuuucaagagaga

SEQ ID NO: 158737 - RNA, 44 nt, Homo sapiens
ugcugugagucuagguacuccaauuaugaagccagaauggauuu

SEQ ID NO: 158738 - RNA, 48 nt, Homo sapiens
ucuugagggucauacuuucaaggaaguaaacgugaagaaaggagaaau

SEQ ID NO: 158739 - RNA, 46 nt, Homo sapiens
uuuugaggucagguuggugacauugguccaucacauggguggaguu

SEQ ID NO: 158740 - RNA, 45 nt, Homo sapiens
auaugaugaaaaggacauuaaagugggcuuuguaaagauggaguc

SEQ ID NO: 158741 - RNA, 43 nt, Homo sapiens
gauuaugcugauuuuccuuucuguaaguauuaagugcuauagu

SEQ ID NO: 158742 - RNA, 70 nt, Homo sapiens
ggaagucccuguuauaaagauaaaagaaaguuguccuggaaaaucggaugaaaaauuaauaaaaaguguu

SEQ ID NO: 158743 - RNA, 28 nt, Homo sapiens
agaagagaugccucagauugaaacaaga

SEQ ID NO: 158744 - RNA, 213 nt, Homo sapiens
uuguguggagcugguuuauuagaccaagugaccauugugucauugaacguauagagaaggggggccagauuccagagauacuugaggugggauugauaggaauuuuggggagggaaaugugggagaggaaaaaauuaggauagaucucagauuuuuggcuaggauuuuugugggagguguguuauggugguguuauaauugaauauaggaaga

SEQ ID NO: 158745 - RNA, 41 nt, Homo sapiens
uuauaccggagagguuuagagacauccacagaggaugaguc

SEQ ID NO: 158746 - RNA, 52 nt, Homo sapiens
auuggcacucacccaugcauaauuguuuugucaaaccuuuuaggggagaggu

SEQ ID NO: 158747 - RNA, 46 nt, Homo sapiens
uuguuguucacuuuaagacaucuauucaguuuucaucuuaacuaga

SEQ ID NO: 158748 - RNA, 33 nt, Homo sapiens
aaauugaucauauacaguaucaucaggggcaau

SEQ ID NO: 158749 - RNA, 46 nt, Homo sapiens
cacugauccuauugugcuuauuuuaaaggcuucuggaauacaguaa

SEQ ID NO: 158750 - RNA, 47 nt, Homo sapiens
uucuucauccauacauugaaaauaauaauaguaccugccucuuagga

SEQ ID NO: 158751 - RNA, 55 nt, Homo sapiens
gcaagauaaauccaggccauccgccccucguccuccccagccacccggcacagau

SEQ ID NO: 158752 - RNA, 40 nt, Homo sapiens
gagugguaaggacucugugugagugagagaggugcaagug

SEQ ID NO: 158753 - RNA, 43 nt, Homo sapiens
cgaggaauggcgguauuugugagaggagucggcguuugaagag

SEQ ID NO: 158754 - RNA, 63 nt, Homo sapiens
uggcauauuuuuaucaaauucaagcuuaucuuuaaaaaaauccgagaauuuuucuaauuucua

SEQ ID NO: 158755 - RNA, 46 nt, Homo sapiens
ucuacacuuuauuuuucuuguguaaucucauaauugaaucacuggu

SEQ ID NO: 158756 - RNA, 74 nt, Homo sapiens
cugacagaaacuggugaaguucgugaggaucuuaaacugccagaaggugaacuaggcaaagaaauagagggaaa

SEQ ID NO: 158757 - RNA, 46 nt, Homo sapiens
aguuagaugauaaaccaggguuuuaaaucaaacaauguagcauaaa

SEQ ID NO: 158758 - RNA, 47 nt, Homo sapiens
auucuauaaacugaauuauuuuaaaagguauuuuaggugacaccacu

SEQ ID NO: 158759 - RNA, 42 nt, Homo sapiens
acaaaggaaauuucuaaagcacaagaaauagugagguaguag

SEQ ID NO: 158760 - RNA, 48 nt, Homo sapiens
aguuaggcauaauauuucauaguuuucaagccuuuuuuuucugcuaac

SEQ ID NO: 158761 - RNA, 42 nt, Homo sapiens
acuggaaaucucgggaauguuguucacauugaacgcuucaag

SEQ ID NO: 158762 - RNA, 30 nt, Homo sapiens
aggcugaaaguaacauguaaaauauauuag

SEQ ID NO: 158763 - RNA, 40 nt, Homo sapiens
gggaaacccuaggaaaucaucaaagaaaauuagcaaagag

SEQ ID NO: 158764 - RNA, 40 nt, Homo sapiens
auuccacugggaauguuacauaaucccugauauuuguacc

SEQ ID NO: 158765 - RNA, 45 nt, Homo sapiens
uaaggucacagauauaccccagccuacaucaggaaccuacugaau

SEQ ID NO: 158766 - RNA, 60 nt, Homo sapiens
aaaggaaagacuuuuggaaucuuggccuauauuuggaaacuuggaaauuuuaauauguac

SEQ ID NO: 158767 - RNA, 37 nt, Homo sapiens
ucugucuucaugcugagaagcccaggucaggucauga

SEQ ID NO: 158768 - RNA, 49 nt, Homo sapiens
agaaucuucuuuucuucuuagaaauccuagaaaacagaaagcaacagga

SEQ ID NO: 158769 - RNA, 53 nt, Homo sapiens
uacaucauucuuauuuucauguuaaacauuaacagcaauaaaaaaacagaaaa

SEQ ID NO: 158770 - RNA, 106 nt, Homo sapiens
gggggccagaagaguagcaaauugagaaaggccuggggugaugguggaaucagggugaggcagccagggcugcaggucauguuuagauuuaugaguuagcgccccu

SEQ ID NO: 158771 - RNA, 21 nt, Homo sapiens
uuggggggaggauaaaaaagu

SEQ ID NO: 158772 - RNA, 43 nt, Homo sapiens
gacugagcaucugaaucaccugagaagcuacuaaaaugcagau

SEQ ID NO: 158773 - RNA, 57 nt, Homo sapiens
uuaagcuuaugagacauggggaauccucuguguaaacaaaacaaaaagcuuagugag

SEQ ID NO: 158774 - RNA, 44 nt, Homo sapiens
cucaaaagaugauccacccaggaugaacaaagaucaccaagggg

SEQ ID NO: 158775 - RNA, 43 nt, Homo sapiens
acauuuaaacuagauucccaguccucuccuucaaaagcuuggu

SEQ ID NO: 158776 - RNA, 46 nt, Homo sapiens
aguguagcaacuuucuaaaacugaaaaaucucaaaggagaucauug

SEQ ID NO: 158777 - RNA, 46 nt, Homo sapiens
aauuuaaaauuagauuaccuucuuuggaaaaagaauuuccuaaauu

SEQ ID NO: 158778 - RNA, 46 nt, Homo sapiens
aagguuuucuagggggaaggauagggaaguagaggaggagacaagu

SEQ ID NO: 158779 - RNA, 73 nt, Homo sapiens
guugaaugcucuaaacagaacuuuuuaaaagguguguuuuaagagcagucaccuaggaguagacaagguggaa

SEQ ID NO: 158780 - RNA, 42 nt, Homo sapiens
aaucuuuagaugccucuuguuugaauguaugcuuuguggaau

SEQ ID NO: 158781 - RNA, 41 nt, Homo sapiens
gguugucacagcuuggggguggguucaggggaggguugcua

SEQ ID NO: 158782 - RNA, 42 nt, Homo sapiens
uacuuaauugauuaccuuuccuauugguuucuuuacccuuaa

SEQ ID NO: 158783 - RNA, 30 nt, Homo sapiens
uaauucccaaaacacuuuuuguucuauauu

SEQ ID NO: 158784 - RNA, 46 nt, Homo sapiens
uacaauguuagcuguucuaaaaaauuugcacuuagucguuggaauc

SEQ ID NO: 158785 - RNA, 26 nt, Homo sapiens
gugugauccucaguuuauaauauaau

SEQ ID NO: 158786 - RNA, 50 nt, Homo sapiens
cauuuuaguauaaauuauuuguaaguuuauaucuuaaaacauuuucaugu

SEQ ID NO: 158787 - RNA, 46 nt, Homo sapiens
acagcagcaacagcaaauucagccaaucacacuucagaauucaacu

SEQ ID NO: 158788 - RNA, 50 nt, Homo sapiens
ggcuucugauugucucauucucugcaagcaaaacuaguguuuuccuagau

SEQ ID NO: 158789 - RNA, 60 nt, Homo sapiens
auacuguuuagcauagucuauaucaacacaguuuuaaaagacugacauaaaauuuucagu

SEQ ID NO: 158790 - RNA, 84 nt, Homo sapiens
auaauacccaccuauaccacaggcauuuuguaaguaugaaugagagacacgugaaagcacuuucagccccuuggaugaagggca

SEQ ID NO: 158791 - RNA, 52 nt, Homo sapiens
uaaaacauuuuaaaaugugaauuuuauaaacuuaaucuuaauguguagcuug

SEQ ID NO: 158792 - RNA, 42 nt, Homo sapiens
gucacccggacaucaaguauucaccaguuaauagcaccaggu

SEQ ID NO: 158793 - RNA, 42 nt, Homo sapiens
aagcacuagucaaacucagucauugacaauuugucauaacaa

SEQ ID NO: 158794 - RNA, 31 nt, Homo sapiens
uuaagucugcagcaccgaacugcagggagua

SEQ ID NO: 158795 - RNA, 60 nt, Homo sapiens
aacuuuaggaauuucucuauggauauuguuucucuucucugugcuuuugaaauggcagug

SEQ ID NO: 158796 - RNA, 42 nt, Homo sapiens
ccaccaucaccacuuccuccucucgaaugcagcagccacaga

SEQ ID NO: 158797 - RNA, 42 nt, Homo sapiens
acuguauaauguugaacaguuaccauaugaugcugugauuug

SEQ ID NO: 158798 - RNA, 55 nt, Homo sapiens
cgacuccagaacuuacuguuuccuggguaggccucuugugcaccagaacugcugg

SEQ ID NO: 158799 - RNA, 41 nt, Homo sapiens
ggggggcgcaugcgcagcccauguuagugauggaggagaga

SEQ ID NO: 158800 - RNA, 41 nt, Homo sapiens
auuaaacuuuccaccuuacuaauaauuuaacugucuuagaa

SEQ ID NO: 158801 - RNA, 44 nt, Homo sapiens
aguguuuauauaaaacucccuugaauguuuuaguuccuggaacu

SEQ ID NO: 158802 - RNA, 46 nt, Homo sapiens
gacauguguucuuuugacaacgaacagcucuucaccaugaaaugga

SEQ ID NO: 158803 - RNA, 34 nt, Homo sapiens
ucuaguguguaguaacuaugggaauuagcaaauc

SEQ ID NO: 158804 - RNA, 30 nt, Homo sapiens
uuuuuuuuguagugaugaaaguaaauauga

SEQ ID NO: 158805 - RNA, 49 nt, Homo sapiens
auaauccuucaagucaugagaguuuggaucaaguuggugaagaaaaaga

SEQ ID NO: 158806 - RNA, 60 nt, Homo sapiens
cagucuaggucuucaggauuuugauuugcuccggguaauaggaagaggaaguuaugccaa

SEQ ID NO: 158807 - RNA, 54 nt, Homo sapiens
aguacuguugguucgauuaaaaaaaacagaucguauuuaugcaaugaaaguugu

SEQ ID NO: 158808 - RNA, 42 nt, Homo sapiens
uagcauuaaauuaucuucaugagcgagggauaauuuauagag

SEQ ID NO: 158809 - RNA, 370 nt, Homo sapiens
ccuguuaguguguuuugccuuauuuuuuuuccauccuacagcuauuaaaauacaggcccggcaugguggcuuaugccuguaaucccagcacuuugggaggccgaggugggcagaucaucuggucaggaguuugagaccagccugagcaacauggagaaaccccauuuucuacuaaaaauacaaaauuaguugggugugguggcacacgccuauaaucucagcuacucuggaggcugaggcaggagaauugcuugaauccgggaggcggagguugcagugagcugacauugugccauugcacuccagccugggcaacaaagugaaacucugucuccaaaaaaaaaaaaguguucuuaggaaaaauaaacag

SEQ ID NO: 158810 - RNA, 132 nt, Homo sapiens
aaggaaaauauuguagucuuaucaaugguuguauuaggaggugagauuuaaagugcuucuuuucuucaugaaauaugccuuauucuacuaauauuaaaauuuuguuauuaaauuuuaacuuguauguaaauu

SEQ ID NO: 158811 - RNA, 49 nt, Homo sapiens
agugagcuuaauguaucacugcagaugcugaacuuauaugauaggugaa

SEQ ID NO: 158812 - RNA, 46 nt, Homo sapiens
uacaaccagcacuuucugugguacuccuaauuacauugcuccugaa

SEQ ID NO: 158813 - RNA, 37 nt, Homo sapiens
ggaauauacagaauugacagaaacaagcagacaagug

SEQ ID NO: 158814 - RNA, 45 nt, Homo sapiens
uauaauacuauaauuuuuaucuuucuaguuauuuuggaaaaacaa

SEQ ID NO: 158815 - RNA, 70 nt, Homo sapiens
aacucuguuuccauuuucucuguaucauuauccauagaaucuauuuauuaccauguacuuuuugagcacg

SEQ ID NO: 158816 - RNA, 46 nt, Homo sapiens
ggggauuuuaaauuaagcuaaaaacaaacuucucaugaaguuugga

SEQ ID NO: 158817 - RNA, 44 nt, Homo sapiens
ucagaucuuucuuuucucuucccguugacacacccuaguucagg

SEQ ID NO: 158818 - RNA, 55 nt, Homo sapiens
ucuuuuuuuggagggguggaugcugcauuucauuggaaaugucauuuuuccaaag

SEQ ID NO: 158819 - RNA, 23 nt, Homo sapiens
uauguuucucuuaacaccugaaa

SEQ ID NO: 158820 - RNA, 48 nt, Homo sapiens
cccaccuuagacuucuuuuggggccuucgaccucacuuugagaaauac

SEQ ID NO: 158821 - RNA, 46 nt, Homo sapiens
uuuggcuuucuaagaaaaacuuuauuuugcauaagcauguggucag

SEQ ID NO: 158822 - RNA, 46 nt, Homo sapiens
cagaauuuaagacuuggggcaaacagagucucuuuucuccuccaac

SEQ ID NO: 158823 - RNA, 44 nt, Homo sapiens
auuacauaaucuuugugcaucaguuaauguaaucagcccacagg

SEQ ID NO: 158824 - RNA, 44 nt, Homo sapiens
aacgucuggggugcaaacauuccacaacacuccagacauugaau

SEQ ID NO: 158825 - RNA, 46 nt, Homo sapiens
aguauuuuugguucacaugaagauagcaaugccauuuagcugauuc

SEQ ID NO: 158826 - RNA, 47 nt, Homo sapiens
aauuagaaauauaaaugaaauuauagguguuugaguuugucuuccaa

SEQ ID NO: 158827 - RNA, 37 nt, Homo sapiens
uuauugagaagaaaauuuuagaagcugauuaaaaucc

SEQ ID NO: 158828 - RNA, 45 nt, Homo sapiens
aaaguguaauuaguaaaaauauggauuuucccuccaagggcccaa

SEQ ID NO: 158829 - RNA, 44 nt, Homo sapiens
gguagcuacccagaaaggaaguuuacaaauguuccucccauuca

SEQ ID NO: 158830 - RNA, 54 nt, Homo sapiens
cuucccagaguuuggaauuuaaggagcaaacugaguuauuguaggcaauacggu

SEQ ID NO: 158831 - RNA, 44 nt, Homo sapiens
uuugaauucaagaaaauuugcgcuucaaugauggggagacauga

SEQ ID NO: 158832 - RNA, 60 nt, Homo sapiens
gcaaaagcguuaugaccuaagaagcacguucuucacacccaccuccccccgccccgcccc

SEQ ID NO: 158833 - RNA, 47 nt, Homo sapiens
gaaagcucacuuucacuugaggaaauucuagcaugugucucccccag

SEQ ID NO: 158834 - RNA, 92 nt, Homo sapiens
ugcauuauugugugguuauuuuuuaaaacacgaauuaaaaugccaaggagaucuaaguauaguaagaugugcccuauuaguagggaaacaac

SEQ ID NO: 158835 - RNA, 45 nt, Homo sapiens
uuguguaauagauauuugaagcucauggcagugacaguagucuca

SEQ ID NO: 158836 - RNA, 59 nt, Homo sapiens
ugucuucauauuccuuagcauaggugggcuucucggcaagaugacuuugcaucuguggg

SEQ ID NO: 158837 - RNA, 51 nt, Homo sapiens
cuuuuuaaauaacaagauuaagagaauuugacaaaguaaguauggacuuca

SEQ ID NO: 158838 - RNA, 59 nt, Homo sapiens
aauuaacaaaugaauaagcuuuuuuggaguuucacaucuugugucugccuaucaccauu

SEQ ID NO: 158839 - RNA, 56 nt, Homo sapiens
cuaggaacacaaugcucuuuaccaucuaauugccuaaggucacagcuuugauaggg

SEQ ID NO: 158840 - RNA, 42 nt, Homo sapiens; identical to SEQ ID NO: 74348

SEQ ID NO: 158841 - RNA, 57 nt, Homo sapiens
ugaagcaaagcauguuuuuaaguugguaguucauugucauguuuauuauauuuacaa

SEQ ID NO: 158842 - RNA, 45 nt, Homo sapiens
augaucgagacagccgacaucagcgugacagcaggagacgcccag

SEQ ID NO: 158843 - RNA, 45 nt, Homo sapiens
uaaacaguuuaauuuuacaaaaguuaauucaucucccagggccac

SEQ ID NO: 158844 - RNA, 62 nt, Homo sapiens
uagaguguuucucagugaagguuuacuuagaauauacuggucagaacuuuaguuggcagcuu

SEQ ID NO: 158845 - RNA, 47 nt, Homo sapiens
cggaauuaggugaauuucuucuauaaauuugauuguuggagguaaua

SEQ ID NO: 158846 - RNA, 57 nt, Homo sapiens
caaagauccagacagcaauccauacagcuuacuugauaauacagaaucagaucagac

SEQ ID NO: 158847 - RNA, 60 nt, Homo sapiens
ugcagacacugaugccagcgaaucucaucacaguacuaaccgucguaggcggucucguag

SEQ ID NO: 158848 - RNA, 57 nt, Homo sapiens
gaaugacugaaucugauacagcuucaguuaaugaaaaugggcuagguauguaagcac

SEQ ID NO: 158849 - RNA, 34 nt, Homo sapiens
acugugucccugaaugauggcaguuuaagucuga

SEQ ID NO: 158850 - RNA, 47 nt, Homo sapiens
cauccgagggacuguguuguagauugugaucaagguugauuggcaaa

SEQ ID NO: 158851 - RNA, 340 nt, Homo sapiens
auuuguuuuccuuccccuucuuuccuccccuccuuuaauguuggaaauauauuuuagggcugggugcaguggcucauaccuguaaucccagcacuuugggaggccagguagcaggauugcuugagcccaggaguuugagaccagcuugggcagugggauccugucuagagaaaauacagaaauuagcugggugugguagugcgcaccuguagucccagcuacucuugagacugaggcaggagaaucacuuuagccugggaggucgaggccgcagugaagggugaucgugccacugcacgcuagccugggugacagugagacccugucucaaaaaaaaaug

SEQ ID NO: 158852 - RNA, 41 nt, Homo sapiens
caagaaaauucaggcuaucaguaugaacuuaacagaauaua

SEQ ID NO: 158853 - RNA, 51 nt, Homo sapiens
uuaauuuaguugauaacuauaucaaaauauuauucugucucuguacacagu

SEQ ID NO: 158854 - RNA, 46 nt, Homo sapiens
gguuucucuaacaacuuuguuccacaacauuagggucaaccagaag

SEQ ID NO: 158855 - RNA, 47 nt, Homo sapiens; identical to SEQ ID NO: 74366

SEQ ID NO: 158856 - RNA, 67 nt, Homo sapiens
gcccaacuagugcuucuggcgaugacauuucuaagcuacagcguacuccaggagaagaaaagauuaa

SEQ ID NO: 158857 - RNA, 46 nt, Homo sapiens
aauagugcuuguacaagcuugccaaagauagaauauggaucgccag

SEQ ID NO: 158858 - RNA, 46 nt, Homo sapiens
uugacaccuacuguguuauaaaauauaucaucagaugugccuugag

SEQ ID NO: 158859 - RNA, 42 nt, Homo sapiens
cauuuuuaauaugcaaccacuucuucaccugaggaaaacuag

SEQ ID NO: 158860 - RNA, 43 nt, Homo sapiens
caaaaaaaccuaacaaaauucuaaucaaaggcaacuuuggaag

SEQ ID NO: 158861 - RNA, 24 nt, Homo sapiens
uuugauuuguccaauggacugaaa

SEQ ID NO: 158862 - RNA, 46 nt, Homo sapiens
cauaacaauugcagaaguuugauuaugucaagaaauagccaacuga

SEQ ID NO: 158863 - RNA, 43 nt, Homo sapiens
gucgaugagcaucucuuauuuucccuuuauuggcaguagggcu

SEQ ID NO: 158864 - RNA, 46 nt, Homo sapiens
uuacaccuaguauuaaugcugcuucccguuuugucauuuuggguuc

SEQ ID NO: 158865 - RNA, 41 nt, Homo sapiens
gaggcuccauaugcuucauggcuugcaaaacguaacggccu

SEQ ID NO: 158866 - RNA, 44 nt, Homo sapiens
gcagcaauggucaguccaacugcuaccacuguacuggccuggua

SEQ ID NO: 158867 - RNA, 44 nt, Homo sapiens
uuuuaauuuugugccaccggugcuaaauacaacuaagcucagug

SEQ ID NO: 158868 - RNA, 46 nt, Homo sapiens
cugggaagcugcaaguucaaaguuggguuugaaauuauuuaaauua

SEQ ID NO: 158869 - RNA, 26 nt, Homo sapiens
cccagagucccuggccaagaggcuuu

SEQ ID NO: 158870 - RNA, 96 nt, Homo sapiens
caugugcggugaggugagugagguacuaaauucugcuuugggucaggaggcagagggagaggcagugaugucugaacugggcuuuggaggauagcu

SEQ ID NO: 158871 - RNA, 44 nt, Homo sapiens
uaugaaugaaugagagggagaaauacaaaaauaauacagggaag

SEQ ID NO: 158872 - RNA, 42 nt, Homo sapiens
auuauuaaugcaggugaacuaaauagaaacaagagaacaaau

SEQ ID NO: 158873 - RNA, 45 nt, Homo sapiens
uuucaucaccaacacuaacaggccaguuuaucuggaguggggugg

SEQ ID NO: 158874 - RNA, 46 nt, Homo sapiens
uucaagaguuguuugguuuggagccaacaauaauuccaccuaagaa

SEQ ID NO: 158875 - RNA, 46 nt, Homo sapiens
gaguuaaaguaaaaacagaaucccaagaccccacaucuucauggag

SEQ ID NO: 158876 - RNA, 47 nt, Homo sapiens
gaugcagucaaaugauguugacaucuacuacuacauggaugagccag

SEQ ID NO: 158877 - RNA, 59 nt, Homo sapiens
uugccuccauguuggggacuggauauaguuugugguaaaggaacagauuuuaauuaugg

SEQ ID NO: 158878 - RNA, 68 nt, Homo sapiens
accaugggccgauaggcagagguacuugaguauguuauauuucuaauaaguuuuuuagauguauuuag

SEQ ID NO: 158879 - RNA, 46 nt, Homo sapiens
aaacauuuugauccaaagaaaaacuugcuuguggcuucuccacaag

SEQ ID NO: 158880 - RNA, 64 nt, Homo sapiens
auaugccagauauuguugggacuaugggaauucagaaauaaaagacauauaucuuccaguuuua

SEQ ID NO: 158881 - RNA, 93 nt, Homo sapiens
acuaucaaguucugaaaguuucugaaauugcacagccugggagaccaagacagauccuugcuuuugaauuacgaaugaauauuauugcagaug

SEQ ID NO: 158882 - RNA, 29 nt, Homo sapiens
gagcuggcucauauuuagaaauuaauauu

SEQ ID NO: 158883 - RNA, 46 nt, Homo sapiens
ggaugccacuaccagcaugcaauaucggacccuuuuagaagcagaa

SEQ ID NO: 158884 - RNA, 74 nt, Homo sapiens
cgcagacauggcagugugaauuagagguuuauaaagccacuuaccacuucaucuuugcacagaaaaacuucuuu

SEQ ID NO: 158885 - RNA, 51 nt, Homo sapiens
uaaaacaaaacaaaaaacagauagaugauagaaagaaauagaaugcagaag

SEQ ID NO: 158886 - RNA, 42 nt, Homo sapiens
uuuuucuuugccuuuuacggacuuuguuccagcuacauguaa

SEQ ID NO: 158887 - RNA, 42 nt, Homo sapiens
ucagaaauggaagagacaaugcuaucuguauuaaggccaucc

SEQ ID NO: 158888 - RNA, 46 nt, Homo sapiens
cuauaauuagcaggucauuagaaucgguuguuuuuuauucugggag

SEQ ID NO: 158889 - RNA, 41 nt, Homo sapiens
gugcaauucgaguugcaaacuguaaucuccacaaucaaucg

SEQ ID NO: 158890 - RNA, 46 nt, Homo sapiens
cagccaauuuaggacuuauuacuguugauauugcuuuagcugcuga

SEQ ID NO: 158891 - RNA, 46 nt, Homo sapiens
agccuggagaauggauaauuacuaaagaaauucccaaaauuauaga

SEQ ID NO: 158892 - RNA, 46 nt, Homo sapiens
gugaauggcaugaagaggaaagaaugggaaaacaaaucagugggaa

SEQ ID NO: 158893 - RNA, 45 nt, Homo sapiens
aagagaacaguaguucuagugcugcacagccuuuguuggcuggug

SEQ ID NO: 158894 - RNA, 60 nt, Homo sapiens
auuucaggaaacagcccugugucuccuaauacucaggauaagucaguaggucaaucuccu

SEQ ID NO: 158895 - RNA, 46 nt, Homo sapiens
ccucuaaauccucauugcaucguccccuugaucuggauacaccaac

SEQ ID NO: 158896 - RNA, 72 nt, Homo sapiens
gaacuuuauauuaagaauaaauuaccaaaauaauucagcucuuuucucugccauggcuuuggcuacauuuau

SEQ ID NO: 158897 - RNA, 66 nt, Homo sapiens
aagcuccaacuucuaauucauggucuuuuuaauauacaauuugcuuguuaaauuguauaguacgcc

SEQ ID NO: 158898 - RNA, 55 nt, Homo sapiens
uuuuauuaugguagaauuacauggguggugaugaguacaguaacagcaacaacaa

SEQ ID NO: 158899 - RNA, 46 nt, Homo sapiens
cugaugccuccuccuccagauucauguagcaugaaguugaccauua

SEQ ID NO: 158900 - RNA, 43 nt, Homo sapiens
cagcuucugauuuuuuucuuuuuguuacagaaaaaacucccau

SEQ ID NO: 158901 - RNA, 42 nt, Homo sapiens; identical to SEQ ID NO: 74442

SEQ ID NO: 158902 - RNA, 50 nt, Homo sapiens
auggauguuuauuaaugggccauagcuuucugcaaugaguuuuggcuaaa

SEQ ID NO: 158903 - RNA, 46 nt, Homo sapiens
accaugucagggaaauauauaauggaagaacaugauaguuauucgg

SEQ ID NO: 158904 - RNA, 34 nt, Homo sapiens
cagguugguuccuuugaacauaaucuuacaacug

SEQ ID NO: 158905 - RNA, 43 nt, Homo sapiens
gaggcuuagguaagggaugauuguagauuugaguuaggaggca

SEQ ID NO: 158906 - RNA, 28 nt, Homo sapiens
auguuaaguaagaaaaaaaaugcacaug

SEQ ID NO: 158907 - RNA, 45 nt, Homo sapiens
ggcaaaaggcuuaaugcucugggcaauacucuuacaacacugaca

SEQ ID NO: 158908 - RNA, 47 nt, Homo sapiens
acagauuaucgaagacaggcagcaucugcuagccagccgggagaacu

SEQ ID NO: 158909 - RNA, 45 nt, Homo sapiens
cuaaaggauaagugggguuugaguuacaaaccaaguuacagccga

SEQ ID NO: 158910 - RNA, 46 nt, Homo sapiens
cgaguaggagaaacugaagagcucccagaaauccguguggaugcag

SEQ ID NO: 158911 - RNA, 45 nt, Homo sapiens
auuaaguugaaaaauacaguauggggaaguacaccacaauccagc

SEQ ID NO: 158912 - RNA, 42 nt, Homo sapiens
aucauguucuguguucaguucucccaaaacuccaggaggcuu

SEQ ID NO: 158913 - RNA, 46 nt, Homo sapiens
uaaugaccggcaagaaagugccaucaucucuacagacaaagccuag

SEQ ID NO: 158914 - RNA, 40 nt, Homo sapiens
uuauaaaauccauuaaauggaauuuauaaauguucuagcc

SEQ ID NO: 158915 - RNA, 45 nt, Homo sapiens
gcugucagcucacaagaugaagauaugggacauuuugaaauacca

SEQ ID NO: 158916 - RNA, 45 nt, Homo sapiens
cacuagugucgucuucaacaucugcuuacucuuccuucccuguag

SEQ ID NO: 158917 - RNA, 46 nt, Homo sapiens
aaaccgaggagaacuggagacuuuagggacuacauauccugcagag

SEQ ID NO: 158918 - RNA, 68 nt, Homo sapiens
auagagaucacacaugcaaaugguaaaaauuuuauugaauaccucugaaaaaaagagacuagacugaa

SEQ ID NO: 158919 - RNA, 31 nt, Homo sapiens
aaaaaacugcuguuucuggccucacaccugg

SEQ ID NO: 158920 - RNA, 42 nt, Homo sapiens
ugugauauagggucugccuccuuuaaauaugauaugcgccga

SEQ ID NO: 158921 - RNA, 45 nt, Homo sapiens
gugguuugaagagccagggccgucugucaguaggaaguaaucgug

SEQ ID NO: 158922 - RNA, 52 nt, Homo sapiens
accaguuccuuaccuuccgccaaagacaaugacuagcaaccuagaaaaaagu

SEQ ID NO: 158923 - RNA, 45 nt, Homo sapiens
uaucaggaugccacauauccuuauuucagauuccauuaccagaag

SEQ ID NO: 158924 - RNA, 50 nt, Homo sapiens
gcauguuuucaugguccaaauuuucguucaaaaucuugggcccuuuuuca

SEQ ID NO: 158925 - RNA, 46 nt, Homo sapiens
caaaccauguggugcuuuggaaaguccuauggcaacaauaaccaag

SEQ ID NO: 158926 - RNA, 46 nt, Homo sapiens
ggaguagcaagugugaaagaaugguucaauuauguuacagcuacaa

SEQ ID NO: 158927 - RNA, 46 nt, Homo sapiens
acugagaauagcacuacugugaagaauucuaguuuguugaguggau

SEQ ID NO: 158928 - RNA, 46 nt, Homo sapiens
aagguucugucaguucuuaucaaaaagcucgguacugcacuacagg

SEQ ID NO: 158929 - RNA, 56 nt, Homo sapiens
uuugccuuugccaaaauaagguuuuauuuugaaagucauuugaaaaacacugagga

SEQ ID NO: 158930 - RNA, 33 nt, Homo sapiens
cuacaaucacuacauuaagaugcauuuuaaaaa

SEQ ID NO: 158931 - RNA, 36 nt, Homo sapiens
guccucaacaucuaauccugacuccugcacaauuau

SEQ ID NO: 158932 - RNA, 43 nt, Homo sapiens
aagaaguccauuuccuauauuuccuaaacuaaugucucuaaac

SEQ ID NO: 158933 - RNA, 47 nt, Homo sapiens
cccugcucccacgguacccaaucaaaacaacucuaaaucacuguagu

SEQ ID NO: 158934 - RNA, 79 nt, Homo sapiens
cauucuuuuacuauacaguguaauaaauauuagauuaaaauuauaaaaauuccagaggaaaaauguauguguuuaauuu

SEQ ID NO: 158935 - RNA, 47 nt, Homo sapiens
gcaugaaagcaauguaguaaaugcaauggaauaaauuauaauggaaa

SEQ ID NO: 158936 - RNA, 48 nt, Homo sapiens
uaugucuaauauauuaaaauugaaaucuacacagcagauauguuuuuc

SEQ ID NO: 158937 - RNA, 52 nt, Homo sapiens
auguuaucauuauucuauuauuauucaggagacagaugggacaauuugcaag

SEQ ID NO: 158938 - RNA, 55 nt, Homo sapiens
agguuugaagacuaggagaaaaagagcagccaggagaagaaucugagguuuugug

SEQ ID NO: 158939 - RNA, 130 nt, Homo sapiens
acguaugcaguuugggaugcaggauuggaguuccagcgacaguccuggcuagaaauguacauuugagagccacguuaauugagugcuaguugaagccuuggaaaugaauaaaauuacucaacaaugacua

SEQ ID NO: 158940 - RNA, 56 nt, Homo sapiens
gguacaacccaggugaagauuguuuuauaaaagcaaaggggagacaguggaagaaa

SEQ ID NO: 158941 - RNA, 55 nt, Homo sapiens
uucaguucauucucauuuaaggacacugauuuuaauugcucacacuaacuuacag

SEQ ID NO: 158942 - RNA, 42 nt, Homo sapiens
gaauuacuuuagauuuugguuucaaauuccaugguaauggau

SEQ ID NO: 158943 - RNA, 53 nt, Homo sapiens
ucuucauguggaccauucucucagacacacaagacagaaacaguagccuuuuu

SEQ ID NO: 158944 - RNA, 93 nt, Homo sapiens
uucccugaggcuucugacaguuugugcaacuuguguaagacauuccugaaagagaggagcauuuguucaacuuauauaacuucuuuuuacauc

SEQ ID NO: 158945 - RNA, 46 nt, Homo sapiens
guguuauuagauucagcugacagaagaggccaccacaagggcucag

SEQ ID NO: 158946 - RNA, 44 nt, Homo sapiens
cauugggaaaaaccagaaguggaaaauuugaguaaaaaucuuca

SEQ ID NO: 158947 - RNA, 40 nt, Homo sapiens
gagcugucaaaccucuggcccuauucuccauuuaaugaaa

SEQ ID NO: 158948 - RNA, 42 nt, Homo sapiens
cauuuuagcugugagugauuucuucuuaaagaugaggaauuu

SEQ ID NO: 158949 - RNA, 46 nt, Homo sapiens
guacuuguaauuaugauauaaaaauagaaagcagaugugucagaca

SEQ ID NO: 158950 - RNA, 25 nt, Homo sapiens
cagaauauuaugccugccuuucucc

SEQ ID NO: 158951 - RNA, 69 nt, Homo sapiens
acaaaauccuguguguauauacuugaguacaugcaauuccgaaagggagaaaaacaugacugaaguuug

SEQ ID NO: 158952 - RNA, 51 nt, Homo sapiens
uuacugcagcugacuauauaaucaacaacuuggacugauuaaaguuauaag

SEQ ID NO: 158953 - RNA, 46 nt, Homo sapiens
gagguccacgacacuugcccauccugcagugcuacgggccugagca

SEQ ID NO: 158954 - RNA, 44 nt, Homo sapiens
guagucaccaacaagaucagaaguggcaugauaaacaguacaag

SEQ ID NO: 158955 - RNA, 84 nt, Homo sapiens
gcugggaaaaguaggaguugaagccaaaaagccaaauucugccauuaggaagugugucaggguccaguggaucaaggauggcaa

SEQ ID NO: 158956 - RNA, 48 nt, Homo sapiens
agccugugucuuucuuuuggcccuauacaaaggcaagaaggaaagacc

SEQ ID NO: 158957 - RNA, 33 nt, Homo sapiens
cacaaguaauagacaaauaacuagguggguggg

SEQ ID NO: 158958 - RNA, 46 nt, Homo sapiens
uuaaugaccagcuggaagaaguugucucuaggcuuuuucaauucag

SEQ ID NO: 158959 - RNA, 43 nt, Homo sapiens
ugaggaccuaagucauuggcacccacaccguagugggacaaau

SEQ ID NO: 158960 - RNA, 41 nt, Homo sapiens
uugcacccuuaaaguauaucaaagugucccccacuuucccc

SEQ ID NO: 158961 - RNA, 41 nt, Homo sapiens
cugugaaauggagaugauaauauaguaccuacccgauuggg

SEQ ID NO: 158962 - RNA, 27 nt, Homo sapiens
aucucaaaaacagaucccucagugaag

SEQ ID NO: 158963 - RNA, 42 nt, Homo sapiens
cagaauagaccugaagacaaaaauccagaaguacaagcaguc

SEQ ID NO: 158964 - RNA, 2928 nt, Homo sapiens
ggaacccucaccuuguuucggacuauagguaauucaucaacucuuccugaggcugggugggugggagggagugaagugucucagacucuacugaauggcagaaacgaggauaauaagaagugcagccacuuuacugucucugcccacuuauccaacugccagaugaugucacuucauuccugugagcccuuuaaauucuugaaacuuguuuucuugcuuucuuuuucuuucuuucuuuuuuuuuuuuuuuuuuuuuuuuuugagacagagucucacccuguugcccaggcuggagugcaguggcgugaucuuggcucacugcaaccuccgccuucuggguucaagcgauucuccugccucagccucccaaguacuugggacuacaggcgugcgccaccaugccuggcuaauuuuuuuuuguauuuuuaguggagacgggguuucaccauguuggccaggcuggucuugaacuccugaccucaagugauccaccugccuuggcuucccaaaaugcugggauaacaggcaugagccauugccuccagcugaaacaugcuuucucaaaggaauugggaucauaugcagguagaagggcagcugguauguguuugccugaaggauagaaugacaagacgugaagaaagauaggaaugacuaagagcuagucauucuugccagccucugacagugugagaucugcagcaguguuuacuaguucauuuucugugaagucaguccuugauaauuugugguacaaagaaaggaaauaacaagucugacaguaaucuuccuaccuuuguagagacuccaucaucccuucugaaucccuguuggcccuacccugcugaggaaguuuaucagggugggcucccuuccugcacuuccugcgcuuggagacauuggagagcccacauugaaaaucucuucaguuaaccacauuuaagucccuucaguccaaagaggaaauggccacuggagucugcuuuaguucccacaagcuuuggguugcuccuuccuccuguucacauguuaaugucuuuagagguucagaggggcauggaagcuacugagagacugacuuccuggggaaaggaagauaacuuguaaccuuaaguugguguuuucuuuuuuuuuuugagacaaagucucgcucugcagcccaggcuggagugcaguggugcgaucuuggcucacuguaaccucugcuucuggguucaagugauucuccugccuuagccuccugaguagcugggauuacaggcacgcaccacuaugucuggcuaauuauuguauuuuuacuagaaacaggguuuugccauguuggccaggcuggucuugaacucuuagccucaagugaucugcccuccuuggccucuuaaagugcugggauuauaggugugagccaccaugcccagccgguguuuuuucucucgaccaccagccuuuuauuauguugauaauguguauuuggagaugauaauuauuaucaagaacuauacuaaagagagcugaaagcagugugggcuuuggaaaguauaugagauuugaacuuggaaagccuguuuuuuugguuuuuguuuuuuuguuuguuuguuuguuuuugagacagggucuugcucugucauccaggcuggagugcaguggcaugaucauagcucauuguagcuggaagaccuguuucaagccucagaucuaccaauuaugggccaggcaggcugggccaaucacuaaccuuguugggccucuguuuuccuacuuguaaagcgaaaaauaauaauaccugacuuuacaagguuguugugagcaucaguuguaauaauuuacuaugugaaguacuuuuuaaacugugaagcacucuacagauagaagggauuauuaucauuguuauuauuauuauuuuuuuaaucuuccaccuauucagccaucaguuuuaaugucaguaaucuucagacuuuccgggaggcaccaacugaguuucagugaauagggcaaucucuccauuucccauuuccuugcuaugaugaguggagauucuucaggcccucugggaaggguugcgggggcaguugaagaggagugcuagauuuauuuauucaucuggugagugggcuucauuguguauuggugcuaaguguuuugguaagcucuaggacaaaaugaaaagucugccauccucaagaaucugagagccuaacugggaaaauggccuugaugacaaugucaugguaacaauacuaaccacaggguguccuuaggagccccagaaaagugugguuguugguucucaaagucuauuuccuagggggggaaaaauauauauauauauauauauauauaguguuagcuccagccaccagugagucaggagaggcuuucuaggcaaagacaucuaaguucagaauccuugugauccagaugccuguacccuuugaguucagaggugggccaggguaucucagguauuucuuuccuuuagcaucuugcaauucaaaauaugguccuugaaucaacaucaccugagagcuuguuaaacagagaaggcuacuucaaauucuauuucugucuuuuauguuagucauuuggguucuuaagucauuucacuguaaccucugggggagcuaggggauucuuuaaggaaguuuccauucucugaguuguuuucagaaacuguuaguuggcaaaggauguaccaucuccuauuaaacgggcaaggacaaguucccuuuucugaggucccuuaagaucucuuccuggggugaucuaggcuugcuguuuuaugagggagggacauauuuacacaggggcaagaacuagucuuuuaauccauuguugcauaggggaggcgugggcacuuggaguugucuuaggacugaugucugaauuaacuaaaugaacuugucugguuugcagagugcugauggcagagau

SEQ ID NO: 158965 - RNA, 46 nt, Homo sapiens
cagagugaggcgauuugaccugcucaaacguaucuugaagauggac

SEQ ID NO: 158966 - RNA, 42 nt, Homo sapiens
cccuagucuaagaguaggaugucugcugaagucauccaucag

SEQ ID NO: 158967 - RNA, 34 nt, Homo sapiens
cuuugacucagaagagguuuguuuauauggaaug

SEQ ID NO: 158968 - RNA, 58 nt, Homo sapiens
aucacgaacaccuguauauccugucacuaacuguuagccuuuuccacacugccgaaau

SEQ ID NO: 158969 - RNA, 40 nt, Homo sapiens
uaacaagguugauuauuauuugcuggucugguggagcugg

SEQ ID NO: 158970 - RNA, 26 nt, Homo sapiens
uccugguuuuuagcuauuuuccagau

SEQ ID NO: 158971 - RNA, 48 nt, Homo sapiens
caacauaugaauuuuggggggacauaaacuuucuguccauaauacgca

SEQ ID NO: 158972 - RNA, 87 nt, Homo sapiens
auguccaaguuaagagagaguucaacagucucugggaagugcugagcgggaacagccuuugagaagacgcuauuaaauauacaggag

SEQ ID NO: 158973 - RNA, 58 nt, Homo sapiens
cuguucguaaagagaggcguugugugggacugauaacagcucugcucaaggacagcaa

SEQ ID NO: 158974 - RNA, 48 nt, Homo sapiens
uaucuugaugggaggggcuacaaagucacagugcaaaggaacauaaac

SEQ ID NO: 158975 - RNA, 49 nt, Homo sapiens
ucuaagacuuuuuuguugaagaucugaucuauggcuuguaacuuauagc

SEQ ID NO: 158976 - RNA, 28 nt, Homo sapiens
cggaggcguucugguuugccaauguguc

SEQ ID NO: 158977 - RNA, 54 nt, Homo sapiens
cauucacaugcaaauaauacauaucaaccuuucaaauguguacagaugcaagga

SEQ ID NO: 158978 - RNA, 64 nt, Homo sapiens
gaaguauguaugaccucaagagagucaauuaacuuucugauucguaguuuccucaucucucaaa

SEQ ID NO: 158979 - RNA, 40 nt, Homo sapiens
acaagggaagagggaauucuugccaaaaacuuaagcccag

SEQ ID NO: 158980 - RNA, 55 nt, Homo sapiens
cuucucauuauauuaaugaaugccacccacaaugaaaaauuaacauuuucggaac

SEQ ID NO: 158981 - RNA, 46 nt, Homo sapiens
ccauaaucuuuugaaauuagaacccugcagcagucuuggaaaaagu

SEQ ID NO: 158982 - RNA, 46 nt, Homo sapiens
ugggaucucuaagaaugguaucgaauggaaagucugggaauucuua

SEQ ID NO: 158983 - RNA, 46 nt, Homo sapiens
gugucaggguggugacuucacacgccauaauggcacugguggcaag

SEQ ID NO: 158984 - RNA, 44 nt, Homo sapiens
acacaaauggaucccaguuuuucaucugcacugccaagacugag

SEQ ID NO: 158985 - RNA, 54 nt, Homo sapiens
ggaggccauggagcgcuuuggguccaggaauggcaagaccagcaagaagaucac

SEQ ID NO: 158986 - RNA, 48 nt, Homo sapiens
uaaguuugacuuguguuuuaucuuaaccaccaggucauuccuucugua

SEQ ID NO: 158987 - RNA, 46 nt, Homo sapiens
gacauaauaagacuuauccauaagcuauaguauauauaacuuaggc

SEQ ID NO: 158988 - RNA, 57 nt, Homo sapiens
auuuugugcccauccacauggagcagggugccuucagucugacauguuccccacaug

SEQ ID NO: 158989 - RNA, 61 nt, Homo sapiens
cacccauuaaguuguguugccaacaauaacaaccaaguguugaaucugaucaggccuuuag

SEQ ID NO: 158990 - RNA, 52 nt, Homo sapiens
uaugagcaguugaaacaugacuguguaagauuugggaaaaggggucucauuu

SEQ ID NO: 158991 - RNA, 63 nt, Homo sapiens
guagauggcaauaaguagaguucugcuuugaaaaaagaaaucaaagggcaaaaaagaaaaaaa

SEQ ID NO: 158992 - RNA, 59 nt, Homo sapiens
gagcgauuaacaacaacaacaaaaaagcagcacaagauuugacaaagaggcaaggggaa

SEQ ID NO: 158993 - RNA, 44 nt, Homo sapiens
acaggcagugggaggccagagggaagccagaggagaaggugucc

SEQ ID NO: 158994 - RNA, 41 nt, Homo sapiens
caaccaaguugcuuuuccaagaugugucauagcaggcagug

SEQ ID NO: 158995 - RNA, 50 nt, Homo sapiens
uguguauaucacauuauuuggggguuuccauuuaaacagacaauauugag

SEQ ID NO: 158996 - RNA, 68 nt, Homo sapiens
cccuuucuauucuaagaaagaaucuguaaucagucagucuccaguauucagauucaggcuguaagaga

SEQ ID NO: 158997 - RNA, 45 nt, Homo sapiens
cuuuauuagacccauauacgaaauauuaaaauucugcccugaacu

SEQ ID NO: 158998 - RNA, 44 nt, Homo sapiens
ggacuuguuuaacuauuuaaggcuguaucucacagucuagugug

SEQ ID NO: 158999 - RNA, 48 nt, Homo sapiens
cucucccucauaaauaaggggcucccucugcuccccuccaccagggcu

SEQ ID NO: 159000 - RNA, 49 nt, Homo sapiens
gcucucucaauaauauuccagugaagcuuguuguucaaaucuuauacgu

SEQ ID NO: 159001 - RNA, 46 nt, Homo sapiens
gauagccuugaaagcuuaucucuaaaauaaguucuuacagaacucc

SEQ ID NO: 159002 - RNA, 51 nt, Homo sapiens
uuucacuggagcuucuaaccuacgucacuaucacggagguaacaagccaau

SEQ ID NO: 159003 - RNA, 44 nt, Homo sapiens
accacuaccuuucagauuuccaaagucuauacaucccaccuuac

SEQ ID NO: 159004 - RNA, 52 nt, Homo sapiens
cugaacaagaaaaguugagagccacagucaacaccuaucugaacuccgugac

SEQ ID NO: 159005 - RNA, 47 nt, Homo sapiens
ccuagucucuggaauaguucuuuuuaauucacaccuuauuaucagag

SEQ ID NO: 159006 - RNA, 24 nt, Homo sapiens
acuuaaaguaaguccuuauaaacu

SEQ ID NO: 159007 - RNA, 40 nt, Homo sapiens
gguuguaugcugcaaacaucugccccacuaaaagccagca

SEQ ID NO: 159008 - RNA, 47 nt, Homo sapiens
auaauaaaaaaacaaggcagccagguuacccuuucagccacagacaa

SEQ ID NO: 159009 - RNA, 55 nt, Homo sapiens
cacucccauucaacagguggugagccuaauggcaggacaagcaucuacugcaagc

SEQ ID NO: 159010 - RNA, 32 nt, Homo sapiens
auccucuuacuucuacaagguugaaaaacaua

SEQ ID NO: 159011 - RNA, 45 nt, Homo sapiens
caggccuuccucagucucuauggcaugauucauauugucguagca

SEQ ID NO: 159012 - RNA, 39 nt, Homo sapiens
acacucccacagcagacaggcucaugccccagguuucuu

SEQ ID NO: 159013 - RNA, 51 nt, Homo sapiens
aggcagccgcgagccaaggaaugcccaagauugcccaaaucaccauaagcu

SEQ ID NO: 159014 - RNA, 85 nt, Homo sapiens
agguccccagccaaaucccaccagcugucucaugacccacccuccaaauauuucuguuauauuuuggauucuugaacacuaguca

SEQ ID NO: 159015 - RNA, 38 nt, Homo sapiens
acccauacacacacacucacacaugcauacacacacac

SEQ ID NO: 159016 - RNA, 49 nt, Homo sapiens
ccuucuuuggccucuucuuuagauuaauguucugggaaaaagaggucaa

SEQ ID NO: 159017 - RNA, 47 nt, Homo sapiens
aaacagauguuacagaaacguaaaccagagccuucacagcugcagac

SEQ ID NO: 159018 - RNA, 47 nt, Homo sapiens
gacaaagugucuucccuuguagcacacagccaagugggaaguaaaag

SEQ ID NO: 159019 - RNA, 61 nt, Homo sapiens
cagccaggaagagucccaacacgagugagaaaaugaacagugcacuuccuugaagcagcac

SEQ ID NO: 159020 - RNA, 46 nt, Homo sapiens
uaaauaugaacgucuaugcuucuuaaauucuucuauaagaaaauua

SEQ ID NO: 159021 - RNA, 46 nt, Homo sapiens
aaucugaauacugguauuaacaaacuaaggagaauuuaggggaagu

SEQ ID NO: 159022 - RNA, 42 nt, Homo sapiens
gaucuacuauuugaucaucugauaaaacuugcauagcaagau

SEQ ID NO: 159023 - RNA, 46 nt, Homo sapiens
ucaaauucuuccuucucggcagucugauucuuaucgagccaguuga

SEQ ID NO: 159024 - RNA, 45 nt, Homo sapiens
ugcuucugaucuucagcuuuguacuucucagcuuccuggaccaua

SEQ ID NO: 159025 - RNA, 44 nt, Homo sapiens
uuucaauaccaagggaaagaggagugacauccaagagcagcaaa

SEQ ID NO: 159026 - RNA, 46 nt, Homo sapiens
uuggagaagcuucugaaucuuggggauaugaguagaaccaccaacc

SEQ ID NO: 159027 - RNA, 73 nt, Homo sapiens
aaggaacaggucagcauucaauucuucaaaugaggcacagguacuggagguauagaugucgauuccuucagag

SEQ ID NO: 159028 - RNA, 44 nt, Homo sapiens
accuuaggccugccagcaucauucaccaccaugaagggccaaug

SEQ ID NO: 159029 - RNA, 46 nt, Homo sapiens
gugaugaucaaggcuccaagggcuaugcauuugugcacuuucagaa

SEQ ID NO: 159030 - RNA, 46 nt, Homo sapiens
ugggcuaugccuacgugaacuucuugcagcuggcugaugcccagaa

SEQ ID NO: 159031 - RNA, 26 nt, Homo sapiens
ggauugcucaaagaacuccaggggac

SEQ ID NO: 159032 - RNA, 24 nt, Homo sapiens
uuuggguugggugguggagagcgc

SEQ ID NO: 159033 - RNA, 60 nt, Homo sapiens
ucuugaguugucaggaaauacagaagcaaaaccagguagaaaagaaaaacaaaaacaugg

SEQ ID NO: 159034 - RNA, 45 nt, Homo sapiens
ugcaaguuaguuccaguugcugaaaaaguugcuuccaguaagagu

SEQ ID NO: 159035 - RNA, 45 nt, Homo sapiens
gcggaccccgaggagccucgauguggauggccccgcgaaguuaag

SEQ ID NO: 159036 - RNA, 57 nt, Homo sapiens
ccuggaaguccccgcacagccccccgguggcggccgcggcggccgccgccgccaccg

SEQ ID NO: 159037 - RNA, 36 nt, Homo sapiens
cugccccgcgagcggcccagcggcggcggggggcac

SEQ ID NO: 159038 - RNA, 46 nt, Homo sapiens
cuuauuccuaacauuugucuaccucaaagaaauuucaagauuauuu

SEQ ID NO: 159039 - RNA, 65 nt, Homo sapiens
uuagaaguguacuguaaacuuugauaggcuuuuaggccuuuuuuaaagcccaacuuggcuucugu

SEQ ID NO: 159040 - RNA, 81 nt, Homo sapiens
ugccuuuugaguagcuugcagucuaguggggagacaagcaggcaaacagucacaacacagcaaaagcgaccuuggagcaua

SEQ ID NO: 159041 - RNA, 51 nt, Homo sapiens
gugaagaacuccagaccuccagauugugcaacuaacauaaaaugagcugcu

SEQ ID NO: 159042 - RNA, 46 nt, Homo sapiens
cacaauccaacuagcagaucaaguuuugccacaucuccuagaaguc

SEQ ID NO: 159043 - RNA, 48 nt, Homo sapiens
caaaaguaacuggcaacaguaugagaauuucuagugggcucaggagau

SEQ ID NO: 159044 - RNA, 41 nt, Homo sapiens
uauguagaggacacaggagauauuuacauuguggauggaga

SEQ ID NO: 159045 - RNA, 44 nt, Homo sapiens
uauucccuuauuaguagucugcuuuaugcucuugcuuguaagau

SEQ ID NO: 159046 - RNA, 31 nt, Homo sapiens
acuuccuugauucccagaaauaaaaagagca

SEQ ID NO: 159047 - RNA, 42 nt, Homo sapiens
caguuuccuggagaacugagaaaauucuuuaccggcuggaug

SEQ ID NO: 159048 - RNA, 46 nt, Homo sapiens
uucaccuucaucccaccagucacacggcagaugguuuguuugccag

SEQ ID NO: 159049 - RNA, 44 nt, Homo sapiens
ucagcacuuguaagaacugguauaaaaaguccaucuguggacag

SEQ ID NO: 159050 - RNA, 95 nt, Homo sapiens
ucgugggagccaccacaacgcagcgcuauucugacgccucaaaacugagggaggagaucgagggaaagggauccuucacuuacuuugcaccgagu

SEQ ID NO: 159051 - RNA, 46 nt, Homo sapiens
ggagagcaacgugaauguugaauuacugaaugcuuuacauagucac

SEQ ID NO: 159052 - RNA, 45 nt, Homo sapiens
caugauuauuccuucaauguauaacaauuuggggcuuuucauuaa

SEQ ID NO: 159053 - RNA, 81 nt, Homo sapiens
augucauugaccgugugcuuacacaaauugguaccucaauucaagacuucauugaagcagaagaugaccuuucaucuuuua

SEQ ID NO: 159054 - RNA, 124 nt, Homo sapiens
agcugccaucacaucggacauauuggaggcccuuggaagagacggucacuucacacucuuugcucccaccaaugaggcuuuugagaaacuuccacgagguguccuagaaaggaucaugggagac

SEQ ID NO: 159055 - RNA, 56 nt, Homo sapiens
cucuccaguguucugagucuauuaugggaggagcagucuuugagacgcuggaagga

SEQ ID NO: 159056 - RNA, 47 nt, Homo sapiens
ugugacaaauaauggugugauccauuugauugaucagguccuaauuc

SEQ ID NO: 159057 - RNA, 57 nt, Homo sapiens
uucagccaaacaaguuauugagcuggcuggaaaacagcaaaccaccuucacggaucu

SEQ ID NO: 159058 - RNA, 68 nt, Homo sapiens
uguggcccaauuaggcuuggcaucugcucugaggccagauggagaauacacuuugcuggcaccuguga

SEQ ID NO: 159059 - RNA, 46 nt, Homo sapiens
ugcaaccuucgaccuuucucaggaaaaugauuucacagacauauuu

SEQ ID NO: 159060 - RNA, 103 nt, Homo sapiens
auacucucagcauggaucagcgccuccuuaaauuaauucugcagaaucacauauugaaaguaaaaguuggccuuaaugagcuuuacaacgggcaaauacugga

SEQ ID NO: 159061 - RNA, 54 nt, Homo sapiens
uuuccuuuccuaggcugucugcauugaaaauucaugcauggagaaagggaguaa

SEQ ID NO: 159062 - RNA, 62 nt, Homo sapiens
gcaagggagaaacggugcgauucacauauuccgcgagaucaucaagccagcagagaaauccc

SEQ ID NO: 159063 - RNA, 49 nt, Homo sapiens
uuauuugugccaaccaaugaugcuuuuaagggaaugacuagugaagaaa

SEQ ID NO: 159064 - RNA, 54 nt, Homo sapiens
acaaaaaugcucuucaaaacaucauucuuuaucaccugacaccaggaguuuuca

SEQ ID NO: 159065 - RNA, 61 nt, Homo sapiens
uuggaaaaggauuugaaccugguguuacuaacauuuuaaagaccacacaaggaagcaaaau

SEQ ID NO: 159066 - RNA, 46 nt, Homo sapiens
acaaaugguguaauucauguuguagauaaacuccucuauccagcag

SEQ ID NO: 159067 - RNA, 42 nt, Homo sapiens
caacugcuggaaauacuuaauaaauuaaucaaauacauccaa

SEQ ID NO: 159068 - RNA, 61 nt, Homo sapiens
aaaauugaaggugaaccugaauucagacugauuaaagaaggugaaacaauaacugaaguga

SEQ ID NO: 159069 - RNA, 62 nt, Homo sapiens
caaaaucauugauggagugccuguggaaauaacugaaaaagagacacgagaagaacgaauca

SEQ ID NO: 159070 - RNA, 47 nt, Homo sapiens
uagguccugaaauaaaauacacuaggauuucuacuggagguggagaa

SEQ ID NO: 159071 - RNA, 49 nt, Homo sapiens
caccaaauucauugaagguggugauggucauuuauuugaagaugaagaa

SEQ ID NO: 159072 - RNA, 46 nt, Homo sapiens
aauugagaaacauaacugaaguuugauguuuauccaaaacacaguc

SEQ ID NO: 159073 - RNA, 45 nt, Homo sapiens
uuagacacacccgugaggaaguugcaagccaacaaaaaaguucaa

SEQ ID NO: 159074 - RNA, 85 nt, Homo sapiens
uaagggaaggucguucucagugaaaauccaaaaaccagaaaaaaauguuuauacaacccuaagucaauaaccugaccuuagaaaa

SEQ ID NO: 159075 - RNA, 51 nt, Homo sapiens
uuguggaguuagccuccugugguaaaggaauugaagaaaauauaacaccuu

SEQ ID NO: 159076 - RNA, 70 nt, Homo sapiens
guauguuauggauacauaaaaugcacgcaagccauuaucucuccaugggaagcuaaguuauaaaaauagg

SEQ ID NO: 159077 - RNA, 31 nt, Homo sapiens
ugcuugguguacaaaacuuuuuauaucaaaa

SEQ ID NO: 159078 - RNA, 63 nt, Homo sapiens
aagugugcuauggcacugauuuuguaaagcagagaaagaagcauuuggcaaaagagcaaauca

SEQ ID NO: 159079 - RNA, 100 nt, Homo sapiens
ucaggcaaaaauagacaucuuauuaguuggagaugucacugugggcuaccuggcugauacuguacagaaacuauuugcaaacauagcagaagucaccauc

SEQ ID NO: 159080 - RNA, 119 nt, Homo sapiens
accaucagugacacgaaggaggcagcagcgcuuuuggaugauugcauauucaacaugguucucuugaaggugccuucuucacuaagugccgaggagcuggaagccaucaaguuaauuag

SEQ ID NO: 159081 - RNA, 45 nt, Homo sapiens
aaagaaaaauacacauucacuguuuguuuuuauaaucccugaaaa

SEQ ID NO: 159082 - RNA, 50 nt, Homo sapiens
uauguauauuaucaacucaaguuguacaccuuaaauauguacaauuucga

SEQ ID NO: 159083 - RNA, 52 nt, Homo sapiens
gaaaacgcaacugggccugaagaacuuggauugccccugcagagguccuaca

SEQ ID NO: 159084 - RNA, 45 nt, Homo sapiens
cugaaucuuuaaggaauggcaaugggcuugaauuaaaugcuucgu

SEQ ID NO: 159085 - RNA, 45 nt, Homo sapiens
aauauugcugugagcagcugcguacucucuugccguauguaaaag

SEQ ID NO: 159086 - RNA, 45 nt, Homo sapiens
aauuccugacuaauacgugcuggaaugggugcuccacuccugaug

SEQ ID NO: 159087 - RNA, 38 nt, Homo sapiens
cuagcacugauugcccaccccucugcuucuacucagag

SEQ ID NO: 159088 - RNA, 45 nt, Homo sapiens
aauaagaauauauauuuaaaaaccuguaagcuuauucaccugagg

SEQ ID NO: 159089 - RNA, 42 nt, Homo sapiens
agaugguggcagacaccagcgaagugaaacugagaauccgag

SEQ ID NO: 159090 - RNA, 49 nt, Homo sapiens
ucuuuccacacgauuuccuaucucccuugaaaaguacaccguaacacuc

SEQ ID NO: 159091 - RNA, 38 nt, Homo sapiens
cugcugucuguaaauugccauugcuguaccugugggau

SEQ ID NO: 159092 - RNA, 70 nt, Homo sapiens
ugaauaaagcaguugaucagcaucauuggaacauggggacgagugacggcaggaggaccacgaggaaaua

SEQ ID NO: 159093 - RNA, 47 nt, Homo sapiens
ucugugagaaacaaauauuuacuuagaguggaaggacugauugagaa

SEQ ID NO: 159094 - RNA, 45 nt, Homo sapiens
uuuuaaauuaaagaugucuaguugcuuuuuauaagaccaagaagg

SEQ ID NO: 159095 - RNA, 51 nt, Homo sapiens
uucauuguaauuuauauauuucacuuguauucauuuguaaaacuuuguauu

SEQ ID NO: 159096 - RNA, 46 nt, Homo sapiens
auggaauguaucucuguuuucuauccucuuggcucuugguggaauu

SEQ ID NO: 159097 - RNA, 35 nt, Homo sapiens
gaacuuuuuuugaaaugaacaacuauaaucucuga

SEQ ID NO: 159098 - RNA, 65 nt, Homo sapiens
accccaugaauuuaaagcauguagugaggauauaugaaucucacaaauuuagcacaguuaugaga

SEQ ID NO: 159099 - RNA, 46 nt, Homo sapiens
agaugcuuucuucuguauuggcugcucucauuggaauugcaggauc

SEQ ID NO: 159100 - RNA, 46 nt, Homo sapiens
cuuucaucuaauuugggguaucacugagcugaagacaaagagaagg

SEQ ID NO: 159101 - RNA, 1042 nt, Homo sapiens
ggcgucccuucccccaaguuaucaaauccaagggcgguguugugggcaucaagguaaggggagggccuccggacgugagguuugagauggaaguggaggaaggaaauccagguuagugaggcagggaaugaaugcuggauugguggccuagagacuugcauggagccugcuucaggcuuagggcauuuacucgacauuuuuaauccucacaauucugagagaacaguaucauucccacuuuacacaugaaaaucucagaagcucagggaagugaaguguuuugcucagaguaaguggcagagccccagucugacacccaauucacucaacauuucuguugucaaauaacaucccaguguauccugucucagaggauuguuacuaagugaacuaagugaaaauauuuuaauuuaauuguaacuaaguauuugaguaacuaaacauuuuaaguaaauuuuuuuuuuuuuuuuuuuugagauggagucucgcugucucccaggcuggagugcaguggugcgaucucuuggcucacugcaaguuccgccucccagguucacgccauucuccugccucagccucccgaguagcugggacuacaggcgcccgccaccacccggcuaauuuuuuuuguauuuuuaguagacacuggguuucaccauguuagccaggauggucucgaucuccugaucucgugaucugcccaccucggccucccaaagugcugggauuacaggcgugagccaccaugcccggcuuaaguaacuaaauauuuuaauuguaacuaagugaaaauauuugccagcccugagaugcaguuuaagggauuaaguaaaugugggggaagacuggggcuaaagaagaggaaagaggggcacgcccagcuaccuaggaggcugaggcgggaggaucacuugaguccaggaaguggaggcuucagugagcugagauuccaccacuguacuccagccggggcgacaguggaaagggugcuagaggucauuuccugugucuuaauguuguuacccugaccccaacagguaga

SEQ ID NO: 159102 - RNA, 46 nt, Homo sapiens
gcugugcccaguacaagaaggacggagcugacuucgccaaguggcg

SEQ ID NO: 159103 - RNA, 47 nt, Homo sapiens
ccaucauggaaaaugccaauguucuggcccguuaugccaguaucugc

SEQ ID NO: 159104 - RNA, 156 nt, Homo sapiens
gagaagguaaauggcuaccugccugaccagugcaagguggcuggccggggacccuggggcuaaccccuauccucuccuccaccccacuacccaccgugcgccugcucugcuccaggugcuggcugcugucuacaaggcucugagugaccaccacau

SEQ ID NO: 159105 - RNA, 66 nt, Homo sapiens
uggucaccccaggccaugcuugcacucagaaguuuucucaugaggagauugccauggcgaccguca

SEQ ID NO: 159106 - RNA, 44 nt, Homo sapiens
aguuuagaauguuauacguaccgaaaguaugcagccaaaucgau

SEQ ID NO: 159107 - RNA, 71 nt, Homo sapiens
gaaaaaaauaagcuguuaaaaaaaggaaaucguagguuaauuuaauugggaaaaugggcaauugacagaga

SEQ ID NO: 159108 - RNA, 55 nt, Homo sapiens
agaaguguugcuaauuacaaguuguguucucaugacguaauuagaaaguaacuuc

SEQ ID NO: 159109 - RNA, 40 nt, Homo sapiens
acuaugaaaugacuuauuuuaccugaaggacccaugguuu

SEQ ID NO: 159110 - RNA, 58 nt, Homo sapiens
aggacaaagcaacaauuuucuguugccaccuuuauaccggaagacucuguuguagaag

SEQ ID NO: 159111 - RNA, 88 nt, Homo sapiens
aaauaagauuccuuuugaucuaccggaauauacauguacagaguacauuggaucauguuggaaagaaggcaagugaaaaggucagaga

SEQ ID NO: 159112 - RNA, 53 nt, Homo sapiens
gaaagacuuuaauaauuugagucucugagaggauacuuucaauuuccaugggg

SEQ ID NO: 159113 - RNA, 43 nt, Homo sapiens
uguaaccaaaaccauuuuuaauuagcuuuuaaggacugagaga

SEQ ID NO: 159114 - RNA, 44 nt, Homo sapiens
uuugaaauauuacaacuggggauuuaaaaaauugcagcuuagaa

SEQ ID NO: 159115 - RNA, 39 nt, Homo sapiens
aaacuauuuaacuugagcuuuaaaaaucauuguauggau

SEQ ID NO: 159116 - RNA, 31 nt, Homo sapiens
gucuuucguguagguugucaucuuugcauug

SEQ ID NO: 159117 - RNA, 47 nt, Homo sapiens
acuggccuguaaguggcaaagaccagaauguacuuuauaguccagag

SEQ ID NO: 159118 - RNA, 56 nt, Homo sapiens
ucacauccuuacuucuucagcuauuuuacacaucacccguccuccagcugcuagga

SEQ ID NO: 159119 - RNA, 46 nt, Homo sapiens
aaaugggaugugacugccuucagauaacuuguauuuuugcagaaaa

SEQ ID NO: 159120 - RNA, 48 nt, Homo sapiens
acucauuggcauugaaaucaugcgagaacauuaacaaaauggaucuga

SEQ ID NO: 159121 - RNA, 49 nt, Homo sapiens
caguggacaguuuguaauuacacuggcucuccucuugcuuguaggcggc

SEQ ID NO: 159122 - RNA, 43 nt, Homo sapiens
ucugcuucacuuuuugaaccuaagccauggcagcagcagggaa

SEQ ID NO: 159123 - RNA, 47 nt, Homo sapiens
augaacuuacuggcccaaauaucaaacugaauuaaacacuuguucca

SEQ ID NO: 159124 - RNA, 24 nt, Homo sapiens
gaaagaaagaaaguuaaaaaaaaa

SEQ ID NO: 159125 - RNA, 51 nt, Homo sapiens
gaguaauggccuuuaagccugaauucccagacauaugcaauaaauggaaga

SEQ ID NO: 159126 - RNA, 45 nt, Homo sapiens
guguauguuuaaucauacuaagguuagcauaucauaaccacuguu

SEQ ID NO: 159127 - RNA, 45 nt, Homo sapiens
gcaggagugcugggacuucaagccauggguaagcucggucagaac

SEQ ID NO: 159128 - RNA, 43 nt, Homo sapiens
gugauugauuccauuuguccccugauuugagccacacgaagau

SEQ ID NO: 159129 - RNA, 46 nt, Homo sapiens
agugccaccccaccaauuucaaaacauuuuaaccccaaacacacaa

SEQ ID NO: 159130 - RNA, 23 nt, Homo sapiens
ucugggagaugccuaugugaguu

SEQ ID NO: 159131 - RNA, 57 nt, Homo sapiens
ucuauucugaugcauuaaaaauagcaggagauggugccguuuaggauuugggcagaa

SEQ ID NO: 159132 - RNA, 43 nt, Homo sapiens
gucacaggacugggacaauccaggggaaugagagggagaguca

SEQ ID NO: 159133 - RNA, 34 nt, Homo sapiens
gugagcauuccaugaaacagaaaguaggagccau

SEQ ID NO: 159134 - RNA, 44 nt, Homo sapiens
caccuguccucccaccugccuucuggccugccagugugucugau

SEQ ID NO: 159135 - RNA, 40 nt, Homo sapiens
ugggaaaucucugaguaauguuuuugaauuaccagaggaa

SEQ ID NO: 159136 - RNA, 61 nt, Homo sapiens
agaaacuaauaugugcuaacugugcaggcucuggugauggugguugugugugugugcacau

SEQ ID NO: 159137 - RNA, 50 nt, Homo sapiens
caauuauuuaaaaauguaaaaaccauucuuagauucccuguuguacaaaa

SEQ ID NO: 159138 - RNA, 39 nt, Homo sapiens
uaccucaagcuugguaccagcgccucagugucugcugac

SEQ ID NO: 159139 - RNA, 43 nt, Homo sapiens
uauuuuaagguuuuucuccuauauacuccucaaaaccccugua

SEQ ID NO: 159140 - RNA, 32 nt, Homo sapiens
gaagucuuuuacaaagaagaugagugugugug

SEQ ID NO: 159141 - RNA, 59 nt, Homo sapiens
uauauuauugguauaaauuuaaugucucuaauaaauuacuuugacaauuggucauucau

SEQ ID NO: 159142 - RNA, 45 nt, Homo sapiens
gguacuggauuguucaucauucaggaaucacagaguuagaaugga

SEQ ID NO: 159143 - RNA, 38 nt, Homo sapiens
aaguacuuuugugagccugagggacucuucuguaagau

SEQ ID NO: 159144 - RNA, 248 nt, Homo sapiens
acaagaaccaaaucuuaccugccuugcauaauacuucucucuuuuuuuuuuuuuuuuuuuuuuuucacuugagacagucuugcucugucgcccaggcuggagugcaguggcaugaucccagcucacugcaaccucugcccccuggguucaagugauucugccucagccucccgaguagcugggguuacaggcaccugccaccacacccagcuaauuuuuugugcauaauacuucucuaaugccuggcc

SEQ ID NO: 159145 - RNA, 30 nt, Homo sapiens
agggaucuccuccuacuccagauccccaua

SEQ ID NO: 159146 - RNA, 43 nt, Homo sapiens
cuugcggcauugauuuuuuuuuuuuaacuuacacuaagaagga

SEQ ID NO: 159147 - RNA, 44 nt, Homo sapiens
acccauaauuccugaacuuugauuauggggguuauuacaggaca

SEQ ID NO: 159148 - RNA, 45 nt, Homo sapiens
cuugaguuauugaucuugcaugucugcauuugaaguaugaagaug

SEQ ID NO: 159149 - RNA, 35 nt, Homo sapiens
cacauucguacauuuuaacauaaaauccaaccaua

SEQ ID NO: 159150 - RNA, 24 nt, Homo sapiens
cgcgcguguguucgugugugugug

SEQ ID NO: 159151 - RNA, 42 nt, Homo sapiens
ggccagagguacuuccucaaguaagucagccuggagccgaag

SEQ ID NO: 159152 - RNA, 45 nt, Homo sapiens
gcacgcucagucugaauguccgccaucuucccggccacugaaaaa

SEQ ID NO: 159153 - RNA, 48 nt, Homo sapiens
ugucuuuguuaccuugaauugguuaauagcaaaaccuuuagaaucaga

SEQ ID NO: 159154 - RNA, 46 nt, Homo sapiens
ugagggaacugguucauuuagucagucaguuagacucuagcacuua

SEQ ID NO: 159155 - RNA, 45 nt, Homo sapiens
agacugggagcacaacauaucaacauaaaaugcaucuucacugag

SEQ ID NO: 159156 - RNA, 48 nt, Homo sapiens
uuuugauuaacucaaaaccagagaaugccugugaacccauagugccuc

SEQ ID NO: 159157 - RNA, 27 nt, Homo sapiens
auuuguucaguuagcuaauuuaaauca

SEQ ID NO: 159158 - RNA, 42 nt, Homo sapiens
auccucccuuguuucagaaaacauuuaaaauuuaaaauccag

SEQ ID NO: 159159 - RNA, 51 nt, Homo sapiens
uauuaaauuauuuaauccucagauuaaacaauaauaaauguguauauugua

SEQ ID NO: 159160 - RNA, 21 nt, Homo sapiens
auccauucauguauauagaug

SEQ ID NO: 159161 - RNA, 49 nt, Homo sapiens
uucuuggggcagucauaucuccuacagauuuaguuuuuuuuaguaauag

SEQ ID NO: 159162 - RNA, 38 nt, Homo sapiens
uccuauuacccaccuuacaacauacacauuucuguagu

SEQ ID NO: 159163 - RNA, 39 nt, Homo sapiens
ugauugagguggagguucuuuuugguacccaagguacua

SEQ ID NO: 159164 - RNA, 46 nt, Homo sapiens
uuuguccaggauagacauagagcuagaagaaacagacuucguaaag

SEQ ID NO: 159165 - RNA, 45 nt, Homo sapiens
gaguaugauguaugugccauuuguuuggaugaguaugaagaugga

SEQ ID NO: 159166 - RNA, 47 nt, Homo sapiens
acucaagcaucaauucagcucuucuuuuggaaugaaaguauagccaa

SEQ ID NO: 159167 - RNA, 48 nt, Homo sapiens
uagacuaauguauaaucaaaaugcuaaggauuuuuauauggccuugua

SEQ ID NO: 159168 - RNA, 46 nt, Homo sapiens
guguuuaauaguuauggcauuuuuuuaaaugcauauuaaaucagau

SEQ ID NO: 159169 - RNA, 66 nt, Homo sapiens
uugugagauggauuuuaacugaccuauuaaggguuucuuucgaauggcacuacuuuagggacauuc

SEQ ID NO: 159170 - RNA, 38 nt, Homo sapiens
cuggggauucaaucaguaugguuacuguaaggucaugg

SEQ ID NO: 159171 - RNA, 48 nt, Homo sapiens
gagacaaaccuuuauucauagugucuacaggacauaugaagagugcaa

SEQ ID NO: 159172 - RNA, 45 nt, Homo sapiens
gagcauuuacuuggcucauuuagucuuccuuuuguagcgcauggu

SEQ ID NO: 159173 - RNA, 42 nt, Homo sapiens
aagugcugaaaagacacugaucagagauuguacaaccggcac

SEQ ID NO: 159174 - RNA, 45 nt, Homo sapiens
aagagucaagguggggagccaacauacaauguggcugucggcaga

SEQ ID NO: 159175 - RNA, 42 nt, Homo sapiens
cugcccuccagccuucuucaccauguccaagaugccggccaa

SEQ ID NO: 159176 - RNA, 50 nt, Homo sapiens
ggcgcccccgcggcgcagcagccccagcaguucgcguauccucagccuca

SEQ ID NO: 159177 - RNA, 42 nt, Homo sapiens
gugucuaccacuucuguuacuaugccaaauguacccgcgccu

SEQ ID NO: 159178 - RNA, 42 nt, Homo sapiens
cacagcgcaccaacaagucuaccacagucugaccuaagccag

SEQ ID NO: 159179 - RNA, 32 nt, Homo sapiens
caggaggcagaacugucucagucuucgaccuc

SEQ ID NO: 159180 - RNA, 65 nt, Homo sapiens
uucugauagcacuaauuuggaaauagugaaauaugguacuggaucuaugaaucugguacuuccua

SEQ ID NO: 159181 - RNA, 42 nt, Homo sapiens
uaaaaggaaucugaccuuccuuuccuaaaauggcaggaguug

SEQ ID NO: 159182 - RNA, 45 nt, Homo sapiens
auaaucaaaauggaagaaaguacaguggaguggcaugaaauauag

SEQ ID NO: 159183 - RNA, 40 nt, Homo sapiens
aaauguuaguuuuaggcuguucaucuuauuacacaaguau

SEQ ID NO: 159184 - RNA, 46 nt, Homo sapiens
aggauucccaaagguaaguguaaagccucuaguuucuaaaguagag

SEQ ID NO: 159185 - RNA, 69 nt, Homo sapiens
agccuguuuuuuuauaaaacaaaaacaacaaccaaaaaaaaaaccagauugaauguucaauugguucag

SEQ ID NO: 159186 - RNA, 79 nt, Homo sapiens
uuagcaggucuaaucagugccuuugauugccuuagaccuaguuaggagaaaaguggaaaaaggauuaaaagaauagaaa

SEQ ID NO: 159187 - RNA, 40 nt, Homo sapiens
aaucaaacaguuacuuuggugauucucuggcaucuuggaa

SEQ ID NO: 159188 - RNA, 45 nt, Homo sapiens
gucagaauuuaguuaaugaguguaaagcacuuagaauagugugug

SEQ ID NO: 159189 - RNA, 47 nt, Homo sapiens
gauauuuguaaaggcauuugauauagaagaguguugauuaggcuaug

SEQ ID NO: 159190 - RNA, 42 nt, Homo sapiens
uuucuuuuaacuuuucaacuagcuuauuaaauuuuccauuga

SEQ ID NO: 159191 - RNA, 45 nt, Homo sapiens
aagggaacauuccaguuagaggaaauauugugcaccacuauggaa

SEQ ID NO: 159192 - RNA, 55 nt, Homo sapiens
uuauaugauaaggauaaaguuaaauuugguagguguauaacauuugaagacagga

SEQ ID NO: 159193 - RNA, 53 nt, Homo sapiens
gguagaauuuuuuuauguucacuuuucugugaaagguucagagcauuugucag

SEQ ID NO: 159194 - RNA, 57 nt, Homo sapiens
uaguacauagucauaaaguucuuuuucaaaaauggauaaggagacauugcuuaauaa

SEQ ID NO: 159195 - RNA, 37 nt, Homo sapiens
uacaaggacuucaugggaaaccuuuauaugugaccug

SEQ ID NO: 159196 - RNA, 48 nt, Homo sapiens
acaauacucaaaguaaucacugucuguauugagugcucagugugccaa

SEQ ID NO: 159197 - RNA, 47 nt, Homo sapiens; identical to SEQ ID NO: 74887

SEQ ID NO: 159198 - RNA, 47 nt, Homo sapiens
cauggguccauaguauuuaaguuuacagacuacaacauuguccacag

SEQ ID NO: 159199 - RNA, 45 nt, Homo sapiens
gaaagaaagcugcuuguguuugcuuuguuaauugccucaggauau

SEQ ID NO: 159200 - RNA, 47 nt, Homo sapiens
caaauuuacguuuuacuaaugguaagggugagggucauagggcaggu

SEQ ID NO: 159201 - RNA, 44 nt, Homo sapiens
gcaagaacaucacccagcgcggcaacgucgccaagaccucggua

SEQ ID NO: 159202 - RNA, 45 nt, Homo sapiens
ggugaugcgcaaggcaaagaagagaucgacaguauuuugaacaaa

SEQ ID NO: 159203 - RNA, 41 nt, Homo sapiens
gaaauauucucauucuuaguggggauguuaauuuggcagag

SEQ ID NO: 159204 - RNA, 82 nt, Homo sapiens
aaaccaaagauggucacuaugguagagacugaccaaaugaugauugauggguguaagaaauacaugcgaaaaacguguggcg

SEQ ID NO: 159205 - RNA, 57 nt, Homo sapiens
gcuggggcgccuguauuguccuguggaauuuucaaaggagaucaucugugucccuuc

SEQ ID NO: 159206 - RNA, 42 nt, Homo sapiens
ggccaggcaaggaaaugaauccaugaccucuuuucgccucac

SEQ ID NO: 159207 - RNA, 44 nt, Homo sapiens
uguguuacauuucaccggagagaccucuagcuuaccaguuuuag

SEQ ID NO: 159208 - RNA, 46 nt, Homo sapiens
gacgagugaggauuaggacaugucugcaugggcgaagugggugcag

SEQ ID NO: 159209 - RNA, 50 nt, Homo sapiens
auuuagaaaggcauaacaauaaugaagugcuauuaaggaaaugguaguca

SEQ ID NO: 159210 - RNA, 37 nt, Homo sapiens
gauuaaaauggguaaacaaauugugguauacucauag

SEQ ID NO: 159211 - RNA, 125 nt, Homo sapiens
auggugauccggaggaugaugcgggcccacaauauagguaaaucucaaaacaugcugagcaaaacaaguuaaaucucaaaacauguugagcaaaacaagucagacacaaacgacuauguaccuug

SEQ ID NO: 159212 - RNA, 152 nt, Homo sapiens
ucauuuauuguaugugguuuauaccccaauauaaauuaggggaaaaagucaaaggcacaaaacuugcucuugaagcaauacagauguugagcauacacagagcagauuguaauguguguguaaaugguauagggugcuugaaagagggcaga

SEQ ID NO: 159213 - RNA, 68 nt, Homo sapiens
aaaggcaggauaaacagaaaaggcuuucuggacaauagaugguuugugcuguguuuugaagaugcaaa

SEQ ID NO: 159214 - RNA, 43 nt, Homo sapiens
gccuaguguccaccuccuaucaauguuacaagcauggcacuca

SEQ ID NO: 159215 - RNA, 48 nt, Homo sapiens
ugggcagaauuuauuuuuuggaagaaguuuaaucaaaggcagccauag

SEQ ID NO: 159216 - RNA, 45 nt, Homo sapiens
uguagccuacccuccccgaauuacaaaucguccacccaggaguau

SEQ ID NO: 159217 - RNA, 48 nt, Homo sapiens
ggacuaugccaagugguuauguaguagacaggccucaaauuaauggga

SEQ ID NO: 159218 - RNA, 46 nt, Homo sapiens
guaucugauagcaagcaaugguucuuuuaucauuucuaaaacaacu

SEQ ID NO: 159219 - RNA, 47 nt, Homo sapiens
aacacuuugacugcagagcugaagggacaccaucuccugaagucaug

SEQ ID NO: 159220 - RNA, 46 nt, Homo sapiens
ugacaccaaaauguacaaacuggauguggucucuaaaccuccauua

SEQ ID NO: 159221 - RNA, 48 nt, Homo sapiens
ccacuuaacaguuauaacagcugcuccccggauaaggcagaguaacaa

SEQ ID NO: 159222 - RNA, 43 nt, Homo sapiens
ucaacaauggaacuuuauacuucaacaaaguugggguagcgga

SEQ ID NO: 159223 - RNA, 46 nt, Homo sapiens
aagcuuccggcuccccagugccagagauaucuuggaguuugccuga

SEQ ID NO: 159224 - RNA, 49 nt, Homo sapiens
augcauguuagccuaagacugaaaccugccaaaauugaccacaagcagu

SEQ ID NO: 159225 - RNA, 41 nt, Homo sapiens
aguuccacugguucggagcgaagaguaguaaugcuuacaau

SEQ ID NO: 159226 - RNA, 46 nt, Homo sapiens
guuacugacaacguggcgacucccauuuccgggcuuaugacaaaua

SEQ ID NO: 159227 - RNA, 52 nt, Homo sapiens
cuuaaucugacagaugugauugaagaacuagcccaagcaaguacucagacuu

SEQ ID NO: 159228 - RNA, 45 nt, Homo sapiens
ucccaccccuuaacccuaugcuuccuaguauuauaagcaaagacu

SEQ ID NO: 159229 - RNA, 44 nt, Homo sapiens
acagcugugaugcuuccuaaaacaucuccugcuuuacccagaga

SEQ ID NO: 159230 - RNA, 39 nt, Homo sapiens
uacaagguuuucaagaaggaaaauucccuggcaacagaa

SEQ ID NO: 159231 - RNA, 46 nt, Homo sapiens
agaauucucuccuguugugaauucacaaauacuaccaccugaagaa

SEQ ID NO: 159232 - RNA, 42 nt, Homo sapiens
ccucccucugcuaggagaauugacccacaacauugggcggca

SEQ ID NO: 159233 - RNA, 46 nt, Homo sapiens
uggaaaacacaccucaagcacaaguaagaggcacaacuaucgggaa

SEQ ID NO: 159234 - RNA, 46 nt, Homo sapiens
uggacuugaugaguccaauccuauugcucaucuuaaggagccacca

SEQ ID NO: 159235 - RNA, 46 nt, Homo sapiens
uaucagucaucaagagacaagaaaguucuaaacaauggcacauuaa

SEQ ID NO: 159236 - RNA, 26 nt, Homo sapiens
caucacacaguuuucauuggugaaac

SEQ ID NO: 159237 - RNA, 46 nt, Homo sapiens
uggaaguaaagugagagccccuuaugucagugaggauggacggauc

SEQ ID NO: 159238 - RNA, 46 nt, Homo sapiens
uuccuugcagcugaacagaacugccaccacauucaguacauuacag

SEQ ID NO: 159239 - RNA, 46 nt, Homo sapiens
acaucgugcuaaauacuucauuuucaacauuuuuggugugcaacau

SEQ ID NO: 159240 - RNA, 46 nt, Homo sapiens
caagugauaacuuuaaggaguauuaaguacacuacugagggaggag

SEQ ID NO: 159241 - RNA, 50 nt, Homo sapiens
gugacagauuuguccaaaaaagacaauuugaggagaagcucuugggacuu

SEQ ID NO: 159242 - RNA, 28 nt, Homo sapiens
gcagaagcgggcgcuggggcggggaggg

SEQ ID NO: 159243 - RNA, 44 nt, Homo sapiens
cagucauguaauuggcccaaaucaccggagccacgugacccucc

SEQ ID NO: 159244 - RNA, 26 nt, Homo sapiens
cgcuuggccaaguacaaccagcuccu

SEQ ID NO: 159245 - RNA, 51 nt, Homo sapiens
gcgugcaagcuggcccaggccaaugguuggugugucauggugccucaucau

SEQ ID NO: 159246 - RNA, 45 nt, Homo sapiens
gaauccagguaguggaggaugaucucagagugaccaacccaaaga

SEQ ID NO: 159247 - RNA, 46 nt, Homo sapiens
uggaaaguaugaccuggaauucaaguuucucgacgaccccaccagg

SEQ ID NO: 159248 - RNA, 44 nt, Homo sapiens
cugcggccacgcgcgcuccgauggcugccaggagcugagcucag

SEQ ID NO: 159249 - RNA, 30 nt, Homo sapiens
cuuuucacuuuagagguagcuugccaucuu

SEQ ID NO: 159250 - RNA, 34 nt, Homo sapiens
acacuccuaagcaguauuauuuuaaaauccuuuu

SEQ ID NO: 159251 - RNA, 45 nt, Homo sapiens
guauuuagugucacaacuguugaccugaaauggaagccugcagac

SEQ ID NO: 159252 - RNA, 24 nt, Homo sapiens
gagacaaagauauuuugugccuuu

SEQ ID NO: 159253 - RNA, 47 nt, Homo sapiens
aauuaaauguuuuucuucaaguaguuuuuuuuuaauugcugagagaa

SEQ ID NO: 159254 - RNA, 46 nt, Homo sapiens
agacuacugaaaugucauuuuaguuauuuuucuuaugaccacauug

SEQ ID NO: 159255 - RNA, 48 nt, Homo sapiens
aauuguaguuuaguuuuaauucggagagcaaugauaaucagugcacag

SEQ ID NO: 159256 - RNA, 64 nt, Homo sapiens
uacuaaauaagaaaggguaaaaugaggaacauucaucaauaccacuaauaucugagcguagaau

SEQ ID NO: 159257 - RNA, 45 nt, Homo sapiens
aauacugccucugauuaucagcaaauacacugcagguccccagcc

SEQ ID NO: 159258 - RNA, 43 nt, Homo sapiens
uaauaacaacaacauugguugcccuucugaaaaaagaaaacga

SEQ ID NO: 159259 - RNA, 46 nt, Homo sapiens
uuauccacucagguggaccguuugcuugggaauaccgaugacagaa

SEQ ID NO: 159260 - RNA, 32 nt, Homo sapiens
gaaggaagaaguuguuuugcuuacacauggag

SEQ ID NO: 159261 - RNA, 52 nt, Homo sapiens
gaguucauuuaaaaaacuuuaucugaagaguaagcauaugcuucuguaugag

SEQ ID NO: 159262 - RNA, 45 nt, Homo sapiens
uggaaccuucaccgugcagaacagagaacuugaguguauucgaga

SEQ ID NO: 159263 - RNA, 55 nt, Homo sapiens
uuaaguaaaauucucuaugcugaauggugauucccucuuccuaccacuuccucug

SEQ ID NO: 159264 - RNA, 46 nt, Homo sapiens
gaaaagaauuagcaaaacguuaaauaugaccacaaguccugaagag

SEQ ID NO: 159265 - RNA, 63 nt, Homo sapiens
agguuuuccuugcccaagguacuuuacggccugaucuaauugaaagugcaucccuuguugcaa

SEQ ID NO: 159266 - RNA, 48 nt, Homo sapiens
aaaacccaucacaaugacacagagcucaucagaaaguugagagaggag

SEQ ID NO: 159267 - RNA, 41 nt, Homo sapiens
gaacaagacccucaagacuuuacuggaauuaacaagcaaua

SEQ ID NO: 159268 - RNA, 49 nt, Homo sapiens
agaauuuacuaccaacagucccuuacugaagaaacuaaaggcaaugauu

SEQ ID NO: 159269 - RNA, 39 nt, Homo sapiens
ccuaggugugaaauauacugugguuuuagaagucuuuaa

SEQ ID NO: 159270 - RNA, 49 nt, Homo sapiens
uucuccacagcaaaaaucuacggcuuaagagcugaguuggggauaacca

SEQ ID NO: 159271 - RNA, 49 nt, Homo sapiens
acacugcuccacugagaagguccauguaaaaaggauuagguggucauau

SEQ ID NO: 159272 - RNA, 54 nt, Homo sapiens
uauauccaggagauaggguuacacuguuuucuaaccuuuuuuaaaucccuuaau

SEQ ID NO: 159273 - RNA, 53 nt, Homo sapiens
uguugacucuuaaauuucugaacguuucacuuaauggcaagugaagagauaua

SEQ ID NO: 159274 - RNA, 46 nt, Homo sapiens
cuuccaacccuauuuuuauguacugaagaggccucagugucucacu

SEQ ID NO: 159275 - RNA, 69 nt, Homo sapiens
uuauugagggccauaccuagccugucuucaucaaacucauaggugaaucuuugucaaaccuauaggaga

SEQ ID NO: 159276 - RNA, 42 nt, Homo sapiens
cagauucuggaacugauugcaccuauauuauguuguguguca

SEQ ID NO: 159277 - RNA, 55 nt, Homo sapiens
ucugcucaagaaagaaagugaaacaaagaaagaggauaaaugaaacuggguggag

SEQ ID NO: 159278 - RNA, 46 nt, Homo sapiens
caagguuuaucaugguaagacauugcuucuacuacaugacccacua

SEQ ID NO: 159279 - RNA, 23 nt, Homo sapiens
gcugaagggauauucagggucac

SEQ ID NO: 159280 - RNA, 82 nt, Homo sapiens
ucccagauaucuggcuguuuacagagauaagggagacugaaggaagaacagguuugggagaaaaaucgaggguucuucuuug

SEQ ID NO: 159281 - RNA, 31 nt, Homo sapiens
caggcacugucuagauugauacggaacagga

SEQ ID NO: 159282 - RNA, 50 nt, Homo sapiens
uacuucuuccuccuuuaaaaaccuggguuuaaagagaaauaaagaugucu

SEQ ID NO: 159283 - RNA, 36 nt, Homo sapiens
uuuauccuucaauugcaguucaguacuacaacagau

SEQ ID NO: 159284 - RNA, 41 nt, Homo sapiens
aacagcuuuaacugcuuuacaaaugagaaaauguuagcaga

SEQ ID NO: 159285 - RNA, 54 nt, Homo sapiens
uaucucaauuuuuaauauuuauuacauguuggaaugauaauauuuuggcuauau

SEQ ID NO: 159286 - RNA, 58 nt, Homo sapiens
auucuuaccuuggcaaaccuuauuuucuagccuaccucugcagcuucauggcucccua

SEQ ID NO: 159287 - RNA, 33 nt, Homo sapiens
gaucccuaccucaaguaccaggcagccacugau

SEQ ID NO: 159288 - RNA, 47 nt, Homo sapiens
uaggaguaacccuaucagacaccuggagguaguuugaaggaugagcu

SEQ ID NO: 159289 - RNA, 74 nt, Homo sapiens
gauggaauagcauggaaaagugaacuggagugauaguauacagugauugguguagguguggggaugcuaagaac

SEQ ID NO: 159290 - RNA, 25 nt, Homo sapiens
uugguugugaguuuucagaugugca

SEQ ID NO: 159291 - RNA, 61 nt, Homo sapiens
aacauuagaauccuaauagacauucuggauaaguuguacaaggccauucuuggggccaagc

SEQ ID NO: 159292 - RNA, 47 nt, Homo sapiens
ucacaauuuuucucaagugggauauuaaugaggguaaguagccaaua

SEQ ID NO: 159293 - RNA, 57 nt, Homo sapiens
auauuauugaaacuuggaaaggauaauuugaaacaagguuugaaguuaacugaaaua

SEQ ID NO: 159294 - RNA, 84 nt, Homo sapiens
uuucuguacuaauagauacauuucugugcauaagauuauaaagcauauacucacaguucaguaguuuucguuaaggauuuacug

SEQ ID NO: 159295 - RNA, 60 nt, Homo sapiens
gggaaaaaauugccaccauucuugguauaauacaguguagcuuagaugagguggugaaau

SEQ ID NO: 159296 - RNA, 66 nt, Homo sapiens
uugggccacuaucuuuuaaaauugcuggugaaaacuugccacuagauggcagugccuguauagaug

SEQ ID NO: 159297 - RNA, 45 nt, Homo sapiens
cauaucacuguaagguacaguuaggguaacacuuuagagguuuau

SEQ ID NO: 159298 - RNA, 117 nt, Homo sapiens
aauuucauacauguuauuaguuguuuucuuuauaauuuuauaaaaauuauucaucgggaguuuaacuuccacuuccaugcuaucggauguguugggcuccaugcaagaacuuggaag

SEQ ID NO: 159299 - RNA, 49 nt, Homo sapiens
agcuaaaaggauaugaaaucacaggugauagcaguugucauucaguaau

SEQ ID NO: 159300 - RNA, 48 nt, Homo sapiens
aggaaucacuguuuuccuugaccagggucucacacccuggaggaaugu

SEQ ID NO: 159301 - RNA, 45 nt, Homo sapiens
cacacuguuccacuguauggcuuuggcccugaguggccagggagg

SEQ ID NO: 159302 - RNA, 46 nt, Homo sapiens
cuuaaagaagggcagccaagguaguaaccuaaaaauagugcccagg

SEQ ID NO: 159303 - RNA, 73 nt, Homo sapiens
uuuuuugacagauuguugaaauuaaaugaauugaaagggaaacucagaguacuaggacguuuauuaaaaggaa

SEQ ID NO: 159304 - RNA, 47 nt, Homo sapiens
gaacacauuuccugugaauguuuuccauuuuuuuuuggucuucuguc

SEQ ID NO: 159305 - RNA, 45 nt, Homo sapiens
cauuguugcuuccuucuucauauugaagaacuucaaccccacagu

SEQ ID NO: 159306 - RNA, 81 nt, Homo sapiens
aacuuccuuuugcaugugugaagggguaaaagaaaagauggaugaaauaccaguaaauuaauaagauaaacuaucagaaca

SEQ ID NO: 159307 - RNA, 61 nt, Homo sapiens
gcaaaacuuguuuucuuuggauuaguauacuuaaugaauauaaugugucaguuaccaauga

SEQ ID NO: 159308 - RNA, 55 nt, Homo sapiens
uccaaacuuacaguaaauggaagaguuauuaagucgauggugucuguagaauuga

SEQ ID NO: 159309 - RNA, 57 nt, Homo sapiens
uaguguuaaaccauguugagacuaugcaucuuacuaggcugguaucauugaucagug

SEQ ID NO: 159310 - RNA, 52 nt, Homo sapiens
aaccuuugccauuugcuggauuagguauuucaaaguggggugagguggaggu

SEQ ID NO: 159311 - RNA, 64 nt, Homo sapiens
ugcuguuuccaaagaagugacucgaaaacuuucugaagcugauaauagaaagaugucucggaag

SEQ ID NO: 159312 - RNA, 59 nt, Homo sapiens
auucuacaccaaauauaucauucugcagcauguacuggaagucaccuguagaugcagga

SEQ ID NO: 159313 - RNA, 58 nt, Homo sapiens
aauggcccuaucuaaaugcaacccaaucaaucuuacuuguuaauuuucuaacccacuc

SEQ ID NO: 159314 - RNA, 46 nt, Homo sapiens
caaauguacucccuuucuuguuuaaucuuaagccacaggccuggcu

SEQ ID NO: 159315 - RNA, 46 nt, Homo sapiens
acaacaccugccccguugccaucgccaccugcagacaagagaggag

SEQ ID NO: 159316 - RNA, 29 nt, Homo sapiens
gccaaaggaaguacaacuggaauaaacaa

SEQ ID NO: 159317 - RNA, 57 nt, Homo sapiens
ccuuugaccaaaaugaagggggaaacaaacagcaagagaaacugacaaucaaaguca

SEQ ID NO: 159318 - RNA, 47 nt, Homo sapiens
agaaaacgggaacacgcucuagguaaggggcagcacuuuccuuaagu

SEQ ID NO: 159319 - RNA, 43 nt, Homo sapiens
uuggacuuguuaaggaggcucaugauggucacuacgcucucgg

SEQ ID NO: 159320 - RNA, 44 nt, Homo sapiens
aaagaaaauaguguauuaucuuaccagaccauccuugaacagca

SEQ ID NO: 159321 - RNA, 48 nt, Homo sapiens
uauucccuacauauuccuuuguuaaggauaugguuuguaaugccaugu

SEQ ID NO: 159322 - RNA, 32 nt, Homo sapiens
gggccugacuaauaaaucacaaguguaacccu

SEQ ID NO: 159323 - RNA, 46 nt, Homo sapiens
uacuggcaauuuagugaaguaucuuuuaaaccuaaaccacucagag

SEQ ID NO: 159324 - RNA, 26 nt, Homo sapiens
ucuaaggacaaugccaacauuuuguc

SEQ ID NO: 159325 - RNA, 46 nt, Homo sapiens
cuugguggggauaugagguucuuacauuuuucuuauuaggccaaga

SEQ ID NO: 159326 - RNA, 44 nt, Homo sapiens
uuugugaugugguaccucagccuuccccacuacaaugugauaga

SEQ ID NO: 159327 - RNA, 78 nt, Homo sapiens
uuggcuuccaguauuuuucaaguucuccaggagauuauaaugugccgcaaagugagaaccacuggguuaaagaagagg

SEQ ID NO: 159328 - RNA, 39 nt, Homo sapiens
cccauuuuacagauaagguaacugaagcuuaaaaagguu

SEQ ID NO: 159329 - RNA, 53 nt, Homo sapiens
auguaagacacauuugggaguuaggagcaagguuuguaaaggaaauguagaca

SEQ ID NO: 159330 - RNA, 104 nt, Homo sapiens
ggcuuuguggaccucuaccaguaguucuuuggggcucguauuugcaggauagcagaacaucaggcacugggagauucuaggaaaacagaaaccuuggacucuag

SEQ ID NO: 159331 - RNA, 51 nt, Homo sapiens
ccagaaaaaaugauguucaguuguagaaagaccauggggcagaaagaagga

SEQ ID NO: 159332 - RNA, 71 nt, Homo sapiens
ggcacuuguagcagcuggaggagagcugcaaaauacaagaaauuuuuccagcuguagugcgugugauauuc

SEQ ID NO: 159333 - RNA, 69 nt, Homo sapiens
ugcuauugaaagaauaggguuuuuuuuuuuuuuuuuuuuuuuuuuuuuaaaugugcaguguugaaucau

SEQ ID NO: 159334 - RNA, 47 nt, Homo sapiens
uuguaggcaaaacaaucccuguauaugggaaucucugauagacuucu

SEQ ID NO: 159335 - RNA, 46 nt, Homo sapiens
gcagacacaccuuuacacucggggugaguagucggagagcaccacg

SEQ ID NO: 159336 - RNA, 50 nt, Homo sapiens
cuucuguucaguaguucacaacagaucugaguguuuuaauuaagcaugga

SEQ ID NO: 159337 - RNA, 375 nt, Homo sapiens
aauaaacacuguugucaaaacagcauccaggccgggcgcgguggcucacgccaguaauuccagcacuuugggaggccgaggcgggcagaucaccucaggucgggaguucgagaucggcuuggccaacguggugaaaccccgucucuacuaaauauacaaaauuagcugggugugguggcacacaccugaaaucccaguuccucggggggcugaggcaggagaauugcucgaacccgggaggcagagguugcagugagccgagauugugccauugcacuccagccugggcaacagagugagacuccaucuccaaaacaaacaaaaaacaaaaaaacaguguccaaguauaauuucagauuagagcaugaggugauu

SEQ ID NO: 159338 - RNA, 62 nt, Homo sapiens
uccuaaauccaacauuaagaaggcgaacggauacugaauucaaagacuacccguacuugagg

SEQ ID NO: 159339 - RNA, 39 nt, Homo sapiens
cggagggauugggaaggaaugugaaacuaaguggggaau

SEQ ID NO: 159340 - RNA, 41 nt, Homo sapiens
ccuagcgcuccgggaaagcguucgccgcaggccuguuaggg

SEQ ID NO: 159341 - RNA, 46 nt, Homo sapiens
caagguauuccgaaacaagucucgauuucguucugcaaacaauguc

SEQ ID NO: 159342 - RNA, 91 nt, Homo sapiens
aucuguguauucagauggaaauuucuguguuuccugacagauguuggauuucaguauguuaucuucucuuuuagguauuuucaaccaccag

SEQ ID NO: 159343 - RNA, 50 nt, Homo sapiens
guguuagauggggacagaauagggaauaugcauaaccauauggaaauugg

SEQ ID NO: 159344 - RNA, 45 nt, Homo sapiens
uuaacuacuaggcuuuguuuuagggaggccagcuauaugaggagg

SEQ ID NO: 159345 - RNA, 70 nt, Homo sapiens
uccagaccaauuguaucuuacuguucacugaaaaguccucuuggguaucucacagauacugucuuaaacu

SEQ ID NO: 159346 - RNA, 48 nt, Homo sapiens
uguucucccacccaccccuucuccccaaacacccauucuggccauucu

SEQ ID NO: 159347 - RNA, 49 nt, Homo sapiens
ucacaaggucuuugcuuuccuccaaaaaauauaauuuccuuuuaaagga

SEQ ID NO: 159348 - RNA, 42 nt, Homo sapiens
gccaauauuucucuguauccuccucaacacuuguucuuauau

SEQ ID NO: 159349 - RNA, 46 nt, Homo sapiens
uuaagauggucuggauuuuuauuauuccucaaaacaacaugcucag

SEQ ID NO: 159350 - RNA, 26 nt, Homo sapiens
auggagauugaaagaagucacaggug

SEQ ID NO: 159351 - RNA, 50 nt, Homo sapiens
cccaaacagcuagaggaguuuauugugauggaaugcagcauaguccaaga

SEQ ID NO: 159352 - RNA, 51 nt, Homo sapiens
cagauuuccucauuugucccaaaagugucuuuuaugccuuguucaaacagg

SEQ ID NO: 159353 - RNA, 51 nt, Homo sapiens
ccagaauauuucagagaugaugccauguacuuuuuauuauaucaagagaca

SEQ ID NO: 159354 - RNA, 43 nt, Homo sapiens
ccugguguuaggguuuguauuauuucauauuuuaaacugccaa

SEQ ID NO: 159355 - RNA, 48 nt, Homo sapiens
ugucaacaaaaugaacucagauagaguuccagaugugguaaggcuuua

SEQ ID NO: 159356 - RNA, 45 nt, Homo sapiens
aagugacaccgaugaugaaggagcaccucgaauuagucuggcuga

SEQ ID NO: 159357 - RNA, 43 nt, Homo sapiens
auguuguagacuguuuccauacaugggcuuaagaaguuggaca

SEQ ID NO: 159358 - RNA, 47 nt, Homo sapiens
cagugcucacucaaaccacuaaaacagauggauagcuuugagguuuu

SEQ ID NO: 159359 - RNA, 50 nt, Homo sapiens
uuguuacauacuuugauccacuuuacaucauuuuuauguuguugagguag

SEQ ID NO: 159360 - RNA, 46 nt, Homo sapiens
aaucucuucuuccucaggagucagcuuggcucccuucuugcagccc

SEQ ID NO: 159361 - RNA, 47 nt, Homo sapiens
caagacaacuugguguaaugucuaaaaaacuucuaaugggagcuuau

SEQ ID NO: 159362 - RNA, 28 nt, Homo sapiens
auauuuuuauauguugucagcucccaga

SEQ ID NO: 159363 - RNA, 24 nt, Homo sapiens
guacuccaaaaguuucagugauac

SEQ ID NO: 159364 - RNA, 47 nt, Homo sapiens
aaaccagugaaggaaauauucuugcuacaaaaauaaaauaggaaaug

SEQ ID NO: 159365 - RNA, 38 nt, Homo sapiens
auuaugugaccgugauagaugugguuugauccauggau

SEQ ID NO: 159366 - RNA, 58 nt, Homo sapiens
uuagauuuuacaagauuuguuagaagucauguuaaauauuaagcuaaaugguucauug

SEQ ID NO: 159367 - RNA, 46 nt, Homo sapiens
cucugucacauaaaagauucugaagguaagugguccagggcuagua

SEQ ID NO: 159368 - RNA, 75 nt, Homo sapiens
gaaagccacagauuuaguugccaaugcagucaacauuuuaaauuuucaaacacuaucucucaaguaauguuaggu

SEQ ID NO: 159369 - RNA, 76 nt, Homo sapiens
auauauccuaagaccugaaagagaucuaaaagagauaaauagaguuaauugaagaguuggagauaaguccauucua

SEQ ID NO: 159370 - RNA, 46 nt, Homo sapiens
uuuucaacuguaguuggcuuuugaaugaggaugacaauggaagaga

SEQ ID NO: 159371 - RNA, 65 nt, Homo sapiens
uugcuuuuuaaccuugcuaucuuccuaugaauuauaccuuuaauaucacuugauuuagacaaggu

SEQ ID NO: 159372 - RNA, 41 nt, Homo sapiens
uuguagucugaguagguaagauaauauuuacaaagagaaug

SEQ ID NO: 159373 - RNA, 40 nt, Homo sapiens
uaaucagaaaucuuaccuuuauguauaaaaacccauuaug

SEQ ID NO: 159374 - RNA, 31 nt, Homo sapiens
uguuucagugucugguucccuauaaguaaua

SEQ ID NO: 159375 - RNA, 47 nt, Homo sapiens
gaaaaaugucauugcuuuaaaaucauagcuguucuguuuaagaggaa

SEQ ID NO: 159376 - RNA, 36 nt, Homo sapiens
guacaaagugacauacaauuggaaauccauuuuugu

SEQ ID NO: 159377 - RNA, 46 nt, Homo sapiens
uauguuucagcguguuaccuuucuggcuuccaguucccagguguuc

SEQ ID NO: 159378 - RNA, 46 nt, Homo sapiens
cguaggucuagagcuucuuuuauauucaagcuaaacaugaaaaaga

SEQ ID NO: 159379 - RNA, 57 nt, Homo sapiens
caagaaguucgagaugacaaccgccccaaaggccgagaggaacacuacgaggaggaa

SEQ ID NO: 159380 - RNA, 57 nt, Homo sapiens
guucaggaagauuugacugaagagaaaaaaagggaacuggagcauaaugcugaagag

SEQ ID NO: 159381 - RNA, 39 nt, Homo sapiens
caaacuuacagacuuggccucuaagaggacccaaaagaa

SEQ ID NO: 159382 - RNA, 48 nt, Homo sapiens
agaccagcaggaggacaauguugaugaacaguaccaggaagaggcaga

SEQ ID NO: 159383 - RNA, 63 nt, Homo sapiens
aaauuugccagaugaaaaugaagagcaaaaacaaaguaaucaaaagcaagagaauacagaagu

SEQ ID NO: 159384 - RNA, 62 nt, Homo sapiens
gcagaugacccuaauaaucaaggugaggaugaauuugaagaagccgagcaagugagagaaga

SEQ ID NO: 159385 - RNA, 37 nt, Homo sapiens
acugagagacacugaaauauguaguaacucugaaagc

SEQ ID NO: 159386 - RNA, 89 nt, Homo sapiens
gagacaaccagcaccaagaugaagcagaaggagauccagguaauagacaugagccucgugaacaaggaccccgagaagccgacccagaa

SEQ ID NO: 159387 - RNA, 48 nt, Homo sapiens
aagcucauuaugaugcuauggauaaugauaucguucagggagcagagg

SEQ ID NO: 159388 - RNA, 48 nt, Homo sapiens
ugcaccagcagaggcugcaggggcacuuacuacggcagcaggaacagc

SEQ ID NO: 159389 - RNA, 46 nt, Homo sapiens
cccuaugaggaacaguuggaacagcagagacuggcagugcagcagg

SEQ ID NO: 159390 - RNA, 56 nt, Homo sapiens
agaggagcacagaaaggcccuggaggaggaagaaauggagcaggucgggcaagcag

SEQ ID NO: 159391 - RNA, 41 nt, Homo sapiens
acccagguggcacauucuccacaagguuacaacacagcaag

SEQ ID NO: 159392 - RNA, 43 nt, Homo sapiens
guccugccuuaaaaaaaagugucagaacuaggugcaauccuua

SEQ ID NO: 159393 - RNA, 53 nt, Homo sapiens
gagagaagagaauagacaacuaaggaaagcacaccaagacauacauacacagc

SEQ ID NO: 159394 - RNA, 98 nt, Homo sapiens
agccaacacgaggagcuaaagaaacagcacagugacuuggaagaggaacaucgcaaacaaggggaagacuucaguagaacauuuaaugaccauaagca

SEQ ID NO: 159395 - RNA, 49 nt, Homo sapiens
uggagggaagcugcacaaauuaaagcaacuugagaaaaacaaagccuau

SEQ ID NO: 159396 - RNA, 45 nt, Homo sapiens
gauuccaauagcagauacagugcacugaauguccaacaucagaug

SEQ ID NO: 159397 - RNA, 45 nt, Homo sapiens
uucuuguuuauaaguuagaagcacaagaaacauuaaauaaaggaa

SEQ ID NO: 159398 - RNA, 70 nt, Homo sapiens
uuuaaguaagcaggagaugagaugaguauuauggauuuucaucuuuuucuccugaguucuuggauucaaa

SEQ ID NO: 159399 - RNA, 43 nt, Homo sapiens
gaugauuugcuggcuucuguccguacuuuggcaacuacguuca

SEQ ID NO: 159400 - RNA, 33 nt, Homo sapiens
auauggggauucaugauaaaauuuagaaucaga

SEQ ID NO: 159401 - RNA, 49 nt, Homo sapiens
gagaaaauuaaauuauuuuuaauccauaacauuuauugaguaccuacca

SEQ ID NO: 159402 - RNA, 70 nt, Homo sapiens
aaggcauuuaguguagaggcaaagagccugacauuccuaaaacacaguauugcaaugcuuuuggacuucc

SEQ ID NO: 159403 - RNA, 59 nt, Homo sapiens
caagggaaaauuaagccaugacccagcagcuuaauuaaagucauggcccagucgaaugg

SEQ ID NO: 159404 - RNA, 64 nt, Homo sapiens
gggaguggccagggcgggacuccaagaacugcccgggggcagcggggccaaaaagugggaagaa

SEQ ID NO: 159405 - RNA, 43 nt, Homo sapiens
uuuugguuagcauaaugccagguuaggguuacuggcacagaga

SEQ ID NO: 159406 - RNA, 44 nt, Homo sapiens
uccuggugcugcaugcgauuuguuauauuuaauaaaauguagag

SEQ ID NO: 159407 - RNA, 41 nt, Homo sapiens
guuuucuuugucuuaaauucagccucuuccuaaaagcaaaa

SEQ ID NO: 159408 - RNA, 61 nt, Homo sapiens
acauaauauuccaguaggaaacugcuuccaaguuuaagcaugagcuccccaaacuggagaa

SEQ ID NO: 159409 - RNA, 49 nt, Homo sapiens
ugcccccagguguguccagcggggcccuggccucguggcuggugcgaau

SEQ ID NO: 159410 - RNA, 48 nt, Homo sapiens
gcugcugacuugggcacagccucccacggugcaggaggaacgggaggg

SEQ ID NO: 159411 - RNA, 46 nt, Homo sapiens
agcuuugcaucuccagagucugacuuugaaagccgcaugaaaaaaa

SEQ ID NO: 159412 - RNA, 53 nt, Homo sapiens
gcugugaaguuuugggggcaggaaugaagauggaccagcaagcugucugugag

SEQ ID NO: 159413 - RNA, 49 nt, Homo sapiens
ugacaguagagaccugggucuuaaaccugacaaagaagcuaacaggagg

SEQ ID NO: 159414 - RNA, 61 nt, Homo sapiens
guggcaaucauggugaaggugaccaaguuuuaaaugggagcaagaucauaacagccuugga

SEQ ID NO: 159415 - RNA, 42 nt, Homo sapiens
agugagacugacucgcaccguagugguagggaagcagaagga

SEQ ID NO: 159416 - RNA, 46 nt, Homo sapiens
ugcucuuguaaagacggauauaucugugacaugcuaaccccagaga

SEQ ID NO: 159417 - RNA, 46 nt, Homo sapiens
auuguagacccacgaccuuccucucuuuuuuccccuacuggcagcu

SEQ ID NO: 159418 - RNA, 45 nt, Homo sapiens
ucccaacugucaugccuguggaucacccucccaucaaagccuucu

SEQ ID NO: 159419 - RNA, 49 nt, Homo sapiens
gccauagacaauaaauaaguaaauaaaugagcacggcugugacccagua

SEQ ID NO: 159420 - RNA, 25 nt, Homo sapiens
acaggaugaauggggaaaacuaaug

SEQ ID NO: 159421 - RNA, 49 nt, Homo sapiens
uuccacauuugcaguacagccuguguaccuucucuggugacauggagau

SEQ ID NO: 159422 - RNA, 48 nt, Homo sapiens
cuucuuccagcaguuaccagcgccgcuggcuucgaagucagacaacaa

SEQ ID NO: 159423 - RNA, 36 nt, Homo sapiens
uguauuaaaauacauauaauaugaaauuuaccaucu

SEQ ID NO: 159424 - RNA, 70 nt, Homo sapiens
ccuccuguccaggcuguguacuuuggagagaagucaggaugcuuaccccauaccuaagggguggggaauu

SEQ ID NO: 159425 - RNA, 44 nt, Homo sapiens
cuuuuguaugugaccucuuuugaguuuugacuugugguucagau

SEQ ID NO: 159426 - RNA, 47 nt, Homo sapiens
aacuuuaauguacaguauccaugagugauugugcaacauaaacuagu

SEQ ID NO: 159427 - RNA, 76 nt, Homo sapiens
ugcaagacagcuuugaguacaucaaccaagauccuaauuugggaaaacugaacacaaaucaaaauaguuugggucc

SEQ ID NO: 159428 - RNA, 35 nt, Homo sapiens
ugguugguaaaggcaugagaaagacuggucagaag

SEQ ID NO: 159429 - RNA, 42 nt, Homo sapiens
auguauuuggaguuuuaaaaaaagauuuggaagaguauguua

SEQ ID NO: 159430 - RNA, 48 nt, Homo sapiens
agauaacauaacuucuuuugcccuuuuuaauccacaguuggucauguu

SEQ ID NO: 159431 - RNA, 65 nt, Homo sapiens
cuccagugcagcagucuuacaccuuaccaccuccuucucuguuccuauggugcgcaucauuuguu

SEQ ID NO: 159432 - RNA, 49 nt, Homo sapiens
ugucucggucauauuuggauaagcauugaugacauaacaggguaaagca

SEQ ID NO: 159433 - RNA, 41 nt, Homo sapiens
acuuaauagaaaauguagcaguuggacagguugaaugaagu

SEQ ID NO: 159434 - RNA, 53 nt, Homo sapiens
aguuauuuaggaugaaagauggggauugaauguccauguaaggacauaauaug

SEQ ID NO: 159435 - RNA, 41 nt, Homo sapiens
augagaaggauguuaugaacagcaaauuuuaauaauggagc

SEQ ID NO: 159436 - RNA, 46 nt, Homo sapiens
cuaaucugguuuuaucuugauacuaucaauuuagcaugugccacag

SEQ ID NO: 159437 - RNA, 49 nt, Homo sapiens
auuuuaucagauuuugaacuguggaauuaaggcuuauuaguuggguaac

SEQ ID NO: 159438 - RNA, 68 nt, Homo sapiens
accgugcuucgaagucucugguagaaagauuugugaucauuuguucuugugcaaggagaaggcauuau

SEQ ID NO: 159439 - RNA, 54 nt, Homo sapiens
agccugaucaugaggaacugacucagagaaaugagagucugcugauucagagcu

SEQ ID NO: 159440 - RNA, 117 nt, Homo sapiens
aaaauaaauaccaggcuaucaugauuagaauuaaacaguuuucugaaaaccuaaccuaauuuaauggaauggagagagaggggugaggguaacaagggagguggaggaggggcguag

SEQ ID NO: 159441 - RNA, 58 nt, Homo sapiens
ugugauauucaugaagcuguaguugucagaagauauuaagccaauauuugccaaagag

SEQ ID NO: 159442 - RNA, 45 nt, Homo sapiens
uucuuggggaccuaaccgguauggauggaggaauguacaugaguc

SEQ ID NO: 159443 - RNA, 47 nt, Homo sapiens
uauuaguaaaauaugcaaauguaugaccaagaacuagaaagaaaaac

SEQ ID NO: 159444 - RNA, 607 nt, Homo sapiens
ucuccuuggguaauuugcauaugcagccaagcacacuacaauagucuucccuuaucugagguuucacuuucugcugucaaccucagucugacaauauuaaaucaaaaauucaagaaauggagcaacucugggugcacugccugugaguuagcucugcucugcaaggagcaguaccauuuaaaaaagaagaaagaagauuccagaaauaaacaauuccuaaguuuugaauugcacaccauucugaguagcacaauggaaucuccacugucacuucaucuuaucauauaggcauuugucaucucacaucaucucaaggagaaggagggugacuauaguaugaugagauauuuccugagaaagagaucacguucgcauaacuaugauuauaguauauuauaauuguucuauuuuuauuauuaguuauuguuguuaaucucuuacugugccuaauuuauaaauuaaacuuuaucauagguauguaugggaaaaaacauaguauauacaggguuuggcauuaagcacuguuucaggcauccacuggaagucuugaaagguaucgccuguggauaagagggcacuacuguaauuuuaccaguccucuacugau

SEQ ID NO: 159445 - RNA, 82 nt, Homo sapiens
auuuuuccauuugagaaacuaauuuagaaauggauuugcgaaucugacauguucuuuaaaaagaaugugccagacuaacaua

SEQ ID NO: 159446 - RNA, 49 nt, Homo sapiens
aagcuaugaaauuguuagcuguggguugaugauguagaacucuucucua

SEQ ID NO: 159447 - RNA, 54 nt, Homo sapiens
aagugcucuaacaguugauugaccugcacccccaccucccuaaaaaaaccuuua

SEQ ID NO: 159448 - RNA, 29 nt, Homo sapiens
cacggucucaccuacuggaguuuacaauc

SEQ ID NO: 159449 - RNA, 46 nt, Homo sapiens
gguuuacuaauugguuguaguccugguuuuaugaauguucccaaga

SEQ ID NO: 159450 - RNA, 90 nt, Homo sapiens
uggucuagacuaucagaauccauaccugaguccauuuagagaguuccaaagguggaaacaccauccuagcauucggccaaccuuggaagg

SEQ ID NO: 159451 - RNA, 49 nt, Homo sapiens
gaacuggaaaccugggagaguagaucacacuguugguuggcccuuggac

SEQ ID NO: 159452 - RNA, 60 nt, Homo sapiens
acaucuagccaagcaacuauauaagaaguuugauuugagagcaaauugugaaccucaaac

SEQ ID NO: 159453 - RNA, 66 nt, Homo sapiens
ggcaacauuugagagaggacuggaacuacaugcuaaagucacaauuuuugcagaagguugccaugg

SEQ ID NO: 159454 - RNA, 46 nt, Homo sapiens
aaaguugaagaaauaaauauuuuuuaaaagccaugggauuuuagaa

SEQ ID NO: 159455 - RNA, 89 nt, Homo sapiens
auuacauuguacgcuugggacauuuagugagcuggaugggcgaacaagcagaagcccuugguguugaaguauacccugguuaugcagcu

SEQ ID NO: 159456 - RNA, 41 nt, Homo sapiens
uauuuauguuuuuguaaugucuuaucaauaaaaagucagau

SEQ ID NO: 159457 - RNA, 48 nt, Homo sapiens
auuuuaacagagaaauacagaauuccugugccaauucuuccagguaag

SEQ ID NO: 159458 - RNA, 42 nt, Homo sapiens
aaaggacauccgugugugucuaguggagaaagcugcccagau

SEQ ID NO: 159459 - RNA, 62 nt, Homo sapiens
aaacuccguucaacauguggaugcggcagagaaaugaccuguccagacaagccggggcagcu

SEQ ID NO: 159460 - RNA, 46 nt, Homo sapiens
agauuggagagcgacccuggagguuggugcgggguccgggagugcg

SEQ ID NO: 159461 - RNA, 25 nt, Homo sapiens
ugcgacucuuggcggacagcgcagu

SEQ ID NO: 159462 - RNA, 50 nt, Homo sapiens
gugugaaauuaguggacuuacugguauuguacuuuauaacagacuauuuu

SEQ ID NO: 159463 - RNA, 50 nt, Homo sapiens
cucagccagugcucaaagugaagggcauuuaauaaaucuagacaaagaag

SEQ ID NO: 159464 - RNA, 47 nt, Homo sapiens
agaaaaucagacaguuguuauuacaaauaaagagcagcuccacucag

SEQ ID NO: 159465 - RNA, 46 nt, Homo sapiens
ucuucagcaaguaaugacacccauucuucuguuaagcucaccuggg

SEQ ID NO: 159466 - RNA, 51 nt, Homo sapiens
aagccugaaucggguuguacugaaauacaucaucaugagugguccaagaug

SEQ ID NO: 159467 - RNA, 43 nt, Homo sapiens
uuuacuagaauuuacucaaauuauaacaccaagauuggagcuc

SEQ ID NO: 159468 - RNA, 46 nt, Homo sapiens
cuaauuucuuguagguguuguggcauuuuacaaauucaauaguaag

SEQ ID NO: 159469 - RNA, 42 nt, Homo sapiens
gacagaaaaugugacauguaaucuagaaauggaaaaaccugc

SEQ ID NO: 159470 - RNA, 42 nt, Homo sapiens
uguuugauggucaagggucuugccgccagcuuucagaggcga

SEQ ID NO: 159471 - RNA, 42 nt, Homo sapiens
agagaugauguaguuggauguugccuuggcuucaaguagcaa

SEQ ID NO: 159472 - RNA, 50 nt, Homo sapiens
agauuuauaaucgcuuagauacaaauugcuguggauucagaccucgcaag

SEQ ID NO: 159473 - RNA, 51 nt, Homo sapiens
gaugaccaagguucugcggcucuagcacacauuauccagcgaaagcaugac

SEQ ID NO: 159474 - RNA, 49 nt, Homo sapiens
ccuaaaguugaggcccuaaacuauauaguaaugucuucagggaacucag

SEQ ID NO: 159475 - RNA, 29 nt, Homo sapiens
guuuccagcuucugcaguuucuguuuuga

SEQ ID NO: 159476 - RNA, 111 nt, Homo sapiens
ugauaaaguguauugggaaagucaaggagguagacaaggaauugaaaagcuuaucgauguaauagaacacagagccaaaauucuuaucaccuauaucaaugcacacggggu

SEQ ID NO: 159477 - RNA, 47 nt, Homo sapiens
aaaugacuuuaaccaaguagcuauaaugggacuuagcacuguaugca

SEQ ID NO: 159478 - RNA, 51 nt, Homo sapiens
uaauaaaccauauuuugugccguuuugacuguucugaccaaauacuaaugg

SEQ ID NO: 159479 - RNA, 46 nt, Homo sapiens
gcuuacagccugcaagagcaucagagcugaccauacauuuaaacag

SEQ ID NO: 159480 - RNA, 45 nt, Homo sapiens
cuccuucuaacacuuuuuaaaucagauuggaagacauggacaaau

SEQ ID NO: 159481 - RNA, 33 nt, Homo sapiens
cccuuacacauccuacuccuuauuuaaaaguuc

SEQ ID NO: 159482 - RNA, 48 nt, Homo sapiens
ggaagcugagacagcuacgggcaagcgggcagcugaagaugaugagga

SEQ ID NO: 159483 - RNA, 42 nt, Homo sapiens
guagaugaagaagaggaagaagguggggaggaagaggaggag

SEQ ID NO: 159484 - RNA, 42 nt, Homo sapiens
uuccacaacuuccuucuucuccuguaaguccuugguggugau

SEQ ID NO: 159485 - RNA, 30 nt, Homo sapiens
ccaaacauagccuaauccucuacccacaga

SEQ ID NO: 159486 - RNA, 57 nt, Homo sapiens
cuugaaauaccaaguuaauauuaaaacugagcagcccgagguaccugauugaguaau

SEQ ID NO: 159487 - RNA, 45 nt, Homo sapiens
ucuggacagagcuuagaauaugccuuggaucuuguuuuauuaguu

SEQ ID NO: 159488 - RNA, 51 nt, Homo sapiens
aggccgaguggucucuucuucggguuuucggggaagggguagaagccggau

SEQ ID NO: 159489 - RNA, 48 nt, Homo sapiens
aagguaaauucacuacuguugauuuuuuuuguguuuuuuuaggacaag

SEQ ID NO: 159490 - RNA, 71 nt, Homo sapiens
uugauccaguuaucuucuugagauaaugaauaccuauucucuuuccuaauaugucuauuguguuuuuauag

SEQ ID NO: 159491 - RNA, 49 nt, Homo sapiens
auacaaaugcaguugcuacagugagaugucaggcugcagaaccacaaau

SEQ ID NO: 159492 - RNA, 38 nt, Homo sapiens
aaugauuuuggacacugagacauucauugaauaguuua

SEQ ID NO: 159493 - RNA, 58 nt, Homo sapiens
guuauaguugcugggaaauguugcaccaagaauaacagcaaauaaauagauugcuaug

SEQ ID NO: 159494 - RNA, 45 nt, Homo sapiens
uuuuagacagaagaaacucauccagucagcuggaaaccagaaauu

SEQ ID NO: 159495 - RNA, 70 nt, Homo sapiens
ggcaauauaauuguucuuuuuuuuuuuuuuuuacuucucccaagaaaucaaacucuuagaagagcuuuua

SEQ ID NO: 159496 - RNA, 22 nt, Homo sapiens
gcuaguauacaaucccuaaguu

SEQ ID NO: 159497 - RNA, 47 nt, Homo sapiens
gugaaggagauaaccuacaucaaccgagauaccaaaaucauccugga

SEQ ID NO: 159498 - RNA, 57 nt, Homo sapiens
uuugcauccccagcauuuccugaguuauaaggccacaggaguggauagcuguuuuca

SEQ ID NO: 159499 - RNA, 46 nt, Homo sapiens
uucaaacuaauaaaaucaugaauauuuuuaugaaguuuaaaaauag

SEQ ID NO: 159500 - RNA, 48 nt, Homo sapiens
ugcagggaucggaagccgguuggagugugugagguuuucucgcucuag

SEQ ID NO: 159501 - RNA, 45 nt, Homo sapiens
uaugaggaagaucagggaucaaaacuuauuggaaaagcuaaagag

SEQ ID NO: 159502 - RNA, 44 nt, Homo sapiens; identical to SEQ ID NO: 142949

SEQ ID NO: 159503 - RNA, 45 nt, Homo sapiens
caccugccauuuuuugaccauggaacacauuuugucacggguaag

SEQ ID NO: 159504 - RNA, 46 nt, Homo sapiens; identical to SEQ ID NO: 142951

SEQ ID NO: 159505 - RNA, 46 nt, Homo sapiens; identical to SEQ ID NO: 142952

SEQ ID NO: 159506 - RNA, 69 nt, Homo sapiens
guaccucacauaucuuaagaauacaaacucaauaaauauuauuaagugaaugaaggagugaaggaauga

SEQ ID NO: 159507 - RNA, 53 nt, Homo sapiens
guauugccuguuagcauaaugaauuucauagaguaacuuccugucucuugagg

SEQ ID NO: 159508 - RNA, 41 nt, Homo sapiens
uccugaaaacugccugaaaccaaaacucauucaggcuucaa

SEQ ID NO: 159509 - RNA, 72 nt, Homo sapiens
cccaccuauuuuuauuuuagaugccagauugcucuguggcauuuugguuagcagcauaucacaguccaucaa

SEQ ID NO: 159510 - RNA, 79 nt, Homo sapiens
uuagaacgcaaggugacugccucacaucuuuguggcuguuucucuguuccuugaagagcugagcagauuuaaaaacuuu

SEQ ID NO: 159511 - RNA, 70 nt, Homo sapiens
agggacggauucaagggcauugccuucuucgcugggggauuaugccuuguuucagggggaaguuggggaa

SEQ ID NO: 159512 - RNA, 38 nt, Homo sapiens
ccaguugcagagaccaggagagaccaucuugugguggg

SEQ ID NO: 159513 - RNA, 97 nt, Homo sapiens
cacucccaggagcagggaacagggguggaguggccuuucccagagcuggaguuggcugcagcagcuuucgaaucagaccugccaaggugaugggcgu

SEQ ID NO: 159514 - RNA, 58 nt, Homo sapiens
agaguuuuuucuuucacugcuuuuuacuuuuuaaaaaaagugagacucaaauugaaga

SEQ ID NO: 159515 - RNA, 40 nt, Homo sapiens
aagaguaaaugugggagaaaaugagcuaaguauauagugg

SEQ ID NO: 159516 - RNA, 37 nt, Homo sapiens
uuucuaauuggcauugcaguaaacauaagacugacag

SEQ ID NO: 159517 - RNA, 77 nt, Homo sapiens
uugcagcaugugaauuuuggggagacaugaacauuuagccuauggcaugguguuuauaguguuguacugggucacua

SEQ ID NO: 159518 - RNA, 68 nt, Homo sapiens
uccacccuuaacaauagcauggcugcccaaaggucccaucuccuacuaccaucacauugggcauuagg

SEQ ID NO: 159519 - RNA, 47 nt, Homo sapiens
caggaagcagauuuuaugcuuaccuggccagagcccuggccuggacu

SEQ ID NO: 159520 - RNA, 48 nt, Homo sapiens
gggagagcccugcgguucuccauucuuuuuuacugaugacuauuuaaa

SEQ ID NO: 159521 - RNA, 68 nt, Homo sapiens
ucuguaaguaagugcaggcuguagucaggguucuggcaggccuuuccaguuauuuuucagguacagaa

SEQ ID NO: 159522 - RNA, 35 nt, Homo sapiens
ugacagaagcaucucacagcuugugguggggcguu

SEQ ID NO: 159523 - RNA, 56 nt, Homo sapiens
aguaugagagaccagugauaaauucagguuguccaggaguucuggggauaggagag

SEQ ID NO: 159524 - RNA, 46 nt, Homo sapiens
guagcugugucagggagcacagggguggccguuaaugcugugaguu

SEQ ID NO: 159525 - RNA, 57 nt, Homo sapiens
uuugcgauugaaaaccuaacuagaucacuuggcaguuucuagauuuagucagcaggu

SEQ ID NO: 159526 - RNA, 59 nt, Homo sapiens
ccauucaucuuguaauacauugagcaaaaguuaagucuucuuuaacaucacucuagacu

SEQ ID NO: 159527 - RNA, 31 nt, Homo sapiens
guggauuguuccuucauagacaauuuuacag

SEQ ID NO: 159528 - RNA, 46 nt, Homo sapiens
gugcuauauagcguguucuuuccacuuucuaccaccaggaagaaga

SEQ ID NO: 159529 - RNA, 46 nt, Homo sapiens
gugguucaagaaucgggugugauuaauucaauuuugucccccugag

SEQ ID NO: 159530 - RNA, 49 nt, Homo sapiens
gcuuacaugauagaaaacuuauauguaguagaauauuguuugggggguu

SEQ ID NO: 159531 - RNA, 47 nt, Homo sapiens
aggauauaugccaaaugcuugacagaauuguccuggguuggugggga

SEQ ID NO: 159532 - RNA, 77 nt, Homo sapiens
uauggaguaacagcucugcauaaauauuuaggcccaaaugucaagcauuugcuucacauuucuuuuucauaauuaga

SEQ ID NO: 159533 - RNA, 38 nt, Homo sapiens
ucucuuauguucugcuuaaagagauugucaguuuguuc

SEQ ID NO: 159534 - RNA, 24 nt, Homo sapiens
gugugguucagagagcucuacucu

SEQ ID NO: 159535 - RNA, 51 nt, Homo sapiens
aggugaucuugcuuuucaauaucaaguauaugauuuggcuugaucuggaga

SEQ ID NO: 159536 - RNA, 46 nt, Homo sapiens
agacuugguaaauacagucuccuuccagaggucgggggucagguag

SEQ ID NO: 159537 - RNA, 71 nt, Homo sapiens
aucuucccuccucuccagaguuggaacauuuaaagcagggcuuugacaagugagcaggacuuccauuagug

SEQ ID NO: 159538 - RNA, 46 nt, Homo sapiens
gcuaaaccauacagcuauaauuauaagacacuaaauuggccagaac

SEQ ID NO: 159539 - RNA, 46 nt, Homo sapiens
gugauguuaugccuagcaaagaacuuaagauaugaucuccaccuuc

SEQ ID NO: 159540 - RNA, 75 nt, Homo sapiens
augguugacaguacuaagggaaaugagaauaaugugaggacauaguaggaaauaagcugggagaaauuuggagau

SEQ ID NO: 159541 - RNA, 57 nt, Homo sapiens
aauguggguguuugaaaucaaauagguaggcaaggacaagauuauguagcgcauaca

SEQ ID NO: 159542 - RNA, 39 nt, Homo sapiens
aaccuuguuagguucaugauuagaccguaugaccaacaa

SEQ ID NO: 159543 - RNA, 43 nt, Homo sapiens
cuuaauuacuucuugagcuuuuaagacuugaaaaaugucagua

SEQ ID NO: 159544 - RNA, 46 nt, Homo sapiens
uaaaauuuucuuuuuuuguuuuguagugguuuauggcaggcuucuc

SEQ ID NO: 159545 - RNA, 45 nt, Homo sapiens
uggacaacauaaaaaugaaagauuucuggaugccaagcaaggguu

SEQ ID NO: 159546 - RNA, 46 nt, Homo sapiens
auucagcaguggggacuuauuaaaaauuaguaauucugcuguguca

SEQ ID NO: 159547 - RNA, 42 nt, Homo sapiens
agagcucacccgcucccugucggacaacgugaaccugcccca

SEQ ID NO: 159548 - RNA, 44 nt, Homo sapiens
ggagacgccgcggaggagaccggaccgaagacggaccgugccgg

SEQ ID NO: 159549 - RNA, 23 nt, Homo sapiens
cccaggguauuuuucaaggggga

SEQ ID NO: 159550 - RNA, 45 nt, Homo sapiens
aaaaugaaagccggcuguagcaucguggaaaagccagaaggaggu

SEQ ID NO: 159551 - RNA, 50 nt, Homo sapiens
agaguacuuacagcauguuugcaaagcacucuagauucugagcaguggaa

SEQ ID NO: 159552 - RNA, 45 nt, Homo sapiens
ucccggcagauccagcuguggcacuucauccuggagcugcugcag

SEQ ID NO: 159553 - RNA, 46 nt, Homo sapiens
caaggacauucuccuccauaaccacaauaacauuaccacacccagg

SEQ ID NO: 159554 - RNA, 39 nt, Homo sapiens
ccaguauugcuucuagucucaccucccauuacuccaccu

SEQ ID NO: 159555 - RNA, 70 nt, Homo sapiens
uuuguauguggaaagccauuaaugaauuuauuuuacuccaagagauacacauaaaagggaaaagggcaug

SEQ ID NO: 159556 - RNA, 61 nt, Homo sapiens
ggcauuuuuuucuuuuccuuuuuaaagaaaauguuuucaggaaacaugaacaaacauacug

SEQ ID NO: 159557 - RNA, 48 nt, Homo sapiens
guuuggggagccaaaccaagugugacugugagcacguucacugagagg

SEQ ID NO: 159558 - RNA, 45 nt, Homo sapiens
aauguuuaaaauuuuauaaauaugaaucuauugaaauuuccuuaa

SEQ ID NO: 159559 - RNA, 105 nt, Homo sapiens
cauccagccuugcugagcucaccuuuuuuccugaagaauggguaggagugaaauauuuaauguaaacauuucaccaagucccuuuacccuaauuuugaagcugca

SEQ ID NO: 159560 - RNA, 69 nt, Homo sapiens; identical to SEQ ID NO: 75412

SEQ ID NO: 159561 - RNA, 46 nt, Homo sapiens
aucaaaaccuccaccaccgugcgcaccacagagauuaacuucaagg

SEQ ID NO: 159562 - RNA, 78 nt, Homo sapiens
ugagggcaggcaaaggagggucccagcaaggaaguggaggggugggcuaggggaccagagggacugauguuuguagac

SEQ ID NO: 159563 - RNA, 46 nt, Homo sapiens
cuuuguaaccaagcucugguacccucugucuccaucuccugcuguc

SEQ ID NO: 159564 - RNA, 45 nt, Homo sapiens
ggcauuggaggaagaagagaaauaugaagaugaagaagagaaaga

SEQ ID NO: 159565 - RNA, 45 nt, Homo sapiens
gucacagugacagagacccuggaggaacugcagcugccucaggaa

SEQ ID NO: 159566 - RNA, 42 nt, Homo sapiens
aacuuuauuuacccuuguguacagaggagugacaaggagggu

SEQ ID NO: 159567 - RNA, 44 nt, Homo sapiens
cggugggaaagcccgugccaggcagaaaggagaggcugggaaga

SEQ ID NO: 159568 - RNA, 50 nt, Homo sapiens
ccucuggggugacauucauggugagaaaaaagucucuauccucagacucu

SEQ ID NO: 159569 - RNA, 44 nt, Homo sapiens
uuuuuggggggcuugcucucugacugcaguugaggggccccagg

SEQ ID NO: 159570 - RNA, 60 nt, Homo sapiens
caucugagaccuuuccuucuugaugucgccuuuucuucuucuugcuuuuucugauguucu

SEQ ID NO: 159571 - RNA, 45 nt, Homo sapiens
ugccaccucuucuuuuucuucccuuuccugagggacugauugguu

SEQ ID NO: 159572 - RNA, 45 nt, Homo sapiens
ggaugggacguggagaagggaaaugcuggagggauccagccagac

SEQ ID NO: 159573 - RNA, 46 nt, Homo sapiens
cugaguguccugaagggacucacugugcccauugccagcaucgaca

SEQ ID NO: 159574 - RNA, 29 nt, Homo sapiens
ggaaauuggguaauuuuuuuccuuaaccc

SEQ ID NO: 159575 - RNA, 93 nt, Homo sapiens
aagugugcuccaugagucccacacaccaccuucucuaaagcuuccuugcccuuucaucucccuggucccuccuuccacucuguagucagaucc

SEQ ID NO: 159576 - RNA, 46 nt, Homo sapiens
agugucagaaaauggacaucccuuuccuuggggaaaugcccgcaga

SEQ ID NO: 159577 - RNA, 36 nt, Homo sapiens
cacagagccgcgcauacggccgcaauucagccgacg

SEQ ID NO: 159578 - RNA, 41 nt, Homo sapiens
ugcggccguaugcgcggcucuguggagugcaccugggguug

SEQ ID NO: 159579 - RNA, 46 nt, Homo sapiens
ucuguuugcagccccauuuggccugcugggggagaagacccgccag

SEQ ID NO: 159580 - RNA, 50 nt, Homo sapiens
gcuacccuugcaggguggcuggaaccgggcauccaggggcuaggggugga

SEQ ID NO: 159581 - RNA, 46 nt, Homo sapiens
ggcagugggcaccaauuccacacugcacuauguguggagcagccug

SEQ ID NO: 159582 - RNA, 45 nt, Homo sapiens
aacugaaugcuguccuuagggagcaccaucaggcccccaucgggc

SEQ ID NO: 159583 - RNA, 39 nt, Homo sapiens
uuuuaccagggugaggagguugggagagaaccaaggaga

SEQ ID NO: 159584 - RNA, 49 nt, Homo sapiens
cguguccgauacggcagcaaagccuuugggaagaccauauccuccauac

SEQ ID NO: 159585 - RNA, 45 nt, Homo sapiens
cugguagggucguucaugggguggccuugaaauguggcacucagg

SEQ ID NO: 159586 - RNA, 45 nt, Homo sapiens
agguccaggccuuuuccagguccagccgaccagcccaacccccuc

SEQ ID NO: 159587 - RNA, 50 nt, Homo sapiens
aggugucugcugugugcaggaggcgaggggguugggcuggucggcuggac

SEQ ID NO: 159588 - RNA, 45 nt, Homo sapiens
ggcuucugggaguaagccacuggucgccacugugcaaagccugau

SEQ ID NO: 159589 - RNA, 84 nt, Homo sapiens
ucuucauccugccuuagcauacucucuuccccagucacccauuguccgagccuucuuugggucccagaauaacuucugugccuu

SEQ ID NO: 159590 - RNA, 42 nt, Homo sapiens
guacucagaguaccaguccauaaauuaaggcccgcucucugg

SEQ ID NO: 159591 - RNA, 31 nt, Homo sapiens
cauuucccuuggaugggacuugcaggccuaa

SEQ ID NO: 159592 - RNA, 118 nt, Homo sapiens
uucaccuuuggggcccgagacagucauaagggauggacuuaguuuucuugcagggaaaaagguggacagccguguuucuuaaggaugcugagggcauggggccaggaccaggggagag

SEQ ID NO: 159593 - RNA, 67 nt, Homo sapiens
cgcuaccuguaucaauggcuggggugagagaaaaggcagagcugggccaaggcccugccucuccggg

SEQ ID NO: 159594 - RNA, 58 nt, Homo sapiens
cuucccuagcuuuagacccugggugggcucugugcagucacuggagguugaagccaag

SEQ ID NO: 159595 - RNA, 50 nt, Homo sapiens
accagcugcgcuugcuuuucuguauuuuauuuagacaagagaugggaaug

SEQ ID NO: 159596 - RNA, 73 nt, Homo sapiens
gaggcuuccugcguccuccucaccucaugcccacccccugcccugcacgucaugggagggggcuugaagccaa

SEQ ID NO: 159597 - RNA, 47 nt, Homo sapiens
ugcgcaagcuggugcgcucagugacugugguugaggacgacgaggau

SEQ ID NO: 159598 - RNA, 77 nt, Homo sapiens
gaccugguguggaaggcacagaacaccuggggcugcgggaacagccugcguacggcucucaucaacuccacugggga

SEQ ID NO: 159599 - RNA, 41 nt, Homo sapiens
gcaggaccaguccaugggcaauuggcagaucaagcgccaga

SEQ ID NO: 159600 - RNA, 32 nt, Homo sapiens
cugggccuuugagcaagauacacccaagagcc

SEQ ID NO: 159601 - RNA, 45 nt, Homo sapiens
agcuucucacagcacgcacgcacuagcgggcgcguggccguggag

SEQ ID NO: 159602 - RNA, 46 nt, Homo sapiens
ccuggacauggagauccacgccuaccgcaagcucuuggagggcgag

SEQ ID NO: 159603 - RNA, 36 nt, Homo sapiens
gcgggacaccagccggcggcugcuggcggaaaagga

SEQ ID NO: 159604 - RNA, 50 nt, Homo sapiens
cgcugcaggaacugcgggcccagcaugaggaccagguggagcaguauaag

SEQ ID NO: 159605 - RNA, 52 nt, Homo sapiens
gcgugagaccaagcgccgucaugagacccgacugguggagauugacaauggg

SEQ ID NO: 159606 - RNA, 44 nt, Homo sapiens
augagaugcugcggcggguggaugcugagaacaggcugcagacc

SEQ ID NO: 159607 - RNA, 46 nt, Homo sapiens
caaggaggccgcacugagcacugcucucagugagaagcgcacgcug

SEQ ID NO: 159608 - RNA, 31 nt, Homo sapiens
uuaggaaagcagugagguggaggaggaggaa

SEQ ID NO: 159609 - RNA, 50 nt, Homo sapiens
ucuugucuugagacuaucuugagacuugucaugggaauuguccacccgga

SEQ ID NO: 159610 - RNA, 46 nt, Homo sapiens
aaggagcgcgcccgccugcagcuggagcugagcaaagugcgugagg

SEQ ID NO: 159611 - RNA, 44 nt, Homo sapiens
caggagcucaaugaucgcuuggcggucuacaucgaccgugugcg

SEQ ID NO: 159612 - RNA, 46 nt, Homo sapiens
ccggcgcacuccgacuccgagcagucucuguccuucgacccgagcc

SEQ ID NO: 159613 - RNA, 42 nt, Homo sapiens
agccaacccagaucccgagguccgacagcgcccggcccagau

SEQ ID NO: 159614 - RNA, 43 nt, Homo sapiens
auuugaaaggcgagaauuggaggcaugucuggaaguuggugcu

SEQ ID NO: 159615 - RNA, 37 nt, Homo sapiens
guaacuuuccuaggucacagagcugguaaguagagac

SEQ ID NO: 159616 - RNA, 39 nt, Homo sapiens
aaacuuaaaugagagcuagguaucuuuagcgguuggggu

SEQ ID NO: 159617 - RNA, 42 nt, Homo sapiens
gugugcgcccgggggcccagcgcgggccuuggcggaagagga

SEQ ID NO: 159618 - RNA, 42 nt, Homo sapiens
auguuaggaggucggaggucaggaccagagggcuuagggauu

SEQ ID NO: 159619 - RNA, 52 nt, Homo sapiens
ggcugguaggggcaggggcagggggaagggaagaaagacaaagacaaggaac

SEQ ID NO: 159620 - RNA, 37 nt, Homo sapiens
gaggaaauccccucugcaccuccaccugcuccaucca

SEQ ID NO: 159621 - RNA, 54 nt, Homo sapiens
uauucguguuuuguguuuguuucuagguuuggcucaauugguaagggugggauu

SEQ ID NO: 159622 - RNA, 46 nt, Homo sapiens; identical to SEQ ID NO: 75488

SEQ ID NO: 159623 - RNA, 42 nt, Homo sapiens
ucucccaggccuucaaggacaguguuuccacuccacuccgug

SEQ ID NO: 159624 - RNA, 50 nt, Homo sapiens
acauauagauggaggugaacuggagcagagggucaggguuagggucaccc

SEQ ID NO: 159625 - RNA, 47 nt, Homo sapiens
aguucuagagguuuaccaccauuacuuuuuucuuuaauaaaguuuag

SEQ ID NO: 159626 - RNA, 48 nt, Homo sapiens
gcuguucaggcaauuauugcugaugcaaggacagaccacaggcuggga

SEQ ID NO: 159627 - RNA, 48 nt, Homo sapiens
ugguuuugacacaggagaugcaguucuuaaugaagcuacucaaauucu

SEQ ID NO: 159628 - RNA, 46 nt, Homo sapiens
ccugauuuuaagccugguguaauggcuuuggcuaaccugcuucagg

SEQ ID NO: 159629 - RNA, 42 nt, Homo sapiens
aguaucucagagauguuaacugucguuuaaagauucaagauc

SEQ ID NO: 159630 - RNA, 46 nt, Homo sapiens
acuucacuguuuggcuugaagaccagaaaaucagauacuacaagac

SEQ ID NO: 159631 - RNA, 42 nt, Homo sapiens
gacuuaccguuggcaucccaaacgccuuuccggagccacaaa

SEQ ID NO: 159632 - RNA, 45 nt, Homo sapiens
auggcucucuaaagaccaaucuuucaagcugugaaaccaaaggac

SEQ ID NO: 159633 - RNA, 45 nt, Homo sapiens
uuuuucucuaugcagcugcagccagcuggaaggacauucagguac

SEQ ID NO: 159634 - RNA, 57 nt, Homo sapiens
ccauaagcaguaaacaucaggggguggggcuggagagaagcucagucaagcagugag

SEQ ID NO: 159635 - RNA, 95 nt, Homo sapiens
ccaagcucacuaaacacagguguuuuuaaaggcagaacacuuuucuuuucccugucccuagucccuuuccuuguuauucaucuccuaaggggaag

SEQ ID NO: 159636 - RNA, 47 nt, Homo sapiens
caggggaaugggugaagaaggaggugaaggaguugcuaggaaggagg

SEQ ID NO: 159637 - RNA, 42 nt, Homo sapiens
ccucucggugggggcugcugcccaccaacucauggggcuccu

SEQ ID NO: 159638 - RNA, 46 nt, Homo sapiens
uccuaggcaucauucaaggucuuuuaugaagacuuuacagaugucc

SEQ ID NO: 159639 - RNA, 95 nt, Homo sapiens
gugcuaccaggguggugacagccucguggacuaaaguucccagugugggagaaaggagcuaguuugcaauaaaaacagcuggaugcaggagccca

SEQ ID NO: 159640 - RNA, 84 nt, Homo sapiens
uagacuugauuguaaacucaacaaauuugguguauuguccccuuaguacaccaguacuccagaggaagaaugcuuuucuuggga

SEQ ID NO: 159641 - RNA, 45 nt, Homo sapiens
ucuacguggaggaaugugacuacuugcagguaguggcguggcaau

SEQ ID NO: 159642 - RNA, 37 nt, Homo sapiens
ucuggagggucaaauccauucccaauggcaaagguga

SEQ ID NO: 159643 - RNA, 46 nt, Homo sapiens
cccuccagacaccaucacuacucagcacucccugggaggggucaga

SEQ ID NO: 159644 - RNA, 40 nt, Homo sapiens
ccagucaaacggcaagccccgacccgcucggcccgucccu

SEQ ID NO: 159645 - RNA, 31 nt, Homo sapiens
ggggaaggggggggaggagagaagaggaggu

SEQ ID NO: 159646 - RNA, 65 nt, Homo sapiens
cagacucccggagggggcugggaaguaagcgaguggaggcggagucggcugugccccugacaggu

SEQ ID NO: 159647 - RNA, 48 nt, Homo sapiens
gggauuuuaccugugugacaaggucuguggugucccugccgcguugaa

SEQ ID NO: 159648 - RNA, 38 nt, Homo sapiens
guugguguguagcggcuguguugguguguguaugugag

SEQ ID NO: 159649 - RNA, 77 nt, Homo sapiens
uuuagggauugggagccccuaguuacuuguugggaaagagcggcaaugguaguguucuguacagcaugugucuguga

SEQ ID NO: 159650 - RNA, 45 nt, Homo sapiens
auaucuuuaacagaaucauuacuacaaaguuguaaagaaugggug

SEQ ID NO: 159651 - RNA, 45 nt, Homo sapiens
gaugagugguucuuaaaauuuuuuggggucacuuauccuuuugag

SEQ ID NO: 159652 - RNA, 52 nt, Homo sapiens
gaggaagaggaccuucgcaaacggaaucgagaaagaaacaucgaagcuggga

SEQ ID NO: 159653 - RNA, 46 nt, Homo sapiens
acuauuaagcacccaaggaaagcacuuaaaaguggaaagaugacgg

SEQ ID NO: 159654 - RNA, 61 nt, Homo sapiens
ugccagucugaagaagucauccgucuucauucacagggagaaaacaauccuuugucuaaga

SEQ ID NO: 159655 - RNA, 63 nt, Homo sapiens
agcugucuccaguacacucagaaauggcagauuauauuaaugcaacgccaucuacucuucuug

SEQ ID NO: 159656 - RNA, 60 nt, Homo sapiens
guccuccuuccaagucuuccaagacaaaaccgaagaaguuaggaacuggcacuacagcag

SEQ ID NO: 159657 - RNA, 66 nt, Homo sapiens
cagcacagcaguuggauugguaacuaaagauccugggaaaaagccaguguuuaaugcagcaguagg

SEQ ID NO: 159658 - RNA, 69 nt, Homo sapiens
guuccagguuuagugcauaaagagucuggcaagaaguuaggacuuggcacugugguuggacugguuaau

SEQ ID NO: 159659 - RNA, 81 nt, Homo sapiens
aaagauuugggaaagaaauuggguucuacuguuggccuaguggccaaggacugugcaaagaagauuguagcaaguucagca

SEQ ID NO: 159660 - RNA, 46 nt, Homo sapiens
agaaccaguuuacuucugaaaguacccacuugaacguuggucauag

SEQ ID NO: 159661 - RNA, 42 nt, Homo sapiens
uuaaaacugggugcaguaucugcaucagacaaacacugccaa

SEQ ID NO: 159662 - RNA, 46 nt, Homo sapiens
uggcaagaagcacaugccggucuccaaaagggcuagaauuagaaag

SEQ ID NO: 159663 - RNA, 45 nt, Homo sapiens
auugggccaacagauaaaugucagcaagaaaggaaccauuuauau

SEQ ID NO: 159664 - RNA, 45 nt, Homo sapiens
ccauucccagugauaguggaauuggaacagauaauaacagcacau

SEQ ID NO: 159665 - RNA, 46 nt, Homo sapiens
cuggaaucuuugaagcgcuauagauuuggaaaggaugcuguuggag

SEQ ID NO: 159666 - RNA, 40 nt, Homo sapiens
aggacuguaaaagggagagaguacagcaugaaauggggag

SEQ ID NO: 159667 - RNA, 30 nt, Homo sapiens
gagagaguagugagaaauguggcaaaagaa

SEQ ID NO: 159668 - RNA, 46 nt, Homo sapiens
auuuauugucucuuucaguaaacggaguucccucucgaaguccaag

SEQ ID NO: 159669 - RNA, 45 nt, Homo sapiens
uguggauagucugcugcagcggaugguacaaaaugaggaccaaga

SEQ ID NO: 159670 - RNA, 45 nt, Homo sapiens
acuccuaucugaaaaguugacaagcagcuguuccccccaucauau

SEQ ID NO: 159671 - RNA, 47 nt, Homo sapiens
gagaaaagguuggcuauuggaagaacagaccagaaaaaagcagaagc

SEQ ID NO: 159672 - RNA, 36 nt, Homo sapiens
gguagcaaagauuuuguucuguaagaauucuauuug

SEQ ID NO: 159673 - RNA, 45 nt, Homo sapiens
gcaguuuucuuaaccuaaggauauaaagagaaaaauggggaccaa

SEQ ID NO: 159674 - RNA, 46 nt, Homo sapiens
acuagauugaccccccaauuacagaugaagccaauguccaaucgug

SEQ ID NO: 159675 - RNA, 42 nt, Homo sapiens
agggauagucggcgcaccccugauggccacccgguccgucag

SEQ ID NO: 159676 - RNA, 46 nt, Homo sapiens
cgggaaggggccacugcuaacgucagugagggugaaaaaaaaacag

SEQ ID NO: 159677 - RNA, 86 nt, Homo sapiens
aaggggaauggggccauguuguugacauuagguacuuaauaagccuuggagcuaguggagagggagaggaaaggguucuguccaag

SEQ ID NO: 159678 - RNA, 65 nt, Homo sapiens
ccagcacacaugcuguuuuuaaugcgcuguaguucuugugugucugcugugcugugcaaauggag

SEQ ID NO: 159679 - RNA, 41 nt, Homo sapiens
uaggggcacuuugggggucuccuuuuagucaaaagcgagaa

SEQ ID NO: 159680 - RNA, 44 nt, Homo sapiens
auaaaugcugcuaauauauuuccuuuuuacaaaagcauaucuaa

SEQ ID NO: 159681 - RNA, 67 nt, Homo sapiens
ccugcccccagccgucuuucuggggcuugcgcgcaaaaucuacaagcggagaaagugaccuagagau

SEQ ID NO: 159682 - RNA, 44 nt, Homo sapiens
caaauuucaauagugccaagguggagaaacccuggaguagagga

SEQ ID NO: 159683 - RNA, 44 nt, Homo sapiens
gugguucagugucugcaacgggccacuccagaacaguaccagau

SEQ ID NO: 159684 - RNA, 61 nt, Homo sapiens
uuaccuugaccucuuuggggaccccagugugaccggcaaaauuggcacugacauccaggac

SEQ ID NO: 159685 - RNA, 62 nt, Homo sapiens
cgagaaggagcacgccaaugccaagaagauccugcuggagaugggggaguucuuucagauuc

SEQ ID NO: 159686 - RNA, 79 nt, Homo sapiens
gagcaagucggucucgcucagucucuuuccucagcuggggauaaaauuccuacuucacaggacuguaaagauuaagcaa

SEQ ID NO: 159687 - RNA, 44 nt, Homo sapiens
auuccgggagcugguggagccaaggaaacaggaugcugauaguc

SEQ ID NO: 159688 - RNA, 45 nt, Homo sapiens
gaacggagaccagaauucagauguuuaugcccaagaaaagcagga

SEQ ID NO: 159689 - RNA, 33 nt, Homo sapiens
guaacgauacugugaggcaucggaaggccagcc

SEQ ID NO: 159690 - RNA, 79 nt, Homo sapiens
aaggagcucaagcaugagcagcuaugcaaguaccacugaagaggggccugcacggacagcacgcucugucgcccugacc

SEQ ID NO: 159691 - RNA, 43 nt, Homo sapiens
agggcuaaugguucagaaacuggaauuaaacuaugaagagauu

SEQ ID NO: 159692 - RNA, 49 nt, Homo sapiens
cacugccugaaguagaagcaauccugugaggcugccagccaugaugcuu

SEQ ID NO: 159693 - RNA, 46 nt, Homo sapiens
cgucgcccacugcguguacucucauagcggcugaagguaccaaggg

SEQ ID NO: 159694 - RNA, 38 nt, Homo sapiens
aacauauuuagcugcuucugggucugucaguaccugca

SEQ ID NO: 159695 - RNA, 42 nt, Homo sapiens
gcagcuguagccguuccauguacugccgcugcaugcggccag

SEQ ID NO: 159696 - RNA, 46 nt, Homo sapiens
cccuggccuucaugucucuccuggaggagaaguugaucccggugcu

SEQ ID NO: 159697 - RNA, 46 nt, Homo sapiens
ggagagacaugaaggccagggugucugccccuugcugagcugacag

SEQ ID NO: 159698 - RNA, 41 nt, Homo sapiens
cugcaucugagcuccguugugcuagcuuuguggugucuggg

SEQ ID NO: 159699 - RNA, 47 nt, Homo sapiens
aagggccacuuccuguuuucagggacuagguugggcuagauaugggg

SEQ ID NO: 159700 - RNA, 28 nt, Homo sapiens
cagccugugcuccucucccucccugccu

SEQ ID NO: 159701 - RNA, 46 nt, Homo sapiens
ugcccuucggaccagucauggagaggucaucucaguuccacacaag

SEQ ID NO: 159702 - RNA, 53 nt, Homo sapiens
uucuuauccagagcgagugugcugcgccccuaggaugggaggaggggaacuag

SEQ ID NO: 159703 - RNA, 24 nt, Homo sapiens
uuuugccccauagaaggagcuggc

SEQ ID NO: 159704 - RNA, 27 nt, Homo sapiens
ggucagaggcaagagaaaugcaagaug

SEQ ID NO: 159705 - RNA, 25 nt, Homo sapiens
cagcccagcccacagccccugccac

SEQ ID NO: 159706 - RNA, 60 nt, Homo sapiens
uaaugauggugugggggaccagugugaugaugaugcugauggggaugggaucaagaaugu

SEQ ID NO: 159707 - RNA, 47 nt, Homo sapiens
ugccugugacaauugccccaacguucccaacaaugaccagaaggaca

SEQ ID NO: 159708 - RNA, 65 nt, Homo sapiens
gguggcugggggaccugugagaauuuggaucagguggggaugaagcagggaagcuaggaagucuc

SEQ ID NO: 159709 - RNA, 46 nt, Homo sapiens
ggauuggacaauugcccuaaaguccccaacccacuacagacagaca

SEQ ID NO: 159710 - RNA, 44 nt, Homo sapiens
ugccaaauagcucccagcuggacucugauaacgauggacuugga

SEQ ID NO: 159711 - RNA, 48 nt, Homo sapiens
uuagacugguguugccuuugcccagguggaggcagcaagcccuguugg

SEQ ID NO: 159712 - RNA, 52 nt, Homo sapiens
agaugauugauuggggccuaggagaugaaaucacuuuuuauuuuuuagagau

SEQ ID NO: 159713 - RNA, 48 nt, Homo sapiens
cagcuuuauccgcuucuggcuuuucuggaaguacccccaggagcaaga

SEQ ID NO: 159714 - RNA, 44 nt, Homo sapiens
gguuucgacucagagaucccuauaucaugguaagcacaacuggg

SEQ ID NO: 159715 - RNA, 46 nt, Homo sapiens
gugauucaaacuaaaucaacccaaugucucuccuacccacucacca

SEQ ID NO: 159716 - RNA, 45 nt, Homo sapiens
ugcagugucuucaccaucagcauguaccucucaccacuggcugac

SEQ ID NO: 159717 - RNA, 48 nt, Homo sapiens
cagugggugcugcgcuucagacccuguauaucuuggcauaucugcauu

SEQ ID NO: 159718 - RNA, 48 nt, Homo sapiens
ggaguguggacaacguccaguuccugcccuuucucaccacggaaguca

SEQ ID NO: 159719 - RNA, 31 nt, Homo sapiens
gugguccggaaaggaugacaggcauugggca

SEQ ID NO: 159720 - RNA, 67 nt, Homo sapiens
gucaggaaaggagagagaggggacagagacguggccacagcaccuggcucguccggaaccgggauca

SEQ ID NO: 159721 - RNA, 31 nt, Homo sapiens; identical to SEQ ID NO: 75640

SEQ ID NO: 159722 - RNA, 46 nt, Homo sapiens
cuacagcgccuucucucugggcuacgaguuccacgccggccacgag

SEQ ID NO: 159723 - RNA, 44 nt, Homo sapiens
uaccgcaccugcaacgccagccagggcuucaagcgcugggagug

SEQ ID NO: 159724 - RNA, 41 nt, Homo sapiens
gggagcugggaagcggagaagccgggagcgcggggcucagu

SEQ ID NO: 159725 - RNA, 43 nt, Homo sapiens
guccgcacagccugucucugcucaguugcaauaaacgugacau

SEQ ID NO: 159726 - RNA, 62 nt, Homo sapiens
cuuagggcuucaagaggcgggcgugcccucuggaguccccuaccaugacugaaggcgccaga

SEQ ID NO: 159727 - RNA, 46 nt, Homo sapiens
gcuggacggugacagucauauccuggagcugcuacagaauagguaa

SEQ ID NO: 159728 - RNA, 62 nt, Homo sapiens
gagcagcaggcagagucagagaaggccccgagggagcccuuggagccccagguccuucagga

SEQ ID NO: 159729 - RNA, 58 nt, Homo sapiens
gguggaguguccggaggagagagggccauuguguguuggggggguggggggugcucga

SEQ ID NO: 159730 - RNA, 41 nt, Homo sapiens
gcagcccucugccuuccuggccgcucccaaauauaggugag

SEQ ID NO: 159731 - RNA, 46 nt, Homo sapiens
cgauuagagggcaacagagaggaaccaauaagcuugguaggaccag

SEQ ID NO: 159732 - RNA, 42 nt, Homo sapiens
accgggugagggcccugaggacagggagagcccaagccaggg

SEQ ID NO: 159733 - RNA, 37 nt, Homo sapiens
ccuuccucuccucacuagugaccuggaugaggagaag

SEQ ID NO: 159734 - RNA, 41 nt, Homo sapiens
uuuccagcuuucucucccuccucccaccccaucccaaguaa

SEQ ID NO: 159735 - RNA, 40 nt, Homo sapiens
aggcgggcccugaggggggggcgggugggagccaggugaa

SEQ ID NO: 159736 - RNA, 42 nt, Homo sapiens
uggacgaagggguugaaguuuauguccuuauugggcggaggg

SEQ ID NO: 159737 - RNA, 86 nt, Homo sapiens
gaggagggugggaaaggcuaggagagcuaaguaagaguuuggagaagggggcaaaaaaggagggagggacccaucugcgcucugca

SEQ ID NO: 159738 - RNA, 44 nt, Homo sapiens
cgagaagccaccugcuggaaagggagggaggcccccugcggagg

SEQ ID NO: 159739 - RNA, 65 nt, Homo sapiens
gcggcggggagggguggguggguggggaugucccacguuuucccaacaccaagaggccggcaaaa

SEQ ID NO: 159740 - RNA, 40 nt, Homo sapiens
cccaccauauugaguauaugauaugugccuggccuugugu

SEQ ID NO: 159741 - RNA, 50 nt, Homo sapiens
cccugcuacagaggaaugacacugaggcuacugugagguguggcugggug

SEQ ID NO: 159742 - RNA, 61 nt, Homo sapiens
acauaaacugagugauaaggaggauuugaucaguucaguaggugggcaagagccaacagua

SEQ ID NO: 159743 - RNA, 41 nt, Homo sapiens
uugccgagucucaguuguaccugaugagguagccaccauug

SEQ ID NO: 159744 - RNA, 97 nt, Homo sapiens
aaagucccuacaauuuuucaaccugagagagcugauugaaaaaaagaaaaauaaaaaggucauugcaauuuaccaagcaguaugguagagggcagag

SEQ ID NO: 159745 - RNA, 55 nt, Homo sapiens
ggagggcgcugcguucuccuguccuuaagggccugcugcacaucccuccauggaa

SEQ ID NO: 159746 - RNA, 48 nt, Homo sapiens
ggcucaguaaucugaagcuuggugggaagaagggauucugggcuagaa

SEQ ID NO: 159747 - RNA, 39 nt, Homo sapiens
ccuugggcagcaugacaugucuguaacagaaacggggaa

SEQ ID NO: 159748 - RNA, 57 nt, Homo sapiens
cucagcggccaaagcucacgacccucgcuauugcucccgcgccagcacuaaccgaua

SEQ ID NO: 159749 - RNA, 60 nt, Homo sapiens
uuucauauugcaccccuuguuagcauuuguugaauaaauaagcaaguauguauugacguu

SEQ ID NO: 159750 - RNA, 45 nt, Homo sapiens
cgugagggcauggggcagcugguggcugcuaacgaugggugacgc

SEQ ID NO: 159751 - RNA, 54 nt, Homo sapiens
uuccagggugauuuuuuugauguuuggcucuugguccuuguuuccacuggcuuu

SEQ ID NO: 159752 - RNA, 106 nt, Homo sapiens
ccaaagcccugcugagcagagccauuuuguggcuauuucuggaggcccaggaguguggcugcaagagaaaaggggcuggaggaagauccggagggcagggguguuc

SEQ ID NO: 159753 - RNA, 36 nt, Homo sapiens
ggcaaguggcccuagauccuuugcuuuagcgguuug

SEQ ID NO: 159754 - RNA, 31 nt, Homo sapiens
cauuuucccagucaccuucaaguucccuaag

SEQ ID NO: 159755 - RNA, 67 nt, Homo sapiens
aauucuguuuaccuucuuaguaaucgccagaguuuggucuuagggaacuugaaggugacugggaaaa

SEQ ID NO: 159756 - RNA, 46 nt, Homo sapiens
cugcccagacucugauaauagcugggugcuugcuggcuccgaggua

SEQ ID NO: 159757 - RNA, 43 nt, Homo sapiens
cccaacuggucccuuccuucauggcaugguccaagugccaaca

SEQ ID NO: 159758 - RNA, 44 nt, Homo sapiens
acaaagguccugaggcgauaguggggaacgccaugcugggggag

SEQ ID NO: 159759 - RNA, 42 nt, Homo sapiens
gugguugggguggguugggcuucugugagcagcugcugggag

SEQ ID NO: 159760 - RNA, 42 nt, Homo sapiens
cggaaaccuggccccugaaaguuccuccucgcagugagugag

SEQ ID NO: 159761 - RNA, 46 nt, Homo sapiens
cacagccccuccaagacagaugggaaagaauuagcugggaccaugg

SEQ ID NO: 159762 - RNA, 51 nt, Homo sapiens
gaaggugauguuugugguguggagccuccuggcccaggagacacaguaguc

SEQ ID NO: 159763 - RNA, 46 nt, Homo sapiens
gaaggccagagcccuccacagagccugccuucaacccccaaagcag

SEQ ID NO: 159764 - RNA, 56 nt, Homo sapiens
gagggccgcugcuccagcagugacgaugacaccgacguggacauggagggucugcg

SEQ ID NO: 159765 - RNA, 42 nt, Homo sapiens
ccauggugccccuggcuguggagaaccaggcugggggugagg

SEQ ID NO: 159766 - RNA, 43 nt, Homo sapiens
gcugcaggccccagugccuccugacaguguccccagccugcaa

SEQ ID NO: 159767 - RNA, 41 nt, Homo sapiens
cuaagguuugggccagggcuggcauaccuguuccacauggu

SEQ ID NO: 159768 - RNA, 46 nt, Homo sapiens
agcugcugcagcucugacuccagagcccgcuggaaggcuucgcccu

SEQ ID NO: 159769 - RNA, 45 nt, Homo sapiens
ccagaaacugcagggccuggagaacuggggccaggacccuggggu

SEQ ID NO: 159770 - RNA, 54 nt, Homo sapiens
ccagaauucuagggaguggaguggaaaggaaaaguggugggaugggcagagaga

SEQ ID NO: 159771 - RNA, 49 nt, Homo sapiens
ucaggaggacagggagccagcaggaagguggaaggagggcaggccaagg

SEQ ID NO: 159772 - RNA, 42 nt, Homo sapiens
gcuugcccuccuucuugcuccccgacuccuccacccuuggcc

SEQ ID NO: 159773 - RNA, 49 nt, Homo sapiens
aggaacccccaaggaaaagugguagcuuccacuccucuggagaaaagca

SEQ ID NO: 159774 - RNA, 46 nt, Homo sapiens
gggcagcugaccaaggagcuaccccucucaccugcuuucuuuggug

SEQ ID NO: 159775 - RNA, 46 nt, Homo sapiens
uggaugcccuggaggacagcuuggaggagguggcugugcaacagac

SEQ ID NO: 159776 - RNA, 53 nt, Homo sapiens
aggugggcagcugugggggaguugggucgggugggacagaggcagucgggagg

SEQ ID NO: 159777 - RNA, 48 nt, Homo sapiens
aagaggccuuuaggggacaauaccaugcaaugaaaacggguuccccaa

SEQ ID NO: 159778 - RNA, 46 nt, Homo sapiens
ggaagaaggacaagcacucacagagcccaagagcugcggggcccag

SEQ ID NO: 159779 - RNA, 38 nt, Homo sapiens
aguucccagagauuaacuugcccaagaucacuuggccu

SEQ ID NO: 159780 - RNA, 54 nt, Homo sapiens
aggcuagaagguagguaggauucaguguccuggggcagguggcugggccuggga

SEQ ID NO: 159781 - RNA, 33 nt, Homo sapiens
gguaggucuaaauggggacccaggucuaucuga

SEQ ID NO: 159782 - RNA, 46 nt, Homo sapiens
acugugguggacagugagggccggacagagacuacaguaacccgac

SEQ ID NO: 159783 - RNA, 98 nt, Homo sapiens
auucccagguuucccaggagggucuuggcccgguucuacagccccagcccaaauccuauuucaagagcaucucugugaccaagaucacuaaaccagau

SEQ ID NO: 159784 - RNA, 56 nt, Homo sapiens
ccuggugagagacuacgggagggacagacacuucgggacucaaugcuuaaguaucc

SEQ ID NO: 159785 - RNA, 49 nt, Homo sapiens
gguuucugguggguuggugggugaaauaaagagccugcagggaguagcu

SEQ ID NO: 159786 - RNA, 59 nt, Homo sapiens
uuccacgauaacuucggcuuugaugaccuaguacgagauuucaauagcaucuucagcga

SEQ ID NO: 159787 - RNA, 37 nt, Homo sapiens
gggaugacucgagaugaagaugaugaugaggaagaag

SEQ ID NO: 159788 - RNA, 116 nt, Homo sapiens
aaaaagaacugucagccauuguauuaauguuuugauguggcagccaguccuccgacccucucccuagcuucccagaccccuugcucuugucccacuuugccacccaugaguugauu

SEQ ID NO: 159789 - RNA, 79 nt, Homo sapiens
cacugaagaaaaacugggggaagguguaugaagggagcugcgagcugaggucugacuuugauuaaaaaaaaaaaaaaaa

SEQ ID NO: 159790 - RNA, 60 nt, Homo sapiens
augcaacagggacccgggcggggaagaccgugagggucuggggaauaagacagugagcaa

SEQ ID NO: 159791 - RNA, 37 nt, Homo sapiens
accacuggagggguucaaagguucgcgucccaguacg

SEQ ID NO: 159792 - RNA, 38 nt, Homo sapiens
aaaaaauggcgucaugaauaugaacagcauugucagau

SEQ ID NO: 159793 - RNA, 45 nt, Homo sapiens
gggaggugggacccccaaacauauaucagcccaacagcccuaagu

SEQ ID NO: 159794 - RNA, 39 nt, Homo sapiens
uggaaaugaaauugccuugugaucacccaucuccaagag

SEQ ID NO: 159795 - RNA, 45 nt, Homo sapiens
auaacacgagcggccggcaaaggaaaucucagagaagggccgggu

SEQ ID NO: 159796 - RNA, 46 nt, Homo sapiens
cgcauucucagauccuucaccaucaccugcagcaggauggccaggu

SEQ ID NO: 159797 - RNA, 44 nt, Homo sapiens
caucaauccggccacagcugcugccuacccaccugcccccuuua

SEQ ID NO: 159798 - RNA, 39 nt, Homo sapiens
gugggcuuaacuuuggaaggcugccuuugucugaggcau

SEQ ID NO: 159799 - RNA, 48 nt, Homo sapiens
gaacuauuaauuuuucaguauggugguuuuaugaagguggggggaggg

SEQ ID NO: 159800 - RNA, 45 nt, Homo sapiens
cuaggaaccaaugcugugcuguggaugaaggguggaggguggccu

SEQ ID NO: 159801 - RNA, 52 nt, Homo sapiens
ucccuugcuuccauaccugacaucugugcucuacuuuuggaggacagggagu

SEQ ID NO: 159802 - RNA, 51 nt, Homo sapiens
uggcccaaccccaacagaaccagacgcagacucaccauaccacgcagcaga

SEQ ID NO: 159803 - RNA, 29 nt, Homo sapiens
gagauaguguugggauugauggcagacac

SEQ ID NO: 159804 - RNA, 42 nt, Homo sapiens
gccacaaguauaugguuaugaugacuugcagaugcuucagac

SEQ ID NO: 159805 - RNA, 46 nt, Homo sapiens
uauaccucccaaaauaaugcucagggcccucuuuaugaacagagau

SEQ ID NO: 159806 - RNA, 35 nt, Homo sapiens
uucuucuugauucaaaucaaguuauuccacuagua

SEQ ID NO: 159807 - RNA, 42 nt, Homo sapiens
gcuguggagaugccuggcucagcagauaucucagggcuaaac

SEQ ID NO: 159808 - RNA, 46 nt, Homo sapiens
agaugucgccuggaucuucagacaaccaguccucuagcccucagcc

SEQ ID NO: 159809 - RNA, 46 nt, Homo sapiens
agcagugcacagccccuuuacaaagcgccaggcuuuuaccccaucu

SEQ ID NO: 159810 - RNA, 47 nt, Homo sapiens
cuugggacaugggcucgacgacacaauccccaucacuggugcaguau

SEQ ID NO: 159811 - RNA, 47 nt, Homo sapiens
gugagcauguuagggaaaggauuuggugaugucggugaagcuaaagg

SEQ ID NO: 159812 - RNA, 46 nt, Homo sapiens
gccauaucacagccugcuucagggaacacauuuucucaucacagua

SEQ ID NO: 159813 - RNA, 48 nt, Homo sapiens
ugaaaaugggcaaauuauguuccuuucugagauuuggcuuguccgcuu

SEQ ID NO: 159814 - RNA, 42 nt, Homo sapiens
ggaagagauuggugguuggguagggcaccagaaguggaguua

SEQ ID NO: 159815 - RNA, 47 nt, Homo sapiens
gauagaaaauggguauguuucuaccccucaaaauucacccuuaagau

SEQ ID NO: 159816 - RNA, 48 nt, Homo sapiens
cccccccacccccauuccugcuuuguaacaaaaacugaaaguagcuau

SEQ ID NO: 159817 - RNA, 33 nt, Homo sapiens
accugaggaccuuaaagauacugcuuugagcau

SEQ ID NO: 159818 - RNA, 47 nt, Homo sapiens
uuuucugaaaauauauguauacaugaagcacaaaaaaggaaugugga

SEQ ID NO: 159819 - RNA, 27 nt, Homo sapiens
agaaauucucacccuuauuuuuuaaga

SEQ ID NO: 159820 - RNA, 46 nt, Homo sapiens
gcuaaugcaacuuggauuccaucgagccaggauaagauggauguca

SEQ ID NO: 159821 - RNA, 39 nt, Homo sapiens
guugaaaaguuuguuuuuaguugugaauagaaauucagg

SEQ ID NO: 159822 - RNA, 46 nt, Homo sapiens
uagcagcggcaauacguggaacaacacuggccacuuugaaccagau

SEQ ID NO: 159823 - RNA, 45 nt, Homo sapiens
uacaaggccacaacccuugucacauauuucuuugcucugggaauu

SEQ ID NO: 159824 - RNA, 78 nt, Homo sapiens
uuuuuccugaaugaccucaauuaugucaucuguaaagucuccuugaaugauaauuucauccuccucuguuacugaggc

SEQ ID NO: 159825 - RNA, 42 nt, Homo sapiens
aaaaaaucacucagcuuuagaucaguaaaauaaucaacaaaa

SEQ ID NO: 159826 - RNA, 54 nt, Homo sapiens
aacagaaagaggcagaaggggccguggccgaggcagaggugaucaguuuguugg

SEQ ID NO: 159827 - RNA, 53 nt, Homo sapiens
ggucaggaaaauggauuggauggcaccaagaguggagggccuucuggaagagg

SEQ ID NO: 159828 - RNA, 55 nt, Homo sapiens; identical to SEQ ID NO: 75773

SEQ ID NO: 159829 - RNA, 83 nt, Homo sapiens
gucucaggccagaaggaugguggccagacggaauccaaugaggaaggcaaagaaaaucgagaccgggacagagacuauagucg

SEQ ID NO: 159830 - RNA, 27 nt, Homo sapiens
gaaguguuuuagacauggaugcugagu

SEQ ID NO: 159831 - RNA, 40 nt, Homo sapiens
ggugagaucauuucagaaaacugaagucgccuuugggaag

SEQ ID NO: 159832 - RNA, 338 nt, Homo sapiens
uuacuagagaaauuuuguuuuuuuaaugagcaguguauuauuauuauuauuauuauuuugagccagggucuuacucuguggcccuggcuggaguacacugacaugcugcaaccuccucguccugggcuuaggugauccuccuacuucagccuccugaguagcugggaccacaggcaugggccaccauguccagcugauuuucccauuuuuaguagagccaggguuucuccauguugcucaggcugauuucaaacuccuggacucaagcuagcugcccgccucguccucccaaagugcugggauuaugggcaugagccaccgcaccuggcccaguguau

SEQ ID NO: 159833 - RNA, 45 nt, Homo sapiens
agaugucaacagagcuaucaauguucuucuggaaggaaacccaga

SEQ ID NO: 159834 - RNA, 87 nt, Homo sapiens
uucuugaucucaucucaauuccuaggccacugcagaacaaauuagacuugcacagaugauuucggaccauaaugaugcugacuuuga

SEQ ID NO: 159835 - RNA, 25 nt, Homo sapiens
gauuucuaguagaauuauaauacuu

SEQ ID NO: 159836 - RNA, 24 nt, Homo sapiens
gauaccucucuagcaagccuuuuc

SEQ ID NO: 159837 - RNA, 55 nt, Homo sapiens
uauucuaccuuguaaauacuguuauuuguauauacuguaaaugaugacaucggug

SEQ ID NO: 159838 - RNA, 44 nt, Homo sapiens
uugguuugagacaaauuugagauucccuguauauuaaggugagu

SEQ ID NO: 159839 - RNA, 67 nt, Homo sapiens
augacuaugccauauuagaaacuucaucuuagagccaauuuuaaaacaaaauaguuuuccucucguc

SEQ ID NO: 159840 - RNA, 55 nt, Homo sapiens
uuucaagaugacuuuuuaauauguuuacaucugacugguacaguauaugcaauag

SEQ ID NO: 159841 - RNA, 37 nt, Homo sapiens
cuacuaauucugugcccucaagugauccauuccagau

SEQ ID NO: 159842 - RNA, 69 nt, Homo sapiens
guccuuaaagauuagacuaucucaaugauuguuuccuuugugaaugggaaauauugcuggcacauaaac

SEQ ID NO: 159843 - RNA, 64 nt, Homo sapiens
aauccuuuuuuuuugucuucucucccauccuaccuuccuccgccgcauauccuguuuuggggau

SEQ ID NO: 159844 - RNA, 45 nt, Homo sapiens
ccucaguuuggugugcgaaggauuaauuuguuccggcugggaggu

SEQ ID NO: 159845 - RNA, 95 nt, Homo sapiens
gccguaggaagggggggccaugcggcuagagccugagaggggagagcgagaaagagcgcgagcgagcgaggccugggccuugccugagguagggc

SEQ ID NO: 159846 - RNA, 48 nt, Homo sapiens
agacccggccugaaaacauggcggacaggcaggagagcugggaaagga

SEQ ID NO: 159847 - RNA, 41 nt, Homo sapiens
ugagugcuuugcguacacccuugaaaggcguacuaguguuu

SEQ ID NO: 159848 - RNA, 42 nt, Homo sapiens
cagggccuccugauagcguagguacucauucuggccaaagac

SEQ ID NO: 159849 - RNA, 68 nt, Homo sapiens
ugcuccuaugacuuuagauggauggucccaccuuuuccccuggucuggggguagcauggaauaucuga

SEQ ID NO: 159850 - RNA, 47 nt, Homo sapiens
aaguagaagggaaauuagagggagaagcugucuggccuuccuuggga

SEQ ID NO: 159851 - RNA, 47 nt, Homo sapiens
aauccccuuuuccccaucuucuucuuucagaucauuaaugagcagaa

SEQ ID NO: 159852 - RNA, 30 nt, Homo sapiens
gcuaugaaugcuuggcuuagggagggcucu

SEQ ID NO: 159853 - RNA, 43 nt, Homo sapiens
auccuggccaugggcuucuuccugguccuggugauggagcaga

SEQ ID NO: 159854 - RNA, 42 nt, Homo sapiens
gcagcauuggcaugaugggccaggggucccacaggcgagugg

SEQ ID NO: 159855 - RNA, 45 nt, Homo sapiens
gugguggcuggcugugggauccucuucucaugcaugacaccucua

SEQ ID NO: 159856 - RNA, 46 nt, Homo sapiens
uuugcccugcucacuggccugcucuucauccaaaucuagggggcuu

SEQ ID NO: 159857 - RNA, 45 nt, Homo sapiens
ccugaucaucaaucuccccugccccucucuugaagcccccuagau

SEQ ID NO: 159858 - RNA, 101 nt, Homo sapiens
uucucugggagcuaaagauagagccuuuggggcuaucugacuaaugagagggaagugggcagacaagaggcuggccccagucccaaggaacaagagauggu

SEQ ID NO: 159859 - RNA, 93 nt, Homo sapiens
caagucgcuagagacauaucaggggacauuaggauuggggaagacacuugacugcuagaaucagagguuggacacuauacauaaggacaggcu

SEQ ID NO: 159860 - RNA, 52 nt, Homo sapiens
auaccaaaauuggcagggagagaccauuuggcgccaguccccuaggagaugg

SEQ ID NO: 159861 - RNA, 54 nt, Homo sapiens
gugucccaugcccagaugauaaacacugagcugccaaaacauuuuuuuaaauac

SEQ ID NO: 159862 - RNA, 42 nt, Homo sapiens
ggaugugaaggagucucguaaacaaacuacaauucccggcgg

SEQ ID NO: 159863 - RNA, 49 nt, Homo sapiens
gggaggcaaaucugggagggugucugugcacgcaugugcacacuuaaau

SEQ ID NO: 159864 - RNA, 66 nt, Homo sapiens
ggcuauaccacugagauacugggguugccauauaugagaccucaaguggucuucaagugguccaga

SEQ ID NO: 159865 - RNA, 67 nt, Homo sapiens
ucaguucugauguuggcuucuguacaagagugugacccuggaagcucuuagaacuugccccuccuca

SEQ ID NO: 159866 - RNA, 62 nt, Homo sapiens
cugcucucuguccacccuccuucuccaggcuucccugccaauucaagagccuuaggauucag

SEQ ID NO: 159867 - RNA, 39 nt, Homo sapiens
gggcaaguggcagagcccagaagccugugcucuccagag

SEQ ID NO: 159868 - RNA, 54 nt, Homo sapiens
uuccucuuaaucucucaauuaguccuggacgcaucuggaaagaaagcagagguu

SEQ ID NO: 159869 - RNA, 511 nt, Homo sapiens
cgguggaccuuucaaaccccaacacuggccuuuuuuuucuggcagauaauuucuuuauuuuuuuuuuaacuuuuuuuuuuuuggagacaggaucucagucugucacccaggcggcuagaguggagugacauaaacaugucucacugcagccucuacuuccugggcugaagugauccuuuuuuuuuuuuuuuuuuuuugagacagagucucucucuguugcccaggcugcagugcaguggcacagucucggcuuacugcaaccuccaccucccagguucacgccauucuccugccucagccucccgaguaacugggacuacaggcgcccgccaccacgcccggcuaauuuuuuguauuuuuaguagagacaggguuucacgguguuagccaggauggugucgaucuccugaccuugugauccgccugccucggccucccaaagugcugggauuacaggugugagcuacugugccuggccuagauauuuuaaaagcaguggcggcagcagcau

SEQ ID NO: 159870 - RNA, 46 nt, Homo sapiens
gcgagauccucgaagaaugguguccccacuucgccgauacacccgc

SEQ ID NO: 159871 - RNA, 45 nt, Homo sapiens
cccuggauaccaguaaacuguccacugaccagcgguuacccccau

SEQ ID NO: 159872 - RNA, 42 nt, Homo sapiens
ccuggauuuuuagggggugaggggccaauggguggcccccag

SEQ ID NO: 159873 - RNA, 42 nt, Homo sapiens
auccucuuucuagcaugaaugaaggaugccaagaaugagaaa

SEQ ID NO: 159874 - RNA, 43 nt, Homo sapiens
ggagggccuaaagcacuuguaacuuugaaccgucugucuggag

SEQ ID NO: 159875 - RNA, 42 nt, Homo sapiens
ccuccucaccacucuuccccuugcaguggaggagagagccag

SEQ ID NO: 159876 - RNA, 44 nt, Homo sapiens
ggcgggcaugaggcagggagugaaagcggggauggcgggggaaa

SEQ ID NO: 159877 - RNA, 55 nt, Homo sapiens
uuucuauaccagaacugcggucacuauuuuguaauaaauguggcuggagcugauc

SEQ ID NO: 159878 - RNA, 31 nt, Homo sapiens
ugcuguuugaaggucucugugguggccaaag

SEQ ID NO: 159879 - RNA, 45 nt, Homo sapiens
cagcccuaguucugcgucccccccacgcuuuggaccuuaugcagc

SEQ ID NO: 159880 - RNA, 64 nt, Homo sapiens
uugagguggcagauuagagaguugagguucagaagcuuuggaucacagagaucagauguccagg

SEQ ID NO: 159881 - RNA, 42 nt, Homo sapiens
ggcccaggaacccacccugcuggaauuagcgauuugcuggcu

SEQ ID NO: 159882 - RNA, 42 nt, Homo sapiens
uccagcaggguggguuccugggccugcagcccacagguggag

SEQ ID NO: 159883 - RNA, 48 nt, Homo sapiens
uaggcugggacuggggacccgacggcggcgacagcggcgaggggagcg

SEQ ID NO: 159884 - RNA, 51 nt, Homo sapiens
guacucuuuuguugaaaaugauaauugagucauuuaauuauaaauacucag

SEQ ID NO: 159885 - RNA, 24 nt, Homo sapiens
aagcugcauacgugaggcuuaccu

SEQ ID NO: 159886 - RNA, 49 nt, Homo sapiens
uguuuguguguccaugcauauaauuagguaagcaaagauacuaugugcc

SEQ ID NO: 159887 - RNA, 49 nt, Homo sapiens
augugaaucaggacucggagcucaaguucaaugaguacuggagauugau

SEQ ID NO: 159888 - RNA, 43 nt, Homo sapiens
aacccgagugaggcuguggggagccugcaagcucccugggaga

SEQ ID NO: 159889 - RNA, 88 nt, Homo sapiens
gaagugaguggaagggugaugggucacccaagcagaggggaucaggaauggccgagguccuugcucggugugugugugugugugugug

SEQ ID NO: 159890 - RNA, 65 nt, Homo sapiens
acaaaugaguaaaugaaaaagggaaugaaugaaugaaugugcaagagagugaaugcauuauugaa

SEQ ID NO: 159891 - RNA, 41 nt, Homo sapiens
aaaaaacuguccuaaagucugagucccgccgcuugguucag

SEQ ID NO: 159892 - RNA, 39 nt, Homo sapiens
ggagaaccuguugaggcgguugagcuggggagcaccugg

SEQ ID NO: 159893 - RNA, 46 nt, Homo sapiens
cagcaggcgaagcagggagaugucagacugcuacacggagcuggag

SEQ ID NO: 159894 - RNA, 60 nt, Homo sapiens
gcagcagcagcagcagcagcagagaccucuccacuuucccuuagccccucugcuggguag

SEQ ID NO: 159895 - RNA, 220 nt, Homo sapiens
aaccgagggguguggccgggcgugguggugagugccuauagucuuagcuauuguggguggguggaggacuggggggaguuggggugggaggaucacuugagcccaggaauucaagaccagccugcgcaacauagcaagaaccaucucuauuaaaauaaauaaauaaacugagggguggugaugcugugagaaagaggaagaaagagaaaggagacagagg

SEQ ID NO: 159896 - RNA, 56 nt, Homo sapiens
gggguagagagaggaagaggaccuggggaaggggcuggagaagaaacucuggguga

SEQ ID NO: 159897 - RNA, 45 nt, Homo sapiens
ugcauggaggcaaugaccuuugagcugaguuuaaagggugauuag

SEQ ID NO: 159898 - RNA, 45 nt, Homo sapiens
gaggagaggugauuauuucguagcauagucaguggugugauuuca

SEQ ID NO: 159899 - RNA, 22 nt, Homo sapiens
cgagguucagaaccagacacug

SEQ ID NO: 159900 - RNA, 54 nt, Homo sapiens
gggugcucccugagggaaguugcagacccugcagaaaugcaguggccuccaggg

SEQ ID NO: 159901 - RNA, 50 nt, Homo sapiens
agaugaagcugcuuuccagaagcugaugagcaacuuggacagcaacaggg

SEQ ID NO: 159902 - RNA, 114 nt, Homo sapiens
ucuuccuguccugcaucgccaugauguguaacgaauucuuugaaggcuucccagauaagcagcccaggaagaaaugaaaacuccucugaugugguuggggggucugccagcugg

SEQ ID NO: 159903 - RNA, 57 nt, Homo sapiens
agugggcacuuuuuuuuuuccacccuggcuccuucagacacgugcuugaugcugagc

SEQ ID NO: 159904 - RNA, 45 nt, Homo sapiens
acuguccuucaggggauccagaaguugaggaguauggcugggcag

SEQ ID NO: 159905 - RNA, 66 nt, Homo sapiens
gaugcugaaauugcaaggcugauggaagacuuggaccggaacaaggaccaggaggugaacuuccag

SEQ ID NO: 159906 - RNA, 50 nt, Homo sapiens
uauuuucagcccuugagggcuucauuguagaucaaagccaaggcccccag

SEQ ID NO: 159907 - RNA, 49 nt, Homo sapiens
ggagacacccucuggggguccucucugagucaaauccagugguggguaa

SEQ ID NO: 159908 - RNA, 37 nt, Homo sapiens
ccugggguggggcaaguccccuuucucaucacagcgc

SEQ ID NO: 159909 - RNA, 52 nt, Homo sapiens
auugaaucauuguccaucaucuggauuaguguuuucaggcagaagggaagag

SEQ ID NO: 159910 - RNA, 24 nt, Homo sapiens
cgcugcggggacagucggguuggu

SEQ ID NO: 159911 - RNA, 43 nt, Homo sapiens
uuucuugagccucuggcaggggcccgccguggggcuguggccu

SEQ ID NO: 159912 - RNA, 41 nt, Homo sapiens
ugaggagagggaagaggaguuucagugacaggaagcccgcu

SEQ ID NO: 159913 - RNA, 43 nt, Homo sapiens
gauacuccuggagguggggagugaggcagggauaaggaaggag

SEQ ID NO: 159914 - RNA, 45 nt, Homo sapiens
cugcacucuccaaauaaccaaaccagcagauggcuauggcucugg

SEQ ID NO: 159915 - RNA, 42 nt, Homo sapiens
aaaugccuaugaagugauaccggguggugugaaaggugguac

SEQ ID NO: 159916 - RNA, 62 nt, Homo sapiens
cccacgccaaagugcccagagccauguccacccccgaagugcccugagccuuaccugccucc

SEQ ID NO: 159917 - RNA, 65 nt, Homo sapiens
gccugccaaagcguccagagccauguccaccccugaagugcccugagcccugcccaccaccaaag

SEQ ID NO: 159918 - RNA, 38 nt, Homo sapiens
aaaggaaacauuuugcugucggggaucaucaugggcag

SEQ ID NO: 159919 - RNA, 42 nt, Homo sapiens
gcgcggggcucgggcuaguugcugaggcagcugcuggagcag

SEQ ID NO: 159920 - RNA, 678 nt, Homo sapiens
gggcccccagcccaccugcgaggggcaaggaaaugcgagcucaggaugcccucuagcccaccagaaagagccuggccccuccccaggccagaggagcaggaauucccaacaccaaagccaggaagaagcggggcgguggggacccacaggccuggaggagcggcguggggcggguggacacuugcggcuguguucuggaagcaaggucauuucuguuccaucccauuacacaauucaugugcuuagauuagaagauucaguccagaucccacccaaagggacaagcauuucugaagggccaagcacacgggucugcacuccaugagcuggcagcaggcaggcagccauguagggccaggggacccagggcgcaggaaccccagcucccuccaguccuccagccccaccgcucggccagccacccuccucugaaguacccagcugggguccucaccaggggcccagaagcccucgccuacccagcucuagccacaggcaaacaagcgcauucccaaaggggaaccagcuugcggacacacaggcuccccgacacuacgcagacagagccagcagaaguuuaaaggaaacagagaccgggccucaaagcauucccagcagaagcugcccgagagcccggguggcgcacguuacccaguccuccaaggccggcugguccga

SEQ ID NO: 159921 - RNA, 1661 nt, Homo sapiens
caaugcuccucauccuggucugucuuggguuccugcaagaggaagggcauguaagggcaggagcuggcgccagcucacccagggccaccacagccauccucugaccuggcuuccaggugagggaccugagacgcagaggcgcgugugccuggccacacaaugcugaggagacaggacccggcccagcaggugaggggacggcaguggcgccuccugagcacgaugcucugcgcccuguccccauccgccgcaaucccgggugugcccugucccccuccgcccauuucacaaauggggagccuagagcuccgaaggcacuuagcugcugccagaccaagcccucucacccuccugcccucuggggugcgguucuuuacacacccgucuccuuccuucaaccaguggaaggcagcgaacuggcccgcucagcacaccgcggcccagggccacggcaggcgcucacaaucgagcacacgcgugugcacacacaugugcacagaucagugucagaagcaucgaccugcgagcucacagagcugggagcagagcacccacgcacaccccgaauggcuauggaagcugcagggcgccagggacacugggagucccugcucucauggcaaagcagggacgggggacuuaaaagccaccaacaggaaaaucggggaaaaaagggagauggugguaacaguuggacacuauuucuuggcaaaaccguggaaaaacacguucuacaccagcagguggcaaauuguggccgccaucuguguuugcaaauaaaguuuaacuggaguuuggcuaugccuguucauuuucucaggccgcugcacacuacuugcacaggugaccagcaacacagaccaugugcuccacagagaccucagccagggccaccccugcucuugaaagugccaaggggggugggguggggacagcagcuccaccucuggcagagagcauggccuucucucuccacacugcaaacgcaugcacacgcuuccugaccacaggcccgccaccaguuuucaccuacagaugauacuggcuuauggaaaaugaucuguguaccgggaaauucuuugcaacacugccuguaacagcacaaaaaacggcaacaagcucaauggucacugacagauggcagaaugagcagcggccucuagacccaaaagacgcucugcagcuguggguaagagaaacccugggcacugacaccccuggccuccaggacacacugccagggaaggggcaggacuguggaaagugugagcaggaugcuucguuucugugagcaccagcagggaagccacacaggggccucugccucugcugugggggccucagugacccacggcaaggggcagagagagggcacugggcaucguuagaaccagggccagcaugucugucugccuggaaauuucacaccgcaaucgguugcccgcagcccagccuggagccuccguacucugggagaggaccucggccccagguagcaugcaccgcagcccugagguggcaucucaggccguguggccggguguggccggcgccugcugguuuauaaaagccaauugcaccacacuguaagcaaguuccuaaccgaaucgcagggcaacaaaaaggcacaaccccaaggccugccccauaccugcauccag

SEQ ID NO: 159922 - RNA, 721 nt, Homo sapiens
aaguccuggcaagccaggggaagagagagucaguggcgcagauggcaucacugugcccagucucaggagagcguacugagcccugggucuaaccggguggggugcgcaaggggcagcuaagccgccagaccccucgcuggcagggucuccacaaggcagagaagccagggucagagacagcccaugaaaggcaaggccgggggagagagcagggaaaggggccuuucagauggcaacgggguuucugagacgugcuggaaacaacauucccagaguaguuaaaaagucaacgcugaacugcucucaaauguaacaaagaacaacuaagaguuugaaaaacaaagaagacugagugaagccgccaggcacagagcuccaggcucuccagggccacaccuccaaccccaggcaccucacacggacaguucaaggccaggcacagagcuccgggcucuccagggccacaccuccaacccaggcaccucacacggacaguucaagauacacaguggccgagaugccccugucaccgcggaaaccaggacgacccaucagcagggcagucgaugacggccccacgagcgguccccagaugcggccaagcccccaccgcgaacuccaaagcgaggacuccgagggcccgagaagucgccuguccugcugcugcggcucagggacacucacgucuuccacguucccggacguccuguccuuccagcag

SEQ ID NO: 159923 - RNA, 53 nt, Homo sapiens
cuccaccaaguacuuguuggaggcgccccgagagccuggcaccaggcuuggaa

SEQ ID NO: 159924 - RNA, 47 nt, Homo sapiens
aaguaauucgcugaaguggaagugagaagccagggacucuugaaaag

SEQ ID NO: 159925 - RNA, 42 nt, Homo sapiens
cccgaagugcccugagcccugcccaccaucaaaguguccaca

SEQ ID NO: 159926 - RNA, 45 nt, Homo sapiens
guccacccaagagcaaguaacagcuucaggauucaucaggagcau

SEQ ID NO: 159927 - RNA, 52 nt, Homo sapiens
cugaccuucagaguagagaaagguaaaccagagacaaaagacagaaagguag

SEQ ID NO: 159928 - RNA, 46 nt, Homo sapiens
ggagauuuaccuugaaaaauauaauuguccuuuccugaaaagauga

SEQ ID NO: 159929 - RNA, 45 nt, Homo sapiens
cacaaucccuaucuugucaucaccagcaguaaccucagucaagua

SEQ ID NO: 159930 - RNA, 46 nt, Homo sapiens
gacaaauggucuacuguguaaauuuuagaaugaggcagacaaaagu

SEQ ID NO: 159931 - RNA, 38 nt, Homo sapiens
cccacagugggcagcagugggggaggugauggagaaua

SEQ ID NO: 159932 - RNA, 44 nt, Homo sapiens
guggaauuauggaaaauaugaguucaacugggagaugaaaggag

SEQ ID NO: 159933 - RNA, 51 nt, Homo sapiens
gacucgaugcaccgcucagucucuguagggcuggagauuuuugccuuugga

SEQ ID NO: 159934 - RNA, 46 nt, Homo sapiens
cucuccaagacagaguuccuaagcuucaugaauacagaacuagcug

SEQ ID NO: 159935 - RNA, 46 nt, Homo sapiens
ugugaaggcagcuaguucuguauucaugaagcuuaggaacucuguc

SEQ ID NO: 159936 - RNA, 42 nt, Homo sapiens
cugcagaaccagaaggacccugguguccuugaccgcaugaug

SEQ ID NO: 159937 - RNA, 149 nt, Homo sapiens
gaaaggggguggguuugaaggccagggccaagggguccucagguccgcuucugggaagggacagccuugaggaaggagucauggcaagccauagcuaggccaccaaucagauuaagaaauucugagaaaucuagcugaccaucacuguu

SEQ ID NO: 159938 - RNA, 36 nt, Homo sapiens
cugucaucaucuccacagcccacccauccccugagc

SEQ ID NO: 159939 - RNA, 36 nt, Homo sapiens
gcaugaggugguuagugugcucaggggauggguggg

SEQ ID NO: 159940 - RNA, 46 nt, Homo sapiens
guuaguaucagccauaucuaagaaucccauuuacuagugccaagag

SEQ ID NO: 159941 - RNA, 42 nt, Homo sapiens
gauguuuacauuucacaaauucgcuggggauaaaggcuacuu

SEQ ID NO: 159942 - RNA, 42 nt, Homo sapiens
cuguggacaaaauaaugaaggaccuggaccaguguagagaug

SEQ ID NO: 159943 - RNA, 48 nt, Homo sapiens
cgggccucaccauugcaugcaaugacuauuuuguaguacacaugaagc

SEQ ID NO: 159944 - RNA, 79 nt, Homo sapiens
aagggucgcuuaaggaaucugccccacagcuucccccauagaaggauuucaugagcagaucaggacacuuagcaaaugu

SEQ ID NO: 159945 - RNA, 57 nt, Homo sapiens
aaaaauaaaaucuaacucucauuugacaagcagagaaagaaaaguuaaauaccagau

SEQ ID NO: 159946 - RNA, 45 nt, Homo sapiens
aaugggugaggcguuaaaaaguuccaaauuuucaccuggcccaaa

SEQ ID NO: 159947 - RNA, 46 nt, Homo sapiens
augggugaggcguuaaaaaguuccaaauuuucaccuggcccaaaug

SEQ ID NO: 159948 - RNA, 40 nt, Homo sapiens
uccaagggguagacucucugccccagaaguggggcagaca

SEQ ID NO: 159949 - RNA, 44 nt, Homo sapiens
ccagagaaggagugggguggggggugguuaacaggguaugcugg

SEQ ID NO: 159950 - RNA, 57 nt, Homo sapiens
ugggaaggcuggagaagagacgggggugaagggagggcuggggaauggagggagaag

SEQ ID NO: 159951 - RNA, 48 nt, Homo sapiens
uuaaucccacucucucccuaugcuaggaugugcaagaggcuagaagaa

SEQ ID NO: 159952 - RNA, 66 nt, Homo sapiens
cccaagccuggcucccucccagcccggggccuuggcaucgggagggugggggcaagauacaggggg

SEQ ID NO: 159953 - RNA, 45 nt, Homo sapiens
gugagccgcuaccagggccgccugcugcugcaucagcugggggga

SEQ ID NO: 159954 - RNA, 42 nt, Homo sapiens
gugauggggguggcgaugaggccauuggcauugauggcagcc

SEQ ID NO: 159955 - RNA, 44 nt, Homo sapiens
cagaggagcagacacacacacaggcagagaaccagucagcaagu

SEQ ID NO: 159956 - RNA, 71 nt, Homo sapiens
gaagcaggccaaggagauggacgaggaagacaaggcuuucaagcagaaacaaaaagaggagcagaagaaac

SEQ ID NO: 159957 - RNA, 43 nt, Homo sapiens
cuauguaccuguugccacuuuugaaaaucuacagucaaugugg

SEQ ID NO: 159958 - RNA, 45 nt, Homo sapiens
ggaauaagaaugucccauaccgaauccgugugcggcugucccgaa

SEQ ID NO: 159959 - RNA, 46 nt, Homo sapiens
ccauggagugggcuucaagaagugugccccucgggcacucaaagag

SEQ ID NO: 159960 - RNA, 44 nt, Homo sapiens
aacuuggacccggcagaauggcucccgcaaagaaggguggcaag

SEQ ID NO: 159961 - RNA, 53 nt, Homo sapiens
ucugagguggaagauggagggagccacagaggagaaaagccaagagggaggga

SEQ ID NO: 159962 - RNA, 43 nt, Homo sapiens
gaugggaggguagaguuguuuuugagagaaccaagaggugaug

SEQ ID NO: 159963 - RNA, 46 nt, Homo sapiens
auaauccuccagcugggccuggagcugcugcagggcuugcuuagag

SEQ ID NO: 159964 - RNA, 141 nt, Homo sapiens
ggagcaccucccgcugcuucccuuccuccuccagggcccgguucagugucugcugcuccugccccaggcgggccagcccccgcugagccuccucuaggcgugccuccagugcccgcuuggcugcugccagacuccccuccu

SEQ ID NO: 159965 - RNA, 43 nt, Homo sapiens
gggaagcaggguuggacugagaaaagguaaaacuuggguucaa

SEQ ID NO: 159966 - RNA, 44 nt, Homo sapiens
accucgagucuccuucagcugcugcuccaaacccaggaugcgcc

SEQ ID NO: 159967 - RNA, 46 nt, Homo sapiens
acaguccugucgcaguugcuggagggucuuuuguagcuggagguuc

SEQ ID NO: 159968 - RNA, 58 nt, Homo sapiens
gcuauuugaauuagcaaggaggcucauggcugguggguaaaagcugaugagaagggag

SEQ ID NO: 159969 - RNA, 17 nt, Homo sapiens
cgcgaagggcgggccag

SEQ ID NO: 159970 - RNA, 44 nt, Homo sapiens
cgacuacgcugauuuccaguauuugaagcaaguucucggccaga

SEQ ID NO: 159971 - RNA, 49 nt, Homo sapiens
gaaaaguguaaucuuaggaaugcuggcagccauuaaguggcccagacuu

SEQ ID NO: 159972 - RNA, 47 nt, Homo sapiens
agagaagaagcuggagggauaagcagugguacgggauuaaaaaguaa

SEQ ID NO: 159973 - RNA, 45 nt, Homo sapiens
ugaugagagcaucagccaaacugggcccaggaggcacugucacca

SEQ ID NO: 159974 - RNA, 50 nt, Homo sapiens
aagaccgcugggaaccggcuuucugggcuuuuggaggcagaggaggaaga

SEQ ID NO: 159975 - RNA, 88 nt, Homo sapiens
ggggguuucacagaggcaagauccgggccugggaaaagggaggggaggaggcaaagaggagcccugaagggagaaaccccggacaaag

SEQ ID NO: 159976 - RNA, 48 nt, Homo sapiens
aagcugaggggauuaauguguucccaggcugucuuuuacaaacaucag

SEQ ID NO: 159977 - RNA, 55 nt, Homo sapiens
gaauccggagaugaugaguaucaaggggaccagucagacacagaggacgaagugg

SEQ ID NO: 159978 - RNA, 51 nt, Homo sapiens; identical to SEQ ID NO: 75970

SEQ ID NO: 159979 - RNA, 37 nt, Homo sapiens
agcuuaaggccucgaaaggucaacaccccggcuggua

SEQ ID NO: 159980 - RNA, 42 nt, Homo sapiens
ucauucagugacagugccacuuguuggggagccaggccccaa

SEQ ID NO: 159981 - RNA, 45 nt, Homo sapiens
cgaggucgauggguaaaagaugaaaauguugaguuugacucugau

SEQ ID NO: 159982 - RNA, 44 nt, Homo sapiens
agagcuggaaacaucagagaaaauagcaucgaucaggaaagagg

SEQ ID NO: 159983 - RNA, 45 nt, Homo sapiens
cagggcucgucuucuuguggggcucaugggugcaggggcugagac

SEQ ID NO: 159984 - RNA, 36 nt, Homo sapiens
agauauuaauaaguucugcauacaaaggauuucaga

SEQ ID NO: 159985 - RNA, 34 nt, Homo sapiens
uccccacuauaacaguugcugccgccggaaguac

SEQ ID NO: 159986 - RNA, 42 nt, Homo sapiens
cagccgggaaaggaaagaaagcagaauccaaaacaucagaau

SEQ ID NO: 159987 - RNA, 77 nt, Homo sapiens
cagauguuucuugccugcacggugggcagucagcauggccaggguguccaguaccggucgaugggggcagauggcac

SEQ ID NO: 159988 - RNA, 32 nt, Homo sapiens
aagaggauaagugguccaggggaagaggguug

SEQ ID NO: 159989 - RNA, 47 nt, Homo sapiens
uguuauuaauuaggacagcaggaguaccuaggauucuuuggcggcca

SEQ ID NO: 159990 - RNA, 41 nt, Homo sapiens
aguuacauuccagaggaugaggcgcugaugcuucgggaugg

SEQ ID NO: 159991 - RNA, 46 nt, Homo sapiens
gaagcaucagcgccucauccucuggaauguaacuggcuaggagguc

SEQ ID NO: 159992 - RNA, 46 nt, Homo sapiens
uuucuagaguucaaaggucagaggucaauguagcgaggaguugugg

SEQ ID NO: 159993 - RNA, 41 nt, Homo sapiens
aggugcugagugaagucaggcccauagagggccgugagcag

SEQ ID NO: 159994 - RNA, 74 nt, Homo sapiens
ucagcuucggcgcgaggcacuugggcaggauccccgggcugcacccuccuccgcccgcgccccguggggcugga

SEQ ID NO: 159995 - RNA, 41 nt, Homo sapiens
gggugggcacauucccacuuccagccccacggggcgcgggc

SEQ ID NO: 159996 - RNA, 38 nt, Homo sapiens
ucggagcaaccacccgagcagacggaguacacggagca

SEQ ID NO: 159997 - RNA, 56 nt, Homo sapiens
aggggcugcggaaaaguugggagccccgggugccgcuuugucgcggggccgcggag

SEQ ID NO: 159998 - RNA, 40 nt, Homo sapiens
gcugauuucucgcuuccaaucaggcugagcaaaaaagugg

SEQ ID NO: 159999 - RNA, 47 nt, Homo sapiens
ccaccuucuccccuccuccucccccaaaucacacacacacauuccag

SEQ ID NO: 160000 - RNA, 44 nt, Homo sapiens
guucccaccagaaguaaucauacaaggucuggagcauccugagu

SEQ ID NO: 160001 - RNA, 46 nt, Homo sapiens
uucuggugggaacgucuguggcugccugugaacuugaccugggccg

SEQ ID NO: 160002 - RNA, 41 nt, Homo sapiens
ccggcccagucuccucaagaaguuccgagaagccagguggg

SEQ ID NO: 160003 - RNA, 46 nt, Homo sapiens
cacagcugguagaagaugaacgcagugaccgggaagaaacagagag

SEQ ID NO: 160004 - RNA, 30 nt, Homo sapiens
cucuggggaaaaaggagaaagugagaggag

SEQ ID NO: 160005 - RNA, 42 nt, Homo sapiens
uaggcugguuagaauuugguuuaaaggcaacugggugacaag

SEQ ID NO: 160006 - RNA, 52 nt, Homo sapiens
cagcuagccuagcugaagagaagagggaagggggaagaggccagagaaagga

SEQ ID NO: 160007 - RNA, 42 nt, Homo sapiens
uuaaagccagaauuacggcuagcaccuagcauuucagcagag

SEQ ID NO: 160008 - RNA, 42 nt, Homo sapiens
gaaagcccacugcuggucagacuucggcuacagcgguugaca

SEQ ID NO: 160009 - RNA, 45 nt, Homo sapiens
caaaauccugacagaugacuuugcagacaaggagggucuggaaau

SEQ ID NO: 160010 - RNA, 43 nt, Homo sapiens
gaguaagaggaggccagggacuucuacaaagaacgugaugagu

SEQ ID NO: 160011 - RNA, 32 nt, Homo sapiens
uacucccuuaauucucucauugagcaccaugu

SEQ ID NO: 160012 - RNA, 28 nt, Homo sapiens
gaaggauaaagguagguucccauuaaga

SEQ ID NO: 160013 - RNA, 24 nt, Homo sapiens
uguauuaauagguagagcuacaga

SEQ ID NO: 160014 - RNA, 48 nt, Homo sapiens
acauuguugcagcuaugacuugcaauagaauggaggugauaguagagg

SEQ ID NO: 160015 - RNA, 37 nt, Homo sapiens
acguccaaauauggguauguccugaaagauuccugga

SEQ ID NO: 160016 - RNA, 49 nt, Homo sapiens
uaugcuggcauuguagcugagacaccaaacgucaaaaacaagcucaggu

SEQ ID NO: 160017 - RNA, 45 nt, Homo sapiens
ccuugagucagaugucuggagaacuaagcaaagauggugaccuga

SEQ ID NO: 160018 - RNA, 49 nt, Homo sapiens
ugcagacuaucauaucccccucuauaugggcauaagcaaucugacaaau

SEQ ID NO: 160019 - RNA, 80 nt, Homo sapiens
gcagguaaaggcacuuggcugaccaucaaugcuuuccacaauguauucaucgccagucaccuccacuuggccuucauaga

SEQ ID NO: 160020 - RNA, 46 nt, Homo sapiens
accgggacaguagcucugaggacgaaucuucccggccuacagaaau

SEQ ID NO: 160021 - RNA, 27 nt, Homo sapiens
acagcaacgcaagaagcagcuagcaga

SEQ ID NO: 160022 - RNA, 43 nt, Homo sapiens
caguggagucugaagagauugcagagcugcaacaggcaguggu

SEQ ID NO: 160023 - RNA, 55 nt, Homo sapiens
cuggguuugcgaauggguaggacgcaccccuagaauggguagcacgggggugggc

SEQ ID NO: 160024 - RNA, 46 nt, Homo sapiens
ugucgacuaucgaaagaaaggauauguuacuccugucaaaaaucag

SEQ ID NO: 160025 - RNA, 91 nt, Homo sapiens
cuguggagggggcuacaugaccaaugccuuccaauaugugcagaagaaccgggguauugacucugaagaugccuacccauaugugggacag

SEQ ID NO: 160026 - RNA, 50 nt, Homo sapiens
aggaagagaguuguauguacaacccaacaggcaaggcagcuaaaugcaga

SEQ ID NO: 160027 - RNA, 50 nt, Homo sapiens
cagccaaauccauccugcucuuccauuucuuccacgauggugcaguguaa

SEQ ID NO: 160028 - RNA, 58 nt, Homo sapiens
auaaaguauuuaucuccugucuacaguuuaauaaauagcaucuaguacacauucauuu

SEQ ID NO: 160029 - RNA, 46 nt, Homo sapiens
ccacuggcaucucuggaagaaaaccuauggcaaacaauacaaggaa

SEQ ID NO: 160030 - RNA, 45 nt, Homo sapiens
uuugugaugcuucacaaccuggagcauucaaugggaaugcacuca

SEQ ID NO: 160031 - RNA, 47 nt, Homo sapiens
auaagucaaacccuaaucggauauugccugauucuguggacuggaga

SEQ ID NO: 160032 - RNA, 85 nt, Homo sapiens
ugugggggcccuggaagcacagcugaagcugaaaacaggaaagcuggugucucucagugcccagaaccugguggauugcucaacu

SEQ ID NO: 160033 - RNA, 31 nt, Homo sapiens
aacaagggcaucgacucagacgcuuccuauc

SEQ ID NO: 160034 - RNA, 45 nt, Homo sapiens
agcuggggccacaacuuuggugaagaaggauauauucggauggca

SEQ ID NO: 160035 - RNA, 51 nt, Homo sapiens
caagaaauaugaagcacuuucucuuaacuuaauuuuuccugcuguauccag

SEQ ID NO: 160036 - RNA, 46 nt, Homo sapiens
gguucuucuuaggcaucaacaucucugcggcugcaggggccggggc

SEQ ID NO: 160037 - RNA, 46 nt, Homo sapiens
cgggaaggcaaccggagaagggaagggggaggggaaacggggacaa

SEQ ID NO: 160038 - RNA, 64 nt, Homo sapiens
aaaggauccaguagaaccucuacagacuucauucgaagaaccuccuuuagcuccaaagaaagag

SEQ ID NO: 160039 - RNA, 42 nt, Homo sapiens
guguguggaagugucaaucuaacgaaauaaauaaacuuagag

SEQ ID NO: 160040 - RNA, 46 nt, Homo sapiens
ucuauuuuacagaugaggaaauagaaauccagagaggcuaaaugac

SEQ ID NO: 160041 - RNA, 63 nt, Homo sapiens
guuuacccuucuuccucuuucccuaacaauauaccuggcaucagacugcaucugaaacauggg

SEQ ID NO: 160042 - RNA, 46 nt, Homo sapiens
aggcagcucagacagaaaagaaaaaaaguacagaauuugagaagau

SEQ ID NO: 160043 - RNA, 97 nt, Homo sapiens
gagggugaaaaagagaaaugugagcauccgcucccccaccaccccgcccagccccuagccccacucccugccuccugaaaugguucccacccagaac

SEQ ID NO: 160044 - RNA, 55 nt, Homo sapiens
uuuccuccugccuuccugaguaaggcaggauuggcaguggcugaccccagcccua

SEQ ID NO: 160045 - RNA, 59 nt, Homo sapiens
acacagggcggcuuagaagaugugaggucugaacaugagaaaugaggcuuagggcacaa

SEQ ID NO: 160046 - RNA, 36 nt, Homo sapiens
uuuccaccuaggaaagucucaaggaaacaggucuug

SEQ ID NO: 160047 - RNA, 38 nt, Homo sapiens
agaaggacaagaccuguuuccuugagacuuuccuaggu

SEQ ID NO: 160048 - RNA, 46 nt, Homo sapiens
uuucaggagggauccuggggagaccgcuccaggacaugugcgcaag

SEQ ID NO: 160049 - RNA, 46 nt, Homo sapiens
cccggcucugcgucuaccccuacuacacagccaccuguugccgcuc

SEQ ID NO: 160050 - RNA, 46 nt, Homo sapiens
uguuacaggggcgcuuccuggagggccgcaguugaggagggcaucg

SEQ ID NO: 160051 - RNA, 46 nt, Homo sapiens
ggugagaacaguugcucggagaagucacguugaacuccguccccag

SEQ ID NO: 160052 - RNA, 42 nt, Homo sapiens
gagaagccggcagguucgcuguguugggaacaauggugauga

SEQ ID NO: 160053 - RNA, 46 nt, Homo sapiens
agcugcguucauccaguuccucucccgacucacgggagaugcagag

SEQ ID NO: 160054 - RNA, 47 nt, Homo sapiens
cucccuccuccuuccaagugcaggggucagagucuuacccggcugaa

SEQ ID NO: 160055 - RNA, 42 nt, Homo sapiens
ccuccuccaauccuugagaaccccaccccagagcccccuguc

SEQ ID NO: 160056 - RNA, 46 nt, Homo sapiens
ggauaagcacucaagagcucugaacacacagaaucaugggcaucag

SEQ ID NO: 160057 - RNA, 54 nt, Homo sapiens
cugcugagcaacggcccccaugccagcucccucuggagccucuuugcucccagu

SEQ ID NO: 160058 - RNA, 46 nt, Homo sapiens
ccccauccccccaagcagaaccucuaagcccugaaacugcucagac

SEQ ID NO: 160059 - RNA, 42 nt, Homo sapiens
ggcugccguuugcggagaauggcucugcucuuggaguagggg

SEQ ID NO: 160060 - RNA, 51 nt, Homo sapiens
cccuccugagucagccugguguugcccuuuauuccccuuaugugcauauga

SEQ ID NO: 160061 - RNA, 42 nt, Homo sapiens
ucggauaaagugggaugaacagacaucuaacacaaagggaga

SEQ ID NO: 160062 - RNA, 45 nt, Homo sapiens
agagcgcaugaagaggccaacgcugcccgaaaacucacagcagaa

SEQ ID NO: 160063 - RNA, 46 nt, Homo sapiens
gagaguucuccguugcucucucuuucccucagcccugccucugauc

SEQ ID NO: 160064 - RNA, 42 nt, Homo sapiens
acagaagcuguucaagaccccacgaagguagaagcccacguc

SEQ ID NO: 160065 - RNA, 34 nt, Homo sapiens
gagauuucacaagcagcucgaaaaacaggcaucc

SEQ ID NO: 160066 - RNA, 45 nt, Homo sapiens
gaaugaaauuuguuugacuggauuaggagaauguugaaguugggu

SEQ ID NO: 160067 - RNA, 57 nt, Homo sapiens
ucuuggaggaggugaguuuuaggcaggauuuggaacagggguuguggaaaaguugag

SEQ ID NO: 160068 - RNA, 46 nt, Homo sapiens
ccuacgguggucacagcagcauugaacuguguggggaagggcaugg

SEQ ID NO: 160069 - RNA, 44 nt, Homo sapiens
auaaguggcacugcugggaauagcugagcuuggaaauugagguc

SEQ ID NO: 160070 - RNA, 45 nt, Homo sapiens
agaagguuuccgguuccgguguaacguucgggcuccgucucaggg

SEQ ID NO: 160071 - RNA, 52 nt, Homo sapiens
gaugcucaucuucucaaccucuagcccagggcauacagcuguccacugugac

SEQ ID NO: 160072 - RNA, 33 nt, Homo sapiens
auuggagaaaucuccuuuuuaugaagacccaag

SEQ ID NO: 160073 - RNA, 44 nt, Homo sapiens
gacaggauccagcguauuguagguguuuugcagaagccacagau

SEQ ID NO: 160074 - RNA, 101 nt, Homo sapiens
uccgguaaccagcauacaccaucucauccgaaacagcgggguucggcuucuccuauggcaggaucuggggcgaaaagaucaagagauggugaacuggagac

SEQ ID NO: 160075 - RNA, 42 nt, Homo sapiens
gucuggccugggcccaugggcccccuuguccucccucucacu

SEQ ID NO: 160076 - RNA, 54 nt, Homo sapiens
acaacgggcggaggggaaggugucuuucaagucgguauuuacucugaacugagg

SEQ ID NO: 160077 - RNA, 46 nt, Homo sapiens
caccuuccccuccgcccguuguucgccagggcuauucgccagccug

SEQ ID NO: 160078 - RNA, 56 nt, Homo sapiens
agucaggugccuuaggggaggauccaggaacggauaccucgcccuuccgugcucgc

SEQ ID NO: 160079 - RNA, 46 nt, Homo sapiens
guucaucuugguccaugugaccgaccggucagaugcccggcuccag

SEQ ID NO: 160080 - RNA, 62 nt, Homo sapiens
cauguuuccccuaccccaccccaccccaggaaggcagaugagggguuagcaucgcugaguga

SEQ ID NO: 160081 - RNA, 42 nt, Homo sapiens
guucuaaguggcuucuuacuuuccuucauccgucacuuccaa

SEQ ID NO: 160082 - RNA, 46 nt, Homo sapiens
gagacaggggccugaguuagggagaaaagcauuuaauggugagugg

SEQ ID NO: 160083 - RNA, 109 nt, Homo sapiens
uuugaguuucugaggagcugaaaaucaaaaguccccuuaaccacaagauguuggugcucugaagggaaagacuggagaauuugagagagauaucugggagucagaaagg

SEQ ID NO: 160084 - RNA, 42 nt, Homo sapiens
ucacuguuuccauggggcucugggccuucaucacagcuggag

SEQ ID NO: 160085 - RNA, 50 nt, Homo sapiens
aauggaggcucaaggauagaugagcucugaguuucucaguacucccucaa

SEQ ID NO: 160086 - RNA, 47 nt, Homo sapiens
gugugauaaauacccuaaacugccuuuuuuucuuuuuugaggugggg

SEQ ID NO: 160087 - RNA, 42 nt, Homo sapiens
caggggugggauaaaaggaguuaaucacccaugcuucuuuuc

SEQ ID NO: 160088 - RNA, 45 nt, Homo sapiens
uuuuuaaggcucaccuuuaugccugacuucaugcaagugacucag

SEQ ID NO: 160089 - RNA, 25 nt, Homo sapiens
acagaauaaauggucagggugggcu

SEQ ID NO: 160090 - RNA, 46 nt, Homo sapiens
gguagagggcagagagaguugcacugugaggaaaagagcaaacucg

SEQ ID NO: 160091 - RNA, 42 nt, Homo sapiens
ggugccaggcuggucauauccguggggcugcagagcaggcaa

SEQ ID NO: 160092 - RNA, 44 nt, Homo sapiens
agcucuuuuacuuaccuguauuuugaggacaagaaagcugaaug

SEQ ID NO: 160093 - RNA, 46 nt, Homo sapiens
uauuuaaaaucaccagccaggcuguguuggugccugccgaguaaaa

SEQ ID NO: 160094 - RNA, 33 nt, Homo sapiens
ugggcagaggguuggaaggauagggacuagaaa

SEQ ID NO: 160095 - RNA, 43 nt, Homo sapiens
ugcgugcgugugugugcgcgcgcuaguguguggacaaggaggu

SEQ ID NO: 160096 - RNA, 64 nt, Homo sapiens
uauuggggaaggcaggaaagggaaaaggagaguaguagcugaagagcaagaggaggacauggag

SEQ ID NO: 160097 - RNA, 41 nt, Homo sapiens
uaaguuuuaaaucauuaaaaucuucuacuuaaaauggcgaa

SEQ ID NO: 160098 - RNA, 31 nt, Homo sapiens
gggccaugugaggcggggucgcggucaacuu

SEQ ID NO: 160099 - RNA, 46 nt, Homo sapiens
aggccugaaugauacuuucaaagaacuagaauuucugaguauggcu

SEQ ID NO: 160100 - RNA, 45 nt, Homo sapiens
uuuuuccuuuguugaauguauaguuggagcuuagugauaauauaa

SEQ ID NO: 160101 - RNA, 81 nt, Homo sapiens
uugaaaagucuugaccuguuuaacugugagaucacaaaccuggaagauuauagagaaaguauuuuugaacuacugcagcaa

SEQ ID NO: 160102 - RNA, 45 nt, Homo sapiens
agauggauuugaucaggaggauaaugaagcgccggacucugaaga

SEQ ID NO: 160103 - RNA, 102 nt, Homo sapiens
gaggaagaggaaaaugaagcugguccaccggaaggauaugaggaagaggaggaggaagaggaagaggaggaugaggaugaggaugaagaugaagaugaagca

SEQ ID NO: 160104 - RNA, 65 nt, Homo sapiens
gguucagaguugggagagggagaagaggaagugggccucucauacuuaaugaaagaagaaauuca

SEQ ID NO: 160105 - RNA, 60 nt, Homo sapiens
gagugccacucaccuuuguaucucagcaucuaguacacugacugguacaugguaggcuca

SEQ ID NO: 160106 - RNA, 47 nt, Homo sapiens
ggaggucuucgaggggagaagaggaaacgagaugcugaagacgaugg

SEQ ID NO: 160107 - RNA, 57 nt, Homo sapiens
agagugaucacaucuuuguuucuucauguacgauagcuaucccuacagaagauaaug

SEQ ID NO: 160108 - RNA, 44 nt, Homo sapiens
uuuucauugacucccauuguggaauucccuagcaauuuauuuag

SEQ ID NO: 160109 - RNA, 42 nt, Homo sapiens
uuggaaaauagaagcagaauaguaaagguucuauucagcaac

SEQ ID NO: 160110 - RNA, 71 nt, Homo sapiens
ugcugcuacugcuucuacaauguaaaauguaugacuugguguuuuaaaguaaaaauuaugauguuacuugu

SEQ ID NO: 160111 - RNA, 44 nt, Homo sapiens
ucccuguucuaguuccuaacaauucucauuacauacuaugccag

SEQ ID NO: 160112 - RNA, 47 nt, Homo sapiens
augaaaucuauauauugacuuucuuaucaaucaucuuacugugcaau

SEQ ID NO: 160113 - RNA, 47 nt, Homo sapiens
uugaauaaagccaugacaguguuaaaaacaaacaaaaaaauuugcag

SEQ ID NO: 160114 - RNA, 41 nt, Homo sapiens
uuuucugugacugcuguaacuuaaaguuuuugaaacugaau

SEQ ID NO: 160115 - RNA, 39 nt, Homo sapiens
uucaacagaacucaugccagcagccuaccacaagggugc

SEQ ID NO: 160116 - RNA, 49 nt, Homo sapiens
ucucuuacuguugugagguccccgaucuuucuuuucugcuucuuucacc

SEQ ID NO: 160117 - RNA, 82 nt, Homo sapiens
cgcucuccgccggcucccugccagcugggccacagacuuguccaggucaacccgaaagcucucagcacaagagguugguucc

SEQ ID NO: 160118 - RNA, 41 nt, Homo sapiens
ugauagugacuugaauguuucuucuucugugauuuaguuug

SEQ ID NO: 160119 - RNA, 46 nt, Homo sapiens; identical to SEQ ID NO: 76155

SEQ ID NO: 160120 - RNA, 1980 nt, Homo sapiens
ugcagcuccucugauuucauccacucgugguaccugcugggacagagggguggcuuuagacauggaggacucauucagaggcauacgucugacaccuuaugaggguccagaaccagacagggcuaacauagggcucaaagaagacccaaaggguuaugauugcuccuaaggcaggggccacagacacaagacccagaagcaagcuagucuuacacaagaacagcaggacgagucaguucuaucuguccaauuuccuauccugucucgggucagugcggaggagcagucugaaaccaaacauucuucaaauuccagaaggggauguauauggcaagccaaccucaacaaaggcggcuggacagaucccacgaaguuagggcaccaggaacccucaaacggaaaacuacaaguagagaauacccaucuacagcaccacuaucccaaucuaccagacaugugccaacugcccccacaggaaucccaucaugacucaguccuggccuuuugaaugguagauaucacaacucaucagcucagaguucaaggacaagcuaacauuaagucuccaagaacugaacauacucacuggcaccagggaaacaucacuaauuuacaauuaggugagaagacaauuucuuuuucuuccacguuuaguuuacauaaagcaauuccuugcugaaaggccaaaaagcugagagaaugaaagggaagaggaugggcagcuccucccaaggaagucacaguccccagguucugcuauuuuuuuuuuuuuuuuuuuugagacagaguuuuacucuuguugcccaggcuggaauuacaggcaugugccaccaugcccagcuauuuuuuuuguauuuuuauuagagacgggguuucuccacguugaucaggcuggucucuuuuuuuuuuuuuuuuugagacggagucucgaucugucacccaggcuggagugcaguggcgcgaucucggcucacuguaagcuccgccucccggguucacacauucuccugccucagccucccgaguagcugggacuacaggcgcccgccaccacauccggcuaauuuuuuuguauuuuuaguagagacgggguuucaccauguuagccaggauggucucgcucuccugagcuugugauccgccugccucggucucccaaagugcugggauuacaggcgugagccacugcgcccagccuuuauuuuauuuuauuuuauuuuugagacaaagucucacucuguugcccaggcuggaguacaguggugugaucucggcucaccacaaccuccaccucccugguucaagugauucuccugccucagccucccaaguagcuggaauuacaggugccgggcaacaagcccagcuaauuuuuuguguuuuuaguagagauggcguuuuaucauguuggccaggcuggucuugaacuacugaccucaugauccacccgccucagccucccaaagugcugggauuacaggcgugagccaccgcacccggccguuuuuuuguuuuuguuuguuuuuguuuuuuuguuuuuuuuguuuuuuuuugagacagguucuugcucugucacccaggcuggaguacagugguacaaucacagcucacagcagucuucaucuccugggcucaggcaauccucccaccucagccucccuaguagcugggacugcagcugugcaccaccaugccuggcuaauuuuuguauuuuuuuguagagacaaggucucgcuacguuacccaagcuggucucgaacugcugggcucaagcaauccuccugccacagccucccaaaguccuggaauuacaggcgugagccacggcacccagccuuuuuuccccccucauauauaauuauuucucacaaccaauguuucuucuuaggggaaauagcccugagacuggggcuguaccuuacacagcucugggugcugauacgcaccccaugucaagcgggaaagauaccugggcacaug

SEQ ID NO: 160121 - RNA, 42 nt, Homo sapiens
cagcguuugacagccucggagccgcugacccuggagcaggag

SEQ ID NO: 160122 - RNA, 41 nt, Homo sapiens
ggccauagccugcggaaaccacuagggaagcgcgcgcuccg

SEQ ID NO: 160123 - RNA, 29 nt, Homo sapiens
uucacaggugccccuucgagacgcgggcc

SEQ ID NO: 160124 - RNA, 46 nt, Homo sapiens
gcgcgccggcccccacucgcuccgcguaguugccuuugcgcagcaa

SEQ ID NO: 160125 - RNA, 53 nt, Homo sapiens
cacgaccagacaugacagcgauaguagucaccgagagaaacuccugccuggcg

SEQ ID NO: 160126 - RNA, 53 nt, Homo sapiens
cgaccagacaugacagcgauaguagucaccgagagaaacuccugccuggcgau

SEQ ID NO: 160127 - RNA, 46 nt, Homo sapiens
gcgccggcccccacucgcuccgcguaguugccuuugcgcagcaagc

SEQ ID NO: 160128 - RNA, 39 nt, Homo sapiens
cacaggugccccuucgagacgcgggccgggcugggccca

SEQ ID NO: 160129 - RNA, 43 nt, Homo sapiens
ggccauagccugcggaaaccacuagggaagcgcgcgcuccgcg

SEQ ID NO: 160130 - RNA, 41 nt, Homo sapiens
cgacuugcgagcagucugcuuaguacgggccauagcgaacc

SEQ ID NO: 160131 - RNA, 43 nt, Homo sapiens
guaaggaagggccagggaaggguuuggggaaaucuagagggua

SEQ ID NO: 160132 - RNA, 46 nt, Homo sapiens
guucagucuggggaaggccacuggggaagcccuuggucgacaggca

SEQ ID NO: 160133 - RNA, 45 nt, Homo sapiens
gagauccaagcugccuacauuggcacaacuauaaucauucggcag

SEQ ID NO: 160134 - RNA, 46 nt, Homo sapiens
aucagagcgcaaucgucggggagcuauaaccauugauacugccaga

SEQ ID NO: 160135 - RNA, 57 nt, Homo sapiens
aacuaaccccucuuuuucuccaaaggagugcuuguggagaucggaucuuuucuccag

SEQ ID NO: 160136 - RNA, 67 nt, Homo sapiens
gucuuuugagguggucuuuaacgacccugaaaagguguacggcaguggcgagaagguggcuggccgg

SEQ ID NO: 160137 - RNA, 53 nt, Homo sapiens
cccaauucauuguuggagggugaaagcugauuagagaagagaauugaauacac

SEQ ID NO: 160138 - RNA, 45 nt, Homo sapiens
aaacaaauaugaguacaaguucggcuuugagcuuccucaggggua

SEQ ID NO: 160139 - RNA, 81 nt, Homo sapiens
cuacacacccauauuuuccuuugaaggauguucccagaggccugugucaagaaaaugaaaauuuuaaaacgcucuccaaga

SEQ ID NO: 160140 - RNA, 72 nt, Homo sapiens
guguguagacuacugggugaaggcuuuucuugaccgcccgagccagccaacucaagagacaaagaaaaacuu

SEQ ID NO: 160141 - RNA, 45 nt, Homo sapiens
ucucuugaguuggcuggcucgggcggucaagaaaagccuucaccc

SEQ ID NO: 160142 - RNA, 49 nt, Homo sapiens
guucauuccugaugggcgggugucugucucugcucgaauugacagaaaa

SEQ ID NO: 160143 - RNA, 68 nt, Homo sapiens
acauguucccgaauugugguccccaaagcugccauuguggcccgccacacuuaccuugccaauggcca

SEQ ID NO: 160144 - RNA, 76 nt, Homo sapiens
ucagggacaugcgcaucauggcguggcaagagccuucggguucagaagaucaggccuucuauccugggcugcaaca

SEQ ID NO: 160145 - RNA, 46 nt, Homo sapiens
ccaguaaggaauauucaacucgaaggauguugcagcccaggauaga

SEQ ID NO: 160146 - RNA, 77 nt, Homo sapiens
uguuucuccagaccucugguguaauaaacugccaucuuccuuucuagaucuauguuagcguuccuggauccaagaag

SEQ ID NO: 160147 - RNA, 48 nt, Homo sapiens
aggucaaggaugaccuucuuggauccaggaacgcuaacauagaucuag

SEQ ID NO: 160148 - RNA, 70 nt, Homo sapiens
gucauccuugaccugccccugguaauuggcagcagaucaggucuaagcagcagaacauccagcauggcca

SEQ ID NO: 160149 - RNA, 48 nt, Homo sapiens
agcuccucccugcuauauggaugucauuccugaagaucaccgauugga

SEQ ID NO: 160150 - RNA, 46 nt, Homo sapiens
cuccaaucggugaucuucaggaaugacauccauauagcagggagga

SEQ ID NO: 160151 - RNA, 60 nt, Homo sapiens
ucugcuagaugacauggauggcucucaagacagcccuaucuuuauguaugccccugaguu

SEQ ID NO: 160152 - RNA, 63 nt, Homo sapiens
aagagccaauuuaacaaacuaggaagaugaaaagggaaauuguggccaaaacuuugggaaaag

SEQ ID NO: 160153 - RNA, 46 nt, Homo sapiens
aauauuuucauaugggaggaugguuuucucuucauguaaguccuug

SEQ ID NO: 160154 - RNA, 63 nt, Homo sapiens
auggcaguauuuggagguucugaacacaggguucggcaucuugaucaagaguuccuccuuggg

SEQ ID NO: 160155 - RNA, 51 nt, Homo sapiens
ccuguguuaggagauagggauauuggccccucacugcagcugccagcacuu

SEQ ID NO: 160156 - RNA, 36 nt, Homo sapiens
acuuauuuccaguuuuguggucccaaaugaccuuga

SEQ ID NO: 160157 - RNA, 45 nt, Homo sapiens
cucaaguggucacuccaaccuuuguccucauuuccccaguuucau

SEQ ID NO: 160158 - RNA, 45 nt, Homo sapiens
cuauuuuuguggggaaaggcaagaaaaccagguaugaggagggag

SEQ ID NO: 160159 - RNA, 40 nt, Homo sapiens
aauuuacuuugcauugcccuacagaugaggccuugaauau

SEQ ID NO: 160160 - RNA, 37 nt, Homo sapiens
gaugacaauauggacgaggcuauauacugaagaagga

SEQ ID NO: 160161 - RNA, 44 nt, Homo sapiens
agacccuggagaagaaggaagaagaaguaacuucagaggaggau

SEQ ID NO: 160162 - RNA, 38 nt, Homo sapiens
cccugccuggggucuccagugaauacugacugguuuua

SEQ ID NO: 160163 - RNA, 55 nt, Homo sapiens
agaguccagcccucucaauacugaggaauuaucuguuuccuuaccccaaacccag

SEQ ID NO: 160164 - RNA, 45 nt, Homo sapiens
uuggggacagcuggccggaugaaguaggggagcugccucauggcu

SEQ ID NO: 160165 - RNA, 44 nt, Homo sapiens
uacacauuaaaugagugauccucuaagaaugcaggggaaaaaga

SEQ ID NO: 160166 - RNA, 46 nt, Homo sapiens
ccauccucauccauggcgaaaucuucgcccccagccucgugaagau

SEQ ID NO: 160167 - RNA, 44 nt, Homo sapiens
gcuccacgcugucauaauccucacgcauccgcgcucgggacccc

SEQ ID NO: 160168 - RNA, 84 nt, Homo sapiens
ccucgagggguggggcagaagcauccuggaggcucagaggaagguccugccguagugaaucgcgguguuugggaagaggcagag

SEQ ID NO: 160169 - RNA, 63 nt, Homo sapiens
aggugggaaguuauaggggaagcuaauggagaaaaaaagacaggacagaggagauaaggaugg

SEQ ID NO: 160170 - RNA, 42 nt, Homo sapiens
uggccaaggcucugcaccuccugaaguccagcugugccccua

SEQ ID NO: 160171 - RNA, 45 nt, Homo sapiens
aggccuccaguacagcccaguccaggggggagauccaucagagaa

SEQ ID NO: 160172 - RNA, 45 nt, Homo sapiens
ucagacagagagucagguaagugguucuuucuucagaaggucuca

SEQ ID NO: 160173 - RNA, 47 nt, Homo sapiens
ugcucuaaccggacauuccacacauuucagacgcccacaaagccaag

SEQ ID NO: 160174 - RNA, 42 nt, Homo sapiens
ggacugaguucccuggauuauggaaacuucgcugucccccaa

SEQ ID NO: 160175 - RNA, 64 nt, Homo sapiens
aaaugcucucucuucuuauuacccaaacccauggcucuauuucuucuucacauccauugucucu

SEQ ID NO: 160176 - RNA, 59 nt, Homo sapiens
aggaccuauguuguaauuuuacuuuuuauuucuaaaguuguagugaagcucucacccau

SEQ ID NO: 160177 - RNA, 44 nt, Homo sapiens
auaaaaacugaggaaucucccuggguggaggccaucuugacacc

SEQ ID NO: 160178 - RNA, 45 nt, Homo sapiens
acauuaucuggauaccccggaccaauuaaauuagaauccuucgga

SEQ ID NO: 160179 - RNA, 27 nt, Homo sapiens
acaaaucuacauaaaaguaaacaaaaa

SEQ ID NO: 160180 - RNA, 51 nt, Homo sapiens
gaagcacaccauuccuaaugcuaacagacaaauuccucccaaggguccuca

SEQ ID NO: 160181 - RNA, 42 nt, Homo sapiens
gagagucguaaggagaauaugguuucggaccaccagcuagau

SEQ ID NO: 160182 - RNA, 49 nt, Homo sapiens
cuggaagucacacaugcaggagaaaaaaagucaagggaacaggcaccaa

SEQ ID NO: 160183 - RNA, 45 nt, Homo sapiens
cucucuguucgaucauccuugcaaaucucuucagcauggggcagc

SEQ ID NO: 160184 - RNA, 40 nt, Homo sapiens
ugagugggccugaugaacuccucuuccccauacacuugga

SEQ ID NO: 160185 - RNA, 82 nt, Homo sapiens
uuuauuuauggacccccauccuagaagacuagcauuggauccugugguguucuaaagauccaaggcagaagguggcaaggug

SEQ ID NO: 160186 - RNA, 45 nt, Homo sapiens
uuggguccugccagccuacaugaaugcccuuccuacucucagcca

SEQ ID NO: 160187 - RNA, 42 nt, Homo sapiens
guaaaguuccauggucaggucaacagcaaacgguggccauuu

SEQ ID NO: 160188 - RNA, 36 nt, Homo sapiens
gcccaucagggcaaccucucggcaccugcuccugca

SEQ ID NO: 160189 - RNA, 46 nt, Homo sapiens
cagauggaacuuucugcucuacaguccaugauggcugugcaggaag

SEQ ID NO: 160190 - RNA, 45 nt, Homo sapiens
agacauaggguauaacuguugucgcggcggaggaagugaggacgg

SEQ ID NO: 160191 - RNA, 45 nt, Homo sapiens
cccgaguggcggacgggcucccgcuggccgccucgaugcaggagg

SEQ ID NO: 160192 - RNA, 43 nt, Homo sapiens
ucuuuuucucagguuacaguaauguuuacagugccucuuguaa

SEQ ID NO: 160193 - RNA, 64 nt, Homo sapiens
gggaacagagagaaggaaggaacaaauucccauuuguaggggguaaguuugaagaaacgggaca

SEQ ID NO: 160194 - RNA, 58 nt, Homo sapiens
gaaaaguaauuuucucuagucuuuugaucuuucccccauagaaauuguugccuuuugc

SEQ ID NO: 160195 - RNA, 45 nt, Homo sapiens
ucauucagaaaaccaagaagcucuacauugacaguugugcucgaa

SEQ ID NO: 160196 - RNA, 45 nt, Homo sapiens
ugccucuaaagaccuugcaagaaaagagauguccugaaaaugaaa

SEQ ID NO: 160197 - RNA, 66 nt, Homo sapiens
guuggugacauuugugauuuucaguaaucugaguuuuugauggccuuuuaaacaagacuccaguau

SEQ ID NO: 160198 - RNA, 46 nt, Homo sapiens
aaguuaaccuuuguuguuuuccuuuuauaauuugcuuauugcacaa

SEQ ID NO: 160199 - RNA, 55 nt, Homo sapiens
cagggcagcagaaaaauuagagaacaagaauaucauaauauggcuccugguuuuc

SEQ ID NO: 160200 - RNA, 45 nt, Homo sapiens
gagagaagcuaccaugaggucacuguuuguugagcacuacaggag

SEQ ID NO: 160201 - RNA, 63 nt, Homo sapiens
ggggaagggauuggacagcacaauaaaggugagucuuugacacaaaacauaugggagucgcag

SEQ ID NO: 160202 - RNA, 47 nt, Homo sapiens
uauucaggagucccuuucaggaaaagcucuggaaugucacugcuacc

SEQ ID NO: 160203 - RNA, 37 nt, Homo sapiens
cauuagccuuguggaauaaggaaagccaaguggcccc

SEQ ID NO: 160204 - RNA, 26 nt, Homo sapiens
cucaacugucuccugcguauuagcca

SEQ ID NO: 160205 - RNA, 45 nt, Homo sapiens
uuccggcagcaaggguccaggcugucacugaugagcacuuuccgc

SEQ ID NO: 160206 - RNA, 52 nt, Homo sapiens
ggaaacuggaguagccaaagcucagaauccccagugaauacccuucugggga

SEQ ID NO: 160207 - RNA, 42 nt, Homo sapiens
gccaggaguaguaguagcaguccaguccuccagcagcuguag

SEQ ID NO: 160208 - RNA, 518 nt, Homo sapiens
cggcagacaaagucacagccauccuguagggggaaaaaaaagaaggaaauaauucgcagcaucuaacuuuaggauaugagaaaguguacuuauggucuaggaauguggcaagaauugguuuucuauagggauaaugagaaaaccuaaaagaucugacaaucagccuaaauucaauuuggggcaacaggagaaaaaguuucuucuuauuaggccucaccuucuucccacccaggcccucuuaaaagcuaaaucagauuuagaagagcccaucuggucaacaguguugcucuuucagcaaugucuuaccaaggccagaaauggaugcugugccacuuacuacucuguacuagggcaacugucuuguuugcugggacuuuugugguuuuagcacucaauguccugugucccaggaacccccucagugugaacaaacgaggaugguuggucacccaaccuuguuugcaggcuacaaauucaaccagcugcccuguuacuuacugcuaccagguugccaagau

SEQ ID NO: 160209 - RNA, 43 nt, Homo sapiens
uggagaaagugcgacauguuuagaaauacugguagggaaccag

SEQ ID NO: 160210 - RNA, 47 nt, Homo sapiens
gggacaggugcagcagcauuccacacccagcgcagaggacagcagag

SEQ ID NO: 160211 - RNA, 83 nt, Homo sapiens
uuaauuagguauuuguuucauuggaguugaaauuaacauuucaaaaguuuuucguauuuuuuuauggcagaugauuugucauu

SEQ ID NO: 160212 - RNA, 37 nt, Homo sapiens
cuucaauauggcuggucuugauuaucucaagagggaa

SEQ ID NO: 160213 - RNA, 87 nt, Homo sapiens
gaauguaaaagaaaauugauuaauguggagguuacaauacauuucaagauaggaagauucuguguuuuaaagauuuaacuuuuccua

SEQ ID NO: 160214 - RNA, 46 nt, Homo sapiens
uagccuucagcuuauguauuagagauuuuuaaagggaucaagucga

SEQ ID NO: 160215 - RNA, 46 nt, Homo sapiens
caaauuaauguauaucuaucucauggcaggaaagagaagcagaaua

SEQ ID NO: 160216 - RNA, 47 nt, Homo sapiens
uuguaucaucgucccaugacaaaucucugagacuuugggagagaaca

SEQ ID NO: 160217 - RNA, 50 nt, Homo sapiens
uacaguuuguacccaagucucaccucuucuucacugccggaaaagaucau

SEQ ID NO: 160218 - RNA, 40 nt, Homo sapiens
uacagaugaaaaacuagguucauggggaugaauuuaccaa

SEQ ID NO: 160219 - RNA, 42 nt, Homo sapiens
auaugcacuuugcucauucuuuguaccuggugauagacaggu

SEQ ID NO: 160220 - RNA, 46 nt, Homo sapiens
auguugaaaugagucugcaagaugaaauccagcgggugacuaauau

SEQ ID NO: 160221 - RNA, 42 nt, Homo sapiens
ggcagaggauggugccuuugagacggaugaagccccugagga

SEQ ID NO: 160222 - RNA, 46 nt, Homo sapiens
cuaguuaagauuuaugcugaacagccauuaucuuaauuugauuaua

SEQ ID NO: 160223 - RNA, 45 nt, Homo sapiens
ggaccuugauacucagcacugcuuuaaaacaaugguuggccaccg

SEQ ID NO: 160224 - RNA, 43 nt, Homo sapiens
aaaauucuguaagauguauaccagaaaacauaauaaagauaag

SEQ ID NO: 160225 - RNA, 48 nt, Homo sapiens
acuagcauauacauugcagugcuccaaucaugcuaacagauaauagau

SEQ ID NO: 160226 - RNA, 104 nt, Homo sapiens
ucuucuuauggaaucaucgaaacugcuauuuaucauaaucaccacuuaugagccuggguuugggauuuugugcauguaguucagucuaguguugguagcaugac

SEQ ID NO: 160227 - RNA, 50 nt, Homo sapiens
gaaauuucuugguuaaguuuaauuuucucugggggcaugaucucacaaag

SEQ ID NO: 160228 - RNA, 50 nt, Homo sapiens
auugcuuaucacuuuuucuccauuuuaauaauggaaugaacuaaaauaaa

SEQ ID NO: 160229 - RNA, 41 nt, Homo sapiens
ccuguguuuuguuuacauggaccacuacagaaauuaguuug

SEQ ID NO: 160230 - RNA, 54 nt, Homo sapiens
cuacgguagggccacucauauacuauguauuucaguauuaaauguuugcugaau

SEQ ID NO: 160231 - RNA, 65 nt, Homo sapiens
aaagguagaauugacaaaccugaauaucuaauuagauaugaggagauucaguaagaaggaagaau

SEQ ID NO: 160232 - RNA, 46 nt, Homo sapiens
auugaaaccuauugguaccuauggcgauucacucacgauccaagau

SEQ ID NO: 160233 - RNA, 46 nt, Homo sapiens
acaucuuauuaagaagucucguggaggucuuaccuuuauuggagaa

SEQ ID NO: 160234 - RNA, 52 nt, Homo sapiens
uugucagaguuauaauuucuguuugguuuguuuuuuucauuaaaccaagaau

SEQ ID NO: 160235 - RNA, 100 nt, Homo sapiens
auauaugagaucauuuaaucauuaucaccauuuuacacaugaggaccuuaaggaacaaugaaguuaaaguaacuugcugaagguugcauugcugguaauu

SEQ ID NO: 160236 - RNA, 49 nt, Homo sapiens
auugggaggaaggucucuagcggaguaaggagggaggggugacucagua

SEQ ID NO: 160237 - RNA, 46 nt, Homo sapiens
gacugaagaagcaauaggcauaacucuggaaagcaagaaaagagaa

SEQ ID NO: 160238 - RNA, 43 nt, Homo sapiens
uucuuaucaauuauacuggauguuagaagguauuggaauggua

SEQ ID NO: 160239 - RNA, 48 nt, Homo sapiens
uaaaauguaaaaacguaguuuucuuauuucagauaagagugacuggau

SEQ ID NO: 160240 - RNA, 51 nt, Homo sapiens
gaagacaaaauugagaaaagcuaguaaauguguggaaauaaaaggagacag

SEQ ID NO: 160241 - RNA, 45 nt, Homo sapiens
agauguucuuuuuauagagaauggcaaacuguuggacuuccuaag

SEQ ID NO: 160242 - RNA, 62 nt, Homo sapiens
caaagccucuuccaaggcagaggacagggcaguaagaaggaauggaagaaaacacugagguc

SEQ ID NO: 160243 - RNA, 36 nt, Homo sapiens
uuugaagcuauaugccagaucaggguacagaaugca

SEQ ID NO: 160244 - RNA, 89 nt, Homo sapiens
ccacuccuuccccaguucugaguagaaacuuuucuucccaagacuagaauggaguuuuaguuuuaggaacuggcuuugcuccaggacac

SEQ ID NO: 160245 - RNA, 46 nt, Homo sapiens
ucgauuuauuggaggccuacuugcagcauauuaccuaucaggagag

SEQ ID NO: 160246 - RNA, 49 nt, Homo sapiens
augugacgguacuagaagauggggacuuugggaggugauuaggucauga

SEQ ID NO: 160247 - RNA, 35 nt, Homo sapiens
agaaugaguucuuucuauuuagauauucuggaaag

SEQ ID NO: 160248 - RNA, 46 nt, Homo sapiens
augaaacaugcuugggauaacuauaggacauauggguggggacaua

SEQ ID NO: 160249 - RNA, 20 nt, Homo sapiens
aguuauuuauucuuauagcu

SEQ ID NO: 160250 - RNA, 38 nt, Homo sapiens
gaagauaaugacauaagagagaaaagggaaaaaauuaa

SEQ ID NO: 160251 - RNA, 102 nt, Homo sapiens
cgagcugaucaugagaaggccuuggaagaagcaaaagaaaaauuaagaaagucaagagaggaaauucgagcagaaauucagacagagaaaaauaagguaguc

SEQ ID NO: 160252 - RNA, 34 nt, Homo sapiens
ugcauaugaaauacaaguaauuuuaugaaguagg

SEQ ID NO: 160253 - RNA, 43 nt, Homo sapiens
ucgaaccuugacagcucuuuugggugugcucucccagagggcu

SEQ ID NO: 160254 - RNA, 41 nt, Homo sapiens
ucuuccugauccauggacccgaugaacauagacacagguuu

SEQ ID NO: 160255 - RNA, 47 nt, Homo sapiens
uuucuaaaguauucucuccaagagcguaaacgaugacuaccccagcc

SEQ ID NO: 160256 - RNA, 46 nt, Homo sapiens
gcaucuaauuauagauaauaaagauuuggaaagcauuaguagaaug

SEQ ID NO: 160257 - RNA, 46 nt, Homo sapiens
uuucaucucuguuggcagaauuggaggcaauucaaagaaauucagc

SEQ ID NO: 160258 - RNA, 61 nt, Homo sapiens
uagucgagagacuucgauuccucacacauuuuccugugugacagcacuucauuuguccaag

SEQ ID NO: 160259 - RNA, 55 nt, Homo sapiens
gcuugacagccggccggcggcacuugcuggccgcgaucuccuccaccuucaugau

SEQ ID NO: 160260 - RNA, 53 nt, Homo sapiens
uuauuccucucaagaacucuaugaggcagguacuauuauuccucauuuuacag

SEQ ID NO: 160261 - RNA, 23 nt, Homo sapiens
cagaagcaggcauuggcuugguu

SEQ ID NO: 160262 - RNA, 49 nt, Homo sapiens
uugaaauuuaugaccaguagugcagacugggacauuggcugcagaaagg

SEQ ID NO: 160263 - RNA, 45 nt, Homo sapiens
aguuuuucuuaacagaguacaagauaaacuggaguacagaagacu

SEQ ID NO: 160264 - RNA, 46 nt, Homo sapiens
augcaguguggaaaaucacaagugaagccaucggucaacugcaucg

SEQ ID NO: 160265 - RNA, 46 nt, Homo sapiens
accacuggcccuccccaccuggugccuccccaaccccuuccucguc

SEQ ID NO: 160266 - RNA, 296 nt, Homo sapiens
uuucuucugcagaauaauccuaagugaauuaaugcaggaacagaaaaccaaauaucauauguucucacgagcaggagcuaaacauugagcacccauaaacaugggaacaauagauacugugaacuacuggagaggggaggagggcauggguuaagaaacuaucuauugggcacuaugcucacugccugagugcaauauacucauauaacaaagcugcauauguacccccuguauauaaaauaaaaguugagaugaaaaggaaaggcauucuagauacgaaguuuguauuaauauuu

SEQ ID NO: 160267 - RNA, 153 nt, Homo sapiens
uugugauuguaaaagcacuuugguuugucacuacuuuuccuugaggccuggaaaagagugaucauggacagagaaggaaccaagcuucgaaaguaucgugaagaaaugaguccuuuguggguuuggcacgucaucuuuucuagacguggaaau

SEQ ID NO: 160268 - RNA, 43 nt, Homo sapiens
guaaggcagaggggaaacgcugguguggaaguauuccauggca

SEQ ID NO: 160269 - RNA, 39 nt, Homo sapiens
uggcuaaacauauuuaguccucaauaaauguuaguuucu

SEQ ID NO: 160270 - RNA, 53 nt, Homo sapiens
aauauuucagaacagcccugauuucagauaucaugucauaaauaaauguaauu

SEQ ID NO: 160271 - RNA, 46 nt, Homo sapiens
aagaucuucccuccgcggacgcgcuggguguagauggcauagggga

SEQ ID NO: 160272 - RNA, 42 nt, Homo sapiens
caggcccgggaugccggggaguaugaaugccacacacccagc

SEQ ID NO: 160273 - RNA, 43 nt, Homo sapiens
uugaugaucugaaugacaaggaagaugagacguaugacaucag

SEQ ID NO: 160274 - RNA, 102 nt, Homo sapiens
aagguuuuuaugugccuuuuuguuuuuguaaaaaaggaacacccggaaagacugaaagaauacauuuuauaucuggauuuuuacaaauaaagauggcuauua

SEQ ID NO: 160275 - RNA, 104 nt, Homo sapiens
cguggagcaucaggccacacacucugcauccgacacccacccccucuuuguguacuucagucuuggaguuuggaacucuacccugguaggaaagcaccgcagca

SEQ ID NO: 160276 - RNA, 57 nt, Homo sapiens
ucagaauguagaucucaguuacaguuugaggacuggucauguuuuagacuuuaaaau

SEQ ID NO: 160277 - RNA, 46 nt, Homo sapiens
ugugccuuccccuacucucuucucaucuucguauaugacgaaguca

SEQ ID NO: 160278 - RNA, 46 nt, Homo sapiens
cucugugcauccccagcucccuacacaaagcugguguacagcaggg

SEQ ID NO: 160279 - RNA, 54 nt, Homo sapiens
ccuuuccuacugcccuggaauggguguugcucuuaggauguauccccucaagua

SEQ ID NO: 160280 - RNA, 53 nt, Homo sapiens
aggaacaagaucuugauauuuggccucuuugaagagacagcccuggcugcuuu

SEQ ID NO: 160281 - RNA, 50 nt, Homo sapiens
gacuuggucaucuguaagaccaggaggaauucggucuuccagcaggggau

SEQ ID NO: 160282 - RNA, 43 nt, Homo sapiens
accgcuggaucaacgauguggaagacagcuacgggcagcagug

SEQ ID NO: 160283 - RNA, 45 nt, Homo sapiens
ggcccugggaggcuucuuuacuuacuuugugauucuggcugagaa

SEQ ID NO: 160284 - RNA, 73 nt, Homo sapiens
ggaaggaagacuaggucucuggugguuuaggaugaaacccugcccugaggaacuuggagcagcgugguuaaau

SEQ ID NO: 160285 - RNA, 75 nt, Homo sapiens
augagcaggcugagagugacaucaugaagagacagcccagaaaucccaaaacagacaaacuugugaaugagcggc

SEQ ID NO: 160286 - RNA, 54 nt, Homo sapiens
gaucaccccguuccugauauuuauuauugcaaacauuccacuaccacuggggac

SEQ ID NO: 160287 - RNA, 60 nt, Homo sapiens
ucugaucuuugauaacuugaagaaauccauugcuuauaccuuaaccaguaacauucccga

SEQ ID NO: 160288 - RNA, 46 nt, Homo sapiens
ugauucuucuggaugacaacuuugccucaauugugacuggaguaga

SEQ ID NO: 160289 - RNA, 47 nt, Homo sapiens
augaccuccgagcagcuggaugacauuuugaaguaccacacugagau

SEQ ID NO: 160290 - RNA, 73 nt, Homo sapiens
ucagaaggcaaugagaccguggaagacauugcugcccgccucaacaucccagucagccaggugaaccccaggu

SEQ ID NO: 160291 - RNA, 50 nt, Homo sapiens
ggguuccaguuugacacugacgaugugaauuucccuaucgauaaucugug

SEQ ID NO: 160292 - RNA, 85 nt, Homo sapiens
ugugcugugguuccgugaaggagaugagagaaagauacgccaaaaucgucgagauacccuucaacuccaccaacaaguaccaggu

SEQ ID NO: 160293 - RNA, 43 nt, Homo sapiens
aauccuguuauuauuuuucuuaauagauugcuuuucuggaagg

SEQ ID NO: 160294 - RNA, 86 nt, Homo sapiens
ucgcacugugaugggaagaauugccacacuugcuucugggcuggaaggaggccagacccccauugcugcagaaauugaacauuuua

SEQ ID NO: 160295 - RNA, 101 nt, Homo sapiens
uccucgcucacuggugaaucagaaccccagacuaggucuccagauuucacaaaugaaaacccccuggagacgaggaacauugccuucuuuucaaccaauug

SEQ ID NO: 160296 - RNA, 45 nt, Homo sapiens
uccugcugaccucagaaucauaucugcaaauggcugcaagguagc

SEQ ID NO: 160297 - RNA, 83 nt, Homo sapiens
aagcccuugugauucgaaauggugagaaaaugagcauaaaugcggaggaaguugugguuggggaucugguggaaguaaaagga

SEQ ID NO: 160298 - RNA, 49 nt, Homo sapiens
uucuuuugaauguaaacucugaauacaggcacaccauguaacagcaaua

SEQ ID NO: 160299 - RNA, 44 nt, Homo sapiens
uggcagagcacagcgauucauguuggcacauccaccuguccaga

SEQ ID NO: 160300 - RNA, 81 nt, Homo sapiens
cccucacucccccucccacuacuccugaauggaucaaguuuugucggcagcucuuugggggguucucaauguuacugugga

SEQ ID NO: 160301 - RNA, 43 nt, Homo sapiens
auaaacuuagccuugaugaacuucaucguaaauauggaacaga

SEQ ID NO: 160302 - RNA, 95 nt, Homo sapiens
uggacgugauaaguaugagccugcagcuguuucagaacaaggugauaaaaagggcaaaaagggcaaaaaagacagggacauggaugaacugaaga

SEQ ID NO: 160303 - RNA, 30 nt, Homo sapiens
guaugaaggccuuuggcgguggcuauagcu

SEQ ID NO: 160304 - RNA, 26 nt, Homo sapiens
gguugagaaagccuucgcauccugcc

SEQ ID NO: 160305 - RNA, 81 nt, Homo sapiens
ccagaugagggcuaacacuuaaaauauacagauuccugggaauguuauuccuaaauugcauucaaaaauaaaagugaacuc

SEQ ID NO: 160306 - RNA, 40 nt, Homo sapiens
ccuugaucauuucuguaaacaugcacuuuaaagcucauuc

SEQ ID NO: 160307 - RNA, 46 nt, Homo sapiens
ccgggagcugcucugugcuuuucucucugauucuccagcgacagga

SEQ ID NO: 160308 - RNA, 72 nt, Homo sapiens
uugagguuaaaaaagagucaagaaagauuucugaguuugggccugggugaucaucuacauagacagaaaaua

SEQ ID NO: 160309 - RNA, 46 nt, Homo sapiens
cuacccccaaauccacccacccugccuacccuucguggcucuagcc

SEQ ID NO: 160310 - RNA, 56 nt, Homo sapiens
cuuugucaucuaucccaaccucaacuuucacagaggaggagaggaaacgcacagag

SEQ ID NO: 160311 - RNA, 60 nt, Homo sapiens
gaaauugauuaccuugccacuccaaccuacguacugagugagugcuccagccacucagug

SEQ ID NO: 160312 - RNA, 49 nt, Homo sapiens
aauccugcaagguggacagcagcauccucaccacuuuucagacagguaa

SEQ ID NO: 160313 - RNA, 41 nt, Homo sapiens
cuugcauucuccaucagauuggaucaccucccacccugagg

SEQ ID NO: 160314 - RNA, 46 nt, Homo sapiens
ggaggaacaccaggaugcuuuggaacuuaucaugagcaaauaucgg

SEQ ID NO: 160315 - RNA, 41 nt, Homo sapiens
cagguggcaauuuagaauuccagucaauauuggcuguccac

SEQ ID NO: 160316 - RNA, 48 nt, Homo sapiens
ccuacugcuagucccaggaaacacacuuggaaauaagucagcuauuuu

SEQ ID NO: 160317 - RNA, 26 nt, Homo sapiens
agugcacaugugugcauucacauaca

SEQ ID NO: 160318 - RNA, 33 nt, Homo sapiens
cacuuaguucaaauacuaaaaguagcuuuuauu

SEQ ID NO: 160319 - RNA, 28 nt, Homo sapiens
auuuucauuagguaacaaaacugcuucc

SEQ ID NO: 160320 - RNA, 50 nt, Homo sapiens
uguaggcaacauugagauucaaaugcccaguggucaacuggguucacuca

SEQ ID NO: 160321 - RNA, 57 nt, Homo sapiens
cacauuucaaauuuauaaauuucuucauguuauacuauucuauuuagauuugcccag

SEQ ID NO: 160322 - RNA, 34 nt, Homo sapiens
uaagcuaauuuuacucaguaguaagucaaaugag

SEQ ID NO: 160323 - RNA, 45 nt, Homo sapiens
gcuuccucuguguauuugccaucaauaauagcaagucauuugcgg

SEQ ID NO: 160324 - RNA, 48 nt, Homo sapiens
agacuuuguccauagaaccauaaaguuucaaagcuagauuggaccaua

SEQ ID NO: 160325 - RNA, 44 nt, Homo sapiens
aacaaggacaguugauacaaaacaagcccacgaacuggccaaga

SEQ ID NO: 160326 - RNA, 24 nt, Homo sapiens
aaugauguauauaauugccuucaa

SEQ ID NO: 160327 - RNA, 47 nt, Homo sapiens
aagcugaugaguuugcucaaaacaggaaguugaaauuguugagacag

SEQ ID NO: 160328 - RNA, 35 nt, Homo sapiens
ucauuucuuuuuuaaaugucugugacuggcaguga

SEQ ID NO: 160329 - RNA, 48 nt, Homo sapiens
cuuuaaacugcugugaauuuuuuugucaugacuugaaagcaaggauag

SEQ ID NO: 160330 - RNA, 46 nt, Homo sapiens
aauguuuuuucuuguuaaaugauguuuaaaaaauaaaaacuggaag

SEQ ID NO: 160331 - RNA, 97 nt, Homo sapiens
ccuagauagcaaaaguaggauucaaaucagucauucuccaaggaccugauuguaaccuuugcgcuauacugaguuucaaauucugugagugagauac

SEQ ID NO: 160332 - RNA, 29 nt, Homo sapiens
ggucuauaaaaaacuauuucaaaaagaag

SEQ ID NO: 160333 - RNA, 76 nt, Homo sapiens
ucagcaugauaagagcuguaaagaaguauagauuuagguacguuugaagaguugcaagaaaaagaaagaaguauag

SEQ ID NO: 160334 - RNA, 41 nt, Homo sapiens
gagagaagauauuaaauuuggcuuugaaggaugaauaggag

SEQ ID NO: 160335 - RNA, 347 nt, Homo sapiens
agauauaagauaacauuacagacuuagguaaguaaaaaguuaagauuuagggccaggcgugguggcucaugccuguaaucccagcacucugggaggccaaggcagguggaucaagaggucaggagaucgggagcauccuggucaacauggcgaaaccccaucucuacuaaaauacaaaaauuauacgggugugguggcgugugccuguaaucccagcuacuugggaggcugaggcaggagaaucauuugaaccagggagucagagguugcggugagcugaggucgugcaccugcacuccagccuggcaacagagugagacugucuuuaaaaaaaaaaguuaugauuc

SEQ ID NO: 160336 - RNA, 53 nt, Homo sapiens
aauugucuuuggagcauucaaguggagaugucgagagaggaucuagaguccag

SEQ ID NO: 160337 - RNA, 43 nt, Homo sapiens
cuggacuucacguuccuguccagcuccacucuauugucuauuc

SEQ ID NO: 160338 - RNA, 45 nt, Homo sapiens
guccuaaugaccaacagacacugcaguuuuuaucuuacuugaccu

SEQ ID NO: 160339 - RNA, 49 nt, Homo sapiens
caugaugauguauaaaaauaaucuuaaaaaauaaaauaugaugguacag

SEQ ID NO: 160340 - RNA, 46 nt, Homo sapiens
guuaaacaugaagggaaaauacuggaaucauuuggauucugacagg

SEQ ID NO: 160341 - RNA, 26 nt, Homo sapiens
auucaucacuugucauucacccaguu

SEQ ID NO: 160342 - RNA, 46 nt, Homo sapiens
ggacuuuggagugagauauaacugucaccaagagauccgucuuaag

SEQ ID NO: 160343 - RNA, 73 nt, Homo sapiens
aagagcaaaaacuuggauguaaccagccgugaaaaugugggucuagauauaaaugaaaauaccaaaagccaug

SEQ ID NO: 160344 - RNA, 45 nt, Homo sapiens
aaauagaagcacuucccccagauaaacucuuaaauuuggcuuuag

SEQ ID NO: 160345 - RNA, 46 nt, Homo sapiens
gggcaagaauguggaccuuccauaaauccuuugccaaaaccucgua

SEQ ID NO: 160346 - RNA, 50 nt, Homo sapiens
gaacaugcagguguugauuaauguggaaggaaaauaagaagugaaaaaag

SEQ ID NO: 160347 - RNA, 60 nt, Homo sapiens
ucucuacuagaagcauugcaaccaaaaugaagaaauugagauugcuugcaggcagacaua

SEQ ID NO: 160348 - RNA, 48 nt, Homo sapiens
auauuuggcucuccuaauuuuaugacauauuucuaaaauaaauuauaa

SEQ ID NO: 160349 - RNA, 45 nt, Homo sapiens
gugucauggaagcuccuuucccagcuccuggacgcaccaucacag

SEQ ID NO: 160350 - RNA, 41 nt, Homo sapiens
ucacagaccccguguagcagaccuuucuugaauuuaacuua

SEQ ID NO: 160351 - RNA, 58 nt, Homo sapiens
uggaacauguugauuuuaaaugucucuuuaagugccugagugugugucaucucauccg

SEQ ID NO: 160352 - RNA, 45 nt, Homo sapiens
cuacaccauuccuuauuggaauccugucuugcuccuuaccacagc

SEQ ID NO: 160353 - RNA, 37 nt, Homo sapiens
ugucuacuguagauaauuggacagacaauaugugaaa

SEQ ID NO: 160354 - RNA, 24 nt, Homo sapiens
cauaagccucuaauuuaauuacau

SEQ ID NO: 160355 - RNA, 44 nt, Homo sapiens
agaagacuuguagaugagagagaucugguggaaaagugccagaa

SEQ ID NO: 160356 - RNA, 25 nt, Homo sapiens
gcugcccugaugcagauuuuggaag

SEQ ID NO: 160357 - RNA, 46 nt, Homo sapiens
agcacucaaaucacuauuuuuauggaauaauuauagugcaguauga

SEQ ID NO: 160358 - RNA, 30 nt, Homo sapiens
ugguaggacauuauucuuugaacaugacug

SEQ ID NO: 160359 - RNA, 43 nt, Homo sapiens
uugaccugggcuaaggaauagacucaucacauaucuccauugu

SEQ ID NO: 160360 - RNA, 46 nt, Homo sapiens
uacacuccaacccagcaggaacaguuaauaauuggauguuuauaaa

SEQ ID NO: 160361 - RNA, 55 nt, Homo sapiens
guauaaaauguuguuuacagaucuuuuaaugaauaaauacauaaaccccccacag

SEQ ID NO: 160362 - RNA, 45 nt, Homo sapiens
gcgcauccaccacaaccucuccagccaccaaaccugugcccgcca

SEQ ID NO: 160363 - RNA, 65 nt, Homo sapiens
uaauccggggcugucagguagcucagguaguucuuaguaggucgguaucugcgaguuuccuccuc

SEQ ID NO: 160364 - RNA, 42 nt, Homo sapiens
accgaccuacuaagaacuaccugagcuaccugacagccccgg

SEQ ID NO: 160365 - RNA, 71 nt, Homo sapiens
gaaacgguaagaauauuaaaauggaaauuaaaauuuaguuuguaguaacucaguaaugagcugagauuugu

SEQ ID NO: 160366 - RNA, 46 nt, Homo sapiens
ccagcccccuccucuggucaaaaaaaugacauuacugcauggcaag

SEQ ID NO: 160367 - RNA, 42 nt, Homo sapiens
uuuuuuccuauuacagaaugaaguuuaagugaaccuuuaaua

SEQ ID NO: 160368 - RNA, 45 nt, Homo sapiens
gaacaugcaacucacagcuggaucuaaauugagagaaauggaguc

SEQ ID NO: 160369 - RNA, 58 nt, Homo sapiens
aauuaagcagcaacauggagaggcaaacaaagaaaacauccggcaagacuucugaaaa

SEQ ID NO: 160370 - RNA, 95 nt, Homo sapiens
gacaauuuagcagguagaagaaaaguugggcuuucacaaaaggcaucugaacuuuuaaugaacuuugaaggacaacagcaucuucccaaaaccau

SEQ ID NO: 160371 - RNA, 55 nt, Homo sapiens
uuaaaaugucuagcuuggugguauuuuuauagccauaaaagaaaaucuuuaggcu

SEQ ID NO: 160372 - RNA, 226 nt, Homo sapiens
aagauuguugcuacucuauccaucaaauggguaaggucauaaaucaauaguuuaaaggcagugccuauuccuguuccuucucuucccuugccuuauauguggcuccauuaaguuguccaucugcuuaauuauuuaugcaaaaaauuaagauuuuguggcuuauuggaagaucuuuugcuaacauguuauuuuuuuccacauuaaaaacagcacaaauggguguagg

SEQ ID NO: 160373 - RNA, 2448 nt, Homo sapiens
uuucaccaauugguagguaaaucauuuguuuuacugugcuuuauuccuuguggauagcuugccugagguuaucagugacuucauagaaaccucagaauuaacaguucacuauagcaaagaauuugauugaggagacuagguaaaucuuacacuucauccaaaaguuucauugcuaaaguauccuuucacauauggcucuauuucauugagggauuaugacaguauacuuuugacaccaccuccaaguguucaggcaccagaugauauuacuuguuauacuuuugagauuaagggggaaaaucacauaaucuuuuaauuuguauaauaucuguuaaauuacaauccacugcuuuguggaacuacaugauuauuaaugaaaauugugucuugaaagaaagaaaauaauuuauuuguuuuuuuucccccuuaugacaugaaagcaccuugccauugagagacaaauuacaguaguuuccuuggaacuaauucuaggcuguuaccagcugucaacuagaaaaaaggacagcucaauaggugaagugaauaugcugucuucauaaaggauauacaacacauuugcaaguaggguggccacuuccuaguaucauggcccuguaggaaaagggccuacaaauggugaaaucuacucuucuaagaggaaacuagaaugaaaucaaccuuucuguucagugccaaaaaugaaggucacacagacuuuucuuuucuuucuuuuuuuuuuuuuuuuuuugagacggagucucgcacugucacccaggcugcagugcaguggcgccaucucggcucauugcaagcuccgccuccuggguucacgccauucuccugccucagccucccgaguagcugggacuacaggcgcccgccaacacgcccggcuaauuuuuuguauuuuuaguagagacaggguuucacuguguuagccaggauggucucgaucuccugaccucgugauccgcccaccucggccucccaaagugcugggauuauaggcgugagccaccgcucccggcccuuuuuuuuuuuuuuuuuuuauugcucuccccagaaauaccccagucacuaacaaacaaaagaacaaucuuuaguaaccagugguucugaacuguuaacuuucucuggcugaggagcucuuugcaaggcuggaaaauauuucuaauuuuacucugccaauauuuuggcaauagaugaucucuucuuuaugugggccucauugcaucuuuuccauacuaaucuggccaauaaucccagcauuagcaagagccaaaaggcaccccuuccaggucauaaauuggcucccuccuucccaucuucuuguaguaacucuccuucaguccccacaacuaaaagaaaggggugaccaccuugacccacuuguccuacaagguugaugacccccuuugaaguuagucuucugagaucauguuuagcauauuuuuccacuuccacacugggaaaagaaaacaaugaaaacaaaauauccucucugccauacaaguuaucugauuucauuggccccuuggaaaaggauauugagcucacccuggccucaaaugugggauuuucuuugcauaagguguucuuaaaauggaaccuauugucuuauuucguuuauuaacuaauuuuauaccuuuuaaagauacauuucuaauuuauuaauauggguuuaaauuaugaucauacucaaaacaucaaguauuugcaucauccucuauggguucuagaacacuuucacagauauucucucaguucuuacaauacccacugauaguaggcagaguauguacuauuaugcucagccuauaggugagauuuagauuagauaacuagagacuggucuucugaugccucaucuagggaucuuuccccuauuuuacaauguccuucuugcuguucagaucuucauaguguauauucagaauagucaugagccuuccaaaucucuuugaccauuuugaugauugccuuugguaguauuuguucuuuaucuaaguaagacuggcuucccugagaauuucagggccaugcaagugagcuaugcaaggcaagguuugggucuggcagaugaugacauggaauggacuaaggguugguauucauacauggcagucaccuaccaaaauugcauguauaccuagaagucuucaagcagaaaacauaagggacacauuuaguucauuugcuuguuuuauguuuggccauagaaccuguuuugguugacucagcacuauguuugcaaguuccaaccauauacccaaaucuuguuugaucuguggguguaucugucaccucacuuuucagaguauauauauuuaccugucuugugugagucccaaauaugcugauguuucaggaaagggcaauuugaggaacccauauuaauucccuuccauuuugccaacagguggaacgggcccuucaucagaugcuggu

SEQ ID NO: 160374 - RNA, 78 nt, Homo sapiens
ccuccuuuucucugugccuggaccgccucucccagcagugauauugauauguguguguguguguguguguagagaaag

SEQ ID NO: 160375 - RNA, 43 nt, Homo sapiens
ggggaaaggacgagguggaccccagggagaagccagggcagaa

SEQ ID NO: 160376 - RNA, 47 nt, Homo sapiens
ccucuauauuuuuagccaauggcaaucaaauucuuucagcuccuuug

SEQ ID NO: 160377 - RNA, 49 nt, Homo sapiens
agguuugaggagcuagccuuguuuuuugcaucuuucucacucccauaca

SEQ ID NO: 160378 - RNA, 46 nt, Homo sapiens
gugucuggccaaguuagauccacagacacuggacacagagcagcag

SEQ ID NO: 160379 - RNA, 46 nt, Homo sapiens
cucggaggccuccuggaagaccugguggagguggugagauggagaa

SEQ ID NO: 160380 - RNA, 45 nt, Homo sapiens
cagcuggucuauggaccaaggauccacuggggcaaacagagaaga

SEQ ID NO: 160381 - RNA, 46 nt, Homo sapiens
gcgggacuucaagaacaagaugcugccacugcuggagguggcagag

SEQ ID NO: 160382 - RNA, 32 nt, Homo sapiens
uuucacuuaguguaaugcuuuugaggcuaauc

SEQ ID NO: 160383 - RNA, 46 nt, Homo sapiens
acgagugcuuucagcauaagaaucacaccugccuuguuuuugaaau

SEQ ID NO: 160384 - RNA, 46 nt, Homo sapiens
cuguggugggugcugcugccacaaccaccacugugaccacaaagag

SEQ ID NO: 160385 - RNA, 67 nt, Homo sapiens
ucacuuuguccagcacguucuguacacuguuucuaugaauauaggucaagauugaauuaguuuuuga

SEQ ID NO: 160386 - RNA, 37 nt, Homo sapiens
aaaggagggaagacauuaaaaaaaaaaaaucaaggau

SEQ ID NO: 160387 - RNA, 46 nt, Homo sapiens
caguuuuuaggucauuuggcuaaccagcuguuaaauuguaugaaag

SEQ ID NO: 160388 - RNA, 41 nt, Homo sapiens
aacaggccacccuaaaggccccggaaccucggccggcucag

SEQ ID NO: 160389 - RNA, 67 nt, Homo sapiens
guccaaccagacgccagagggcaagggaggcuuuugauauaguucauaucagucaguuucagaaaag

SEQ ID NO: 160390 - RNA, 48 nt, Homo sapiens
ccguuauaugcgcggaucgcagcgccgagcgugugcgugacguggugg

SEQ ID NO: 160391 - RNA, 45 nt, Homo sapiens
ccugugaccacgaugcccucugcugggccgccucccuccgccgga

SEQ ID NO: 160392 - RNA, 33 nt, Homo sapiens
guucucuguaacuagcccuaaugcagcuucaug

SEQ ID NO: 160393 - RNA, 46 nt, Homo sapiens
agccccagccuccaucuggggggguguauccaacuggaccuccaac

SEQ ID NO: 160394 - RNA, 117 nt, Homo sapiens
agcugugaauacaucauuuuuauaacagucuuuuaaacucaaugauacaucaguuggagcaaaucaaggucccucacaauuuucucauuucuguuuugaaauacuacaguauacuau

SEQ ID NO: 160395 - RNA, 45 nt, Homo sapiens
ggagcugagccacccgaaggcaaauccaaagaaucccgcauagac

SEQ ID NO: 160396 - RNA, 45 nt, Homo sapiens
ugccaaaagucgauaauugaugcccaugccaaugaagagauagau

SEQ ID NO: 160397 - RNA, 35 nt, Homo sapiens
cuccgggggcgcuccgccuccgcgccccaaauccc

SEQ ID NO: 160398 - RNA, 56 nt, Homo sapiens
cguccuucccgcucauugacugcccucgcccacgccgccucaggacccuguucugc

SEQ ID NO: 160399 - RNA, 45 nt, Homo sapiens
ucggcacaaugaggaccaggcuugcugugaagugguguaugugga

SEQ ID NO: 160400 - RNA, 50 nt, Homo sapiens
uccuucuacccaccucugacccuuccuuauguggcaggaugagcagaugg

SEQ ID NO: 160401 - RNA, 72 nt, Homo sapiens
cuagccucuccauacuuacuccucucacagcccaaauucugaaguugucucccugacccuucuuuaguggca

SEQ ID NO: 160402 - RNA, 131 nt, Homo sapiens
agauggggaaggauccaacucugugugugugugugugugugugugugugugugugugugugugugugugugugugugugugugugugugugugugguguguguguguguguguguguguguguguguguag

SEQ ID NO: 160403 - RNA, 34 nt, Homo sapiens
aaguugagaaugcaguaucucuugguaucuccag

SEQ ID NO: 160404 - RNA, 48 nt, Homo sapiens
uuaaggggucagugggacagucccucuggggcugccucucacagggag

SEQ ID NO: 160405 - RNA, 36 nt, Homo sapiens
gcuugucuucuggggaaucagagagaguccguuuug

SEQ ID NO: 160406 - RNA, 42 nt, Homo sapiens
ugcccaucauccugguggggaauaagaaggaccugaggcaag

SEQ ID NO: 160407 - RNA, 49 nt, Homo sapiens
ggaucagugccuuuggcuaccuugagugcucagccaagaccaaggaggg

SEQ ID NO: 160408 - RNA, 51 nt, Homo sapiens
cagaaauuaucccccuacaaccccagccuccugagggcuccaugcugaagg

SEQ ID NO: 160409 - RNA, 52 nt, Homo sapiens
cuuccccaaaggauggucacacaccagcacuuuauacacuucuggcucacag

SEQ ID NO: 160410 - RNA, 50 nt, Homo sapiens
agcaggggaggggguggaauggcuuggguuguaaacucccucccccagcc

SEQ ID NO: 160411 - RNA, 71 nt, Homo sapiens
cccuccaagggacaggaaggcugggggagggaguuuacaacccaagccauuccacccccuccccugcuggg

SEQ ID NO: 160412 - RNA, 56 nt, Homo sapiens
ucugguucagggucaggcaggcaguuaaggcuuggcuggugcgagaaggcugggug

SEQ ID NO: 160413 - RNA, 42 nt, Homo sapiens
gacagaauuuacugcaaggucugagcaagcucagccccucua

SEQ ID NO: 160414 - RNA, 45 nt, Homo sapiens
ucaucuccaccgugcgaagcagccagagcuuugugcagcuggauc

SEQ ID NO: 160415 - RNA, 45 nt, Homo sapiens
uccagauccagcugcacaaagcucuggcugcuucgcacgguggag

SEQ ID NO: 160416 - RNA, 51 nt, Homo sapiens
gagaggucacugggcaauuguagaucagugagugaaccagugcugcgacac

SEQ ID NO: 160417 - RNA, 30 nt, Homo sapiens
cguggccugucaugugaugcugccaccccc

SEQ ID NO: 160418 - RNA, 45 nt, Homo sapiens
cucaggcgagcuuugcccuucuuggaggagggggccaggagcagc

SEQ ID NO: 160419 - RNA, 42 nt, Homo sapiens
gucuugccggugccuggaggcccaaagaugauguagggggcu

SEQ ID NO: 160420 - RNA, 39 nt, Homo sapiens
gacccggaucaccggaaacccuguggugaccaaucggau

SEQ ID NO: 160421 - RNA, 42 nt, Homo sapiens
guaucuucaugggaaacaugguguggauguggaaguccaggg

SEQ ID NO: 160422 - RNA, 65 nt, Homo sapiens
uguuuuaaacaguggguucuggauuguucguuucugaggggaaaagcccaaucacaggcugcuga

SEQ ID NO: 160423 - RNA, 43 nt, Homo sapiens
ggggaaacuguuugggacagaaaagaaaauacaaacaacccag

SEQ ID NO: 160424 - RNA, 23 nt, Homo sapiens
agcccagucugggggcagaggag

SEQ ID NO: 160425 - RNA, 49 nt, Homo sapiens
uucgcuaauacuuagaauguaaaauuagcagaaauuuggugacugacag

SEQ ID NO: 160426 - RNA, 45 nt, Homo sapiens
gagucuaggauccccaaaucaauggccuggcuucuaggacuaucu

SEQ ID NO: 160427 - RNA, 48 nt, Homo sapiens
ucaauuccgaauacagcaaaaacagcgggggauuuaugaccaaugaac

SEQ ID NO: 160428 - RNA, 55 nt, Homo sapiens
uacaugguaaaauggaggauuauacuagggaugguaagagaaaaaugcuggagga

SEQ ID NO: 160429 - RNA, 75 nt, Homo sapiens
uaugggugagauauggcugcuaaaacagcugaagucuaagauugagcuaacagaagugugauuugggguggggga

SEQ ID NO: 160430 - RNA, 42 nt, Homo sapiens
ugccggcagcuccgggaggcgggccaguguuucgagaguuuc

SEQ ID NO: 160431 - RNA, 56 nt, Homo sapiens
agcucagguaagaaaagaacggaggagggaagccugguggggagaagggagcccgc

SEQ ID NO: 160432 - RNA, 46 nt, Homo sapiens
uugggguaaggggagggcccugagggaggggucagacgcuuuagga

SEQ ID NO: 160433 - RNA, 53 nt, Homo sapiens
aauauccuauccaguacugugauacauuaauguaggcuuacaggcccagaacc

SEQ ID NO: 160434 - RNA, 49 nt, Homo sapiens
ggcuggaggaagaugaucauuccuagaauaauuaugcuuacugggugac

SEQ ID NO: 160435 - RNA, 50 nt, Homo sapiens
uugcucaccuccugcauagcagcacagccccaugaggccacacaccagau

SEQ ID NO: 160436 - RNA, 61 nt, Homo sapiens
augacuucugagcccacaugcagaggcaguugggggugggaagcagggagaacagugagag

SEQ ID NO: 160437 - RNA, 77 nt, Homo sapiens
uaggccuuguguugccuuuuuuuuuuuuuuuuuuuucuuuucuuuucuucucuucccaugcacuauucuggagguuu

SEQ ID NO: 160438 - RNA, 24 nt, Homo sapiens
uccuuuacuccuaucauuaaaaca

SEQ ID NO: 160439 - RNA, 43 nt, Homo sapiens
acuuuguagggugcuagaagaaaaaaacuuggagcccuucuga

SEQ ID NO: 160440 - RNA, 41 nt, Homo sapiens
acaugaacaccuggucaugagauuguugcaguccaccaggc

SEQ ID NO: 160441 - RNA, 46 nt, Homo sapiens
cacuauggccaaacaccuuaugagcaugaucuuugucaaucugaaa

SEQ ID NO: 160442 - RNA, 47 nt, Homo sapiens
ccuccccugaugugguucauauuaaagauucuggaaaaauuccuggg

SEQ ID NO: 160443 - RNA, 47 nt, Homo sapiens
agauaaauaagcacaaucuugcaauggauccaauaacccaguuaggu

SEQ ID NO: 160444 - RNA, 45 nt, Homo sapiens
ucaugcauugaacuuuauuccuaugcagagccaaaacgaauagug

SEQ ID NO: 160445 - RNA, 23 nt, Homo sapiens
gaguugauaguaaaaaggcaggu

SEQ ID NO: 160446 - RNA, 46 nt, Homo sapiens
acaacccagcucagacacagugguuauaugauuuuguguccauaca

SEQ ID NO: 160447 - RNA, 42 nt, Homo sapiens
agucccuaggagggagucuccacguuugacauuccaucagau

SEQ ID NO: 160448 - RNA, 41 nt, Homo sapiens
guccccugagcccccugucuccaggaaucaaguccccaacc

SEQ ID NO: 160449 - RNA, 46 nt, Homo sapiens
uucccuggaguaggugaauggcuugugucaccucuuggauuggcag

SEQ ID NO: 160450 - RNA, 45 nt, Homo sapiens
uuggcacagacuaucgaaaucuagccaacacugccaauccaagag

SEQ ID NO: 160451 - RNA, 45 nt, Homo sapiens
uaaacgcuuagugaguaccggcgaagagcaaggagaggauguuag

SEQ ID NO: 160452 - RNA, 78 nt, Homo sapiens
aucgaaagggaacaacugagagcaaaacugaaccgagaagagaaccggaccaaaacccugaaagaagaaauggaaagu

SEQ ID NO: 160453 - RNA, 46 nt, Homo sapiens
cucucaguuguucccuuucgaugucaaacucugauaacugcuucuc

SEQ ID NO: 160454 - RNA, 46 nt, Homo sapiens
aacuggaagaagaguuggcagcugagagaaagagaggcuugcagac

SEQ ID NO: 160455 - RNA, 42 nt, Homo sapiens
cucggcugccuuguugguggcuuucuugcacucaagcacuag

SEQ ID NO: 160456 - RNA, 64 nt, Homo sapiens
gaagaaaggcagcggcaugcacaggauacggcugaaggagaugaugucaccuacaugcuagaga

SEQ ID NO: 160457 - RNA, 44 nt, Homo sapiens
acagagagauuuugaaacacugaaggagaaaaaugauggcgaaa

SEQ ID NO: 160458 - RNA, 42 nt, Homo sapiens
caauucaugaccuugacaucagaucugcugagaagcugucuc

SEQ ID NO: 160459 - RNA, 45 nt, Homo sapiens
aauuuucaacugacauuuaaucuugguauccuuuccuaucaaauu

SEQ ID NO: 160460 - RNA, 46 nt, Homo sapiens
ucuggacccaaguaaguacuucauaaguauuugucauacaggagaa

SEQ ID NO: 160461 - RNA, 35 nt, Homo sapiens
aaguggauguugugaauuacuaaauuuuaaagccu

SEQ ID NO: 160462 - RNA, 42 nt, Homo sapiens
uguaaguuuauacuugaggacugaagugugacucugccgauu

SEQ ID NO: 160463 - RNA, 55 nt, Homo sapiens
uaaauggguuuauuuuuccaggcuauuaaaauaucuuuuuuaaaaauaaauaucu

SEQ ID NO: 160464 - RNA, 47 nt, Homo sapiens
agagccacaccaacauacuucuaggcaaaaucaguacuacaguuaag

SEQ ID NO: 160465 - RNA, 44 nt, Homo sapiens
ucuuacuggagauuuggaaacaaucacugagaagaccugugagc

SEQ ID NO: 160466 - RNA, 46 nt, Homo sapiens
ucggugcucacaggucuucucagugauuguuuccaaaucuccagua

SEQ ID NO: 160467 - RNA, 47 nt, Homo sapiens
ucaaaauuuagaggaugaaaaguaagaacaauuuuuaaaucucagag

SEQ ID NO: 160468 - RNA, 53 nt, Homo sapiens
ggccagaggaugcgaggggcugcgggaggaagacugagcaucagagaaugggg

SEQ ID NO: 160469 - RNA, 54 nt, Homo sapiens
ucuucccaucccccauucucugaugcucagucuuccucccgcagccccucgcau

SEQ ID NO: 160470 - RNA, 45 nt, Homo sapiens
aaaaggagggauggggcgaagcaaaaaucaaagaccgaccuagac

SEQ ID NO: 160471 - RNA, 43 nt, Homo sapiens
aucuuacggaggaaagcagcuccagucccacccuggcgagcag

SEQ ID NO: 160472 - RNA, 42 nt, Homo sapiens
cccccggaaggccaaacaucccucccuacaccugucccugcu

SEQ ID NO: 160473 - RNA, 48 nt, Homo sapiens
guacgaaaugggguugggggcggcagccuagagaaucgguaccuguga

SEQ ID NO: 160474 - RNA, 41 nt, Homo sapiens
ccuccucggggaauaccgggagguggaggagacggccccgc

SEQ ID NO: 160475 - RNA, 46 nt, Homo sapiens
cauuucugauaaacuugaaaagacuugagucuuuccacugggacac

SEQ ID NO: 160476 - RNA, 45 nt, Homo sapiens
aauacgucugaguuuuucugauaccuaucaggauuaugaggagua

SEQ ID NO: 160477 - RNA, 46 nt, Homo sapiens
aagaaccucuucccagagcaaaggaaauaagucauacuuggaaggc

SEQ ID NO: 160478 - RNA, 49 nt, Homo sapiens
uguaaaucuggauguaccauuggauugggagacauacaugcaucggauu

SEQ ID NO: 160479 - RNA, 46 nt, Homo sapiens
cugccaguaaacagaugcuggcaguaucagcuacuuaucccgaauu

SEQ ID NO: 160480 - RNA, 57 nt, Homo sapiens
cucauuugaaaugaucauuuaaaugaaauauagugugucauguaaugaauauaccag

SEQ ID NO: 160481 - RNA, 38 nt, Homo sapiens
cauauucauuuuuagaaauagggaaaauucagaaaaau

SEQ ID NO: 160482 - RNA, 42 nt, Homo sapiens
gaaauaccaguagcuccucagagcuggaagugaauuugauga

SEQ ID NO: 160483 - RNA, 48 nt, Homo sapiens
gaaaucugugguugcugagcaggaugaaaaguauccuguuagaaagug

SEQ ID NO: 160484 - RNA, 66 nt, Homo sapiens
uuggcacgccaggaggccaagugagccccucucuuagcccaagccccagaguuggggggaccucag

SEQ ID NO: 160485 - RNA, 43 nt, Homo sapiens
aggggugcuuauucuuagcaggaguggcaaacacuggcgucaa

SEQ ID NO: 160486 - RNA, 45 nt, Homo sapiens
agaacagauaugagcaucaagaggccauuuugugcacugccaccg

SEQ ID NO: 160487 - RNA, 58 nt, Homo sapiens
ggccugcugucuacuucccaauccauccccacuaacuauaguuuaugcuaucuauauu

SEQ ID NO: 160488 - RNA, 59 nt, Homo sapiens
auagauggauggaugaauugauagcugcacacauuuaugaauaaacaaauaaggaugaa

SEQ ID NO: 160489 - RNA, 50 nt, Homo sapiens
caguuauuagagacaaguccuaaccauucacugcugcuacacgcagacac

SEQ ID NO: 160490 - RNA, 47 nt, Homo sapiens
ugcacaguugauaguaaauaaacuuagaaugacguaccuguccaguc

SEQ ID NO: 160491 - RNA, 44 nt, Homo sapiens
cuuccuuaaaagaugacagaugcuaaucuugccuuuggagcuga

SEQ ID NO: 160492 - RNA, 41 nt, Homo sapiens
uaaaaaauuaaauagaaaauuuaaauauccugaagugagag

SEQ ID NO: 160493 - RNA, 127 nt, Homo sapiens
gucauauacacugcuguauccguguaauaauguagugcuuuggagauagaaaaccagaaagcugcaccaauagaugggauaaaaggagagauggugguuauuuguguuaagggggguagggggggca

SEQ ID NO: 160494 - RNA, 36 nt, Homo sapiens
accaaauucaaugcgauagcuccaaauaauauaagg

SEQ ID NO: 160495 - RNA, 45 nt, Homo sapiens
augcuaacugacugaggagaaaagaccaaguaaauauguagaaga

SEQ ID NO: 160496 - RNA, 30 nt, Homo sapiens
caaaagaggaauuguagaagggccagagaa

SEQ ID NO: 160497 - RNA, 77 nt, Homo sapiens
ugacuagccuuaaaagucauauuuaucuguuuuacuaugaguucaaggggaaaauuccuuagcuacaaauaauaaaa

SEQ ID NO: 160498 - RNA, 46 nt, Homo sapiens
uaggucauaaguaguggaaaugugguggcuaaaggagcaagcaggu

SEQ ID NO: 160499 - RNA, 36 nt, Homo sapiens
ccugcaagaacugaguugaucuguacaucaacauuu

SEQ ID NO: 160500 - RNA, 43 nt, Homo sapiens
ggccauauuuuuuaauuaaaauugaaauugucacugaguauug

SEQ ID NO: 160501 - RNA, 45 nt, Homo sapiens
gcuuuugcgguuagauggcacccagagccacacacuggcacaaag

SEQ ID NO: 160502 - RNA, 44 nt, Homo sapiens
gaaaacacacucuggagguugggggugaguggggagaaagugag

SEQ ID NO: 160503 - RNA, 48 nt, Homo sapiens
gaaaacugaaucaaaguaaaaaucuguaaggcuuuguaguuuaugggg

SEQ ID NO: 160504 - RNA, 74 nt, Homo sapiens
ggauucuuuggccuugcaaaguguguuauaaaagggaagaacuccucuucuuaaaccacaauagagagcuauuu

SEQ ID NO: 160505 - RNA, 42 nt, Homo sapiens
cauugagauauuuguauuuuuuagauucuaaauuaagaucca

SEQ ID NO: 160506 - RNA, 34 nt, Homo sapiens
uaagaaauaggugacuagucucugaacucuugua

SEQ ID NO: 160507 - RNA, 45 nt, Homo sapiens
gacuccuguuugauuagugaccucuauuaaauguuucuuggaguu

SEQ ID NO: 160508 - RNA, 49 nt, Homo sapiens
aacaacaacaauggugucugaagccaauggugcagcauugcuggcuucc

SEQ ID NO: 160509 - RNA, 46 nt, Homo sapiens
ugaaaccgucacggugcaugcacauccaaggcauguggaaccaaag

SEQ ID NO: 160510 - RNA, 43 nt, Homo sapiens; identical to SEQ ID NO: 76713

SEQ ID NO: 160511 - RNA, 19 nt, Homo sapiens
auucaacguugggauuauu

SEQ ID NO: 160512 - RNA, 46 nt, Homo sapiens
uucagcuuggaggaagcagugcuggugcuaggugcacucccaucag

SEQ ID NO: 160513 - RNA, 46 nt, Homo sapiens
gcagccuucgcuuccuaggcuggucucugcugcugggcagaucucg

SEQ ID NO: 160514 - RNA, 42 nt, Homo sapiens
ccccgccuccaccccgggagcugcugcgcgauucgcccccgc

SEQ ID NO: 160515 - RNA, 45 nt, Homo sapiens
ggguugcugcugucacugagcaagaaguaccguuacagggcagac

SEQ ID NO: 160516 - RNA, 42 nt, Homo sapiens
gcugaaauaacuguccaucacucgcuuaaagggguaggccug

SEQ ID NO: 160517 - RNA, 60 nt, Homo sapiens
cugggacgccuagcggacaccauuuuacgucgcugugguagcugagugaacagccggggg

SEQ ID NO: 160518 - RNA, 85 nt, Homo sapiens
ccaguggacaacugccugcagaguguccugggccaacggguggaccucccugaggacuuucagaugaacuaugaccucugguuag

SEQ ID NO: 160519 - RNA, 102 nt, Homo sapiens
cggccuugggacuuccaggcagaggagugugcccuucgugccaacauugaacgcuucaacgcccggcgcuaugaccgggcccacagcaacccugacuuccug

SEQ ID NO: 160520 - RNA, 49 nt, Homo sapiens
auccuaaaguucuucaaucaaaacaucauguccuacaucacugccaaga

SEQ ID NO: 160521 - RNA, 46 nt, Homo sapiens
ggaggcuccggaguccaucuuuucugugggcaccuagaaaugaggu

SEQ ID NO: 160522 - RNA, 47 nt, Homo sapiens
agcagaagcuuaggggagaucuuggaaaggagaagaaguucauuuuu

SEQ ID NO: 160523 - RNA, 88 nt, Homo sapiens
ugaagauccuguuggcugcagcacccaccucaaaagccaaaacagacucaaucaacauccuagcggacgucuugccugaggagaugcc

SEQ ID NO: 160524 - RNA, 49 nt, Homo sapiens
caagucccugcagaaacccucuaccaaggcuugcuccccagccugccuc

SEQ ID NO: 160525 - RNA, 47 nt, Homo sapiens
uauuacaaguaaaaugcuuggcacauuguuuguguucaggguuugcu

SEQ ID NO: 160526 - RNA, 354 nt, Homo sapiens
ccucucucagggguaaguuggagguccucaguccgggcgcgguggcucacgccuguaaucccagcacuuugggaggccgaggagggcagaucaugaggucaggagauugagaccauccuggcuaacauggugaaaccccgucucuacuaaaaaaaaaaaaauuagccagccgugguggcgggcgccuguagucccagcuauucaggaggcugaggcagaagaaugacgugaacccgggaggcggagcuuguagugagccgagauagcgccacugcacuccagccugggcgacagagcgagaccaucucaaaaaaaaaaguuagagguccucuucagcccccgggauccccagcu

SEQ ID NO: 160527 - RNA, 48 nt, Homo sapiens
ccuuucugucucuccucucauucuuggacucccauuauguacauguug

SEQ ID NO: 160528 - RNA, 27 nt, Homo sapiens
uuuuugagcacuugguggcaucagagc

SEQ ID NO: 160529 - RNA, 56 nt, Homo sapiens
aaaaaggcauucccccuucaucccccuaccuuaaacauauaauauuuuaaagguca

SEQ ID NO: 160530 - RNA, 97 nt, Homo sapiens
agagcaagggaggggagggcacagacagagaggcuacagggcgagcucugacugaagaugggccuuugaaauauagguaugcaccugagguuggggg

SEQ ID NO: 160531 - RNA, 64 nt, Homo sapiens
ccagagccggucuuuaggcuguguuguucgcccagguuucugcaucuugcacuuugacauuccc

SEQ ID NO: 160532 - RNA, 46 nt, Homo sapiens
ugugaacacuguaccugccugcugaacagccugcccccguccaucc

SEQ ID NO: 160533 - RNA, 25 nt, Homo sapiens
cuccuccuuccagcaccugccagag

SEQ ID NO: 160534 - RNA, 42 nt, Homo sapiens
gacuggcuucagggcugacucacggacugacccuggccagcu

SEQ ID NO: 160535 - RNA, 86 nt, Homo sapiens
auacuguugucauauguugagccuguggucuauuaaaaccccuaguuccauuucccauaaacuucugucaagccagaccaucucua

SEQ ID NO: 160536 - RNA, 47 nt, Homo sapiens
cugaggucaguucugcuuccuugcuuuuaggaucauguugacauaga

SEQ ID NO: 160537 - RNA, 46 nt, Homo sapiens
gagccaucaagagccucagagagcggauucucccuuggagcaacca

SEQ ID NO: 160538 - RNA, 68 nt, Homo sapiens
aacagccggcagauguaacugguaccgccuugcccagggugggccccgugaggcccacuggccaggac

SEQ ID NO: 160539 - RNA, 51 nt, Homo sapiens
cuuucccccuccaggccaggagggggcagcaugcagacagagcccgccaga

SEQ ID NO: 160540 - RNA, 48 nt, Homo sapiens
uugacucugcaaugggcacuaauugggucccagaagaagccucuggag

SEQ ID NO: 160541 - RNA, 54 nt, Homo sapiens
gcggccacccaggagcaccugccagagcuuugagccgccagagaccccaguugu

SEQ ID NO: 160542 - RNA, 58 nt, Homo sapiens
guaccccaaagccaucccuagcagugacccggccucugucuccccucaucagccccuc

SEQ ID NO: 160543 - RNA, 60 nt, Homo sapiens
ccucaggacuuuugcacggucuguucuugcagccuggacagcucucugggaucccaucuc

SEQ ID NO: 160544 - RNA, 51 nt, Homo sapiens
ggaggacaccaugcgcuucagagauaacacccccaaugccaucgccauugu

SEQ ID NO: 160545 - RNA, 74 nt, Homo sapiens
ggggcagagccuguagcauuguagauaugaggccuuuguuuuucugcguugagcagggcauggggauaacuggg

SEQ ID NO: 160546 - RNA, 67 nt, Homo sapiens
augaccagucagugggcucauaauagauuugcuucugaggaguccuggaagaaaaugagaggggaaa

SEQ ID NO: 160547 - RNA, 28 nt, Homo sapiens
agggacuugcuggcagagggacggagag

SEQ ID NO: 160548 - RNA, 46 nt, Homo sapiens
gggaggggaggcgggggaaggcggcugagugggccucuggagugug

SEQ ID NO: 160549 - RNA, 28 nt, Homo sapiens
caggguggggacgcgguggagcccgcgc

SEQ ID NO: 160550 - RNA, 41 nt, Homo sapiens
gugcugggugccuuggaauguacugagagacaugugugugc

SEQ ID NO: 160551 - RNA, 37 nt, Homo sapiens
uagcuacugguauguagagaggggacuccacugagau

SEQ ID NO: 160552 - RNA, 45 nt, Homo sapiens
gaggacuagggaaacugugagcgggaggggcuuuauacccgacau

SEQ ID NO: 160553 - RNA, 105 nt, Homo sapiens
cgccccuccccacagggcccgcgaucccagaggcugggcaggggucgacauccguggcucggcagcucgaaaaggcucccgcguagagcugcuccugcuggagau

SEQ ID NO: 160554 - RNA, 44 nt, Homo sapiens
ggaguucacggauaccucuuaugaggagaaacgguacacgugcg

SEQ ID NO: 160555 - RNA, 44 nt, Homo sapiens
agacugaagaagaaaagauucgaguggacaucauagagaaccaa

SEQ ID NO: 160556 - RNA, 1078 nt, Homo sapiens
ggcauggcggccggggcgcucuucggcaccuuuuccugucucaggugaggggcgcgggcggugaucucugggcaggacaaccagaccuuccggcccugccccauucggccuggagccugaacacagccuccuucuuucgacuucccucucuguccccucgcgagccagacucauuccaaaccaccuucaaucuguaaagucagguuggaagcgucagugcuuaagaauuugagcuuuagagucaaaaugcuuucuggcccuuuucuuacugguucggugacuuuaggcaaguuggagacuggguuuccuuaaguguagaaugaagacaguagcaucuaacuuauagaguuguaaaaauucgaucagcacacuuugcacagcaucuggcacauauuaagugcucaguaacuaguuacuacuguugcuuuuauuuuuuuuuccaauugcgcauaaggaaagaaacucguucagcgguuuuacuauucuggauacaggauacagagauaaagcaguuaaacuuuacacucuaaaggucauuuucacauuuagaggcuguuauugccauaucccuagauuguaaauuaucauuuacagagcacuuacucuauguuaagcacugugcuaaauacuguaguuuucaaaauccuguaaauaauguugagaugcccauuuuacacuugacacuauguguaaauuguagagcugacucuugaacccccaccuuacuccaaaaucauuaacaccaagaaacuaaaagacagaugucuuuauugggucuuaaacugcaggcaacaccagucaaaaaagcugguuucucuauguauuuuacacugcaucugcugccucccacaaacugaaggcaguuaauacgacauccaccagaaaaauacccuggagacccagauggaucuuuuuccuucucauuacccaccccagguaguaagauauaauauccaguaaguggaaaaucagauguagggguugcuagacuaguguuagcaaaaaauuggaaaggagcaguuaauacucuuucugauauuuuuguuaccaaauagcuccaucuugguuuccuccucag

SEQ ID NO: 160557 - RNA, 58 nt, Homo sapiens
caguuagcuggggucuagaagauuacgaagacaugacacuuacaagauggacagggau

SEQ ID NO: 160558 - RNA, 53 nt, Homo sapiens
gauaauugggccuccaggaacaauuuaugaaaaccgaauauacagccuuaaaa

SEQ ID NO: 160559 - RNA, 52 nt, Homo sapiens
aauaugaauggaguuaauaguucuaauggagugguggacccaagagccauac

SEQ ID NO: 160560 - RNA, 79 nt, Homo sapiens
auuaaccaaaaagaaaaaccacaggcccuuccccuuccccccaacauucgauuuaagcagucuucauuuuucaguagua

SEQ ID NO: 160561 - RNA, 42 nt, Homo sapiens
cggccucauggucucccuguccacugaugaucccuugcaguu

SEQ ID NO: 160562 - RNA, 45 nt, Homo sapiens
ugcccaggcccccguccugcaguaccuguacuaccuggcccagau

SEQ ID NO: 160563 - RNA, 47 nt, Homo sapiens
gccccguaugaguuccccgaggagagccccauugaacagcuggagga

SEQ ID NO: 160564 - RNA, 42 nt, Homo sapiens
cugggggccccuccgcugcagucugcccgaucccugccgggc

SEQ ID NO: 160565 - RNA, 42 nt, Homo sapiens
uacacacgugcaccugccucugggagguagucacguggagau

SEQ ID NO: 160566 - RNA, 60 nt, Homo sapiens
cccugguguggccgccugguccuuaccaagcaccuggugugugucucugagggugucugu

SEQ ID NO: 160567 - RNA, 45 nt, Homo sapiens
gcuuaggcuguucuguggcuaguuccacuuuuuaggaccccacau

SEQ ID NO: 160568 - RNA, 24 nt, Homo sapiens
aauggagcgggggugugugggacu

SEQ ID NO: 160569 - RNA, 58 nt, Homo sapiens
gcuuccugcaucagucacucccgcugggggcggggcggaggaagggguuggauguggc

SEQ ID NO: 160570 - RNA, 56 nt, Homo sapiens
ccgccccccgccaggcccagccaccaucagucacgucacuccugggacugaggagg

SEQ ID NO: 160571 - RNA, 23 nt, Homo sapiens
gggcaaaggagccccaggcaucu

SEQ ID NO: 160572 - RNA, 45 nt, Homo sapiens
cgggagggcauggaagauaauuucuuucuccauuggggccggaaa

SEQ ID NO: 160573 - RNA, 43 nt, Homo sapiens
cuuuuuauaacuuuauauuauuuuuuuuuaagaaaaaaagcuc

SEQ ID NO: 160574 - RNA, 44 nt, Homo sapiens
gaacucugaggacagggucaguugggaggucucguaggguaaug

SEQ ID NO: 160575 - RNA, 45 nt, Homo sapiens
guggggaccugggagaguaucuauuugggaugccacauaguagca

SEQ ID NO: 160576 - RNA, 47 nt, Homo sapiens
uuucguucuauccaucauuccccgcacuugcauuuaacggacuuaga

SEQ ID NO: 160577 - RNA, 46 nt, Homo sapiens
uucggggugacagcaggcaucacgccccugaagaaguuugcaagug

SEQ ID NO: 160578 - RNA, 41 nt, Homo sapiens
guggguggagcgggccgaccugcccgcggcugacggugagu

SEQ ID NO: 160579 - RNA, 47 nt, Homo sapiens
aaagaccagaaugaugggggaggggaauuggaggaggaggaagagaa

SEQ ID NO: 160580 - RNA, 50 nt, Homo sapiens
acucuuuaggauguaaguacuaauaagcuucccuaccuucaaggcagaga

SEQ ID NO: 160581 - RNA, 54 nt, Homo sapiens
gggaacccugggaaggcgcugguccccuugccccacucacacgcgguccagggg

SEQ ID NO: 160582 - RNA, 71 nt, Homo sapiens
agcgcucgguguucacacugaacuguggggucgacgggaggggugccuuuuacauguucuauuuuguaucc

SEQ ID NO: 160583 - RNA, 44 nt, Homo sapiens
accccucccgucgaccccacaguucagugugaacaccgagcgcu

SEQ ID NO: 160584 - RNA, 42 nt, Homo sapiens
cgcacacacugcccgcacagggcucgcucacacugaccgcag

SEQ ID NO: 160585 - RNA, 41 nt, Homo sapiens
ucggggcccaggccuaccuggaccacgugugggaugaaggc

SEQ ID NO: 160586 - RNA, 40 nt, Homo sapiens
ccuuccuggggccuaacagcguuacuggguccugauuauu

SEQ ID NO: 160587 - RNA, 53 nt, Homo sapiens
ggucaugcuggaggcaaagcaagcgcccaggaguggcaccucccgcacagcua

SEQ ID NO: 160588 - RNA, 45 nt, Homo sapiens
agugggauaaagaggcugguaccugucagauggugacagcccccc

SEQ ID NO: 160589 - RNA, 58 nt, Homo sapiens
ggugaguaccccucccggcaaggcccaggcuccucagauggacguuucgucgcugcug

SEQ ID NO: 160590 - RNA, 46 nt, Homo sapiens; identical to SEQ ID NO: 76803

SEQ ID NO: 160591 - RNA, 54 nt, Homo sapiens
caggucagcgaccggggcccgcccagagcacaggcucugcuucgggucaggcau

SEQ ID NO: 160592 - RNA, 42 nt, Homo sapiens
ccuguguggcagacagcccaaagccccgcugggugcucucgu

SEQ ID NO: 160593 - RNA, 49 nt, Homo sapiens
cacacaugggcucuaggggaacagggcauacgaccuccuugagccccca

SEQ ID NO: 160594 - RNA, 40 nt, Homo sapiens
uugugguggcguaacuccaggacucgguggugagcugacg

SEQ ID NO: 160595 - RNA, 41 nt, Homo sapiens
aaguguugcugucacacacguucuucuuggcagggcagccu

SEQ ID NO: 160596 - RNA, 45 nt, Homo sapiens
accguggugguugacuccccuggggaaaggaccaggugagcugga

SEQ ID NO: 160597 - RNA, 41 nt, Homo sapiens
ccgggggcgucggugucccgcuguacguugaagaccaccac

SEQ ID NO: 160598 - RNA, 45 nt, Homo sapiens
agacaaagccucaggagaggagccagcaaugggcaagugggagag

SEQ ID NO: 160599 - RNA, 46 nt, Homo sapiens
caaagcugauuguuuuuguaauuggagggaucacauacucugaagu

SEQ ID NO: 160600 - RNA, 88 nt, Homo sapiens
aaggaacuacggaagaaaauuuggacagguugauccagaauguaaagauagaaaaugagagugacaugauucguaacuggaguuaccu

SEQ ID NO: 160601 - RNA, 46 nt, Homo sapiens
caucuuaacuuagcagaagauugcaugaauaaguucaagcuuaaua

SEQ ID NO: 160602 - RNA, 347 nt, Homo sapiens
aauaguuaacaacauuuuugucuguccugcuucauuaaaauuuuuuuauuuuauuuuauuuuuugagacauagucucacucugccaugcaggcuggagugcaguugcgccaucucagcucacugcagucuccgccucccaggcucaagugauuguuuugccucagcgggauuacuggugugcaccaccacaccugacuaauuuuuguauuuuuaguagugacaagguuuugccauguuggccaggcuggucucaaacuccuggccucaagugaucugcccacuuuggugcugggauuacaggugugagccacugugccuggccauaaaguuuauuuuaaggccauuu

SEQ ID NO: 160603 - RNA, 42 nt, Homo sapiens
agcacagugauucugucuuuggucaucuguaauccacacagg

SEQ ID NO: 160604 - RNA, 55 nt, Homo sapiens
gcauauacaaacaggauagaauaugagcauuuaaugauuuauauaggcaccagaa

SEQ ID NO: 160605 - RNA, 47 nt, Homo sapiens
cuaagguugaaaucugggaaauaccagcauuuacaugugggugagag

SEQ ID NO: 160606 - RNA, 23 nt, Homo sapiens
auguauuuuuauaagguaguaau

SEQ ID NO: 160607 - RNA, 50 nt, Homo sapiens
aaaaguuuccuuuaaacuuauuauuuuaauauguaaguuuaguauagggu

SEQ ID NO: 160608 - RNA, 51 nt, Homo sapiens
uuaccaguuuauuacaaaagauacaaaugaacagccagguuggagagguac

SEQ ID NO: 160609 - RNA, 110 nt, Homo sapiens
uguauuaauauaaacaaaggguuguauuucaggaaggugacucugacagcugugugaaaaauggauugaaauagcaaagguguuggagguggaaagcaggaaauccagau

SEQ ID NO: 160610 - RNA, 35 nt, Homo sapiens
gucgggaagauggcgccgccgguggcagagagggg

SEQ ID NO: 160611 - RNA, 45 nt, Homo sapiens
ccuuucucuugaucgcucucucucuuuuucucguucauuuccucu

SEQ ID NO: 160612 - RNA, 94 nt, Homo sapiens
cgggaucuucgccguucuuucucccuuucuuuggcuucacgcucuagucgcuggcguucuuucucucuuucuaauucucugucaaaacuagaag

SEQ ID NO: 160613 - RNA, 46 nt, Homo sapiens
cuugaccuucuuggggaccuccguggacucagagaucuccuuggag

SEQ ID NO: 160614 - RNA, 45 nt, Homo sapiens
cccaacuccccccaggggugggcaggagguugggggaggagagag

SEQ ID NO: 160615 - RNA, 409 nt, Homo sapiens
ccuuccugaaguaggcacgcacacuuaagacuaauaauccaccuuuguuucuucugcugaacucaccucuguuuuuuuuguuuguuuuucuguuuuuuguuuuuuuugagagggaguuucgcucuuguuucccaggcuggagugcaauggcgcgaucuccgcucaccgcaaccuccgccuccuggguucaagcgauucuccugccucagccucccgaguugcugggauuacgggcgcaugccaccagggccggcuaauuuuguauuuuugguagacgggguuucucccuguuggucaggcuggucucaaacucgcgaccucaggugauccgcccaccucggccucccaaagugcugggauuacaagcgugagccaccgcgcccggccuaacucaccucugguuuuauuc

SEQ ID NO: 160616 - RNA, 61 nt, Homo sapiens
augaguuuuauucucagcaaauagaccugucaaauuuagauuauguuacucaaauuauguu

SEQ ID NO: 160617 - RNA, 75 nt, Homo sapiens
uauacaugugcacaugcggcauuuuacuaugaaauuuaauaugcuggguuuuuuaauaccuuuauauaucauguu

SEQ ID NO: 160618 - RNA, 101 nt, Homo sapiens
ggcccuuauucguccugauuuuccacgccaucucccccaucccccauuucauugccaaaagagucaccuaugacucagaugcaaccaguagugccugucgg

SEQ ID NO: 160619 - RNA, 29 nt, Homo sapiens
acuuuucuuuuuggauuuugccugggucc

SEQ ID NO: 160620 - RNA, 24 nt, Homo sapiens
caggcaaaauccaaaaagaaaagu

SEQ ID NO: 160621 - RNA, 46 nt, Homo sapiens
augaucaaugacuuuggugaucagaaucagaaguucggauuugaag

SEQ ID NO: 160622 - RNA, 39 nt, Homo sapiens
cauaucaaaucaacagaaaauauaccuuggugccaccaa

SEQ ID NO: 160623 - RNA, 65 nt, Homo sapiens
uauagaaaacaacgcugcauauacagguaccauuuaggaaauaccgaugccuuugugggggcaga

SEQ ID NO: 160624 - RNA, 47 nt, Homo sapiens
auucucagagggcaaaaaucuggaagacuuuuggaagcacacucuga

SEQ ID NO: 160625 - RNA, 38 nt, Homo sapiens
uucagaauguugugugauucauuucaagcaacaacaug

SEQ ID NO: 160626 - RNA, 44 nt, Homo sapiens
cugcauaaggaagcccacuuuaucuaaaugauauuagccaggau

SEQ ID NO: 160627 - RNA, 39 nt, Homo sapiens
ggcugggggugggcaugggggacagaggugugugucuuc

SEQ ID NO: 160628 - RNA, 41 nt, Homo sapiens
gaaccuacggguguaggggcagugaaaauugcaguuggucg

SEQ ID NO: 160629 - RNA, 62 nt, Homo sapiens
auuuaugcauucuuuaaagccaaaggaaucaaagugaaauuucacaccuagucuguaucaag

SEQ ID NO: 160630 - RNA, 62 nt, Homo sapiens
ucuugcaaaguaaauuaucauuccaauggcagguauuauuaaggaggaugcaaaauagagca

SEQ ID NO: 160631 - RNA, 45 nt, Homo sapiens
cuugaacaucaaguguuaaacuucuuaauugugagccaacuuugu

SEQ ID NO: 160632 - RNA, 67 nt, Homo sapiens
uucaggauuauccauguuucuggaacauuuccacauguacaagagaugaugacagugucuccuucuu

SEQ ID NO: 160633 - RNA, 50 nt, Homo sapiens
ucaacaauagcuucccuggagcuauuugugcuuagcguuugcauuaaaug

SEQ ID NO: 160634 - RNA, 45 nt, Homo sapiens
uacaugucaacaugacugagucuccaaucugagcagcaauccggg

SEQ ID NO: 160635 - RNA, 45 nt, Homo sapiens
uugggaguaaucaacauauuguaguccaauuccugggaaucuagu

SEQ ID NO: 160636 - RNA, 31 nt, Homo sapiens
auaugcauacacacacacacauacacacaca

SEQ ID NO: 160637 - RNA, 45 nt, Homo sapiens
cuagucauuauuuuauaguauuuaugaaauagugcaauauaucaa

SEQ ID NO: 160638 - RNA, 46 nt, Homo sapiens
cagaagaugaagaagacgccgcuaaagauacuuauauuauugaaug

SEQ ID NO: 160639 - RNA, 48 nt, Homo sapiens
uuuaguucccuauauauaucguucaaaagauccaguucagagaaggua

SEQ ID NO: 160640 - RNA, 46 nt, Homo sapiens
augcuuggucuuuagguucuugaacaggcuggauguuaacauacaa

SEQ ID NO: 160641 - RNA, 46 nt, Homo sapiens
uuacccaaaaggggguggugaagugauuguucgaaugucaccaguu

SEQ ID NO: 160642 - RNA, 41 nt, Homo sapiens
uucuagggaaaauauuuucaagggaauuuucacagugaggu

SEQ ID NO: 160643 - RNA, 33 nt, Homo sapiens
accuuguuauauaguaacuaaucauauccagac

SEQ ID NO: 160644 - RNA, 38 nt, Homo sapiens
cgaccccccgaucccccagcuucacggcccaacucccc

SEQ ID NO: 160645 - RNA, 43 nt, Homo sapiens
ugcacccgcaaggggaggccuaggagacagcucaaggccguag

SEQ ID NO: 160646 - RNA, 38 nt, Homo sapiens
ucuucucccuguaccccaaccuuugcagggcggccaga

SEQ ID NO: 160647 - RNA, 41 nt, Homo sapiens
gucccccauggcggggccgcggguggaggucgauggcagca

SEQ ID NO: 160648 - RNA, 46 nt, Homo sapiens
ccauucccgagauauucuguuguacuuaucucugucuguuuuauag

SEQ ID NO: 160649 - RNA, 103 nt, Homo sapiens
aaaaaugcugccauuacuguuaauauuugggugauaaauucuuguuguaaaugcaaccuuagaugguuugaagggguagucuguaggaaaacgaauuguccaa

SEQ ID NO: 160650 - RNA, 44 nt, Homo sapiens
auuaauccguuucagcgccauagugugugcuugucgucuggcuc

SEQ ID NO: 160651 - RNA, 26 nt, Homo sapiens
uugucucgucucacaccagcucugcc

SEQ ID NO: 160652 - RNA, 46 nt, Homo sapiens
auugcugauugaccaaggucgaauccaguauuugcagcagaaggga

SEQ ID NO: 160653 - RNA, 49 nt, Homo sapiens
ugggaaguaggcuuuaugcagaauaaaucauuaaagaaauugagaagau

SEQ ID NO: 160654 - RNA, 36 nt, Homo sapiens
caaugacuaaauguauuuugucagaaaauaauaguu

SEQ ID NO: 160655 - RNA, 48 nt, Homo sapiens
acuucaguuccuuugucagugaauugggaauuuuuaggguuaaaggaa

SEQ ID NO: 160656 - RNA, 49 nt, Homo sapiens
cgugggcacauagguauagauuagaaugguugugaucuuucaggagagc

SEQ ID NO: 160657 - RNA, 67 nt, Homo sapiens
uucucgguaggauuuuuauggcuuaggugacuaagugguguucuuuccugagauaaggaaugaagga

SEQ ID NO: 160658 - RNA, 48 nt, Homo sapiens
augggaguacauggugcaaaguagaguucagcaaugaugggacuggag

SEQ ID NO: 160659 - RNA, 28 nt, Homo sapiens
uuuagaaaagagacccaggcaaauacau

SEQ ID NO: 160660 - RNA, 42 nt, Homo sapiens
aauauauagaaagagccaagcucaagcuaggaguuaaaaguc

SEQ ID NO: 160661 - RNA, 77 nt, Homo sapiens
cuucuauuuuagguaacauugaaaauuuaaaguuacuugguccaagaagaugcuuuguugaguuuggagcgggaaag

SEQ ID NO: 160662 - RNA, 67 nt, Homo sapiens
uuugauucuugaacccuucugagccuagacuuguucuugaccuugaggaaguuaggaaaauuaaagu

SEQ ID NO: 160663 - RNA, 52 nt, Homo sapiens
agggaggauggcagguacagagcaggggauaaagggaagaaucaguauuuua

SEQ ID NO: 160664 - RNA, 27 nt, Homo sapiens
cucaguuacuuugacaacaaaauacuc

SEQ ID NO: 160665 - RNA, 56 nt, Homo sapiens
cuguuucuaaauucaacuaauaaauuuuaaaugugcuuuuuuuuuccuaugcuaca

SEQ ID NO: 160666 - RNA, 74 nt, Homo sapiens
ugauugaagucccaaagguuucacuaguuguguucuaauuguuauuucaugaaagagaagcacuucucgugaau

SEQ ID NO: 160667 - RNA, 42 nt, Homo sapiens
ucuaaguaaagcgccagcagugacccauuuauuuugaucuau

SEQ ID NO: 160668 - RNA, 41 nt, Homo sapiens
uacauccagaacuagaggugaaaacuaagaccugggugcug

SEQ ID NO: 160669 - RNA, 46 nt, Homo sapiens
gccucuccuggcgcuuguguauuaugaggauggcugugacugccac

SEQ ID NO: 160670 - RNA, 46 nt, Homo sapiens
aaaaugugcugggacaagacgguuugcucaccaucuuaacugacac

SEQ ID NO: 160671 - RNA, 25 nt, Homo sapiens
ugaaagaagaggcagauaugucaag

SEQ ID NO: 160672 - RNA, 46 nt, Homo sapiens
cugcugaagggucagagaaaacccaaaaauguaagcauagaaagaa

SEQ ID NO: 160673 - RNA, 56 nt, Homo sapiens
aagguaaguaggaaauuucuugagguuguucauaggaaggcucugcccugcacaaa

SEQ ID NO: 160674 - RNA, 38 nt, Homo sapiens
uaaaaaguuguccucucuaagacagcauuuuagguaca

SEQ ID NO: 160675 - RNA, 76 nt, Homo sapiens
ucuucaaaauggcucuguaacacacccuggagguaggaggcuagagagcgagccaggauggguucuggucuucacc

SEQ ID NO: 160676 - RNA, 49 nt, Homo sapiens
ucaaauggcagacucacuaucugaugaucuuggccuucucugagauucu

SEQ ID NO: 160677 - RNA, 32 nt, Homo sapiens
uuaaaucauucuuaaauuuugaacaugugaau

SEQ ID NO: 160678 - RNA, 46 nt, Homo sapiens
cuguuacacagcugacauauaguguauuaccuuugcagcuaguaaa

SEQ ID NO: 160679 - RNA, 42 nt, Homo sapiens
gaaucuucauuaauuugguucuuuacuguuuugaggggagaa

SEQ ID NO: 160680 - RNA, 45 nt, Homo sapiens
ucagcugcuuccauucaaaugcugccuuaaacuugagugccuaaa

SEQ ID NO: 160681 - RNA, 46 nt, Homo sapiens
ugugaaccugaaguauuuaugauaagaaaaagaaaacaucucugcu

SEQ ID NO: 160682 - RNA, 36 nt, Homo sapiens
uuuugggggaggguauuagaguugucaggcucaaag

SEQ ID NO: 160683 - RNA, 46 nt, Homo sapiens
gccuuuagggcauuuuguuauuuccgcugaaucauuaguuauuagg

SEQ ID NO: 160684 - RNA, 47 nt, Homo sapiens
cauccaagauuaauuguucacuaugugagcugaguguaggcuugauc

SEQ ID NO: 160685 - RNA, 47 nt, Homo sapiens
gucauacauagauguaacucuagagaaaaacaguaaaggugcaguaa

SEQ ID NO: 160686 - RNA, 50 nt, Homo sapiens
augaaagaaggugaaguucucuacauuauagaggaggacaaaggugacgg

SEQ ID NO: 160687 - RNA, 61 nt, Homo sapiens
cuaguaggguuucauuguauuuugugcauuguauuaguaacuuuaaaaaaaauuaucacaa

SEQ ID NO: 160688 - RNA, 47 nt, Homo sapiens
uacugacuauguuaucucuuacucuaugaaaguugaagaacaaacuc

SEQ ID NO: 160689 - RNA, 45 nt, Homo sapiens
gccaccccagcagcauggucaccacaaugaguuugaugaugaauu

SEQ ID NO: 160690 - RNA, 56 nt, Homo sapiens
aauacuuugugccuagaauauuguaaucuuguaauuuuuuuuuaauucaggaaauu

SEQ ID NO: 160691 - RNA, 48 nt, Homo sapiens
ggcucucugaagucgaaggcaaaacaggugggagaggagacagaagac

SEQ ID NO: 160692 - RNA, 40 nt, Homo sapiens
uuuuauaaacuucauuaugauagauugguuuuuguuagaa

SEQ ID NO: 160693 - RNA, 46 nt, Homo sapiens
aacaaaaugaaagauguauaugagaagaauccacaaaugggggauc

SEQ ID NO: 160694 - RNA, 69 nt, Homo sapiens
uagaauucaggagagagaggucuggagauaugcauuugaaaaucaucugaagauggaugauauuaaaac

SEQ ID NO: 160695 - RNA, 41 nt, Homo sapiens
aauacuaguacuuuuucuuaaauugcauaguuuuuugaaua

SEQ ID NO: 160696 - RNA, 46 nt, Homo sapiens
accguuugguauuuacuagauauuuaucucaaaaauuaaccuauag

SEQ ID NO: 160697 - RNA, 86 nt, Homo sapiens
auuuauuauuagcuauaccacuccagagaagaaagcagugugaaagagaaaauaugacaaaccaacuagggguuuagaggacagag

SEQ ID NO: 160698 - RNA, 58 nt, Homo sapiens; identical to SEQ ID NO: 76958

SEQ ID NO: 160699 - RNA, 68 nt, Homo sapiens
agauguacaaggaauacuggaauuaaaaaaaaaaaggugaaauaaggaugaaauagaaacagccugag

SEQ ID NO: 160700 - RNA, 44 nt, Homo sapiens
gaaccauuucugaugggacuaucagugcauccaaacaggagagu

SEQ ID NO: 160701 - RNA, 42 nt, Homo sapiens
uugaaagagaauguagagaggcagaaaaggcacaacagaguu

SEQ ID NO: 160702 - RNA, 95 nt, Homo sapiens
agauauccaaggaucccaggauauuuaaagaagacaucuaaugugcacaugagggaccagaacuaauaugcaggaaagaaggcaaugugacuaug

SEQ ID NO: 160703 - RNA, 91 nt, Homo sapiens
uucuucugaggaauucucagagcacagguugcaaggugcguauuuuccaggcaagaaauuggaagucuuucgggguaaucuaaucauuuag

SEQ ID NO: 160704 - RNA, 58 nt, Homo sapiens
aaauauaaaaauacuuuuguacauaaguagccucaguuuguaccagaauuaguagccu

SEQ ID NO: 160705 - RNA, 114 nt, Homo sapiens
ucuguacugggcggggcaggcucugcuaagcaagaguaggggaguagaaguggcuguacuucgucugccacaccaaggaugaagggaaaaacaaucuuuucuggaguauauuuc

SEQ ID NO: 160706 - RNA, 67 nt, Homo sapiens
uuccucuggaugccuuugacagaauuagauuacuuaccucugcccuggcuguggggagucuaggaga

SEQ ID NO: 160707 - RNA, 44 nt, Homo sapiens
acgaaaagcucaacaauaucuugacaugugcuggaaacagaugg

SEQ ID NO: 160708 - RNA, 46 nt, Homo sapiens
aauggcgcacagaguguauggugaauuaaugagauaugcucaugau

SEQ ID NO: 160709 - RNA, 46 nt, Homo sapiens
aaauguagacuaggacuccacuugaaugauuuagucugcagaagaa

SEQ ID NO: 160710 - RNA, 51 nt, Homo sapiens
uccuauagaaaucugguuaagaaguacugccccaaacguucauccaaagau

SEQ ID NO: 160711 - RNA, 46 nt, Homo sapiens
uccugcugcugcagcucugucucucccauacaaggucgauccagau

SEQ ID NO: 160712 - RNA, 48 nt, Homo sapiens
gagauggagguggacgcaccggguguugauggucgagauggucuccgg

SEQ ID NO: 160713 - RNA, 28 nt, Homo sapiens
ccuuuucgauguggugguguuucucuuu

SEQ ID NO: 160714 - RNA, 35 nt, Homo sapiens
uagaagaauuucacaucuccaagggacccuuccuu

SEQ ID NO: 160715 - RNA, 82 nt, Homo sapiens
cacaccaaacuguccauccagcuccucaacuaacgauuuucaggcaaacucaggugccauugaugcauuuugccaaccagaa

SEQ ID NO: 160716 - RNA, 72 nt, Homo sapiens
aucuuccgaagcacaguuuaaguacagcuucagaaccaaguuuagaagugaguacacauaugaaugaugaaa

SEQ ID NO: 160717 - RNA, 45 nt, Homo sapiens
gaacauauccaccagucagaugaacagaaacuugaaaaaccgaau

SEQ ID NO: 160718 - RNA, 45 nt, Homo sapiens
uuucuagugaccagauuacgacaagcaaccuaaauaaagaacgug

SEQ ID NO: 160719 - RNA, 41 nt, Homo sapiens
aaagguuuaaugaccauauaugaagaugaaaugaagcagga

SEQ ID NO: 160720 - RNA, 42 nt, Homo sapiens
gaaacauuaaauguugauaguauuuuuagugaaagugaaaaa

SEQ ID NO: 160721 - RNA, 71 nt, Homo sapiens
aacagaaaaacuuacuuucuucacaaaggaaagauuuagagaagggacaaagaaaagauuuaggacgacau

SEQ ID NO: 160722 - RNA, 49 nt, Homo sapiens
aaguuaagucacauugaucaaagggaaaagauaaaagacauuuccagag

SEQ ID NO: 160723 - RNA, 60 nt, Homo sapiens
agaaauuuccaacugauaauauuucaucaucuaaucggagccacagucacacagguguag

SEQ ID NO: 160724 - RNA, 45 nt, Homo sapiens
ucauaagucagauaauuuaaaagaaaauggauuuggugaucaggc

SEQ ID NO: 160725 - RNA, 44 nt, Homo sapiens
gaugcacucaggcaggucaucagcuggucacauuacaaaucugu

SEQ ID NO: 160726 - RNA, 79 nt, Homo sapiens
ucuuuuguuuucuucuguaaguuuuaguuuuugugugagccauucugaguucauuuuuuuguuguuguuuuauaugaag

SEQ ID NO: 160727 - RNA, 48 nt, Homo sapiens
aaucugugaacauauuuuuuuccguugcuguuagauaauaccuugaag

SEQ ID NO: 160728 - RNA, 53 nt, Homo sapiens
auuaugugucaaagacaugauucaucuaauuauuccucauuuuacaaaagaug

SEQ ID NO: 160729 - RNA, 51 nt, Homo sapiens
guuaacaaugugaugucaguggugccuucaaguaauaauauaauauuagau

SEQ ID NO: 160730 - RNA, 53 nt, Homo sapiens
agucaugugucauuagagauacucuauuauugcuaaacuaauuuguagugaau

SEQ ID NO: 160731 - RNA, 54 nt, Homo sapiens
uuucaauuacaaacuaaacugucucauggcuuuugcuucuuucacucuaaaauc

SEQ ID NO: 160732 - RNA, 41 nt, Homo sapiens
uucaaauucuucuaaaacaucauccugauguuuuaucugau

SEQ ID NO: 160733 - RNA, 41 nt, Homo sapiens
aaaaaauaaaaauucgccguguuuuaaugaauugcccagag

SEQ ID NO: 160734 - RNA, 84 nt, Homo sapiens
acaccaaggaaauauggguggcgauggcaggagcuuuaugagcaaggaagagagugguagaaggugagcucugaggugagggua

SEQ ID NO: 160735 - RNA, 54 nt, Homo sapiens
gcaaaauauuauagaguauguuagaugguaauaguuguaacauuggaaaaauac

SEQ ID NO: 160736 - RNA, 177 nt, Homo sapiens
uuugcaaaaacacugaguuaucugugacagaaaaauggauccuauucauuaugcuuuaauaaaaggcaacguuuaaagagaaauuuugaaaugaccuuuaguuguggaguaguugaaaauauaggaaauauuaaagccaguuuguuuuuauuaacuuuuuguuuuuauuugggagaa

SEQ ID NO: 160737 - RNA, 25 nt, Homo sapiens
auuuguauaaauacuggguacauuu

SEQ ID NO: 160738 - RNA, 47 nt, Homo sapiens
cucaucacuuuuuugcauagauccacauuccaucugauauccuuuuc

SEQ ID NO: 160739 - RNA, 66 nt, Homo sapiens
guaagaaggauaacaauauauucuagagcaauuuaguguugacagauacagcauaccagcugaaau

SEQ ID NO: 160740 - RNA, 2681 nt, Homo sapiens
uuagacaaaacuguuaguaauacagguauaccacugagguauugcagguuugauuccagaccacugcaauaaagcaaguugcaggaauuuuuuuguuucccagugcauauaaaaguuauguauacacuauaccacagucuauuaagugugcaaaauagcauuauuucuaaaaagacaauguauauaucuuauuuaaaaacuauuguuagaaaaugcuaaugaucauuugagcuuucaguaaguuguaaucuuuuuggugguagagggucucgccuugauguugauggcugcugacugaaucagggugaugguugcugaagguugagguggcuguggcuauuaaaauaaggcaacaaugaaguuugccacauugacucuuccuuucaccaaagauuccucuguagcaugugacacuguuugauagcauauuccccaccacagaucuucuuucagaacugggguggaacccuggcacugcaguaaugguucuaaacccuuuguugucauuucaacaaugugcacagcaucuucaccagaaguugauuucaucucaagaaaccacuuucuuugcucagccguaagaagcaauuccccuguucaaguuuuaucaugagauugcagcaauucagucacaucuucacacuccacuuauaauuuuaguucucuugcuguuuacauccaguuacuuucuccacugaagucuugagccccucagagucauucauaaguguuggaaucauuaaccaaauauccugguaauguugauauuuugcccuccucuugugaauccugauuguucuuuauggcaucuagaauggugaauccuuuucagaagguuuucaguuuacuuugcccaguuccaucagaggaaucucuuucuguggcagcuguggccuuaugaaauguguuucuuaaauaaugggacuuuaaagucaaaauuacuccuugauucaugagcugcagaaugguuauugcagggaugaaagcaacauuaaucucuuuguacaucaccaucagaaaucuuggguaaccaggggcauugucaauaaacaguaauauuuugaaaggaauauuuucugagcaguaggucuucaacugugagcuuaaaauauucaguaaaccaugcuguaaacagaugugcugucauccaggcuuuguuguuccauuuguagaauacagucagucuagauuuaucaugauuuuuaaggcccuagaauuuucagaaugguaagugagcauuggcuucaacuugaagucaacaacugcauuauguccuaauaagagagucagccuguggccagaaagguggccgcccccucgcccgucacgcaaugcauguucguggggaaccuggugcuaaacuauucauagaugaccugcuucugggucgggguuuuguauguagcagagcggcucccucgcugcuaucuauugaaagucagcccucgacacaaguguuugaaaaaauuaaaaaauaauuaaaaaaaaaaaagacagaaucagccuguccuuugaagcuuugaagccaggcauugacuucuuucugacugugaauguccuagauggcaucuucuuccaucugucaauaucacugucagucuucaacuguuucuuccacagaugacagucuucaucugucaaacaguugaugacuguuucuucaacacugaaaaucuguuaauuaguguagccacuuucauuaguuaucuuagcuagauuucuggauaauuugcuguagcuucuccaucagcauuugcugacucaccuuguauuuuuauguuauggagauggcaucuuuccuuaaaccuccugaaucaaccucugcuagcuuccuacuuuucuuuagcuuccucacccucuuuuucucagcuuucguagaauuaaagagcguuagggccuugcucuggauugggcuuuggcuuaaaggaauguuguaacugguuggaucuucuauccagaccacucaaauuuucucacuaucagcaauaagggaguuucacuuucuuaucauucagguguuuauuugaguaacacuuuuaauuuccuucaagagcuuucccuuugcauucacaacuuggguuacuuacugcuugauguaggaagccuaccuuucugccugucucaacuuucaacaugccuuccucaccaagcuuagucauuuccagcuuuugacugaaaaugagagacaugcgacuccuuuuacuugaacaccuaggggccauuguaggguuaugaacugacgucauuucaguacugcugcaucucagggaguagggaggccugaggaaaagagagaguuggggaaacagauggucaguggagcagucagaauacacacauucauggauuaugcuugcuaucguauaugggagugguucauauugccugaaaacaauuacaauggaaacaucaaagauaacuuaucacagaucagcauaacagauacaguaauaaugaaaaagaauuacugaagugugacauagacaugaagugggcauaugcuguugggaaaauggugcugguagauuggcuugcuacaggguugacacacaccuucaguuuguuaaaaaggcaguauaucugcaaagagcgauaaaguaaaaugcuauaaaacaaaguauucuugcauuuguuuguuuuuaauucauagguuuaacauuuaaaguccuuuuaaucaggag

SEQ ID NO: 160741 - RNA, 85 nt, Homo sapiens
guuugggauuuauuuuuucuauuguuugacuauaaauugacuuggaaaucuccuuucuucuuuuuaguauaagguuucacaguuu

SEQ ID NO: 160742 - RNA, 45 nt, Homo sapiens
cauuuuguuugugcaguuuaggugcagugacccacucuuaucagu

SEQ ID NO: 160743 - RNA, 51 nt, Homo sapiens
uuucuggaguauagauucucaguauuggguuucggagguugaaguguguuu

SEQ ID NO: 160744 - RNA, 58 nt, Homo sapiens
guauuacuuacaaaucgagagagaagagggcagcacaccuccuauggccaacuggaag

SEQ ID NO: 160745 - RNA, 46 nt, Homo sapiens
gaagguuauugacugugaaggggcacaggagagcuucucaggguga

SEQ ID NO: 160746 - RNA, 47 nt, Homo sapiens
gcugauguggcuggaaugggaaagccaaaggucaaguaguuagauga

SEQ ID NO: 160747 - RNA, 46 nt, Homo sapiens
aauuuuaaauaaguguaggccucauuuaagugacuuuuuuggcaaa

SEQ ID NO: 160748 - RNA, 46 nt, Homo sapiens
auugcaucuggaagcauuuuuaacacagugugcuaggugugcuagg

SEQ ID NO: 160749 - RNA, 49 nt, Homo sapiens
cugcuguugucauaagaauuccaaauagacaaacucgguguaaguagga

SEQ ID NO: 160750 - RNA, 50 nt, Homo sapiens
uauugggacuaaaaagucuaaucagaggagauuggauuauagaaggcaga

SEQ ID NO: 160751 - RNA, 45 nt, Homo sapiens
gaauauggccucuuuuguuggauaauacccauuaucauucugagu

SEQ ID NO: 160752 - RNA, 58 nt, Homo sapiens
caaaucuaaauuugauaggggagguggagauuccaggggugggugaaagaagagauag

SEQ ID NO: 160753 - RNA, 63 nt, Homo sapiens
uugaagacauugaaccuauucauccuccucuaaccuucuuuauuguaauuaaauuucaagugg

SEQ ID NO: 160754 - RNA, 46 nt, Homo sapiens
uuucagugcuccuaauuccuacuugacugguuguacagaagaaauu

SEQ ID NO: 160755 - RNA, 46 nt, Homo sapiens
ugaagauauuuguuggauuaaaaccaauaaaaacaauccugggaag

SEQ ID NO: 160756 - RNA, 67 nt, Homo sapiens
uucauuaccaucuguuaagguacuugaaaaucuuauuuaaaaagcauuuuuuuaaaaaccucauuuu

SEQ ID NO: 160757 - RNA, 47 nt, Homo sapiens
aaggaugaacuagaaaugcaacaggaugaagaaaauuugccauauga

SEQ ID NO: 160758 - RNA, 46 nt, Homo sapiens
ggcuuccuaugauaccucugcuccaaaugcaaaacguaaguaucug

SEQ ID NO: 160759 - RNA, 50 nt, Homo sapiens
auaaaauauuuauuuucugaggauaguaaguucccauuuguaaaguacuu

SEQ ID NO: 160760 - RNA, 49 nt, Homo sapiens
aagugccgacagcauuggugccguguuaaauagcaaagaugagcagaga

SEQ ID NO: 160761 - RNA, 52 nt, Homo sapiens
cggaguuggaacauggauagccgcuugcaggagauccgggagcggcagaagu

SEQ ID NO: 160762 - RNA, 48 nt, Homo sapiens
auacauggagauucacaauccagaauuaaccagcaaccaaacugcuac

SEQ ID NO: 160763 - RNA, 46 nt, Homo sapiens
cugaaccaguucugcaagugacuguguuuuguauuacugugaagau

SEQ ID NO: 160764 - RNA, 103 nt, Homo sapiens
uacauaucuccauuccuuauuccacuuggauuuccuauagcaaagaaacccauuuauguauacggaaucaucuguuuacagucuuuucacacugcagcauugg

SEQ ID NO: 160765 - RNA, 52 nt, Homo sapiens
auggaguuucuuagagacaaccuaacacuauggaccucagacagugcaggag

SEQ ID NO: 160766 - RNA, 46 nt, Homo sapiens
gauucuuaauaacccagagcuugccugcacgcuggcuaaaacggcu

SEQ ID NO: 160767 - RNA, 28 nt, Homo sapiens
accaaaaggcauuugauauaagcaagaa

SEQ ID NO: 160768 - RNA, 42 nt, Homo sapiens
aauccagagaguggggucuucuaucugaaaaugaagggugau

SEQ ID NO: 160769 - RNA, 46 nt, Homo sapiens
uuuccugaacucuacuuccagaaaaccaaaaaacaagacaucccuc

SEQ ID NO: 160770 - RNA, 46 nt, Homo sapiens
uucaaauagaguagacuguccgccaaagaggaaagagaaaucuuca

SEQ ID NO: 160771 - RNA, 41 nt, Homo sapiens
ucuuuauuuuacagguagugauuauuagugcuucaucccca

SEQ ID NO: 160772 - RNA, 43 nt, Homo sapiens
cgacacgagccgauccaucauccgcaauguaaaaggccccgug

SEQ ID NO: 160773 - RNA, 52 nt, Homo sapiens
cuuggcugcucgcugggucuuggaugucggguucgaccacuuggccgauggg

SEQ ID NO: 160774 - RNA, 90 nt, Homo sapiens
uuuuuuuuuuuuugaaacacaaacgcuuuauuuaaaggagcaucucaguuacguguggcggacaaaaaaaaggagcagauugugacagac

SEQ ID NO: 160775 - RNA, 53 nt, Homo sapiens
ccuccuucaacuccaaggucucggauuugacgaacauccuaccgaagagagaa

SEQ ID NO: 160776 - RNA, 58 nt, Homo sapiens
ggacacggaggaggacggcgcggggcuguuggugcaacuccacguggaggcgggcgag

SEQ ID NO: 160777 - RNA, 63 nt, Homo sapiens
uggguauccuucauucagacgggcucugauuuacugaaggugugauggagcuuauugucaaag

SEQ ID NO: 160778 - RNA, 47 nt, Homo sapiens
ccgcuccuccuccuccucccgcucaaugcccaaacccaggcccggca

SEQ ID NO: 160779 - RNA, 44 nt, Homo sapiens
acaccuaggaaaacuguggcaguaacaugcaaaugugaggaagc

SEQ ID NO: 160780 - RNA, 39 nt, Homo sapiens
gcuguggguuggaaaaauggguaccauuugcagggaccc

SEQ ID NO: 160781 - RNA, 40 nt, Homo sapiens
acugaaaaacaauucucaugugcgucuuuggacugcaagu

SEQ ID NO: 160782 - RNA, 42 nt, Homo sapiens
cacgucagucgcacccggagaagggucugggaggaggcggag

SEQ ID NO: 160783 - RNA, 43 nt, Homo sapiens
gauggggggaggauguuguggagguacaggccaaguagaccag

SEQ ID NO: 160784 - RNA, 37 nt, Homo sapiens
gcaaaggcagaaggccucgcggcggccugguugcgag

SEQ ID NO: 160785 - RNA, 40 nt, Homo sapiens
cgcuucuuacaccuucuuuacgguuguuucggccauucag

SEQ ID NO: 160786 - RNA, 44 nt, Homo sapiens
acccccucuucuaaauuauaaucauaguuuuguaaaaagggcuu

SEQ ID NO: 160787 - RNA, 44 nt, Homo sapiens
caacgauaaaaagaauaaagaccaaaaugcucucccaaaucaga

SEQ ID NO: 160788 - RNA, 38 nt, Homo sapiens
aagacagagucuauggguuuucugggauccuucgaaaa

SEQ ID NO: 160789 - RNA, 58 nt, Homo sapiens
cuccuugcagcugccucuccuuccagggcggcugcuugucgagccaagugggagugag

SEQ ID NO: 160790 - RNA, 42 nt, Homo sapiens
aggaaaucaagaaugaaaggaaaaagagaaaaagcggauuac

SEQ ID NO: 160791 - RNA, 46 nt, Homo sapiens
ggccuggcgcgcggacaggccuguggugggcuuaggguaaagaaga

SEQ ID NO: 160792 - RNA, 55 nt, Homo sapiens
uuauuugguuguuuugcuaggcgagaaagaguguuggcggccuagucccuguuaa

SEQ ID NO: 160793 - RNA, 54 nt, Homo sapiens
uggggcaacuccgcccuugaaagacugggaauuaugcuagaaggucgugggcac

SEQ ID NO: 160794 - RNA, 43 nt, Homo sapiens
caucagcgggccauuuccucaguugcaugaauggaggaaaaac

SEQ ID NO: 160795 - RNA, 40 nt, Homo sapiens
gguucccgcuucuccuagugccucugaaaauaccgucagg

SEQ ID NO: 160796 - RNA, 39 nt, Homo sapiens
gcggaggcccgagaaagggugagaagggauguggcgggg

SEQ ID NO: 160797 - RNA, 53 nt, Homo sapiens
aaacauuaauuuaacuuuagaauuacaacuuuuacaugugggcccaggaaugu

SEQ ID NO: 160798 - RNA, 66 nt, Homo sapiens
ugugaagcagaucauacuggucugggccauuucuagucuucuagacuuccuuucugagagaagaaa

SEQ ID NO: 160799 - RNA, 29 nt, Homo sapiens
uguuuuguuuuguuuuacauuuuauuuua

SEQ ID NO: 160800 - RNA, 62 nt, Homo sapiens
aucccucuggcuguugugcugagaacagaaggggucaagggagugggggaguaaaaauggaa

SEQ ID NO: 160801 - RNA, 195 nt, Homo sapiens
ggaaggaccuaaaagauuugcugauggcuuagaaguuagguaugaguuaagucaaaaaugauaccacaguuuuuggccugaacaacuggaaggacagaauuaccauuaacugauauggggaagaccguggaaagaacaguuuucgggcauuaggaaaaauaauaacacauuuguaugcuuuugagaaugguucag

SEQ ID NO: 160802 - RNA, 46 nt, Homo sapiens
cacugggugaauaacucuagauuuaaaaacugcucagcagucgaga

SEQ ID NO: 160803 - RNA, 46 nt, Homo sapiens
caucagucuuuggaggcuggcugaugaaugcucaccaagcccaaaa

SEQ ID NO: 160804 - RNA, 102 nt, Homo sapiens
gccaacgagccgcaugcaggugucauuaugaagaaaaaacugaucuuuaaaggagaugccgacagcuagugacagaugaagauggaagaacauaccuuugac

SEQ ID NO: 160805 - RNA, 49 nt, Homo sapiens
uauuuugagaccuuaaaauaauuuauaucuugauguuaaaaccucaaag

SEQ ID NO: 160806 - RNA, 56 nt, Homo sapiens
uccccagcauugcucccuuacuuaguaugccaaaugucuugaccaauaucaaaaac

SEQ ID NO: 160807 - RNA, 44 nt, Homo sapiens
ucauaaugucuguucaacauuaucuuauuuggaaaauggggaaa

SEQ ID NO: 160808 - RNA, 44 nt, Homo sapiens
uuccaguuguaaaauuggaaccaucagcugauaaccucguaggg

SEQ ID NO: 160809 - RNA, 40 nt, Homo sapiens
aaacuguuuccugaacaauaagauguaugaacggagcaga

SEQ ID NO: 160810 - RNA, 47 nt, Homo sapiens
ucagaaauuaacauaaaauccagaagcaagauuccguaagcugagaa

SEQ ID NO: 160811 - RNA, 48 nt, Homo sapiens
caaugaaguuuuaaaggcuguaccaauccucuaauaugaaauguggaa

SEQ ID NO: 160812 - RNA, 46 nt, Homo sapiens
acucaauagauuccuucuucuguucauuggauucgucuguguccua

SEQ ID NO: 160813 - RNA, 42 nt, Homo sapiens
gaguaaauggacaauauauuauggaaggacuugcauccagcu

SEQ ID NO: 160814 - RNA, 45 nt, Homo sapiens
accuccaagugucgguucuaugacugaugaacaugggcaucagag

SEQ ID NO: 160815 - RNA, 58 nt, Homo sapiens
cacagagucagaaagcuaaauaaaaaaaugaaacuuuuuugaguaauaaaaaugaaaa

SEQ ID NO: 160816 - RNA, 59 nt, Homo sapiens
caagcgugcuuuccuuaucgaggagcagaaaaucguugugaaaguguugaaggcacaag

SEQ ID NO: 160817 - RNA, 65 nt, Homo sapiens
guucgugcuguaagaccuaaaguucuuaugagauuguccaaaacaaagaaacaugucagcagggc

SEQ ID NO: 160818 - RNA, 44 nt, Homo sapiens
ucccgaaccccugguaauagaauuguuuaccuuuauaccaagaa

SEQ ID NO: 160819 - RNA, 41 nt, Homo sapiens
uaggcacucagaaugguccagcguuugacauaccgacguag

SEQ ID NO: 160820 - RNA, 49 nt, Homo sapiens
uuaccaugcuuccuucauauuuuaaaauuuguuuuugaaaaauauauau

SEQ ID NO: 160821 - RNA, 24 nt, Homo sapiens
aagaggaacuguugagauuagaga

SEQ ID NO: 160822 - RNA, 44 nt, Homo sapiens
uugaacuccucaauaaucuugggcuccaagcuaaguuuucccaa

SEQ ID NO: 160823 - RNA, 42 nt, Homo sapiens
uuagaagcagagugaagaugguaaaugguagugcauccuuuu

SEQ ID NO: 160824 - RNA, 45 nt, Homo sapiens
gugaacguagucuggaagacuugcuucgagaaaggaaaccuguga

SEQ ID NO: 160825 - RNA, 35 nt, Homo sapiens
gcaaauuggaaaaaaaauuagggagaugguuggug

SEQ ID NO: 160826 - RNA, 45 nt, Homo sapiens
augguauaguacacagggcauugucuccucauaauauccuguugg

SEQ ID NO: 160827 - RNA, 50 nt, Homo sapiens
uaaggaacaacaaaguaaaauguuaccaucuguuucaaaauacuguaaag

SEQ ID NO: 160828 - RNA, 48 nt, Homo sapiens
auugucuuugaguguuaaaaugcuaugcuacagaagagaaaguuguug

SEQ ID NO: 160829 - RNA, 46 nt, Homo sapiens
aaaaccauugccuucuggccccaaaucagauguauggucucuugga

SEQ ID NO: 160830 - RNA, 41 nt, Homo sapiens
guaaggaaauaauuaaaauauaaugugugcaucuuaaaaua

SEQ ID NO: 160831 - RNA, 42 nt, Homo sapiens
auucaugcucuguauuuuaaauguucucaaggccaaccccag

SEQ ID NO: 160832 - RNA, 42 nt, Homo sapiens
guuuuauuaaacauccagucuaaaguuuaauucuuuuuugau

SEQ ID NO: 160833 - RNA, 79 nt, Homo sapiens
uagguuuuuuucuuuaauuaaaaccuuacagauacacaagaaaucuuguaugccucuuugauuucacaaaauaugggag

SEQ ID NO: 160834 - RNA, 58 nt, Homo sapiens
agaccauuguaacuagagcacagugaacaagaagauaaggucaaauagguaauagagg

SEQ ID NO: 160835 - RNA, 52 nt, Homo sapiens
agauuuuaacaaggucauucuggcugcuaugcugagaaaaaucgaaggaugg

SEQ ID NO: 160836 - RNA, 49 nt, Homo sapiens
agcaguggaaguagugggaaguuuuuauaugcugcauaucuuuugaagg

SEQ ID NO: 160837 - RNA, 63 nt, Homo sapiens
caaguaccugagcaauugaaaggggauagaguugcuucuaacugagauuuggaaacuacuugg

SEQ ID NO: 160838 - RNA, 44 nt, Homo sapiens
uaucuaagaacugaaccugggacacuccagguugagagugagag

SEQ ID NO: 160839 - RNA, 49 nt, Homo sapiens
uugauuaucaauuuuuuaagaugccuuaggaagcuauaaauuuucaaag

SEQ ID NO: 160840 - RNA, 35 nt, Homo sapiens
uaaguuuuagauacaugcuuaagauauuacggggc

SEQ ID NO: 160841 - RNA, 52 nt, Homo sapiens
auuuaaagagaaauggauuuuggcacaauucuacggaaaggcuagcaacaac

SEQ ID NO: 160842 - RNA, 36 nt, Homo sapiens
augugcaaaauaaauaggccauguuauaugagauuc

SEQ ID NO: 160843 - RNA, 65 nt, Homo sapiens
uuuguguuucagaauguagaacuuuauucagagcuuaaaugaauaauuagcuuaccccugagaug

SEQ ID NO: 160844 - RNA, 47 nt, Homo sapiens
guauauacuguuguuaucucuguuuuacugauaaacugaaguuuaaa

SEQ ID NO: 160845 - RNA, 46 nt, Homo sapiens
aggguauaaaaugauuacuggccugugcauucaccuucuuggcuuu

SEQ ID NO: 160846 - RNA, 48 nt, Homo sapiens
aaagaucugaauacggaaaacuagcaggacacaaaauauuuaucucag

SEQ ID NO: 160847 - RNA, 58 nt, Homo sapiens
ucacaucugcuaucuagaaggaagagaaugagggaaggagggaggggaugaagagaaa

SEQ ID NO: 160848 - RNA, 52 nt, Homo sapiens
gaguacauauugagguacagcuaacaaccucugccucugccacauuguuuuu

SEQ ID NO: 160849 - RNA, 46 nt, Homo sapiens
uaaaaacaauuauuuguaaauaaaaacacuguuaguaauaccaguu

SEQ ID NO: 160850 - RNA, 43 nt, Homo sapiens
uucauuuccuuuauggucauauaacugcacagcugaagaugaa

SEQ ID NO: 160851 - RNA, 49 nt, Homo sapiens
gggauguguuggaacgggauuuacacacacuggaggagcagggcaaguu

SEQ ID NO: 160852 - RNA, 42 nt, Homo sapiens
cguggucacacuggggagauuggauuagaugaugugagcuug

SEQ ID NO: 160853 - RNA, 46 nt, Homo sapiens
cauucaggcacaaggugacggggcugcacucuggcacacuccaggu

SEQ ID NO: 160854 - RNA, 46 nt, Homo sapiens
gauucuagcuuggaaagaaggaugggaagaccaaaagauggcagag

SEQ ID NO: 160855 - RNA, 46 nt, Homo sapiens
ugaaauauuugaaauagaaagaggagucagugcagacgaugaagca

SEQ ID NO: 160856 - RNA, 39 nt, Homo sapiens
uuugaguuugaucuuaaaggagccagggaaacuguuuaa

SEQ ID NO: 160857 - RNA, 40 nt, Homo sapiens
uuuaguuuaugcagaaggcuguaagaagcaacaggcaaga

SEQ ID NO: 160858 - RNA, 44 nt, Homo sapiens
uuuucaagauuuuugauuuauauuuuaauuagauccuaugguag

SEQ ID NO: 160859 - RNA, 57 nt, Homo sapiens
accccugccaacagagcucagaacaccucuaccaccuacaaccccagaaaggccaac

SEQ ID NO: 160860 - RNA, 48 nt, Homo sapiens
aaauuuaaauagcgagagaucaaauagauacuugguaaaugugucuga

SEQ ID NO: 160861 - RNA, 49 nt, Homo sapiens
aaagucauccucuacaaacauauuuucuuuuuuucccucuuuugguugc

SEQ ID NO: 160862 - RNA, 48 nt, Homo sapiens
acauugauuauugccacaacuaucuccacggaggaacagcuuuaaaca

SEQ ID NO: 160863 - RNA, 59 nt, Homo sapiens
ucaguaacaugguggcugcaguauuuguaaugcugguugugaaaggugaagaagaugua

SEQ ID NO: 160864 - RNA, 64 nt, Homo sapiens
uuuuuaugaggaucaaaugaggaaacccaaagcguuugacucagcaacuggcuuauauucacau

SEQ ID NO: 160865 - RNA, 28 nt, Homo sapiens
caguucccugggagguguggcuuuccac

SEQ ID NO: 160866 - RNA, 47 nt, Homo sapiens
accggagggugggcgcuccgugaaugugagcaugaguguguggaugu

SEQ ID NO: 160867 - RNA, 39 nt, Homo sapiens
aaagaauaaauaaucucuacuggguuaggaaauggccuu

SEQ ID NO: 160868 - RNA, 37 nt, Homo sapiens
uucugcuucaaacucauauauauauauauauauauau

SEQ ID NO: 160869 - RNA, 35 nt, Homo sapiens
augaagagagcuguugaacaugcccggagcugcac

SEQ ID NO: 160870 - RNA, 50 nt, Homo sapiens
cucaugagugggauaaggaggcaauuucccuacaugauguacauuugguc

SEQ ID NO: 160871 - RNA, 103 nt, Homo sapiens
uaaccuaaguauuuagauguaaaacucuggcuauuuccaaaccuuggcugguaaaguguauggaugggugguagacugagcuuagacagagggucuuggcuug

SEQ ID NO: 160872 - RNA, 42 nt, Homo sapiens
agauaucugaagugugugaagaguuuggauaaggacuaacug

SEQ ID NO: 160873 - RNA, 114 nt, Homo sapiens
uuuaaaacaaaacauuagcaacuggaugcacuaaauauauuuaagugcauacucuugcaguucuauucuaaauucuuauauuccuggaaaauaauauauauccauauccaguaa

SEQ ID NO: 160874 - RNA, 48 nt, Homo sapiens
cccaaacaccccccaccccaaccaaaacaaaacaagggucacuugcag

SEQ ID NO: 160875 - RNA, 30 nt, Homo sapiens
gcacuuagggaaauucacuauuucugccag

SEQ ID NO: 160876 - RNA, 85 nt, Homo sapiens
uuuggagaagugcaccuggugugaggguuuuuggaacuggagauguugguccacuguaccuugggacugcccuugauucauuuca

SEQ ID NO: 160877 - RNA, 66 nt, Homo sapiens
ggugaaaacgaggggccuucaauucaauccauccugguuucagauagugcuguguugggggcacaa

SEQ ID NO: 160878 - RNA, 46 nt, Homo sapiens
cagguuuacccucuauuuucacuucccuuaaaaguguuguguuacu

SEQ ID NO: 160879 - RNA, 46 nt, Homo sapiens
gagggggagaaagaagcaauugugaugguggugguggugugguagu

SEQ ID NO: 160880 - RNA, 46 nt, Homo sapiens
cuguuaauggcauuuaugugagaugugguuuucugcaccgcaaugg

SEQ ID NO: 160881 - RNA, 62 nt, Homo sapiens
uuuuaaguaauacaauguucuugucaugguaauuagcacuuuuccccuccugcucauucaga

SEQ ID NO: 160882 - RNA, 42 nt, Homo sapiens
uugacugcuuucaccuggauuucuuucuuggcuuaccccgaa

SEQ ID NO: 160883 - RNA, 44 nt, Homo sapiens
ucucaggcagugggcuuccauucuggagcuuuguagccagaggu

SEQ ID NO: 160884 - RNA, 33 nt, Homo sapiens
auauuuuuaaaaaccaagauggaaaacauuuca

SEQ ID NO: 160885 - RNA, 47 nt, Homo sapiens
cuacaaauuacuuucuauuauaagcacucauuucccaaaugaagagg

SEQ ID NO: 160886 - RNA, 31 nt, Homo sapiens
cacuagcaucggaaaagaguacaguugccaa

SEQ ID NO: 160887 - RNA, 62 nt, Homo sapiens
uuaguaagauagacaccacucuuucucccuguaucccacugauaaacaacugcaggcuucag

SEQ ID NO: 160888 - RNA, 29 nt, Homo sapiens
ggauggggaaaggggagaggcagguauaa

SEQ ID NO: 160889 - RNA, 24 nt, Homo sapiens
ccaccagcucuacuuggcaacugg

SEQ ID NO: 160890 - RNA, 65 nt, Homo sapiens
uauuaaaacaauaacaacaaaaacaauuuaacuugcauuagaagcaauuaaagcauaaaaaguag

SEQ ID NO: 160891 - RNA, 27 nt, Homo sapiens
agcugauucgggagaagcacaaagccg

SEQ ID NO: 160892 - RNA, 54 nt, Homo sapiens
uagaaaggaaagcaaauuuaaaaaucacuuuucugaggauuaaaaaaggccggg

SEQ ID NO: 160893 - RNA, 60 nt, Homo sapiens
gugggugacacuacaggguuugcuccccagucccuggaagcccgagaaaaagcgaagggg

SEQ ID NO: 160894 - RNA, 30 nt, Homo sapiens
ccuuccucccucccuuccuuccuuccuucc

SEQ ID NO: 160895 - RNA, 44 nt, Homo sapiens
agaacaauuuuggacauacaccuuguaaaacuucucaaaaacca

SEQ ID NO: 160896 - RNA, 45 nt, Homo sapiens
acggcuugcuucccacguccggggccgagugaauacgugucaagc

SEQ ID NO: 160897 - RNA, 45 nt, Homo sapiens
caagcugcggccucggccuccuccccgcgcggcagcuggugccuc

SEQ ID NO: 160898 - RNA, 43 nt, Homo sapiens
gccaccuccaccacgcgcccgcgcugucccugaggcuccggcu

SEQ ID NO: 160899 - RNA, 42 nt, Homo sapiens
gcggggcaggguccggagcccagcagaggaggagccggggcc

SEQ ID NO: 160900 - RNA, 55 nt, Homo sapiens
ggcggggcaggauugucucgucucacaccagcucugccagacacaggcgccuuuu

SEQ ID NO: 160901 - RNA, 73 nt, Homo sapiens
gugcuugucgucuggcuccucacucucucgguguaugcucaaagguccggccaaaacucuugauuaucccggc

SEQ ID NO: 160902 - RNA, 42 nt, Homo sapiens; identical to SEQ ID NO: 77261

SEQ ID NO: 160903 - RNA, 63 nt, Homo sapiens
auaaaaccaccaaaaagggaagacaguuuucaggaagauacacauguaacuuagaaaacaaau

SEQ ID NO: 160904 - RNA, 46 nt, Homo sapiens; identical to SEQ ID NO: 77263

SEQ ID NO: 160905 - RNA, 66 nt, Homo sapiens
auaucgagacaaaugcugccauuacuguuaauauuuggaugauaaauucuuguuguaaaugcaacc

SEQ ID NO: 160906 - RNA, 50 nt, Homo sapiens
ccgugcaaucucuggcacuagggggucaucuggguuuggaucacauagca

SEQ ID NO: 160907 - RNA, 30 nt, Homo sapiens
ggcccugugaagacaagcagauuugaagau

SEQ ID NO: 160908 - RNA, 62 nt, Homo sapiens
cgcuguuguccccuguggcgugcagacaguagagacaguaauucccgaccuuaugcuuguca

SEQ ID NO: 160909 - RNA, 61 nt, Homo sapiens
uguuaaacaaaaauuugcaagacccacccagaacagacugaacacaggaagaugaagaaaa

SEQ ID NO: 160910 - RNA, 93 nt, Homo sapiens
cuuaacuguuuucacuaaacagcuuuuucuaaggggagagcaagggggagagaucuagauugggugagggggacggggaugucagggaggcaa

SEQ ID NO: 160911 - RNA, 45 nt, Homo sapiens
gguccgaccccuccuucuuuacagcuuaguguuauucuggcauuu

SEQ ID NO: 160912 - RNA, 55 nt, Homo sapiens
aauuguuuuccauaaagaacaguauaaacauauuauucacauguaaucaccaaua

SEQ ID NO: 160913 - RNA, 48 nt, Homo sapiens
cgaugaggacuaauagucauagaggaugcuuuacccaagagccacagu

SEQ ID NO: 160914 - RNA, 24 nt, Homo sapiens
ccuucagcuucuugggcuuugaga

SEQ ID NO: 160915 - RNA, 53 nt, Homo sapiens
gcaguccuguccagccagagccuguuuguagaaaucccagauggauuauuagc

SEQ ID NO: 160916 - RNA, 46 nt, Homo sapiens
cuauguacuuuuaaggucuuuagagagccaagaguagcacuuagaa

SEQ ID NO: 160917 - RNA, 26 nt, Homo sapiens
aauggcuaaaugauugugaacacaga

SEQ ID NO: 160918 - RNA, 59 nt, Homo sapiens
cuccucaaauuucuuucucuggcagaccaaacagaugauauguaaugaaucauugauuc

SEQ ID NO: 160919 - RNA, 46 nt, Homo sapiens
gaauuuuuggcaacaauauacaagaggugcugaaauauucaaagua

SEQ ID NO: 160920 - RNA, 40 nt, Homo sapiens
aguaaaaaugaguaaaccucaagcuuugcgggacugcuaa

SEQ ID NO: 160921 - RNA, 48 nt, Homo sapiens
aucaccuaggaugucaauuaccuggcuguguaauuuuucaugggauuu

SEQ ID NO: 160922 - RNA, 50 nt, Homo sapiens
agggagagagaggagugggguggggggggggugggcggugguaauggaau

SEQ ID NO: 160923 - RNA, 38 nt, Homo sapiens
ugcugaaacggaaucuuuaggaacagagagagugaaaa

SEQ ID NO: 160924 - RNA, 42 nt, Homo sapiens
cacaaauguucccagcagcauuauucauaauagccaaacaga

SEQ ID NO: 160925 - RNA, 45 nt, Homo sapiens
aacuugcuauugaaagaccaguccucuguagacgagaccuuucaa

SEQ ID NO: 160926 - RNA, 43 nt, Homo sapiens
gaaagccaaaucuugccaaguaggaaaggaaaagggcaaauac

SEQ ID NO: 160927 - RNA, 41 nt, Homo sapiens
cgagacgcuuucccauaaaagcaaaaaagcucagauaaagg

SEQ ID NO: 160928 - RNA, 42 nt, Homo sapiens
auucauacacagguguuauuguuugauguagacugccuagau

SEQ ID NO: 160929 - RNA, 42 nt, Homo sapiens
aaaauaaucaagagugucaggagacggcaaggucaaguaguc

SEQ ID NO: 160930 - RNA, 49 nt, Homo sapiens
uaaacaauuaagccuuuauuuuuuaccacauuauaauaagaccacaguu

SEQ ID NO: 160931 - RNA, 35 nt, Homo sapiens
cauuuccugagcacaagaggccucugcuggaagaa

SEQ ID NO: 160932 - RNA, 42 nt, Homo sapiens
aguccaugcugacuuucuuccuccuacccacuccuuccagcc

SEQ ID NO: 160933 - RNA, 41 nt, Homo sapiens
uagcaauugggcuaguaauaggacccaaggagccaugcaca

SEQ ID NO: 160934 - RNA, 42 nt, Homo sapiens
guguuauuugauuugcacccaaaagugcuuuccuuagucacc

SEQ ID NO: 160935 - RNA, 40 nt, Homo sapiens
uggggucauugguauccguaaggucauuuugccuguaaag

SEQ ID NO: 160936 - RNA, 46 nt, Homo sapiens
gcaaaagggaguaaucaacagugacaucaaacuguuuuagugcuuu

SEQ ID NO: 160937 - RNA, 23 nt, Homo sapiens
caagccgcgauuggggcgugggg

SEQ ID NO: 160938 - RNA, 32 nt, Homo sapiens
cccccccauauuuaucguaugggcagcccaag

SEQ ID NO: 160939 - RNA, 27 nt, Homo sapiens
ccaugacuggucguccuagauuuuagg

SEQ ID NO: 160940 - RNA, 50 nt, Homo sapiens
gauuugacaguucagucacaaagaaaugugcuuaguuauugcugcuagau

SEQ ID NO: 160941 - RNA, 39 nt, Homo sapiens
guuggaaaaauuaagaaauguaagggugaaaguugguag

SEQ ID NO: 160942 - RNA, 62 nt, Homo sapiens
auaaauuugaugucuaagucaucuguauccucaaugauuucuuaaaauuuaccuuauaucag

SEQ ID NO: 160943 - RNA, 44 nt, Homo sapiens
aucugguaguggugaagguggaaaaggcuauaccaaagaccaag

SEQ ID NO: 160944 - RNA, 38 nt, Homo sapiens
augggagaauuucaugagaggaauauugaguguaauag

SEQ ID NO: 160945 - RNA, 41 nt, Homo sapiens
uaccuuuucucuuauauuagccuucauaaguguugcuuuag

SEQ ID NO: 160946 - RNA, 46 nt, Homo sapiens
uuugaaguuucauccagacaaaaaccaugcaccuggagcaacagau

SEQ ID NO: 160947 - RNA, 43 nt, Homo sapiens
gaaugaagauuuauguuuacaccuaauccuguacaugaauaua

SEQ ID NO: 160948 - RNA, 45 nt, Homo sapiens
cauguaaccaccaaaacaauggcagauuuaauuuccauagagguu

SEQ ID NO: 160949 - RNA, 42 nt, Homo sapiens
aagacuuguuuaauauauuuuuuggggguggauuuccuucag

SEQ ID NO: 160950 - RNA, 46 nt, Homo sapiens
gguuauagccaacaacaucagcaucgacauaguggacaugaaagag

SEQ ID NO: 160951 - RNA, 46 nt, Homo sapiens
uaagccaguugauggucucuaauccuccuuauuccuuauaucccag

SEQ ID NO: 160952 - RNA, 41 nt, Homo sapiens
gccucugggagugacagugcugacaagaaggcucaaggucc

SEQ ID NO: 160953 - RNA, 41 nt, Homo sapiens
auucaaugaaguggccacacaauauagugaagauaaagcca

SEQ ID NO: 160954 - RNA, 44 nt, Homo sapiens
ugugauggauaagccuguguuuacagacccagcaguuaagacaa

SEQ ID NO: 160955 - RNA, 46 nt, Homo sapiens
uucaaaaaugaauauaaaggaauguuauuacaaaagguagaaaaga

SEQ ID NO: 160956 - RNA, 45 nt, Homo sapiens
gcaguaugcagcaaaaguauaccgugaugaucgacuccgaaggaa

SEQ ID NO: 160957 - RNA, 55 nt, Homo sapiens
uacauagugcaguguagauauacauuauacuuauuguauaguguagacagugcga

SEQ ID NO: 160958 - RNA, 124 nt, Homo sapiens
cuaauguugacaaaaagcaaggcauaaaugaagaucaagaggagagccagaagccaagauuaggugaagggugugaaccaauaucuaaacgacaaaugaaaaaacuaauaaaacagaaacaaug

SEQ ID NO: 160959 - RNA, 47 nt, Homo sapiens
auaacaaaauguuauuucaauuacuaauuuuagacaaaagcgaaaag

SEQ ID NO: 160960 - RNA, 46 nt, Homo sapiens
gacaaugucaaauggaaccaaacucagauggacaugacagaaaacg

SEQ ID NO: 160961 - RNA, 46 nt, Homo sapiens
acucacauauaaacaagcgucagauuauggaaucaaucaugcacag

SEQ ID NO: 160962 - RNA, 42 nt, Homo sapiens
caucauguauggcucucaguucuuaauugaugauaacaugau

SEQ ID NO: 160963 - RNA, 42 nt, Homo sapiens
uauguaaaauggaaauguuauuccauuuacucugucagggcu

SEQ ID NO: 160964 - RNA, 46 nt, Homo sapiens
acggguccccgcgcuccgucuuccuucugacugggggacuccgcgg

SEQ ID NO: 160965 - RNA, 57 nt, Homo sapiens
cggugugggggaggggcggcguggcgccuccugcggaaccgcgaggugucuacaggg

SEQ ID NO: 160966 - RNA, 46 nt, Homo sapiens
acacuagugucaguaaaaagcauuacaucugguaauaggggcaagg

SEQ ID NO: 160967 - RNA, 29 nt, Homo sapiens
uuuguaacagcuauuuuuaauguagaaag

SEQ ID NO: 160968 - RNA, 360 nt, Homo sapiens
aaguaccacacugaaugcuuuacauauauuaacucauuuauuucuuuuuuuuuuuuuuuugagacagcgucucacuguugucccagcuagaguacaguggcgcgaucucggcucacugcaaccuccgccuccuggguucaagugauucuccugcuucagccuccugaguagcugggacuacaggcacgugccaccacgcccggcuaauuuuuguauuuauaguagagaugggguuucaccauauuggccaggcuggucucgaacuccugaccucgugauccgcccaccucagccucccaaagugcugggauuacaggcgugagccaccgcgccaggcuaacucauuuaauucuuaacagu

SEQ ID NO: 160969 - RNA, 40 nt, Homo sapiens
aucuccagcaguuuuuugagaaaaaguacauaguaaaaaa

SEQ ID NO: 160970 - RNA, 127 nt, Homo sapiens
uuuuucuguuucuuucugucuauuggugguuccuugagggcuuugaugauuagggcagaggcagaagguaccaccucaaucugggccugucuguucugaaucgucaguuucacuguaauccuuagac

SEQ ID NO: 160971 - RNA, 48 nt, Homo sapiens
ucaaacuucagcagcaugguggaggcagcuugugucagaugaauccga

SEQ ID NO: 160972 - RNA, 39 nt, Homo sapiens
ccacugucugccuggaaacccaucauuaauuuuaagcua

SEQ ID NO: 160973 - RNA, 43 nt, Homo sapiens
uccacuaggaaaccaccccuacuccuaaucccccgacuacaga

SEQ ID NO: 160974 - RNA, 25 nt, Homo sapiens
uagauaugcuaagguugaggguucu

SEQ ID NO: 160975 - RNA, 52 nt, Homo sapiens
cucaaagucaagguaacaauguuguguaauacuguugucuucuaacccugua

SEQ ID NO: 160976 - RNA, 220 nt, Homo sapiens
uuuauaguuagcacuuguuaaguuaaucacuuuaaauguuugaauaagugacuauuuugcuuuuuuuuagagacagggucuuguucugucgcccaggcuagagugcaguggggccaucauagcucacuguagccuccuggguucaagcaaucauccugccuuagccucucaaguagcugggacuacaggugcaugccagcacagccagcuaaugaaugaa

SEQ ID NO: 160977 - RNA, 57 nt, Homo sapiens
uucugugccuuauuggagaaucuuuugaugacuacagugaugauguauguggcgcug

SEQ ID NO: 160978 - RNA, 60 nt, Homo sapiens
uuguuaauguuagagcuaaaggugauaagauagcaauauggacuacugaaugugaaaaca

SEQ ID NO: 160979 - RNA, 28 nt, Homo sapiens
aucagucccacgcagacacagcuacuaa

SEQ ID NO: 160980 - RNA, 65 nt, Homo sapiens
auagguuuguuguuuaagaagacaccuucugaguauucucauaggagacugcgucaagcaaucga

SEQ ID NO: 160981 - RNA, 39 nt, Homo sapiens
cgccuuugucuuguacuucuguguucauuuuuuuuuuuu

SEQ ID NO: 160982 - RNA, 52 nt, Homo sapiens
uuucuauguuaagugucaaaaugauaguguagggaaaguacagguggugggg

SEQ ID NO: 160983 - RNA, 40 nt, Homo sapiens
uuuguacauaguacauacuuguauaguccugugagaugaa

SEQ ID NO: 160984 - RNA, 33 nt, Homo sapiens
uuuuguuuuucauucuaaaaaagucuccagaaa

SEQ ID NO: 160985 - RNA, 70 nt, Homo sapiens
auuuugcccugaauaggaagacauagcagguuaguagauagacucaaucagugaaagaauuuucuaagau

SEQ ID NO: 160986 - RNA, 43 nt, Homo sapiens
aggcagacagggaagaaguaaagaagauaggaacaaaggaaag

SEQ ID NO: 160987 - RNA, 48 nt, Homo sapiens
ucaugauguuugauaauucccuggcuacaugucaaucuuccccaccag

SEQ ID NO: 160988 - RNA, 42 nt, Homo sapiens
uuuucuuucaucuccgaacaacugacugggggugccugcuug

SEQ ID NO: 160989 - RNA, 41 nt, Homo sapiens
uggacggaguagcuccaagaguucucacugugacagcccac

SEQ ID NO: 160990 - RNA, 74 nt, Homo sapiens
uggagagaaaaacagcucacagucugaggaagaugauauugagagaaggaaggaaguugaaagcaucuugaaga

SEQ ID NO: 160991 - RNA, 41 nt, Homo sapiens
uccccccaaggaguuccucuuuaaacacccgaagcgcacgg

SEQ ID NO: 160992 - RNA, 43 nt, Homo sapiens
ucugcugcucucucauuugcuggccaucggauuggggaucuau

SEQ ID NO: 160993 - RNA, 43 nt, Homo sapiens
aaaaaacuggaaauggaaaaaaaaauaaaucuuugccaaaucc

SEQ ID NO: 160994 - RNA, 57 nt, Homo sapiens
uuguaaguuuccuaauuacuugauuaauuaauacuauuugaguuauuaaauguuaau

SEQ ID NO: 160995 - RNA, 42 nt, Homo sapiens
aaggagccugguucaguagaaaguuuugaauuuaaaccagaa

SEQ ID NO: 160996 - RNA, 46 nt, Homo sapiens
aaugguaaucauucucagguguucucaccugguaaaauuguagacc

SEQ ID NO: 160997 - RNA, 42 nt, Homo sapiens
cucacaugagucaaaauacagcucauuacccuagcccaguga

SEQ ID NO: 160998 - RNA, 45 nt, Homo sapiens
aaugauacuuccuuuguugucacauggacgauacaaaagccagca

SEQ ID NO: 160999 - RNA, 77 nt, Homo sapiens
ugacagguaaaccuuuggcauauaguuugaauaaaaaauaaauuucuagucucucccauuccagggguucuuucucu

SEQ ID NO: 161000 - RNA, 42 nt, Homo sapiens
gucauccacaccauugcucuggggccgucugcugacgaagaa

SEQ ID NO: 161001 - RNA, 81 nt, Homo sapiens
aaugguaacugaagcaucuacuuaccuguuucaugccaccaaacaaagagcuuauuucaggaauguaagcauuuuaauucc

SEQ ID NO: 161002 - RNA, 43 nt, Homo sapiens
aaaauucaaucuauuuuucaauuaguuuucccaaaauguuugg

SEQ ID NO: 161003 - RNA, 41 nt, Homo sapiens
gauucucuuccuauccuugcuucucucgccuguauugaaaa

SEQ ID NO: 161004 - RNA, 42 nt, Homo sapiens
cagcagaggccaaggaucgugaguugauggaguuugcugcug

SEQ ID NO: 161005 - RNA, 46 nt, Homo sapiens
ggagggaguaagggacuuagcaggggcggaggaguucggcggcgga

SEQ ID NO: 161006 - RNA, 94 nt, Homo sapiens
gccaguggguagaacaggagguggaggauaggccugaggugaaggaugagaacgcaggcguauuggaggugaagcaggagacggauaguaguuu

SEQ ID NO: 161007 - RNA, 43 nt, Homo sapiens
agguaaaggaagagaagguaaaggaagagguaauggacugguc

SEQ ID NO: 161008 - RNA, 37 nt, Homo sapiens
auggagaguguguaaaagaagagaaggauuuccugaa

SEQ ID NO: 161009 - RNA, 63 nt, Homo sapiens
ggguuucuggagucagacggcguucgcggggguggguugggaaguggaggguguuguacauga

SEQ ID NO: 161010 - RNA, 40 nt, Homo sapiens
ucacugaguuuauaaauugauugggaauucuaaguuuaua

SEQ ID NO: 161011 - RNA, 36 nt, Homo sapiens
uuuagugggagauauaggagauaaguagaggaacaa

SEQ ID NO: 161012 - RNA, 50 nt, Homo sapiens
gucaugugaacauuuggaggcagauuaucccagguagggacaaaaguaaa

SEQ ID NO: 161013 - RNA, 34 nt, Homo sapiens
aggaugucugguuugaggaauuaaaagauuugca

SEQ ID NO: 161014 - RNA, 43 nt, Homo sapiens
cuggugaggguuucuaauucuaagugcaaauggaaaccaugga

SEQ ID NO: 161015 - RNA, 41 nt, Homo sapiens
ucccuauaugcuugggucauuuuguggccuugucuuuucca

SEQ ID NO: 161016 - RNA, 38 nt, Homo sapiens
uuuugcccucuuuggggccaugcugcccucauugagaa

SEQ ID NO: 161017 - RNA, 54 nt, Homo sapiens
gaguuucuuuccuuauaacugguaaccuaguuauuaucauuagucauauauuug

SEQ ID NO: 161018 - RNA, 45 nt, Homo sapiens
auggaggcacuggauggacugcuaaaguucauaaaauuucacaaa

SEQ ID NO: 161019 - RNA, 42 nt, Homo sapiens
uaaguuuaaaaaaaaaucauggaaaaaauuuauucuaaccac

SEQ ID NO: 161020 - RNA, 51 nt, Homo sapiens
aagacugaauguuuuauuuaucaaaauguagcuuuuggggagggaggggaa

SEQ ID NO: 161021 - RNA, 85 nt, Homo sapiens
gcugaccaggacugugaagaugcgguuccgcugcgaagauggggagacauuuuccaagaacgucaugaugauccaguccugcaaa

SEQ ID NO: 161022 - RNA, 131 nt, Homo sapiens
ggcaagaaaugcagcaagaccaagaaaucccccgaaccagucagguuuacuuacgcuggauguuugagugugaagaaauaccggcccaaguacugcgguuccugcguggacggccgaugcugcacgcccca

SEQ ID NO: 161023 - RNA, 38 nt, Homo sapiens
aggcugcuguacacuggcuguccacaaggccgcaccuc

SEQ ID NO: 161024 - RNA, 46 nt, Homo sapiens
guuaccaaugacaacccugagugccgccuugugaaagaaacccgga

SEQ ID NO: 161025 - RNA, 46 nt, Homo sapiens
gcggcacucaggguugucauugguaacucguguggagauaccaguu

SEQ ID NO: 161026 - RNA, 43 nt, Homo sapiens
gagccucgcauccuauacaacccuuuacaaggccagaaaugua

SEQ ID NO: 161027 - RNA, 78 nt, Homo sapiens
ugggaccaugaaguuguuugaacaauacauuucuggccuuguaaaggguuguauaggaugcgaggcuccauuccaaaa

SEQ ID NO: 161028 - RNA, 90 nt, Homo sapiens
gccuccuuggcaaggagcugggauucgaugccuccgagguggaguugacgagaaacaaugaauugauugcaguuggaaaaggcagcucac

SEQ ID NO: 161029 - RNA, 47 nt, Homo sapiens
gcacugcccgguaacuuugaccagccgaggguugggacagcccaagu

SEQ ID NO: 161030 - RNA, 45 nt, Homo sapiens
gggcugucccaacccucggcuggucaaaguuaccgggcagugcug

SEQ ID NO: 161031 - RNA, 45 nt, Homo sapiens
uaacuccagaaucuaccaaaacggggaaaguuuccagcccaacug

SEQ ID NO: 161032 - RNA, 46 nt, Homo sapiens
uacggaaaagugauuccugacuaacuuauuguucuggucuggaguc

SEQ ID NO: 161033 - RNA, 46 nt, Homo sapiens
ccuccagggggcaguggcaggcagcggggcagguggagagcgccug

SEQ ID NO: 161034 - RNA, 42 nt, Homo sapiens
gauccggcgaagucggcgggcggcuguaggaacaaggcggag

SEQ ID NO: 161035 - RNA, 28 nt, Homo sapiens
aaccuuaaagaaaaaaaaagucagccug

SEQ ID NO: 161036 - RNA, 44 nt, Homo sapiens
guuaaguuagaaggaguuccaaauauguggcagguaacacugcu

SEQ ID NO: 161037 - RNA, 45 nt, Homo sapiens
uacaaagcauugauuguauuuuaauauauacaauguaaauacuau

SEQ ID NO: 161038 - RNA, 68 nt, Homo sapiens
ggagaaccagcaaagaagaaaaaguagaaacaaaugaccagaauuucuguacugcuaaacuuguugaa

SEQ ID NO: 161039 - RNA, 47 nt, Homo sapiens
uaauaaagagugcuugaguagcuugucugauguuacacagcuaguga

SEQ ID NO: 161040 - RNA, 68 nt, Homo sapiens
gguacuuuuuucuguuguaccuggagauccguuaguagagaucuuuuccucuccugauuggaugacug

SEQ ID NO: 161041 - RNA, 46 nt, Homo sapiens
cugcuuggggcagaagccccggggugccccaugagaaagccgucag

SEQ ID NO: 161042 - RNA, 53 nt, Homo sapiens
caacucacaggcagcagcugugaggaggagaggugcaccccaggcugugggug

SEQ ID NO: 161043 - RNA, 43 nt, Homo sapiens
aacuagaagugucagagaccuagcuuacucaguuguggucacc

SEQ ID NO: 161044 - RNA, 57 nt, Homo sapiens
uuucguaaccauuaaaugucauucaggugugccuuuaucauagauaggauggaccaa

SEQ ID NO: 161045 - RNA, 60 nt, Homo sapiens
cugcugacuggaguaucuucaaguacaaaucccuucagaccccagaaagucuguuccuuu

SEQ ID NO: 161046 - RNA, 63 nt, Homo sapiens
ccaggaagcugcuuccuaaaauaccuuguuacauaguugugcccuccuuaauuaagcuuccua

SEQ ID NO: 161047 - RNA, 50 nt, Homo sapiens
caucuuagguuucccaaaccacuccuuaugauccagugaauauucaagag

SEQ ID NO: 161048 - RNA, 57 nt, Homo sapiens
ccucucugaauuuucaugaauuucuauuucacaaggguaauuguuuuauauacacug

SEQ ID NO: 161049 - RNA, 46 nt, Homo sapiens
gaaauggauacaaguagaagaaaauuccauuuauaaaguacugaga

SEQ ID NO: 161050 - RNA, 46 nt, Homo sapiens
accacguuuuaccuuaaaauuaaggucucuucagaaaggaaccuuu

SEQ ID NO: 161051 - RNA, 61 nt, Homo sapiens
aaauuagcuacagcugucaagacugugaagguaucuaguuuguuuuucacuuagcauguga

SEQ ID NO: 161052 - RNA, 44 nt, Homo sapiens
uuaauucugacuacauaaaaaggugacauuugaaguagaccaua

SEQ ID NO: 161053 - RNA, 56 nt, Homo sapiens
uagguuuguuauuauuguugcuguuuuauuuauuuauuuauugaaugauggcuaug

SEQ ID NO: 161054 - RNA, 50 nt, Homo sapiens
ccaagaccauugacaaccagcgaguguaugaugaaaccacaguagacccu

SEQ ID NO: 161055 - RNA, 58 nt, Homo sapiens
uacguuucugguagguaaacaaacugaaacguaaagagguuuaaacgacuugucaagg

SEQ ID NO: 161056 - RNA, 20 nt, Homo sapiens
uuagggcggucgcggggcgc

SEQ ID NO: 161057 - RNA, 45 nt, Homo sapiens
acagcggcgacacuuaauguucacgcgguggaaacagcagcagcg

SEQ ID NO: 161058 - RNA, 89 nt, Homo sapiens
ggagcccuagacugaaagucaagacaucugaauuucaggcuggaaaacuaucaguaugaucucagccucaguucucuugucuguaaaau

SEQ ID NO: 161059 - RNA, 47 nt, Homo sapiens
uuuaccugcauauaaaauuuauuuuuaaucaagcugaucuuaaugua

SEQ ID NO: 161060 - RNA, 53 nt, Homo sapiens
ugauuaaugaaagugacaaauuuuaaauuuucucuaauaguccucaucauaaa

SEQ ID NO: 161061 - RNA, 47 nt, Homo sapiens
guagcucagacuugguuuugccaaaacucuugguaauuuuugaagau

SEQ ID NO: 161062 - RNA, 48 nt, Homo sapiens
caaaagaauuuggugaauuuuaaagaggaacaagaugacaucugagcu

SEQ ID NO: 161063 - RNA, 52 nt, Homo sapiens
agaggcucuggagauaccagcaacuuugaugacuaugaagaagaagauaucc

SEQ ID NO: 161064 - RNA, 24 nt, Homo sapiens
uucuugguguuuggaaacucucag

SEQ ID NO: 161065 - RNA, 69 nt, Homo sapiens
ucauccauuucccuuucuaauuaucauugcuuauauuaucuuuauuguuguauuuauuguuaauuaaug

SEQ ID NO: 161066 - RNA, 65 nt, Homo sapiens
uauaaauuuuaacagacuaauucuuggguauuggucucuucaaguuuuuacuuuuugacucaauu

SEQ ID NO: 161067 - RNA, 45 nt, Homo sapiens
auagagaauacaaaaggaagagcaguuuggugagaaagauuagau

SEQ ID NO: 161068 - RNA, 43 nt, Homo sapiens
gggaguaggaagacucugucucaaaaggcagcaaaaaaagaga

SEQ ID NO: 161069 - RNA, 47 nt, Homo sapiens
gaaauucaauauuuacaugaaggguaauugauuaucagcccaauugc

SEQ ID NO: 161070 - RNA, 40 nt, Homo sapiens
gagaaguguagacucucaagaggacuaaaggucauaugaa

SEQ ID NO: 161071 - RNA, 43 nt, Homo sapiens
ggucacagacuuuggguuugccaaaagaguuaaaggcagaacu

SEQ ID NO: 161072 - RNA, 111 nt, Homo sapiens
auaaugauucacaaugagcuaacuauuuuagguuuauauuuuuccucaacauaugcuuccccauaaauuuaucagagcguuauuugaacaaaauauagagauuuaauaaau

SEQ ID NO: 161073 - RNA, 60 nt, Homo sapiens
aaacacaaguaugaacugaaacaggacugaugaugguaauuugauucauaaaaugauggu

SEQ ID NO: 161074 - RNA, 42 nt, Homo sapiens
aacuuauuuuguuugauuaauauuuuggccauaugaagcauu

SEQ ID NO: 161075 - RNA, 31 nt, Homo sapiens
uagaauaaugccggacuugaagauuuugaaa

SEQ ID NO: 161076 - RNA, 44 nt, Homo sapiens
gaagaaagaaacugauaaagacgagcaaagaucaguggguggaa

SEQ ID NO: 161077 - RNA, 48 nt, Homo sapiens
agaagaagauacagguauuauugggaugcagaggaugucauggagcuc

SEQ ID NO: 161078 - RNA, 51 nt, Homo sapiens
gaagugaaaacagaaaccuuggucauuucuaacuuguuucuuacccucaga

SEQ ID NO: 161079 - RNA, 42 nt, Homo sapiens
auguugccgugguaacaacucaugcugauauaauugagaaca

SEQ ID NO: 161080 - RNA, 101 nt, Homo sapiens
cuugccagguucaacaugggauugugugaguauuugaagaaaacagcaauuuuuucauaucuuugaaagauguaaaaagcguagauuagugcuuaaauuua

SEQ ID NO: 161081 - RNA, 45 nt, Homo sapiens
cacuagcaacagcacacagcauuuuaauaucagugagguccacag

SEQ ID NO: 161082 - RNA, 47 nt, Homo sapiens
acugacauacuaaguguauguaguuccuguauguauuaggccuaaau

SEQ ID NO: 161083 - RNA, 48 nt, Homo sapiens
cuucuaaaaaugcagaugucuauaacuacaaugguacuaagaugggaa

SEQ ID NO: 161084 - RNA, 60 nt, Homo sapiens
auaguacaauccugccauaaaguauuaaagcacaagauaccuguuauuccuucaacaucu

SEQ ID NO: 161085 - RNA, 69 nt, Homo sapiens
auguaacaagguauaaagucccaggcucuauggccauaguuuaauguuauauucacuguugucuucuau

SEQ ID NO: 161086 - RNA, 99 nt, Homo sapiens
gauugaauaggacagaguaccugcucagggugcccauauuccagaagggggaagauagacaugucagcaaacacaugaaaccugccacaaauccuuuca

SEQ ID NO: 161087 - RNA, 67 nt, Homo sapiens
ugcuaacauuauggaaaguggaauuagaacucugaaaauugcuguaugaaaauguuugauuugaaaa

SEQ ID NO: 161088 - RNA, 64 nt, Homo sapiens
uuucaauuaaagacuauaaguaaaagcugaaaaauguuacugucuaaugggaaagaaaauaugu

SEQ ID NO: 161089 - RNA, 51 nt, Homo sapiens
cugaccuccgaagaagcuggaguugagaucauacuguuaguaauaacagag

SEQ ID NO: 161090 - RNA, 39 nt, Homo sapiens
cagcuccgcguugagagcugaacgcgaagggccggaugu

SEQ ID NO: 161091 - RNA, 32 nt, Homo sapiens
gcgaccgccaagaaaggcagcgagguggagag

SEQ ID NO: 161092 - RNA, 53 nt, Homo sapiens
gugaugcugaaaccuggccuacccagcaccacagagaaguccaggccguagau

SEQ ID NO: 161093 - RNA, 40 nt, Homo sapiens
caugggguucuccuuuucaccuugauccgccaugauagag

SEQ ID NO: 161094 - RNA, 45 nt, Homo sapiens
gagcagugggagcugcagaccagucuuccauggcaggcugagcac

SEQ ID NO: 161095 - RNA, 66 nt, Homo sapiens
gaucaggcaugaccucccauagguguucacgagaaauggugccacgcaugcgcagaacuucccgag

SEQ ID NO: 161096 - RNA, 47 nt, Homo sapiens
guagguuaacauaagaugccuccgugagaggcugguggucagcccug

SEQ ID NO: 161097 - RNA, 40 nt, Homo sapiens
gcccucuggccaguauuccuggaggauauaacacugacau

SEQ ID NO: 161098 - RNA, 48 nt, Homo sapiens
ccucuucagauuuaugauauagaugccaucacuuuuccuuuuauagau

SEQ ID NO: 161099 - RNA, 44 nt, Homo sapiens
cgacgggaauccagaacgacgcuguauggaccccucuguaggua

SEQ ID NO: 161100 - RNA, 41 nt, Homo sapiens
uguuguaucacguaucaguacuuuauuuuuuguguggcacg

SEQ ID NO: 161101 - RNA, 45 nt, Homo sapiens
uaugacgugccacacaaaaaauaaaguacugauacgugauacaac

SEQ ID NO: 161102 - RNA, 44 nt, Homo sapiens
uggauaugggcugccauuuccaaaaaauccugaccaacguggug

SEQ ID NO: 161103 - RNA, 46 nt, Homo sapiens
uucuuccauccaguguugguacauuaauugagcagccacacaaugc

SEQ ID NO: 161104 - RNA, 46 nt, Homo sapiens
uguuuuuaucauuaaagacaaagaucauccaaaauuuaaaagggau

SEQ ID NO: 161105 - RNA, 45 nt, Homo sapiens
gagauuaaaaaaggguggaaagaaggcaccaaaauuacuuuucca

SEQ ID NO: 161106 - RNA, 45 nt, Homo sapiens
aagauccuccaguuauucaugaacuuagaguaucacuugaagaga

SEQ ID NO: 161107 - RNA, 46 nt, Homo sapiens
aauguagcaugaggaucgccaugaaagguguaccggaagguaccuc

SEQ ID NO: 161108 - RNA, 61 nt, Homo sapiens
cagagaaaaaggcagaagcaaaaacaauguaaaauauaaucacacauauacauauaugaga

SEQ ID NO: 161109 - RNA, 65 nt, Homo sapiens
uuaaaauauagucaagcagugacugcuuauuuugaaugaaacaaauuaaauguagacaagcaggg

SEQ ID NO: 161110 - RNA, 26 nt, Homo sapiens
gaggaaaaauuuaaagaggucgcaga

SEQ ID NO: 161111 - RNA, 45 nt, Homo sapiens
agacuauuauugcauuuugggaauugagaaaggagcuucagauga

SEQ ID NO: 161112 - RNA, 46 nt, Homo sapiens
cuuucaaggacuuauuguaaaagaggguaacaaagaagggcuaguu

SEQ ID NO: 161113 - RNA, 36 nt, Homo sapiens
uuuugccuguguugaaagaucacacuauuuagacca

SEQ ID NO: 161114 - RNA, 42 nt, Homo sapiens
ggaguacacagaaaaaaaaugucuguagcccaagaggaggag

SEQ ID NO: 161115 - RNA, 58 nt, Homo sapiens
aaacagagcacaagaaucaggcugacaauugggaugacaaugacucacauucacuagc

SEQ ID NO: 161116 - RNA, 35 nt, Homo sapiens
uguucagagacuuccucucagcuaacagcuaagaa

SEQ ID NO: 161117 - RNA, 38 nt, Homo sapiens
gagcuguaaaggcuacuuuaaugauaaaucccuucccu

SEQ ID NO: 161118 - RNA, 52 nt, Homo sapiens
ugggcgggauuuacgugucagucuguuccaccaguccgccccccuuauuucu

SEQ ID NO: 161119 - RNA, 55 nt, Homo sapiens
ccugaggccauuuugagaaauaaggggggcggacugguggaacagacugacacgu

SEQ ID NO: 161120 - RNA, 33 nt, Homo sapiens
uaauuugaacuuuacauucuuagauaguccccu

SEQ ID NO: 161121 - RNA, 47 nt, Homo sapiens
caaaugacuaugguuaugggggacaaaaaagaccuuuagaagaugga

SEQ ID NO: 161122 - RNA, 46 nt, Homo sapiens
uauuuauuaccuguguucaguauguaaacgugaaauaaaccagugg

SEQ ID NO: 161123 - RNA, 75 nt, Homo sapiens
uuucuuggauuaugugucugcgcauauuuuauuuuugcugcacaacauucugauguuuaaucauuuaaguuugaa

SEQ ID NO: 161124 - RNA, 54 nt, Homo sapiens
ccauaccuucagauauuucaauaaauguuuauauuguuauuuauucuuguuugg

SEQ ID NO: 161125 - RNA, 71 nt, Homo sapiens
ccccuugggaagguaccauaaagugaugauuuuucuuuugagugagaaaaauuugugauuuggagagauag

SEQ ID NO: 161126 - RNA, 62 nt, Homo sapiens
guaauuggcagaggaggugaacagaucucacgcauacaacaggaaucuggaugcaaaauaca

SEQ ID NO: 161127 - RNA, 46 nt, Homo sapiens
ugauuccagcuagcaaggcaggauuagucauuggaaaagggggaga

SEQ ID NO: 161128 - RNA, 58 nt, Homo sapiens
uuucagagaaguucggaaugaguaugggucaagaauaggaggaaaugaagggauagau

SEQ ID NO: 161129 - RNA, 45 nt, Homo sapiens
ccauuccaagauuugcuguuggcauuguaauaggaagaaauggag

SEQ ID NO: 161130 - RNA, 64 nt, Homo sapiens
acauacuaaguaaauguaaauguauuuuaagagaagcaugaaaugcuuccuaaaauuugauuuu

SEQ ID NO: 161131 - RNA, 46 nt, Homo sapiens
ucuggugcaagaauagaacuucagagaaauccuccaccaaaugcag

SEQ ID NO: 161132 - RNA, 60 nt, Homo sapiens
aaaugaaugaggaaaggaaggaaaaccuaaaauuuguuauuugugacuauaagaggguag

SEQ ID NO: 161133 - RNA, 46 nt, Homo sapiens
gcuuauuauuuguguguuaucuguauuauuuuccacuccuguuaca

SEQ ID NO: 161134 - RNA, 49 nt, Homo sapiens
uuuauuuaugauccuuuuuucucaccugcuaccuaccuuuuaggccucu

SEQ ID NO: 161135 - RNA, 31 nt, Homo sapiens
gugcaaaguugggguuguguucuauagcaaa

SEQ ID NO: 161136 - RNA, 46 nt, Homo sapiens
guucauuguucuaaaauaauuuucuuucuuauacagguuagucccu

SEQ ID NO: 161137 - RNA, 58 nt, Homo sapiens
cagccaccaccagcagccccugcaggugcaccaacuacaacucaaacuaauggacaag

SEQ ID NO: 161138 - RNA, 36 nt, Homo sapiens
auguucauaucaccacauccguuucagcauuuuggg

SEQ ID NO: 161139 - RNA, 42 nt, Homo sapiens
cagccccagcuggacagguugauuauaccaaggcuugggaag

SEQ ID NO: 161140 - RNA, 44 nt, Homo sapiens
ugguuacauaauuuauuuucugaacugggauccuuuuuagaaug

SEQ ID NO: 161141 - RNA, 50 nt, Homo sapiens
uaauuuuauauuaaaguuuagggguuuuuuuuuuuggucaacaagggcaa

SEQ ID NO: 161142 - RNA, 47 nt, Homo sapiens
uucauugugugggggaaaaaaaccuuuguuaaauauauggaugcaga

SEQ ID NO: 161143 - RNA, 45 nt, Homo sapiens
uuuuaaacacuggcauguuuuuccccccuugcaguauagugguag

SEQ ID NO: 161144 - RNA, 44 nt, Homo sapiens
acauuucauaaauauauauuuugucauugguggagagcaccauu

SEQ ID NO: 161145 - RNA, 45 nt, Homo sapiens
agugacuucccuuacccuuauuuagaucugcauauauaguucuag

SEQ ID NO: 161146 - RNA, 40 nt, Homo sapiens
cuuaacuauuaaacuucauacuagaacuauauaugcagau

SEQ ID NO: 161147 - RNA, 41 nt, Homo sapiens
caaaaguuauaugcugaagaaggaaaaaguuauaaggcagu

SEQ ID NO: 161148 - RNA, 42 nt, Homo sapiens; identical to SEQ ID NO: 77619

SEQ ID NO: 161149 - RNA, 53 nt, Homo sapiens
uaagcauuauuuuaaaugacgcugaucuuaagucugaaauaaauggaaagcag

SEQ ID NO: 161150 - RNA, 47 nt, Homo sapiens
cuuuuaaacaaauuaucuugguaguuaauucauaaggguggguuugg

SEQ ID NO: 161151 - RNA, 88 nt, Homo sapiens
guuaucuguuguguagaauaaugauguagaguuuacuaaucagugaggaugucuuguuuuuauuuucugcaaacucugccucacuuua

SEQ ID NO: 161152 - RNA, 46 nt, Homo sapiens
guguaaaaagaagauuggcuuaaaauggcuacugugaugggaacag

SEQ ID NO: 161153 - RNA, 57 nt, Homo sapiens
aaaagccucaauuuagauagagaccuagaagaaaugugagaugaaaugugguuaaaa

SEQ ID NO: 161154 - RNA, 46 nt, Homo sapiens
guuaccucauuuugaaagucuugggaaacaggaaaaaauuccuaac

SEQ ID NO: 161155 - RNA, 45 nt, Homo sapiens
uaaaaguuaucucaaacuaaugacagagcuguggcauaaaagcag

SEQ ID NO: 161156 - RNA, 46 nt, Homo sapiens
ggaagaagacaagagccagucggauguagauuuucagucuugugaa

SEQ ID NO: 161157 - RNA, 49 nt, Homo sapiens
caauucagaaaugucaaaggauuggcaaaaagagaagaugugcaauaag

SEQ ID NO: 161158 - RNA, 46 nt, Homo sapiens
agaauauaucacugauguccauucgaaugaccugucuacaccacag

SEQ ID NO: 161159 - RNA, 46 nt, Homo sapiens
aauggaaaagauauuauuugagguaggucuucaauguuggcaggag

SEQ ID NO: 161160 - RNA, 46 nt, Homo sapiens
aagauucagacaugaacuaauguuuuccaccaaaaucaguacccau

SEQ ID NO: 161161 - RNA, 45 nt, Homo sapiens
aauguaguaaaaugcauauugaauuuaacuaaucauuguccuuaa

SEQ ID NO: 161162 - RNA, 46 nt, Homo sapiens
cgacaguggcuuaauaaauuuaagaccuuugccgaaccuggcccua

SEQ ID NO: 161163 - RNA, 47 nt, Homo sapiens
aggagagccaagaauuuuccucucccacuuauuucccauuuccccac

SEQ ID NO: 161164 - RNA, 45 nt, Homo sapiens
uuuggcaaguaugacaaauguacagaugguugacagcugguccuc

SEQ ID NO: 161165 - RNA, 40 nt, Homo sapiens
aagacuuaaaggagguaagggagauagucauucagacacc

SEQ ID NO: 161166 - RNA, 46 nt, Homo sapiens
cugcgaccuccgguuguucauguugauccagauauacuucaagcag

SEQ ID NO: 161167 - RNA, 46 nt, Homo sapiens
uauuuuuuuucaucauuuaucccauuuauuucuucuuagugggcau

SEQ ID NO: 161168 - RNA, 52 nt, Homo sapiens
agggacaauugugaaaucaguagguuaucuuuaaucuuuacacuacaugcag

SEQ ID NO: 161169 - RNA, 121 nt, Homo sapiens
uucgauugccuuuuccacauuaauagcaucaagcuuccccuacaaacaaaaaaaaagaugccuguuaaauuccagaguauucagcagaucagacucaaaaaaaaaaaaaauuccagaguau

SEQ ID NO: 161170 - RNA, 45 nt, Homo sapiens
aaaaaguaacagcaaauuaucuuaagcugcuuaaagaaagcccag

SEQ ID NO: 161171 - RNA, 25 nt, Homo sapiens
gaaaagaugaaaaacuuauaaacug

SEQ ID NO: 161172 - RNA, 49 nt, Homo sapiens
gauuuaauacagaauauccuguagaaaaacuaaugagggaugccaaaau

SEQ ID NO: 161173 - RNA, 60 nt, Homo sapiens
uugcuggagauauugcaaaucaguuagcuacugaugcugugcagauacuuggaggcaaug

SEQ ID NO: 161174 - RNA, 28 nt, Homo sapiens
uuuggaugaagcuaccaaguaugcccug

SEQ ID NO: 161175 - RNA, 48 nt, Homo sapiens
agccuuuacuggauucauuguggaagcagauaccccaggaauucagau

SEQ ID NO: 161176 - RNA, 62 nt, Homo sapiens
uagcugguauaaagaccaaagcagaaaagaaaggagaugaguauauuauuaauggucagaag

SEQ ID NO: 161177 - RNA, 46 nt, Homo sapiens
auuugagugguuucuuugauuuuguaagaacauuuuaauuuuagau

SEQ ID NO: 161178 - RNA, 41 nt, Homo sapiens
gcuggaaaugaucaacaaaagaagaaguauuuggggagaau

SEQ ID NO: 161179 - RNA, 41 nt, Homo sapiens
agaauuucaagcuacugcucguaaauuugccagagaggaaa

SEQ ID NO: 161180 - RNA, 39 nt, Homo sapiens
caguugcuuugugcuaauuuauaagcuugucugaguuua

SEQ ID NO: 161181 - RNA, 76 nt, Homo sapiens
augacaaugucaguggcacucgaaguugugcagugcacauucuuaucuaccaacauauacagcaguccuucuggga

SEQ ID NO: 161182 - RNA, 88 nt, Homo sapiens
uuuagaacccacugauaacagacuuauuccuggagacagcauuugaggaggaauugaagauuuuucuaaugaaaagaaaaagggucac

SEQ ID NO: 161183 - RNA, 45 nt, Homo sapiens
uuauaaauagagcccaagaucaacuaacuguacaccuggugaagu

SEQ ID NO: 161184 - RNA, 41 nt, Homo sapiens
caauguuugagcaaagcggaccucagccggaagggcagugu

SEQ ID NO: 161185 - RNA, 45 nt, Homo sapiens
aaauuacaaaacacccuguuaacacaucguuggauguuuauacug

SEQ ID NO: 161186 - RNA, 48 nt, Homo sapiens
aagcucuacuccuccagcauuagggaacagacugcccuguuccauacg

SEQ ID NO: 161187 - RNA, 46 nt, Homo sapiens
augcauguggugucaaccccguggagacauacauucgcucugguac

SEQ ID NO: 161188 - RNA, 50 nt, Homo sapiens
caccccucagcuuguggcaaccuggcuucugcccccaucgcuccacugaa

SEQ ID NO: 161189 - RNA, 50 nt, Homo sapiens
uuaaacuuuuucugcagcuucugugacaucauuuucuucuguucuccucu

SEQ ID NO: 161190 - RNA, 44 nt, Homo sapiens
auuggagaagguggccgaggcucaugaaaauaucauucauggua

SEQ ID NO: 161191 - RNA, 53 nt, Homo sapiens
aauaagauuuuucuuuagagagcagaagcagaagaguaaaauuuauuguauag

SEQ ID NO: 161192 - RNA, 44 nt, Homo sapiens
auuaagaauuaucugcauuugucucguaacauaauaauguguaa

SEQ ID NO: 161193 - RNA, 45 nt, Homo sapiens
gauggucguaucgcagaaguuuguccagaagaucuagggccucag

SEQ ID NO: 161194 - RNA, 91 nt, Homo sapiens
aacaucaguggccaaaagaagagaaaccugcaaaggagacagaauaaacaaucaaucaaacggggguuggugggggcggugaaggagguac

SEQ ID NO: 161195 - RNA, 46 nt, Homo sapiens
gaucucgaacguucucuggaacuggaacgagaucuugacugcgaac

SEQ ID NO: 161196 - RNA, 46 nt, Homo sapiens
uuucuaaugcuaaaauaaaaucgacaaguagaagcaaaauaagggg

SEQ ID NO: 161197 - RNA, 34 nt, Homo sapiens
aaaugcauuuacacauauuuaaaugaggacagau

SEQ ID NO: 161198 - RNA, 72 nt, Homo sapiens
aagcaaaacuaaucauucuguacaaguaggaaucaugagauaauccuaccacugaacccagcaauuaauaga

SEQ ID NO: 161199 - RNA, 47 nt, Homo sapiens
acucaaaaacagaguaauuuuuuuuacaaagaaacaaaugcagagaa

SEQ ID NO: 161200 - RNA, 46 nt, Homo sapiens
acauuauuucuuuuuugaacuugaacgggaaccagaaugggaugau

SEQ ID NO: 161201 - RNA, 46 nt, Homo sapiens
agggggcuaugguggugguggaccaggauauggaaaccaagguggu

SEQ ID NO: 161202 - RNA, 65 nt, Homo sapiens
acaagagaugcagucugcuggaucacagagaggucguggagguggaucuggcaauuuuauggguc

SEQ ID NO: 161203 - RNA, 371 nt, Homo sapiens
uuuuauucauauaaauuaaaaauuuuugggccggugugguggcucacgccuguaaucccagccccuugggaggccaaggcagguggaucacgaggucaggagaucgagaucauacuggcuaacacggugaaaucccaucucuacucaaaauacaaaaaacuagccaggcaugguggcaggcgccuguagucccagcuauucgggaggcugagacagcagaauugcuugaacccgggaggcagacaucgcgccacugcacuccagccugggcgacagagugagauuucgucucaaaaaaaaaaaaaaaaaaaaaaaaaaaaauuuaugacauaguaauuuuuuggggaagagcauuaccuuuuacuuuguag

SEQ ID NO: 161204 - RNA, 24 nt, Homo sapiens
aguaggagcccccaaagcagccag

SEQ ID NO: 161205 - RNA, 41 nt, Homo sapiens
aaaucuggcauaaaauaaaacacccagugcccauuuggcac

SEQ ID NO: 161206 - RNA, 37 nt, Homo sapiens
acacaucaaacacacaacaaacagugagaaggagggg

SEQ ID NO: 161207 - RNA, 46 nt, Homo sapiens
auucugugggauaagcaacauaauaugugacgaaaccagcuaucaa

SEQ ID NO: 161208 - RNA, 95 nt, Homo sapiens
cuuugguagcagaaaaccuuucauguugaguugguaaugcaaggacagauaguaaauuaucauucuaggcauagcauaaugguuaaaagugcagg

SEQ ID NO: 161209 - RNA, 30 nt, Homo sapiens
uagcuauuuuugccuuaaaaccgaacauau

SEQ ID NO: 161210 - RNA, 42 nt, Homo sapiens
uuguacaauuuggggcuggugggauuuuucaucaggcugaga

SEQ ID NO: 161211 - RNA, 45 nt, Homo sapiens
ugaauuggcuggcauggaaucacuagaauugcuuuauuugcggag

SEQ ID NO: 161212 - RNA, 46 nt, Homo sapiens
gauaaacaagcaacuuugauuccugaugagguguuugaugcaguaa

SEQ ID NO: 161213 - RNA, 43 nt, Homo sapiens
guauaagaauuauuaaaaacauuauuuuucccauauaaugaaa

SEQ ID NO: 161214 - RNA, 51 nt, Homo sapiens
aaaagggaucucuaauccaucuucugguucucucuuguuuuaaaggacuga

SEQ ID NO: 161215 - RNA, 52 nt, Homo sapiens
aaguuugcuuugggcgggggguccuggaucaaauaaguuaauugggaauaaa

SEQ ID NO: 161216 - RNA, 46 nt, Homo sapiens
uuuaaauucuuugccagaagaaauggaaucacugguaagacugcaa

SEQ ID NO: 161217 - RNA, 47 nt, Homo sapiens
gaaguuuugcugauuuuauacaauaaauagcaacuguuacaagucug

SEQ ID NO: 161218 - RNA, 94 nt, Homo sapiens
aaugccaauuacagaauaacauacacuaaagaaaaaacugucaugucaaauuuaagauaauauguuuuaaggaaugauuuuggucugauuccag

SEQ ID NO: 161219 - RNA, 42 nt, Homo sapiens
cucuuacaaauuccaccagagcucgguaauuguguaaacuua

SEQ ID NO: 161220 - RNA, 105 nt, Homo sapiens
ucucuacugcauaaaaaugucggggaaauauuaacuccuuagcuuugaauacaggguuuuuuuuuuuuuuuuuuuugaaauugauugcagauuaccaccauucua

SEQ ID NO: 161221 - RNA, 60 nt, Homo sapiens
ucagcaucagguacuuuuacccuguuuucaucaauaauuggccuauugaaugucaccuuu

SEQ ID NO: 161222 - RNA, 27 nt, Homo sapiens
aaacaagcucuuaaaucuuaaguugaa

SEQ ID NO: 161223 - RNA, 74 nt, Homo sapiens
uggaaauccauuccgaguuccucgagcagccauauuaaugaaaggaacagcugcuauacuugaauauuugagag

SEQ ID NO: 161224 - RNA, 32 nt, Homo sapiens
gaagucaauucaguagcauguauaucaauuua

SEQ ID NO: 161225 - RNA, 50 nt, Homo sapiens
gucaucaaagcuaaaaccaaauuuucuagaguaaaacuuacauacaacag

SEQ ID NO: 161226 - RNA, 41 nt, Homo sapiens
ugagaguuucaucuugcuuuuccuauggaccguccaaaaau

SEQ ID NO: 161227 - RNA, 58 nt, Homo sapiens
ccugaacccugaauugucccaacugaaugaagcucccuugcucauuugcagccaccag

SEQ ID NO: 161228 - RNA, 51 nt, Homo sapiens
ucagcugucugucuaaaugacaugcaugagacuugaucuaugucugcauag

SEQ ID NO: 161229 - RNA, 369 nt, Homo sapiens
uauaaaagcaauagagccgaggaugguggcucaugccuaucaucccagcacuuugggaggcugaggugggaggaucacuugagcucaggaguucgagaccagccugggcaacauagcaagacucugucucugcaaaaaauaaaaaauuagccaggagugguggugcaugccuauagucccagcuacucaggaggcugagguggaucacuugagcccagguggucaaggcugcagugggccaugaucaugccacugcacuccaaccugggugacagagcaagacccugucucagaaaaaaaaaaaaaaaaaaaaaaaaggcauuaaaaaagcaauaaagcagaaagaaagcauuugccauuuuauuaaac

SEQ ID NO: 161230 - RNA, 44 nt, Homo sapiens
auuuguggagaaauguaaauuguaauaauguaaaugggggcuuc

SEQ ID NO: 161231 - RNA, 53 nt, Homo sapiens
cacaugguuacauuugggaacuuguguagggaucauggccccuguagccaggg

SEQ ID NO: 161232 - RNA, 57 nt, Homo sapiens
agaauauaacagaaauagagcaagaagcccuugagauccagaaaaucuaaaacaaaa

SEQ ID NO: 161233 - RNA, 46 nt, Homo sapiens
auaauugagccuugacccucuguuguagggaaaugaagcaggugau

SEQ ID NO: 161234 - RNA, 1377 nt, Homo sapiens
acguuauggcagaucuuauuuaacauuuauauuucuuaacuugacaaaagguauauauucuuuuuuuauauacauacuuuaaguucugggauacaugugcagaacgugcagguuuguuacauagguauacacgugcuauggugguuuguugcacccaucaacccgucaucuauauuagguauuucuccuaaugcuaucccucccccacccccacccccugccaaugacaggccccggugugugauguuccccucccuguguccauguguucuuauuguucaacucccacuuaugagugagaacauguaguauuugguuuuccguucuugugguaguuugcugagaaugaugguuuccggcuucauccaugucucugcaaaggacaugaacucauccuuuuuuauggcggcauaguauuccaugguguauaugugccacauuuucuuaauccagucuaucauugauggacauuugggcugguuccaagucuuugcuauugugaacagugccacaauaaacauacaugugcaugugucuuuauaguagaaugauuuauaauccuuuggguauauacccaguaaugggauugcugggucaaaugguauuucuaguucaagauccuugaggaaucaccaaacugucuuccacaaugguugaacuaaguuacacucccaccaacaguguaaaagcauuccuauuucuccacauccucuccagcaucuguuguuuccugacuauuuaaugauugccauucuaacuggcgugagaugguaucuuauuguaguuuugauuugcauuucucuaaugaccagugaugaugagcuuuuuuucauauguuuguuugaaacauuucauauguuucaaaugucuucuuuugagaagugucuguucauauccuucgcccacuuuuugacuggguuuuuucuuguaaauuuguuuaaguuccuuguagauucuggauauuaucccuuugucagauggauagauugcagaaauuuucugccguucuauagguugccuguucacucuuugauaaaccugacaaaaauaagcaauggggaaaggauucccuauuuaauaaaugguguugggaaaacugucuagccauaugcagaauacugaaacuggacaccuuccuuacaccuuauacaaaaauuaacucaagauggauuuaagacuuaaacguaagaccuaaaaccauaaaaacccuagaagaaaaccuaggcaauaccauucaggacacaggcaugggcaaagacuugaugacugaaacaccaaaagcaauggcaacaaaagccaaaauugacaaaugggaucuaauuaaacuaaagagcuucuccacgacaaaagguauauauucugcagccacaacuaacc

SEQ ID NO: 161235 - RNA, 43 nt, Homo sapiens
uuuucuuugucuuucuuaauuguacauuuuuuaaggcaaaaau

SEQ ID NO: 161236 - RNA, 46 nt, Homo sapiens
uuguacaucagucucgaaugcuuagaaauaaccguuuagccucagu

SEQ ID NO: 161237 - RNA, 51 nt, Homo sapiens
ucuggaggaggagcucuacgugcuggaggcagagggagcgagauaggggac

SEQ ID NO: 161238 - RNA, 57 nt, Homo sapiens
agaccucuugauaaaaggcccuuuguauagaggccugaaugaugagaaggggugggc

SEQ ID NO: 161239 - RNA, 64 nt, Homo sapiens
caggccccacccacaaugagcaaaggacacaguaguuaguagagcucccucggggugcaguagg

SEQ ID NO: 161240 - RNA, 36 nt, Homo sapiens
cacagaggagguagcuguagagccaagaauggcggg

SEQ ID NO: 161241 - RNA, 45 nt, Homo sapiens
aauaaauuuuaaaaccucagucuaagaauaguuugcuucauggac

SEQ ID NO: 161242 - RNA, 47 nt, Homo sapiens
gauuggaaaaggauuaagcuaucaauagagaagggaaacuccuccau

SEQ ID NO: 161243 - RNA, 45 nt, Homo sapiens
uguaaugguauagcauuauugaacaguuaugaauucugugcagug

SEQ ID NO: 161244 - RNA, 76 nt, Homo sapiens
ccuuucuguuacuccagugcacccacccauaggagugauggagggacaggagggauaaacagccucaaccgaagau

SEQ ID NO: 161245 - RNA, 45 nt, Homo sapiens
acagagcagggacagcuuguugucaguaucauaaacaaccaaaau

SEQ ID NO: 161246 - RNA, 42 nt, Homo sapiens
cuucugacagggcagggggcgaugcggcuggggacccgaagg

SEQ ID NO: 161247 - RNA, 45 nt, Homo sapiens
aaaugcuuacuuguauauagagauaauaaaccuauuaccccaagu

SEQ ID NO: 161248 - RNA, 44 nt, Homo sapiens
cuccgacgaagaaggcgaaaguuacuccaaagaaguuccugaaa

SEQ ID NO: 161249 - RNA, 55 nt, Homo sapiens
caagagauaugggggcuucaugagaggcuuaaagagaagcccccaacuggaagau

SEQ ID NO: 161250 - RNA, 64 nt, Homo sapiens
aaacaggggacaaccgagagcguagccaccaccaggauggcagugauaaugaggaagaagugag

SEQ ID NO: 161251 - RNA, 68 nt, Homo sapiens
aagaagaggccaauggaagugagauccucgccaagcgguaugggggcuucaugaagaaggaugcagag

SEQ ID NO: 161252 - RNA, 44 nt, Homo sapiens
ugucuguuuauuuuaugucugauuucuuuugaaugaguaguugg

SEQ ID NO: 161253 - RNA, 45 nt, Homo sapiens
cuguuauuguucucuaccaauaggggaaaaaauuaaaacauuaga

SEQ ID NO: 161254 - RNA, 47 nt, Homo sapiens
cauugguagaauuauuucaguguuauuauuuuugugauuucguaugu

SEQ ID NO: 161255 - RNA, 46 nt, Homo sapiens
accuucaguauuuauugaacagaggaaauaacugacaagggcaaua

SEQ ID NO: 161256 - RNA, 50 nt, Homo sapiens
aauauccaaauuaauuacuaaaaucgagaagagaaggcaaacucuugaaa

SEQ ID NO: 161257 - RNA, 32 nt, Homo sapiens
uaaaaacaaaaggagacuuucuuuaucucauu

SEQ ID NO: 161258 - RNA, 82 nt, Homo sapiens
agauuuuguauauuuugaaucaaagcuaacuaggaauguuagauauaagaauguaaugauauucaugcacugaauucuaagc

SEQ ID NO: 161259 - RNA, 52 nt, Homo sapiens
gagaugauuucugcuacaauucuguagaaagauuaaggauggcagaguaaaa

SEQ ID NO: 161260 - RNA, 45 nt, Homo sapiens
gaacacagugucuuugccuaugguagauccaugugaaugucagga

SEQ ID NO: 161261 - RNA, 67 nt, Homo sapiens
auggaauuauuuuauauuguuauaaaaaucccagaugcaaauuuuuuuaaugccaauuauuagagcu

SEQ ID NO: 161262 - RNA, 47 nt, Homo sapiens
auuuuucuaguguagcuagacuauuuugucaucauguaccacuacau

SEQ ID NO: 161263 - RNA, 57 nt, Homo sapiens
ggucuucugccaguauuuaaggugaacauuugauagcuucuaccuuaccagccaaag

SEQ ID NO: 161264 - RNA, 40 nt, Homo sapiens
gaacaccaagagucaauucccuugacuugcagcccgagua

SEQ ID NO: 161265 - RNA, 79 nt, Homo sapiens
gcacgagguauggcaggaugccucaucuuuccggcugauauucaucguggauguguggcauccggaacugacaccacag

SEQ ID NO: 161266 - RNA, 42 nt, Homo sapiens
auauuccaucaugcaccccgggacucacguguggccgcacac

SEQ ID NO: 161267 - RNA, 48 nt, Homo sapiens
aaaaccuguaccuuacuagaaaaguuccccgagacaacaggaugcaga

SEQ ID NO: 161268 - RNA, 44 nt, Homo sapiens
gagggaaaaaggggacuggagccaguucacgcuguggcagcaag

SEQ ID NO: 161269 - RNA, 91 nt, Homo sapiens
ggaaguuauuacaguguacugauguaaucugaucaacaagaucaguacucuucuuagguugugguuucaaaaaaaagucuuuaggcaaaac

SEQ ID NO: 161270 - RNA, 57 nt, Homo sapiens
accgucaccugccccuccacuccuagucucuacuggucauaagcucccuuucuggca

SEQ ID NO: 161271 - RNA, 56 nt, Homo sapiens
uaaauauaauuuggcagcucuagcacuaggaguguggagaggcuauucaacucaag

SEQ ID NO: 161272 - RNA, 29 nt, Homo sapiens
uagagugcaguuuuccugaaggcagggga

SEQ ID NO: 161273 - RNA, 46 nt, Homo sapiens
acugauugacauagcuggaagccuagcaguagggcagacuucgggg

SEQ ID NO: 161274 - RNA, 51 nt, Homo sapiens
gagcuccucccucuccuccuuacuccagucuagucagggccagcuauggag

SEQ ID NO: 161275 - RNA, 50 nt, Homo sapiens
cgguauucccauaacuuccaaauccacguucuagcuagauuuagucuccu

SEQ ID NO: 161276 - RNA, 42 nt, Homo sapiens
ggagauuuuauuuccaccugggggaugccaugcagaggguug

SEQ ID NO: 161277 - RNA, 56 nt, Homo sapiens
gagguggccagccuaccugaugucccugcagaccugcugaagcugaguuugaagcg

SEQ ID NO: 161278 - RNA, 42 nt, Homo sapiens
gugugaggaugauuuggcugagaagaggagaaguaaugaggu

SEQ ID NO: 161279 - RNA, 104 nt, Homo sapiens
ccuuaguccaagccauaaccaucccacaccuggauuccugcuggaguguucugccucucccagcuucucagucuguucuccauacggcugccaccaugaucccu

SEQ ID NO: 161280 - RNA, 89 nt, Homo sapiens
augucuuauuuugugaaaaaaaaucccauaguugucuuauuuugucaauuugugcugauucuuagguuuguuuguuuguuuguucuuua

SEQ ID NO: 161281 - RNA, 59 nt, Homo sapiens
acaggaggcccagcaugccaaacagggcuacaugggaaagacucaaggugaucagggga

SEQ ID NO: 161282 - RNA, 51 nt, Homo sapiens
augcauuuaaagaacuaguacgcaaauacccucagaguccacgagcaagau

SEQ ID NO: 161283 - RNA, 33 nt, Homo sapiens
gugaagccaucuacuguuuguggucaguuugua

SEQ ID NO: 161284 - RNA, 44 nt, Homo sapiens
aaaaccccuaguggggaaggaccacaaaacagagauacgcaggg

SEQ ID NO: 161285 - RNA, 60 nt, Homo sapiens
ugccuucgggaggagggcuccuguuugcugggugcugagguugugcacagagccaaaaac

SEQ ID NO: 161286 - RNA, 71 nt, Homo sapiens
uacuagaguuugggaagcaggggaaguuuagcauggccucaaagcucuuuaauccuuuguugacuugaaau

SEQ ID NO: 161287 - RNA, 18 nt, Homo sapiens
cccacaucccccgccugu

SEQ ID NO: 161288 - RNA, 65 nt, Homo sapiens
acaaagcuaauuuguauaaugauugugacaaugugagcaggaaaguaaaauacuuuucuuaagga

SEQ ID NO: 161289 - RNA, 46 nt, Homo sapiens
uguuaaaauacacauucucuuuguuuuuauuuuucauuucaugauu

SEQ ID NO: 161290 - RNA, 57 nt, Homo sapiens
aaaacagucucccguccacccuugcagcugugaaaagagauuaugagauaacugcuc

SEQ ID NO: 161291 - RNA, 41 nt, Homo sapiens
caguuccagcuaaccacuaugccuaguaauuuuuccauguu

SEQ ID NO: 161292 - RNA, 80 nt, Homo sapiens
uccuuccuuauuucccucccaagagugggaagaucuguggagagcccuaaacuccccuucaugaccagcacccaccuguu

SEQ ID NO: 161293 - RNA, 51 nt, Homo sapiens
uuagaaacacacauuucuaaaaaugucauguuacauuccugcaugucccuu

SEQ ID NO: 161294 - RNA, 48 nt, Homo sapiens
ugccccuaccaccacaggaggaccagccuaaccauacgcuccaaaaga

SEQ ID NO: 161295 - RNA, 53 nt, Homo sapiens
guguuucuuaaaagauugagauuauucaguucaguuuuaauucucaagugcuc

SEQ ID NO: 161296 - RNA, 48 nt, Homo sapiens
uuacaaagcacaaaggccaugacagcaugccagacgggugaaagagga

SEQ ID NO: 161297 - RNA, 43 nt, Homo sapiens
augaaugagaaaagcaguccauggagaaauugaccuuuuacau

SEQ ID NO: 161298 - RNA, 45 nt, Homo sapiens
aguaagcauuuuuccuguggaagaacagcaggaaguaccaccagg

SEQ ID NO: 161299 - RNA, 45 nt, Homo sapiens
gcaguauaugaaccucuagaaaaugaagggauagaaaucacaggu

SEQ ID NO: 161300 - RNA, 45 nt, Homo sapiens
gugaaccaguaguagaagaugaaagauugcaccaugauacaggua

SEQ ID NO: 161301 - RNA, 50 nt, Homo sapiens
caagacuguaaucaggauauggaagagaugaugucugagcaggaaaaucc

SEQ ID NO: 161302 - RNA, 86 nt, Homo sapiens
caacaagaggaugaugaguuucuuauggcgacugauguagaugauagauuugagacccuggaaccugaaguaucucaugaagguag

SEQ ID NO: 161303 - RNA, 39 nt, Homo sapiens
ugggaauccaguuaggaagcuaucuuaggcuuugugaga

SEQ ID NO: 161304 - RNA, 31 nt, Homo sapiens
aagugugugaggacucaguuguggagguauu

SEQ ID NO: 161305 - RNA, 44 nt, Homo sapiens
agagccagcagucccgccagaagaggcugagccacacacugagc

SEQ ID NO: 161306 - RNA, 69 nt, Homo sapiens
gaacauuuaaacaaugauuuuguuuuaauuugaagugaaaagcuaacuaagacaaagagauauauucaa

SEQ ID NO: 161307 - RNA, 48 nt, Homo sapiens
cacuucugagcacucacccugagcacagauaaccauagcuggaguaac

SEQ ID NO: 161308 - RNA, 46 nt, Homo sapiens
gguauacugaggaagaucuguauucacugauuacacaagccaggag

SEQ ID NO: 161309 - RNA, 49 nt, Homo sapiens
uguuugaaaucugucuguccagcuuggguuacuugaagaugcuuugaau

SEQ ID NO: 161310 - RNA, 50 nt, Homo sapiens
uacaagagauugagguggcugcaaucccuccagugaaaugcugcaaaaua

SEQ ID NO: 161311 - RNA, 89 nt, Homo sapiens
uuuauugaaguugaagucacacuuuauccaacugcguaauauuuaagcuucaacuaaaaacaagcuuucagucaugauuagaggguuaa

SEQ ID NO: 161312 - RNA, 40 nt, Homo sapiens
uuuuuauggauuaauauauugaauacuuucauugacguua

SEQ ID NO: 161313 - RNA, 34 nt, Homo sapiens
aaaaucugaaaguuaaagaacucacuaaagaaga

SEQ ID NO: 161314 - RNA, 45 nt, Homo sapiens
agaaaaugcaauuuccaguggcaauuaaguauuucuaaugccaac

SEQ ID NO: 161315 - RNA, 56 nt, Homo sapiens
cccuuccugaggagaugaacacuacauugcaccuccaacccuaaugugccuaagaa

SEQ ID NO: 161316 - RNA, 44 nt, Homo sapiens
cuucagaaacugaauguaauaauuguuuaaauuauuagcuuggu

SEQ ID NO: 161317 - RNA, 48 nt, Homo sapiens
augggacggaggaagaugagaaggcuuacagugacucacaggucucac

SEQ ID NO: 161318 - RNA, 45 nt, Homo sapiens
gugugcauuuuaauggacuucuuuauuuuccaaauaccguuucug

SEQ ID NO: 161319 - RNA, 59 nt, Homo sapiens
caaagugaauuauuauuaauagcugacucuugucauuggccagaauuacaggaccauga

SEQ ID NO: 161320 - RNA, 46 nt, Homo sapiens
gaacuucauucuucacgugguuuauggugauugcauugcugggcgu

SEQ ID NO: 161321 - RNA, 52 nt, Homo sapiens
cacagaagcuuacucacuuucguaaaucuuuuuuucuucaaauuuuaguagu

SEQ ID NO: 161322 - RNA, 41 nt, Homo sapiens
gggagaguucugcugagagggucaagucagaugaggacuga

SEQ ID NO: 161323 - RNA, 25 nt, Homo sapiens
aagucugggcugagagcccgagaca

SEQ ID NO: 161324 - RNA, 44 nt, Homo sapiens
uuugugguucacaccuuuauacuuuuuguaagacacauaacaca

SEQ ID NO: 161325 - RNA, 44 nt, Homo sapiens
uuugacuuacauaaaccucaaaaucuguguuguaaauauuuguu

SEQ ID NO: 161326 - RNA, 51 nt, Homo sapiens
ccuuugauaauuuuauuucacaaccagcauuguuguaacugccuuuucuca

SEQ ID NO: 161327 - RNA, 50 nt, Homo sapiens
gaaaugccagcacuucucuccuacaugugugcccacacguugaacccagu

SEQ ID NO: 161328 - RNA, 50 nt, Homo sapiens
ugacugucaucaucugccguagauacuaugugugcuccagagcggagagc

SEQ ID NO: 161329 - RNA, 25 nt, Homo sapiens
uugccaugcuugaauuuuagguucu

SEQ ID NO: 161330 - RNA, 52 nt, Homo sapiens
cuccuuuaggcgcgcggggcggaggccgcauucggcgggccuggcgggcggg

SEQ ID NO: 161331 - RNA, 41 nt, Homo sapiens
gcagcagcggcuccggcagcgguagcacgagugcgggcagc

SEQ ID NO: 161332 - RNA, 44 nt, Homo sapiens
ggcaguggugcaucagagguggcagaacuacuucacacuaacca

SEQ ID NO: 161333 - RNA, 46 nt, Homo sapiens
acccaugacagcuuaaugggugaacucccagccuuucccccaucag

SEQ ID NO: 161334 - RNA, 45 nt, Homo sapiens
caugccaacagcaccaaccccaacaacuguaaucuuauucugggc

SEQ ID NO: 161335 - RNA, 53 nt, Homo sapiens
auuggacuuggaaccaaaaggaaucaggaaugcacaucaggcagucgucgggg

SEQ ID NO: 161336 - RNA, 52 nt, Homo sapiens
aauauaccaguugcccgacuuaacagauucaagaacaagugaaaagacagua

SEQ ID NO: 161337 - RNA, 44 nt, Homo sapiens
gaaaugcaagcucauuuccugauguugcugcuucuccgcuggag

SEQ ID NO: 161338 - RNA, 45 nt, Homo sapiens
ucugcuugggcacucgcuaacauugcuucugggacaucagaauaa

SEQ ID NO: 161339 - RNA, 46 nt, Homo sapiens
acacuuucaauccucugcugcuacaagaauccugcaccccaguuag

SEQ ID NO: 161340 - RNA, 46 nt, Homo sapiens
accuuaguuuggcuccugcaucaugaugauccagaaguauuagcag

SEQ ID NO: 161341 - RNA, 46 nt, Homo sapiens
ggagcuucugaauugccaacugugacuccugcacuaagacccauag

SEQ ID NO: 161342 - RNA, 47 nt, Homo sapiens
ucuuucaggcugcugagaaacuaggugaaacugagaaacuuaguaua

SEQ ID NO: 161343 - RNA, 61 nt, Homo sapiens
cuuuguuaagcuuaauugagaagaauuucuugguagaggaagaggaagaucaaaaugcugu

SEQ ID NO: 161344 - RNA, 42 nt, Homo sapiens
cuuuuuucaguggccgggaagauggcggacauucagacugag

SEQ ID NO: 161345 - RNA, 46 nt, Homo sapiens
cacgcucagucugaauguccgccaucuucccggccacugaaaaaag

SEQ ID NO: 161346 - RNA, 45 nt, Homo sapiens
acauugacaagaaaugccccuucacuggugaugucuccauucgag

SEQ ID NO: 161347 - RNA, 42 nt, Homo sapiens
cccacuagcuuuuccauaggcuuagagaggugggccccacag

SEQ ID NO: 161348 - RNA, 49 nt, Homo sapiens
aaccuuuauugacuuuguuuuuacaauaaaaaauauuuuacaacuuacu

SEQ ID NO: 161349 - RNA, 49 nt, Homo sapiens
gcugcaaacaacuacagucuuugaaauauggaaaaucagcagucuaaag

SEQ ID NO: 161350 - RNA, 51 nt, Homo sapiens
uagaguagcaauugcuauuucuaaauugugaacuuuaagucaaucuagauu

SEQ ID NO: 161351 - RNA, 58 nt, Homo sapiens
gaaaauaaacagucucuuuuuuacaaagccuguguuagagcacagauuuaccuaggcu

SEQ ID NO: 161352 - RNA, 55 nt, Homo sapiens
caaauuauaauugucaaauauauauuuuaaauuaauaaaaguugucauucuuagg

SEQ ID NO: 161353 - RNA, 62 nt, Homo sapiens
ggucgcccgagucgugucccccuguuaugcgcccgggcugagccgcaggcugacacccccga

SEQ ID NO: 161354 - RNA, 39 nt, Homo sapiens
agggcggcagggccgggaaggagggaaaggagacuggag

SEQ ID NO: 161355 - RNA, 72 nt, Homo sapiens
cgggggagaggguggaggacccagaaaaacccguuugaggaagaugugccucccugcgcguucaagguguca

SEQ ID NO: 161356 - RNA, 48 nt, Homo sapiens
cagacggaauccccccaagaagcccagauaauccaggccaagaagagg

SEQ ID NO: 161357 - RNA, 45 nt, Homo sapiens
ggaugucaaaaaaagaagagaggaggucaccaagaaacaucagua

SEQ ID NO: 161358 - RNA, 48 nt, Homo sapiens
auuaucuggggggaucaguccuugcauuaucauugaaacaccucacaa

SEQ ID NO: 161359 - RNA, 38 nt, Homo sapiens
cauauuuagcuguaaaugugcuuucuauguacucucaa

SEQ ID NO: 161360 - RNA, 56 nt, Homo sapiens
cacaagaaggcauuggguuuugacuuuuucugacugucuagugaucauggaaucaa

SEQ ID NO: 161361 - RNA, 124 nt, Homo sapiens
auuuauuauuaauaacaauagugaaacaucagggcaauuccuauuaaagucagaaacaagggauaagauuuuguuuaucaccaauguuaaccauucaguauccuuugauaauuuuuaacagugc

SEQ ID NO: 161362 - RNA, 46 nt, Homo sapiens
gcauccgccucccgccagccaggaagccacugcggccugcggcuuc

SEQ ID NO: 161363 - RNA, 43 nt, Homo sapiens
gagagucaacuucuuucaggaauaacggcaaggacaaucucug

SEQ ID NO: 161364 - RNA, 46 nt, Homo sapiens
uguggaauuaaauuucuuuaguaaagaccaaauauuaucagcuggu

SEQ ID NO: 161365 - RNA, 78 nt, Homo sapiens
ccuucucauucaagucauguuugucaacauaacuccagaguuuacuccagcuuuuccacacuauggaugccuagcaaa

SEQ ID NO: 161366 - RNA, 71 nt, Homo sapiens
ugauaaaucuuuaaaccacagggauccaccuagagccuuagcugauuacauguauccuagguaguucucag

SEQ ID NO: 161367 - RNA, 45 nt, Homo sapiens
cccauugaugaagaucuauucucucacucuugcaugauacucuug

SEQ ID NO: 161368 - RNA, 45 nt, Homo sapiens
gcaguugucgaccucaccaagacaucugaacauauucaguuuuca

SEQ ID NO: 161369 - RNA, 42 nt, Homo sapiens
uuuucgaagugauggaucacgcugagaccacaugaugcguac

SEQ ID NO: 161370 - RNA, 37 nt, Homo sapiens
cuuucacacuuaaggcgggcccgaacuugccaaagag

SEQ ID NO: 161371 - RNA, 48 nt, Homo sapiens
guuccacuuuuuucugagcucgaccaacguaaauuuguuuuccauuga

SEQ ID NO: 161372 - RNA, 46 nt, Homo sapiens
agacguucaucaucaauaccaucaucaagauuuuucacauaaagau

SEQ ID NO: 161373 - RNA, 42 nt, Homo sapiens
cauuucuguaacugcuuuaguggcuucuucuggggaggagaa

SEQ ID NO: 161374 - RNA, 60 nt, Homo sapiens
uugcauuguaacuuguggcugugcauuacgauguugcugaggauugcgaacucccgcagc

SEQ ID NO: 161375 - RNA, 45 nt, Homo sapiens
aauuaucaaucuccaacaacaugccagugauuuucccagcaagag

SEQ ID NO: 161376 - RNA, 54 nt, Homo sapiens
acaaugagcuauaaucuggcuuuuguuggugucugaauuuuuuccugccuaaga

SEQ ID NO: 161377 - RNA, 42 nt, Homo sapiens
aggcgcugccccggcugcugcagcacgccgcccucccgggcc

SEQ ID NO: 161378 - RNA, 42 nt, Homo sapiens
gggcaugggucugaugauggugggcguccucaucggcaccuu

SEQ ID NO: 161379 - RNA, 45 nt, Homo sapiens
gguggccgccaggauccagagcagcgagaagcugagcgcgguuau

SEQ ID NO: 161380 - RNA, 58 nt, Homo sapiens
uuugagcggucuuguggcggcccuaggagggcgcucuaucagauaaauaccagcagag

SEQ ID NO: 161381 - RNA, 45 nt, Homo sapiens
ugggaagucuguccuacacauaaaacauaccuaacgcggagccuc

SEQ ID NO: 161382 - RNA, 41 nt, Homo sapiens
uuuuuagcgacauggaccaaaggaaguguuucaguaaacag

SEQ ID NO: 161383 - RNA, 50 nt, Homo sapiens
cagagagaauaaacaacuugcccaaggucacuagauucuaagcagacagc

SEQ ID NO: 161384 - RNA, 47 nt, Homo sapiens
gagucaaacuuugaaccauggucugauggcagugucucaaccaacca

SEQ ID NO: 161385 - RNA, 57 nt, Homo sapiens
uuuagcauuguguggucaauaaaaaagaagggaaaaaaaagaaaaauggccucuugc

SEQ ID NO: 161386 - RNA, 51 nt, Homo sapiens
uuuuuuuuuuaaagaaaaaaauuccaguuaaaacucauuuuuuuugugugc

SEQ ID NO: 161387 - RNA, 61 nt, Homo sapiens
uuuugugaccuucuuuuacuugaaguaaugaacaucuuguuauuacguguauuacaacaug

SEQ ID NO: 161388 - RNA, 67 nt, Homo sapiens
uuaggcucacuuuuuaaaaagauuucugcaggguuaccauagguagugaguggggguagucugugua

SEQ ID NO: 161389 - RNA, 46 nt, Homo sapiens
gacgguggauagauuuccccagagaaggugcgguugacaagaugua

SEQ ID NO: 161390 - RNA, 44 nt, Homo sapiens
ccagcuagggccgcugagauugggaacacagaaaagaugaagag

SEQ ID NO: 161391 - RNA, 37 nt, Homo sapiens
aguacccagcauuuuggcucaggaguuguauuccaaa

SEQ ID NO: 161392 - RNA, 51 nt, Homo sapiens
gaauaaagugaccaaacuuuaguaagagguauaaaagaagauuuugaguaa

SEQ ID NO: 161393 - RNA, 40 nt, Homo sapiens
gauuauuugguaucuaaugcugggaaaauuggcuacugga

SEQ ID NO: 161394 - RNA, 43 nt, Homo sapiens
cuagauuacugaucucucauuacccaacuaucugauggcaucu

SEQ ID NO: 161395 - RNA, 68 nt, Homo sapiens
gcuuccuacccagcuucugaauucuuacuuggguaccacccugcggacaauggaagaugucauugcag

SEQ ID NO: 161396 - RNA, 49 nt, Homo sapiens
auuaguuacagcuuaauuuguaucaggaggcauuuaaugcagcuuacaa

SEQ ID NO: 161397 - RNA, 47 nt, Homo sapiens
aacauugauuccaccuccagaaaauguuaggguccucuuguuguaga

SEQ ID NO: 161398 - RNA, 48 nt, Homo sapiens
agguggaaucaauguuguaugauucuaaugagauacgugauugucaag

SEQ ID NO: 161399 - RNA, 44 nt, Homo sapiens
agcuugguuuuuaaaaaaggcguuuugaucaaacaaggccaccu

SEQ ID NO: 161400 - RNA, 43 nt, Homo sapiens
aacauguuuauaauuucaugaaguacauauauauuguucccau

SEQ ID NO: 161401 - RNA, 46 nt, Homo sapiens
agaccucccauuugccuuuucauuacggugaaagcuuugcccucau

SEQ ID NO: 161402 - RNA, 54 nt, Homo sapiens
gcaccugggucuacaggacauaauuggcaucuaaauccucauuucuugcuauua

SEQ ID NO: 161403 - RNA, 41 nt, Homo sapiens
cgauuuauugugagugcaacuuaaaaacccagcaaccaaau

SEQ ID NO: 161404 - RNA, 101 nt, Homo sapiens
aaacucuccuuuucucugcaaaugcugcuuggcugugaacagcauggauuuaccugcaccaauguggcacacaccuagcaacuuucucaagcauucuaaag

SEQ ID NO: 161405 - RNA, 29 nt, Homo sapiens
augcuguucacagccaagcagcauuugca

SEQ ID NO: 161406 - RNA, 44 nt, Homo sapiens
cagauaguguuauacugaacaucauucugauauaaugaguagcc

SEQ ID NO: 161407 - RNA, 42 nt, Homo sapiens
uuuaaagucauugcuuuaaucugaaaagccauuagaagggag

SEQ ID NO: 161408 - RNA, 53 nt, Homo sapiens
ccuguggaacagugauuccucucccuucuaauggcuuuucagauuaaagcaau

SEQ ID NO: 161409 - RNA, 44 nt, Homo sapiens
acugucuuaaaagugacuuaguguucuauaagguagccugcugg

SEQ ID NO: 161410 - RNA, 44 nt, Homo sapiens
ucaaguagguuucauagcagagcauuaaauuauuagauggacuu

SEQ ID NO: 161411 - RNA, 25 nt, Homo sapiens
aguacuuuacuuuccacuagauaaa

SEQ ID NO: 161412 - RNA, 50 nt, Homo sapiens
aacggauggauaaucauacccaaagucagcaucuggaugaagaaguguau

SEQ ID NO: 161413 - RNA, 49 nt, Homo sapiens
auauccacaaccuagagacucauucuaaacucacugagagguuagacaa

SEQ ID NO: 161414 - RNA, 67 nt, Homo sapiens
aaaugaccggccagggagcagcggcagcaccacacgggcauggagcgcugcgcgaggggcgcccgag

SEQ ID NO: 161415 - RNA, 62 nt, Homo sapiens
acauaaaaugaugcuuaauauuauuagucauuuggaaaugcaaauuaaaacugcaaugaguu

SEQ ID NO: 161416 - RNA, 79 nt, Homo sapiens
aggagaaaaucuucaugaccuaggguuaggcagaaucuuuaaauaugacaucaaaaauaaauaggauucauuaaaaaau

SEQ ID NO: 161417 - RNA, 46 nt, Homo sapiens
aaauucugaagacagaagaguuacagaauuaagauaguauuucaga

SEQ ID NO: 161418 - RNA, 42 nt, Homo sapiens
cugauagaaguuuaggugaaauucuuacugcuguguggaaag

SEQ ID NO: 161419 - RNA, 113 nt, Homo sapiens
ucaaaugcugaagaaagaguauucagccaaacaaaacagcaagcauaaaggcucugagccuagaagaggaaaaaguuuuauauucucaagaaacagugagaaggccugugugg

SEQ ID NO: 161420 - RNA, 63 nt, Homo sapiens
caagauacacaaauugugacagucuuauaaggaaauaagcaagguaauagacuaauuaaggga

SEQ ID NO: 161421 - RNA, 81 nt, Homo sapiens
aacagaguaguaaacaagacaaacuuucuguagcuaguucacauucuaguugagaaggcagagugaaaacaaauaaauaag

SEQ ID NO: 161422 - RNA, 41 nt, Homo sapiens
ucccucucacagucacgaaguagcaaaucugcaccagaagg

SEQ ID NO: 161423 - RNA, 41 nt, Homo sapiens
gugaucuuaagaugcuagugcauauaaagugacugacaugu

SEQ ID NO: 161424 - RNA, 46 nt, Homo sapiens
accccuuaugaguaaugaguccaauugguuguucaaauacccugua

SEQ ID NO: 161425 - RNA, 47 nt, Homo sapiens
ugauaaaguaaaugaucacuucgaucauguuucuaugcuguaaaaug

SEQ ID NO: 161426 - RNA, 41 nt, Homo sapiens
ugagauccauaguuuuacagcauaaugaagagcugucauug

SEQ ID NO: 161427 - RNA, 32 nt, Homo sapiens
aaucauaauucacuuauuccaaggaaagauac

SEQ ID NO: 161428 - RNA, 45 nt, Homo sapiens
uuauauggaguaucauccugguggagaagaugaacuaaugagagc

SEQ ID NO: 161429 - RNA, 73 nt, Homo sapiens
gauuggauucgacugaccaaaaguggaaaggaucuaacgggauuaaaaggcagguuaauugaaguaacugaag

SEQ ID NO: 161430 - RNA, 48 nt, Homo sapiens
uaggaaaaauuuuuuacccggcguuacacacaaaaauaaacucgaggu

SEQ ID NO: 161431 - RNA, 52 nt, Homo sapiens
gguggggagaggguagauauugauagcuugggcuaagguaauguuggagagg

SEQ ID NO: 161432 - RNA, 45 nt, Homo sapiens
uuaggaauauuaaugcaaaaaugccguaauaaagucaugaaaaac

SEQ ID NO: 161433 - RNA, 36 nt, Homo sapiens
gguauauuggaaucaugugaucuuguagaaacagug

SEQ ID NO: 161434 - RNA, 61 nt, Homo sapiens
auaaauauauucccaccuugcaugaagacuuagacucaaaucuaugcauuguauuaguagu

SEQ ID NO: 161435 - RNA, 62 nt, Homo sapiens
gugcuuauuaacugccacagauacuguugacguggcaaugccgcugaacuucacuggaggua

SEQ ID NO: 161436 - RNA, 53 nt, Homo sapiens
aaauaccuugacagacuuuccuccagccaacaacaaaauaaaugugggugaua

SEQ ID NO: 161437 - RNA, 46 nt, Homo sapiens
gcugugaaaaccgcauuuuauuuagcagaguuuuuuguuaaugaag

SEQ ID NO: 161438 - RNA, 51 nt, Homo sapiens
ccccgggagcggggagaacucggcggcgggcggcgcgggucaccaccauca

SEQ ID NO: 161439 - RNA, 28 nt, Homo sapiens
uaaacguaugcugcuuaaagcuuggaaa

SEQ ID NO: 161440 - RNA, 42 nt, Homo sapiens
gcuccccucuggaguggauaggguuaauccgggcagccagaa

SEQ ID NO: 161441 - RNA, 61 nt, Homo sapiens
uccucagauauuuuuuuuucccuugccgaugucggcuuguggguaugcggcauauggagag

SEQ ID NO: 161442 - RNA, 47 nt, Homo sapiens
caacuacuuuuacuaaacaugcaaugugcuggccacuucaacagaua

SEQ ID NO: 161443 - RNA, 46 nt, Homo sapiens
auguaagucaugcuaucagcgugaaucauguaaagagagcaauagc

SEQ ID NO: 161444 - RNA, 48 nt, Homo sapiens
ucagcuuaugguuuuuuaaccugaacacaaucuaugggauacuucaag

SEQ ID NO: 161445 - RNA, 55 nt, Homo sapiens
gguguuaugaaugugaugaaaaauuaucaacgcauuguaauaagaagguuuuggc

SEQ ID NO: 161446 - RNA, 51 nt, Homo sapiens
gcauuuucuagaaucaugaaacuuugugaagaaaaaugugaaacagaugaa

SEQ ID NO: 161447 - RNA, 32 nt, Homo sapiens
gcuagaugaaauuugagaguguauuccauaaa

SEQ ID NO: 161448 - RNA, 42 nt, Homo sapiens
ucuuacugaucugaugaaugagaucaaagaaaguaguacaaa

SEQ ID NO: 161449 - RNA, 44 nt, Homo sapiens
auuuucuuuuuugguccuaauuaagaagugucauuuuagagaga

SEQ ID NO: 161450 - RNA, 24 nt, Homo sapiens
gaaguuuacgggagacagaucaug

SEQ ID NO: 161451 - RNA, 52 nt, Homo sapiens
uguccuucucaccuccccacacuuguacucuauuuucuagcuagacuucccu

SEQ ID NO: 161452 - RNA, 38 nt, Homo sapiens
gauauguuuaagaauuauuggcauuuauuuucaaugag

SEQ ID NO: 161453 - RNA, 78 nt, Homo sapiens
auugcauuuuaaaaugugucaugugagauuuacugcucaucuagccauaauaguuuauaagacuuuccugauuaaaau

SEQ ID NO: 161454 - RNA, 52 nt, Homo sapiens
auuguaaguauauaaagagucuuaaagaucaauaagaaaaauaucagacccu

SEQ ID NO: 161455 - RNA, 44 nt, Homo sapiens
accuguccaaauuagcaaagauguaguaguguugauaaggauga

SEQ ID NO: 161456 - RNA, 88 nt, Homo sapiens
uucucuucugaaagggaauuuuaauagccagugauuaagucaguaauauguggaacacuuaauacauugaauaugauuuuuguccuuu

SEQ ID NO: 161457 - RNA, 61 nt, Homo sapiens
ucaaaacugcugcuacuuuaauaauuagguacagaaagcagacuggcuuaucauugcuuau

SEQ ID NO: 161458 - RNA, 40 nt, Homo sapiens
ccuaaaaccuuacauccauggccaguccugcccuauccac

SEQ ID NO: 161459 - RNA, 49 nt, Homo sapiens
acuauuaaugguaaugauuauuuaggucauuuguuuuugaaugccacag

SEQ ID NO: 161460 - RNA, 32 nt, Homo sapiens
cccagaauuuacaguaggaaaggaaaccccuu

SEQ ID NO: 161461 - RNA, 28 nt, Homo sapiens
aggauagcuuugaaauauaaauuaccaa

SEQ ID NO: 161462 - RNA, 55 nt, Homo sapiens
uuuuaacagugaaauaaucaagaaauauaucuuuaaguuaaucugcaaagucagg

SEQ ID NO: 161463 - RNA, 53 nt, Homo sapiens
uauugacugucuuuauucaagucagccaucuugguaagagcaguuuucauccc

SEQ ID NO: 161464 - RNA, 51 nt, Homo sapiens
aguaacaugcaaguaagauauuuuuauugucauuuucuucauguuaaagga

SEQ ID NO: 161465 - RNA, 56 nt, Homo sapiens
acaguaguuucuggaucaccucaggaaacaguauaaauaaauaauaauguuuacuu

SEQ ID NO: 161466 - RNA, 47 nt, Homo sapiens
gauuuugcauuuguuggauuuguuaguagugaagauacuauggugaa

SEQ ID NO: 161467 - RNA, 45 nt, Homo sapiens
aaguauagccauacauacauaacacucaacaauacaaucaugaaa

SEQ ID NO: 161468 - RNA, 51 nt, Homo sapiens
uauguuggggaucuuuuuucgggagggaccggaaaagaggugggaucguuu

SEQ ID NO: 161469 - RNA, 38 nt, Homo sapiens
aauacaaaagcugcgcgucccuuaauuuccucggcggg

SEQ ID NO: 161470 - RNA, 40 nt, Homo sapiens
accuucucuuuggagcccuuaaugauacgacgaaccccaa

SEQ ID NO: 161471 - RNA, 51 nt, Homo sapiens
uaacauucacaagguauuaaucaucauccccaaauuaaagagguauugaag

SEQ ID NO: 161472 - RNA, 41 nt, Homo sapiens
aaauuaggcaacaacuguacaacuuggaaaccuuguuacag

SEQ ID NO: 161473 - RNA, 52 nt, Homo sapiens
guguuaagugcuuaacacagugucuaccauuauugaugccuagcaaccaaag

SEQ ID NO: 161474 - RNA, 44 nt, Homo sapiens
auuagucuaguaaggcuuugagaauucuuucucgugcguagucu

SEQ ID NO: 161475 - RNA, 48 nt, Homo sapiens
aacuaccuagauaauuauugcugauauaaaugcugaaguaagugaggg

SEQ ID NO: 161476 - RNA, 48 nt, Homo sapiens
agacuugaaaagauagguuauuugaagcucagaagacuaaauuuuuaa

SEQ ID NO: 161477 - RNA, 59 nt, Homo sapiens
uuguuuuaauugguacuuccaguugagcuucuuuuauuuuuuaagaacucucuagguau

SEQ ID NO: 161478 - RNA, 44 nt, Homo sapiens
cuaugcuguuaaaauauuuugauuguugcuuuuauuucuuuaau

SEQ ID NO: 161479 - RNA, 50 nt, Homo sapiens
aagaauccucuaaugaacaagacagagguuuucccugagcuuuugaauag

SEQ ID NO: 161480 - RNA, 45 nt, Homo sapiens
caucuccacuuggauauacauuggcuggugcuagaaauucuuuac

SEQ ID NO: 161481 - RNA, 51 nt, Homo sapiens
ucuguuuauguuaguaccuauaguucuacuuuauccauuuaaaggcugcau

SEQ ID NO: 161482 - RNA, 24 nt, Homo sapiens
uuguggauauguugcccauuuauu

SEQ ID NO: 161483 - RNA, 64 nt, Homo sapiens
aaauacauuguggguaauuggagucagguuugucuguguuggggaauugaguuacacauaugga

SEQ ID NO: 161484 - RNA, 46 nt, Homo sapiens
gaaggagguguugauggauacaguagguauacaaauagaaauaugg

SEQ ID NO: 161485 - RNA, 45 nt, Homo sapiens
gguuuuaguugguggauuauuacucauguagcaucauuuuacaag

SEQ ID NO: 161486 - RNA, 43 nt, Homo sapiens
aaucaugggauuggauugucacaaagauuccuucuaguuuuaa

SEQ ID NO: 161487 - RNA, 46 nt, Homo sapiens
uggaaucaaauuggaacuuuguagaagaacugcugaaaaaguccau

SEQ ID NO: 161488 - RNA, 61 nt, Homo sapiens
uuaaacauauuguauggaagcccuguaaaguuuuguaauauguuaucauuuuuguaagagu

SEQ ID NO: 161489 - RNA, 45 nt, Homo sapiens
acgaauguaucuucacuguuguuugacacuuugugauuucuggga

SEQ ID NO: 161490 - RNA, 56 nt, Homo sapiens
aacaagucuauuagacacauacuauaugucaagcacuauaguggggauaguaguag

SEQ ID NO: 161491 - RNA, 52 nt, Homo sapiens
ggagaauggaaaguguuuucagaaguuaguaguauguugaugagagguagag

SEQ ID NO: 161492 - RNA, 75 nt, Homo sapiens
uuuauucaacaaauuuaacuaguauuuuugaaugccuacuaugauaguaggcacuuaggauauaucagugaacca

SEQ ID NO: 161493 - RNA, 47 nt, Homo sapiens
gcuaaugguuuauacuuguccugaaauuuuauaugcuuauccaacaa

SEQ ID NO: 161494 - RNA, 56 nt, Homo sapiens
agaggaaaaagagaaaacauaaggguggagaaagaacacuguaaaacagaaacuag

SEQ ID NO: 161495 - RNA, 74 nt, Homo sapiens
guuaacucuucucugacuauggaauagguuaaaaacaccuaaaauugugacuuugguacauugaccuaguuuaa

SEQ ID NO: 161496 - RNA, 48 nt, Homo sapiens
agaacagugucaucuugcuuauauaaugacagaagaaugaagucagca

SEQ ID NO: 161497 - RNA, 46 nt, Homo sapiens
cuccuacuggcaguuuuccuggaaacuaguaaaauauuauaaagaa

SEQ ID NO: 161498 - RNA, 46 nt, Homo sapiens
gaaaaaaaucagaaauugggaaguugauuguucuagaauuuucuag

SEQ ID NO: 161499 - RNA, 50 nt, Homo sapiens
uauucuucuacacauuacuauucauauacuuuuuuaaaaccaaaaauaag

SEQ ID NO: 161500 - RNA, 46 nt, Homo sapiens
aaaaauagaaccuuagauguaauucuuaaaaaugaaugggagccau

SEQ ID NO: 161501 - RNA, 61 nt, Homo sapiens
acauagaauagucuuuugcuuauaguaaaaaaaaauuacuguauuuuucaaaauguuacaa

SEQ ID NO: 161502 - RNA, 60 nt, Homo sapiens
auagguggcaaauauuagaagggaggaauuuuaagucuuuagaaguuuguguuuauuuag

SEQ ID NO: 161503 - RNA, 54 nt, Homo sapiens
gaagagaaaauuacuaauaaauugguuguaauuguagauagcuugaggucagug

SEQ ID NO: 161504 - RNA, 57 nt, Homo sapiens
agccuuuuuuuuuuuuccuuguuaaaugugugcuauaaauugugcuucuugaaagag

SEQ ID NO: 161505 - RNA, 46 nt, Homo sapiens; identical to SEQ ID NO: 78143

SEQ ID NO: 161506 - RNA, 47 nt, Homo sapiens
uuaauaaacaacaacaacuuuuucuauaaauuuuuucggagcaucag

SEQ ID NO: 161507 - RNA, 44 nt, Homo sapiens
uuaguaguauaguucuuuaaugaauaaauguuggugauuaagag

SEQ ID NO: 161508 - RNA, 46 nt, Homo sapiens
gagagguugccagguaaacacccuucuguuagugcacaggaguagc

SEQ ID NO: 161509 - RNA, 44 nt, Homo sapiens
gguuuuacagcauagcuggugcuggaaguuaaauugaugcccag

SEQ ID NO: 161510 - RNA, 53 nt, Homo sapiens
caaauuacuuauccuuucuguacugagauuccuugucuauaaaaugaggacaa

SEQ ID NO: 161511 - RNA, 56 nt, Homo sapiens
agaugaaagaaucaggaaaauacuugaagauaaugaggaaagcuaaaggaggcagg

SEQ ID NO: 161512 - RNA, 31 nt, Homo sapiens
ucuauaauuaggacuuuacgaugauagauua

SEQ ID NO: 161513 - RNA, 50 nt, Homo sapiens
uaacauuaaaaaugaaaagaaggauauuuguuuaacaucuuuuuggguuu

SEQ ID NO: 161514 - RNA, 45 nt, Homo sapiens
cguuuuuguuuuaaaaauauuugucaauuuguuucuacagcacau

SEQ ID NO: 161515 - RNA, 45 nt, Homo sapiens
aaagaguauuuucucaaaggcccaaguugaauauuuauccaucuc

SEQ ID NO: 161516 - RNA, 51 nt, Homo sapiens
aauucacacuuaaggacagcagaaaaauuacauuaaugaagaauaauaaaa

SEQ ID NO: 161517 - RNA, 63 nt, Homo sapiens
ccuuauuuaguuguugauuggaucugaaccugcaauuaaaugccuguggugugcuaggagcua

SEQ ID NO: 161518 - RNA, 41 nt, Homo sapiens
auaguguaaaaucuuuuacaugaaucaacacugcggcccaa

SEQ ID NO: 161519 - RNA, 36 nt, Homo sapiens
uuuuuuguuuuuuuccuuuauuucucuguggucaaa

SEQ ID NO: 161520 - RNA, 44 nt, Homo sapiens
uguaaauuacaggaaaagcuauagcaauucaggcaucuuaauuu

SEQ ID NO: 161521 - RNA, 61 nt, Homo sapiens
agcaacauguacaagggcaugagcuuuaagaaaauauagaaugguucuguuguggcuggag

SEQ ID NO: 161522 - RNA, 57 nt, Homo sapiens
cauccuaagaaguuuggacuuaaucuuuuacauggggaccugaugaauuuggagcag

SEQ ID NO: 161523 - RNA, 54 nt, Homo sapiens
gagcugugauuaagaguacuugcuaauugaguguuguggaggaacucaaagaag

SEQ ID NO: 161524 - RNA, 61 nt, Homo sapiens
uugagaaacacagccacuauuccaccaauaucaucucuaaagaaaugcauugugcaaguca

SEQ ID NO: 161525 - RNA, 26 nt, Homo sapiens
ucuauauccuuuaacuuuaacauuag

SEQ ID NO: 161526 - RNA, 51 nt, Homo sapiens
ugccuucauguauuauuuauuuuuauaugaaauuagcuuuuaaacuuuaag

SEQ ID NO: 161527 - RNA, 51 nt, Homo sapiens
aauaucuuuuuuguccaugaaauaaauuucaugcuccuuagcucucugcaa

SEQ ID NO: 161528 - RNA, 46 nt, Homo sapiens
auaagggguccucaccuccuccucgcuuagcauccauucuggccuu

SEQ ID NO: 161529 - RNA, 45 nt, Homo sapiens
ucccuggcauuuuaaaaugcuugguguuagucagugaaccacaag

SEQ ID NO: 161530 - RNA, 49 nt, Homo sapiens
uuagcaacuguguaauaggauccuuggaacuuuuuacaaaacugcauuc

SEQ ID NO: 161531 - RNA, 44 nt, Homo sapiens
guaguaaaaagagugcucugcaaguguguguugugaucaaucua

SEQ ID NO: 161532 - RNA, 40 nt, Homo sapiens
gaagaguguuucaggccuaguuugcaauauaaagauacaa

SEQ ID NO: 161533 - RNA, 46 nt, Homo sapiens
cuuaaauauuuuguuacuuuugaagucgaaaucuucccuccugaag

SEQ ID NO: 161534 - RNA, 28 nt, Homo sapiens
aauuuaaagaauaauuaaaaaaccaugg

SEQ ID NO: 161535 - RNA, 26 nt, Homo sapiens
gaucauuggaagggaccugagaaauu

SEQ ID NO: 161536 - RNA, 45 nt, Homo sapiens
uauagaggauguugaagaauucaaugugaugacggaaugaggcau

SEQ ID NO: 161537 - RNA, 46 nt, Homo sapiens
guauucccuaagugucgagacucagucucauccaagacuaaacgau

SEQ ID NO: 161538 - RNA, 32 nt, Homo sapiens
agauaaaugugguuaggauaugguucccugau

SEQ ID NO: 161539 - RNA, 28 nt, Homo sapiens
auuaaacuugauaggaacgcaacauuaa

SEQ ID NO: 161540 - RNA, 43 nt, Homo sapiens
uccagugguaggagcaucuguaagugcauuuaaaucauuagaa

SEQ ID NO: 161541 - RNA, 54 nt, Homo sapiens
aaugaucuuaauuuacauuugucauauaguaagcauuuucccccaagguugaag

SEQ ID NO: 161542 - RNA, 35 nt, Homo sapiens
cacuucagggccuggugucaagccauacuagcaag

SEQ ID NO: 161543 - RNA, 47 nt, Homo sapiens
uuguuuaguuucaugugacuucucacaguaaggaccaucccucaaac

SEQ ID NO: 161544 - RNA, 40 nt, Homo sapiens
uaauuuuuuaaaacucuaaucucaaacuaaauucaaaagc

SEQ ID NO: 161545 - RNA, 77 nt, Homo sapiens
ugcuucugggacgggcagaaaacgcacaaucaaggacuugcaagaagaaguuucaaaccuguacaauaacauuaggu

SEQ ID NO: 161546 - RNA, 41 nt, Homo sapiens
uaggaaagaagaagccagagaucaguuuuauguuccaggau

SEQ ID NO: 161547 - RNA, 69 nt, Homo sapiens
caguggaagcaugagaggaggaggugggggcaaugccagagaguacaaaauuaaaaaagucaagaagaa

SEQ ID NO: 161548 - RNA, 45 nt, Homo sapiens
aguaaaaaggauaaaaaagaugagcgaagaaggaaagcaacaggu

SEQ ID NO: 161549 - RNA, 40 nt, Homo sapiens
acauggguugauauugcaguauguuuuaucuuuuccucac

SEQ ID NO: 161550 - RNA, 46 nt, Homo sapiens
cucuuguuuuugaaagcagcuuguguuggucaaggacuuguggauc

SEQ ID NO: 161551 - RNA, 40 nt, Homo sapiens
ccuugacauucaugaccuugacacuuuugaagaucacagg

SEQ ID NO: 161552 - RNA, 29 nt, Homo sapiens
aaggcacugggguacaaaagggagaaggu

SEQ ID NO: 161553 - RNA, 51 nt, Homo sapiens
acgcauagaucauuuaaaauaaaugaaugucuuuucuucaaaggucgagua

SEQ ID NO: 161554 - RNA, 118 nt, Homo sapiens
ucugauuaaacuggaaauuagggcauuuuuuguuuuguuuuguuuuguuuuuucuuuuuuccuaccuaaauaaaugucuucaauuuucccuucagauuugaagauuggaagcaggccu

SEQ ID NO: 161555 - RNA, 27 nt, Homo sapiens
gaagcaggcugcauugugaacggggca

SEQ ID NO: 161556 - RNA, 45 nt, Homo sapiens
uuuccuaaauucaguguaaguaccucgcugauuuagcacuggagu

SEQ ID NO: 161557 - RNA, 37 nt, Homo sapiens
cuuccuagaucaucuacauaaaaaucauuugaaauau

SEQ ID NO: 161558 - RNA, 51 nt, Homo sapiens
guguuugaucauaucuuugaguucccuugaacucugaucucauuuugagaa

SEQ ID NO: 161559 - RNA, 31 nt, Homo sapiens
auucaaguauuuuuaaauauccaauuuguug

SEQ ID NO: 161560 - RNA, 46 nt, Homo sapiens
gucgacaaaaacaauaaguuauaccuuaguuacuuuaacuggagga

SEQ ID NO: 161561 - RNA, 41 nt, Homo sapiens
gagcuaagcaaaagcauugaaauccauaccuacgggcaagc

SEQ ID NO: 161562 - RNA, 47 nt, Homo sapiens
cuucuugacgguaagcacaaaucccuucguguuugaagugccaagca

SEQ ID NO: 161563 - RNA, 59 nt, Homo sapiens
ucacaacggaccguucacuguacaacaaaucccaugcaguucugauccaucaccgagac

SEQ ID NO: 161564 - RNA, 71 nt, Homo sapiens
gguguggccauuugggcagaccuuugaccuuacauccugccaagcaauguucaacauccaaggaugccauc

SEQ ID NO: 161565 - RNA, 48 nt, Homo sapiens
aaauuaugacaucaacauccaaaggaauucuucgcccauuuuuaauug

SEQ ID NO: 161566 - RNA, 51 nt, Homo sapiens
uuaauaaagacagugaugaaggacuagugauugaguagagaggagagagag

SEQ ID NO: 161567 - RNA, 48 nt, Homo sapiens
agaccauuaaaccaucaccuuguuuuaaaaauauaaaaaucagaaaug

SEQ ID NO: 161568 - RNA, 44 nt, Homo sapiens
aauguuuagguaugauagagaaaccaguaauucuucucaucagu

SEQ ID NO: 161569 - RNA, 40 nt, Homo sapiens
aaaugaaucauuggaguggggcuugaaaaaucuggauaau

SEQ ID NO: 161570 - RNA, 47 nt, Homo sapiens
gacggauucaggcuugcauaaauaaucugcaggaguucuuugaauau

SEQ ID NO: 161571 - RNA, 50 nt, Homo sapiens
gagguaagugggaauguacuaucuugaaagaagcuaggagggagucauau

SEQ ID NO: 161572 - RNA, 51 nt, Homo sapiens
ucaguauugcagguuguuaacaaaauuuucagagagaaauagcgaauagaa

SEQ ID NO: 161573 - RNA, 56 nt, Homo sapiens
aacuaaaacucauccaaguuacagaauaauuucagaagguuagcuucuaugaggag

SEQ ID NO: 161574 - RNA, 46 nt, Homo sapiens
auacagugaaguaguauaacaacugucuacgugcuucccaugauau

SEQ ID NO: 161575 - RNA, 44 nt, Homo sapiens
aagucagcucauaucucuccucugcuucuaggcuucugugacuu

SEQ ID NO: 161576 - RNA, 50 nt, Homo sapiens
uaccaacagcugcuacauuaaugaauucagacaaaguaucaguccucauu

SEQ ID NO: 161577 - RNA, 43 nt, Homo sapiens
acacacuaguuuaaaugucacaucaucugugaagccaucuauu

SEQ ID NO: 161578 - RNA, 182 nt, Homo sapiens
aaugcaaaccuguguccuaggaagacaaguuuuuguuguugucauuguuguuguuauuucaauagguuuuuggggaacaggugguguuugguuacaugaauaaauucuuuagcggugauuucugagauuuuggugcacccaucuccugagcaguguacacgguacccaaaguguagcacaau

SEQ ID NO: 161579 - RNA, 41 nt, Homo sapiens
uuagcaccugugccuccuauauagucaguggaacacaugcc

SEQ ID NO: 161580 - RNA, 47 nt, Homo sapiens
aauaggaacccaaguuuauuuuuuucuucauaucaaaaaucuggcuu

SEQ ID NO: 161581 - RNA, 55 nt, Homo sapiens
uaaauauccucuugugggccuauaugaaaguuucucugugaaaauuggauguaaa

SEQ ID NO: 161582 - RNA, 49 nt, Homo sapiens
uuuaauaauucauucauuucauuauauuuugaaaggaaaauuauacgga

SEQ ID NO: 161583 - RNA, 64 nt, Homo sapiens
aggaaaguauaagaaaagaaaaaaagacaguaauauugagaaacaaaacaauccuccuagaaau

SEQ ID NO: 161584 - RNA, 40 nt, Homo sapiens
aaugcaguucuggaaagaggggacagcuaguguauauauu

SEQ ID NO: 161585 - RNA, 57 nt, Homo sapiens
aggauacauuuaucaagcaacuguuuuaguacaaacauuuuauuuuucuuuuccuag

SEQ ID NO: 161586 - RNA, 42 nt, Homo sapiens
cugauucaucaaauguuccuggacacguccuaagugccaguu

SEQ ID NO: 161587 - RNA, 42 nt, Homo sapiens
gacuaaacccagauaccacaguucaaagaaaagagaugggga

SEQ ID NO: 161588 - RNA, 45 nt, Homo sapiens
uuucuuucacuggagagcucuucaguucauccaugaagcugaguc

SEQ ID NO: 161589 - RNA, 41 nt, Homo sapiens
cguguuauuagagcaauuguaagaaaacuucaggccagauu

SEQ ID NO: 161590 - RNA, 50 nt, Homo sapiens
uuaauaaaguaaaggacacuagaaagaaagacaaguaguaaggaaagaaa

SEQ ID NO: 161591 - RNA, 48 nt, Homo sapiens
uggcauaaaaauugaaagagcaggaaagagcaaaaugaaggugagaag

SEQ ID NO: 161592 - RNA, 46 nt, Homo sapiens
ugaauaguugggauuaugggauuaacaacuugauucaguuggugau

SEQ ID NO: 161593 - RNA, 52 nt, Homo sapiens
agcaaggaguaauacuuugaucaguuauugcccauaauuauguuaaugauaa

SEQ ID NO: 161594 - RNA, 49 nt, Homo sapiens
uuuuuguuauuguuguuuuaaagcgcagaacuauuugcauugcuuaggu

SEQ ID NO: 161595 - RNA, 94 nt, Homo sapiens
caaagccuucuccacaaaguccucccugacccaccuucucuccuuucccaaagccuggcucucgagcccgacugucccguccuauuccuuccca

SEQ ID NO: 161596 - RNA, 43 nt, Homo sapiens
gucaccccaaacagggucaucucuacuguuacugucccugcgu

SEQ ID NO: 161597 - RNA, 46 nt, Homo sapiens
cugcagcucgcagucccgccucaccuuccagcccccaggcucccac

SEQ ID NO: 161598 - RNA, 41 nt, Homo sapiens
agucgcgcucuuaggacagcgccgccaccgccgccuggccc

SEQ ID NO: 161599 - RNA, 43 nt, Homo sapiens
cagaaacaaaaauuagcacuaaauuuuuuauaaaauagaccag

SEQ ID NO: 161600 - RNA, 49 nt, Homo sapiens
gacgaaaaguaauagagaaaauuuacuuagcauuuuagauucuagagac

SEQ ID NO: 161601 - RNA, 44 nt, Homo sapiens
ccuauaccacgcuagguguuuugacauguuuaguguuucugcuu

SEQ ID NO: 161602 - RNA, 46 nt, Homo sapiens
accaguaauacaguguaccuagauuaccguccucauaaaccagguc

SEQ ID NO: 161603 - RNA, 46 nt, Homo sapiens
uugugauaaauacaacuuaauauuuaucccaagugugggcccagga

SEQ ID NO: 161604 - RNA, 49 nt, Homo sapiens
guuguggcaggggauaggggagugugcaggggugaagguagagaauaga

SEQ ID NO: 161605 - RNA, 46 nt, Homo sapiens
ugaccuucuuccagaacuucaucaacgaacuauucauuuggggaaa

SEQ ID NO: 161606 - RNA, 37 nt, Homo sapiens
auagaauaagcugucuuuagaugaaguuugggcacag

SEQ ID NO: 161607 - RNA, 41 nt, Homo sapiens
ucauggagcacuucuugcuggagguggcagccgcgccgcug

SEQ ID NO: 161608 - RNA, 55 nt, Homo sapiens
aguuagaaaaaacacuugcuuuagcaaaaucuuaacuauagcauuauucugaagg

SEQ ID NO: 161609 - RNA, 32 nt, Homo sapiens
gguacguucuucagaugugucauaguuugaua

SEQ ID NO: 161610 - RNA, 60 nt, Homo sapiens
augaaaauugcauuacauauccaccuuuaguccacuucucuugcacagcuccugauaaau

SEQ ID NO: 161611 - RNA, 46 nt, Homo sapiens
uucccuccucucugguaguuuuaucuggaguguggggauugaaggu

SEQ ID NO: 161612 - RNA, 27 nt, Homo sapiens
uuuaauuuuauucuuuagacuuuuaug

SEQ ID NO: 161613 - RNA, 46 nt, Homo sapiens
uagagauguguguugagguaaacagcuucauaaaaaccguugagca

SEQ ID NO: 161614 - RNA, 51 nt, Homo sapiens
uuuuggaacaacuuuaggccucugauguuacuuuagcccugggugguaggu

SEQ ID NO: 161615 - RNA, 24 nt, Homo sapiens
uuggggagaggaaggagagagguu

SEQ ID NO: 161616 - RNA, 42 nt, Homo sapiens
uuucuaacugaagugagccaaaaggaaaauuaugcuggggca

SEQ ID NO: 161617 - RNA, 87 nt, Homo sapiens
cauggccagcuuguucaugguauacacuuguaugagcaaccaaagauaaacagacagaaaagcaaauauaacuugccacuaaccaag

SEQ ID NO: 161618 - RNA, 39 nt, Homo sapiens
ugauuaacugcauuuuuaguggcgaacaagagugaacuu

SEQ ID NO: 161619 - RNA, 39 nt, Homo sapiens
cguucuugaagcaguuacuaaaccagaaaggagguacac

SEQ ID NO: 161620 - RNA, 79 nt, Homo sapiens
uauugacguggaaaguugugguccucuuucgugucgugucuugcuuacuaccgcguuacaaguguugguagugcaguga

SEQ ID NO: 161621 - RNA, 117 nt, Homo sapiens
cguuuuauggacuuaaguucaaugacuuaaucuucguaauaaugaaaugaaaaaguucccguuauuuagugaagaauguugcauugaauuagagauuugcgguuuaucugugcccuu

SEQ ID NO: 161622 - RNA, 178 nt, Homo sapiens
gccgcacaaaacugauuuuauuacuuuugccacugugguacuucguguuaguguguccagaguaaguuuucagaagaguuagcaauugaauugacuuagcccgucugauugcagugcuauugcauuaggauaaaauggauagaaguuuaaauaggauuaagucuacgaaaugauuuca

SEQ ID NO: 161623 - RNA, 42 nt, Homo sapiens
gcagcugcccagccgcuuccaccaguaccagcagcaccggcc

SEQ ID NO: 161624 - RNA, 13 nt, Homo sapiens
aaagagaauguaa

SEQ ID NO: 161625 - RNA, 42 nt, Homo sapiens
acuugcaaacggauuggccuaaucaagaaguucaaccuggag

SEQ ID NO: 161626 - RNA, 50 nt, Homo sapiens
uacucuguagaaucugggacugggcaaauguuuguguggccuccuuaaac

SEQ ID NO: 161627 - RNA, 36 nt, Homo sapiens
uuggguagaacagggacaucuuuuucuuugggccga

SEQ ID NO: 161628 - RNA, 43 nt, Homo sapiens
uggcaaauaaauguuuuuaauggucuuuguacuuugagucuua

SEQ ID NO: 161629 - RNA, 36 nt, Homo sapiens
agguuuuuucugcuaaguguuuugauagaucuagaa

SEQ ID NO: 161630 - RNA, 49 nt, Homo sapiens
uagcauggguuaaguuugggccucuugaauaguugguucaugaaacuag

SEQ ID NO: 161631 - RNA, 57 nt, Homo sapiens
gaauuucuugccuuugagagcaccgccugcuuuuaaaaagguaugagagaaaauauu

SEQ ID NO: 161632 - RNA, 65 nt, Homo sapiens
aauuucaguuuuacccuguaauucuguaccaaauuuucuuuuuagacuguucuaugacauuguca

SEQ ID NO: 161633 - RNA, 45 nt, Homo sapiens
agaacaaauucuguacaacauaaaacaagaguauaaacgaaugca

SEQ ID NO: 161634 - RNA, 52 nt, Homo sapiens
uugccguguuuuuccagcgucaccagcugauggaauuauuauuuugguuguu

SEQ ID NO: 161635 - RNA, 46 nt, Homo sapiens
aauugggaccucuugcaacaacucaacaaggaacaaggcagcccac

SEQ ID NO: 161636 - RNA, 42 nt, Homo sapiens
gggcugccuuguuccuuguugaguuguugcaagaggucccaa

SEQ ID NO: 161637 - RNA, 48 nt, Homo sapiens
ucccaggacaauauuaagcaaauagccugcagugcuuccugugaaaua

SEQ ID NO: 161638 - RNA, 61 nt, Homo sapiens
agagaucgagaugucauuucaucugggccuuacuuugcucaucugaguuguauuuguuugg

SEQ ID NO: 161639 - RNA, 56 nt, Homo sapiens
cuguuuggcuuuauuuaggcaguaaauauucuacuucgggaugaccugucauggag

SEQ ID NO: 161640 - RNA, 91 nt, Homo sapiens
aaauuccguuauccaggaguauaaauuauuugcaguugcuuuagcaauccucauuccuccucucccaauucccugcauuggcauuccucac

SEQ ID NO: 161641 - RNA, 49 nt, Homo sapiens
auguggcaagacuaacauggggaggcugcuagaaagcaaauaagcaaag

SEQ ID NO: 161642 - RNA, 45 nt, Homo sapiens
ugaauucucuauuuuucuaauguacguuuagaagugggggcgggg

SEQ ID NO: 161643 - RNA, 33 nt, Homo sapiens
ugguuaauauuaacaaguaauacgguuguuugg

SEQ ID NO: 161644 - RNA, 45 nt, Homo sapiens
cugaaaaaauggaugcaaauucugcaaccucagaagaaaugaaug

SEQ ID NO: 161645 - RNA, 117 nt, Homo sapiens
ucccaauccccugcccucugauccugaauuccuuaaccaagccaauucuguguucaugcuaggucaaaauaaguaugugaucuaacccaauaguuagcauuaagcaaaaacuaaaca

SEQ ID NO: 161646 - RNA, 53 nt, Homo sapiens
agaaugaagcacugaaaagcgaagaaggcugcauuccgaauaucgccccagac

SEQ ID NO: 161647 - RNA, 62 nt, Homo sapiens
gauauucggaaugcagccuucuucgcuuuucagugcuucauucuaacaauuaacaguaaacu

SEQ ID NO: 161648 - RNA, 43 nt, Homo sapiens
auuugaucuacuucauuaggucagguggggagagaugagauag

SEQ ID NO: 161649 - RNA, 41 nt, Homo sapiens
uuuguuuucauuuuuaaaccacaaccaggaacaaagcagac

SEQ ID NO: 161650 - RNA, 89 nt, Homo sapiens
uucaaaaaaucagcuacugaauuuuaaaaguguaaccacaaugaaaacaaaacaaaauacaaccuaacaaaacucccucaaaccaacag

SEQ ID NO: 161651 - RNA, 47 nt, Homo sapiens
cucucuagaaggagcacagcuguacauuuaagcaguuaugguuuucu

SEQ ID NO: 161652 - RNA, 49 nt, Homo sapiens
ccuuaacauuuauuacauauuacaguuuggguuuaaaauuacaguuggg

SEQ ID NO: 161653 - RNA, 50 nt, Homo sapiens
gcuagagcuaaauaaaggaaugcagcuuuugaaaugggaaggucgaagau

SEQ ID NO: 161654 - RNA, 179 nt, Homo sapiens
gcccuaauagugaucacuggaucagcaaggggccaaccuuaaguacauaaauaggguaaaaggcuuagaaaaauagaagguaaauacuguguaaauuucagucuuuuacaaaaugggacuuauggagauugcuguaaaaauaaacugcacauauaauuuuuucuucuuuuuuugcuggg

SEQ ID NO: 161655 - RNA, 49 nt, Homo sapiens
acggcagcuuguuugagaucacacagcuagcuagugguagcacucagac

SEQ ID NO: 161656 - RNA, 45 nt, Homo sapiens
gugcuucuuugucuuaaaaaucuuuuggcuuuaggaaacugcuuu

SEQ ID NO: 161657 - RNA, 45 nt, Homo sapiens
gagaguuguacuguacauguuuagaaaagaacauaugggauucag

SEQ ID NO: 161658 - RNA, 25 nt, Homo sapiens
aaauaggagcgagccaggucagaau

SEQ ID NO: 161659 - RNA, 43 nt, Homo sapiens
gauuuuaaaaaccuauauauguauuaguaaccuuuggugcaaa

SEQ ID NO: 161660 - RNA, 43 nt, Homo sapiens
uaaguuuuaccagugaaauaggaugaaaagaaaacugccaaua

SEQ ID NO: 161661 - RNA, 43 nt, Homo sapiens
aaguauucaaauucuuuauaauugaauauucaaagacuuccua

SEQ ID NO: 161662 - RNA, 51 nt, Homo sapiens
auauuagacaguacuguuuugaucuaacaaggauauguuucugcagcacua

SEQ ID NO: 161663 - RNA, 50 nt, Homo sapiens
uguagauauaaaauccaaagaggaggaaaguguucacgucacccaaagaa

SEQ ID NO: 161664 - RNA, 34 nt, Homo sapiens
aaagcauucaaaaaggauacaaaaauauacagac

SEQ ID NO: 161665 - RNA, 41 nt, Homo sapiens
ugagaccugaaaaaugaguagaaguuagguuaaggauuagg

SEQ ID NO: 161666 - RNA, 56 nt, Homo sapiens
cugacgaucacaaauuuuaaguguuagcaaggaaaagaguucuaggcagacaacag

SEQ ID NO: 161667 - RNA, 48 nt, Homo sapiens
uggcgugcggcuuucgccgcgcuauugcuugccagguauggaucccgg

SEQ ID NO: 161668 - RNA, 69 nt, Homo sapiens
cuuucuguggauucuuuauuggaaaaagacaaugaccauucaagaccagauauucaaguucaagccaag

SEQ ID NO: 161669 - RNA, 41 nt, Homo sapiens
uagagaccauuuuaaccaacucuuuaauaauaaaauuuuuc

SEQ ID NO: 161670 - RNA, 46 nt, Homo sapiens
auugaagauggcucaaaauauggauuaaaaagugaacuuuucucug

SEQ ID NO: 161671 - RNA, 38 nt, Homo sapiens
uaaauuuauaugagccuccugccaauucaggaaaugga

SEQ ID NO: 161672 - RNA, 45 nt, Homo sapiens
gcagggacuuuauagauugggaaagucuacaacuagggaagcugg

SEQ ID NO: 161673 - RNA, 48 nt, Homo sapiens
aagcugacauaaauaacucccaaaacugcacuauggaaccuugucauc

SEQ ID NO: 161674 - RNA, 46 nt, Homo sapiens
gcagaauagauguugagugugaaaccagcaucagcaguaugggaaa

SEQ ID NO: 161675 - RNA, 48 nt, Homo sapiens
aaauugacuagaauagcaguuacucuaacauguccucaaauccuauua

SEQ ID NO: 161676 - RNA, 48 nt, Homo sapiens
uccauaacacaugaaaacacaaugaugaauguuuuaguaaaaaacauu

SEQ ID NO: 161677 - RNA, 46 nt, Homo sapiens
aaagaagcuuuaggacaucaaguaauaagaauaaauuaccuuggcg

SEQ ID NO: 161678 - RNA, 62 nt, Homo sapiens
ggcgaugugcaagcacuuucacuguggcaaaaauuucgggacuugagcauugaagaguacau

SEQ ID NO: 161679 - RNA, 43 nt, Homo sapiens
uuugggcugaaagaacugcaaaauaauccugaagcagugucag

SEQ ID NO: 161680 - RNA, 42 nt, Homo sapiens
uuuuagcgucugggaguauauuuugaugaauauucaggagaa

SEQ ID NO: 161681 - RNA, 48 nt, Homo sapiens
ucaauuuguacuguaaugcgaagugaugggacuucucucuaugcaacc

SEQ ID NO: 161682 - RNA, 70 nt, Homo sapiens
guuucagagaucuugcagcugcuauagaucgaauggacaaguauaauuuugauacaaugauauauguggu

SEQ ID NO: 161683 - RNA, 47 nt, Homo sapiens
cauuuucagcaaguauuccaaaugcugaagaucaugggauaugacug

SEQ ID NO: 161684 - RNA, 42 nt, Homo sapiens
ugcccuuuggaguaguacagggaaugaagacucgaagaggag

SEQ ID NO: 161685 - RNA, 36 nt, Homo sapiens
agagacugcagagagggucgggcucgcagcacucau

SEQ ID NO: 161686 - RNA, 55 nt, Homo sapiens
ucauucauucagugauacaagguacugucacuguagacuggagaaugggaacuga

SEQ ID NO: 161687 - RNA, 65 nt, Homo sapiens
gagaugguguuagggcaaccagcccagccuugagcgaucagagagggcuucucagaggaaaggag

SEQ ID NO: 161688 - RNA, 48 nt, Homo sapiens
gaggaguauagauuuuuucaccaaggaaguuacuggcaugguuugaga

SEQ ID NO: 161689 - RNA, 40 nt, Homo sapiens
ggauucggguucucagcuauaccgugugggcccauuugaa

SEQ ID NO: 161690 - RNA, 52 nt, Homo sapiens
aaucuacugaaauuguucuuuugaagguuaccagugacucugguugccaaau

SEQ ID NO: 161691 - RNA, 36 nt, Homo sapiens
uuugagauuccaguuauaaaaauugaaaguuuugug

SEQ ID NO: 161692 - RNA, 45 nt, Homo sapiens
ugcuuggagaugcuuuuaaggaaugcuuugugaguagaccacauc

SEQ ID NO: 161693 - RNA, 46 nt, Homo sapiens
aaaauucaucagagauagucaagaaaaaccaaaaccuguaccugau

SEQ ID NO: 161694 - RNA, 47 nt, Homo sapiens
auguacaaagaaaaaaugaugaaugacucuauuuuacgccuucagac

SEQ ID NO: 161695 - RNA, 41 nt, Homo sapiens
gugggcaaugucaucaaaaugauccaaaccagagguaagag

SEQ ID NO: 161696 - RNA, 42 nt, Homo sapiens
cucugcuucaucuuacaagaagaguaccacuuaaacccagag

SEQ ID NO: 161697 - RNA, 45 nt, Homo sapiens
agaaaacuuaucucaaauucaaaauagggaauuuggaacacagaa

SEQ ID NO: 161698 - RNA, 49 nt, Homo sapiens
gaugcgucagugauagcaacagucaaacacaaucuggaggaacuggagc

SEQ ID NO: 161699 - RNA, 73 nt, Homo sapiens
caacacccguacaauaugaucauguuuaauuaucuagaucagaaacuuggaggaucuucaggcccacugcccc

SEQ ID NO: 161700 - RNA, 42 nt, Homo sapiens
gaggauaagauggaaacuucugacauacagauuuucuaccaa

SEQ ID NO: 161701 - RNA, 46 nt, Homo sapiens
uagauuacuuuuaaaacguuuacaaccagaauuuaaaaccagaauu

SEQ ID NO: 161702 - RNA, 83 nt, Homo sapiens
cugcacacggaggcgcggaggcccgggggaccugcacacggaggcgcggaggcccgggggaccugcacacggaggcgcggagg

SEQ ID NO: 161703 - RNA, 63 nt, Homo sapiens
acacacagacgcggaggcccgggggaccugcacacggaggcgcggaggcccgggggaccugca

SEQ ID NO: 161704 - RNA, 37 nt, Homo sapiens
aggcugagaggcugagacgugcauggacguuggcaaa

SEQ ID NO: 161705 - RNA, 39 nt, Homo sapiens
ugcacagaaugcaagugugcaagcauggcauaugggagg

SEQ ID NO: 161706 - RNA, 61 nt, Homo sapiens
ggcaagugugcaaguguaagugugcacagagcagguuuguaagcauaagggugcacacaga

SEQ ID NO: 161707 - RNA, 77 nt, Homo sapiens
gcauaaggugcacagagagcaacugugcaagcaaaagggugcacagcggcagggguacaaguauaagggugcucaga

SEQ ID NO: 161708 - RNA, 70 nt, Homo sapiens
cagacaccaucgaagcauagaugaugcagccccaggagauuaaaacgauggcaagcagcaacuaaaccaa

SEQ ID NO: 161709 - RNA, 62 nt, Homo sapiens
gaaaauuuguaacucuucuggauuuaauuaucugaaaauacaguucuuucccucaugcuuau

SEQ ID NO: 161710 - RNA, 49 nt, Homo sapiens
cauguaacuaaauacuuuuccauaccguuuuccaagucaagaaugacca

SEQ ID NO: 161711 - RNA, 32 nt, Homo sapiens
uuuaaacuucuggguacuuuaagggaaguugc

SEQ ID NO: 161712 - RNA, 87 nt, Homo sapiens
gaguuugaggaagaggcaaagaacccuggccuggaaacacacaggaagagaaagagaucaggcaacagugauucuauagaaagggau

SEQ ID NO: 161713 - RNA, 46 nt, Homo sapiens
gauuguuuauuccauagguaggagucaaucccaccagcauugacuc

SEQ ID NO: 161714 - RNA, 86 nt, Homo sapiens
accagcgaaucagacuuccacauuuggaagcaguugugauugggcguggcccagagaccaagaucacugauaagaaauguucucga

SEQ ID NO: 161715 - RNA, 46 nt, Homo sapiens
gauacagccggccucugacgucaucccgcagcgccggaagcgguga

SEQ ID NO: 161716 - RNA, 66 nt, Homo sapiens
gaaaaugguaccacgggggcuuaaugggaauugggguccgcuucuuuauccagggacacagcaggu

SEQ ID NO: 161717 - RNA, 44 nt, Homo sapiens
aaucuucuggagcccuuuucuccacucagcgagccugagagugc

SEQ ID NO: 161718 - RNA, 39 nt, Homo sapiens
cuuucucccucccacccuggacccaaguggcggugggga

SEQ ID NO: 161719 - RNA, 49 nt, Homo sapiens
ccauggaauguuaucuucuggccaucuuucaugccuaaaaacaaaacau

SEQ ID NO: 161720 - RNA, 34 nt, Homo sapiens
uuuguucuaaaauguacauaaaugcucaucuagu

SEQ ID NO: 161721 - RNA, 33 nt, Homo sapiens
aaguuaggguccuuuauugggggaugucagcag

SEQ ID NO: 161722 - RNA, 60 nt, Homo sapiens
ucaaacuccuaagacuuguuuucaugucccacguucucugcugacaucccccaauaaagg

SEQ ID NO: 161723 - RNA, 49 nt, Homo sapiens
ucaccauaccccugggcacccccugacaacuucugcacauacuggggcc

SEQ ID NO: 161724 - RNA, 64 nt, Homo sapiens
ggagagguaguccccaagggcaccccagcggggccgguagaucuggaagauggugauccaggag

SEQ ID NO: 161725 - RNA, 71 nt, Homo sapiens
ucagcugugggcuuccucuucugggugauagugcucaccuccuggaucaccaucuuccagaucuaccggcc

SEQ ID NO: 161726 - RNA, 41 nt, Homo sapiens
cuguggcuuuguguugguaggugagcuuggggugagagcag

SEQ ID NO: 161727 - RNA, 69 nt, Homo sapiens
gagggacuaagccauguggauaucugggagaagauuccaggcagagggaacagcucaggugcaaaggac

SEQ ID NO: 161728 - RNA, 54 nt, Homo sapiens
cguaguucguuaaacugaccuaugccccaggaaacagauucugagcuauacaug

SEQ ID NO: 161729 - RNA, 36 nt, Homo sapiens
aacagccagaauuacaggaagcagagaggcuaccag

SEQ ID NO: 161730 - RNA, 41 nt, Homo sapiens
gugagcaguggcaacugccuugugucucucucaaggcggag

SEQ ID NO: 161731 - RNA, 46 nt, Homo sapiens
cucccugaacagcagacacggucagugggagacccucuagccccca

SEQ ID NO: 161732 - RNA, 45 nt, Homo sapiens
gucugccucuggacccagcucaaggacgcuggucagucccucagg

SEQ ID NO: 161733 - RNA, 42 nt, Homo sapiens
ccagagucuuugugcuuugguggaucuuggcugaugucccac

SEQ ID NO: 161734 - RNA, 45 nt, Homo sapiens
acugcaggacauggucaaaagcccggaucauggguuugggaguca

SEQ ID NO: 161735 - RNA, 46 nt, Homo sapiens
caucagcacagagguugagauggccugaggaauccaggaagacaac

SEQ ID NO: 161736 - RNA, 42 nt, Homo sapiens
gggaucugagcugagacauaaacugaucccguugacugucag

SEQ ID NO: 161737 - RNA, 43 nt, Homo sapiens
caggcagagcgcacauuguucuugguuggcagcaagcggcacg

SEQ ID NO: 161738 - RNA, 42 nt, Homo sapiens
aagguagcugcccacaacaguaaccugggcugggggcaggaa

SEQ ID NO: 161739 - RNA, 46 nt, Homo sapiens
ggaccuucacuccauccuuuucugcuucggccuuaguggcugaaac

SEQ ID NO: 161740 - RNA, 47 nt, Homo sapiens
aagaaucaauauagugauggaaggguaaagaaugcaagaauucagac

SEQ ID NO: 161741 - RNA, 42 nt, Homo sapiens
uuuucucuugcccaauccccaccuaauaaaguucugagagca

SEQ ID NO: 161742 - RNA, 48 nt, Homo sapiens
aaauaaucugaguuauucagccagucagcuccccuuuaaaaaucuaag

SEQ ID NO: 161743 - RNA, 40 nt, Homo sapiens
ucucugcacaugcagcccucuccucgagcacgucacacac

SEQ ID NO: 161744 - RNA, 21 nt, Homo sapiens
gaccugacuagcagcccucuc

SEQ ID NO: 161745 - RNA, 48 nt, Homo sapiens
cucccucugcccucccgucugugagcucccugcccagcaccaccuccu

SEQ ID NO: 161746 - RNA, 46 nt, Homo sapiens
ccugcagucugacaagcucaucacugaauucugcuaguccaguagc

SEQ ID NO: 161747 - RNA, 53 nt, Homo sapiens
auugccaaauauuucauuguguugauaauaccacauuuuauucauucauuagu

SEQ ID NO: 161748 - RNA, 92 nt, Homo sapiens
acuugcauuuauuuguuuuuguuguuguucuugauaguuucauuauuguugguaguaauuguggugguaguacaugccuugaaaaguauggu

SEQ ID NO: 161749 - RNA, 42 nt, Homo sapiens
caccaccccaaguacacagcagaauaguacaagucacccuac

SEQ ID NO: 161750 - RNA, 48 nt, Homo sapiens
cauacuugugaaaauacuugauauguuuuaaagccuugggcagaaauu

SEQ ID NO: 161751 - RNA, 47 nt, Homo sapiens
ugaggaaggauagcugcauuuauuuagucaguuuucauugcauagua

SEQ ID NO: 161752 - RNA, 47 nt, Homo sapiens
auaauuauguaaugcccuugcugaaaucuauguguguccacugaauu

SEQ ID NO: 161753 - RNA, 51 nt, Homo sapiens
ucagaaacuguuagugaaggcugugaagauaggcuuauggaaguauaagcu

SEQ ID NO: 161754 - RNA, 50 nt, Homo sapiens
cuuuggccaagcccuugucuucacaaauucgcaacacaacaaucagaugg

SEQ ID NO: 161755 - RNA, 47 nt, Homo sapiens
gaucugguagccuugcuccagaagccuguuccucacagucaagccuc

SEQ ID NO: 161756 - RNA, 45 nt, Homo sapiens
agcuaguaguuugggaagcugcucagaauggugcagaugagggaa

SEQ ID NO: 161757 - RNA, 46 nt, Homo sapiens
aguggacaaaccuucagaucguggcaagcgagcccgggguagaggu

SEQ ID NO: 161758 - RNA, 60 nt, Homo sapiens
guuuuauauucuccauuuauagacacucaugguauagacaaggguuagauuaagaggaaa

SEQ ID NO: 161759 - RNA, 58 nt, Homo sapiens
agucguggacguggaaacaacaaccggaaaggaagaggcggcaaucguggcagagaau

SEQ ID NO: 161760 - RNA, 61 nt, Homo sapiens
uuuugcaaaagaaaauucagaaaacaaagagaauagagagaagaaaagcgagaaagaaucg

SEQ ID NO: 161761 - RNA, 48 nt, Homo sapiens
gugaacaaagcuaucaauauauugcuggaagggaauucagacacagua

SEQ ID NO: 161762 - RNA, 46 nt, Homo sapiens
acagaugcgucucgcucaagugaucuuugauaagaaugauucagau

SEQ ID NO: 161763 - RNA, 44 nt, Homo sapiens
gggaaaaaccacagauuucagcagcacaaucaacgcaaccacag

SEQ ID NO: 161764 - RNA, 27 nt, Homo sapiens
cuuuagguaacagacauuuuuaagaaa

SEQ ID NO: 161765 - RNA, 65 nt, Homo sapiens
ugcuuggaagguaauuuuucugagccuuuguuuuugagaguaauccggauguagagaacaguuga

SEQ ID NO: 161766 - RNA, 129 nt, Homo sapiens
ugauggaaaccagaauacagaagguuaaggagauguuuagugaggaaauggaggcagugaauguauucauuuugugaaauacaguuuauguaguuguugcuuacaagauagaacaugaaguuucaggag

SEQ ID NO: 161767 - RNA, 58 nt, Homo sapiens
cguaugaaauguuuugaaugacagagacagaugaaagaaugagaacagaagaaagauu

SEQ ID NO: 161768 - RNA, 47 nt, Homo sapiens
ccuguggagccccuucgcuaggguuguccuuccauugcuuugaaggc

SEQ ID NO: 161769 - RNA, 196 nt, Homo sapiens
ccuaacaguugagagauuuuaaaaaauuacuauuaauuuuagagauauggucuccauauguugcccaggcuggccuccagcuccuggguuuaagcgauucuuucaccucagccuccugaguaucugggauuacagugugcaccacggugcucagcuaguugaggguuuuuucaggucuccauaagguauccaaaga

SEQ ID NO: 161770 - RNA, 28 nt, Homo sapiens
cugccuggcagaaaaggcaaacucuggg

SEQ ID NO: 161771 - RNA, 40 nt, Homo sapiens
ugccuuucccuugugccuagagaauaugauuaacuaaccc

SEQ ID NO: 161772 - RNA, 45 nt, Homo sapiens
cucucccaagacugcagggacacuccgucagcccacccuggagca

SEQ ID NO: 161773 - RNA, 45 nt, Homo sapiens
aggaugccucccaaagugagguuucuggggagaaugagggcaacu

SEQ ID NO: 161774 - RNA, 45 nt, Homo sapiens
cucuacuuccucagggccuucucccagagacagccuggcagagaa

SEQ ID NO: 161775 - RNA, 44 nt, Homo sapiens
uaacuaaaagcuggguggacuccagggaccccauaaaccacaga

SEQ ID NO: 161776 - RNA, 46 nt, Homo sapiens
gugaaagagcagcagaugcaagggacucagauagacagacaaagau

SEQ ID NO: 161777 - RNA, 46 nt, Homo sapiens
aacugugacuauguucaauaugauauaaauuaaaauggugagagau

SEQ ID NO: 161778 - RNA, 55 nt, Homo sapiens
cauacuuaucauuaaguuuaaacauuacagaaauauguaagaagauaguaaaggc

SEQ ID NO: 161779 - RNA, 46 nt, Homo sapiens
uauagccaucguaauagcccuauccaaucacugucuaccuaagacu

SEQ ID NO: 161780 - RNA, 49 nt, Homo sapiens
auuucacaucuaacauauaaggguuuaaauaaaacacuaauaacucagc

SEQ ID NO: 161781 - RNA, 47 nt, Homo sapiens
gagauggagaaaaucagaguuuguguucgaaaacgcccccugggcau

SEQ ID NO: 161782 - RNA, 42 nt, Homo sapiens
auuaaaaauuaaaagccuguuuauaaacauauuagacagaac

SEQ ID NO: 161783 - RNA, 46 nt, Homo sapiens
guuucaggguauaacuauggaaucccucauucuuguaucagguaau

SEQ ID NO: 161784 - RNA, 58 nt, Homo sapiens
guccacuuaccuaaaagugcuagaacacaugcuaccagaugauucccaguaccauaca

SEQ ID NO: 161785 - RNA, 25 nt, Homo sapiens
gacaauaaagacagaaaugccagca

SEQ ID NO: 161786 - RNA, 49 nt, Homo sapiens
ggaagcccguucgcuucccuuuucccauaaaauuuugaagccuuugagg

SEQ ID NO: 161787 - RNA, 30 nt, Homo sapiens
caugucaaagucaucaucgcuggccaugga

SEQ ID NO: 161788 - RNA, 47 nt, Homo sapiens
cccauguuaggguaguuaguguguacuugaugccagggaaaggcugg

SEQ ID NO: 161789 - RNA, 44 nt, Homo sapiens
agugugugcaaaaaugcauuuaaaagugagcauaaguguggcuc

SEQ ID NO: 161790 - RNA, 40 nt, Homo sapiens
uuauauacagcagccaugagacagugaaacuuuggucccu

SEQ ID NO: 161791 - RNA, 86 nt, Homo sapiens
gaucugcaugguguaugucccugucuguaaacaugggcuccagcaaguggauaugugcgggccugcccgcuccugucuauccgcag

SEQ ID NO: 161792 - RNA, 44 nt, Homo sapiens
gugagcucaagccggaggccccgagcauaggagcgaagaguaua

SEQ ID NO: 161793 - RNA, 46 nt, Homo sapiens
acuuuugguggugcccucucuccacugguggaaggugccagagaug

SEQ ID NO: 161794 - RNA, 46 nt, Homo sapiens
gccgcagcuccacgaucagacgagagaaggccagcucgugguccag

SEQ ID NO: 161795 - RNA, 52 nt, Homo sapiens
gagccccagggugggcauuccagaggcggugacaccugagcagugucuuuaa

SEQ ID NO: 161796 - RNA, 44 nt, Homo sapiens; identical to SEQ ID NO: 78660

SEQ ID NO: 161797 - RNA, 44 nt, Homo sapiens
aaaggugccaugaugggcuguucuaacccccacccccacugcca

SEQ ID NO: 161798 - RNA, 61 nt, Homo sapiens
cucaauacccccgaggaauagaaagaagaccaauguagcuggaguuuucagugggugaggg

SEQ ID NO: 161799 - RNA, 46 nt, Homo sapiens
cugaggugaacccacugggugccagcacacgccugcuggaugugag

SEQ ID NO: 161800 - RNA, 38 nt, Homo sapiens
cugggcuccucuacucaucuucagaguguuaagcuuag

SEQ ID NO: 161801 - RNA, 78 nt, Homo sapiens
guucugcucaaggaacguguguaauguguacaucuguguccaugugugaccaugugucugugaggcagggaacaugua

SEQ ID NO: 161802 - RNA, 99 nt, Homo sapiens
uucucugcaugcauguauguaggugccuggggaguguguguggguccuuggcucuuggccuuuccccuugcagggguugugcaggugugaauaaagaga

SEQ ID NO: 161803 - RNA, 145 nt, Homo sapiens
ggcugaggaggguucuuggcugaggccagccccauucagagaagcugggggaaggcccuuuaugguaauauuaaggguguuuuggagaugcugagguggggcagcuuuccccaggaugaugagacagggaggaaaggugggguag

SEQ ID NO: 161804 - RNA, 48 nt, Homo sapiens
ggugaggaggccggucaucuccggggccuggggcauuuagggggccag

SEQ ID NO: 161805 - RNA, 41 nt, Homo sapiens
ggcagagcggagcucggccgggacaaaaggcgcggcgagga

SEQ ID NO: 161806 - RNA, 39 nt, Homo sapiens
cacugacacgcugccauacagccgcucacagccagccag

SEQ ID NO: 161807 - RNA, 44 nt, Homo sapiens
ggggguuccuguaugucacagaggggaugaggaugaguuggagg

SEQ ID NO: 161808 - RNA, 36 nt, Homo sapiens
ccauuuccgaaaacgguugcccccccccccaacgag

SEQ ID NO: 161809 - RNA, 59 nt, Homo sapiens
cccaccuagggccuugggcgccucccccuuacccgguuacaggccucacuccuggaagg

SEQ ID NO: 161810 - RNA, 44 nt, Homo sapiens
uauuacaagauucuugggaucccaucgggggccaacgaggauga

SEQ ID NO: 161811 - RNA, 45 nt, Homo sapiens
cgguaggcuuucuugaucucauccucguuggcccccgaugggauc

SEQ ID NO: 161812 - RNA, 42 nt, Homo sapiens
gacaagaauaaagaacccaacgcugaggagaaguuuaaggag

SEQ ID NO: 161813 - RNA, 40 nt, Homo sapiens
agccagaggccuuccccgcccuucuuuccuucccagccuu

SEQ ID NO: 161814 - RNA, 46 nt, Homo sapiens
ccuuaaggggaccuccauggccuggggagggagaagcagcuuagaa

SEQ ID NO: 161815 - RNA, 53 nt, Homo sapiens
cuggagcugcacacagagucuguguguauaacugcucuauaauaaauggcugc

SEQ ID NO: 161816 - RNA, 45 nt, Homo sapiens
gauuccuggaggcagccuucaugcacaggagggggugcuggcagu

SEQ ID NO: 161817 - RNA, 46 nt, Homo sapiens; identical to SEQ ID NO: 78682

SEQ ID NO: 161818 - RNA, 46 nt, Homo sapiens
guucaaaguucgcuucccagacagauuaacaccacagacaagacag

SEQ ID NO: 161819 - RNA, 44 nt, Homo sapiens
uccugggguggggucuuuagguuuucucacuuugacaacccccg

SEQ ID NO: 161820 - RNA, 271 nt, Homo sapiens
aguggaauaaaauaggccgggcguggugacuugcaccuauaaucccagcacuuugggaggcagaggugggaggauugcuuggucccaggaguucaagaccagccuguggaacauaacaagaccccgucucuacuauuuaaaaaaaaguguaauaaaaugauaauauaauuaugugugucugagaugugggggagccccacuguucuauagggguugugaggaggaucagucucuccugccaccaggcacagaugagaucagucaucuuagg

SEQ ID NO: 161821 - RNA, 47 nt, Homo sapiens
cucucuugaggcaguagguugcccacugcuccugcucuggccuuucc

SEQ ID NO: 161822 - RNA, 42 nt, Homo sapiens
uccucucccuggcugaguccucuggcauccaugguggguggu

SEQ ID NO: 161823 - RNA, 81 nt, Homo sapiens
uggggguccaagaggccccuggcaacccuguuucccaucccugggcccguccuguuacuccugcuguuucgcuuggcugug

SEQ ID NO: 161824 - RNA, 67 nt, Homo sapiens
cugaaaacccuuuaaguaugccagugcaggguaguaguuucucaugaaaguacuucuuucccacgaa

SEQ ID NO: 161825 - RNA, 42 nt, Homo sapiens
gagagcucuaaccugagccaccaugcuggugacaucgccagg

SEQ ID NO: 161826 - RNA, 41 nt, Homo sapiens
ggcaggggagauucccaagaauggggccugugagaugcaua

SEQ ID NO: 161827 - RNA, 41 nt, Homo sapiens
ccuucacuuccccuacccucugaccuaucucugaaagccaa

SEQ ID NO: 161828 - RNA, 46 nt, Homo sapiens
acuacacccugcccuacuucggguacuccaugugccuguccccucc

SEQ ID NO: 161829 - RNA, 46 nt, Homo sapiens
cucuuuuuggugccugugggugaggagggaaaugcuaaccccaccc

SEQ ID NO: 161830 - RNA, 43 nt, Homo sapiens
aggcauggaucagacugcaagcuaggggcacgaggcaucaguu

SEQ ID NO: 161831 - RNA, 44 nt, Homo sapiens
agcuuguguggauguauguagggacaaaauagagagcagcuggc

SEQ ID NO: 161832 - RNA, 45 nt, Homo sapiens
cucucuccccucugaagauagagggcucuaggcugggggccgagg

SEQ ID NO: 161833 - RNA, 44 nt, Homo sapiens
gaagggcccggagcagcggccaccuccgcggagccaauuuggga

SEQ ID NO: 161834 - RNA, 48 nt, Homo sapiens
uggaggagguacaugaggggcaggggacauggaggugcuuugaaggaa

SEQ ID NO: 161835 - RNA, 43 nt, Homo sapiens
uguucacucagggaaggaggggagacuguacuccccacagaag

SEQ ID NO: 161836 - RNA, 38 nt, Homo sapiens
ucccuagcuccacacccucucugacacccuguggggac

SEQ ID NO: 161837 - RNA, 46 nt, Homo sapiens
gugacauccuagcccugguuuuuggccuccuuuuugcugucaccag

SEQ ID NO: 161838 - RNA, 27 nt, Homo sapiens
aucgcagcacaggaagaaaugcuucgg

SEQ ID NO: 161839 - RNA, 40 nt, Homo sapiens
gacuuuacaucucuuucugcaaccuucgcuuauugcagga

SEQ ID NO: 161840 - RNA, 47 nt, Homo sapiens
gcugcagccaaaaagcuagagcagcugaagccccgggccaaacccaa

SEQ ID NO: 161841 - RNA, 42 nt, Homo sapiens
cccugaguucuccagcauuccugcccagaucagcccugaggu

SEQ ID NO: 161842 - RNA, 43 nt, Homo sapiens
cuucccuggagcauuuaaagaauauaccaaaguacgcacaaaa

SEQ ID NO: 161843 - RNA, 42 nt, Homo sapiens
gccaagagcaacugguggaggcuggacgacugguagccaaag

SEQ ID NO: 161844 - RNA, 42 nt, Homo sapiens
uguggcaagugcugcagcugcccugguccucaaggccaagag

SEQ ID NO: 161845 - RNA, 45 nt, Homo sapiens
ugagaauuuccaggugggcagcaugcccccugcccagcagcagau

SEQ ID NO: 161846 - RNA, 41 nt, Homo sapiens
cuacagaaaaaaagcaaggaucacuuugggcuggaaggaga

SEQ ID NO: 161847 - RNA, 52 nt, Homo sapiens
agauggcuauuacucaguacagacaacugaaggggagcagauugcacagcuc

SEQ ID NO: 161848 - RNA, 28 nt, Homo sapiens
aguauacugaguauuacuccagaaaaaa

SEQ ID NO: 161849 - RNA, 62 nt, Homo sapiens
ggaagaacaagcuagugcccaggcuucugggcaucaccaaggagugugugaugcgaguggau

SEQ ID NO: 161850 - RNA, 42 nt, Homo sapiens
ugaacuggcuggaccauggucggacacugagggagcagggug

SEQ ID NO: 161851 - RNA, 48 nt, Homo sapiens
uaacagggaccuuaagaaaggacaagacauugcugcgagaugaaaaga

SEQ ID NO: 161852 - RNA, 46 nt, Homo sapiens
aacagagaccccugaagauccguaugcuggauggaacugugaagac

SEQ ID NO: 161853 - RNA, 30 nt, Homo sapiens
gcaguuugagccgucuaccaugguguacga

SEQ ID NO: 161854 - RNA, 63 nt, Homo sapiens
ccccauagccaggucuguccagcugggacacaagcggauaguaauaagguugggcaaagugcc

SEQ ID NO: 161855 - RNA, 40 nt, Homo sapiens
acaucuuugagucuguuuucugaucuguaaaaauggaaau

SEQ ID NO: 161856 - RNA, 65 nt, Homo sapiens
cccgagggcgacccgagaagcggcggggcggcgggccggcgggcggggcgcagagccaggcagcg

SEQ ID NO: 161857 - RNA, 62 nt, Homo sapiens
gugggggacguucccaggacggaaguggccgagagagugucgaagggagggcgaggccggag

SEQ ID NO: 161858 - RNA, 43 nt, Homo sapiens
ggcggggguuccggggcuccggcuccgccuucuaccccaagcu

SEQ ID NO: 161859 - RNA, 42 nt, Homo sapiens
gcugugaugguccagauggcugcucuguguggggcacaggac

SEQ ID NO: 161860 - RNA, 64 nt, Homo sapiens
aaguccaccccaaggucagcuucccucccucaacuuuugcacccucuacccuauccaccaaugc

SEQ ID NO: 161861 - RNA, 42 nt, Homo sapiens
ucacacacauagcugugugccccuccucaggcaugcccauuc

SEQ ID NO: 161862 - RNA, 52 nt, Homo sapiens
caccaaaugcuagaauagaaggggaggggggcacacauaaugacucacugcu

SEQ ID NO: 161863 - RNA, 45 nt, Homo sapiens
aaaaaaugucccuacccucagaagaauccauacagcagucaggga

SEQ ID NO: 161864 - RNA, 50 nt, Homo sapiens
cuuggcuccagcauucagccucaucuucaaaggaaaaaugacuagcaaau

SEQ ID NO: 161865 - RNA, 49 nt, Homo sapiens
uugguuagaaguggugugacugaacaguaggcauaauguggcaguaggc

SEQ ID NO: 161866 - RNA, 39 nt, Homo sapiens
auaaagaguagcagacugugcguaaaaaggggaacgggg

SEQ ID NO: 161867 - RNA, 46 nt, Homo sapiens
uauccaguauguagacuccaggcuuauaguguccuauucuccccag

SEQ ID NO: 161868 - RNA, 46 nt, Homo sapiens
gccgagggaaaguugggacguuuggcaucuucaaaucuguguacag

SEQ ID NO: 161869 - RNA, 42 nt, Homo sapiens
gacucacgcccggcaccaggaauccugccuacauacaacuag

SEQ ID NO: 161870 - RNA, 47 nt, Homo sapiens
gaacagaagagcaauacaagaugggccaaaccugaagggaccaacac

SEQ ID NO: 161871 - RNA, 63 nt, Homo sapiens
cccauccucccugugcccucucugcugcuccuccauuccuaacgcuucaccccacuuuaccuu

SEQ ID NO: 161872 - RNA, 50 nt, Homo sapiens
gacaggagcccaggggagaaagacagaaacuaagacucaaggagcaacgc

SEQ ID NO: 161873 - RNA, 47 nt, Homo sapiens
guaggcauauaggggcuucuggaaagcuagaggcugggcugagccag

SEQ ID NO: 161874 - RNA, 40 nt, Homo sapiens
gccgggcggcgcuccagccucggggcaggugcgcggagag

SEQ ID NO: 161875 - RNA, 81 nt, Homo sapiens
ucgcuacgggcgcgaaacggacacugaacacagucugacuguauggaggcagguggggagggauccccugggagaacuugg

SEQ ID NO: 161876 - RNA, 30 nt, Homo sapiens
ucccccuacuccuaaaaccuacccuucacc

SEQ ID NO: 161877 - RNA, 30 nt, Homo sapiens
agggugaaggguagguuuuaggaguagggg

SEQ ID NO: 161878 - RNA, 47 nt, Homo sapiens
cucauacugagaaaucugugcugucugugccuuugagcccagggaag

SEQ ID NO: 161879 - RNA, 82 nt, Homo sapiens
uggcugccuccaaaauccuaaaacacugacuuuccuaagugccaguaguaggcuauauugugggggagaaaaguucaggaag

SEQ ID NO: 161880 - RNA, 63 nt, Homo sapiens
agaucugauccuagcccuugggugggcuuccacccuuuauggagaggugaggcaucguucugg

SEQ ID NO: 161881 - RNA, 29 nt, Homo sapiens
gaccaagaagauacugacccgacaagaau

SEQ ID NO: 161882 - RNA, 46 nt, Homo sapiens
cagauuagaagggggugaggugauauagcuugaacuagugugauga

SEQ ID NO: 161883 - RNA, 55 nt, Homo sapiens
gacagagaaauaaagagggaaucuuugcugcaacacaagagaagggaacuaggca

SEQ ID NO: 161884 - RNA, 50 nt, Homo sapiens
uacaggaaggaggcacccgggaggauggacuucgaauuguggaaaagaug

SEQ ID NO: 161885 - RNA, 46 nt, Homo sapiens
cugguggaggaacgcacacaggccuaucuggaggaaaaacgcaagg

SEQ ID NO: 161886 - RNA, 85 nt, Homo sapiens
ugggugggcaauggccaccaugucugcacacaccagaaauggacauuuucauaugcaauggaaaacagccacaaaaaaaccuacc

SEQ ID NO: 161887 - RNA, 46 nt, Homo sapiens
acuccuuguggccaagcagacagcaaaggcugagggccugggagau

SEQ ID NO: 161888 - RNA, 57 nt, Homo sapiens
gucaaacagggcgauugcauuaaaacuuaaauaaaacaggcgacaaggcuuaaagau

SEQ ID NO: 161889 - RNA, 42 nt, Homo sapiens
ggcggccgagggcacccucaggaugguggccaggaugagcaa

SEQ ID NO: 161890 - RNA, 45 nt, Homo sapiens
aggggauccucaggaugguggcaaugaugaagacauaggagaaag

SEQ ID NO: 161891 - RNA, 43 nt, Homo sapiens
ucuucgugcugaaaccauacuauuucuagauauuuaggcaguu

SEQ ID NO: 161892 - RNA, 40 nt, Homo sapiens
auauugaccuguacuacauuguuccuagaaccccauagag

SEQ ID NO: 161893 - RNA, 46 nt, Homo sapiens
ugaggaaacugagguucagaaagccuaaguggcaugccucuucagu

SEQ ID NO: 161894 - RNA, 27 nt, Homo sapiens
ggaggggcggucccccuaaaacaacuc

SEQ ID NO: 161895 - RNA, 42 nt, Homo sapiens
ccucucccagucggcaccacagcgguggcugccgggcguggu

SEQ ID NO: 161896 - RNA, 42 nt, Homo sapiens
cgaagaagacccggcugcggccuucuuggcgcagcaagagag

SEQ ID NO: 161897 - RNA, 49 nt, Homo sapiens
accggacuaaaggcacagcaaaugcuuaaugaaaaguugcugaauugaa

SEQ ID NO: 161898 - RNA, 54 nt, Homo sapiens
augcaguucagcauuuaagcacuuaagguguacagaguguuggauuacgaggag

SEQ ID NO: 161899 - RNA, 46 nt, Homo sapiens
ugagcgauugauuuacagcuaggacuucuggagcucuuccucuggg

SEQ ID NO: 161900 - RNA, 49 nt, Homo sapiens
guggaaaagaccuacuuaauaauacaaagaaguaggaaauuuagcuaga

SEQ ID NO: 161901 - RNA, 24 nt, Homo sapiens
ucaucucacaaucacagccuaguu

SEQ ID NO: 161902 - RNA, 49 nt, Homo sapiens
aacuaaacacugcaacagaaugugguauauucuaagaguggguagacuu

SEQ ID NO: 161903 - RNA, 71 nt, Homo sapiens
agcagaacccaagaucuguaguuggaagauuguccugauucaaggacaguguuacccuuacuguuuuaucu

SEQ ID NO: 161904 - RNA, 81 nt, Homo sapiens
ugacaaagaaaugggcaaaaaugucagauccaaggguccuauguagaacugacagaucuuggugacgggcaguuagggaag

SEQ ID NO: 161905 - RNA, 103 nt, Homo sapiens
guauauaacuaccaccacugcccggccucaguuuucuccuuuguaaaaguugcauaauauaauuuauaaugcuauguggcaucuuuaggauuacauuaaagag

SEQ ID NO: 161906 - RNA, 37 nt, Homo sapiens
uauauuaaguaucuagugaauuccagcuacuauuagu

SEQ ID NO: 161907 - RNA, 34 nt, Homo sapiens
ggccuuuaggcuuugaaguguacugaguaaauug

SEQ ID NO: 161908 - RNA, 65 nt, Homo sapiens
auaaacuggccccagccuugcggaaagcgucuauggaggaugggcacaggcaaaaaccagagggg

SEQ ID NO: 161909 - RNA, 55 nt, Homo sapiens
ggaggcagcacaaguggagcuguugaaaagcucucaaucaugagggcugagucgg

SEQ ID NO: 161910 - RNA, 62 nt, Homo sapiens
uaggagaagaaagagacaugggugaauuaaagggaagcuuucuggagaaguaauuuuauugg

SEQ ID NO: 161911 - RNA, 35 nt, Homo sapiens
aaaauauuugacuauuagagagcaaauacuuagag

SEQ ID NO: 161912 - RNA, 61 nt, Homo sapiens
acaguuaugcagcuauuucacaaguggaucgauugcagucagagccugaaaguauccguaa

SEQ ID NO: 161913 - RNA, 135 nt, Homo sapiens
gcuuagaggcaagauuuagcuggucuuaguacugcuguaguauuuuucauguuacagaacccaaauuuaucuuuucuguuuuaccaagcucuagcaguuuuucuucuccauggagagagucuacuuuggugucug

SEQ ID NO: 161914 - RNA, 46 nt, Homo sapiens
cggaagcaagaagcagaguggaaagaaaaggcaauaaaggagcuag

SEQ ID NO: 161915 - RNA, 58 nt, Homo sapiens
ugucaugaauacacccagaucuaguuacuuuggauaugauuauagacuuggucauguu

SEQ ID NO: 161916 - RNA, 45 nt, Homo sapiens
ccagccaggugccuuggggccacucagggcacacuggcaggagag

SEQ ID NO: 161917 - RNA, 40 nt, Homo sapiens
gcagaagaagccuuuguaaaugacauugacgagucguccc

SEQ ID NO: 161918 - RNA, 45 nt, Homo sapiens
aaagaugucucccgcaugcgcucaguccucaucucccucaagcag

SEQ ID NO: 161919 - RNA, 51 nt, Homo sapiens
ugauugcauguuuccuuccuucaacuguguucucccuggcauucagagagg

SEQ ID NO: 161920 - RNA, 31 nt, Homo sapiens
uuaccuuugguauuucuccuuuguuagugga

SEQ ID NO: 161921 - RNA, 49 nt, Homo sapiens
ucuaggcccacauugguauuacucauccaaagacaugauguaauuugag

SEQ ID NO: 161922 - RNA, 46 nt, Homo sapiens
ucauuuuuagaaauggcuagaggugggaugugauauaaggaaguca

SEQ ID NO: 161923 - RNA, 36 nt, Homo sapiens
uuauggcugccacggauuacacacauagacaccauc

SEQ ID NO: 161924 - RNA, 50 nt, Homo sapiens
accugauuugacugagcuaaggggaaaggauuuguucaugccagguugua

SEQ ID NO: 161925 - RNA, 67 nt, Homo sapiens
agaguauuguguuggcugcagaaauccuuuauuauguggggugguuuuucaucuagcuucucuuugc

SEQ ID NO: 161926 - RNA, 65 nt, Homo sapiens
uuaugcagcaccugaguuaauacaaggcaaaucauaucuuggaucagagguaauuauucauugau

SEQ ID NO: 161927 - RNA, 47 nt, Homo sapiens
gaugacauccuuggccugagacuccuugccauaguccuuaacuacua

SEQ ID NO: 161928 - RNA, 22 nt, Homo sapiens
ggcagaggcagggaaagagccu

SEQ ID NO: 161929 - RNA, 47 nt, Homo sapiens
gagucaccaaccccaaugccaggcugcgcagcgaagaaaaugaguag

SEQ ID NO: 161930 - RNA, 48 nt, Homo sapiens
acaauuucaagccacuggaauucccaggauuauuuugcuuaguccaua

SEQ ID NO: 161931 - RNA, 41 nt, Homo sapiens
uuucagaauuuaaaggcauaaugucuuuuuuauuaugauag

SEQ ID NO: 161932 - RNA, 23 nt, Homo sapiens
cuugugcaguuggagggauacug

SEQ ID NO: 161933 - RNA, 24 nt, Homo sapiens
guaugacauuuuuguuuucuacug

SEQ ID NO: 161934 - RNA, 45 nt, Homo sapiens
uaaguaacuugcccauggucaaacaacgaguaaguguagaaccag

SEQ ID NO: 161935 - RNA, 341 nt, Homo sapiens
gggcugccauaaagagagauuuuuuuuuuuuuuuuuuuuuggagauggaguuucacuguuguugcccagccuggagugcaauggcuugaucucagcuccccacaaccuccgccuccuguguucaagcgauucuccugccucagccuccugaguagcugggauuacaggcaugcaccaccacgccuggcuaauuuuguauuuuuaguagagacgggguuucuccauguuggucaggcuggucuccaacucccaaccuaagaugauccacccaccucggccucccaaagugcugggauuacaggcgugagccaccgcaccuggccuaagagaguuauguugga

SEQ ID NO: 161936 - RNA, 48 nt, Homo sapiens
caucguaaaggcuccuugaauugugcuaaacauaaacauaaccugagg

SEQ ID NO: 161937 - RNA, 46 nt, Homo sapiens
agaacuuucuguacaucacagaaacaacaggcaaacaauggaggau

SEQ ID NO: 161938 - RNA, 29 nt, Homo sapiens
caucaagcaaacugaugagagcuccagaa

SEQ ID NO: 161939 - RNA, 50 nt, Homo sapiens
aaauauuaacuuagcuaaacauugugauaaaauuauaguaggaggauaca

SEQ ID NO: 161940 - RNA, 54 nt, Homo sapiens
gagaaagcuauuagauacguauaccucuaugcuuagaaaaaucacuuucacuaa

SEQ ID NO: 161941 - RNA, 39 nt, Homo sapiens
ucucaauugaucugcuuauaugaguuguaaguggaaaag

SEQ ID NO: 161942 - RNA, 49 nt, Homo sapiens
uauuauugaaucaauuuuauggcagaucaagagacauuuuaguaacaag

SEQ ID NO: 161943 - RNA, 51 nt, Homo sapiens
uaccucucugaggcccaucuuacccuucucuucugccaguaaaauacagau

SEQ ID NO: 161944 - RNA, 53 nt, Homo sapiens
uguauuaucuacauacauuaaauuuauguguauauauagauauauacauugau

SEQ ID NO: 161945 - RNA, 42 nt, Homo sapiens
uggaucucaaccaagcacauauggaggagacuccaaaaagaa

SEQ ID NO: 161946 - RNA, 45 nt, Homo sapiens
uguugacugcuuauuuuugagagaucaagccucuuucccaaaaca

SEQ ID NO: 161947 - RNA, 31 nt, Homo sapiens
auauuuugguacauaacaguaugaaacagaa

SEQ ID NO: 161948 - RNA, 46 nt, Homo sapiens
uugauccaaauaaaaccucaaauggcuuccugacuauuaaguagag

SEQ ID NO: 161949 - RNA, 31 nt, Homo sapiens
gaaucugagcauggggaauaaagucaggaag

SEQ ID NO: 161950 - RNA, 45 nt, Homo sapiens
gaugaugucaucagggaggaagagcaugaagaaaagaacucuggg

SEQ ID NO: 161951 - RNA, 46 nt, Homo sapiens
gaagacaguauuuauagauguaaaggaaagaauguuagaguucaag

SEQ ID NO: 161952 - RNA, 46 nt, Homo sapiens
gaagccuaaaucugaagagagaucagguguaauccgagaggucaug

SEQ ID NO: 161953 - RNA, 69 nt, Homo sapiens
uguuguugaauuauuccuaaaaaggaagagagacacuaguaauugcuaaaucaucaaauauuuguagag

SEQ ID NO: 161954 - RNA, 43 nt, Homo sapiens
guaguuaugauuuuaguauucaauugagaaaaugcauauuaga

SEQ ID NO: 161955 - RNA, 56 nt, Homo sapiens
uuucccaggaggcugaaggcucuuaaguuggaaaucauugcacuugagugaaucaa

SEQ ID NO: 161956 - RNA, 47 nt, Homo sapiens
aaacuuuguuuaaaaaauaggauuagugaauuugagauaauucauaa

SEQ ID NO: 161957 - RNA, 42 nt, Homo sapiens
ucaaaucagcaaaacaugauaaaaucuauccagagaaggcaa

SEQ ID NO: 161958 - RNA, 49 nt, Homo sapiens
aauaguaauuuaaaauaguugaugacuaaugcacuuguuacagucuuaa

SEQ ID NO: 161959 - RNA, 46 nt, Homo sapiens
auaaugacuugagcuguguuauucacuguuccauggugaaguuguc

SEQ ID NO: 161960 - RNA, 91 nt, Homo sapiens
agugaaaaucauuuguacuuccccucccucgcuuuugcuuaaauauacaauuaacuuauaaccaccucagugugaaagaauggauguuaag

SEQ ID NO: 161961 - RNA, 53 nt, Homo sapiens
aaagaaaggagauuuucuuuaaagagaagaugugcaaccacaaucaauccugu

SEQ ID NO: 161962 - RNA, 46 nt, Homo sapiens
acuaggagaacacuguagagccgaacuugaaauuuauuaaggaaag

SEQ ID NO: 161963 - RNA, 71 nt, Homo sapiens
guguucagugaaguaauuuuuugauuaugauauuuugauuuuauuaauauguaaacuaaaaauuauaaaag

SEQ ID NO: 161964 - RNA, 54 nt, Homo sapiens
cuugcaaaacuucacaaaauaauuuaauguauuuuaauuuaguaagcuugcuga

SEQ ID NO: 161965 - RNA, 50 nt, Homo sapiens
uaccuagaauaauuuauuauggaauugaauauuaaaaauuugacgauccc

SEQ ID NO: 161966 - RNA, 63 nt, Homo sapiens
gucuaaccagguaauaccuagcaaauacagaaagagagauaaagcaagcaagcuguuuugaaa

SEQ ID NO: 161967 - RNA, 50 nt, Homo sapiens
uuccauaaaauuaaaaauaagaguggggggaaaaaacaaaucccaagaaa

SEQ ID NO: 161968 - RNA, 52 nt, Homo sapiens
ccuauggcuuaauagaagagguaagaggugaguggcauaauagagucauggg

SEQ ID NO: 161969 - RNA, 46 nt, Homo sapiens
cugucuaaacuacauucuaauugguggcagaaaguagguggccuag

SEQ ID NO: 161970 - RNA, 59 nt, Homo sapiens
guuuuuuaacaauaacaaacacuauaaagcucauauuuaaugaguaauaauuaaugucu

SEQ ID NO: 161971 - RNA, 23 nt, Homo sapiens
uccuucaagucuuucucagugag

SEQ ID NO: 161972 - RNA, 50 nt, Homo sapiens
aaugguaguauguaguagaaagagauugaaagaauuucucucccuggagu

SEQ ID NO: 161973 - RNA, 51 nt, Homo sapiens
uuaaauuucuguuuucuuugauuuaagccauuuucaugaauuuucuccaga

SEQ ID NO: 161974 - RNA, 28 nt, Homo sapiens
gucauaauggagauuaugaaguucagaa

SEQ ID NO: 161975 - RNA, 46 nt, Homo sapiens
acucaauaaauauuuauugaauuugaauuaaaaauuaggcacagag

SEQ ID NO: 161976 - RNA, 38 nt, Homo sapiens
cuuugguggaauauuuugaacaugccacuuauuuauag

SEQ ID NO: 161977 - RNA, 55 nt, Homo sapiens
auguugauuaaaaaguuuucuuggcacuuuuagauuaaaaaccauaaaucagcag

SEQ ID NO: 161978 - RNA, 68 nt, Homo sapiens
uggacauucuuagcaacuuguuuucacagcccuuucuuugauguucauuugaaccauagcguuguuga

SEQ ID NO: 161979 - RNA, 47 nt, Homo sapiens
cauuuuauaugguucaaacuaacaguuaauuugcuucaguuuaccag

SEQ ID NO: 161980 - RNA, 44 nt, Homo sapiens
ggaaacucaggauuugaacccaacuccucuugcuccagagucua

SEQ ID NO: 161981 - RNA, 49 nt, Homo sapiens
aucuaguccccucuuggccaucugguaguuuuguaaauucaagcauagc

SEQ ID NO: 161982 - RNA, 47 nt, Homo sapiens
auuuggggcaagagaaacguaagagguuaauccacuucuaaggcuac

SEQ ID NO: 161983 - RNA, 46 nt, Homo sapiens
agaaaaagacaucuacuggaaucuguacggcaguccuucaacaaag

SEQ ID NO: 161984 - RNA, 41 nt, Homo sapiens
aauaaaguuuuuuuuguuuauuuucuucucaucuccuuuag

SEQ ID NO: 161985 - RNA, 45 nt, Homo sapiens
aauccuggagaaucugguaaagggggaacuuaaauaugucgagga

SEQ ID NO: 161986 - RNA, 44 nt, Homo sapiens
uuagagucaccacgauuuaaugacuugauaaaaauguuaaugga

SEQ ID NO: 161987 - RNA, 45 nt, Homo sapiens
ugugugauuuuuuaaaauaauucaacuacugauagcaauagggaa

SEQ ID NO: 161988 - RNA, 61 nt, Homo sapiens
accuuuuuauuuguuuguuucuauuauguaccuugucugcuuccacaaaaggauuugagau

SEQ ID NO: 161989 - RNA, 23 nt, Homo sapiens
auagcuguaauuauauucuauag

SEQ ID NO: 161990 - RNA, 46 nt, Homo sapiens; identical to SEQ ID NO: 78923

SEQ ID NO: 161991 - RNA, 37 nt, Homo sapiens
gaauuguguugaucagacguguacuaagcaguuacug

SEQ ID NO: 161992 - RNA, 40 nt, Homo sapiens
cuuuuuuuuagaaaaauuaaaauaauuuuaaauagucuuu

SEQ ID NO: 161993 - RNA, 47 nt, Homo sapiens
gaaauugcauuauuuugcuauuauucaggagacuguuucucaccugg

SEQ ID NO: 161994 - RNA, 29 nt, Homo sapiens
uugaucagugagggccacuguguauuuuu

SEQ ID NO: 161995 - RNA, 48 nt, Homo sapiens
auuuauaauagcuaauuuccccauaagaagccuaccaaaacaugauag

SEQ ID NO: 161996 - RNA, 47 nt, Homo sapiens
uaagacaaaucaaauuuuuagaaaagacugauuuucaaauacaguaa

SEQ ID NO: 161997 - RNA, 53 nt, Homo sapiens
uuauguauaauuugguguggcuggaccauagguuuuaaagguaauggagaaua

SEQ ID NO: 161998 - RNA, 48 nt, Homo sapiens
agguguccagaaaggaacuggauauaugaauauagagccaagcucaag

SEQ ID NO: 161999 - RNA, 55 nt, Homo sapiens
uaaagaucacuuauccucauaguuagcaagacuuccucauuuaaaaaauucuuuc

SEQ ID NO: 162000 - RNA, 47 nt, Homo sapiens
gacuguagcuauugaaucugacugggguucuaagaggaaggcuuuug

SEQ ID NO: 162001 - RNA, 48 nt, Homo sapiens
ucuacaggauaucacuucauuucuuuaacaaauaauugcauggaaaag

SEQ ID NO: 162002 - RNA, 46 nt, Homo sapiens
uuagaagauugccuaaaauaguaaaucauaauuaauuugcccagag

SEQ ID NO: 162003 - RNA, 45 nt, Homo sapiens
cugugguccccauacuuguacccaccaaaaaaaaagagagagaga

SEQ ID NO: 162004 - RNA, 44 nt, Homo sapiens
aaagccuuucaaagaaacaagucaagcuugauuuguguuuuuga

SEQ ID NO: 162005 - RNA, 46 nt, Homo sapiens
gugauuuaacucuucagaaacuugguucagccuugaguuuugucag

SEQ ID NO: 162006 - RNA, 47 nt, Homo sapiens
ucccaaaaucaggaauuaauaauuuauuggaacuguuaccaagccac

SEQ ID NO: 162007 - RNA, 44 nt, Homo sapiens; identical to SEQ ID NO: 78950

SEQ ID NO: 162008 - RNA, 46 nt, Homo sapiens
cuuuaaaauguuguauuauccacaguccacaagcauucaguccaca

SEQ ID NO: 162009 - RNA, 47 nt, Homo sapiens
guauuucaacccuacugccuuuuauuuuaacugaagguuuaagcagg

SEQ ID NO: 162010 - RNA, 63 nt, Homo sapiens
aaugucaacagauuuggauuuaacucuagaacuauguuuuacacuccagaaggaaggaauaag

SEQ ID NO: 162011 - RNA, 66 nt, Homo sapiens
aaggugguuuugguucugagacuauagcuaugcaaaagccuuuauccugagauugugauguaagau

SEQ ID NO: 162012 - RNA, 65 nt, Homo sapiens
aguucauuuuggaagcuuuuguuuugguaguucaacuuacuuugccuacuuccucaagaaccaga

SEQ ID NO: 162013 - RNA, 45 nt, Homo sapiens
augacucuuuuguagugcuucagagccaucuuuccauuauaguac

SEQ ID NO: 162014 - RNA, 42 nt, Homo sapiens
uugccaucuucuaaauaucuuuaaugaccuacucacuaguca

SEQ ID NO: 162015 - RNA, 47 nt, Homo sapiens
ccuucuucuguccauauuacuauaaucuuaaacauaaaauguggcaa

SEQ ID NO: 162016 - RNA, 46 nt, Homo sapiens
auuguucucugcuuacugagguuuucuuucuguuguuggaguuguu

SEQ ID NO: 162017 - RNA, 46 nt, Homo sapiens
uuacugaguuuacuggugcaugaaaagcuuucagcaagaauagcag

SEQ ID NO: 162018 - RNA, 52 nt, Homo sapiens
caucuuugguuuagaguauguuguagagggcagggauagaagcggagagacc

SEQ ID NO: 162019 - RNA, 40 nt, Homo sapiens
aauguaacucuaaauacuuacuuuuuaauaaacauuaaag

SEQ ID NO: 162020 - RNA, 25 nt, Homo sapiens
uggauuuuucaccuacucuuuaaaa

SEQ ID NO: 162021 - RNA, 46 nt, Homo sapiens
uuucaguacucaagaaaaaugggguuaucccagagccauccaagcu

SEQ ID NO: 162022 - RNA, 48 nt, Homo sapiens
guggccucaagaaaauaaagaaacacaaaaagaaaugaagaacaagaa

SEQ ID NO: 162023 - RNA, 56 nt, Homo sapiens
aaaacaucacuagcugacuauaaaaacaaaagugucaucauugaagcccugaagag

SEQ ID NO: 162024 - RNA, 46 nt, Homo sapiens
cuucucauaaccuaaugucagacuaagaaaaauaaaauaucugaga

SEQ ID NO: 162025 - RNA, 28 nt, Homo sapiens
ugaaucgggaccccagugauuauuucuc

SEQ ID NO: 162026 - RNA, 49 nt, Homo sapiens
gaaauacaggguaccaucuggauggaugguggaaauauuuuauuacuag

SEQ ID NO: 162027 - RNA, 45 nt, Homo sapiens
gaaaguuacuggcuccuccccuuggggaaccuaucauuacccugg

SEQ ID NO: 162028 - RNA, 46 nt, Homo sapiens
cucaacaaauagggggccucacucuccagccugcagucacuagugg

SEQ ID NO: 162029 - RNA, 42 nt, Homo sapiens
caaaauauggauaucaccuacccugucugugcuagacugggg

SEQ ID NO: 162030 - RNA, 99 nt, Homo sapiens
cagaguguauuugugaagagucucuuauauuauguuuuguggaaaucagcacacaaccacaaugacauuuaagcacaggaucauuauuagucuauguuu

SEQ ID NO: 162031 - RNA, 45 nt, Homo sapiens
ccugguuacaguuucgacuccucucugcaagugaauaggcccaga

SEQ ID NO: 162032 - RNA, 27 nt, Homo sapiens
ugaaaggcagaggauaugggaaaacac

SEQ ID NO: 162033 - RNA, 57 nt, Homo sapiens
ugggggugcggaguggaggauuuaugaacucagcaaguauuuauuaagcaucuauaa

SEQ ID NO: 162034 - RNA, 52 nt, Homo sapiens
uagguuauguuggauaguaauaugaaugaggagaggaagguagucugugagu

SEQ ID NO: 162035 - RNA, 99 nt, Homo sapiens
agggagauaccuauguuagugaaauaauguaauagcucacauaauugugccuuuuuccagucugguggaaaggacagaggacuaaguccauggacugga

SEQ ID NO: 162036 - RNA, 44 nt, Homo sapiens
cgagugccaggagggagagauccuggccacaggcaguacggcau

SEQ ID NO: 162037 - RNA, 46 nt, Homo sapiens
aaaauguccagagaaaacagagacacugggaaaagauaguugcagc

SEQ ID NO: 162038 - RNA, 48 nt, Homo sapiens
accuaaguauaaagcagcaaagaaaugucaccuguagucccauuauuc

SEQ ID NO: 162039 - RNA, 36 nt, Homo sapiens
cuauggguuuuuucaggugaaccucccccauuuaaa

SEQ ID NO: 162040 - RNA, 37 nt, Homo sapiens
uuucuuuucucuucccaccaggcuauuagcuccagau

SEQ ID NO: 162041 - RNA, 42 nt, Homo sapiens
ggggccggcugcugaaccgccuggcagaccuaguggagcggg

SEQ ID NO: 162042 - RNA, 39 nt, Homo sapiens
ugcuucacccggcaugagcccguuggugucuguggccag

SEQ ID NO: 162043 - RNA, 42 nt, Homo sapiens
gcuuggccagaaggagggcgcaaaacuccucuguggcggaga

SEQ ID NO: 162044 - RNA, 48 nt, Homo sapiens
aaagaggagaucuuugggccugugcagccccuguucaaguucaagaag

SEQ ID NO: 162045 - RNA, 46 nt, Homo sapiens
gagguaaagacggucaccaucaagguuccucagaagaacucguaag

SEQ ID NO: 162046 - RNA, 49 nt, Homo sapiens
gagcuuccucacgccggcugucgcagcgccuagccccacccggcggccu

SEQ ID NO: 162047 - RNA, 45 nt, Homo sapiens
ggcagcaugucgcggcggcggcacagcgacgagaacgacggugag

SEQ ID NO: 162048 - RNA, 96 nt, Homo sapiens
cuuggucucuaaggaugcuucagaauuucguccguaaaaccacggagcagggaagcacaccugugucugugcugccgccucuuagggacccacugg

SEQ ID NO: 162049 - RNA, 56 nt, Homo sapiens
aaaagggcucggaagaauucacugaaggaaaggacugagagaucucaugaguugca

SEQ ID NO: 162050 - RNA, 114 nt, Homo sapiens
uugaacuggccguaagcgcauuucccuugugugagagagagugcuagaaaacuaacuucaggccucugagagaguuagaacagggguucccaucuccguuuggaugauugugcu

SEQ ID NO: 162051 - RNA, 67 nt, Homo sapiens
uguuaacauuuuaguguauuguuuuuugaagagaguguauaguagugguuaagagaugagacuuugg

SEQ ID NO: 162052 - RNA, 47 nt, Homo sapiens
cccuaccauuuacuuggugaucuuguccagguuaugaaaucuccuua

SEQ ID NO: 162053 - RNA, 46 nt, Homo sapiens
auuugccaacgcuuaagaggcgguaaacguuagcagaugcugucaa

SEQ ID NO: 162054 - RNA, 47 nt, Homo sapiens
ggagcagagugagugagggggaaguuguaggagauaagauuagagag

SEQ ID NO: 162055 - RNA, 60 nt, Homo sapiens
gauuaggaggcuauaccaaugaaguucauguaguaguccauuuauaaacaaggaaaagga

SEQ ID NO: 162056 - RNA, 29 nt, Homo sapiens
ggaauuugggcaauuuacaaaaauuucag

SEQ ID NO: 162057 - RNA, 30 nt, Homo sapiens
gaccucugaugcaaaugaaacugaagauca

SEQ ID NO: 162058 - RNA, 46 nt, Homo sapiens
aagcugacaauuuauacaacauuaguuggacuacugaaugccagga

SEQ ID NO: 162059 - RNA, 45 nt, Homo sapiens
ugcaggggaaacuagaaugggaccucaaaauuuguuucuccugaa

SEQ ID NO: 162060 - RNA, 70 nt, Homo sapiens
auuuuuguguuugaaagagcauaauuuuaaauauuaaaaaguaauuccauuuucauaugaaugccaugga

SEQ ID NO: 162061 - RNA, 41 nt, Homo sapiens
ucuguuuagcuguugccuuuaaaaguaaggcaaccaaugau

SEQ ID NO: 162062 - RNA, 47 nt, Homo sapiens
aagagugggaaaauugacaaaauaauuuauacaguugccugaaucaa

SEQ ID NO: 162063 - RNA, 23 nt, Homo sapiens
aauuucccaaacaaacaaucuua

SEQ ID NO: 162064 - RNA, 45 nt, Homo sapiens
caugaucuugaccgagcaccuaguacgaugcgaaacugaugggac

SEQ ID NO: 162065 - RNA, 25 nt, Homo sapiens
uacauggugacccuggagaaccuuc

SEQ ID NO: 162066 - RNA, 51 nt, Homo sapiens
aggaccaagagaaaagaaauuaaaaccuacaaauuucucuagaauguggau

SEQ ID NO: 162067 - RNA, 96 nt, Homo sapiens
agcauguuaaauugcaccagcacaauuuaacagaauauuuauugcaagguaugauguacagugacaugccaucuuuugucuguaugaacuucauua

SEQ ID NO: 162068 - RNA, 73 nt, Homo sapiens
aauugcggcgagcaguaagaagcagcguguggaaaagggagacgauuguucaucaacaugaguauggaccaga

SEQ ID NO: 162069 - RNA, 54 nt, Homo sapiens
ggagacucaguucucuguuacucugcuuuaguuuauggaggacuaaagaagacc

SEQ ID NO: 162070 - RNA, 143 nt, Homo sapiens
auuacagaaaucaguuacagaauauagaaauguuuugauuucaaaacuucaggaugcacaggccuuaauauuagaugggaacguucagcugguucaaauguacagaacguuuuggguuugcaugucuacucuauaaauaaggu

SEQ ID NO: 162071 - RNA, 51 nt, Homo sapiens
uugaaguuugggguagucaagaagcauuagaagaagcaaaggaaguccgac

SEQ ID NO: 162072 - RNA, 45 nt, Homo sapiens
ccaaaacagaggcaaaacaagaauaucuucugaaagacugugauu

SEQ ID NO: 162073 - RNA, 48 nt, Homo sapiens
aggaggaggcuucauuuuagaagaggaagaagaagaagaacagaaaau

SEQ ID NO: 162074 - RNA, 45 nt, Homo sapiens
ggaagcuggcagggucauugauagcaaguaaguacuuccugaagg

SEQ ID NO: 162075 - RNA, 45 nt, Homo sapiens
uuuuaguuugauguguguuucccaaacuagagauaaaacuaguaa

SEQ ID NO: 162076 - RNA, 43 nt, Homo sapiens
uuugagaaauuuuauguuacauauaugaaugaaguugaaagcu

SEQ ID NO: 162077 - RNA, 43 nt, Homo sapiens
cuugagucuuucauaacuacacauuuuuauauuuccuuuugug

SEQ ID NO: 162078 - RNA, 46 nt, Homo sapiens
ucugucucacauuuuacaaacaccaauagagauaauacaggcagau

SEQ ID NO: 162079 - RNA, 4521 nt, Homo sapiens
aucagccaccucggauaucaaaagcacaaaagagacggguaugaaagucaugucaccaaguauauaaguuagugcuguguguucaauacuaucuuagguacuaucuuaggucuuguuauaggaagagaaugaaaaaaaaaugaugcaguuccuugucuaggcacuugaacuaacauuuauuaagcaccugcugugugucacauacuaugcuaagcugcuuauaugacaucucauuuaguccugacaauaauccugugaaguaggauuucuuauccccauuuuauggagaagaaaaugauccuaagauaauauaaaauaacguauucagguugcagcucucauaggagagcgaagcugggagugggagugcaaaguaguuuuuuuuacaaauauauuaucccagacuuaaaaauucagaaugugggcccaggggauucugaugcacaacccuagccaagaacuauaccauugggugagaaauaaggauuugaaccuagaaguuaacauguguagguauacaaaauucuuagagaauuauguagguaucuauauaaugguuaauuaugaaaauuuagagaagggaaaguucauuaugcuaauaauggguuggaauuugaaagaaauauuauuuagauaggauauuccaaauaggaggagcagcaugcacaaaaacaaaugugggggugauauauugcauuauugaagagcuauaaggaaacugauuuauuggaaguagcuaguucauaucagcauuauggaaaugagauuagauagguaagucccuuugaauuugaaaaagaaaaaugauuaaauucagucuuuuuaguugcgaguauuauuuuauuaacacuugauguuuucuaugguuuaaaugcauauuuuuaaauucauuuugcaucuuaugacauaguauguaauuuaguagagcauggaguuuagugucaaacagaugagguuuuaauuucauuuacuguuauacuuuggguacgguucuucuuuaagccucaguuucacaucuauaaaacgggggcaaauuauagcuacuucauaagcuaauucauugugaauauuaaauacuguacuauuuccaaagccuuuaacacaaggccuggagaacuaaugggucaacaaaugauaguauuguuucuauauuaaguaguguauaguaugccucuuaaaaauguaaccuaaaagcaaugucuuuuucuguguuaaguagugcauacuaugccucuuaaaaaauuaaaccuaaaagcaaugucuuuuuuuguuugcaagcugaugaaaugcacauaguccaacauuucucauucuuguguagaauuuuauuuuugaguaaauauaauugugaauuuuguagauucauaaaauuuagaucucauggaaucuuggagauugucugcuuaggauaugcauucuuuugugaugaucucacaauugucuagcuucuauagaucaaaaaggaagggcagaauuuuugcaugccaguagcauaacaaaacauuggaauuacgucuacuuaguaauugaaacaucuuauaauagccuauuuaauucuggaaaaccuaagggcacaaguucuuccuaucuuuaucaaaacuuguuccuccccagcuggaccucuaacaacaaaacaaacaaaacgaaaacucccuuaccuuucucaaaaauuuuguuacuuuuucccuaagauacugcacaacuggaauuaauacuuuugucaguuauacucucaaaccauuuaguaucuuuuauagucagcugcuuuaacacuugguagaaaaaaugcccaaguaauguuuuuacaggguuauauuaaugggauuuuagaacagaaaacauuaaacguuuauaaugcuuaagaaaauggaaccugaagucaggaugcacaaucggguguuagauuauuuggaaccuccuuuuugcuagaagcaccaaggaaugcaaagucauuuaauuaaugauguuuaucuuugggaaggauacaacucuggaagaaaaacgugauaaaacuuugucaagauuuauuuuaagaauaucguggaauauuguagagcauaucucuuauuuuuagucuagaaaaacaguauuuuauucaaagaacuuacaaacuuuuugauaugagagaaagagucuaaaauagaacuuagaagagcuggguuucaaaaauauggaauuugagggcuggaaugagauugaauucaauuucuguauuuuccaaugagaaagcagagacccaaguuaucucaauuguacacuaaaaguuugauacaaacccaggacugguguccagcucuuaauauucccuuugaaucuucuuuguuauauuacuauaucaacaugacuguaguuuuauugacaauauauuuaugauuuacaugcuauuuucaucuuuuauacguuuuuauuagaacuuauuagugccauucuaucuccacuacuauagcuguagaaaccaaagugccuagugcucuugggaaacuauauauugcuggaaaaagaauucaguggauuucuuaccuagugcccugaaaaggaaacucaauugcuuuguucuaaugaagcaaagcaugaagggaaaaaaaugaaaugauuagaauuaguauuuuagaggcuuaaacaguuuugcagauaagauaaagugccacucuuucaguaaauaguacaugacaucauuaacuccagcucccaucugcuccaacuuuuauucugauucaggugccuggauagaaggagcucucuguguuguccuuggucccugcucugcucuuaccagcuguauggccuuuggaaaucuuucugcgugcuguuuccucagaagaggaaaaugagggguuuuggauuagaugauaucuaaggugcuuauucuuccuuuccccucugaaacuuuuuuagucuuuuauaaaguaauagugccaucuuguguuuuaagauauuaugccucugugauccacaguucuagguacacagugaaauaaauuuguuccuauuacuuauacaaaccuuaaauaggcuauguuuuauuagggagauauuacugcuuuugauucagguaacuuagaaaucacuuuagguucaucuagcauggcacauaacaggcaaguaguacagguacaugacaauaaguuuaauugaaacuugccuucccauucacuuuuguuccaaggagaaaucagagcuaguguuauggaagucuuuaccuuuuccuauucuuggcuuaccaaauccuucacuguaacuuauuaaugucaaaauuuauauaacuuaguuuuuauucuuaaauuauaaagcaguuuccgcuugaguguacaaacaaaauauaugauagagaauuagaaagaugcagaaaaacauacagacauacacacacauacacauacacacaccccaaaauaaaacuuauuuuggaaucccgucauccagaaaaaagcacuauaaauacuuuguguauauuguaguuucuuuuuaguccuauguuaaguauagaccuacuguauauuaauuauaugccuaugcuuuuugccuccaauuucaucucuugacaguuuucucuggcacuguagcucuaggaacuguuuuuagcuaugaaacauauagugcuuucuggcuuuugaucauuacuaguccaucuguuaggaauuuuuuuuccuuucuucuuccccaaccuucccuauacaccuccugucuauucuucaugucacaaaucucucauuuccgucaccccacuccauccuugcauauguuuccaugggaggagcuuaucagacauuugcauaaggaaagcaaauuguagaauguaacauaugauaccauuuuuauuaagaauuuauacauauuuucaagaguauaccauauuuauuaaaaugaauggaaaaacaaucuagaaggaugcauaccaaaccucuagagcaagcacugggauggcagugguguuauggggagcuugagucucucucuuauauuuuaauuuuuuuuuuacaaaauauuuguuaauuaaauguauguguauacagacauuuuaaaaagcuugauaaaaagggugucugccuguacccuuuuaaaggcugugucauauuaacacguuacugguggacugauaagaagccuggauuagccugggcuuuaauauaauaauaaugugcuuuaaggccuaggauaacucagucuuaagagaauacuuugaaaucaguaaguaagguuuuuagaaacuuggcauguagccuuuaaguagacuuuaaagaaaaauuagagggcuuucuuaauguccaguauagagcaaggugcuggaaacacacagaugaguaagagaguaaggagcucaccuuguagaaaauucuugagaugaucaaugugauaguguuugugcgagaagggagaauaaacaccggaaaguuuugagaccuuuacauuucccuucccuuaauaaaugagaauuaguccaaauuauuaugaauuaacuuucaugcauucugcuuuucuuaggaaaagaaagcugcauuggaaaaggagcgagaagaacgg

SEQ ID NO: 162080 - RNA, 2601 nt, Homo sapiens
uggaacagaaacauagagaggaacuggagcaauugaagcugacuacuaaggagaauaagguaugugaaauaaauguuugucguugccuacaccauuugaaaacagcuguccacuucuguuaaauguuaaacugcuuuuuuuuuuuuuuuugagacggugucucgcuuugcaaaacacgcucaaucuuggcucacugcaagcuccgccucccggguucaggccauucuccugccucagccucccgaguagcugguacuacgggcgcccgccacuacgcccggcuaauuuuuuguauuuuuaguagagacaggguuucaccauguuagccaagacggugucgaucuccugaccuugugauccacccgccucggccucccaaagugcugggauuacaggcgugagccaccgugcccggcccuguuaaacuguuuauuaucuaaaaucauaaaauugguagggaaaugaaaucacuuaguuaugcucaugcaucacuucucauuaauguuuuugugaccaaguuuacagggcaguguguuucuauaagggagaucggcaaagaaagugcuauacuucuuuaccuauuuacuugcccaaaagaugaagcuucaccaaaucaaaguuggaagaccaggcaucugaucccagaauugcgacugaaugggauuguaaccugagcaagguuacuuaaucuuucugagcucaaauuuucccacauauauaauacgauacaaauauuucuacacucuaagcacagguuuuuguaagaaucaagaaagugaacgugaagucauuuuuguuauaaaagugcuuuauuaacaaguuguaaugaaugaaauuuuacugauguuucuuggguaaguuggagcauccuaacuuucauaauuuuaacuaauauuuauuuuaucguuggaucuaauauauaugugucaaauacuuugguuuauauguauuaucucauuuaaccucaguaacacacugugagguauuaccuaugaaguaaguauacauaaucccauuuuucaagugggaaacaggguuagagagauuaagaacuuuguccaggagucguaacagcuguugauugccaaagccagaauuccaaaugagaacuaucuuacuccaggaagugaauacugaauucuguuacagcuuuguauagugugguauuuauuguauggguuuuggauaugaagggucauauagaccccacaaccucacuccaucuuugauagaaaguucuuaugucuauguaaaaucuuaaucugccauacuuaaauuuugguugauuuuugguuugcuguugacaaguacagcuugucugugcuuuuuauaaugguccuuacauuaaauauagucuaaauuucuuuaacuuuguuaguuaucaaguucccaacuuuccuugccuuuaauguacuucaucuccagguaacaaggcauauaugauacuccaggcguuaaauuguguugugacaauuguguuccuaauugucuccccaucuuuucuauuaaugagauaguuuuguuugcucccucagaccuuuccauuuugagguuucuuucccagguuuccaaggacaaaaauguuugauucauaagcuacauggaguccuacuguuaaaacacaaacucccauuuuaguuugaacuauuuaucuguuucauuaauuuaaauugguuuucuuuucugaauacuaccaaaaacuaaugccauugcuuuuuuguuuuucagaugcaucucuuuuaucuugccuauugucaauauagauguuuguaaauuuuaacagcuuccucugaagaaucacaggacuccuaauuucacuauaguugauagccacucuuugaagucucuaucugauuuugauauuuugaucauuugggacacagccuuugcagacuucugucucuguguauuaaaggccuugaguuguucuaugcauguguuauacuaaaaacuggcuuaccuuagaguugcaguaauaauggcuacucauccuuauaguuaaaagucuagcaucuuuuuuuuuacucuagcaaacacacacuagccauuuaggauugauuauaauaucaaaugauauuacaaauuaaauauauuuucugccugcaguuaucaguuuguagauggaaaaggguaggguaggaaaagcucaacuugcuacuagggucaaggauuaguacucaucagguucuggcuaauuaagauggaaaaaggccucugcugccaguagagguuaugcagguaauaaugaacugagccagcacaggaccuuuaucuuauauguacuggcaguagucagagaaaagaagaguggagugcuaaaugaguuggcgcuuacaggaaguacaguacugcauuuagauuaauggaguaggcauucuaagaaggaaggaaagcaugcagggaugagcaugaucuuugaaagaaacuucuugggaacuugucaaauucuuccauaaaaauagaaacaggagacaaaaccauauuaucuaauacagugucuauugcuguuacucaaauuugaaaugugggauuagauauauuuaugauuuucaguaauuuaauaaguacauugacuuguuaaugcuuuuuguuuccuucaga

SEQ ID NO: 162081 - RNA, 71 nt, Homo sapiens
ugcuguucccaagaaugacaagaagaggaggaagcaacucaccgaagauguggccaaguuggaaaaagaaa

SEQ ID NO: 162082 - RNA, 53 nt, Homo sapiens
guauaaaauaauauuuuugcaguaccaucaugugaugacuuuuguuggacaac

SEQ ID NO: 162083 - RNA, 42 nt, Homo sapiens
ccuguggccacuuuagaagugcgguuuacuccucaugccgag

SEQ ID NO: 162084 - RNA, 111 nt, Homo sapiens
cucuaagcaggucacuacccuaccguggggaaagcgcucuagcagagguuugugcacaggcuucucuauggggacuguaggaaagaaugcuuuugucuggaggagccagaa

SEQ ID NO: 162085 - RNA, 46 nt, Homo sapiens
aaucaggguccuguauuaguuacguuuuucuuaaauggagacggaa

SEQ ID NO: 162086 - RNA, 44 nt, Homo sapiens
uuuuacaucuagaauaaauuauuuaaauuauuucacagcaaggg

SEQ ID NO: 162087 - RNA, 37 nt, Homo sapiens
gggagguuuagaaccaaaccacaaguccccucaagga

SEQ ID NO: 162088 - RNA, 29 nt, Homo sapiens
ccccgagacccgccccggggagccaggag

SEQ ID NO: 162089 - RNA, 45 nt, Homo sapiens
aagaucuaggaucauacagcagcagaaaucauaucgcugggagaa

SEQ ID NO: 162090 - RNA, 46 nt, Homo sapiens
uaggguauauuucuuaaugucaucuaggucauuaguuuuguuaaua

SEQ ID NO: 162091 - RNA, 33 nt, Homo sapiens
gacccaguuuugaaaccaaaaaagaaaccuaga

SEQ ID NO: 162092 - RNA, 46 nt, Homo sapiens
gaagcaauagaaaaguucauccgugaaccuuccuuaaaagccacca

SEQ ID NO: 162093 - RNA, 46 nt, Homo sapiens
uguggaacauuaucaggaauugaagaaaaugguccaacaguccgac

SEQ ID NO: 162094 - RNA, 41 nt, Homo sapiens
gcuaggugucugccuguaucccaguguucaggcuggcuaga

SEQ ID NO: 162095 - RNA, 42 nt, Homo sapiens
gguuuuccuggcgcucuacgugcuguuccucgccgacgagga

SEQ ID NO: 162096 - RNA, 40 nt, Homo sapiens
uaggacccagaaccucgcugauucugggguggagacccua

SEQ ID NO: 162097 - RNA, 54 nt, Homo sapiens
uuagggcacuacucuuaaaaaaggaaaguuaacaaacuggaauagagucagaga

SEQ ID NO: 162098 - RNA, 40 nt, Homo sapiens
uccugugggugcgguuccuugggaaugguucugcuuaaug

SEQ ID NO: 162099 - RNA, 46 nt, Homo sapiens
gacaauguaauuucaggcaauaagggcuaugaagauaaauaaagcu

SEQ ID NO: 162100 - RNA, 44 nt, Homo sapiens
cacacaaugguuuggggacgaauaggccuccuaggcaaaaggag

SEQ ID NO: 162101 - RNA, 74 nt, Homo sapiens
guuaguuuugaaaaccauuguguugagguauagaagggagagacaguuacacaguggccagaaagaaaggguaa

SEQ ID NO: 162102 - RNA, 47 nt, Homo sapiens
gcaucagguaggcacuuaguucauugugguuaucaugaucaaaggag

SEQ ID NO: 162103 - RNA, 48 nt, Homo sapiens
acacucguucguagauucaguuacauccaucugucaucugaagaagga

SEQ ID NO: 162104 - RNA, 78 nt, Homo sapiens
guucaugagagaaauuuucuguaagcuugcuguuuuacaggggauuuaucaauaauugauuuugaggaaucaguuuuu

SEQ ID NO: 162105 - RNA, 48 nt, Homo sapiens
aagggucauuuuauacuuggguauaaaucaaucccaguuugggaaaag

SEQ ID NO: 162106 - RNA, 65 nt, Homo sapiens
acuuugaaguggaggagagucauaagacagaacauuuggcaggaauuguccuuaugaaacaagaa

SEQ ID NO: 162107 - RNA, 46 nt, Homo sapiens
cagaaacuagcacccagugaauauagguauacucuauugagggauc

SEQ ID NO: 162108 - RNA, 48 nt, Homo sapiens
gcacagagaauuccaucauggaccugacccaacugauacagccccagg

SEQ ID NO: 162109 - RNA, 45 nt, Homo sapiens
gauacagaaaguuuagaaauauuccagaaugaaguagcucggcaa

SEQ ID NO: 162110 - RNA, 51 nt, Homo sapiens
ugguugucuugauauucuucuccuuaaucuuuuaacauuuguuugguaaag

SEQ ID NO: 162111 - RNA, 46 nt, Homo sapiens
uaaauguguuccucuuguccgagaaauaacauuugaaaauggagag

SEQ ID NO: 162112 - RNA, 51 nt, Homo sapiens
cugggguauaaauuuacuugguaccugccagauaauaaggagcagcuaggu

SEQ ID NO: 162113 - RNA, 42 nt, Homo sapiens
uugacuuccaugcaguauuauuucucuuuucauuggcucaug

SEQ ID NO: 162114 - RNA, 40 nt, Homo sapiens
gagcaaaaggacucggacaacuauagaguuuuugaacgag

SEQ ID NO: 162115 - RNA, 72 nt, Homo sapiens
auaagcaaauacccaacccucaaauuguuucguaaugggaugaugaugaagagagaauacaggggucagcga

SEQ ID NO: 162116 - RNA, 48 nt, Homo sapiens
gccauuauuggcuccuuaaauguuugguagaauuuacuggugaagaug

SEQ ID NO: 162117 - RNA, 28 nt, Homo sapiens
uagugcuuaagacccucuagaguccguc

SEQ ID NO: 162118 - RNA, 49 nt, Homo sapiens
gaggaagcuuccgaugucauuaaggaagaauuuccaaaugaaaaucaag

SEQ ID NO: 162119 - RNA, 32 nt, Homo sapiens
ucucuacuacauuguuugcucugugagaauac

SEQ ID NO: 162120 - RNA, 47 nt, Homo sapiens
uaccccuacucuugacucugauuaggagcccuucuguuauuuccggu

SEQ ID NO: 162121 - RNA, 48 nt, Homo sapiens
ccuuaaaauguuuccauuaccuuuggguuaaaguuuaaauccuuuacu

SEQ ID NO: 162122 - RNA, 59 nt, Homo sapiens
agccuacuuagagaccaauaguucucacugugcagaacuaaauguuaaugaccuuagga

SEQ ID NO: 162123 - RNA, 46 nt, Homo sapiens
uccuguaacaacugaaauaacaagucuugauacagagaauauagau

SEQ ID NO: 162124 - RNA, 43 nt, Homo sapiens
cuaggagccuguuagugcuuuuauuagugccuugggcaguguu

SEQ ID NO: 162125 - RNA, 40 nt, Homo sapiens
uguuuguaaaguaauaguagagaaggaaauguuguuaagu

SEQ ID NO: 162126 - RNA, 90 nt, Homo sapiens
aguuauuuaaccuuucugaguuuccauuuucucacauaucagauagagauaaagaccucuccugcuuaguucuggggcagcuaaugagac

SEQ ID NO: 162127 - RNA, 51 nt, Homo sapiens
uguuuaauccugauguagagugguagacuucugguucauagaaauauagaa

SEQ ID NO: 162128 - RNA, 44 nt, Homo sapiens
aaggagagcagcgugauugucauauagugaauaagauacagcau

SEQ ID NO: 162129 - RNA, 43 nt, Homo sapiens
gaccucaccaacaauguaauaguuucccuguagccuugauuaa

SEQ ID NO: 162130 - RNA, 23 nt, Homo sapiens
ggaaaauauguuagagaauaccu

SEQ ID NO: 162131 - RNA, 45 nt, Homo sapiens
acuguacuccucguagcccccguagccugugcuguaggcaccagg

SEQ ID NO: 162132 - RNA, 48 nt, Homo sapiens
guuucccuagagccuucucagcuaacuccugcgaggcaaacugcacga

SEQ ID NO: 162133 - RNA, 41 nt, Homo sapiens
uggccacgcgccgcugccaguccuuguggaaguggggcuuc

SEQ ID NO: 162134 - RNA, 99 nt, Homo sapiens
ggagacaguucugcugaagaacugaaacuggccacccagcugaccggaccggucaugcccauccggaaugucuauaagaaggagaaagcucgagugauc

SEQ ID NO: 162135 - RNA, 42 nt, Homo sapiens
cugcuacagagcaggaguugccgcagccgcaggcugagacag

SEQ ID NO: 162136 - RNA, 51 nt, Homo sapiens
guccacacaagaagcccagcugguggcagcagcugaaauugaugaagagcc

SEQ ID NO: 162137 - RNA, 46 nt, Homo sapiens
gcaagagcccugcuuuggauaccuacauaguuucuggggaagccaa

SEQ ID NO: 162138 - RNA, 50 nt, Homo sapiens
aacauucaagaaaacacacaaacuccaacuguacaaaaggagagugaaga

SEQ ID NO: 162139 - RNA, 44 nt, Homo sapiens
guaagugccauuauggaauuaacaauguaaccaucugaaagcaa

SEQ ID NO: 162140 - RNA, 45 nt, Homo sapiens
aauacuuccauauggagcauuuuucagaguuuucuaacccagucu

SEQ ID NO: 162141 - RNA, 56 nt, Homo sapiens
auuauauuugaguuucuuucagaucauuuaggauacucuuaaucucacuucaucaa

SEQ ID NO: 162142 - RNA, 46 nt, Homo sapiens
cgguucuuguggaauugugcccuaaguguugucaaggaggggagau

SEQ ID NO: 162143 - RNA, 46 nt, Homo sapiens
auucggaaacugggccucgugaaguauggagaaaaauaugcuggua

SEQ ID NO: 162144 - RNA, 42 nt, Homo sapiens
ugcccuuuugagaggagucccagagaaagaaguuggcaaggu

SEQ ID NO: 162145 - RNA, 46 nt, Homo sapiens
caugggcuacugcccucaguuugaugccaucacagagcuguugacu

SEQ ID NO: 162146 - RNA, 25 nt, Homo sapiens
uauacgauguguuaaaaccaagaaa

SEQ ID NO: 162147 - RNA, 45 nt, Homo sapiens
aaugcaaagcuaucuccucugaaugaugaagaugaagaugugagg

SEQ ID NO: 162148 - RNA, 36 nt, Homo sapiens
gugucugacuuaugccaggcauaggugauucagaga

SEQ ID NO: 162149 - RNA, 45 nt, Homo sapiens
gcaaaagggagagaacccuagccauuauggaauuacugcuuucaa

SEQ ID NO: 162150 - RNA, 45 nt, Homo sapiens
gcagaucgauuucucaacagcuugggaagauuuaugacaggacug

SEQ ID NO: 162151 - RNA, 46 nt, Homo sapiens
uuucccugggugucaguaauacucaagcacuuccuccgagucaaga

SEQ ID NO: 162152 - RNA, 47 nt, Homo sapiens
gcugacguguaacuucucugaggcaaaauuuagcccuccuuugaaca

SEQ ID NO: 162153 - RNA, 24 nt, Homo sapiens
cuuaaagaacaagaucugggugaa

SEQ ID NO: 162154 - RNA, 42 nt, Homo sapiens
aacaaaacacugcagauauccuucaggaccugacaggaagaa

SEQ ID NO: 162155 - RNA, 23 nt, Homo sapiens
guccugagccauuuuuuuuuucu

SEQ ID NO: 162156 - RNA, 48 nt, Homo sapiens
cuuccagaaugggaacuggacaaugcagaacccuucaccugcaugcca

SEQ ID NO: 162157 - RNA, 46 nt, Homo sapiens
aauuggagagggggcaaacuugacuuucaaguuucaaugggaagau

SEQ ID NO: 162158 - RNA, 46 nt, Homo sapiens
uaaacgcccucaccaaagacccuggcuucgggacccgcuguaugga

SEQ ID NO: 162159 - RNA, 46 nt, Homo sapiens
agcuuucuucaguccugaaagauuuguagaccuguagaugggggaa

SEQ ID NO: 162160 - RNA, 51 nt, Homo sapiens
ccacccuuuggcaaguaccccagccuggaacuucagcccuggauguacaac

SEQ ID NO: 162161 - RNA, 30 nt, Homo sapiens
accauaaauaaugacaacauagagauaguu

SEQ ID NO: 162162 - RNA, 54 nt, Homo sapiens
guggaagagacugcuaauugccagacggagucggaaaggauuuuuugcucaggu

SEQ ID NO: 162163 - RNA, 62 nt, Homo sapiens
ggcaaaggguccuaccaggugaaaggcuggaaacuuacacagcaacaguuuguggcccuuuu

SEQ ID NO: 162164 - RNA, 67 nt, Homo sapiens
gcagagcugucuucgcccguucacugaagaugaugcugcugauccaaaugauucugacauagaccca

SEQ ID NO: 162165 - RNA, 46 nt, Homo sapiens
auuccucaagguggccgaagagagugggguggaugcugagaccuca

SEQ ID NO: 162166 - RNA, 79 nt, Homo sapiens
ggagcaggauuaucauggaguuagucauugaguuuuuaggucaucgacaucugauuaauguuggccccagugagccauu

SEQ ID NO: 162167 - RNA, 78 nt, Homo sapiens
aucucagagacgacccuggaagaaguaaguuaaguggcugacugucggaauauauagcaaggccaaauguccuaaggc

SEQ ID NO: 162168 - RNA, 46 nt, Homo sapiens
ucucugagaagcacgugaaggcggagauggagcagauggcccugga

SEQ ID NO: 162169 - RNA, 52 nt, Homo sapiens
ucgggcaccgccuacauccugggaaaagacauucgcucugagaugagcacca

SEQ ID NO: 162170 - RNA, 46 nt, Homo sapiens
agguggcugucgauggccuggcacugaauuuuuaugagggccagau

SEQ ID NO: 162171 - RNA, 38 nt, Homo sapiens
caaagagauaagaacuaacuaauuuaauacuaguuacc

SEQ ID NO: 162172 - RNA, 45 nt, Homo sapiens
aacaauaaucagaaggauauauauuguugcagguuagacugucug

SEQ ID NO: 162173 - RNA, 50 nt, Homo sapiens
gccccucuucaugacgcuggccuggauuuacucaguggcugugaucauca

SEQ ID NO: 162174 - RNA, 42 nt, Homo sapiens
ggagcaggcaaucaucagggugcugacgggcaccgagaagaa

SEQ ID NO: 162175 - RNA, 37 nt, Homo sapiens
uuuauuguaugguucuaaaggaaugguugauuaccug

SEQ ID NO: 162176 - RNA, 45 nt, Homo sapiens
caugucaaguacaagauccgaauggacauugacaauguggagagg

SEQ ID NO: 162177 - RNA, 70 nt, Homo sapiens
guuggacagcagggacaaugaccacuuuugggaacagcaguuggauggcuuagauuggacagcccaagac

SEQ ID NO: 162178 - RNA, 48 nt, Homo sapiens
aaucauuaugcugccauugaaauaauaaauacaaaggcgcaagggggg

SEQ ID NO: 162179 - RNA, 45 nt, Homo sapiens
ggcagagaccagggaggaggcucuccaaguggccaaggcauaaag

SEQ ID NO: 162180 - RNA, 78 nt, Homo sapiens
cuggggcuggagagaaaggcaugggcaugccuuggagggacuugugugucaagcugaggaccuuuacuuuaagcucua

SEQ ID NO: 162181 - RNA, 45 nt, Homo sapiens
aagaaugagauaauggcagaaggacaaauccugcaagaucucacu

SEQ ID NO: 162182 - RNA, 48 nt, Homo sapiens
ucucguauugucugcgggcaucccgagggaggggggcugaagaucaag

SEQ ID NO: 162183 - RNA, 64 nt, Homo sapiens
ggaacuguaccugauugagauaguucagcauggagcagauauagcuguggggaguuugauggga

SEQ ID NO: 162184 - RNA, 35 nt, Homo sapiens
guccuuaaagcgucuguguggguuuuugcaggaga

SEQ ID NO: 162185 - RNA, 84 nt, Homo sapiens
agaccacacuauuuagcuuacuuaguaauaacauugcaaagaaaaauuccgacgaaguuuuuucagccuaggaaucaauaguuc

SEQ ID NO: 162186 - RNA, 45 nt, Homo sapiens
uugaugggaagauggauaucuauuuauguuuaaaaacccaucaua

SEQ ID NO: 162187 - RNA, 26 nt, Homo sapiens
uuaugauaacguuucuccacuguccc

SEQ ID NO: 162188 - RNA, 44 nt, Homo sapiens
agugcugcuuuuucuguuuuguugcacuggauugaagccuuuuc

SEQ ID NO: 162189 - RNA, 107 nt, Homo sapiens
gaguaugugugagucagcauucagaguacuuaacacacuuagugucauuagugauaacuuaacccacacguauaggaagcuagaccuccauuuacagaaaaauggag

SEQ ID NO: 162190 - RNA, 43 nt, Homo sapiens
gugaauaugguaaaacuugugagaguaguuuguaaaugauuga

SEQ ID NO: 162191 - RNA, 46 nt, Homo sapiens
gccuuguuugguuuuccuugaacuauuaacaggaagauagggagau

SEQ ID NO: 162192 - RNA, 45 nt, Homo sapiens
auguuaaaagguugggacuccaaacaguucuguuaaagcuuagag

SEQ ID NO: 162193 - RNA, 46 nt, Homo sapiens
gaagccagcaacagaaacagaugauuucaggagcuccaggaaaaug

SEQ ID NO: 162194 - RNA, 50 nt, Homo sapiens
aguaccuggggaaauugagaugagggaguccuggcucagcugggagaaaa

SEQ ID NO: 162195 - RNA, 23 nt, Homo sapiens
uucuguaaaauguguauaacaag

SEQ ID NO: 162196 - RNA, 38 nt, Homo sapiens
agaagaaagggcagggaaaagguuuuccgugcuuagcc

SEQ ID NO: 162197 - RNA, 47 nt, Homo sapiens
ggggaaccugaauucugaggucucuagugagagaacagggacuggaa

SEQ ID NO: 162198 - RNA, 53 nt, Homo sapiens
ucugggauuccaguaugccauuuccauccucaguguuuuuggccaccugagag

SEQ ID NO: 162199 - RNA, 97 nt, Homo sapiens
guauguaaggaaguucagggaauaguauaagucacuccaggcuugaggcaaaauuuacaaaugcugcugacuuuguauguaaggggaggcauuuucu

SEQ ID NO: 162200 - RNA, 57 nt, Homo sapiens
gugagcacuggacucuauguucaggugcugaggagcuggcaaaagguuuuaagucgg

SEQ ID NO: 162201 - RNA, 48 nt, Homo sapiens
acaagagaacucaccagugaagucccagugguaggagagcgugcagca

SEQ ID NO: 162202 - RNA, 100 nt, Homo sapiens
uuacgacaagccaggacccuuuugcauacuaaggaaaacagggaugaaggaaacagaaauggucucugcucugacucagaagguagaaauccucuuuccc

SEQ ID NO: 162203 - RNA, 48 nt, Homo sapiens
ccaggagugcugccacccuugaauucugacacccuauuucuccuaucc

SEQ ID NO: 162204 - RNA, 41 nt, Homo sapiens
gcagcgccuccuggccggaggaccuaggaaucggccggcuc

SEQ ID NO: 162205 - RNA, 55 nt, Homo sapiens
acagucccggacugugaauccgggaacucgaguuggaggugucccaaacgguccg

SEQ ID NO: 162206 - RNA, 46 nt, Homo sapiens
cucagaggggucggggguucccgggcgugcugagggcgcugcugcc

SEQ ID NO: 162207 - RNA, 48 nt, Homo sapiens
gauccggagccccacauccccaccacuugcaacucagaugggaccgga

SEQ ID NO: 162208 - RNA, 41 nt, Homo sapiens
cccuucucucccgggcugcggcagggcagggcggggagcuc

SEQ ID NO: 162209 - RNA, 33 nt, Homo sapiens
auggaguguuguuggaugagcuuugugaagugu

SEQ ID NO: 162210 - RNA, 42 nt, Homo sapiens
cuagcuggggaaggaagauggaaagagaagugccccauccaa

SEQ ID NO: 162211 - RNA, 40 nt, Homo sapiens
ucauuaacuguggucugugauuuguuuguuuuagggggca

SEQ ID NO: 162212 - RNA, 45 nt, Homo sapiens
ccuuuaagacagaaaaguauugauaguuuauggauagcuuguuca

SEQ ID NO: 162213 - RNA, 46 nt, Homo sapiens
aagauuacuuagcaaauugccguaagucuuuguccuuaauggcuag

SEQ ID NO: 162214 - RNA, 49 nt, Homo sapiens
uacuauuugauguguuaacaguacagucauuuaaaaauguuauuggccu

SEQ ID NO: 162215 - RNA, 54 nt, Homo sapiens
uuaaguggugaguuaguauucuugcaggccaugguccuucaagagcaccuuggc

SEQ ID NO: 162216 - RNA, 46 nt, Homo sapiens
acacuuaaggagcuguaauaaugaguacaauccacuaaagagggaa

SEQ ID NO: 162217 - RNA, 43 nt, Homo sapiens
gcuuccugaaaaugauucuccagcaaaagaucuggucuggaag

SEQ ID NO: 162218 - RNA, 48 nt, Homo sapiens
gugggucccaguuagccucauuuuacagaggaggaaacagaaacucag

SEQ ID NO: 162219 - RNA, 45 nt, Homo sapiens
uucauauucccuccuuucaagaagccuuccucuucaguccacacu

SEQ ID NO: 162220 - RNA, 55 nt, Homo sapiens
ggcccgugcugcaggauacuucaaccuuuaauuuuaaaccuugggccacagaugg

SEQ ID NO: 162221 - RNA, 47 nt, Homo sapiens
uaaugagagaggucagcauugucugcaaccacuuaccccaaugggug

SEQ ID NO: 162222 - RNA, 44 nt, Homo sapiens
augaaauuuuaaaaaaugguuacaggauagccaaaaaagucaau

SEQ ID NO: 162223 - RNA, 44 nt, Homo sapiens
auccugcccuaucugcugggucccaauagcccucuguaucuuaa

SEQ ID NO: 162224 - RNA, 57 nt, Homo sapiens
ucauuaaugaguaaauugucuuucuccacuuaggcaguugguacuuaugaguugcca

SEQ ID NO: 162225 - RNA, 56 nt, Homo sapiens
aaagcacuuccauagcucagucauuugaacauuuuagccgugguuuucuuccuugc

SEQ ID NO: 162226 - RNA, 59 nt, Homo sapiens
ucuacugacuguagcuauguucucuauucuuuccuuguagcucccuuaccugcacaaug

SEQ ID NO: 162227 - RNA, 31 nt, Homo sapiens
uguuuauuauuuuauuuagcccucagcaaau

SEQ ID NO: 162228 - RNA, 101 nt, Homo sapiens
aucucaugggaauuacaguuuuguggagacaacaauaaaaucaucauacaaucacaaauuauuauagcuauaggaagcguuuugaagagagagguguaagg

SEQ ID NO: 162229 - RNA, 55 nt, Homo sapiens
gagucaguaaaaaugaugcuguagaaguauguccauagcaugcaauauaugcaua

SEQ ID NO: 162230 - RNA, 111 nt, Homo sapiens
cuccccuuagggcagcaucuugguugcagguuguacauaugaguugaagacucucagccagugacaggguuucagggacaggguaauuuuaggcagaguuuuggagccuca

SEQ ID NO: 162231 - RNA, 66 nt, Homo sapiens
caggaaggugcuccugacucuaucuuguacuccugacucuaucuuguggaguuguagaagcucaga

SEQ ID NO: 162232 - RNA, 46 nt, Homo sapiens
uagauaccucacauaaacuuguauuugagaacuuauuuccucccaa

SEQ ID NO: 162233 - RNA, 51 nt, Homo sapiens
uggaaaauauuagaaguuguaaagacgcuaacuaaauuuucagaagguaaa

SEQ ID NO: 162234 - RNA, 47 nt, Homo sapiens
ugauagguaagauuuuucaugcaacuggggauguaucuguacgagua

SEQ ID NO: 162235 - RNA, 45 nt, Homo sapiens
accagaaagcaaguucacauuggucugacuaaagcaagggauaag

SEQ ID NO: 162236 - RNA, 43 nt, Homo sapiens
uuccagugcugacugucacugacuggcucuguaaugaggguaa

SEQ ID NO: 162237 - RNA, 22 nt, Homo sapiens
cuguuuauuuaauaauaaagua

SEQ ID NO: 162238 - RNA, 42 nt, Homo sapiens
ugaauacacuacaucuccaaaaucuucuguucucugccccaa

SEQ ID NO: 162239 - RNA, 42 nt, Homo sapiens
aagaaaaaaaacacugaacauauugggcauccuguuccugua

SEQ ID NO: 162240 - RNA, 52 nt, Homo sapiens
auaugacagcaugaaagauguuacuuuuucuuaccaucaauggugcucauuu

SEQ ID NO: 162241 - RNA, 48 nt, Homo sapiens
accugcauuuucaaauaauauucuauauguucucuaucuucccugcag

SEQ ID NO: 162242 - RNA, 40 nt, Homo sapiens
aucuguaaugauuggauaaauaauaggccuugaaaaaaac

SEQ ID NO: 162243 - RNA, 46 nt, Homo sapiens
ugcaguacauguggugguaccauguggugggccugauuuggaucag

SEQ ID NO: 162244 - RNA, 32 nt, Homo sapiens
aucauuuugccuugcucuuuccaguauaucac

SEQ ID NO: 162245 - RNA, 44 nt, Homo sapiens
uauauguauauguauauacacacacacacauaaaucagccaaaa

SEQ ID NO: 162246 - RNA, 45 nt, Homo sapiens
uuuuaugcuuauuuuugucaaacauguacuccuuucauacgggug

SEQ ID NO: 162247 - RNA, 48 nt, Homo sapiens
aacauaaagcauugaaaauuccggugcuugggcuucggcuucagagua

SEQ ID NO: 162248 - RNA, 49 nt, Homo sapiens
auggaaggagaaucuuuugaaagaaagcauugccuccuaccagaacuag

SEQ ID NO: 162249 - RNA, 47 nt, Homo sapiens
guaauauuucugauuuuucagaauauuugcaauaagagucuggauuu

SEQ ID NO: 162250 - RNA, 47 nt, Homo sapiens
aaaugaauauaauuauauaacuaacaauuguccaaauagaugagaga

SEQ ID NO: 162251 - RNA, 48 nt, Homo sapiens
ucauagccgcacagauuuuggacuuucacaaacauugggaacuaaauu

SEQ ID NO: 162252 - RNA, 85 nt, Homo sapiens
ucacuuggacaucccugcaucauggacuguugcugcucccuguuccauaugcucgcaaucucagcuauuuggaagcuaccaggaa

SEQ ID NO: 162253 - RNA, 28 nt, Homo sapiens
cggagguguguucuguuuuaguguuuuc

SEQ ID NO: 162254 - RNA, 39 nt, Homo sapiens
uccaaggaggaauagcgugugugaagaaaugaugaugug

SEQ ID NO: 162255 - RNA, 44 nt, Homo sapiens
cugggccaggaaaacaaagugaagagaccauuguaaauauacca

SEQ ID NO: 162256 - RNA, 59 nt, Homo sapiens
aggauuuuaaaguauguucaaaguaaauuuuaucuguguuuaauaagcucacaggauaa

SEQ ID NO: 162257 - RNA, 34 nt, Homo sapiens
agaagccucuuauuugcuuuggaacucccaacuu

SEQ ID NO: 162258 - RNA, 45 nt, Homo sapiens
agaacaaaugcauggucuccaagcccuccccauccaggauccccg

SEQ ID NO: 162259 - RNA, 42 nt, Homo sapiens
auguguuuuuucagcugaagaaaaggugacuggucucaugag

SEQ ID NO: 162260 - RNA, 41 nt, Homo sapiens
auaaaagaaaugauauuugaauggacauuagcagaggucaa

SEQ ID NO: 162261 - RNA, 39 nt, Homo sapiens
caaaauuacgccucaguuaaaaaaaauuguuuccugagg

SEQ ID NO: 162262 - RNA, 79 nt, Homo sapiens
ucacaacaguucuuauuccuguugcacuguuagggaaaaugaagcccagagagguuaagugucuuguucacagucacac

SEQ ID NO: 162263 - RNA, 46 nt, Homo sapiens
uguuaaagauuuucaguuuuauccaagguacaaugggaagcuauug

SEQ ID NO: 162264 - RNA, 53 nt, Homo sapiens
gaaaauuuuagcuuuaugucacauaugcaagcuagggucaaguuucagaacuc

SEQ ID NO: 162265 - RNA, 63 nt, Homo sapiens
ugaagaauuugauaguuuauacucuauacuggaugaaguaaaagaaaguaugauuaacuguau

SEQ ID NO: 162266 - RNA, 44 nt, Homo sapiens
aaugcccuggagaacucugaagaacuauuagaauuugcaacaag

SEQ ID NO: 162267 - RNA, 64 nt, Homo sapiens
cuucaaaaagaauauuucaaguucuaauauuuaaauuaucacauugcagugucucagcaugaga

SEQ ID NO: 162268 - RNA, 48 nt, Homo sapiens
auuuuagaacauaccuucacuaauuuuuuuuaacugcuagaaguuugg

SEQ ID NO: 162269 - RNA, 46 nt, Homo sapiens
uucuugguguuuaugucuuacagaaaugcaaucuccuauuguacaa

SEQ ID NO: 162270 - RNA, 36 nt, Homo sapiens
ccucucccuuucuauaaaaagagaaaugaugauauu

SEQ ID NO: 162271 - RNA, 40 nt, Homo sapiens
aguguuaaauuuuccuccuaaaaggugauuuuuguggggu

SEQ ID NO: 162272 - RNA, 46 nt, Homo sapiens
auucuuuuuuuguuuuucccuccacauucaucuaguaaauguuuau

SEQ ID NO: 162273 - RNA, 41 nt, Homo sapiens
accaggauucuuacauuccugguguuguguauuuugggauc

SEQ ID NO: 162274 - RNA, 33 nt, Homo sapiens
uucuccaagaggaauggugcccugagggccaca

SEQ ID NO: 162275 - RNA, 46 nt, Homo sapiens
uugguggcagauaacucuguaacaguggcuuggagaaugccagaag

SEQ ID NO: 162276 - RNA, 45 nt, Homo sapiens
uugaaauggcaaaauauugccugaguuguccaaugcuuauuacgc

SEQ ID NO: 162277 - RNA, 36 nt, Homo sapiens
gaauuggacaguaaagaaauuauuugggaagcuggu

SEQ ID NO: 162278 - RNA, 45 nt, Homo sapiens
ucauuuuuguauaguuaccaauauuugcuguugaauaacuugggu

SEQ ID NO: 162279 - RNA, 61 nt, Homo sapiens
ucacguucuguuuugcuguccccguacccaauagcaagaaacuacugccuaccuuagcaca

SEQ ID NO: 162280 - RNA, 49 nt, Homo sapiens
aaauccuacagugugggaguagcauacaaaacguuggggaaauuugacc

SEQ ID NO: 162281 - RNA, 42 nt, Homo sapiens
ccugaaaaaauagguguauuuugugauuuugauggggguaag

SEQ ID NO: 162282 - RNA, 52 nt, Homo sapiens
aacaggaagaaaaggaggagauggugaaguuauccccaggguuaugauacaa

SEQ ID NO: 162283 - RNA, 47 nt, Homo sapiens
uugaauuuauuuaagcaaauguuauugcuuuuuccaacucauaaccu

SEQ ID NO: 162284 - RNA, 47 nt, Homo sapiens
cccgaaccggccgcggggggacuuggcuccacccucccgucccggga

SEQ ID NO: 162285 - RNA, 45 nt, Homo sapiens
uaaaaucuucaucgacgugaagguaccuucuggguuggcuugggu

SEQ ID NO: 162286 - RNA, 43 nt, Homo sapiens
uuccgagugcccggagggaccuagggaaguccuccugccccga

SEQ ID NO: 162287 - RNA, 31 nt, Homo sapiens
agccccgcguuguuugcacuuucuggcugau

SEQ ID NO: 162288 - RNA, 41 nt, Homo sapiens
uucuuuuuuucuuuuggugcgcagucaaaacauuucacaag

SEQ ID NO: 162289 - RNA, 41 nt, Homo sapiens
ggcggcggcagaggaggaggagguggugguggaggaggggg

SEQ ID NO: 162290 - RNA, 41 nt, Homo sapiens
ugcugaggcugcugcugcuguucccccuccccccugcugaa

SEQ ID NO: 162291 - RNA, 46 nt, Homo sapiens
uucugucuugcuuucucucucccccugguugcucauuauucagaga

SEQ ID NO: 162292 - RNA, 44 nt, Homo sapiens; identical to SEQ ID NO: 79362

SEQ ID NO: 162293 - RNA, 45 nt, Homo sapiens; identical to SEQ ID NO: 79363

SEQ ID NO: 162294 - RNA, 57 nt, Homo sapiens
gagagggagagagagagagagagagagagagagagagagagagagagagagagagag

SEQ ID NO: 162295 - RNA, 45 nt, Homo sapiens
gggauuuaguucuuugcuugggucaauuauguacauucucuaaaa

SEQ ID NO: 162296 - RNA, 43 nt, Homo sapiens
cucuuugaauaagguuggggguaagauguggacaggcgcagca

SEQ ID NO: 162297 - RNA, 42 nt, Homo sapiens
uuacccaguauuagaacagacaauauucaauugacagcagaa

SEQ ID NO: 162298 - RNA, 67 nt, Homo sapiens
cccagguucacaaagcuaggaaguggcaggcaggggagugaauucaggucauaccccacagccaauc

SEQ ID NO: 162299 - RNA, 54 nt, Homo sapiens
cgcuagaaucaagugcuccucccucauaugagggcacgcugcugcucccaacau

SEQ ID NO: 162300 - RNA, 44 nt, Homo sapiens
aaggugaagaaggauguuuucugaaucugcuugaccaucuucaa

SEQ ID NO: 162301 - RNA, 44 nt, Homo sapiens
auucuuuucauucccaugaggcucuuaaaguuagaaggaaagug

SEQ ID NO: 162302 - RNA, 46 nt, Homo sapiens
ugagcucugcaccauacgccuaaagggugaccuaaugcugaguucu

SEQ ID NO: 162303 - RNA, 42 nt, Homo sapiens
uaccuuuuccuggggaaaacaaaaagucccgucuaucuagau

SEQ ID NO: 162304 - RNA, 47 nt, Homo sapiens
cccucugacccuagguacauuuggcuaaccugagacauuuacccaua

SEQ ID NO: 162305 - RNA, 49 nt, Homo sapiens
acagauaacucagggggaaaacaaagaaaacgcagacaugaauaaaaau

SEQ ID NO: 162306 - RNA, 43 nt, Homo sapiens
ccuaaucuucugaguugcacuuucguuaaauggaugccaggau

SEQ ID NO: 162307 - RNA, 45 nt, Homo sapiens
cauagaacugaguuaagagguacauuucauauucuauaucuggaa

SEQ ID NO: 162308 - RNA, 48 nt, Homo sapiens
cacauauauaguaaaaugauacaaaaaguuugaaaaucuaauaucauu

SEQ ID NO: 162309 - RNA, 93 nt, Homo sapiens
uguuauuccaagaaaaaguaagacugaaucaguaaaauggaaacaucuuggugagguuacagaauuucaaggcuaaacauugaauccuauaua

SEQ ID NO: 162310 - RNA, 94 nt, Homo sapiens
gguuucguagaaguagacagcaaaacaaaacaaagcaaaacaaaauaugcuuaaaucugugguagaaaauacuuaguugaaauaaaagaguauc

SEQ ID NO: 162311 - RNA, 83 nt, Homo sapiens
gacacagaagaaaauuauauacaacaauuaacagagauucuaugaaagaagagaucaaagacaagaugacaagacaucagcac

SEQ ID NO: 162312 - RNA, 44 nt, Homo sapiens
aaacauguuuggaagacugaaaguugcugacaaagguauacaca

SEQ ID NO: 162313 - RNA, 45 nt, Homo sapiens
acaaucuccuuguucugcuacaaaggagauuaaaggguuaugaga

SEQ ID NO: 162314 - RNA, 46 nt, Homo sapiens
acgguaguauuggguaucucccggcuugcagcauucauggucagau

SEQ ID NO: 162315 - RNA, 39 nt, Homo sapiens
caucugaggguaagacaugggcgaaaacuuggaagcuga

SEQ ID NO: 162316 - RNA, 42 nt, Homo sapiens
ggauguuuucuaugugacgagagaugcuacgucgaugcaugg

SEQ ID NO: 162317 - RNA, 46 nt, Homo sapiens
uggcccagggguggaaugcuugguagugauuagugaugucccagau

SEQ ID NO: 162318 - RNA, 47 nt, Homo sapiens
aaguuguuauacucagauuggcauaccgugcacugguauggggugga

SEQ ID NO: 162319 - RNA, 42 nt, Homo sapiens
cuucaguggucaucucgggcucgagggggacuggcagcuucg

SEQ ID NO: 162320 - RNA, 25 nt, Homo sapiens
cguguacccuuagagaaagggcaga

SEQ ID NO: 162321 - RNA, 45 nt, Homo sapiens
cggcuguuauaggaggacuugaaggagcagaguuugcaucggaau

SEQ ID NO: 162322 - RNA, 43 nt, Homo sapiens
agccccacucagucacucaaagcaaugucauggaggccaaggu

SEQ ID NO: 162323 - RNA, 42 nt, Homo sapiens
ugcagugugggaaaccuuaacugugagccaauagccccacag

SEQ ID NO: 162324 - RNA, 45 nt, Homo sapiens
ggcaggaacauaucauuuccugagccuaaacagaaacggacugaa

SEQ ID NO: 162325 - RNA, 51 nt, Homo sapiens
auagagauuauucuggguagggagaggcuggcaugaugggugacccuuaca

SEQ ID NO: 162326 - RNA, 23 nt, Homo sapiens
guuuguuuuuucugccacuguag

SEQ ID NO: 162327 - RNA, 45 nt, Homo sapiens
agcuacauaaaauuccuguuuguucaugaagcauggccugaagag

SEQ ID NO: 162328 - RNA, 46 nt, Homo sapiens
caaucauguugcgcuuguauuuggugugauagaggcagagaggaca

SEQ ID NO: 162329 - RNA, 49 nt, Homo sapiens
uuccauugaguuugcaugaacaugggugaguaugucacaaauguauugg

SEQ ID NO: 162330 - RNA, 35 nt, Homo sapiens
acgccguauuuuauuuauccauccauuuuauguga

SEQ ID NO: 162331 - RNA, 42 nt, Homo sapiens
gcaguuuauuaucauuuccccaaaggcccacaacaaagggag

SEQ ID NO: 162332 - RNA, 24 nt, Homo sapiens
ggagggcaggaugagacuaaccuc

SEQ ID NO: 162333 - RNA, 43 nt, Homo sapiens
aaaaggagaaacuugguuccucaccauugccucuccucccacg

SEQ ID NO: 162334 - RNA, 23 nt, Homo sapiens
caaaugaaacuuccaugaugaag

SEQ ID NO: 162335 - RNA, 45 nt, Homo sapiens
aagaaguaaaccagguauauuaccugacuuaggucauaaauguug

SEQ ID NO: 162336 - RNA, 46 nt, Homo sapiens
cagaaaaguaggcgccgguuugcuguucucuccagugaucccggag

SEQ ID NO: 162337 - RNA, 42 nt, Homo sapiens
uuguguagguuuugccgcagcccgcguaaucacaaguguggg

SEQ ID NO: 162338 - RNA, 45 nt, Homo sapiens
cggcugcaucugaucgggcaggaaggauggguaauugggccccgg

SEQ ID NO: 162339 - RNA, 47 nt, Homo sapiens
ccuuugcugacgcugaugaccgacgggcugccguacucgcugccagg

SEQ ID NO: 162340 - RNA, 44 nt, Homo sapiens
gccacgaagccgcccgaggggcucacgucguugauguccgccag

SEQ ID NO: 162341 - RNA, 46 nt, Homo sapiens
uagaggaggccuccgcccgugccgcccggcgccacgcccgggucgu

SEQ ID NO: 162342 - RNA, 41 nt, Homo sapiens
gaagaggaggcugacgcugacgaggacacgguggcggccac

SEQ ID NO: 162343 - RNA, 35 nt, Homo sapiens
aagagaagaaacgaagccaaaacccaaaaccccaa

SEQ ID NO: 162344 - RNA, 47 nt, Homo sapiens
uguucuuucacuugggcuguuugagagcauaauuaugguaaucauga

SEQ ID NO: 162345 - RNA, 104 nt, Homo sapiens
gaacuggaaagaguaaaaugauaacuuaccuuagcauugccaagaacuucagcagacaacaagcaauucuauuuauuuuauguuguguauacaucuugaucauu

SEQ ID NO: 162346 - RNA, 48 nt, Homo sapiens
agaacccaguggaagcugagccugcuagacugagugacugcaguuagg

SEQ ID NO: 162347 - RNA, 45 nt, Homo sapiens
aagaagcacagccucaaagaaggcaguccgcuggaggaccuggcc

SEQ ID NO: 162348 - RNA, 46 nt, Homo sapiens
accucaugcucaaacuauuuuccauucugcaucuccagcccagaaa

SEQ ID NO: 162349 - RNA, 47 nt, Homo sapiens
accucuuucuuuuugcugaauuuuaacccuccuucacugcuccccgc

SEQ ID NO: 162350 - RNA, 41 nt, Homo sapiens
guuuuguuuucuaaacacuguuaggaaaugcucccucugau

SEQ ID NO: 162351 - RNA, 46 nt, Homo sapiens
cucauguaaagaagacaaccccagaacuggaaauuguacugcaaaa

SEQ ID NO: 162352 - RNA, 45 nt, Homo sapiens
agugaguuguagacaucaguccacucuaccaccuguacuucuccu

SEQ ID NO: 162353 - RNA, 292 nt, Homo sapiens
gguuuguaggauauuggcugcauuuugucuucuguuccaugcccuaucuaucucuguguguguggcguguauguguguguggcguguauguguguguggcguguauguguguguggcguguauguguguguggcguguauguguguguggcguguauguguguguggcguguauguguguguggcguguauguguguguggcguguauguguguguggcguguauguguguguggcguguauguguguguggcguguauguguguguggcguguauguguguguguguuccu

SEQ ID NO: 162354 - RNA, 37 nt, Homo sapiens
ugaugugugugcugagaugugaagaaaaagaaggcuc

SEQ ID NO: 162355 - RNA, 54 nt, Homo sapiens
aagccacaccuuauucaucuauaaaaugggaaaaucaguaucugucuaucaggg

SEQ ID NO: 162356 - RNA, 45 nt, Homo sapiens
guucgguuuccuuauccaugcacccagaccgaauuggccaugauu

SEQ ID NO: 162357 - RNA, 46 nt, Homo sapiens
uauuacagcuggcugauggccagauauuuaaguaccuuugggguga

SEQ ID NO: 162358 - RNA, 75 nt, Homo sapiens
cuccacauguuaagcaaauggaguuagguuuuugucuuuuaugagcauacaacuuuugacuucuauugaucaagg

SEQ ID NO: 162359 - RNA, 36 nt, Homo sapiens
agaauaaugaagaucaagauguaaacccgcugaaac

SEQ ID NO: 162360 - RNA, 48 nt, Homo sapiens
cuacugcaagugacauaccugccagagccugguuugaaugcugguaag

SEQ ID NO: 162361 - RNA, 45 nt, Homo sapiens
gagcgugggagauaauucaagugacuuguccaauguggcugucau

SEQ ID NO: 162362 - RNA, 46 nt, Homo sapiens
gacccugugaccccauaccggcugcauguucucugucagggcuggc

SEQ ID NO: 162363 - RNA, 50 nt, Homo sapiens
ugcucuggaaugcagauuccucugugcuugcagucuggcuggaagaccuu

SEQ ID NO: 162364 - RNA, 47 nt, Homo sapiens
aucuuaagugguuuguauaccauuaagauucuugcugaagugagaac

SEQ ID NO: 162365 - RNA, 53 nt, Homo sapiens
ccaccaguaucugaaugguauuauaugauagagcagaagagaaauguauuuga

SEQ ID NO: 162366 - RNA, 56 nt, Homo sapiens
auuccuaacucuuaaaaggcugugguuuuaaggcaggguauauaugaagccauugu

SEQ ID NO: 162367 - RNA, 59 nt, Homo sapiens
agaauuagaagaguccuuugaggccauuugguccauccuccuaccugguggacacaaau

SEQ ID NO: 162368 - RNA, 58 nt, Homo sapiens
gaaauauauugcaguuaaacaacaauaaaaaauuuuuaucuuauuaaaauuaaggaaa

SEQ ID NO: 162369 - RNA, 51 nt, Homo sapiens
aaccucuuaaaaaacaucuguaucuaguggucugaggcuuguuugauucug

SEQ ID NO: 162370 - RNA, 68 nt, Homo sapiens
uauugacugcuggucaauuuauugagaggcguuagaggaccugaguaauugccaaugacuaacuucau

SEQ ID NO: 162371 - RNA, 51 nt, Homo sapiens
uguguucuaacuuuuggcuccaccauuagggagggucucaaucucuaaguc

SEQ ID NO: 162372 - RNA, 46 nt, Homo sapiens
aaggguuguguuguuucagcaacucugccuaauaguuuauauaaga

SEQ ID NO: 162373 - RNA, 46 nt, Homo sapiens
aguuuugcaaaucccugcuguaaccgcaucauuucuugucuuccau

SEQ ID NO: 162374 - RNA, 76 nt, Homo sapiens
guuuuagggagaagaaaagaagaaagauggaauagaaggcugguuuuuguuacuacgauuagauccaaucugcauu

SEQ ID NO: 162375 - RNA, 60 nt, Homo sapiens
aaggccuacugaugccucuccaggucugaggguuuaaggucacuuagauaguuauuaccc

SEQ ID NO: 162376 - RNA, 52 nt, Homo sapiens
gauuuugagccaauccuggagcagcagauccaucaggaugauuuuggugaaa

SEQ ID NO: 162377 - RNA, 82 nt, Homo sapiens
auggcaaauuuguuacaugaaaacaaaaucauuuuuguuuguguuucucuaaggucaacagacccugauuaugaugacaaaa

SEQ ID NO: 162378 - RNA, 43 nt, Homo sapiens
auauuuagagguaucuuggggacaaggaguguugaaguuagug

SEQ ID NO: 162379 - RNA, 39 nt, Homo sapiens
uauguguguguguauauauauauaaaacguagagugauu

SEQ ID NO: 162380 - RNA, 42 nt, Homo sapiens
guguagccagugguaucucuguuaugaguuggaguccugacc

SEQ ID NO: 162381 - RNA, 47 nt, Homo sapiens
uccauuuaguacaaucauaaaccuuuacuugcaguucauggugggaa

SEQ ID NO: 162382 - RNA, 37 nt, Homo sapiens
auuacuucauuaguugugaucuccuuaacauugauua

SEQ ID NO: 162383 - RNA, 46 nt, Homo sapiens
gacggugcucauugguucagaacauggccugauagaaguagacccu

SEQ ID NO: 162384 - RNA, 52 nt, Homo sapiens
uuacauaacucuuugaaaauguaucaucccuggguucucaggugaaggaggc

SEQ ID NO: 162385 - RNA, 32 nt, Homo sapiens
gcuccaucauuuugugguauaaacuuagggga

SEQ ID NO: 162386 - RNA, 46 nt, Homo sapiens
acuaaugugcaaauacaguggugauauauugauauuacauuuuaau

SEQ ID NO: 162387 - RNA, 26 nt, Homo sapiens
gguugagcagcuuuuggcaaaaugug

SEQ ID NO: 162388 - RNA, 45 nt, Homo sapiens
uagagucagaaauucugugcuagaaugggacuucuaaaauuaggu

SEQ ID NO: 162389 - RNA, 51 nt, Homo sapiens
cuuaguuauuguuaaaauugcaagguuucuucacacccucuuugauaagaa

SEQ ID NO: 162390 - RNA, 36 nt, Homo sapiens
ggacacaacuacagggaaagaugcugcaggagaagc

SEQ ID NO: 162391 - RNA, 28 nt, Homo sapiens
gaaaccacaccuggggacuggaaaugag

SEQ ID NO: 162392 - RNA, 46 nt, Homo sapiens
ccaucacguuugcaaagcugccucaaaauuuggacaaaaaccgaua

SEQ ID NO: 162393 - RNA, 47 nt, Homo sapiens
aaacgaaaaucagagaggcugagggacuugcccaguggcacacaacu

SEQ ID NO: 162394 - RNA, 55 nt, Homo sapiens
uauacaggacaugagcccccagcucccaguuccucccaggcccagcgcagcccac

SEQ ID NO: 162395 - RNA, 57 nt, Homo sapiens
cuuacaaaagcuuucaccuuugcaagacagauaaauacucaccucuagcuggcaaau

SEQ ID NO: 162396 - RNA, 42 nt, Homo sapiens
aauggugacagcuacuuagucuugauccguaucacaccagau

SEQ ID NO: 162397 - RNA, 44 nt, Homo sapiens
agcuuuucaaaccacaagcacaucuagaaauacaaagcaggagu

SEQ ID NO: 162398 - RNA, 73 nt, Homo sapiens
ccauucuagaauguucuaccaaggucuuuguaugauccuagagaauaguaaaauuccuucauuuccccaaagu

SEQ ID NO: 162399 - RNA, 34 nt, Homo sapiens
ugauaguuuuuuuaaaaagauuauggugauauaa

SEQ ID NO: 162400 - RNA, 46 nt, Homo sapiens
cauacaucauccaggcuaucuuuccgauagucacuuuauacccgau

SEQ ID NO: 162401 - RNA, 46 nt, Homo sapiens
uugcagaaugauaccagggaugggacuguuaacugguaugauggau

SEQ ID NO: 162402 - RNA, 37 nt, Homo sapiens
uugccuguuguaaacaguaaauucuauuuagaguaaa

SEQ ID NO: 162403 - RNA, 47 nt, Homo sapiens
aacuacacacccugcucuggucucagaacaggcaaaauagcaagaga

SEQ ID NO: 162404 - RNA, 23 nt, Homo sapiens
acaaagauaguaucauugugcac

SEQ ID NO: 162405 - RNA, 46 nt, Homo sapiens
gcuugucuucucagugaaucagcaaguacaggaaauaugugaacca

SEQ ID NO: 162406 - RNA, 47 nt, Homo sapiens
aaaaguuuuagaagagggggaggggaggugaacaagcaucccaaggc

SEQ ID NO: 162407 - RNA, 57 nt, Homo sapiens
uggacaagagagacagggagauagacaaacacaaacaccucauacuuuccaacagca

SEQ ID NO: 162408 - RNA, 50 nt, Homo sapiens
aaggaaaaggaaggaggauggccuuacuuagcccgaugugagagccaggg

SEQ ID NO: 162409 - RNA, 75 nt, Homo sapiens
agaugcuuccagaucagcccucuaggauccgccccagcugugggaaagaaggggaagggugagaguaggcagcuc

SEQ ID NO: 162410 - RNA, 46 nt, Homo sapiens
uuccugcaaagucugccuguuaaaguagaauuugcaguuuuccaaa

SEQ ID NO: 162411 - RNA, 51 nt, Homo sapiens
aaguggauacauaaaacuuuaagaaauggaacauucauauaucuguaaguc

SEQ ID NO: 162412 - RNA, 70 nt, Homo sapiens
ugggaaaaggggacugcgccacggagaagggcuucuauacugcaaaaaggauuuuugaaauaagcugaac

SEQ ID NO: 162413 - RNA, 25 nt, Homo sapiens
uuguugcuuguuggggccaugguug

SEQ ID NO: 162414 - RNA, 57 nt, Homo sapiens
auuagagguggccaggaguuggaggaggggugaauggggaguuauugccuaaugggu

SEQ ID NO: 162415 - RNA, 22 nt, Homo sapiens
auuuuaaaaagcuauagauaga

SEQ ID NO: 162416 - RNA, 31 nt, Homo sapiens
aggagacuggcaaggguacauugggcuuucc

SEQ ID NO: 162417 - RNA, 35 nt, Homo sapiens
cugaccaauuucuaauagaauuuaagagccagggu

SEQ ID NO: 162418 - RNA, 76 nt, Homo sapiens
ugugccugccacaccggccuuuugucagcucucaccucacuaugguaccugucugccacaaggacuggcagagucu

SEQ ID NO: 162419 - RNA, 48 nt, Homo sapiens
uccugugggucucagcuccaugauugcagagccuuugcucaccuuccu

SEQ ID NO: 162420 - RNA, 50 nt, Homo sapiens
aggacugugcaggggccauggcugccugaaugcugugcugaugagggucc

SEQ ID NO: 162421 - RNA, 48 nt, Homo sapiens
uuugauauggaugacuuuccggaugauuaaaucaagaugugaaguaua

SEQ ID NO: 162422 - RNA, 100 nt, Homo sapiens
aagaacgucccacagagggaaaggcgggcgccaauguccugagguuagugaaguucgaguguuugauggacagaaaggcgcucuaggauccgcaggaagg

SEQ ID NO: 162423 - RNA, 51 nt, Homo sapiens
gaaaauggauaaaucacuguuaaaugcuaugaagaaaacagaguacacgga

SEQ ID NO: 162424 - RNA, 68 nt, Homo sapiens
agagagacccucacugcuggggagucccugccacacucagucccccaccacacugaaucuccccuccu

SEQ ID NO: 162425 - RNA, 46 nt, Homo sapiens
aucccacaagcuugccccuaugauguacuugaugacugguguccug

SEQ ID NO: 162426 - RNA, 50 nt, Homo sapiens
ccuguuaucacaggaggcccuggaggugacaaugugcagagcaagagugg

SEQ ID NO: 162427 - RNA, 44 nt, Homo sapiens
caggaccuggggaggggagagagagggagggggcagugagggag

SEQ ID NO: 162428 - RNA, 39 nt, Homo sapiens
aagggggaaggagaaagaugaaggggaagaggagguagg

SEQ ID NO: 162429 - RNA, 143 nt, Homo sapiens
aagaggagaaggaaaugucagaggaaagaaggggcagcgaagggggaaagacuggaggaaggaggugauagugacaagcggggauuaauggggcgagagaagaaagagagggaggaagauggagacaggcaggaggaggcagg

SEQ ID NO: 162430 - RNA, 50 nt, Homo sapiens
gagucagucuccuucggauaauuccaaucgucuuccuuuuacagguggau

SEQ ID NO: 162431 - RNA, 59 nt, Homo sapiens
uggugguguucuuugaaaaaccaagugggaaaaaguaaagauuaaucuguagcaugcau

SEQ ID NO: 162432 - RNA, 92 nt, Homo sapiens
gaaagcagcguuacugaagaaaacacuugaaaaucuggaauaaauuagaaggggaagaaacaaacaagugccauguucauuggggguugaag

SEQ ID NO: 162433 - RNA, 66 nt, Homo sapiens
augcagagugcuccuaauugagucuuuagcuacuauggagccagacagcagaccugaacugcagga

SEQ ID NO: 162434 - RNA, 45 nt, Homo sapiens
gugagaacagaagcuuuaucugugauagaauugcugcuuaaaaaa

SEQ ID NO: 162435 - RNA, 57 nt, Homo sapiens
acaugccgauccugaggcuuuggcugaaauucugcuugaaacuuguaaaucaaucac

SEQ ID NO: 162436 - RNA, 64 nt, Homo sapiens
agugaauauuugugaacaauuauauugcaccuuugugggggcaguuucugaucaaggaaauuug

SEQ ID NO: 162437 - RNA, 84 nt, Homo sapiens
acucacuugaaagcagugggguccggacaaccaaaaaugaagaggagaaugaaaaggaaaaggagcuccagcuggaauaucugc

SEQ ID NO: 162438 - RNA, 40 nt, Homo sapiens
ucauuuuuaaaaguugggcacuggucccccccccaaaaaa

SEQ ID NO: 162439 - RNA, 45 nt, Homo sapiens
guagcaaucagcugugcagcugauaucuugaaggccaccaaagag

SEQ ID NO: 162440 - RNA, 114 nt, Homo sapiens
gauucugacuucaucuuucauuuugcauaauaguaacgaucugguuuuguguaacuuuuccaauggauuauuuuugugaacuagauuuccuagacaguggaagcuuuggguaaa

SEQ ID NO: 162441 - RNA, 47 nt, Homo sapiens
uacugaccgcauugcugcaaggccuggcuggaagaacgugggcagga

SEQ ID NO: 162442 - RNA, 49 nt, Homo sapiens
gccucuggcauuuuuaggcaugcaugaaauugcugaugaggagaaaucc

SEQ ID NO: 162443 - RNA, 46 nt, Homo sapiens
cucuugugcuuugacuauucaugcuauuggacgauacagcccugau

SEQ ID NO: 162444 - RNA, 42 nt, Homo sapiens
gguagguaaacuuaugagugcuuugcugaguggccugacaga

SEQ ID NO: 162445 - RNA, 33 nt, Homo sapiens
uuucaagaucuuugaaggaucagacaccccccu

SEQ ID NO: 162446 - RNA, 51 nt, Homo sapiens
cuugaugugucagugcugggcgagcuaguuccuagguugugugaacugauc

SEQ ID NO: 162447 - RNA, 40 nt, Homo sapiens
ucaacuguuaauagcuaaauuuuuuaaggucaaaauaggu

SEQ ID NO: 162448 - RNA, 48 nt, Homo sapiens
gcuguuuuggggugaggggaugagaacucgaauuagaggcagaaucug

SEQ ID NO: 162449 - RNA, 46 nt, Homo sapiens
auucuucaagauuugguuaagaaccuuacaagcaauauguggcgag

SEQ ID NO: 162450 - RNA, 47 nt, Homo sapiens
ggaagaugauucuagccuugaaggaauaaagucagaagugcuugaga

SEQ ID NO: 162451 - RNA, 39 nt, Homo sapiens
gguuucugacuuuauguuuuauauauuaugauuucaagu

SEQ ID NO: 162452 - RNA, 47 nt, Homo sapiens
aauaggaacuaguucuguggcugcccgagaugccuggcaaaugacug

SEQ ID NO: 162453 - RNA, 26 nt, Homo sapiens
ugcaguuuugcaugcugugagauuuu

SEQ ID NO: 162454 - RNA, 39 nt, Homo sapiens
ucuagcauuaauacuuacaauaagaagaagauacaaagu

SEQ ID NO: 162455 - RNA, 38 nt, Homo sapiens
cuuuggauuguuaauguugauucuggugcucuguugcu

SEQ ID NO: 162456 - RNA, 46 nt, Homo sapiens
aaauuugccaguacgguguuucccucagaucauaucccuuccagau

SEQ ID NO: 162457 - RNA, 46 nt, Homo sapiens
aggugguguaugauggacuuuuugguacaaauacaaauucaaaguu

SEQ ID NO: 162458 - RNA, 46 nt, Homo sapiens
agaauauuggccugucugcaacuuuuaugucuauuuaauuagagaa

SEQ ID NO: 162459 - RNA, 30 nt, Homo sapiens
auaucaaagccaugucaccagaugacuaac

SEQ ID NO: 162460 - RNA, 46 nt, Homo sapiens
cuguugaaucaucaaaaucagcuucuccauuuaaucuugcugagaa

SEQ ID NO: 162461 - RNA, 416 nt, Homo sapiens
ucuggaauugauuuucuuuuuguuugaugauaugguuuggcucuguguccccguccaaaucucaucuuguagcucccauaauucccaugugcugugggagggaugcagugggagaugauugaaucaugggagugagucuuucccaugcuguucucgugauagcgagugggucuuaggagaucugaugguuucagaaacgggaguuugccuguacaagcugucccuuugccugcugccauccauguuaagaugugacuugcuccuccuugccuucugccaugauugaaaggcuucccuauccacauggaacuguaguucuccauuaaaccucuuuccuuugugaauucucuagucuuggauaugucuuuaucagcaucaugaaaacggacuaauagauauggugugagguagggauu

SEQ ID NO: 162462 - RNA, 46 nt, Homo sapiens
auacccuaucccauaaauaucauguaaucugugaauacugacaguu

SEQ ID NO: 162463 - RNA, 44 nt, Homo sapiens
agcgguguuugagaugguguuggcucuaucagccgacuguagug

SEQ ID NO: 162464 - RNA, 37 nt, Homo sapiens
agggcuucugucuugucaccuggcccagucuugccaa

SEQ ID NO: 162465 - RNA, 46 nt, Homo sapiens
caaaucuuuauuccuugggcguuuagagaaaugaaaaauugggaga

SEQ ID NO: 162466 - RNA, 69 nt, Homo sapiens
aaccuugguucugaagcuagggagacagugugggaaugauucccaugguagagcugugggaaugggcau

SEQ ID NO: 162467 - RNA, 355 nt, Homo sapiens
cuguaaaaugagauaauaaaacuuacaagauuuuuuucuuuucuuuucuuuuuuauugagacagggucucucucugucacccaggcugaaguacaguggugugauuucggcucacugcagccacaauuuccuggucucaauccaucuucugaccucagccuccugaguagcugggacugcaggcggguaccaccaucccuggcuaauuuuuguauuuucuguagagacgggguuuggcuauguugcccaggcuggucucaaauuccuguacucaagcaaucugcccuccucggccucucagagugcugggauuacaggcgugagccaccgugccuggccaggauuguuuuaagaa

SEQ ID NO: 162468 - RNA, 78 nt, Homo sapiens
guuagagaugaaucuaaaucugaccugagacuagaagguggaggaguaacagagaguguagccucuagacagauuuag

SEQ ID NO: 162469 - RNA, 113 nt, Homo sapiens
agaaacuuagggucugaguugggacaguggaaguggauuuggcaaggaguuaauauaauguaaaaucccuaaaauagggagaaauuguuggcugacgagaugaggguuguuga

SEQ ID NO: 162470 - RNA, 79 nt, Homo sapiens
uugguguaacacugauugcaaggauccggagaucaagagcagcaagacuaauuaggaggguaucacaauggccaaguaa

SEQ ID NO: 162471 - RNA, 50 nt, Homo sapiens
cuaguuuggacuuuguucuguagacaguagagaaccaucagagcuuuuaa

SEQ ID NO: 162472 - RNA, 42 nt, Homo sapiens
uaagucuguuaugaugggaaugggggugcuacggcuguguga

SEQ ID NO: 162473 - RNA, 41 nt, Homo sapiens
ugaggcuaaaggaaaaauagcuugagcugagacuuggagau

SEQ ID NO: 162474 - RNA, 44 nt, Homo sapiens
gauuauaacuauugcaaaugaaaugaaauucaaugcaagacaug

SEQ ID NO: 162475 - RNA, 78 nt, Homo sapiens
ugaagcugaaguaaacacuuggugugauccugagcagauuggagagucggaggagacaaggucucauggugcgauuag

SEQ ID NO: 162476 - RNA, 67 nt, Homo sapiens
gccggucgaaccgcaggagaaaccacggggugacagcgcuuucagaaaggagaguuagugcccccuc

SEQ ID NO: 162477 - RNA, 59 nt, Homo sapiens
aggugccuuuuugugacacucuaguaaucagccgaaaggucacgaauaggcggugaccc

SEQ ID NO: 162478 - RNA, 42 nt, Homo sapiens
uguuuccccaggucgggcccagccaacgugacagccgcagac

SEQ ID NO: 162479 - RNA, 63 nt, Homo sapiens
agccucugguucuccaaggaagauaaaaacaugcuaccaaaauacacagacauaaauacugga

SEQ ID NO: 162480 - RNA, 41 nt, Homo sapiens
uguaaaauagaaaaggaaaaggcaauauagggaaacaaugu

SEQ ID NO: 162481 - RNA, 46 nt, Homo sapiens
cuguuuagguagguggagaguuuucaaacacuguuaucggccagau

SEQ ID NO: 162482 - RNA, 97 nt, Homo sapiens
uuucauggauauauuccauuuguuugaaugucugacacucugauuuuccaaaaugguuuguucagaacuuggucaacaggaagauauuugaugcaug

SEQ ID NO: 162483 - RNA, 42 nt, Homo sapiens
agccaaaagauugaaggaaggugauacaaugauggggcagca

SEQ ID NO: 162484 - RNA, 23 nt, Homo sapiens
cuaaaagaaaaaaaaagaguacc

SEQ ID NO: 162485 - RNA, 46 nt, Homo sapiens
uggagauguaauggcuguuuguuuggauuguauccuccggcuguaa

SEQ ID NO: 162486 - RNA, 37 nt, Homo sapiens
ugaguuccaguggcucuggaauaaaaacgggaugcag

SEQ ID NO: 162487 - RNA, 73 nt, Homo sapiens
guuuuuuuuuuuaggugguggugguuaaaaaauaaguacacuaacaugacuuaaauacaguugguaagacaag

SEQ ID NO: 162488 - RNA, 45 nt, Homo sapiens
gugcauggagaaauggaggaaaaccaaaaaaaaagaagugugggu

SEQ ID NO: 162489 - RNA, 43 nt, Homo sapiens
ugugcucaauacaaggccuaaugcccugcaucaucauuuuuga

SEQ ID NO: 162490 - RNA, 26 nt, Homo sapiens
ugauaucuacguucuguagaacagag

SEQ ID NO: 162491 - RNA, 46 nt, Homo sapiens
auuaugauuacaugcuggaucauccagaagaguacuacagccauua

SEQ ID NO: 162492 - RNA, 46 nt, Homo sapiens
gaauagcuacaauaaggcaaucagcuaccuagccacagugcccaag

SEQ ID NO: 162493 - RNA, 45 nt, Homo sapiens
ugucgguggaucuauaauuuuaacaucaaaggcaaagaauaugga

SEQ ID NO: 162494 - RNA, 45 nt, Homo sapiens
cguaaaucuaugaagaugucaaagucucaauuugauagucuagaa

SEQ ID NO: 162495 - RNA, 46 nt, Homo sapiens
aagcaagaacaagaggaagaauuaaagaaaaaguuggcaaaugacc

SEQ ID NO: 162496 - RNA, 46 nt, Homo sapiens
ccgcuuccacccggcucuccgcgggacgcguaagggcuggggagca

SEQ ID NO: 162497 - RNA, 71 nt, Homo sapiens
gcaauuccaccucguuucugggguccuugugggacauuccuuccuacucuugggagucagguccccauagc

SEQ ID NO: 162498 - RNA, 52 nt, Homo sapiens
cccccucacaauucucuauuguuuccuggcauuuggugcuauagagcagaag

SEQ ID NO: 162499 - RNA, 51 nt, Homo sapiens
ccaucagcgagcacaagucccauuucaacagcaauaaaugcaacaaguauu

SEQ ID NO: 162500 - RNA, 55 nt, Homo sapiens
cugaacaaucuauaaacugucucauuaaguugucucaguuauuugcuucacuucg

SEQ ID NO: 162501 - RNA, 31 nt, Homo sapiens
auguauuuuuuuuuacugugaguuauggcaa

SEQ ID NO: 162502 - RNA, 43 nt, Homo sapiens
cuuaaugguuuaacaggauugaccagcauuuuuuccgaaaaaa

SEQ ID NO: 162503 - RNA, 69 nt, Homo sapiens
uauucuuucuggacuuauaacuacuucccccuuuuucacuuuaaaacaaaccucaagaauaaauuacua

SEQ ID NO: 162504 - RNA, 45 nt, Homo sapiens
gaagcugaaaauccagcccaguauuaaguauuugacaaaggccau

SEQ ID NO: 162505 - RNA, 44 nt, Homo sapiens
uauagaucacuuguugccagaucuugagauauauuucaagagaa

SEQ ID NO: 162506 - RNA, 85 nt, Homo sapiens
aucagaaacucaaauucuuacagauaauguaaacaaggugauaaggauuguaaugagcuggagagugcccagcuaaaggggacaa

SEQ ID NO: 162507 - RNA, 53 nt, Homo sapiens
uggaaaaugugcuuuccucccauauucauucuucuggccuaaugauuccaguc

SEQ ID NO: 162508 - RNA, 63 nt, Homo sapiens
gagucugcuauuacuagaguuugaugacauagcaugggugggcagagaggggaaaaugggaga

SEQ ID NO: 162509 - RNA, 46 nt, Homo sapiens
auugugaagugcugaccaauugccacuggacauacuugaaacaaaa

SEQ ID NO: 162510 - RNA, 44 nt, Homo sapiens
uuuacacuucagaguucugugucuuuuugcuauuaaggauguaa

SEQ ID NO: 162511 - RNA, 44 nt, Homo sapiens
ucaucaguagcccuugggcaucaauuuauuguuuuacagugaaa

SEQ ID NO: 162512 - RNA, 50 nt, Homo sapiens
aagcaggcugaguaaguggaaaaugcucaggaacaggaggucuuuacagg

SEQ ID NO: 162513 - RNA, 44 nt, Homo sapiens
gagcucugggauacaggagcagagagacuucgcuacagaaccaa

SEQ ID NO: 162514 - RNA, 49 nt, Homo sapiens
ccugauuugaaagguauugauguggguggugacacaacaggaucagcag

SEQ ID NO: 162515 - RNA, 58 nt, Homo sapiens
agggcagacugagacuggauuccucguccuuugauucaggacauagugagcuaguggg

SEQ ID NO: 162516 - RNA, 56 nt, Homo sapiens
ccucgaggaaaguccccuuucuagaguccaccuguauucuacgcggaugaggugca

SEQ ID NO: 162517 - RNA, 77 nt, Homo sapiens
gaugcaacuggaaucuaagcacuagaaccggaacuggaacuagaaucuaaggacuagcacuagaacuguugcaguag

SEQ ID NO: 162518 - RNA, 93 nt, Homo sapiens
uccuaaaaucaauagccuuuuuggugauuggaacaucacgaacaugcauacgcagauuaucacuguagaaacacagcugcugauucucauuag

SEQ ID NO: 162519 - RNA, 46 nt, Homo sapiens
aguuagcggacuggaagugcgucaaggcuacaaaaggauccuguaa

SEQ ID NO: 162520 - RNA, 42 nt, Homo sapiens
uacacuugaucuucuuuguacagaagggugggagugggcaag

SEQ ID NO: 162521 - RNA, 24 nt, Homo sapiens
gaagaagcauuauuuauagucaga

SEQ ID NO: 162522 - RNA, 51 nt, Homo sapiens
gaugauucugauccaggugguccuuggaccacacuuugagaagcacuugag

SEQ ID NO: 162523 - RNA, 154 nt, Homo sapiens
cuuaaguugugccccucaaaccauuuuaugcccagaaauuagaugauucuucucaucuuccuaaaguuuuaacagaugccauucuggauccuggaaaauuaaacagcuguagccauaaggauuuaaucuauaaagauuuuuuuccuucuguaaa

SEQ ID NO: 162524 - RNA, 41 nt, Homo sapiens
ucaucuccuuugcugaguuugaacagcuugauaagcuggag

SEQ ID NO: 162525 - RNA, 42 nt, Homo sapiens
gaguuaucgucccuuuuugcuaaaauagauauuuuuagccaa

SEQ ID NO: 162526 - RNA, 310 nt, Homo sapiens
uauuaagcauaccuauuaaaggaacuauacugguggggcacaguggcuuacaccuguaaucccaacacuuugggaggccaaggcaagaggauugcuugagcucaggaguucgagaccugccugggcaacacgagaccucaucuguacgauaaaacaaaaaauuagcugagcgugguaguggugcaggccugugauuccaccuacucaggaggcugagguugaggcuguggugaguugcacuccagccugggugauggagcaagacccugucucaaaaaaaaaggaacaauucugcagaauaaggaagggu

SEQ ID NO: 162527 - RNA, 46 nt, Homo sapiens
aauguggaacuacuguuuuccgguuuggugaucaauacagcuggag

SEQ ID NO: 162528 - RNA, 66 nt, Homo sapiens
uuuacuuauuugauaaguuauuaguccuggacauaagacuaacucaaauuaaguaccacaaaauaa

SEQ ID NO: 162529 - RNA, 49 nt, Homo sapiens
cuuagguaccagaugucuguuuggagccauaaaaucaauuuguuuuggg

SEQ ID NO: 162530 - RNA, 47 nt, Homo sapiens
ugccauugacaucaaacucuauggcguggccuuaucgauugcagugg

SEQ ID NO: 162531 - RNA, 76 nt, Homo sapiens
cuccucuuugugcacguacacacacacacacacacacacacacacacaccccugcucaacagagguuuaguuuaca

SEQ ID NO: 162532 - RNA, 58 nt, Homo sapiens
uaacuucagccaggauugauggcagcugagggaaauucuugcccaacuaaacccagaa

SEQ ID NO: 162533 - RNA, 51 nt, Homo sapiens
agcucuaggcguguugguuuccgucucagcauacugaagucaacacuaagg

SEQ ID NO: 162534 - RNA, 45 nt, Homo sapiens
uuguacuaaaucaggcauuaucuucuaccagauuccaaugcagac

SEQ ID NO: 162535 - RNA, 61 nt, Homo sapiens
ccagaagcaaacacauggccugaacaaucccuggauuguaaaauaaacaacacuacaaagg

SEQ ID NO: 162536 - RNA, 40 nt, Homo sapiens
gguuucuugucugggaacagcacucaccccacaccccaaa

SEQ ID NO: 162537 - RNA, 47 nt, Homo sapiens
cuaacccaucgaguugagucaaaugcuccuacagccuccccucuguc

SEQ ID NO: 162538 - RNA, 54 nt, Homo sapiens
uacauaguaagucagcaagagcacaguuaucuaagccauggggaaagggacaag

SEQ ID NO: 162539 - RNA, 49 nt, Homo sapiens
uaauaaaucuucacucuuuaccagggaucaagucuuuguagcucacaau

SEQ ID NO: 162540 - RNA, 46 nt, Homo sapiens
ccucagaaucugggagcaaagcccuguaauuacuguauuuggucgg

SEQ ID NO: 162541 - RNA, 46 nt, Homo sapiens
acagaaguuguaucugucgggagggauaggagaauagauuggggaa

SEQ ID NO: 162542 - RNA, 709 nt, Homo sapiens
aaguauuaauuuggcugggcgugguggcucacgccuguaaucccagcacuuugggaggcugagguggguggaucaccugagaucaagaguuugagaccagccugggcaauauggagaaacuccgugucuacuaaaaauacaaaaguuagcugggcgugguggugugcgcguguagucccagcuacuugggaggcugagacaggagaaacgcuugaacccaggaggcagagguugcagugagcggagaucugucccacagcacuccagccuuggggacagagggagacgccgucucaaaaaaaaaaaaaaacaaaaaacaaaccaaaguauuaguuuauggcuuacauacuucucagauuuuuuuuuuuuuuuuugagacagagucucacucugucacucaggcuagagugcaguggcaccaucuuggcucacugcauccuccaccuccagaguucgagauuuugugccucaggcucccaaguagcugggauuacaggugccuaccaccaugcccaucucuacuaaaaauacaaaaacauauaaauuaauacauaaauaaaaaaauaaauuuuuguauuuuuaguagagacaguguuuuacuaugucggccggguucuucucaaacucucggccucccaaagugcugggauuacagauaugagcgacugcgccuugccugucucagaauuguuaauaguuaggaacagag

SEQ ID NO: 162543 - RNA, 60 nt, Homo sapiens
ggccgaagcagacaguaguaggccagaaauaauacuggagugaauguggacuugcagaaa

SEQ ID NO: 162544 - RNA, 46 nt, Homo sapiens
ucagaauauccagcauagcucagagauccuggucgaaguuugaaaa

SEQ ID NO: 162545 - RNA, 95 nt, Homo sapiens
uuaccagugauguaggcuauacuauggugcauacaauaauaguacaaaaacagaucacagaaagcauagaggaggcagggacaauuguggaaagg

SEQ ID NO: 162546 - RNA, 42 nt, Homo sapiens
cguggcaguugcagcacugaaguggagaaggagacccaggag

SEQ ID NO: 162547 - RNA, 42 nt, Homo sapiens
agaugcccucacgaauaugaagcuuagcacagcucuaguuac

SEQ ID NO: 162548 - RNA, 45 nt, Homo sapiens
uaaugguuauauguugucuuuuuuuccuaugucuuuuggcucaag

SEQ ID NO: 162549 - RNA, 51 nt, Homo sapiens
ugaagaaaggaagggauuaaauaauuuuuuucccuaacacuuucuugaagg

SEQ ID NO: 162550 - RNA, 41 nt, Homo sapiens
gucuuacuccuuggaggccaugugggccaugagguccacca

SEQ ID NO: 162551 - RNA, 89 nt, Homo sapiens
aacuaaggauuuuucaagagaucuuucuuuccaaaacauuucuggacaguaccugauuguauuuuuuuuuuaaauaaaagcacaaguac

SEQ ID NO: 162552 - RNA, 44 nt, Homo sapiens
gaagccaucccuuuuuuuacauuucauacaacagaaaccagaaa

SEQ ID NO: 162553 - RNA, 78 nt, Homo sapiens
uagaaccagccguauuuuacaugaagcuguauaauuaauugucauuauuuuuguuagcaaagauuaaaugugucauug

SEQ ID NO: 162554 - RNA, 109 nt, Homo sapiens
caacauguuucuguuuuguuguuugauucagcaaaaaucucccagugacaacaucgcaauaguuuuuuacuucucuuagguggcucugggaaugggagagggguaggau

SEQ ID NO: 162555 - RNA, 68 nt, Homo sapiens
ccauggaucccuggggccaacggcaacagcaugggccucaccuccucugugauuucuuucuuugcacc

SEQ ID NO: 162556 - RNA, 64 nt, Homo sapiens
cuucagaaaucuugaaggcaggcgcaaacgggcauaaauuccagggaccacugggugagagagg

SEQ ID NO: 162557 - RNA, 64 nt, Homo sapiens
gguuccacuggaagggccacgaacacucaauccaguuugcugagaugaagcugagaccaagcaa

SEQ ID NO: 162558 - RNA, 66 nt, Homo sapiens
gggcuuucugguacaggaacugucaccgugucaaccugauggggagauauggggacaauaaccaca

SEQ ID NO: 162559 - RNA, 67 nt, Homo sapiens
agauccuucuccaccuuugacaaggacacagauucagccaucaccaacugugcucuguccuacaaag

SEQ ID NO: 162560 - RNA, 57 nt, Homo sapiens
guucagcgugggagaugccaagacucgcuacaagcugaagguggagggguacagugg

SEQ ID NO: 162561 - RNA, 74 nt, Homo sapiens
acagcccaggggcaguacgagcuccggguggaccugcgggaccauggggagacagccuuugcugucuaugacaa

SEQ ID NO: 162562 - RNA, 66 nt, Homo sapiens
gacgcgagaacuucuaccaaaacuggaaggcauaugcugcuggauuuggggaccgcagagaagaau

SEQ ID NO: 162563 - RNA, 104 nt, Homo sapiens
cucccaagcaaugcugaauggagacacgaccucuggccucuacaccauuuaucugaauggugauaaggcugaggcgcuggaagucuucugugacaugaccucug

SEQ ID NO: 162564 - RNA, 67 nt, Homo sapiens
auccacccacuacacagccaagauccaggcacucaaugggccccugaggagcaauaugauccagacc

SEQ ID NO: 162565 - RNA, 55 nt, Homo sapiens
aggaagucauuguggguccagauaccaccuccuacagccuggcagaccugagccc

SEQ ID NO: 162566 - RNA, 62 nt, Homo sapiens
ccccgggcaucagucaccgguuaccugcuggucuaugaaucaguggauggcacagucaaggu

SEQ ID NO: 162567 - RNA, 57 nt, Homo sapiens
agagacuugacugcuacugagguucagucggaaacugcccuccuuaccuggcgaccc

SEQ ID NO: 162568 - RNA, 47 nt, Homo sapiens
cgagccugccacggaauacacacugagaaucuuugcagagaaagggc

SEQ ID NO: 162569 - RNA, 47 nt, Homo sapiens
gccauugccacuguggacaguuaugucaucuccuacacaggcgagaa

SEQ ID NO: 162570 - RNA, 67 nt, Homo sapiens
gacggaaccaagacucagaccaggcuggugaaacucauaccuggcguggaguaccuugucagcauca

SEQ ID NO: 162571 - RNA, 111 nt, Homo sapiens
aaaggaagucauuuucucagacaucacugaaaauucggcuacugucagcuggagggcacccacagcccaaguggagagcuuccggauuaccuaugugcccauuacaggagg

SEQ ID NO: 162572 - RNA, 46 nt, Homo sapiens
cuguaggaggagaugucuuagaugagagaaaaaugcagaaagagga

SEQ ID NO: 162573 - RNA, 70 nt, Homo sapiens
cucagagaggcuacugaauacgaaauugaacucuauggaauaagcaaaggaaggcgaucccagacaguca

SEQ ID NO: 162574 - RNA, 86 nt, Homo sapiens
uuuguucucaaaaucagagauaccaaaaagcagucugagccacuggaaauaacccuacuugcccccgaacguaccagggacauaac

SEQ ID NO: 162575 - RNA, 46 nt, Homo sapiens
uucacugcuuugaugguguggaggugcaaagaggccagcuaucaaa

SEQ ID NO: 162576 - RNA, 47 nt, Homo sapiens
auaucccaugucaaugcuaauggcuauauucugcuucugaaccaaau

SEQ ID NO: 162577 - RNA, 49 nt, Homo sapiens
uuuuucuuuuuuuucuugcuuuaguagccaaaccucuucuuagccaccu

SEQ ID NO: 162578 - RNA, 79 nt, Homo sapiens
guacugauuuuauugucuaccucucuggacuugcucccagcauccggaccaaaaccaucagugccacagccacgacagg

SEQ ID NO: 162579 - RNA, 32 nt, Homo sapiens
gcuucaaucucuccuggauggcuaccgauggg

SEQ ID NO: 162580 - RNA, 46 nt, Homo sapiens
uagagucuccaucuauggggugauccggggcuauagaacaccagua

SEQ ID NO: 162581 - RNA, 45 nt, Homo sapiens
gucugagguuggcugggauggccucagacucaacuggaccgcagc

SEQ ID NO: 162582 - RNA, 47 nt, Homo sapiens
agauaaacuuggugguugcuagaaacuacauaaaauuccaaaaauaa

SEQ ID NO: 162583 - RNA, 60 nt, Homo sapiens
agggccaacuuuuuggugauaggguuucugugcugagcccuaagcccaugccccacucua

SEQ ID NO: 162584 - RNA, 57 nt, Homo sapiens
accaucaccauccgcggggucacucaggacuucagcacaaccccucucucuguugaa

SEQ ID NO: 162585 - RNA, 45 nt, Homo sapiens
gcuccagaaggggccuaugaguacuuuuucauucaggugcaggag

SEQ ID NO: 162586 - RNA, 46 nt, Homo sapiens
uuaucauucaggugcaggaggccaacaagguggaggcagcucggaa

SEQ ID NO: 162587 - RNA, 34 nt, Homo sapiens
ggagaaagaguaaugacauuuccagcaaagggaa

SEQ ID NO: 162588 - RNA, 45 nt, Homo sapiens
ugccgguguauagaagagaaagaaacagcuucucuucucaagaaa

SEQ ID NO: 162589 - RNA, 53 nt, Homo sapiens
gcaucuuuucaauuguuucuuguuuauuuccuucuuuuagccuaauaauuaau

SEQ ID NO: 162590 - RNA, 44 nt, Homo sapiens
agccgagaaaggcagacacaagagcaagcccgcacgugugaagg

SEQ ID NO: 162591 - RNA, 121 nt, Homo sapiens
gacaccguuggccaaauuugaccgcuaccgccucaauuacagucuccccacaggccagugggugggagugcagcuuccaagaaacaccacuuccuauguccugagaggccuggaaccagga

SEQ ID NO: 162592 - RNA, 62 nt, Homo sapiens
gacacgcccaaggaccuucagguuucugaaacugcagagaccagccugacccugcucuggaa

SEQ ID NO: 162593 - RNA, 81 nt, Homo sapiens
cgggaacugaauaugggauuggaguuucugcugugaaggaagacaaggagagcaauccagcgaccaucaacgcagccacag

SEQ ID NO: 162594 - RNA, 56 nt, Homo sapiens
aggggaccacgcugagguugauguuccaaagagccaacaagccacaaccaaaacca

SEQ ID NO: 162595 - RNA, 54 nt, Homo sapiens
gacagauaacagcaucacccuggaauggaggaauggcaaggcagcuauugacag

SEQ ID NO: 162596 - RNA, 62 nt, Homo sapiens
cugacacugaguacgaggugucccucaucucccgcagaggugacaugucaagcaacccagcc

SEQ ID NO: 162597 - RNA, 61 nt, Homo sapiens
accuacggcaucaaagacgugccaggagaccguaccaccaucgaucucacagaggacgaga

SEQ ID NO: 162598 - RNA, 58 nt, Homo sapiens
ccccagccagaucgaggugaaagaugucacagacaccacugccuugaucaccugguuc

SEQ ID NO: 162599 - RNA, 74 nt, Homo sapiens
ccaacuucuuuaaugcaagggguacuaaggaagguaguagguacgguuugggugcuugcuagcaccuauaagaa

SEQ ID NO: 162600 - RNA, 46 nt, Homo sapiens
agauaucucugcacauagugaaaaacaauacccggggcccuggccu

SEQ ID NO: 162601 - RNA, 46 nt, Homo sapiens
agaucaccaaaagccugaggaggccagagaccucuuaccggcaaac

SEQ ID NO: 162602 - RNA, 45 nt, Homo sapiens
aaguggagugggauccucuagacauugcuuuugaaaccugggaga

SEQ ID NO: 162603 - RNA, 46 nt, Homo sapiens
acgaggguggucuggaaaugcaguuccgugugccuggggaccagac

SEQ ID NO: 162604 - RNA, 44 nt, Homo sapiens
ucuccucccaaagaccucguugugacagaagugacggaagagac

SEQ ID NO: 162605 - RNA, 43 nt, Homo sapiens
cuggacuguggccagcacuccugccccagugacugcaacaacu

SEQ ID NO: 162606 - RNA, 46 nt, Homo sapiens
cagugcgugugccaugaaggauuuaugggcaaagacugcaaggagc

SEQ ID NO: 162607 - RNA, 80 nt, Homo sapiens
guguguuugugaugacggcuacacaggggaagacugccgggaucgccaaugccccagggacugcagcaacaggggccucu

SEQ ID NO: 162608 - RNA, 95 nt, Homo sapiens
aaauguguaugugagcaaggcuucaagggcuaugacugcagugacaugagcugcccuaaugacugucaccagcacggccgcugugugaauggcau

SEQ ID NO: 162609 - RNA, 53 nt, Homo sapiens
cccaauggcugcaguggccauggccgcugugucaaugggcaguguguguguga

SEQ ID NO: 162610 - RNA, 48 nt, Homo sapiens
cgggaaacccaccugcccacaugccugccacacccagggccgguguga

SEQ ID NO: 162611 - RNA, 47 nt, Homo sapiens
agccucugugucucaacaauugcuacaaccguggacgaugcguggag

SEQ ID NO: 162612 - RNA, 51 nt, Homo sapiens
cugcagccgugaaaucugcccagugcccugcagugaggagcacggcacaug

SEQ ID NO: 162613 - RNA, 64 nt, Homo sapiens
ucaccuucgaggccggugcauugaugggcagugcaucugugacgacggcuucacgggcgaggac

SEQ ID NO: 162614 - RNA, 66 nt, Homo sapiens
cuucuguagcggucggggcaacuucagcacugaaggauguggcugugucugcgaaccuggcuggaa

SEQ ID NO: 162615 - RNA, 53 nt, Homo sapiens
cugagcagacuggaggagcuggagaaccuggugucuucccugagggagcaaug

SEQ ID NO: 162616 - RNA, 71 nt, Homo sapiens
cuucagagcccagcgaaagcuuucaggagcacacaguggauggggaaaaccagauugucuucacacaucgc

SEQ ID NO: 162617 - RNA, 51 nt, Homo sapiens
gcuaccgaaggugggguccucaagaaagucauccggcacaagcgacagagu

SEQ ID NO: 162618 - RNA, 65 nt, Homo sapiens
ugcuucuaaauccccaauucugcugaaagugagauacccuagagcccuagagccccagcagcacc

SEQ ID NO: 162619 - RNA, 40 nt, Homo sapiens
ccaacagcagcacugccccugaggaaccuuggccaggguc

SEQ ID NO: 162620 - RNA, 44 nt, Homo sapiens
uuuuccaaacguguuuaauuaggaaaucuuuuucccucagauua

SEQ ID NO: 162621 - RNA, 44 nt, Homo sapiens
uaagggucuaggauuuguucucuaucaguucuucccccaucgug

SEQ ID NO: 162622 - RNA, 45 nt, Homo sapiens
gauuuuaaaaagaauuuaaaaagauuugggggcugcuguggagag

SEQ ID NO: 162623 - RNA, 48 nt, Homo sapiens
uuuccguaauugaggggcagagcuggcuuugacccaagcuuucuaacu

SEQ ID NO: 162624 - RNA, 34 nt, Homo sapiens
uugugaugguaaaacacacaaacacaaaguuaau

SEQ ID NO: 162625 - RNA, 40 nt, Homo sapiens
aguuucuggcuuugugcgcauacaagucauuugcaggaga

SEQ ID NO: 162626 - RNA, 29 nt, Homo sapiens
agcuccacacuccagguacuucuuccaag

SEQ ID NO: 162627 - RNA, 55 nt, Homo sapiens
uguccuuuugagagauagaaccacaaacaagccccucuccuccuguguguugggg

SEQ ID NO: 162628 - RNA, 47 nt, Homo sapiens
ucugaaugcugguuccgucacuaugcguggcuuaccuuagcugaacu

SEQ ID NO: 162629 - RNA, 44 nt, Homo sapiens
uacauuuaucuggcaaacuaauuaaagcuaaaaauaaccgacaa

SEQ ID NO: 162630 - RNA, 44 nt, Homo sapiens
uaaugucggggcccugaggaggaacgggguguagcaugugggag

SEQ ID NO: 162631 - RNA, 51 nt, Homo sapiens
ggugaguucuugagggacucuaucuuguuagcagaaagaagggagcuggcu

SEQ ID NO: 162632 - RNA, 46 nt, Homo sapiens
ggcagccuuguuuaauaaacugaucugcacugccagcucugggaag

SEQ ID NO: 162633 - RNA, 24 nt, Homo sapiens
uagcaauacccuucaaaggaagag

SEQ ID NO: 162634 - RNA, 83 nt, Homo sapiens
ugucaaagaagcagcugaggagcggcgucgggacuuuggagagaaguuaacucgucugcgggaacuuaugggggagcugcagc

SEQ ID NO: 162635 - RNA, 45 nt, Homo sapiens
gaaguucuucacaggcucuuuggcugaaguugagaaguccaauag

SEQ ID NO: 162636 - RNA, 29 nt, Homo sapiens
cugccucuaccucuguuacuuuuagagag

SEQ ID NO: 162637 - RNA, 46 nt, Homo sapiens
cuuuuccauuggcucuguaggcccugaugggcagcugggucgccag

SEQ ID NO: 162638 - RNA, 40 nt, Homo sapiens
aagagucaucugcuuagguuccuuuguguguacaugguaa

SEQ ID NO: 162639 - RNA, 45 nt, Homo sapiens
cacucaaagccacccaggcaaagcaggaacuuuuggcaaagaagg

SEQ ID NO: 162640 - RNA, 42 nt, Homo sapiens
uggcagcagaaaccugacaaggugcaucucagacgacuagaa

SEQ ID NO: 162641 - RNA, 46 nt, Homo sapiens
gcgugaguuuacuggugcagagaaccauugcaagacuuugccuaaa

SEQ ID NO: 162642 - RNA, 71 nt, Homo sapiens
agaccaucccucugacagacaacacagugauugaggagcaccuggggaaguuuggcaucauuugcuuggaa

SEQ ID NO: 162643 - RNA, 70 nt, Homo sapiens
uucuugcgcccuuuccaccucucaguggcccaucaugcuaccaaaaauagagugggcuuccucaaggaga

SEQ ID NO: 162644 - RNA, 57 nt, Homo sapiens
ccgccagcugaacuagacccaggugccaaacugcaguauauuuuugaucaaugaagu

SEQ ID NO: 162645 - RNA, 55 nt, Homo sapiens
aacaucuuacagucuggaucuggaucuaccuauacaguccuacauuagcuucuaa

SEQ ID NO: 162646 - RNA, 42 nt, Homo sapiens
ucugaauuuccuccagggaaagauccuucuucuuuggagggg

SEQ ID NO: 162647 - RNA, 1698 nt, Homo sapiens
cgacaggcaguguauucugcacaaucaacugggauaaggaaaguccugaaaaugauuuucaaaaacaugcaaucacuuucuuugccuuucuauaugucaucaacccaaaaaaaucucacaucacaucuacauacaucgucagaaaaauacguggaauaaagacgucuaaauuaaccacgaaaaaaauuaucaaaaucuacuaaauaaacauugggaaauaugaccugaauaugauauugguuccagaaaaucaaguuaacugagcuuucucggucauaaaacucuuggauuuuuaaaaucagacaaagucacaagggugaagaauuuuucccccauaaacucuuuaacauuucaccgaaacuguaagaagauauuccagauucaacucaacagugcccccggagccaucuuaauacugccuacaacucauugugcaaaugaaauacccaccccugcuuugucugugucugacgugguggauaagaaaacgcccaagcuaauaguaaccaauaauguugaacuccuauugucccucagguuuaagcuuccuugcccaacagcaagcaaaauguuuaugaaccucuagauuuugacuuauauuugcugccguuaugucaugaaaaaugcuguaucucuuguugaucuuuuuaacauuaugacuuuuguagacgccagcuaguaccaaaaacguaggaugacagguucccaaaagcuaggaauuaaaaucagaggcagcgacaagauuuaagaaaagcagagaauuagacgcagcaccggacccaggaugggcguggcccugguccgggcgaggaaaagaggaccggucgcccccggccaaucagagcacgccuugcgcuccggccccuggccccgcccccuuccuccccgcgccuuuucgaaucuccccgaacucaacaccccggagcccgcgcgcgugggaaggggaggggugggcggggcuaacgguccaauccggguaacuccgccccugccugacucccccugcgcggacgccccccccaacucccgccaaaaacaccuccaggccgccgccaccacccccuucacaguucagcggguggggcaggccccgggaacaggcccccggguggucccgcggugagcucgccaccgccucccgccguccccaugcccaaccugccgccacccacgcuguccgcgcguccggccgcgaagacagaagaacccucguggggcccgggagcgccgccccucaaucaccagcugcggucgccaggggacggucgcagggagggucgcggcccuggcugcccgcaguuugguccuaaagccgcuggucccuggggcaccgccccgucccuucagacaauggggaacccggcggggcccgcagggaagggagggagggagggagguaaacgagggcccacgcccccuauugucuccucgacggcaccccggagcggacgcccggugaucgcccagcccccugcccacgaacagccgcgcccccggagagcggggacaaaggcgaggcuccgcccgagccacacacaaagcggagcgacccccgcccaccaaccccuccgaggcccgcagccccgcccgccgcccugcagcagggggucgcugccacggcccagccccucccgccgaccgcgucccucuugcuggccucagccagccgccgccuccuccgagccccgcacccaccug

SEQ ID NO: 162648 - RNA, 46 nt, Homo sapiens
cacuauugauccugcaguuucaaaagaauuggccaaagaaguugag

SEQ ID NO: 162649 - RNA, 47 nt, Homo sapiens
cacacguuccaccucaucaucagugaguucucccgcccucuugguga

SEQ ID NO: 162650 - RNA, 56 nt, Homo sapiens
cgcaaaauaugcuggaacuuuucagggaucacuagcgacauggcggcagcacaagc

SEQ ID NO: 162651 - RNA, 132 nt, Homo sapiens
cuaucugacagacucagauggcuuguuaauggaguaauggaguguuuaucuuuucuguucucucucccuccccgccuuacuucccuauuuucucuaauaccaacaaugaaguagcuuaaagaccauuagagu

SEQ ID NO: 162652 - RNA, 46 nt, Homo sapiens
uuguaaauauauuugguuuauuacaguaaaggcuuuaguaccaaua

SEQ ID NO: 162653 - RNA, 61 nt, Homo sapiens
gccuccgagggagcagggccucugaguaccguuguuccacauuaaacacauguccauuguu

SEQ ID NO: 162654 - RNA, 47 nt, Homo sapiens
ugguuugugaguacuggaaaagauaaccuccucaaugcuuggcggac

SEQ ID NO: 162655 - RNA, 35 nt, Homo sapiens
uggaaaaaauguucuccgagcagcuggaugcaaua

SEQ ID NO: 162656 - RNA, 41 nt, Homo sapiens
aguggcuggcagugggcauggagagcagcaauguggaggug

SEQ ID NO: 162657 - RNA, 88 nt, Homo sapiens
gagccagcuguauugacauuucuaaugauggcaccaagcucuggacgggugguuuggacaacacagucagguccugggaccugcgcga

SEQ ID NO: 162658 - RNA, 63 nt, Homo sapiens
cagacuccaaacuuguucuaaaaauauuucuggcuuuugccaagggguggccuaauguggauu

SEQ ID NO: 162659 - RNA, 49 nt, Homo sapiens
guccucggcccccgccugcuacgcccuggccaucagccccgauuccaag

SEQ ID NO: 162660 - RNA, 45 nt, Homo sapiens
cgacgcccucaucggacccggaaucccccggcaugcucgccagau

SEQ ID NO: 162661 - RNA, 46 nt, Homo sapiens
ucuuccucccuuuccgcauucccugacccacauacuuguccacugg

SEQ ID NO: 162662 - RNA, 72 nt, Homo sapiens
gcuauaauaauuccucacuuuacuucucucucucccucuucaccuugucagaaaugacuuuugguuuauggg

SEQ ID NO: 162663 - RNA, 43 nt, Homo sapiens
uguuuaguguuuaaauaaaucuuuaaaguaccuuuuugguuua

SEQ ID NO: 162664 - RNA, 46 nt, Homo sapiens
caggauagagugaacaaggcguuaaaaguuauacaaauaauucucu

SEQ ID NO: 162665 - RNA, 46 nt, Homo sapiens
acuagaauuccaaagggaguacaggcuugggcguuuccaaggagau

SEQ ID NO: 162666 - RNA, 51 nt, Homo sapiens
uaguaaauggcguuaauguuucuuuuuuccaggacagugauggugacaaaa

SEQ ID NO: 162667 - RNA, 44 nt, Homo sapiens
uuucuauuuuugguauggaagacaucuaaccugauuaaagcaag

SEQ ID NO: 162668 - RNA, 34 nt, Homo sapiens
uaaauaauuguauuuauugucugcuccagaguuu

SEQ ID NO: 162669 - RNA, 35 nt, Homo sapiens
uugguauaaguuuuggggggaagauaaaaguucag

SEQ ID NO: 162670 - RNA, 51 nt, Homo sapiens
cucauuuuucauguguacauuugaucuguacaugcaucugccaguuagcuc

SEQ ID NO: 162671 - RNA, 37 nt, Homo sapiens
auuuggauguagucugacuuauuuuucaugaacauaa

SEQ ID NO: 162672 - RNA, 28 nt, Homo sapiens
acuggagagacuauugaaauauuuuugu

SEQ ID NO: 162673 - RNA, 53 nt, Homo sapiens
ucucaccauagcaccugccuucaacuuacauagaguaccgguauuuaagaaaa

SEQ ID NO: 162674 - RNA, 50 nt, Homo sapiens
uagguaauacccauuuugagcugaaucagagaauaaaaauagcagaucuu

SEQ ID NO: 162675 - RNA, 45 nt, Homo sapiens
cucaaguacccgguuaaacuuuguggaacauguuuguuuucugau

SEQ ID NO: 162676 - RNA, 47 nt, Homo sapiens
uguguuugauuagcaaagacuaauagugaauuguacuuguagcucaa

SEQ ID NO: 162677 - RNA, 48 nt, Homo sapiens
ugggcucucuaaucacauucaacaaaaaacacaauuacaucugcauuu

SEQ ID NO: 162678 - RNA, 46 nt, Homo sapiens
uuuuccucccugaaauggggagcuucaguggauuuucagcuuaaau

SEQ ID NO: 162679 - RNA, 99 nt, Homo sapiens
auggaaccaguuaauccaucagggcuuaaaauuacaucccaacuggagauggagaaaaaacauaagagccaaggaggauuaaagaaugagccucagcuu

SEQ ID NO: 162680 - RNA, 50 nt, Homo sapiens; identical to SEQ ID NO: 79910

SEQ ID NO: 162681 - RNA, 47 nt, Homo sapiens
agcugaaacaagggaccguccuuucugauuuuauucauaugugagug

SEQ ID NO: 162682 - RNA, 47 nt, Homo sapiens
uuaaccccuccuuguuuucagagaacugcgagugugaaagaugagga

SEQ ID NO: 162683 - RNA, 46 nt, Homo sapiens
uggcaacaguugggucaaaacauuuaagucauuaauuagacggaac

SEQ ID NO: 162684 - RNA, 50 nt, Homo sapiens
caagaauauuuuguaucuaaggauugaaaugccuaaauaaugauuaagca

SEQ ID NO: 162685 - RNA, 45 nt, Homo sapiens; identical to SEQ ID NO: 79917

SEQ ID NO: 162686 - RNA, 63 nt, Homo sapiens
uaaauggaaguauaaggaggaaguauaaggagguuucaaauacugacuggauuuuucugagua

SEQ ID NO: 162687 - RNA, 46 nt, Homo sapiens
cucugugugggaacaucuaguugauggcuggggagaaaauugauuu

SEQ ID NO: 162688 - RNA, 32 nt, Homo sapiens
gacugauaacaugaagcagggauuuccaugua

SEQ ID NO: 162689 - RNA, 47 nt, Homo sapiens
caccucagugugaugcuauaugcuggugcuggguuuauuggaggagc

SEQ ID NO: 162690 - RNA, 46 nt, Homo sapiens
gaguugcuucaguccuagugguuuuuaaagcaugaaaagauuagug

SEQ ID NO: 162691 - RNA, 45 nt, Homo sapiens
agcaaacaaauuuuugaaaaauuucucaguuguugcaggugugga

SEQ ID NO: 162692 - RNA, 31 nt, Homo sapiens
acuugcacacaccguguuuacccagcaggga

SEQ ID NO: 162693 - RNA, 45 nt, Homo sapiens
uugacauuuuuugcuuuugucaugcuugagaaaaagcacacagau

SEQ ID NO: 162694 - RNA, 72 nt, Homo sapiens
ccgagcgcccgacgucuccgcgcagguucuugaagcagcugggccuggggcgcccacuaauguggcccugag

SEQ ID NO: 162695 - RNA, 84 nt, Homo sapiens
gcuggagcgcccuuugcggagaagcacacgaaggugaaggaaggaaagaaagaagaccgaggaagaaggagcucggaagaaggg

SEQ ID NO: 162696 - RNA, 44 nt, Homo sapiens
uuugcucacuggugugaagauaugcccaaucuuucuuagcuaag

SEQ ID NO: 162697 - RNA, 120 nt, Homo sapiens
ucccuccccagcuugacagucgcugcagucacggacggagcgucucugccccagcgucgccgcucgcccggacgcccgcacccccgugccccacgcggaggggggcagugccgggaagac

SEQ ID NO: 162698 - RNA, 45 nt, Homo sapiens
caucaugguuccuccaggcacugcaggaagaaauggccccaugcc

SEQ ID NO: 162699 - RNA, 42 nt, Homo sapiens
cauggagguggccgagguggaaaguccucugaaccccagcug

SEQ ID NO: 162700 - RNA, 259 nt, Homo sapiens
ccagauaauauucuuaaaaaaaaaugguagugacuuaagccuuguggguguaagugacaugccccgagucauagggguggucagugaggugcugagaacucauugcacauuuggaugcauagguccaaaguaagaucuuugaaagagagauccacuauaugauauaauucaucguccaacuugagaugguuugugugucccuucuauaauguaagucuauuuuaauuaaaaaauuucccauggaagaauauauuucauu

SEQ ID NO: 162701 - RNA, 50 nt, Homo sapiens
uuaguggagugucuugugagguaggguggcacguucaguaacuuuagaag

SEQ ID NO: 162702 - RNA, 63 nt, Homo sapiens
cuggaagaacuuaacuuuuguggcaccuaucuauggugcagauauuaaugggagcauauauga

SEQ ID NO: 162703 - RNA, 33 nt, Homo sapiens
aaacaauguauuacaugcuaagauugaauggau

SEQ ID NO: 162704 - RNA, 49 nt, Homo sapiens
ggguguggaugaauggaacauagcucgccucaauacagucuuggaugug

SEQ ID NO: 162705 - RNA, 46 nt, Homo sapiens
uaccccauaucucuauuuuggcauguggaagaccacguuugcaugg

SEQ ID NO: 162706 - RNA, 46 nt, Homo sapiens
uugaaauuugggcaucaggcacauauugaagaggauuuuguucuuu

SEQ ID NO: 162707 - RNA, 75 nt, Homo sapiens
ugagcaaaacagcaacaacaagcagaaacauaaauaagggaggaaaugacuacuucacacggccuuaguuaggcg

SEQ ID NO: 162708 - RNA, 46 nt, Homo sapiens
aggugaguggaagcugggacaucuguaggugcugcagccccuguug

SEQ ID NO: 162709 - RNA, 39 nt, Homo sapiens
uaaacacacagccccagggcucccaaaaaacaauaggga

SEQ ID NO: 162710 - RNA, 39 nt, Homo sapiens
gauuucgcccuucagcugcuuucuuauuuauacagguuu

SEQ ID NO: 162711 - RNA, 45 nt, Homo sapiens
ucagcuuuggaaacaaggaaaggauauauacaccauugaucacac

SEQ ID NO: 162712 - RNA, 51 nt, Homo sapiens
gucaugggguaaaaucagucagccuugacauguuuuaggguucuacagaag

SEQ ID NO: 162713 - RNA, 25 nt, Homo sapiens
uauagaaacaaauauuuuauucaag

SEQ ID NO: 162714 - RNA, 63 nt, Homo sapiens
gauaagauugcucaggugcuuauaugugcaguucugcacuuccuuguguuucuagucuucccu

SEQ ID NO: 162715 - RNA, 49 nt, Homo sapiens
aaaaaaaaucauugcacuuccuuaacucccuuguacuagaagcugucgg

SEQ ID NO: 162716 - RNA, 46 nt, Homo sapiens
ugaacauuacaugcuuucgacauaaggucaaccccaacgugguaag

SEQ ID NO: 162717 - RNA, 29 nt, Homo sapiens
uuauuucugggaaaaguguuugcaaccaa

SEQ ID NO: 162718 - RNA, 28 nt, Homo sapiens
gaaugcagagaaucucuuaccagugggu

SEQ ID NO: 162719 - RNA, 60 nt, Homo sapiens
auuuccaaaaacagcugccuuuguacuuucuaggccuuuuaagguuuuugcaugccagaa

SEQ ID NO: 162720 - RNA, 283 nt, Homo sapiens
ucauuggagggaaaguacguacuaacaaagcagcggaccaggcacuguggcucacaccuguaaucccagcacuuugggaggcugaagcaggaggaccuuuugagggcaggaguucaagaccagccuugccaacauagugagaccuugucucuauaaaaagcaacaaccacaaaaaacuagauggccuucaggaauucaccaaauaaguuuuagugcuuuuauuuuugugaaaauaacagaccuaucuuuuagaaaauagguauagcuguguaugaggacauug

SEQ ID NO: 162721 - RNA, 45 nt, Homo sapiens
gggcuucauuucagcuuaagggacaaccacagcaucuuggaguuc

SEQ ID NO: 162722 - RNA, 101 nt, Homo sapiens
ucccagaaugauuagugucaguauagaagcagcuuggcuugaaucgauuaacccagagccugaaauuacaggggucuagaaccagcacagaacacgcuuag

SEQ ID NO: 162723 - RNA, 51 nt, Homo sapiens
cugcauuuauagcuugauuggucaagugugcauuucauucagauuguccuc

SEQ ID NO: 162724 - RNA, 62 nt, Homo sapiens
aaaucaagauucucaggcuaaacuguagagugaaaacaagaagguugaaguaaaaggagaaa

SEQ ID NO: 162725 - RNA, 34 nt, Homo sapiens
ccagcauagcacuacagauguaggagcagaucaa

SEQ ID NO: 162726 - RNA, 84 nt, Homo sapiens
auguaucauguuauauuaucuuucauuagguugaguuugaagauggaucccagauagcaaugaagagagaggacaucuacacuu

SEQ ID NO: 162727 - RNA, 54 nt, Homo sapiens
gaaugcaaacuucaaauucaaccaaaaucggggaaauuaaugcaugugcuuuac

SEQ ID NO: 162728 - RNA, 46 nt, Homo sapiens
caacauuaaaaguauucaggaguagaucaaaggggacucggcauaa

SEQ ID NO: 162729 - RNA, 21 nt, Homo sapiens
auaaugacagcaagcaaagaa

SEQ ID NO: 162730 - RNA, 48 nt, Homo sapiens
gagguuagccgcccuugucaggaggccuuguauuuuaaugacuucggc

SEQ ID NO: 162731 - RNA, 75 nt, Homo sapiens
gauugugugggguucuuuuccacucacuucagaagcagccccguuaccuuuuauugucucacagaauaaccauag

SEQ ID NO: 162732 - RNA, 44 nt, Homo sapiens
gccaagaaugaaugaaacaaaaguguuuucuccuaauggcagag

SEQ ID NO: 162733 - RNA, 66 nt, Homo sapiens
uccacagccucugacaugcgauuugaagacacguuuuauggagcagacauuauccaaggggagaga

SEQ ID NO: 162734 - RNA, 50 nt, Homo sapiens
acaguagucugcauacaucgcugcaggccacagagcagcuuggguuggaa

SEQ ID NO: 162735 - RNA, 55 nt, Homo sapiens
ucuucuaugaucccaaagaaguuuucuaagugaaaggaaauacuagugaaucacc

SEQ ID NO: 162736 - RNA, 46 nt, Homo sapiens
uuugugaaaugaaauuuuuggcucuugagaaagaauucuuaugaau

SEQ ID NO: 162737 - RNA, 47 nt, Homo sapiens
uuuugaacuaauguaacaugauuuuucuuuuuuaaaacagccugaaa

SEQ ID NO: 162738 - RNA, 45 nt, Homo sapiens
gacacuuguacauggacagacaucacuacuguggauacuacaaga

SEQ ID NO: 162739 - RNA, 48 nt, Homo sapiens
ggauaccccccgaguccauggaccauuacgcagauggucaucggccuc

SEQ ID NO: 162740 - RNA, 46 nt, Homo sapiens
ucaugggcuuccgugccacccaguacacguacccgcccgcccccau

SEQ ID NO: 162741 - RNA, 37 nt, Homo sapiens
uuuaagaaguauggcuuuuuaugcauccuucaucgag

SEQ ID NO: 162742 - RNA, 45 nt, Homo sapiens
acucuagaaauaucuguguguugcaauucaaauguauguugagau

SEQ ID NO: 162743 - RNA, 47 nt, Homo sapiens; identical to SEQ ID NO: 80089

SEQ ID NO: 162744 - RNA, 46 nt, Homo sapiens
gacauggcaaaaaucuuaauuauagcaauauaguuaucggguaaug

SEQ ID NO: 162745 - RNA, 43 nt, Homo sapiens
accgcccagucccauugaguguauucauuacuagaaggaaaau

SEQ ID NO: 162746 - RNA, 60 nt, Homo sapiens
uuaacugacuuucuagaugccuuaauauuugcaugauaagcuaguuuuauugguuuagua

SEQ ID NO: 162747 - RNA, 56 nt, Homo sapiens
gauaauagaccagcaauugcagcacuuacaaucacuaauucccuuaagguugaaac

SEQ ID NO: 162748 - RNA, 45 nt, Homo sapiens
aaacacaacaauaguuuaagaaauuuuuuuuuuaaauaaaaaaaa

SEQ ID NO: 162749 - RNA, 40 nt, Homo sapiens
aaaaagaaugauauugcauuuauauugauuaauguaaaau

SEQ ID NO: 162750 - RNA, 43 nt, Homo sapiens
gauuauccauauaguaauucucacuaugaauuaaaacuauuaa

SEQ ID NO: 162751 - RNA, 42 nt, Homo sapiens
guaccacuuuuaacaauagcauugaaaagaagcccaggguag

SEQ ID NO: 162752 - RNA, 38 nt, Homo sapiens
ugauuuucucuagugaaaggcacuauuuugaagcacca

SEQ ID NO: 162753 - RNA, 40 nt, Homo sapiens
acucuauucucaucaaaauuauuugcaccuguuaugaaau

SEQ ID NO: 162754 - RNA, 38 nt, Homo sapiens
aacuacaguacaacagcuggguuguuccuggaguuccu

SEQ ID NO: 162755 - RNA, 70 nt, Homo sapiens
aaggcagauaauagacaucuaaaaucuucagggcauggcuauggcuuuagaaucaucugaauaaguugaa

SEQ ID NO: 162756 - RNA, 41 nt, Homo sapiens
cuauaaaauguuuucuacaauuuauacuguuuuuggugggg

SEQ ID NO: 162757 - RNA, 46 nt, Homo sapiens
gccuuuaauauacaugauccuuuaagaauaaauaucgucaccaggu

SEQ ID NO: 162758 - RNA, 50 nt, Homo sapiens
aauuuuaaaagaauuauagaaaugaaguuuuauguuuacuauccaggaau

SEQ ID NO: 162759 - RNA, 47 nt, Homo sapiens
aaugcauaucaugcuauagauguauauuaguaaacuaaggcuagagu

SEQ ID NO: 162760 - RNA, 84 nt, Homo sapiens
guuguauaaagauggcugcaucaguccauuuuccacuccuacauaaaagaaacauagugaguaguuuuucuuuccuauaaacaa

SEQ ID NO: 162761 - RNA, 61 nt, Homo sapiens
ucagccuguuuguuaaugaauuguuuuuauacuuacauacagguuguucaaaaagggaucu

SEQ ID NO: 162762 - RNA, 159 nt, Homo sapiens
uaaguacucauuuuaaaaguggaugucuucacaucuuugagcaaacaaugucagcaauuuaaauaaaagcacacagaaaacaaagauuuuuuuuuaaguaguugaaagauuaucacaggauaaauggucaaaaccaaguucuagaaacucugaugccua

SEQ ID NO: 162763 - RNA, 50 nt, Homo sapiens
uggcgccuaugcgcagugugcuggauccacacagucgugugugcugagug

SEQ ID NO: 162764 - RNA, 36 nt, Homo sapiens
guagaaacauuuuuaccauugaauguaccaccaaug

SEQ ID NO: 162765 - RNA, 56 nt, Homo sapiens
uuuuagaagaaaauguuaaaauguuguagcacuuuucaugacugaaguacuaaaga

SEQ ID NO: 162766 - RNA, 50 nt, Homo sapiens
cugcaucuccacaggauucuuccccaagacugagcacuuucccccagcac

SEQ ID NO: 162767 - RNA, 62 nt, Homo sapiens
uacaaaaggagacccaugaauuugccugaguuuaaugaaaagucugauauaguuacaguagu

SEQ ID NO: 162768 - RNA, 51 nt, Homo sapiens
gaaacaauaucauuuuucaccuuggcaugaagccuuuuagacuguagacau

SEQ ID NO: 162769 - RNA, 47 nt, Homo sapiens
cucaaagguugucuuguuugaaucaggacucaaauuuaguccauaga

SEQ ID NO: 162770 - RNA, 51 nt, Homo sapiens
uaacuaguaaagaagugaggggcugaagagggugguggugggaacugagac

SEQ ID NO: 162771 - RNA, 47 nt, Homo sapiens
cucuccaaguucaccagcugcuggaagucgaacauggcacgaaagag

SEQ ID NO: 162772 - RNA, 40 nt, Homo sapiens
aaaauacuauaauuuuuuauuauuaaugauaggguuauua

SEQ ID NO: 162773 - RNA, 53 nt, Homo sapiens
aaguauaucaaccacuauggguauaaaauagcuucuuaaucuuuguucuggau

SEQ ID NO: 162774 - RNA, 51 nt, Homo sapiens
gugaauuuugaagauuuuuaaaaagguuuuaccagcauaggugugaauaag

SEQ ID NO: 162775 - RNA, 85 nt, Homo sapiens
agggaacuggagucaacuucccaauuggagaaaucccaagccaaccauacuaucaugacaugaacucgggggucaaucuucagag

SEQ ID NO: 162776 - RNA, 56 nt, Homo sapiens
uauuagaggcuuaaggugaagaaaguucucucuaucuuugaccagaggcaugaaag

SEQ ID NO: 162777 - RNA, 44 nt, Homo sapiens
uuagaggucaugaauaagaauuaugaugauccagaaagaacaaa

SEQ ID NO: 162778 - RNA, 46 nt, Homo sapiens
acuaacgugcagaguguagagggaugcagaaauuaacuuugcagau

SEQ ID NO: 162779 - RNA, 56 nt, Homo sapiens
uuucagguuaccuugaggauaguuuuguaaaaucuggagucuucaauguaucagaa

SEQ ID NO: 162780 - RNA, 28 nt, Homo sapiens
uuuauuauauuuuaaaaauugggaaaua

SEQ ID NO: 162781 - RNA, 46 nt, Homo sapiens
ggaauuauacaguauuugucuuuuugugacuggcuuuuuuccagau

SEQ ID NO: 162782 - RNA, 53 nt, Homo sapiens
auacgaaaagugaaccuacaaaagaauagcuucaauaaaugcgguauucugug

SEQ ID NO: 162783 - RNA, 78 nt, Homo sapiens
ucaagaaccacgaggacauaucuuugaaaauaaagaacuagaaaaaaauuccagagaaaauguuuacccagaagacuu

SEQ ID NO: 162784 - RNA, 54 nt, Homo sapiens
uacuagcauuuagugcacuauuuuaucucuauuuucgcaucuacuccccuuaau

SEQ ID NO: 162785 - RNA, 43 nt, Homo sapiens
acuugugagcuuuugggagaaagaauguagaaagaacagagga

SEQ ID NO: 162786 - RNA, 30 nt, Homo sapiens
gaaaugauucucauuaaauccaugaccagu

SEQ ID NO: 162787 - RNA, 42 nt, Homo sapiens
cuuuccuuuccaugguguuucuacuuuaugaagccaucaacu

SEQ ID NO: 162788 - RNA, 48 nt, Homo sapiens
gcaaaagaaacagaugcuuucaagucucaugaugaaauagaauuguaa

SEQ ID NO: 162789 - RNA, 47 nt, Homo sapiens
ugcucuucucuaaaggcuuaagaugacauaccgaaguuacagaagau

SEQ ID NO: 162790 - RNA, 26 nt, Homo sapiens
aaagaaugaggugggagaagagggga

SEQ ID NO: 162791 - RNA, 43 nt, Homo sapiens
uacuuuuauauuggcgucaucaguauuuaccuaaucaccaaug

SEQ ID NO: 162792 - RNA, 43 nt, Homo sapiens
acauuugcaaucugacauuguuggagaacaaagguaccacugu

SEQ ID NO: 162793 - RNA, 24 nt, Homo sapiens
cauguucugucaaaguuuaccuau

SEQ ID NO: 162794 - RNA, 42 nt, Homo sapiens
ccucuuuguguccuggccuugccuuccagggagcugccagaa

SEQ ID NO: 162795 - RNA, 41 nt, Homo sapiens
gcaauaagguucaggaagguuguaacagacgaaauucaaga

SEQ ID NO: 162796 - RNA, 46 nt, Homo sapiens
cuuggagauguugagucauuuaucugaauuacaaagcaagugagug

SEQ ID NO: 162797 - RNA, 54 nt, Homo sapiens
gaugaagucuguuauuucuuaauauugaacauuauuuuugacuaaauuuaaauu

SEQ ID NO: 162798 - RNA, 52 nt, Homo sapiens
uuggggagucagauaagcuugaggggcagugugguauguggcugugagccuu

SEQ ID NO: 162799 - RNA, 26 nt, Homo sapiens
gcuugaggugcaugaauuagugucag

SEQ ID NO: 162800 - RNA, 39 nt, Homo sapiens
guacagaguugcaguuuuguaggaugaauaagccuugag

SEQ ID NO: 162801 - RNA, 41 nt, Homo sapiens
uaacacacucuaauaaaauuaaaauacaguuacaaagagac

SEQ ID NO: 162802 - RNA, 28 nt, Homo sapiens
auaauagcaaaagagcuaaauacugggu

SEQ ID NO: 162803 - RNA, 42 nt, Homo sapiens
cauuuccuaccuuuguuuggaaaugaacugauuggaccaggc

SEQ ID NO: 162804 - RNA, 45 nt, Homo sapiens
augcuguuuaggagacaccagggaguccugggaauuaggaaacaa

SEQ ID NO: 162805 - RNA, 49 nt, Homo sapiens
ccugaaggaaacaguuuguauguuaaguauaccucuaaaccuuauucau

SEQ ID NO: 162806 - RNA, 46 nt, Homo sapiens
uauuccucuucuuuuauuacauuuuuuacucauuccuuuuuaugau

SEQ ID NO: 162807 - RNA, 42 nt, Homo sapiens
ugaacugaggcuugggagaguuugccaaaugagguggugaug

SEQ ID NO: 162808 - RNA, 51 nt, Homo sapiens
uacaguauacgguaauuuccaugaaaccagacaguuuaauucugcuaccaa

SEQ ID NO: 162809 - RNA, 53 nt, Homo sapiens
caugcugcacuaaucuaggcugauguauggccagagacuuuuaucaugaaagu

SEQ ID NO: 162810 - RNA, 42 nt, Homo sapiens
uuguugaacauaaccaagcuaagacuucugugaaagucagga

SEQ ID NO: 162811 - RNA, 48 nt, Homo sapiens
uaugaagguguagugacuuccuguaccuaagacaaagggauguggaga

SEQ ID NO: 162812 - RNA, 79 nt, Homo sapiens
aauaauaagaacacccuguuccugcuuuuaguuuagguagaagugaaacuguuaaugaggugacaucaaagcaugcaga

SEQ ID NO: 162813 - RNA, 319 nt, Homo sapiens
aaguagagcugaggugggaggauugcugaggccaggaguucaagaccagccugggcaacauagggagaccccaucucuacaaaaaaauucaaaaguuagcugggcaugguggugcaugccuuuagucccagcuacucaggagacugaggcaggaggauugcuugaguccaggaguucagaguuacagugagcuuugauuaugccguuguacuccagccugggugacagggagagacccugucucaaaaaaaaaaaaaaagaaaaaaagaaaaaauuaguagauacuguguagacaacaccuaaacaaacagggcagaua

SEQ ID NO: 162814 - RNA, 47 nt, Homo sapiens
guggcuggaacugacaaacugggauuagcugaccuccugcaggaggc

SEQ ID NO: 162815 - RNA, 48 nt, Homo sapiens
auaugaauauuguuagagggagaggcuucuagaaaaagugggucaaaa

SEQ ID NO: 162816 - RNA, 34 nt, Homo sapiens
uauguaacaaugaaugagaugugaauguugaaua

SEQ ID NO: 162817 - RNA, 46 nt, Homo sapiens
uaccaccacgaauccaucuucagguuguauuggaggccuacuucuc

SEQ ID NO: 162818 - RNA, 40 nt, Homo sapiens
agggaaaaguuccuauuauuugaagcaccaugagauuuag

SEQ ID NO: 162819 - RNA, 50 nt, Homo sapiens
uccaccaauuuaguauaccuacagguuucuugcuauuaaaaagcuaagac

SEQ ID NO: 162820 - RNA, 100 nt, Homo sapiens
cauccuugaguucguagcuuuuaugaaaaaaaaaaaauccccucaugcuauucaaaugccauugaaacauccaccuuuaaauaaugcaguaagggaaaaa

SEQ ID NO: 162821 - RNA, 45 nt, Homo sapiens
uuauaauuaggaaugcagauuuggguguuauugaagacuuagaag

SEQ ID NO: 162822 - RNA, 47 nt, Homo sapiens
cacugaaucaaugcugagaugggccacaaaaauggggcauauaagag

SEQ ID NO: 162823 - RNA, 51 nt, Homo sapiens
uucaacaaauuuauaagcaagucauuuccgauuguguuaaaugcuaugaga

SEQ ID NO: 162824 - RNA, 60 nt, Homo sapiens
ggaggcaauucagaauucacaagaauccaaagaagguucucaugacucaagaaaugagcu

SEQ ID NO: 162825 - RNA, 48 nt, Homo sapiens
aaacacuugcagcuccuacccugucuuucaaauuagcaugugcacaga

SEQ ID NO: 162826 - RNA, 30 nt, Homo sapiens
uuguuucuguccucugccuuuuuuuuuuuu

SEQ ID NO: 162827 - RNA, 54 nt, Homo sapiens
uucuaaugagccaccuccaugguuauggccucugguuggucucuuaaaacaugc

SEQ ID NO: 162828 - RNA, 38 nt, Homo sapiens
accucaucccucuucgucaguuucacuuggaaagauag

SEQ ID NO: 162829 - RNA, 47 nt, Homo sapiens
aaaauuguuuaccgagagaaaagacuaauuguauugcuuccugagau

SEQ ID NO: 162830 - RNA, 44 nt, Homo sapiens
guuuucaagaccacauaccauugggaaggaaguagggguggaga

SEQ ID NO: 162831 - RNA, 58 nt, Homo sapiens
gguucugaaacaauguuuccaaacgaugguuguccuuuagcaugcugucagagcacag

SEQ ID NO: 162832 - RNA, 48 nt, Homo sapiens
uaagagaauguuggcugauaaagaagaaguugacuuuaguugaacaca

SEQ ID NO: 162833 - RNA, 46 nt, Homo sapiens
auaccaaaaaauggaguauggcaaaccuagaccuuuuuugcuugac

SEQ ID NO: 162834 - RNA, 50 nt, Homo sapiens
gcacuucagcugcuaucagagcaaucccgcugguuguguugucauugugu

SEQ ID NO: 162835 - RNA, 43 nt, Homo sapiens
agaaaaauuaugcccagggucacacaacuagcaagugguggaa

SEQ ID NO: 162836 - RNA, 24 nt, Homo sapiens
gaaggggguggugaauguagauac

SEQ ID NO: 162837 - RNA, 47 nt, Homo sapiens
ugcuuguuaugacaucuuguagcauguagcuuuuuuugcaggagguu

SEQ ID NO: 162838 - RNA, 49 nt, Homo sapiens
gaguuuucucagggguuauguaacaaaaccaaaacaaaaugaaacagau

SEQ ID NO: 162839 - RNA, 47 nt, Homo sapiens
uccuuuauguuuccaauagcacugacuuuuagucccacaaauaaggu

SEQ ID NO: 162840 - RNA, 38 nt, Homo sapiens
cuggaguaggcaugcacuuuauuuggcaauugugaggg

SEQ ID NO: 162841 - RNA, 52 nt, Homo sapiens
uuuuucaggcacaauuguugauggaaaaauaggugaacaaaagauggguaca

SEQ ID NO: 162842 - RNA, 45 nt, Homo sapiens
ugucuauaauuuauguuuuagaaaugcccugugugugcuuaugua

SEQ ID NO: 162843 - RNA, 79 nt, Homo sapiens
uuuaguaaauaaaacauaugaaauuuacaaggggaauuuaauuucaaaaagcaacuuucaaugaaucuuuuuguuaagg

SEQ ID NO: 162844 - RNA, 46 nt, Homo sapiens; identical to SEQ ID NO: 80206

SEQ ID NO: 162845 - RNA, 45 nt, Homo sapiens; identical to SEQ ID NO: 80207

SEQ ID NO: 162846 - RNA, 43 nt, Homo sapiens
aggaaaauuuaaaucacgugucacauugacguaggguaaaaag

SEQ ID NO: 162847 - RNA, 24 nt, Homo sapiens
uaaauuugcuaugcuauguuaaaa

SEQ ID NO: 162848 - RNA, 47 nt, Homo sapiens
aaaauggaauuuguuuaaacaagugcgaaauaaaauaagaauuaccu

SEQ ID NO: 162849 - RNA, 47 nt, Homo sapiens
caucaaacugcagagaacuugugaaaacuaagugcguuguaguaagg

SEQ ID NO: 162850 - RNA, 39 nt, Homo sapiens
ugcauugcaguuaauaugaucucauuuuucaaagggaag

SEQ ID NO: 162851 - RNA, 49 nt, Homo sapiens
gcugcucucuaggaugauuuggugugucugcacugugaaaugcucuggg

SEQ ID NO: 162852 - RNA, 41 nt, Homo sapiens
guguccugucugaaggggaaaaaaggaagggggugguggug

SEQ ID NO: 162853 - RNA, 53 nt, Homo sapiens
auuuuaaguugcuugaaggcuagguuuugaggugugccugccugcaugcacau

SEQ ID NO: 162854 - RNA, 45 nt, Homo sapiens
uauuuaugaauagccaaaccauccuagauaauuuuuguauuaacc

SEQ ID NO: 162855 - RNA, 30 nt, Homo sapiens; identical to SEQ ID NO: 80217

SEQ ID NO: 162856 - RNA, 47 nt, Homo sapiens
agucauggugauccuguucaaaggcauccccuuggaaaguaccgaug

SEQ ID NO: 162857 - RNA, 47 nt, Homo sapiens
cccgugcugugucuuauccaaucccgaccagaaggguaagauuagga

SEQ ID NO: 162858 - RNA, 33 nt, Homo sapiens
gcauccaggcuccuugccaaacugcgcaaagau

SEQ ID NO: 162859 - RNA, 45 nt, Homo sapiens; identical to SEQ ID NO: 80221

SEQ ID NO: 162860 - RNA, 47 nt, Homo sapiens
aauaagaaaggaauguuauuuucauguauaacuuuuuguacugaauu

SEQ ID NO: 162861 - RNA, 42 nt, Homo sapiens
aggacuggguuuguugugaaguugcggugauccagcgcagag

SEQ ID NO: 162862 - RNA, 46 nt, Homo sapiens
caccccaauccaacccacaccgaaccuucgcgcacccccuacaccc

SEQ ID NO: 162863 - RNA, 46 nt, Homo sapiens
aaaaaaaagagccuagagcagaaaagagaggaguuuggagccgagc

SEQ ID NO: 162864 - RNA, 42 nt, Homo sapiens
guggagaggcuggugcaaaaggaaugcgcguuugcaggagga

SEQ ID NO: 162865 - RNA, 21 nt, Homo sapiens
ggaaaaaaaaaaaaagucaug

SEQ ID NO: 162866 - RNA, 45 nt, Homo sapiens
gauaacucccacuuggugaaggaaaaagucacugguuccuccagg

SEQ ID NO: 162867 - RNA, 23 nt, Homo sapiens
uuugcuguguggaacccuagucc

SEQ ID NO: 162868 - RNA, 48 nt, Homo sapiens
gguaucagcuccuucugcagcucuaaaauuagaccgcacuucagggau

SEQ ID NO: 162869 - RNA, 45 nt, Homo sapiens
auuaaaaugggagagaguaugggauguaaaaauacuuuuuggaga

SEQ ID NO: 162870 - RNA, 53 nt, Homo sapiens
agaaucagagauauuccgacaagugaauugugagucuaacacgggaggacaaa

SEQ ID NO: 162871 - RNA, 28 nt, Homo sapiens
caugugaaguguuaaaaauaauguggaa

SEQ ID NO: 162872 - RNA, 51 nt, Homo sapiens
auuauuuaacuuaaagaauuuauauugcgguuucucuucaguuggucagau

SEQ ID NO: 162873 - RNA, 23 nt, Homo sapiens
ccacaaacuuacuaagauggaga

SEQ ID NO: 162874 - RNA, 48 nt, Homo sapiens
auauucuuuucccucuuccucuuuaccuuuccugguccugaucccucu

SEQ ID NO: 162875 - RNA, 44 nt, Homo sapiens
gaacuccugaccagugggcauguauuccuauuuuauccuaagau

SEQ ID NO: 162876 - RNA, 45 nt, Homo sapiens
aucaugcuauuucuguucauguccaauuaguuuagugcugcaaau

SEQ ID NO: 162877 - RNA, 34 nt, Homo sapiens
ccucacuguguaaaaccgugcauuaaaaccacag

SEQ ID NO: 162878 - RNA, 47 nt, Homo sapiens
aacugcguuuaaggcuaugagagcagugggugacagaaggggaagag

SEQ ID NO: 162879 - RNA, 42 nt, Homo sapiens
aagauuaagguaauaauuuuuuuaagcgacagagaaguagag

SEQ ID NO: 162880 - RNA, 44 nt, Homo sapiens
uuuuugaguuuuaugaagaauuaugauucaguagauguagaaug

SEQ ID NO: 162881 - RNA, 27 nt, Homo sapiens
uuuuuuguuuuuuuucugcugccccaa

SEQ ID NO: 162882 - RNA, 52 nt, Homo sapiens
ggcucauguacuuuucugcuucuaauguuaauaaauuuaagcuacucucaua

SEQ ID NO: 162883 - RNA, 25 nt, Homo sapiens
ggugggauauaauuaaaaaaaauga

SEQ ID NO: 162884 - RNA, 85 nt, Homo sapiens
agcggcccggccugggcggcggcgccggaggaggcggagguggcgcggcaggaggaggggaaagagcugcuggcggucgggagag

SEQ ID NO: 162885 - RNA, 48 nt, Homo sapiens
gggauuaggaaaagagagauuuagccaggauuggaugcugucaugagg

SEQ ID NO: 162886 - RNA, 41 nt, Homo sapiens
ggcacuguccugcaggucucccaauguacuucauggcuuuu

SEQ ID NO: 162887 - RNA, 51 nt, Homo sapiens
cuacaacugguuuacuuaacaugcaauugaauuguuauuuaaauaaauuac

SEQ ID NO: 162888 - RNA, 41 nt, Homo sapiens
uagacuaguugaacuuugaggucacucuaugauucuuuuau

SEQ ID NO: 162889 - RNA, 85 nt, Homo sapiens
uuauauaggaaaauuaaguccauugauccugucuuuauccucagagggcagaaaugagacaaguggauaaaggcuguaggaagcu

SEQ ID NO: 162890 - RNA, 120 nt, Homo sapiens
acagugcaauucauguaguuccuggcauaauugccuuuuuuuuuuccuuaauggagaggcaggguucugauuggugcuguauaaauuuaaguaacuuugugcuuuguaggaauggugaca

SEQ ID NO: 162891 - RNA, 49 nt, Homo sapiens
cuacaaauauuuauguuuccugcuauguucaagauauuguaguggcacc

SEQ ID NO: 162892 - RNA, 25 nt, Homo sapiens
acucugcauuacuaaacaaauauaa

SEQ ID NO: 162893 - RNA, 39 nt, Homo sapiens
uaucaauguguuauuaguaauacaacuuuagguacagac

SEQ ID NO: 162894 - RNA, 41 nt, Homo sapiens
ucauagaagccucugcaguuuaacagaaggagccacauauu

SEQ ID NO: 162895 - RNA, 98 nt, Homo sapiens
aaauucuuauauuuugccucccccaaaagaauuucauauuauuugaauuagggggcgaagaagucuuuugaaagacuugcagaugcaauagucuaauu

SEQ ID NO: 162896 - RNA, 67 nt, Homo sapiens
ggaauuuuuccucaauuagcaucggcaucugcuauagauucaaccuuauauuaaaguggaaaaauga

SEQ ID NO: 162897 - RNA, 51 nt, Homo sapiens
gucaacagcacagagacaguaauauuuaaagcaauggcgugugaugaaguc

SEQ ID NO: 162898 - RNA, 56 nt, Homo sapiens
ugaugaugcuuucugcugugcuggggaauacuuagaagaauguauuuggggagaga

SEQ ID NO: 162899 - RNA, 56 nt, Homo sapiens
cauggugccuggguguuacuucaggauagauugauucugaaauauuuccuugggga

SEQ ID NO: 162900 - RNA, 46 nt, Homo sapiens
augaugagugcuuagugaaguuacuuaaaggauguugccucaagaa

SEQ ID NO: 162901 - RNA, 50 nt, Homo sapiens
uggaaguguuauccucuccuguauugaagccaacacagaagccaaacaac

SEQ ID NO: 162902 - RNA, 91 nt, Homo sapiens
uguacuucagaaccguuuuguuaaaucuuauggcauaguuuuccccaaaaagaacacaaccugggagaauugauaaguuguaaacauaaug

SEQ ID NO: 162903 - RNA, 75 nt, Homo sapiens
ggaaaaaguggugaaaaaauccuugacauuuuccucaagcaguuagaaguuuguggagauuuuaggugccuuuca

SEQ ID NO: 162904 - RNA, 75 nt, Homo sapiens
uguaaauugucguucugucuuggaauaacguuguacuugccuguaacuugcaaaaaaauuucaaaaguguaaaug

SEQ ID NO: 162905 - RNA, 58 nt, Homo sapiens
cccagggccucguauguucccuuuacugccguccucucuacugucacagccugaaaug

SEQ ID NO: 162906 - RNA, 46 nt, Homo sapiens
cuugaacuguuaggacgguuuaguaauuaagcuccuauccuucaga

SEQ ID NO: 162907 - RNA, 84 nt, Homo sapiens
aaugauguaugucuggaaugguuuuucaauagugagcaaaagaaaagaccuuucugaaaaucuguuaguaacuguugaaaaagc

SEQ ID NO: 162908 - RNA, 42 nt, Homo sapiens
guggauuaauguuuuccaacaaaacuggaugcaggcauauua

SEQ ID NO: 162909 - RNA, 37 nt, Homo sapiens
cuguucucagcuaaaauuucuauauuaaggugaucua

SEQ ID NO: 162910 - RNA, 49 nt, Homo sapiens
uugaugauuccugaggagauggaagucugaguaguaaucugucaaauuc

SEQ ID NO: 162911 - RNA, 44 nt, Homo sapiens
agguuuuugguaacaaggaacaguggaauccauuuccauuucca

SEQ ID NO: 162912 - RNA, 42 nt, Homo sapiens; identical to SEQ ID NO: 80303

SEQ ID NO: 162913 - RNA, 52 nt, Homo sapiens
aaauugccuuuacaaacagauauuuaaaugcaaugagugccugggaugugaa

SEQ ID NO: 162914 - RNA, 87 nt, Homo sapiens
gagauauucugguaguuaccuacucauaagugccuaauggcuaauuuugagaacuaaagaacuaugcaauguaaaucaaccacagug

SEQ ID NO: 162915 - RNA, 619 nt, Homo sapiens
aaaucuggaauaagguagaaaauuacuuuuuacuaauuauaaaaaguaggcugggccugguggcuugugccuguaaucccagcuacuugggaggcuaaggugggaggaucccuugagcccaggagguggaauguauuaguccauuuucacacuacucuaaagaacugcccaggacuggguaauuuauaaaggaaagagguuuaauugacucauaguucugcauagcuggggagaccucaggaaacuuaaagucauggcaggaggcaaagaggaagcaagguaccuucuucacaagguggcaggaaggagaagugcguguaggaggaacuugucaaacacuuauaaaaccaucagaucucgugagaacucacucacugucaugagaacagcaugggagaaaccacccccaugauccaaacaucucccaccaguucccacccuugauacaaggggauuauggggauuacaauucaagaugagauuugggugaggacacaaagccuaaccauaucacagagguugcagugagugcagaucaugccccuguacuccacccugggugacagagcaagaaccugucucuacauaaauaaaaaaaauaaacuaauaaacuugugac

SEQ ID NO: 162916 - RNA, 48 nt, Homo sapiens
uuuagcugcauuuuggcaugaaugacaugguauuuuuuguaugaguau

SEQ ID NO: 162917 - RNA, 45 nt, Homo sapiens
uguuuauuuuguuagaugaguauuaucaacuuguuauggacguug

SEQ ID NO: 162918 - RNA, 245 nt, Homo sapiens
uucaagggguaaguuauuuugauaucuuuuaaaaaaugauagguguuucacaguauggaagaugcuugguuuguggacauuuaggaauauucaagaauccaggaauggcuggcugcagcacccugaucagauggaugggaggaaaugaccccuguugcugucaauugcuugaugugccccccauaggacuagggcagaagguucaugaucagaagguuaacaugggugaaauuacauccugaugu

SEQ ID NO: 162919 - RNA, 45 nt, Homo sapiens
uugaauuaaaaugucugaauucccuguguucuucccagggcuaag

SEQ ID NO: 162920 - RNA, 49 nt, Homo sapiens
ugcuuuuuucuugaucuuuaguucaucaucaaccaagguggaucucaag

SEQ ID NO: 162921 - RNA, 42 nt, Homo sapiens
auacauccucucugccacuaugguuucuggcuuuugccuguu

SEQ ID NO: 162922 - RNA, 46 nt, Homo sapiens
uucaaaucuguuuacaaacuaguuguugaaacaacuguguuaaggu

SEQ ID NO: 162923 - RNA, 26 nt, Homo sapiens
gucaggcagcauggcuaaaggucagu

SEQ ID NO: 162924 - RNA, 49 nt, Homo sapiens
ggaggaaggaaccuuuugggaacacagaacauugaagcauggcugagac

SEQ ID NO: 162925 - RNA, 28 nt, Homo sapiens
gaccuauugaagcauguuaucaaugcag

SEQ ID NO: 162926 - RNA, 27 nt, Homo sapiens
cagaaaaagugcaagaauaacacagag

SEQ ID NO: 162927 - RNA, 28 nt, Homo sapiens
aaauuaaaauagucugugaacuuuauga

SEQ ID NO: 162928 - RNA, 28 nt, Homo sapiens
auuuagguugucacuggcuuagaaaugu

SEQ ID NO: 162929 - RNA, 83 nt, Homo sapiens
gguggcagggagacgagcugagaggguggugcaauaugugaaaugaaggcccagaggaugcucacuuggcuagccauggagaa

SEQ ID NO: 162930 - RNA, 53 nt, Homo sapiens
guggcuugggcuaugguaagagugguagggaugucagagaaggaugcuuggaa

SEQ ID NO: 162931 - RNA, 23 nt, Homo sapiens
aaagaaagaccuguggcuggagu

SEQ ID NO: 162932 - RNA, 50 nt, Homo sapiens
guuuggcuagauugauugaucgauaggaagggaaaaggagguggagaggg

SEQ ID NO: 162933 - RNA, 64 nt, Homo sapiens
ggggacauguguguucugagaaccaccugguggaggagggaugccaggguacuuugugagcaca

SEQ ID NO: 162934 - RNA, 27 nt, Homo sapiens
uggauguguccccuugguacugcugau

SEQ ID NO: 162935 - RNA, 69 nt, Homo sapiens
uuaaaggauuucucagaacgugaaagaggacuugacuugguggccugucccccaguuugagggucagug

SEQ ID NO: 162936 - RNA, 41 nt, Homo sapiens
aaauggaugcugugcuggccugccggcuccgggggcgggga

SEQ ID NO: 162937 - RNA, 46 nt, Homo sapiens
cgcgcgcuuuccaugugggcgccuuuggggagcuguggcggggccg

SEQ ID NO: 162938 - RNA, 45 nt, Homo sapiens
ccgcgguggccagggaucuggacugcagccuggaggcggcggcug

SEQ ID NO: 162939 - RNA, 98 nt, Homo sapiens
uccucugggacucaucccugagaagggccugugguuuagaccugggcuaggaguauuacccuuuaaagcuuucaacccgcuggagccuuccugggaca

SEQ ID NO: 162940 - RNA, 50 nt, Homo sapiens
gcgacguguaccugccauugacagacacuuugacaauggaggaaccugag

SEQ ID NO: 162941 - RNA, 47 nt, Homo sapiens
ugaggauccagaagucauuccggagaauacugaccuggugacuuugg

SEQ ID NO: 162942 - RNA, 36 nt, Homo sapiens
uaugggaugccugcuguguguuuuuucauuuugcua

SEQ ID NO: 162943 - RNA, 24 nt, Homo sapiens
cgugcaggugucuaccacaggcaa

SEQ ID NO: 162944 - RNA, 62 nt, Homo sapiens
guuagaaaaagguucuuggaacaucgggaagaaaccauuacaauagaucgagccugcagaca

SEQ ID NO: 162945 - RNA, 136 nt, Homo sapiens
ucuuaaaacaguaaaccgacauuggcugaggguuaguaaugacaguaugguagcuuuauacuggauaugcuuaguugaaaacaaacuagagaaacuccuuugagucugggaacuagugagagaagaggacccuuag

SEQ ID NO: 162946 - RNA, 44 nt, Homo sapiens
auaggaaaaaagccugaaaauucagcagacaugauugaagaagg

SEQ ID NO: 162947 - RNA, 52 nt, Homo sapiens
aaaacucacacaacugagggauucaauucgaugugucagugaccuccagauu

SEQ ID NO: 162948 - RNA, 51 nt, Homo sapiens
auuuugaaggaacauuuuauaaugauaaaagauacccagaaugcagagauu

SEQ ID NO: 162949 - RNA, 46 nt, Homo sapiens
ggucagagucccaugauagaggcuauggaaaguuucagacugcuag

SEQ ID NO: 162950 - RNA, 45 nt, Homo sapiens
cuugcuuauccuuauguugauccuggaaccuuuaauuaagaauag

SEQ ID NO: 162951 - RNA, 59 nt, Homo sapiens
uaauuauugucauaaugcauuauuccauguguggugucaauacauuuuagcggacaaag

SEQ ID NO: 162952 - RNA, 45 nt, Homo sapiens
auuuuaucccacauuuacuguauaauguagcuguuaauacugcac

SEQ ID NO: 162953 - RNA, 43 nt, Homo sapiens
auggggggaagggggaaauucaguccaaugagucuguaucaag

SEQ ID NO: 162954 - RNA, 51 nt, Homo sapiens
uggauuaaugcuuugagcccaaaaugagauauauuuuuuauuacuguagau

SEQ ID NO: 162955 - RNA, 46 nt, Homo sapiens; identical to SEQ ID NO: 80388

SEQ ID NO: 162956 - RNA, 49 nt, Homo sapiens
aaagucuauuauuuaaaaauuccaugcuagccuuuaaaaagaacccaaa

SEQ ID NO: 162957 - RNA, 45 nt, Homo sapiens
ucucauguuggccuuucagcauauuccuucugugagcagucugaa

SEQ ID NO: 162958 - RNA, 46 nt, Homo sapiens
cuguuuuagcuaaauuuuuccuuuuugauucaacuucuuucuuccc

SEQ ID NO: 162959 - RNA, 70 nt, Homo sapiens
ucccaguuuuuccuguaauuuuaagaaagaucaaaauaauaacaaacauccuguaagagaaaacugauaa

SEQ ID NO: 162960 - RNA, 62 nt, Homo sapiens
cuaguaaguguuauauaaguguuguccauuauguuguuguuguuguuacuucacguugugag

SEQ ID NO: 162961 - RNA, 62 nt, Homo sapiens
ugacuaaagcaguugacauaacuacuccaaaagcugccagaagggggagaaagagaaaggua

SEQ ID NO: 162962 - RNA, 58 nt, Homo sapiens
ugggcauuuuauaucaaaaugaauugacaaaaucauuauuuuauguaguuaaacagau

SEQ ID NO: 162963 - RNA, 80 nt, Homo sapiens
uauuuccuuacucagaaaauaaggaaaaguauggcaaaccaaauaaaagaaaagguuuuaaugaagguuuaugggagaua

SEQ ID NO: 162964 - RNA, 54 nt, Homo sapiens
uuaagaagugauaaguuucugauuccaugggauacuuuaaagaaacucuucagu

SEQ ID NO: 162965 - RNA, 27 nt, Homo sapiens
aguguauucuauauauaacaauauaau

SEQ ID NO: 162966 - RNA, 91 nt, Homo sapiens
gcuaaacguguucgugacagggucaagcgugcuuuccuuaucaaggagcagaaaaucguugugaaaguauugaaggcauaagcacagaguc

SEQ ID NO: 162967 - RNA, 79 nt, Homo sapiens
ugaaccccugguaauagaauuguucaccuuuauaccaagaagguugggaaagcaccaaaaucugcaugugguguguacc

SEQ ID NO: 162968 - RNA, 42 nt, Homo sapiens
gcaggcacucagaauaguccagcauuuggcauagcgacguag

SEQ ID NO: 162969 - RNA, 44 nt, Homo sapiens
gcagggaugauguucuggagagccccguggccaucacgccacag

SEQ ID NO: 162970 - RNA, 45 nt, Homo sapiens
ugagcuugaaaaagugguuguugagggcaaugacagccccagcau

SEQ ID NO: 162971 - RNA, 44 nt, Homo sapiens
aaacaugauuuauuuuuuaagggggguuggugagauccgaagag

SEQ ID NO: 162972 - RNA, 45 nt, Homo sapiens
gguguauacaucucaagugaaccuauuaacucagcacauugucug

SEQ ID NO: 162973 - RNA, 72 nt, Homo sapiens
cugacuaauaucuuacugaaaugugacuguuuguaauggggccaacuaucuucucugagaugcgcugcggga

SEQ ID NO: 162974 - RNA, 42 nt, Homo sapiens
aaauugcuauuaacccuaggucuuugugucucaugaggacag

SEQ ID NO: 162975 - RNA, 53 nt, Homo sapiens
caaaaguauuguugacucaguagucuuacaauguacuuaacccuagcaucuag

SEQ ID NO: 162976 - RNA, 51 nt, Homo sapiens
acaaaaauguugagguaaguguaauagauaguguuguagcaauccagauaa

SEQ ID NO: 162977 - RNA, 30 nt, Homo sapiens
aacaacuacuaauuuuacagaaagguauag

SEQ ID NO: 162978 - RNA, 46 nt, Homo sapiens
aucacauugaugggaaauaagauuucguaaguaaaacaagacccau

SEQ ID NO: 162979 - RNA, 46 nt, Homo sapiens
uuaauucuuuuuguugcuugcucuaauuuugacuuuaccuuaggaa

SEQ ID NO: 162980 - RNA, 47 nt, Homo sapiens
uugagugccaagauauguguaugagggagaggcaggcaagcuaagac

SEQ ID NO: 162981 - RNA, 67 nt, Homo sapiens
aaagcauuagaggggauuuugagugggggcugaagugugcagggcuauaggguuucuaggauuccug

SEQ ID NO: 162982 - RNA, 94 nt, Homo sapiens
uuagacuuaccuucuccugucucuucacuuuuacuuuguuagucacgagaaccccaggaauuuuaucuccuugguuuuucccuuuuaauuugcu

SEQ ID NO: 162983 - RNA, 45 nt, Homo sapiens
aagugagugaaaaaguccugaugaauagugagaggccugaugaga

SEQ ID NO: 162984 - RNA, 41 nt, Homo sapiens
accaaauccauuguggagcugauggcaauucaggagaaaga

SEQ ID NO: 162985 - RNA, 47 nt, Homo sapiens
uaucuacaaauuuaguaguggaacuuugguuuaugcaaggagaggua

SEQ ID NO: 162986 - RNA, 69 nt, Homo sapiens
gucccuaaguaaguuaguccccccaaaacuaacuuacauaagauuccauaugaggagaaaagucagaaa

SEQ ID NO: 162987 - RNA, 44 nt, Homo sapiens
auacacaaaaacaaagaacagaaagagggaggggcaucucuuug

SEQ ID NO: 162988 - RNA, 46 nt, Homo sapiens
guugcaggcaaaaguauucccaaccugcaaucugaauuguauggag

SEQ ID NO: 162989 - RNA, 35 nt, Homo sapiens
uuuuccugccugacuacuccugucaucuguuugca

SEQ ID NO: 162990 - RNA, 88 nt, Homo sapiens
uugcccaccugcagccaaaaccacauagcuuuauaguauuugaaucuugugucuugaagaaaccaugcagauacauguaauuugagag

SEQ ID NO: 162991 - RNA, 46 nt, Homo sapiens
uuuuccagugugucaaaaacaaggagcuuuauuucggggguggaau

SEQ ID NO: 162992 - RNA, 47 nt, Homo sapiens
guuucugaggaauauauguuugcugaaaagcugaaaauuaggguuag

SEQ ID NO: 162993 - RNA, 32 nt, Homo sapiens
gucacuucuggauucccaguggauuuaaaagg

SEQ ID NO: 162994 - RNA, 88 nt, Homo sapiens
ugugcuucuaguuguucuucaaguaaacugacucagccccaggcuuacugucuugccuuuaggcaaacagguaacuugaguuacacau

SEQ ID NO: 162995 - RNA, 52 nt, Homo sapiens
aauuguuaaauuggguuauuuuuuaagugcaguuguauucaaauaaggaccc

SEQ ID NO: 162996 - RNA, 46 nt, Homo sapiens
cccacugugcaguacuguaauaaaagagaaacaaaugaggcagcuc

SEQ ID NO: 162997 - RNA, 59 nt, Homo sapiens
uaauauucaacuauuaauauuguucugcuaaaacaguuuagaauaaagauuuaauguuc

SEQ ID NO: 162998 - RNA, 48 nt, Homo sapiens
cauggaaacaaaguggcuuccucauggguugcuuacugauccugcauu

SEQ ID NO: 162999 - RNA, 33 nt, Homo sapiens
ucuuugcuccuugauuggcuagugacaggcaaa

SEQ ID NO: 163000 - RNA, 50 nt, Homo sapiens
uauccuuuugccuagcucuuccauuaaaccacauaagcuccuugaggguc

SEQ ID NO: 163001 - RNA, 42 nt, Homo sapiens
uugaguugaguuugguggauggguaggauucugaauggugag

SEQ ID NO: 163002 - RNA, 44 nt, Homo sapiens
aaagaagcuaguuauauccaggacuuuccuugacaaauaauggu

SEQ ID NO: 163003 - RNA, 46 nt, Homo sapiens
ggguagauaaaauuucaacuugccagaugacacagggucagaaaau

SEQ ID NO: 163004 - RNA, 39 nt, Homo sapiens
ggcuugaggauuauuaugacucaugauauuuuagugucc

SEQ ID NO: 163005 - RNA, 38 nt, Homo sapiens
cuacccuucuccaguaaaacaacuaauugaugguugag

SEQ ID NO: 163006 - RNA, 36 nt, Homo sapiens
agagaggaaagaaaguuuaugauacagauaacagau

SEQ ID NO: 163007 - RNA, 52 nt, Homo sapiens
aaaaucaagaugaucugcuuauccagugauugccauuagcaaugaagaaaga

SEQ ID NO: 163008 - RNA, 45 nt, Homo sapiens
cacagacuauuggcuucuuggagcugacaugauucccucucggau

SEQ ID NO: 163009 - RNA, 46 nt, Homo sapiens
gccccguagcauuccuuucagcacagcuuucauuagccaaggggau

SEQ ID NO: 163010 - RNA, 46 nt, Homo sapiens
uaacgggauccaucccaacugagugacacuaaacagacagccagag

SEQ ID NO: 163011 - RNA, 45 nt, Homo sapiens
uuuuuuuagcauggaauugaaagucauaugguuaugauuugagaa

SEQ ID NO: 163012 - RNA, 45 nt, Homo sapiens
aaguagcacuuuuaaggaaucucacguuacaaagaaucucuggaa

SEQ ID NO: 163013 - RNA, 52 nt, Homo sapiens
ucaggacagguuaugucuguaggaacuuauauacaguaucuaguagauagaa

SEQ ID NO: 163014 - RNA, 50 nt, Homo sapiens
cagacguggcucaggaaauggccgagaguaaggugaaucacaaggcaaaa

SEQ ID NO: 163015 - RNA, 46 nt, Homo sapiens
aaaugaaaacuguccauagccccuuuuuguagagauaacacuucuc

SEQ ID NO: 163016 - RNA, 57 nt, Homo sapiens
uauaauaaaacuugaagaugaagcuauauucagggagaaaaucugcaaagagaggaa

SEQ ID NO: 163017 - RNA, 75 nt, Homo sapiens
ccauaaaaguggaucuugaucaucgcccucucuccuagacagagaaaagccuugucaguuuuuuuaugagagaga

SEQ ID NO: 163018 - RNA, 44 nt, Homo sapiens
guauuucaauuuuauauuaugucaguuuagagagacggauuaag

SEQ ID NO: 163019 - RNA, 47 nt, Homo sapiens
gcugguguaugaaaucuugaagggcugugaaaaguagaaaaugagau

SEQ ID NO: 163020 - RNA, 51 nt, Homo sapiens
agccugauaauguuucuguguuaugguccuauuguucugccuuggccagug

SEQ ID NO: 163021 - RNA, 46 nt, Homo sapiens
gugcuagacauaucuccacuguuuauucccugagcuacuguguguu

SEQ ID NO: 163022 - RNA, 51 nt, Homo sapiens
cuaucugucuuccuguaacccuugaggggucaauguugagaacagcauuuu

SEQ ID NO: 163023 - RNA, 47 nt, Homo sapiens
auauaaacuuauauaaccaguaaacccucacaugauagccuucagau

SEQ ID NO: 163024 - RNA, 43 nt, Homo sapiens
uucuucauaugauuugcauucucaagcauauucauuagguaca

SEQ ID NO: 163025 - RNA, 46 nt, Homo sapiens
auauagauauauguuccuuuaagaaaauuaagucuuuaaagugaau

SEQ ID NO: 163026 - RNA, 45 nt, Homo sapiens
uccagcaguccagaagaaaacacacgucagugccaaaagugugug

SEQ ID NO: 163027 - RNA, 35 nt, Homo sapiens
auuaagaguuguucuuccauauauuuuugauuuau

SEQ ID NO: 163028 - RNA, 64 nt, Homo sapiens
ucuggcaagcccauaccuaaaagaaaauccuauucagacucaauuugcauaaauccuaaaucag

SEQ ID NO: 163029 - RNA, 48 nt, Homo sapiens
auagguacagagcuuauauccuaaacucaucagaaccauaugaauauu

SEQ ID NO: 163030 - RNA, 44 nt, Homo sapiens
gugaggacuccaacaucugaaaccaauagggauccauagauuua

SEQ ID NO: 163031 - RNA, 52 nt, Homo sapiens
guuuucccucuuugccuauucccccuaagccaaauuuguaucuuggcuuuug

SEQ ID NO: 163032 - RNA, 42 nt, Homo sapiens
cagggaagaggcugcagaauaugcuaaacuuucggccaagag

SEQ ID NO: 163033 - RNA, 37 nt, Homo sapiens
aaggaugaaguucggucuucuccuuagcaggcuggac

SEQ ID NO: 163034 - RNA, 40 nt, Homo sapiens
aaacuauccuggagcccuucccuucaugugcagguuauag

SEQ ID NO: 163035 - RNA, 56 nt, Homo sapiens
uauagguucgaugaagaauggacaguccuggaaaaaugugauaagacaaaaaagag

SEQ ID NO: 163036 - RNA, 46 nt, Homo sapiens
uuucguaaccaaagugauuaauuuucaauuuacauguggcuaagaa

SEQ ID NO: 163037 - RNA, 46 nt, Homo sapiens
augcuguuauagaaugaacugaaaucuacguagaauagcucuagag

SEQ ID NO: 163038 - RNA, 49 nt, Homo sapiens
uuuggaaaaugaaugccauugcugcuguguuguguucuccuuacauagg

SEQ ID NO: 163039 - RNA, 48 nt, Homo sapiens
gaaauuauuaccgaaugugggggauccacggaaagugaacuccuggag

SEQ ID NO: 163040 - RNA, 45 nt, Homo sapiens
ucauauaaauaguccugucagaacacgggaugaguagagucuugu

SEQ ID NO: 163041 - RNA, 59 nt, Homo sapiens
uuuuuaacuacagugagaaaauuuaaaagccuuggcuucauagacuaaauaccugaaca

SEQ ID NO: 163042 - RNA, 46 nt, Homo sapiens
aacucucauguauuuguauuuaauauaaucuguuuagaugaucugg

SEQ ID NO: 163043 - RNA, 178 nt, Homo sapiens
caaggaacauuauuaauuguuaucuuuuuuaccugcaagucauagacaaggacuagagaaauucuuguauguguuaagaguuuaccuaagagacuauuaugacagcagucaggaaugauuucuuuaaaguauguaaauguagcgucuucauuauggcuuagauuuacaaugcugacga

SEQ ID NO: 163044 - RNA, 46 nt, Homo sapiens
uaacagacuaguggccuuauguggacuuuccaugaauaaaacagau

SEQ ID NO: 163045 - RNA, 47 nt, Homo sapiens
cacuuuaaaucuuuuauuaaagugaauuuuucaaaaaguagaccacu

SEQ ID NO: 163046 - RNA, 45 nt, Homo sapiens
cagagugaagaaaacagagaacugaagaugagaccaaaaucagau

SEQ ID NO: 163047 - RNA, 46 nt, Homo sapiens
caaaauaugucaggcaaacaaaauguucagguugaauaaugcuaac

SEQ ID NO: 163048 - RNA, 42 nt, Homo sapiens
uaaguggagagucccacuguuaauuuucaauuaacuacaaug

SEQ ID NO: 163049 - RNA, 46 nt, Homo sapiens
cuuguauccagcauagugccccauacauaguagguccucaaaacau

SEQ ID NO: 163050 - RNA, 48 nt, Homo sapiens
uuggagucaugguccacaaauuauaagguuaacuauuaucauguauca

SEQ ID NO: 163051 - RNA, 41 nt, Homo sapiens
uucagaaaccaacuucuaacaaaagcaguugaauuacacaa

SEQ ID NO: 163052 - RNA, 46 nt, Homo sapiens
guauaguuaaugcuucuauuaaaccaugacauaugauagaucagug

SEQ ID NO: 163053 - RNA, 80 nt, Homo sapiens
agagguauuuagcagaauucugccacaggguaauuuggcucuuucagauguucaaaaguagacccaaaucuuuacuggca

SEQ ID NO: 163054 - RNA, 44 nt, Homo sapiens
gugaugugggcccuuauguaaacaguugagagagugacuugcau

SEQ ID NO: 163055 - RNA, 51 nt, Homo sapiens
ucaggauuuuugcuucguguuguuuacccugcuuucuuuccuugucucuau

SEQ ID NO: 163056 - RNA, 55 nt, Homo sapiens
aauugaugcuguaaugagaugaacuuauauaucuaaaaggcuuugaguggaauau

SEQ ID NO: 163057 - RNA, 61 nt, Homo sapiens
uuuguauguacauacacacaugucauauauauguauauauccauauuuuuauauaagaaua

SEQ ID NO: 163058 - RNA, 44 nt, Homo sapiens
augacaucguguugaaccauuucacagaguuacaguuuguagga

SEQ ID NO: 163059 - RNA, 45 nt, Homo sapiens
aacaagucaagugacugcauguuuuugaccauggaguagaguaua

SEQ ID NO: 163060 - RNA, 58 nt, Homo sapiens
aauguuauauuuacagguuaaaguaacauucugguuguagaugaaccagauugugggg

SEQ ID NO: 163061 - RNA, 46 nt, Homo sapiens
aucagcgucaucaggaaaagacaaccauugaguuagguguaaagag

SEQ ID NO: 163062 - RNA, 46 nt, Homo sapiens
aaugcacagugcccccgcucuucucccugcugcauuucuuucuuau

SEQ ID NO: 163063 - RNA, 55 nt, Homo sapiens
agaggaauaauaaaacaauuggacaagauugaaagugaaugugcaucauaugaag

SEQ ID NO: 163064 - RNA, 59 nt, Homo sapiens
ccuccucucugccagcaaucccuuuuuuccuucggucuuccuuuucuuuuucucucccu

SEQ ID NO: 163065 - RNA, 47 nt, Homo sapiens
cgugcguuuuugauaaauuuaagaagucaaaucgcugacacagauag

SEQ ID NO: 163066 - RNA, 60 nt, Homo sapiens
caacacuucagcccaaauaggaaagcggaaagaacagcagaacuaccuaggacuggcuga

SEQ ID NO: 163067 - RNA, 67 nt, Homo sapiens
aguuauuccuucucuucugugucacuuuugacggaugguaccuaaugcaaucaaccacaggccgaga

SEQ ID NO: 163068 - RNA, 50 nt, Homo sapiens
aaaccuuucaacugggaauuagauaaaguaucuuuaauauaaggggaggg

SEQ ID NO: 163069 - RNA, 43 nt, Homo sapiens
uuacaguacauuuucacuuaaguacaugauagcucuagaaagg

SEQ ID NO: 163070 - RNA, 46 nt, Homo sapiens
ucagaugcaucguaagaaaugguuugaagaaaagugugaaaggggu

SEQ ID NO: 163071 - RNA, 50 nt, Homo sapiens
aaauuuccauuuuuuuucccuaaagcuauauacuuaaaaaagaaagaaag

SEQ ID NO: 163072 - RNA, 43 nt, Homo sapiens
agccagccgggcagccggaaagcuggccucauacaggugagau

SEQ ID NO: 163073 - RNA, 45 nt, Homo sapiens
acccucaggugaaaaauuuaugacuggaguucauuuggguggaga

SEQ ID NO: 163074 - RNA, 50 nt, Homo sapiens
gggaauguuuuccuauaagaaaaacugguaaagaugcaggaaaaauaaga

SEQ ID NO: 163075 - RNA, 46 nt, Homo sapiens
ucuacauuuugcugggcgaucuucaucuacuguaaggacccuggag

SEQ ID NO: 163076 - RNA, 30 nt, Homo sapiens
uuugugguuguagagaaaacagagugaauc

SEQ ID NO: 163077 - RNA, 47 nt, Homo sapiens
cauuuaaacgaguauuacuuucaauauauacaguuacgcuaguuuuu

SEQ ID NO: 163078 - RNA, 29 nt, Homo sapiens
aguggaugugagagaaagagagacacaga

SEQ ID NO: 163079 - RNA, 46 nt, Homo sapiens; identical to SEQ ID NO: 80539

SEQ ID NO: 163080 - RNA, 37 nt, Homo sapiens
agaggcgagagagaacacaggcaaaaacacacaggca

SEQ ID NO: 163081 - RNA, 46 nt, Homo sapiens
aaaagcaauuauuguggaagugauacuugucuucuuccuucuaguu

SEQ ID NO: 163082 - RNA, 45 nt, Homo sapiens
uuuuugggcgggaggaggugaacuuuuuacugucuuuccaucuau

SEQ ID NO: 163083 - RNA, 40 nt, Homo sapiens
guuuugauguacucaaugcuuuuaaguaauacugucuggg

SEQ ID NO: 163084 - RNA, 73 nt, Homo sapiens
uagucucuuuuuucccuguagugaaaaacaaacugccaacuuaugaacacaaccugucugagcuccucuaacu

SEQ ID NO: 163085 - RNA, 89 nt, Homo sapiens
auucucuccucggacccuuucauaccauuuucccucuggcuuagaucuucaauaucguuuucucucuuggcuucauccccuuugccugu

SEQ ID NO: 163086 - RNA, 42 nt, Homo sapiens
aaagcuuguacacucaagucaucguguaguuucuuuggagau

SEQ ID NO: 163087 - RNA, 49 nt, Homo sapiens
uauaagcuuucacauuuuacacaguuuuucugauaaagcucagugagac

SEQ ID NO: 163088 - RNA, 45 nt, Homo sapiens
aucuugugggugaauuuagacugaugguuggugaaugcuuugaga

SEQ ID NO: 163089 - RNA, 60 nt, Homo sapiens
ccagugcucacaauauacuaggguuuuuuuuuuuuuaaaccauuuucaaugcaauuuaag

SEQ ID NO: 163090 - RNA, 57 nt, Homo sapiens
ugugcuggggacagcagcuuuauauuucuagaacaauaauaacuuuuuauaugauuu

SEQ ID NO: 163091 - RNA, 63 nt, Homo sapiens
auaucuaaauuuuuucaccccuauugaaaaugcaugauuuagacccaauauguggaugcacaa

SEQ ID NO: 163092 - RNA, 25 nt, Homo sapiens
gugggcuuugauucauucccacuug

SEQ ID NO: 163093 - RNA, 44 nt, Homo sapiens
acuuuuuaaugcuaaacagucaucucagaauauguucuguggaa

SEQ ID NO: 163094 - RNA, 40 nt, Homo sapiens
ucuaaagcccuuaucaccauaaccucucagcuagagagcc

SEQ ID NO: 163095 - RNA, 38 nt, Homo sapiens
cccuucaugcuguauguuuuauuuguuuccuaacuuca

SEQ ID NO: 163096 - RNA, 51 nt, Homo sapiens
uaaugagcuaguacauggguuaaaauguuauauuaguaguuucaagaaagg

SEQ ID NO: 163097 - RNA, 38 nt, Homo sapiens
cccuccucccuccuucccuccuucuuucccucccucuc

SEQ ID NO: 163098 - RNA, 45 nt, Homo sapiens
aagacugucucuuuguguauguuuaccauauuagagacaaaaauc

SEQ ID NO: 163099 - RNA, 96 nt, Homo sapiens
guuuccuugugucucucugagcacugacccccagccaguuuuaucccaguacugaggacugcccaaacugagaagguucuccccagccugccagua

SEQ ID NO: 163100 - RNA, 42 nt, Homo sapiens
gucuguaugucaggccugauagaauguaagguugagcccaga

SEQ ID NO: 163101 - RNA, 45 nt, Homo sapiens
ggagguuuuagguuuauguuuguguuuagauuaaauuugaauggu

SEQ ID NO: 163102 - RNA, 51 nt, Homo sapiens
uggaauucguuucaacuaagguggggaaucuagaaggaaaaacagguggga

SEQ ID NO: 163103 - RNA, 71 nt, Homo sapiens
gggcaauuggauuuguuuuggugucugacuuuguugacaauccuguuguuauauuaaagcuguuucuugca

SEQ ID NO: 163104 - RNA, 46 nt, Homo sapiens
ggacuugugugacacucuuacuagaugcauaccuagccuccagcua

SEQ ID NO: 163105 - RNA, 46 nt, Homo sapiens
cuuggguccuagagaccaaagaaagaaucagcaggaaugcccaggg

SEQ ID NO: 163106 - RNA, 48 nt, Homo sapiens
uucaguguaguugugcaauggaaauggacuuacagggugguggggagc

SEQ ID NO: 163107 - RNA, 41 nt, Homo sapiens
agauggcagagaugagccucucuucucaguauggcugguga

SEQ ID NO: 163108 - RNA, 43 nt, Homo sapiens
augcauuuuguucaguuucauuuaagcacaaaugguuaagagc

SEQ ID NO: 163109 - RNA, 46 nt, Homo sapiens
aauaaauuuuguuucaaccugugcagcuguaguuuacuuuccaggc

SEQ ID NO: 163110 - RNA, 45 nt, Homo sapiens
cucaagcuagugauuaggcuuuacuccagcuuuaaccucaggcaa

SEQ ID NO: 163111 - RNA, 44 nt, Homo sapiens; identical to SEQ ID NO: 80589

SEQ ID NO: 163112 - RNA, 98 nt, Homo sapiens
gagggcaagguagagggugcugaguauugcaaaaggacugaaggccugagauuagagagagcuugcuugggacauuggagguguggacaggccauugu

SEQ ID NO: 163113 - RNA, 95 nt, Homo sapiens
ugagaccacucuucauuuuucagauagaauauuacucagaauccaaaaauacaaagcagugaccaccaacuggaguuuguggggucagagaagau

SEQ ID NO: 163114 - RNA, 51 nt, Homo sapiens
ugaguacucuaaggaaguagcauuguuuucuucuuucuacagaagagugac

SEQ ID NO: 163115 - RNA, 44 nt, Homo sapiens
guuuagcaguuucuggugacugucauggggugguggugggugug

SEQ ID NO: 163116 - RNA, 46 nt, Homo sapiens
aaacauugcagauaggcucugugguauggaccagaaggcacaaggu

SEQ ID NO: 163117 - RNA, 49 nt, Homo sapiens
gagauauuucaucugugaauuggaaauugauggccuagugcugugauag

SEQ ID NO: 163118 - RNA, 362 nt, Homo sapiens
caaccucuucuccacagcguaaaaugcaaauuuugcauggggucaggugcgguggcucacgccuauagucccagcacuuugggaggcagaggcgaguaggucacuugaagucaggaguucgggaccagccuggccaacauggugaaaccccaucucuacuaaaaauacaaaaauuagucgggcgugguggcaugcgccuguaaucucagcuacuuugggggcugaggcaggagacuugcuugaacuugggagguggagguugcagcgagccgagauugcgccacuguacuccagccugggcgacagagggagacuccaucucaaaaaaaaaaaaaaaaaaaaaaaaucuuuugcauggaauc

SEQ ID NO: 163119 - RNA, 39 nt, Homo sapiens
uuuuguauacggauaaguggaaaugguggaaaaaaagau

SEQ ID NO: 163120 - RNA, 39 nt, Homo sapiens
caccuuuucauggaugcauucaguuuguucaccagcuga

SEQ ID NO: 163121 - RNA, 46 nt, Homo sapiens
aaaaauuguuagauuuugauguucaagcuguacauuuggcguaggc

SEQ ID NO: 163122 - RNA, 46 nt, Homo sapiens
guuccguaugauaagagacacacuucaugcccugaaggguggaauu

SEQ ID NO: 163123 - RNA, 29 nt, Homo sapiens
aaaaagucuugguaguacuccaggggaca

SEQ ID NO: 163124 - RNA, 41 nt, Homo sapiens
aagaccaacaguuugugaaggaauuuugcuuaacaggccaa

SEQ ID NO: 163125 - RNA, 46 nt, Homo sapiens
agcuucacugucuggaaaggcaaggaaaaaccgaaaggccccacug

SEQ ID NO: 163126 - RNA, 50 nt, Homo sapiens
ugaaauuccuuuucagugucuuuuuuuuuuuuuuuuucaguccaaagcca

SEQ ID NO: 163127 - RNA, 37 nt, Homo sapiens
uuauuauggaucaaaaaauaaguuaaagaaauaggau

SEQ ID NO: 163128 - RNA, 57 nt, Homo sapiens
gcagguauuauuuuucuucccuuuacccuagccuauguuaacuauuugucuacacau

SEQ ID NO: 163129 - RNA, 38 nt, Homo sapiens
cugaaaaacccuaggugaaaucuccugugaagugaguu

SEQ ID NO: 163130 - RNA, 42 nt, Homo sapiens
ugacagccuccucacuucuagcaaggggcagcugcagaaaau

SEQ ID NO: 163131 - RNA, 46 nt, Homo sapiens
cagcuccagaccacgugccacacccuccuguccaacauccaaggug

SEQ ID NO: 163132 - RNA, 26 nt, Homo sapiens
cgucggacagugcgggcggcgcgucg

SEQ ID NO: 163133 - RNA, 37 nt, Homo sapiens
aguguuugacacacauaaaagcccaaauaaauguaag

SEQ ID NO: 163134 - RNA, 92 nt, Homo sapiens
agagugaauuggacauguaauucacccucaggaggcuucaaaauuuggagaauguuacaacucaacacugucuuuuauaguuucuucucuaa

SEQ ID NO: 163135 - RNA, 43 nt, Homo sapiens
ccuaauuaaagcagaagagcccgagaagaagcaaaaaguggaa

SEQ ID NO: 163136 - RNA, 56 nt, Homo sapiens
agguggcauucuacuaaguacuagucggcccuacaagacaaagcccacccacgcca

SEQ ID NO: 163137 - RNA, 63 nt, Homo sapiens
cacucccgcgcagugagguuggcacagccaccgcucuguggcucgcuugguucccuuaguccc

SEQ ID NO: 163138 - RNA, 42 nt, Homo sapiens
aggaagcaguuaaggaaaauguuuguaugcaguggauucugg

SEQ ID NO: 163139 - RNA, 38 nt, Homo sapiens
gcugagggcugaguugccagcuaccuggugcagaguca

SEQ ID NO: 163140 - RNA, 44 nt, Homo sapiens
uuggaauaauugguggaacaggccuggaugauccagaaauuuua

SEQ ID NO: 163141 - RNA, 81 nt, Homo sapiens
uaagcagucauacaaaaugcuuuaggcuauuguagcuggucauuuucagcucaaauggacgacgcgugggaaccggcaggg

SEQ ID NO: 163142 - RNA, 36 nt, Homo sapiens
aacauauuaccccacauaucaucuuuaguggugaga

SEQ ID NO: 163143 - RNA, 41 nt, Homo sapiens
gcaaguaucgccauggcgacagauuaugacugcuggaagga

SEQ ID NO: 163144 - RNA, 48 nt, Homo sapiens
cauaaaaauuucaaugauuucuuacagugggguaaggauaagggauag

SEQ ID NO: 163145 - RNA, 73 nt, Homo sapiens
uaacuugaaaaaaauaugggaaagacaugcagcuuucaugcccuugccuaucaaagaguauguuguaagaaag

SEQ ID NO: 163146 - RNA, 47 nt, Homo sapiens
ugcaacaauaaaggguggaggguaaucucuacuuuccuauacugcca

SEQ ID NO: 163147 - RNA, 52 nt, Homo sapiens
gaugcauacaaagaauuauauauaaagaaggguguuuaauaaugauaguuau

SEQ ID NO: 163148 - RNA, 45 nt, Homo sapiens
auuggagguaaauuaugucuuaguuauaauuagauugugaaucag

SEQ ID NO: 163149 - RNA, 124 nt, Homo sapiens
gaaauauauauaaccuuguuauuguauuugggggagggauacugggauaauuuuuauuuucuuugaaucuuucugugucuucacauuuuucuacagugaauuuaaucaaauaguaaaguuguug

SEQ ID NO: 163150 - RNA, 55 nt, Homo sapiens
gauaaguaaaguauaaguuacgcauucuagauuggauuuaaggaauucuacaaaa

SEQ ID NO: 163151 - RNA, 50 nt, Homo sapiens
uuguucugccaucucaugaucagagaugcaaggaauagacugaauugggg

SEQ ID NO: 163152 - RNA, 34 nt, Homo sapiens
aggggguggggagacgccggccccuuggcccagc

SEQ ID NO: 163153 - RNA, 47 nt, Homo sapiens
ccaagaaaaacaaagacccagugaacaaauccgggggcaaggccaaa

SEQ ID NO: 163154 - RNA, 31 nt, Homo sapiens
guaauuuacaccagaaauaccaaggguggag

SEQ ID NO: 163155 - RNA, 44 nt, Homo sapiens
uaaacauguaucaagacaucacaguguacccauauaauacauac

SEQ ID NO: 163156 - RNA, 24 nt, Homo sapiens
uggggaaaaauucugaacauuuau

SEQ ID NO: 163157 - RNA, 44 nt, Homo sapiens
uauuguccagaugagguggaggccaugggagagaugaugggagc

SEQ ID NO: 163158 - RNA, 88 nt, Homo sapiens
aaggguuuugaagggaacaaaaauaagaggcugagguagagaaucauuggugaagggugagaggaagccauuuuucaaagaauauuag

SEQ ID NO: 163159 - RNA, 51 nt, Homo sapiens
uaagcauagacucuuguuaaagguuguacccauuaauguuuauccccacca

SEQ ID NO: 163160 - RNA, 50 nt, Homo sapiens
uuuuguguuuggauucuuuguacuuuuucauguucaguacaucaauaaac

SEQ ID NO: 163161 - RNA, 43 nt, Homo sapiens
caguguuuuaucagagcacuuaauaaaauguaaggcugguauu

SEQ ID NO: 163162 - RNA, 46 nt, Homo sapiens
uucaucaggaugcacugagaacuauauaguuacguccugcuuuuug

SEQ ID NO: 163163 - RNA, 46 nt, Homo sapiens; identical to SEQ ID NO: 80669

SEQ ID NO: 163164 - RNA, 46 nt, Homo sapiens
aaucacuuuuguuguccugaggacuugaauuuacagugcaucagau

SEQ ID NO: 163165 - RNA, 47 nt, Homo sapiens
gaauguuuuuguaucaguuuuuuccuuuguaaauggcauuaacauug

SEQ ID NO: 163166 - RNA, 45 nt, Homo sapiens
ugucuuaaggaaaaaagacguugcacaugauuuguacugcagcaa

SEQ ID NO: 163167 - RNA, 47 nt, Homo sapiens; identical to SEQ ID NO: 80673

SEQ ID NO: 163168 - RNA, 67 nt, Homo sapiens
auuugcagcgguuggaaaauuuagaaagauuuaugguguagaaaauacuuuugagaucuuuguauga

SEQ ID NO: 163169 - RNA, 117 nt, Homo sapiens; identical to SEQ ID NO: 80675

SEQ ID NO: 163170 - RNA, 46 nt, Homo sapiens; identical to SEQ ID NO: 80676

SEQ ID NO: 163171 - RNA, 46 nt, Homo sapiens; identical to SEQ ID NO: 80677

SEQ ID NO: 163172 - RNA, 46 nt, Homo sapiens
cauaaucccuuuccacaguugauugguuucuuugauuuugggagug

SEQ ID NO: 163173 - RNA, 45 nt, Homo sapiens
uggcagucggugcccauuagcuuaaaaacguaaaaagacccagca

SEQ ID NO: 163174 - RNA, 38 nt, Homo sapiens
ugcaggcaccaacagaguugugaaaaucaaaaguagua

SEQ ID NO: 163175 - RNA, 71 nt, Homo sapiens
gugcaaugagaggguggugggucaaggcacgcacacacacacacgcaccacgcacacagagacacacucac

SEQ ID NO: 163176 - RNA, 53 nt, Homo sapiens
ccacucgccgccucuccccuucgaugauugcucagucuucccccagggaggca

SEQ ID NO: 163177 - RNA, 41 nt, Homo sapiens
uuaaauuauaaacucuaaucaaacauaaaaaaggauaaaga

SEQ ID NO: 163178 - RNA, 49 nt, Homo sapiens
gagaauaagagauugucaguuguaagggaaacuugguuucagaaaaugg

SEQ ID NO: 163179 - RNA, 36 nt, Homo sapiens
uaaauugcaaacguaggaugaacaagccugaaggaa

SEQ ID NO: 163180 - RNA, 55 nt, Homo sapiens
uuaaaucuaugcauuuauuuuuuucauuggaauauuugcagugcugaagagagug

SEQ ID NO: 163181 - RNA, 43 nt, Homo sapiens
augcuaacuguuuaaguuuuauucugauccugggauaacaaac

SEQ ID NO: 163182 - RNA, 55 nt, Homo sapiens
aguuaccugguccaaagcaccaauaaugcugugguugagaaauucuaaucuguag

SEQ ID NO: 163183 - RNA, 72 nt, Homo sapiens
uuagcaaauucuucuuucuguucuccuuguuucaaggacaggaacuacugugucccucauuucugagcugcu

SEQ ID NO: 163184 - RNA, 25 nt, Homo sapiens
acucuagcuguguagaggcuguuuu

SEQ ID NO: 163185 - RNA, 46 nt, Homo sapiens
uguucauaaauaugcauggauaaaaauagauuguggaguauaguga

SEQ ID NO: 163186 - RNA, 57 nt, Homo sapiens
ucacaauauggacgcauuauuacuucucguauucuugucgaccaggucacugguaag

SEQ ID NO: 163187 - RNA, 62 nt, Homo sapiens
caaauuuauaugucagcggacuuccaaaaacaaugacccagaaggaguuggaacagcuuuuu

SEQ ID NO: 163188 - RNA, 78 nt, Homo sapiens
gcauugaggauacagugaugaccaagaaugaugugguuucuucccucacagaguuuacaugaggaaugaugauuauaa

SEQ ID NO: 163189 - RNA, 93 nt, Homo sapiens
aaaccaaagggaaugcgaucaggaauagcucaugagacuaaauguuggcaaagauagguuauaggcagagagucaucaauuacaauuggggca

SEQ ID NO: 163190 - RNA, 59 nt, Homo sapiens
uugccauucuguuuuccuguuaauugguuuguaaucuuauaaaagggagagacacuauc

SEQ ID NO: 163191 - RNA, 47 nt, Homo sapiens
ccaaguggcaaaggggauacuauuuggcgguuuaauuacagccagug

SEQ ID NO: 163192 - RNA, 48 nt, Homo sapiens
uaaaugucuaucuagaaauuugugcuugccuuaaccaaauaaccauau

SEQ ID NO: 163193 - RNA, 29 nt, Homo sapiens
uguaguccuggaaacuaauaauucagaaa

SEQ ID NO: 163194 - RNA, 67 nt, Homo sapiens
ccaauggauuuccuuuagauuuucccacaguuguuggagcagaggcagagccuacaaagagggaagg

SEQ ID NO: 163195 - RNA, 71 nt, Homo sapiens
ucuuaaucccaagggaagugaguuagaaauacaguuucugggauccacuguagaucuacucgaucccuguc

SEQ ID NO: 163196 - RNA, 96 nt, Homo sapiens
gguggucauacaauuuagccaagaccaggcaguugaagaaagagcugcgacucaaacaaauccuugucuucugaucguuauaucaaaacucuugcc

SEQ ID NO: 163197 - RNA, 45 nt, Homo sapiens
gcagagcuugggauauggcuuugugaacuacauugaccccaagga

SEQ ID NO: 163198 - RNA, 51 nt, Homo sapiens
ggugacgauccacuuucaucauuaaugaauauuuucaucauugcaucagca

SEQ ID NO: 163199 - RNA, 40 nt, Homo sapiens
uuuuaaaaacugugcgcucauuuauaaccagaaauaugca

SEQ ID NO: 163200 - RNA, 42 nt, Homo sapiens
ccuucauauuguuuaaucuggugccauaaaaacauagcgccu

SEQ ID NO: 163201 - RNA, 42 nt, Homo sapiens
agcccagaaugaugauuaaugauauuacaccagccuuuauga

SEQ ID NO: 163202 - RNA, 42 nt, Homo sapiens
uagagagaugugugauuuuuacagaguuauccagagggcauc

SEQ ID NO: 163203 - RNA, 46 nt, Homo sapiens
caacuuaauagucaacuaccuuccucagaacaugacacaggaggaa

SEQ ID NO: 163204 - RNA, 54 nt, Homo sapiens
auuuuccuucaucccuuuaaguauucccugagaaaacuuagcuuacguagagaa

SEQ ID NO: 163205 - RNA, 48 nt, Homo sapiens
aggguuuagaaagucuaccugggaacauuguuaagguagauuaggaug

SEQ ID NO: 163206 - RNA, 45 nt, Homo sapiens
uccagagcauaguaaauguuuuggugguuuguaggaaugugagca

SEQ ID NO: 163207 - RNA, 49 nt, Homo sapiens
ggaaucaauaauugcuaguuucuuucccuugccauuuauuuuuacuuuu

SEQ ID NO: 163208 - RNA, 48 nt, Homo sapiens
guaguggagugcugcccauuauuuuaguuagauccccacagccgugga

SEQ ID NO: 163209 - RNA, 47 nt, Homo sapiens
uuaaaauagucuaagauagagcgauagaguggcauuugaguagaucu

SEQ ID NO: 163210 - RNA, 45 nt, Homo sapiens
cccaagucuguuuaccaaaccuugguggucaagcaggcugguaaa

SEQ ID NO: 163211 - RNA, 58 nt, Homo sapiens
uguugcccuuuccucauguuugaauucuugucuuucccauuaaaauuuauuuacaggu

SEQ ID NO: 163212 - RNA, 36 nt, Homo sapiens
acguugagcuuuauggugacagaugagaugaaggau

SEQ ID NO: 163213 - RNA, 47 nt, Homo sapiens
uccaaggaccaaaauggguacacuucguuuucauaauauuccaaaau

SEQ ID NO: 163214 - RNA, 36 nt, Homo sapiens
uccucugaggagauuuaaaaagcggcucauugcccu

SEQ ID NO: 163215 - RNA, 46 nt, Homo sapiens
ucaucuuucuaggggagggguaaauuuaagaauaaagcuguggaau

SEQ ID NO: 163216 - RNA, 93 nt, Homo sapiens
gcucuaaucauggauggcuaacuuuaagaagcguuauugggccagguucuccugugguauaugccaagcucaugcucgugcauggguacacac

SEQ ID NO: 163217 - RNA, 36 nt, Homo sapiens
gucuaguuggugaguuuaauuuacuuggaccaccca

SEQ ID NO: 163218 - RNA, 48 nt, Homo sapiens
uauuuguuggaguggaagagacuuaggcaguuuuuuuuuuguagaaac

SEQ ID NO: 163219 - RNA, 24 nt, Homo sapiens
aaaauacguggaguuggcaauuga

SEQ ID NO: 163220 - RNA, 47 nt, Homo sapiens
aacccagcauuaauguagcuucuuaggauggaacaaugcccauaaaa

SEQ ID NO: 163221 - RNA, 39 nt, Homo sapiens
gcacuuuggaagaaagcguguuaaaaugagguuccauuu

SEQ ID NO: 163222 - RNA, 28 nt, Homo sapiens
aauguuuauuuggaauugagagaggcua

SEQ ID NO: 163223 - RNA, 49 nt, Homo sapiens
agagaaaaacaaagccuuucugucccaguuucagugguuuuaguuaaga

SEQ ID NO: 163224 - RNA, 28 nt, Homo sapiens
aaaucauuuggcuuucuacugccaaaga

SEQ ID NO: 163225 - RNA, 70 nt, Homo sapiens
guagggguacaaugggagguuagauguggagugagcuucaagauugagaucggaaguucauuucgugggg

SEQ ID NO: 163226 - RNA, 26 nt, Homo sapiens
uuuuuuaauuuuaaagagcuagacua

SEQ ID NO: 163227 - RNA, 41 nt, Homo sapiens; identical to SEQ ID NO: 80747

SEQ ID NO: 163228 - RNA, 46 nt, Homo sapiens
caccguuacuuuaaaaacacacauacacaaaaaccuuaagggagaa

SEQ ID NO: 163229 - RNA, 54 nt, Homo sapiens
gagcgcgugugagagccgaggagggaggaaggaagacggggagggccaggagag

SEQ ID NO: 163230 - RNA, 50 nt, Homo sapiens
ucugugggugguuugaaggggaauccucacacacaaaggguugggggcug

SEQ ID NO: 163231 - RNA, 54 nt, Homo sapiens
aaacaaaaaggaaacauaagaaaaaacauaaagagagacauaaaaugggagaag

SEQ ID NO: 163232 - RNA, 44 nt, Homo sapiens
ugaguccacugaaccccaaaagcagugcucaaagaaaaagaaaa

SEQ ID NO: 163233 - RNA, 42 nt, Homo sapiens
gaagagaagaaaaagaaaaagaagaagaaaggccgaaugaaa

SEQ ID NO: 163234 - RNA, 46 nt, Homo sapiens
uccuaaaacagugaaaaauaagcccauuccagccuuaagaguugug

SEQ ID NO: 163235 - RNA, 46 nt, Homo sapiens
auuuauaauaggaguuacuucccaaaaauguuaaucacagcuggau

SEQ ID NO: 163236 - RNA, 44 nt, Homo sapiens
cgggcaaguucggggcuggcagggcggccggggugacgacggag

SEQ ID NO: 163237 - RNA, 36 nt, Homo sapiens
auagauuagucauauaucuuuuagauuuguggauuu

SEQ ID NO: 163238 - RNA, 87 nt, Homo sapiens
uacuuucuaguauauucugagucuaucuucuaagccaccuuacauuuuuccuggaacaagggagggaauaaauaguugccuccacua

SEQ ID NO: 163239 - RNA, 42 nt, Homo sapiens
ucuaccaauauaugguauuuaggaaaacuucuuuuauccaag

SEQ ID NO: 163240 - RNA, 52 nt, Homo sapiens
uuguugaaagcuaggccuguaaaauagagauggacagaccaugcauguuucc

SEQ ID NO: 163241 - RNA, 27 nt, Homo sapiens
ggaggcagagucucaaaggaacaccug

SEQ ID NO: 163242 - RNA, 55 nt, Homo sapiens
uuuuauuguucauucuaaucguuggacuacucuugugaaguuuauauuuugaguu

SEQ ID NO: 163243 - RNA, 41 nt, Homo sapiens
ugugauuuggggagauacaguuuacuuucccugagccuuaa

SEQ ID NO: 163244 - RNA, 42 nt, Homo sapiens
ggcaugacaagaaaaucuuaaaaacaggaaaaacccaaagga

SEQ ID NO: 163245 - RNA, 45 nt, Homo sapiens
guuccuuuccaauuauaaaagcaaccaagagaauggaguaaccga

SEQ ID NO: 163246 - RNA, 46 nt, Homo sapiens
uaguauuugaaaagacaagauggauaauagaaaaauacaggcucuc

SEQ ID NO: 163247 - RNA, 30 nt, Homo sapiens
ugguuauaagugaggaaauuagcccagaug

SEQ ID NO: 163248 - RNA, 48 nt, Homo sapiens
cagaggaggugcaaaguucauugggaugauuguuagucccuauaaucg

SEQ ID NO: 163249 - RNA, 31 nt, Homo sapiens
caccgagagaacauugccaggccuugggucc

SEQ ID NO: 163250 - RNA, 44 nt, Homo sapiens
ugcucauguuucuauggcagaagugauuggucuguuaggaggaa

SEQ ID NO: 163251 - RNA, 48 nt, Homo sapiens
aucccuuccaacugauaccuuguaauuuuuuuagugaagaaaagcagg

SEQ ID NO: 163252 - RNA, 46 nt, Homo sapiens
gguccgagacccauggggaaacuggugugaugcaaaggacuuagaa

SEQ ID NO: 163253 - RNA, 45 nt, Homo sapiens
cauacacuauccuuuggcaacugguccauuuuaaaggccucacua

SEQ ID NO: 163254 - RNA, 73 nt, Homo sapiens
uuuccucuuguguuucaccuuagcaauucgcuuuucuggguuucauucaauuucauguugcuuucugaggcaa

SEQ ID NO: 163255 - RNA, 39 nt, Homo sapiens
ugugucuguacauaaauuucugaauucaagguccuggga

SEQ ID NO: 163256 - RNA, 53 nt, Homo sapiens
aucuaguucuuaaacaaugcucagaauauagaagguacucuuauuuguuaggg

SEQ ID NO: 163257 - RNA, 39 nt, Homo sapiens
aaaaaauagaagaguuaaaguuuugaaauaaaaagaagc

SEQ ID NO: 163258 - RNA, 86 nt, Homo sapiens
uacuauaaauuacauggcaauaguuuccuaagucauuugccuugguucaugaaacugguuagguauugcuauuucauuauggugau

SEQ ID NO: 163259 - RNA, 23 nt, Homo sapiens
uaauauuauggggauuuuauuuu

SEQ ID NO: 163260 - RNA, 69 nt, Homo sapiens
cauagguuaaccccauuuaggcuuucuuauucucuaauucuccccagacauugcaguuauagccuagau

SEQ ID NO: 163261 - RNA, 48 nt, Homo sapiens
acagcaucaguuuuacaaaaagaucacuaucuugauucaucuuggaga

SEQ ID NO: 163262 - RNA, 43 nt, Homo sapiens
gauuaugagauaugcuuuagcauacgguaggugcccucugaau

SEQ ID NO: 163263 - RNA, 41 nt, Homo sapiens
cccaucauggcggcugaagaggcggauguggauaucgaagg

SEQ ID NO: 163264 - RNA, 159 nt, Homo sapiens
cuguuaacugcucucuuuucauauaggugauauuuuccuuuuucuuugcaagucuagcaaauuuugauuguacacuaguagauacaucagacauuguggauauguugucaagacuggauucuguuuuuaauuccuacagaaugauuuuuguucuuacag

SEQ ID NO: 163265 - RNA, 44 nt, Homo sapiens
ugaauuuccauuaagaccuuaaacuuauucauaauugcugauac

SEQ ID NO: 163266 - RNA, 46 nt, Homo sapiens
acuucacacagaaauuuagguucaaaaucauuuucucucagaaugu

SEQ ID NO: 163267 - RNA, 46 nt, Homo sapiens
cuuucacagaagauuuuuggcuggcaaauuuucuaaggcuuugcag

SEQ ID NO: 163268 - RNA, 52 nt, Homo sapiens
gucuauucuuucuucaaguauguccauucugcuacucagaucaucuacugaa

SEQ ID NO: 163269 - RNA, 44 nt, Homo sapiens
uuuguggcccacugaguccacucgcuccuacuuugcagugggag

SEQ ID NO: 163270 - RNA, 41 nt, Homo sapiens
gccucaguugccccuuuaugggugcaaaugucguccaagac

SEQ ID NO: 163271 - RNA, 21 nt, Homo sapiens
ugaggaccaguacaugagauu

SEQ ID NO: 163272 - RNA, 43 nt, Homo sapiens
uuuuauuguuaugcguuauacuuucccugcagccagaggcugc

SEQ ID NO: 163273 - RNA, 61 nt, Homo sapiens
gaaaaguaauuguguuuuauugauuaaauaauuugcaguggauuagaaagucacugaauuu

SEQ ID NO: 163274 - RNA, 44 nt, Homo sapiens
ccaaucagaaguaccuagaccaaagccaauuagaugggcgggag

SEQ ID NO: 163275 - RNA, 42 nt, Homo sapiens
cucagucucaggacccccguguuuuagccuccgcccgcgcca

SEQ ID NO: 163276 - RNA, 97 nt, Homo sapiens
cacagggcaaccugcguggaaacguuucuuucuccccauccuucaccgcucucgggaacggaaagaaagcuggaaggacgagcagcgaccaggcugc

SEQ ID NO: 163277 - RNA, 57 nt, Homo sapiens
acauuuugccaggugcaguaucuuccuugcuauuucuugcuccuggcuuuccuugua

SEQ ID NO: 163278 - RNA, 46 nt, Homo sapiens
agggcuaccucuugaaaguccauuacuuucacuagguaugacacca

SEQ ID NO: 163279 - RNA, 32 nt, Homo sapiens
cuuuacuguagaauuuuuaaaguacagaaaug

SEQ ID NO: 163280 - RNA, 47 nt, Homo sapiens
uuccugugcaucaugcuguagauauccuucauacauaggguugaguu

SEQ ID NO: 163281 - RNA, 51 nt, Homo sapiens
cuguuaauaccauucauuuccucuuucggaugagguauuucuucuaccuua

SEQ ID NO: 163282 - RNA, 46 nt, Homo sapiens
aauauuaaugccuguuuggucacuggauuccuuguuucuaucagau

SEQ ID NO: 163283 - RNA, 62 nt, Homo sapiens
gagauguagaaggggaaagagaauucagaaaguccuucucuucaguaacuuugacuucagaa

SEQ ID NO: 163284 - RNA, 64 nt, Homo sapiens
uacacaaggaaaauacacucacucuauaauuucuuauaaaauagcaaguaaggaguagaaguag

SEQ ID NO: 163285 - RNA, 28 nt, Homo sapiens
uccucgcaacagauaugcaucuuaucuu

SEQ ID NO: 163286 - RNA, 42 nt, Homo sapiens
uaaaucgaucggcggugauuaaagaaucgauguggccugggu

SEQ ID NO: 163287 - RNA, 47 nt, Homo sapiens
gagcacgaggggaggaguuccgagaggaaauaauuagugaaauauuu

SEQ ID NO: 163288 - RNA, 35 nt, Homo sapiens
cgccuccucuuuccucccucauuuaggccgccuag

SEQ ID NO: 163289 - RNA, 48 nt, Homo sapiens
ggcccagggagcgggugggugugagugugggugggugugagcgaguca

SEQ ID NO: 163290 - RNA, 54 nt, Homo sapiens
ccuucuugccucgugaugugggagggaagaaagaaggcggcaacugcaggcccg

SEQ ID NO: 163291 - RNA, 52 nt, Homo sapiens
guuuacucaaaucugcagaauucccagcaucagaccaugcauauagaagcac

SEQ ID NO: 163292 - RNA, 42 nt, Homo sapiens
uuuagaagucaaagcuggguagaguaauauuggaagcuguua

SEQ ID NO: 163293 - RNA, 46 nt, Homo sapiens
auuuccucaucuguaaaacggacaaaaaaauaccugaccgcuguaa

SEQ ID NO: 163294 - RNA, 45 nt, Homo sapiens
augucaucagccucugcagucaaaacaaaaccaaccauguccccc

SEQ ID NO: 163295 - RNA, 39 nt, Homo sapiens
uuuaaauuuguucauagccuacaucaccaaggucucugu

SEQ ID NO: 163296 - RNA, 143 nt, Homo sapiens
ccagcacugguuuugaaugcuguaugcaaccagucugaauaccacauacgcugcacuguucuuagaggguuuccauacuuaccaccgaucuacaaggguugaucccuguuuuuaccaucaaucaucacccuguggugcaacac

SEQ ID NO: 163297 - RNA, 46 nt, Homo sapiens
acccauggccagaugacagucacaagacuugugaauacguuaaaag

SEQ ID NO: 163298 - RNA, 41 nt, Homo sapiens
cuccagaauguuuaaugcaaucuaaauuuuauauugccucu

SEQ ID NO: 163299 - RNA, 46 nt, Homo sapiens
uuggcagcaagaaauguccuuguugagagugaacaccaagugaaaa

SEQ ID NO: 163300 - RNA, 76 nt, Homo sapiens
auuucugccuucgggaagccuuaaggaauaucuuccaaagaauaagaacaaaauaaaccucaaacagcagcuaaaa

SEQ ID NO: 163301 - RNA, 46 nt, Homo sapiens
acaauacaggggagcagguggcuguuaaaucucugaagccugagag

SEQ ID NO: 163302 - RNA, 67 nt, Homo sapiens
cuuacgaaaucuaccuguaaguggagauguugagaaucgaaugaggaauuggcaauuccaccugacc

SEQ ID NO: 163303 - RNA, 51 nt, Homo sapiens
uuauuucugagucauucagucauugaaguuaaugcaucagaggguuugaag

SEQ ID NO: 163304 - RNA, 42 nt, Homo sapiens
uuguggaaggggguccucuggaucucuucaugcaccggaaaa

SEQ ID NO: 163305 - RNA, 46 nt, Homo sapiens
ugauggauuacaaggaugacgaaggaacuucugaagagaagaagau

SEQ ID NO: 163306 - RNA, 55 nt, Homo sapiens
guugaaaaggaaaaaaauaaacugaagcggaaaaaacuggaaaauaaacacaaga

SEQ ID NO: 163307 - RNA, 62 nt, Homo sapiens
auuuccuaaaggaauuuaacaacaagaccauuugugacagcagcguguccacgcaugaccug

SEQ ID NO: 163308 - RNA, 65 nt, Homo sapiens
gcuacaagcgauauauuccagaaacauugaauaaguccaucagacagaggaaccuucucaccagg

SEQ ID NO: 163309 - RNA, 45 nt, Homo sapiens
ugucuagggauggcuguccuggccaucucacacuaugccaugaug

SEQ ID NO: 163310 - RNA, 47 nt, Homo sapiens
gauuuggugaaaugccuggcuccuauucgagaccccaagaccgagca

SEQ ID NO: 163311 - RNA, 50 nt, Homo sapiens
aaaaaaaagauuccagaugcaaccccucuccuugaugccagcucacugga

SEQ ID NO: 163312 - RNA, 71 nt, Homo sapiens
ucuauuucaccaauuggcauggaaccaacgacaaugagcagucaguguggcgucauucuccaaagaagcag

SEQ ID NO: 163313 - RNA, 49 nt, Homo sapiens
gagcuguggucagcauggaguuccagucagcagguguuucccuauucug

SEQ ID NO: 163314 - RNA, 41 nt, Homo sapiens
augaaugaaaccuuccuuguagaguugcugugaagauuaaa

SEQ ID NO: 163315 - RNA, 46 nt, Homo sapiens
cgcaccaucaccguugaugacaagaugucccuccggcuccacuacc

SEQ ID NO: 163316 - RNA, 48 nt, Homo sapiens
aucucuccucuuugucacaaccucuuugcccuguaugacgagaacacc

SEQ ID NO: 163317 - RNA, 43 nt, Homo sapiens
gcguaguaggcucuuacugacuaaaccugacacagaauaaaau

SEQ ID NO: 163318 - RNA, 47 nt, Homo sapiens
uccaugguuucaucucuuaugagaucugacauguuugguuuccagga

SEQ ID NO: 163319 - RNA, 45 nt, Homo sapiens
aaagauauuccuauagaggaaucagugugagugaaggcaggaggg

SEQ ID NO: 163320 - RNA, 40 nt, Homo sapiens
aagaagcgagggccuuagggaaugggauggagguucagag

SEQ ID NO: 163321 - RNA, 63 nt, Homo sapiens
guucucuacuuuuccuucauagcauuuuagcucuuuguaaugaccucuuucuguacaucuuag

SEQ ID NO: 163322 - RNA, 49 nt, Homo sapiens
ggggucccaguagcaauagauacaagucauuuucgguggcucuaugggu

SEQ ID NO: 163323 - RNA, 44 nt, Homo sapiens
uaaggaacuuuggagggcauccaauacuuuuucauuaugcaggg

SEQ ID NO: 163324 - RNA, 62 nt, Homo sapiens
uuugaggugaaauaugucucacuguuucauauucagcuggggaaugucucacuguuuuauau

SEQ ID NO: 163325 - RNA, 51 nt, Homo sapiens
agacaaugauagugacugagaauggcguaguagcaguguagguggcgagaa

SEQ ID NO: 163326 - RNA, 45 nt, Homo sapiens
uccaccuauaaaauuagggagauccuggcaugucagggcugaggg

SEQ ID NO: 163327 - RNA, 39 nt, Homo sapiens
acuuugcuuuuuaguaguccauauuacuugauaguaaag

SEQ ID NO: 163328 - RNA, 47 nt, Homo sapiens
gaauaacagaguuaagagucauaauuguauuucaauuaaugaauaca

SEQ ID NO: 163329 - RNA, 44 nt, Homo sapiens
gagucucagcucagauacuucucuuugcaaaaccugaguuaguu

SEQ ID NO: 163330 - RNA, 51 nt, Homo sapiens
acuaucuuuugacauagacuaguuuagaagacguugguuauggucuugaaa

SEQ ID NO: 163331 - RNA, 53 nt, Homo sapiens
gcaugugccucgggcuugugaacuuugaacgucacuaagagugagccauucau

SEQ ID NO: 163332 - RNA, 44 nt, Homo sapiens
ucuuuuucuccauuguuuugaugggccuuuccaaccuggcaacu

SEQ ID NO: 163333 - RNA, 24 nt, Homo sapiens
uguacaaagggacuaagaagggaa

SEQ ID NO: 163334 - RNA, 497 nt, Homo sapiens
uucuucuuguuuuauuuuuccuuaaggcuuuauuuucuuaaagcaguuuuagguuuagagcaaaaauuuuuuuuuuugagacagaguuucccucuugucucccaggcuggugugcaauggugcaaucuuggcucacuuccuggguucaagcgauuccucugccucagacuccuaaguagcuggcauuacaggugugcgccaccacacccugcuaacuuuuuguauuuuuuuuuuuuuuuaguagagaugguguuucacuguguuagucaggcuggucuugaacucuugaccucaggugauccgcccgccucagccucccaaagugcugggauuacaggcaugagccacugcgcccagccuagagcaaaauuaagaggaagguacagaucucacacuugcauaaccucccucauaaccaacauuucccaccagaaugguacauuuguugcacuugaugaaccuacacugacaucauuaucacccaaaguccauaguuu

SEQ ID NO: 163335 - RNA, 91 nt, Homo sapiens
cucugcaccaucaggugagcaaagaucuaguguguacucagaguuggaaaguggggucuggagacaauagcacuggccguaggagagaggc

SEQ ID NO: 163336 - RNA, 73 nt, Homo sapiens
cauggcauagaaugcuuucaccccaagcggcuguuucaggggcacuggcagguuuggaggggcauuguguuuu

SEQ ID NO: 163337 - RNA, 104 nt, Homo sapiens
guucuugggauuuauaaaugguuuuaguauugagaaguagaggagauaaauaguucuggugucaagggaagcggagcaauaaaaugaagcugaaacaugaccau

SEQ ID NO: 163338 - RNA, 66 nt, Homo sapiens
cuuauguagacauaaaauauuaagagagacuucaugaggaggcauuucucaguuucuuuuguaaug

SEQ ID NO: 163339 - RNA, 48 nt, Homo sapiens
auuuuuacuaugaugcauaaauauguaccuuugcaaguuuuagcagac

SEQ ID NO: 163340 - RNA, 68 nt, Homo sapiens
ugucuaguaaauacuguuuaaggguuauuagcacacaaugaucauaaaaucuuguaauacuuuuaaga

SEQ ID NO: 163341 - RNA, 41 nt, Homo sapiens
uggaaguaggaagaagucagaggaggucauauuggcccaaa

SEQ ID NO: 163342 - RNA, 46 nt, Homo sapiens
augcuuuguaauguggagaaaaugucuccccuguauagauccagau

SEQ ID NO: 163343 - RNA, 23 nt, Homo sapiens
gcucgggcggggaaggcggggau

SEQ ID NO: 163344 - RNA, 41 nt, Homo sapiens
cgcggggcuggccgccuagcgagccugccggucgaccccag

SEQ ID NO: 163345 - RNA, 53 nt, Homo sapiens
gucaugcacuuuguuucuuauuugcuauuguuacauguguacaguguccuuag

SEQ ID NO: 163346 - RNA, 51 nt, Homo sapiens
ggcuugguguuuacagcuucguauuccugaaaucgauaugugccagauauc

SEQ ID NO: 163347 - RNA, 44 nt, Homo sapiens
uuauuaccccauuuuauaggcagaaaaaaaaaaaaaaaacuuag

SEQ ID NO: 163348 - RNA, 59 nt, Homo sapiens
gggaaagaaagccagagacaggcugcuuaggccuggcucuggguuaagcuuaaggggaa

SEQ ID NO: 163349 - RNA, 45 nt, Homo sapiens
uggagagcaggggauucccugguuucucagcucaccucuccuuca

SEQ ID NO: 163350 - RNA, 24 nt, Homo sapiens
cggaccgccgccgccgcggggacu

SEQ ID NO: 163351 - RNA, 46 nt, Homo sapiens
gacuggccgggccgaccucugaccccuggaggccgagucggcaggg

SEQ ID NO: 163352 - RNA, 35 nt, Homo sapiens
aacaucaaggccagcaccggugaggggcugcgggg

SEQ ID NO: 163353 - RNA, 55 nt, Homo sapiens
caagaugugcaugcuuacagaagaggcagcuaacccagcauuuaggaggagguga

SEQ ID NO: 163354 - RNA, 27 nt, Homo sapiens
aaaaauuugcagaaucagcuauuuaaa

SEQ ID NO: 163355 - RNA, 45 nt, Homo sapiens
agcaaaaucuggcagaguuugagguuucuuauuggguaauuuuau

SEQ ID NO: 163356 - RNA, 42 nt, Homo sapiens
gaugauuguguguuggcccgcucaguggacugcuuguccuug

SEQ ID NO: 163357 - RNA, 44 nt, Homo sapiens
gggcagcaguagcaauccauccugugugagcagauggcacugga

SEQ ID NO: 163358 - RNA, 49 nt, Homo sapiens
ucagguuacagggaggcuguucuaugguuuuuacagaguaagaaaaucc

SEQ ID NO: 163359 - RNA, 116 nt, Homo sapiens
uuuugucuggguauucaucaugacugauaaacuuugacuuugccaccacguaacaguaauuucucuaguuuacauuuuuaaauugugagucuucucaucuugcaaaaugaauuugu

SEQ ID NO: 163360 - RNA, 61 nt, Homo sapiens
ccgcucugccacuuucuggcagccugugugacccugggccucugguugcucaugaaacaca

SEQ ID NO: 163361 - RNA, 27 nt, Homo sapiens
auuuuccccccuggacuuugaagguag

SEQ ID NO: 163362 - RNA, 55 nt, Homo sapiens
ugauugucaugaacaauggcuugcauuuguaacuugguucuuacuuauucaacaa

SEQ ID NO: 163363 - RNA, 34 nt, Homo sapiens
gaagcccuggacaaaaucugugaaguggaucuag

SEQ ID NO: 163364 - RNA, 53 nt, Homo sapiens
uacauggcuuacucauaaaucauaagaauaagucauauacccaaggcccugag

SEQ ID NO: 163365 - RNA, 47 nt, Homo sapiens
aacuauugaugcugacaguguuucacuccuaugagugacccaaacau

SEQ ID NO: 163366 - RNA, 60 nt, Homo sapiens
cuguggagauggggugcauaucagauauauaaauaaagcucagguuugcuagggaaccag

SEQ ID NO: 163367 - RNA, 84 nt, Homo sapiens
aggaaaaucuucaaacuucuuucuucacuucccuuuguguuuagcugacccuccaaugugaucauugccuuuggaguuugggag

SEQ ID NO: 163368 - RNA, 1481 nt, Homo sapiens
ugggcuugggcccaggcuaaucuaugaaggaagcaagcucguguuccuuaccuauccuuuugguguccauuggauugugccccgaaguggccuuuacccuugagccguccccagccauggugcucacacauaggcuuuugagcuccuuggagcuauccagauccugcucacuuuuccuuccugagaucagaacaaaucacccccuuacucccacuccaaacaaggccuugaugauaaacuaauccuuccuaaaaugcugguagguaaacaagcaaugaugaagcauugaacacagguuaacuccugacuuuuguaccauugucuauuccauuacacauuaacaugacucugaaugccagauccaaaccuuugcccaccaucugcuugucgugcaacaguugaggcaguaaccaggggagauucacuuccugucuuguccuuccccagggaucaccccccugcugcccucuagcagccaaacucagaugaguuccauuguuacccuaggugugcccaucucuuugguagggaaggagaaagguaagaauagccaucagugaggaaggauucuuggagcgaggagccacugugguuuuuccugcuauuuaagauguugagaccggauaacuuuagaaagauaccugcacaaacccauaaauagugcuuuuauaaaguuuaguucaccggaaccugaguucaguauuugacauuagcuuuuuguccaaagaguugaagccugcuggaggucuuugcucaaauaauaaauaccacauauuuccaaguguguucagguauaggcacuagguacugucuguuuacuucauguuaggcacauuacaugcauuggcuaaucaaauccucaucaauuacauauguaauaaucuaaacuugccuccuuguauuauaaauggaaauaauccuguuuauuuaaacggguuuucauguaccuguagggauuaggaaacucaaauggccuuuuuaauaccuuucccuaguuugagcucccuguucucuuuaacagauaaaacaacauauuugcuucagccuggaaucuguuuuuggugcuuuggugcagagacaggaaaugggcacucagagucacacugguaguugcacacuguaucuacagagggcgugucucaucuguacucugcuggguuacaggauuucaguagguauuuguguccaccugagaauucuguuuauuaccuuucauuugacagugucuuuccuuucugcaguugauuuugcuagagaggcaauucauaaggugagguccuguucauaguaugacuugcuuucucaauaucuccuucaauuuuuaguaacucuuggucuauuuggugucuuuaaaaaaaauaaccuaguaauaaagacuucuuuuaauguggaaauguggucugguaguaaguuauuucuuuccacauguaacugacccaaucugguuuccaaaugagaagugugcaggccccagagguuga

SEQ ID NO: 163369 - RNA, 161 nt, Homo sapiens
uaggguugauaugugucuaauucauuuuauaaaaauuauucuugucuucauuuuaaagcuuuggcuauauagucagaaauguccuaaauaacaaacuauuuuguauuuaauuuagggaagacuaaagggaagaaaaaugaaaacucagucuuuauguaagc

SEQ ID NO: 163370 - RNA, 142 nt, Homo sapiens
cccucucaagcucagaucaguucuauaacccaaugacaaccugucucuuugguuuacuguccugugaaaugucagcucaaguuucccagaagucguguguuuaugaugagucagagugcuuuuccucggugggacaguugcu

SEQ ID NO: 163371 - RNA, 23 nt, Homo sapiens
uuuguccagcacuuuauuguuua

SEQ ID NO: 163372 - RNA, 90 nt, Homo sapiens
uucccagagugccugaauugagcaaggggaaagagagggaugcagggccuggaucgaggucugggcagaacaugaagaggaguucggauu

SEQ ID NO: 163373 - RNA, 34 nt, Homo sapiens
agggcuugguacuguguagauacugcuuaugaau

SEQ ID NO: 163374 - RNA, 49 nt, Homo sapiens
uacaggugcaugauuguagagagcugugcuucuccaagguuggucucca

SEQ ID NO: 163375 - RNA, 35 nt, Homo sapiens
ggacuuaguggccaguggagccugccugaagcuuu

SEQ ID NO: 163376 - RNA, 54 nt, Homo sapiens
uuauuccuuuugcaauauaaauggguguuuuccuucccuucucccacuucuuuu

SEQ ID NO: 163377 - RNA, 24 nt, Homo sapiens
agaggagacugggaggguucagaa

SEQ ID NO: 163378 - RNA, 59 nt, Homo sapiens
cuaugugguuuugacguuuaaauuuuaaugaagcagccuuaguggggaagaaaacagcu

SEQ ID NO: 163379 - RNA, 61 nt, Homo sapiens
auggcagagccaugauucaaaaucaggucuuuuuuuaucuccaaaaccauucacaugguag

SEQ ID NO: 163380 - RNA, 54 nt, Homo sapiens
cuaaauauuaaaaaauagugugguguucauccuccaaucuguaauucaaaauaa

SEQ ID NO: 163381 - RNA, 30 nt, Homo sapiens
uuuugucacugcugcaugugacugggugag

SEQ ID NO: 163382 - RNA, 47 nt, Homo sapiens
uggcgugcagagauugaacccagcugugacuccugcugcugugagau

SEQ ID NO: 163383 - RNA, 46 nt, Homo sapiens
cugaaaacagagugaagacuauuucugaucugguuuggaaauccag

SEQ ID NO: 163384 - RNA, 42 nt, Homo sapiens
gaaaauuaucuuaaaaggauuaaaaguccauuaaaaaugcaa

SEQ ID NO: 163385 - RNA, 23 nt, Homo sapiens
uuugagucacuuagccuguucug

SEQ ID NO: 163386 - RNA, 52 nt, Homo sapiens
cauacuugagugggauaaagcugagccauaaaaauccagguuuuacugggug

SEQ ID NO: 163387 - RNA, 81 nt, Homo sapiens
gagauguacugagugcuguuaagggucagauacucugcugggugcuguaaauaucaccuaucauucauaaagcaauucuac

SEQ ID NO: 163388 - RNA, 51 nt, Homo sapiens
agguggaaaaauauauaaaauaucuuauugauuacauguugaaauggcaau

SEQ ID NO: 163389 - RNA, 760 nt, Homo sapiens
uuaaugaaacugccuuugcaaaaauuauaacagugagaaaauuaugacagugacagaucugacuuaaugacuccauuuugcuauucuaaccuucaagcugcccuuguucauuguugggcgcaggcugaacuaaguuugggaggaacuuaguuuaaccuugaaacaaagaugauaacagcccuucuugccugaaaccagacugcccauguaggacuaauaaauuagcugcaagauuggaaauguagguuuaggaguccuguagccggaggcugcaaguucugaaccucccccauugcuccuugggguaacaucauuauugugaaaccuaagauuggucugagauguuuuucagaccuugcauucugaggcaccagcuggcgccacccagacugguaaucuggcacaaccaguucugcagugccucccaggaacagaagacagcaagaagaacccacuuuaacccccuaugauuccaucugugacccaaucaaucagcacuccccacucccuggcucccccuacgugccaaaucauccuuuaaaaaaaacccuagugucugaauuuuccagggagacugaaucgaguaauaaaacucugaucucccauucaguuggcucugugugaauuacacucuuucucuauuacaauuccccugucuugauaaauuggcucuuaucugggcagugggcaaggugaacuaguuggaugauuacguuacuuccaugcugauuuugagaucuguugggcagcaaggccuaag

SEQ ID NO: 163390 - RNA, 114 nt, Homo sapiens
caaaguguuuguuaauuauuuauuaagauaaacaauuucuuagcccacauauucauguuucacagauaguucaggaacacagguacagugacaaacuucuauguaauucaaccc

SEQ ID NO: 163391 - RNA, 45 nt, Homo sapiens
uucccuacuuuugaauauguuugaaaauuucccuaauagaaagua

SEQ ID NO: 163392 - RNA, 52 nt, Homo sapiens
uggccauauugaagcuaauagucucagaaccacugugucauaacacugacau

SEQ ID NO: 163393 - RNA, 50 nt, Homo sapiens
acuguauugagaucaugcaaguagaucaaagaaagagaauuacacgcaaa

SEQ ID NO: 163394 - RNA, 67 nt, Homo sapiens
ucuguccugaaaggcagucucuggauagcaggaugagauggagugaucacuggcuuuggagucagac

SEQ ID NO: 163395 - RNA, 46 nt, Homo sapiens
uaagcucuuuauguacuuuauguuaugcaauuuuaauaacuacccu

SEQ ID NO: 163396 - RNA, 41 nt, Homo sapiens
auuacugagcagaaacauacacacacucauacauaucacac

SEQ ID NO: 163397 - RNA, 28 nt, Homo sapiens
auagcauauguuaagcacuuauuauaug

SEQ ID NO: 163398 - RNA, 31 nt, Homo sapiens
cucauaagaauccuauaagguaaaugauagu

SEQ ID NO: 163399 - RNA, 34 nt, Homo sapiens
aaauauaaagaauuuaaaaacacuggaaaugaaa

SEQ ID NO: 163400 - RNA, 44 nt, Homo sapiens
auccccugccccuacacaggcaucgccucucccauuaucaacau

SEQ ID NO: 163401 - RNA, 44 nt, Homo sapiens
gccucaucccucuggagaggauuggagggguccaaagcuguuag

SEQ ID NO: 163402 - RNA, 34 nt, Homo sapiens
gaccccuuagcuugggcggguuaugcaaccucuc

SEQ ID NO: 163403 - RNA, 43 nt, Homo sapiens
uguccgaagagcagauggaaccacacagaccagacugcaggaa

SEQ ID NO: 163404 - RNA, 46 nt, Homo sapiens
uccuuacaauaaugaaugauggcaaagagucaaagauaggaugaug

SEQ ID NO: 163405 - RNA, 61 nt, Homo sapiens
uaugggauacuaacucacuuuacuagaccuggaugaugaaaacauucuggaaagaggaaaa

SEQ ID NO: 163406 - RNA, 50 nt, Homo sapiens
cauauuucaucucucacucugcuaccaugccucagugucaggacaagaaa

SEQ ID NO: 163407 - RNA, 44 nt, Homo sapiens
acccccuguccuuucuugagagccaguuggcuaaaacaggaaag

SEQ ID NO: 163408 - RNA, 42 nt, Homo sapiens
aaucaggggauguuauggcccuuuuucaaaugaaaccaugau

SEQ ID NO: 163409 - RNA, 51 nt, Homo sapiens
auccuacugcacaaccaguuggcacuggcugcacuccuguuuuugcucaag

SEQ ID NO: 163410 - RNA, 42 nt, Homo sapiens
ucaaccccugagcugcauuagucugcuuaaacauacugauug

SEQ ID NO: 163411 - RNA, 46 nt, Homo sapiens
uuccugaaguuauaguuuucugaauauaugugggcuauccagagaa

SEQ ID NO: 163412 - RNA, 28 nt, Homo sapiens
guguguguguguuuuaaaucccaguugc

SEQ ID NO: 163413 - RNA, 49 nt, Homo sapiens
uggguggaggauucccgccucucagcucgccacagaaggcgucucccca

SEQ ID NO: 163414 - RNA, 52 nt, Homo sapiens
uacauuucagugugugcaaaaacagguauguguaugucuuacaguauagaga

SEQ ID NO: 163415 - RNA, 66 nt, Homo sapiens
aguugaggaguagagauaauaaguaacuugccuagauuacaucacuaauaaguggcagagcuggaa

SEQ ID NO: 163416 - RNA, 70 nt, Homo sapiens
uugaagaccuacucucuggucaagguuucaaugcucacaaagacaaaaaggggccucggacaauagcuga

SEQ ID NO: 163417 - RNA, 46 nt, Homo sapiens
caaacugugaauguucauaguucaaauaaauggcuaaaugggucaa

SEQ ID NO: 163418 - RNA, 46 nt, Homo sapiens
caaguggaaaccaguuggcauggcagaccugguaacaccagagcag

SEQ ID NO: 163419 - RNA, 47 nt, Homo sapiens
ugcauuccuuuuaaauaacugguugugacaaagcuuguuguugauca

SEQ ID NO: 163420 - RNA, 55 nt, Homo sapiens
aacaugccuucuucucuucagguacuuaagcuacauuaguaagaccagaacuuag

SEQ ID NO: 163421 - RNA, 46 nt, Homo sapiens
aguggggcuauuggacugacuuuucuuaugcugggaugugccuuag

SEQ ID NO: 163422 - RNA, 56 nt, Homo sapiens
gcuggggacacacaaaugaagagagaguccuguccucaaagaggagguaaaguucu

SEQ ID NO: 163423 - RNA, 87 nt, Homo sapiens
cuggcccuuauucguccugauuuuccacgccaucucccccaucccccauuucauugccaaaagagucaccuaugacucagaugcaac

SEQ ID NO: 163424 - RNA, 84 nt, Homo sapiens
caguagugccugucgggaacuggcauauuucuucacuacuggaauuguuguuucugccuuuggauuuccuguuauucuugcucg

SEQ ID NO: 163425 - RNA, 75 nt, Homo sapiens
gcauugaauuucuuagaacucauacuaucuguauacaugugcacaugcggcauuuuacuaugaaauuuaauaugc

SEQ ID NO: 163426 - RNA, 57 nt, Homo sapiens
agaugaguuuuauucucagcaaauagaccugucaaauuuagauuauguuacucaaau

SEQ ID NO: 163427 - RNA, 50 nt, Homo sapiens
aaaccuuuugcuuggggaugugcuuggagaggcagauaacgcugaagcag

SEQ ID NO: 163428 - RNA, 44 nt, Homo sapiens
auuuugaugagauccaaaggaguuguaugcacaugaaaguuuga

SEQ ID NO: 163429 - RNA, 36 nt, Homo sapiens
uaggcaguuccucaaauuuaugaaaaguguucucag

SEQ ID NO: 163430 - RNA, 189 nt, Homo sapiens
uaaucaaaauaaaaaacaaaacauacucucucccccaaaaaaacaucucaguggggaacagauguaucuuuucaucugaaagacaaugcugggggaagagcuccacugagaugcgggcagggaggcugggcucgagccagccccugcguuagcaggagggggagaacagauagguaacucuuuuacauu

SEQ ID NO: 163431 - RNA, 114 nt, Homo sapiens
aguucugguuugcccugacuucucuacggcucuggcuucuucccgaagagauauaggagccauguaagcacgcagugggugaacugcuuaauuucacuacguguugauguacuu

SEQ ID NO: 163432 - RNA, 96 nt, Homo sapiens
aucacaguuuucccugcucaccuuuuugucuaagaucuauugagaaagggaaauaugggaaggagaaccauuugaucagaauacaaccaauagucu

SEQ ID NO: 163433 - RNA, 46 nt, Homo sapiens
ggccuuguucaugauuuuauguuuucaguguccuguguacauauag

SEQ ID NO: 163434 - RNA, 26 nt, Homo sapiens
aguucugaucacauucuucguucaaa

SEQ ID NO: 163435 - RNA, 46 nt, Homo sapiens
ugacagagagggagaaguccccaggagcgcucucacucucucggau

SEQ ID NO: 163436 - RNA, 45 nt, Homo sapiens
ugguuucuggagacagauguagaucugugauaauccaccagcuca

SEQ ID NO: 163437 - RNA, 52 nt, Homo sapiens
cugaacacguuuuccagccuaaacucggcagggcaaaccagaacauuccccg

SEQ ID NO: 163438 - RNA, 50 nt, Homo sapiens
cgccuguguguggagcaacaguuuuauugugccgugcaauccucaacaag

SEQ ID NO: 163439 - RNA, 44 nt, Homo sapiens
uguuauccuagaagucugccagcuauguuuguugaccugccaca

SEQ ID NO: 163440 - RNA, 50 nt, Homo sapiens
aguugcuguagagauaauccaguauuucuggaacugauuaaauguugaaa

SEQ ID NO: 163441 - RNA, 34 nt, Homo sapiens
acuuuaagaauuuguaaaauaaauuuuugucaag

SEQ ID NO: 163442 - RNA, 52 nt, Homo sapiens
aaugguggcaggcacuuccuccuaacaagaaggaaguaguuaaagaaaauau

SEQ ID NO: 163443 - RNA, 26 nt, Homo sapiens
auauaagagaaaacuaauguuuagaa

SEQ ID NO: 163444 - RNA, 56 nt, Homo sapiens
aggagguaaaguauguuuugugaggguacaauauuuguuaagggacaauauucuaa

SEQ ID NO: 163445 - RNA, 46 nt, Homo sapiens
auuugggccauuuguccucgagauagcuuggcacuuuugugccagu

SEQ ID NO: 163446 - RNA, 43 nt, Homo sapiens
auuuuuuccuaaaucaaggccccucaauaauuuuggugacgag

SEQ ID NO: 163447 - RNA, 42 nt, Homo sapiens
uaucagacugcgugcacuaagaaguucccacauaagggggcc

SEQ ID NO: 163448 - RNA, 49 nt, Homo sapiens
acuucuuuauuagcaauuuuaaggauuuuacaccuugucuagcauaggg

SEQ ID NO: 163449 - RNA, 42 nt, Homo sapiens
uagguaauaagcaaaaucuauuuuucaucacagaaaugagaa

SEQ ID NO: 163450 - RNA, 48 nt, Homo sapiens
aaaugcugagaauggcuuagcugaaauuaucucaagauuauguugcau

SEQ ID NO: 163451 - RNA, 37 nt, Homo sapiens
cauuuaaugggugggaggaagacagagccuguguugg

SEQ ID NO: 163452 - RNA, 68 nt, Homo sapiens
ucccuguccucaugaagcuuauucugcaguaaagggagacagauaauaaauuuggugcugggggcggg

SEQ ID NO: 163453 - RNA, 63 nt, Homo sapiens
gacuucaaaauaugaauuuuagaggaacacaugaguccuuagcacacaguuaugugugagcag

SEQ ID NO: 163454 - RNA, 49 nt, Homo sapiens
aauguagaaagguauguuauuaaguuucugauucauuuuacaagcauaa

SEQ ID NO: 163455 - RNA, 42 nt, Homo sapiens
aaugauguuugaagugaaaaaaaaaaggauauucagggucaa

SEQ ID NO: 163456 - RNA, 59 nt, Homo sapiens
ugaugaagggggaaacagucugaagguaucuguuugcaggaaauaguuugcauuggggu

SEQ ID NO: 163457 - RNA, 46 nt, Homo sapiens
ugacccuauuuaugguaggcauucuauucuacuaugcccuauuaua

SEQ ID NO: 163458 - RNA, 134 nt, Homo sapiens
cccugcaggggacgacccgucagccucgccggcgacaccgaacccaccccgcaacgcagaacccaggagccccgcggcgccauccacucaccuggugucuggggcgcccgacgauggaaggaaacacggcucgg

SEQ ID NO: 163459 - RNA, 55 nt, Homo sapiens
ggggccacgcgcagcucguuguagaagguguggugccagaucuucuccaugucgu

SEQ ID NO: 163460 - RNA, 46 nt, Homo sapiens
gaccccgucuccagaguccaugacaaugccaguggugcgcccagag

SEQ ID NO: 163461 - RNA, 48 nt, Homo sapiens
aggaucuucaugagguagucggucaggucccggccagccagguccaga

SEQ ID NO: 163462 - RNA, 124 nt, Homo sapiens
aguugaagguggucucguggaugccgcaagauuccauaccuaggggacagagcccucccuuagugaugcugugucaccgaggauguaagaguagaaaccuuuagcucacaacaccuacccagga

SEQ ID NO: 163463 - RNA, 49 nt, Homo sapiens
cugacacguuaauacccugcacagaucagaggcugcuggccacacagac

SEQ ID NO: 163464 - RNA, 42 nt, Homo sapiens
gaaacuggguccuacggcuuggacuuuccaacccugacagac

SEQ ID NO: 163465 - RNA, 46 nt, Homo sapiens
uaugcaaaauuccucagaaguugguuaugaugcuaugguuggagau

SEQ ID NO: 163466 - RNA, 41 nt, Homo sapiens
uucgaugcauuccagccuuggacucauugacuccagcuaau

SEQ ID NO: 163467 - RNA, 49 nt, Homo sapiens
gaauggcuggcaaaacuuucagauggaguaguugugcugaaguuuggug

SEQ ID NO: 163468 - RNA, 46 nt, Homo sapiens
gaaccaacuuaaagauauggcuauugcuacugguggugcaguguuu

SEQ ID NO: 163469 - RNA, 46 nt, Homo sapiens
ggaaaaacacugaaugaugaauuagaaauuauugaaggcaugaagu

SEQ ID NO: 163470 - RNA, 45 nt, Homo sapiens
cccugaagaaauugcacagguugcuaugauuucugcaaauggaga

SEQ ID NO: 163471 - RNA, 56 nt, Homo sapiens
guagcauuuuuauuaauauggugacuuuuuaaaauaaaaacaaacaaacguugucc

SEQ ID NO: 163472 - RNA, 41 nt, Homo sapiens
uccaccaaggaggcaggauucuucccauggauaggggaggg

SEQ ID NO: 163473 - RNA, 73 nt, Homo sapiens
cugagcuuuaaaaugguuccgacuugucccucucucagcccuccauggccuggcacgaggggauggggaugcu

SEQ ID NO: 163474 - RNA, 94 nt, Homo sapiens
cguuacuauuguuuucaucacccguugcuuuaaaauccagccucugguauaggcaacuauugacgggcuacccugugucgaaaacaugcccagg

SEQ ID NO: 163475 - RNA, 42 nt, Homo sapiens
acaccagcauacagagugaccaccgggaaaucgagggcaggg

SEQ ID NO: 163476 - RNA, 42 nt, Homo sapiens
ugacuuggguccuucuuggcaguagcauugccagcugauggc

SEQ ID NO: 163477 - RNA, 44 nt, Homo sapiens
ccguggaaccuggagcggauuaccccuccacgguaccgggcgga

SEQ ID NO: 163478 - RNA, 88 nt, Homo sapiens
aguuguggcaggaggcuguuaccacuuaggucugaaggguaaggagagggaauagcuuucccucugcccaguuggagccgguggcaug

SEQ ID NO: 163479 - RNA, 46 nt, Homo sapiens
agacccaccucucgcagucagagcgcacugcccgccgccugcaggc

SEQ ID NO: 163480 - RNA, 63 nt, Homo sapiens
cugaaggggcaggggagaaggggcggagguauucucgaggcccauuggcguccuuuaggacuc

SEQ ID NO: 163481 - RNA, 45 nt, Homo sapiens
cugguggaugagcacgaacuccagccccuucaggcgcacccacag

SEQ ID NO: 163482 - RNA, 47 nt, Homo sapiens
uguacaaaauaaaguccaaacucggccuuggcaucaaggccccucuc

SEQ ID NO: 163483 - RNA, 42 nt, Homo sapiens
cucugcagggagagaggcuccagagaaugaagucaaccuaga

SEQ ID NO: 163484 - RNA, 50 nt, Homo sapiens
uguauauguuaacucaugcaucacuuugaggggaagaggaggagcaggga

SEQ ID NO: 163485 - RNA, 52 nt, Homo sapiens
gaggacagcccugugcagucuccacaaaaccugaaugcucuugguggugggc

SEQ ID NO: 163486 - RNA, 47 nt, Homo sapiens
gacuggcacugcugcccaacgacccacaauggcaggggcauugcaca

SEQ ID NO: 163487 - RNA, 58 nt, Homo sapiens
cucucugugccucacagucuucuccuugggaaauaagggaaucagaucaggucuccaa

SEQ ID NO: 163488 - RNA, 46 nt, Homo sapiens
cagcugcauaaugaaagugagacuuagggccaccuggauacaggcg

SEQ ID NO: 163489 - RNA, 69 nt, Homo sapiens
agggugcugacugcugacacucagggagaacugcccuuggcagaagggagcugccucauccaaggucag

SEQ ID NO: 163490 - RNA, 46 nt, Homo sapiens
gggagaucuugggaggcaccauccagccaaagagguagcggaagau

SEQ ID NO: 163491 - RNA, 47 nt, Homo sapiens
ccagcucagugccuggcggccuugcagaucuugucguacaccucggg

SEQ ID NO: 163492 - RNA, 41 nt, Homo sapiens
ugcacaggugaccuaauguggagccuuuucaggcuccacug

SEQ ID NO: 163493 - RNA, 47 nt, Homo sapiens
ccacuccccagccccugcugcagagcagcgcggacccacucccacca

SEQ ID NO: 163494 - RNA, 25 nt, Homo sapiens
ggaagacacguccauccgugcccac

SEQ ID NO: 163495 - RNA, 27 nt, Homo sapiens
uuaaaacgcugaucgcugggccccaac

SEQ ID NO: 163496 - RNA, 40 nt, Homo sapiens
ccauuccacucccuauccauuuggcuaaccauggcucucc

SEQ ID NO: 163497 - RNA, 41 nt, Homo sapiens
aacucuugguaggcugggaacuucuagaauaagugaucugg

SEQ ID NO: 163498 - RNA, 34 nt, Homo sapiens
gaugaacugugaaagaugacaaguuagcaagcug

SEQ ID NO: 163499 - RNA, 46 nt, Homo sapiens
aauccaggugacuagaguaggauacagcagggaagaagugauggag

SEQ ID NO: 163500 - RNA, 60 nt, Homo sapiens
uuggaagacgagagagguguaagugagguaagaagacuauugcaauagaauaugagcauu

SEQ ID NO: 163501 - RNA, 42 nt, Homo sapiens
ugauuaaaaacaaaaaugguugggcuauggcuaaugauacug

SEQ ID NO: 163502 - RNA, 89 nt, Homo sapiens
gaaggccuucuauuaacuuggucuuggugagccagagggccugcuuuacaccuuugagguaauuagccacaaaaauaaagaaggaaaga

SEQ ID NO: 163503 - RNA, 45 nt, Homo sapiens
ugaaagauauagcaggccuggucuuuguacagcggaugcucguga

SEQ ID NO: 163504 - RNA, 85 nt, Homo sapiens
cuuuuuguuugaauuuaccuauggcauuagcauaguaagcagauauuucuacuuuuguggugugggaggggaaugcuauggaagu

SEQ ID NO: 163505 - RNA, 64 nt, Homo sapiens
aaagagaaagccccagauugccaugggccaguguugaaacacgaagcuaucucaagccaggagu

SEQ ID NO: 163506 - RNA, 48 nt, Homo sapiens
ucccaccaugaugaucauuuucaaauauauuauuuuuauacauuuggg

SEQ ID NO: 163507 - RNA, 41 nt, Homo sapiens
acaggccaaauacuguauuuuaaaaagaaaagacauaaaca

SEQ ID NO: 163508 - RNA, 42 nt, Homo sapiens
gaaauuuucccaagaauacugcauuuucagauaaaccaaaag

SEQ ID NO: 163509 - RNA, 44 nt, Homo sapiens
gcauguucuuggagggaaguagggagccugaaaggguaugggug

SEQ ID NO: 163510 - RNA, 80 nt, Homo sapiens
ugggcgaagggagugggguuaggauuuuuggugugagaagcgcuagaauugguaagagugucacguugugggagagacug

SEQ ID NO: 163511 - RNA, 115 nt, Homo sapiens
agguugggagaucggagguuggaagguugggucugugggacagcaagccaccuuucaccaggggcucggaagggcuggaagggucugaagguugaaaggggcaggagagcugggg

SEQ ID NO: 163512 - RNA, 45 nt, Homo sapiens
agaaaaguuggggguguggaaugccaaguuggggauagugaggcg

SEQ ID NO: 163513 - RNA, 47 nt, Homo sapiens
agagagcgggaagaaggaagggggaagggaaugggauuuuagggguu

SEQ ID NO: 163514 - RNA, 44 nt, Homo sapiens
auggguuuaaggguggcguaggggugcgggggcaggcuaugggg

SEQ ID NO: 163515 - RNA, 42 nt, Homo sapiens
gcccucagagcaucuaggccucugcaacaaucaggucucugg

SEQ ID NO: 163516 - RNA, 540 nt, Homo sapiens
gauaaacuucugaacugaggaucaggaaggaagaagggcaccaucagucuuugggagcugccucauucacccugggcuccugaguugggcugaaagcucuucaacccaauucaauguccaaaucagaggcagauacaacuugauguaggggccucauaucuacuuucguggaacaacuggaauucacucaauagcgcagccagucaacaaguauuuauugagugccuacuguguuacaggcaccuuucugggugcuggcaacaucugugaacuuaaaugauucuccguaaugcuauuuuuacuccacuguguugcaauuuuaugcucauguuugugacuuacccacuggacuguagcaaccugaagaaaaugaaugaaugaucuuaaagccacauucuacaaagcgcaaucagauucuuugaaguuauuacuuaggagagacaacaucaccaagcaauuuauacaagucgcucaagcaggacaagagcaacugacacaugaauacuuacugguacucagaauguccugaugagaaaugag

SEQ ID NO: 163517 - RNA, 27 nt, Homo sapiens
caaguuaggcuucucuagaccuuaugu

SEQ ID NO: 163518 - RNA, 59 nt, Homo sapiens
accagagauggaccaucucccaacaacuacagcuacuccaaaccaaacaguugcugcag

SEQ ID NO: 163519 - RNA, 48 nt, Homo sapiens
aaggaaugcacggaauuggaaagaaauguggcauuaguagaggcuggg

SEQ ID NO: 163520 - RNA, 53 nt, Homo sapiens
ucugcaccacaguauuuauaauuuucagcaggauugauuuguuucauccuaua

SEQ ID NO: 163521 - RNA, 28 nt, Homo sapiens
gguuccugucaucgauucgaaauugugg

SEQ ID NO: 163522 - RNA, 41 nt, Homo sapiens
acaaauauuauaugauucuacuuauacgagguaucuggagu

SEQ ID NO: 163523 - RNA, 29 nt, Homo sapiens
ugugauuuagcagauacauuaugaaaaga

SEQ ID NO: 163524 - RNA, 47 nt, Homo sapiens
uguaugaaaaaaaaguccuaucuagaaauccuucauaucuugugaag

SEQ ID NO: 163525 - RNA, 54 nt, Homo sapiens
ucaucuuugauucuaacaaaauuaagaauauuaaaaauaaaagaaaguguuagg

SEQ ID NO: 163526 - RNA, 458 nt, Homo sapiens
ucugaaauuccuuaaggaagaaucagucguaauauaagcauaaaagaagaccagggcugggugcaguggcucaugccuguaauccuagcacuuugggaggucaaggugggcagauugccugagcucaggaguuugagagcagccugggcaauauggcaaaaccccaucucuacugaaaauauaaaaauuagccaggcguggcgugccuauaguccuagcuacucaggaggcugaggcacaagaauugcuugaaccugggagguagagguagcagugagcugagauggcaccacuucacuugagucugggaggcagagcaagacucuuaucuccaaaaaaaaaaaaaaaaaaaaaaaaagagagagaaguacaucuuuuauuuuuuucuuuuuccuuagauuccuucuaaucauuuaucuuguuuuccauugguauuuuaggggcagagacugagaagg

SEQ ID NO: 163527 - RNA, 40 nt, Homo sapiens
ucauuagaauuuucagguucccacuaaggaacuauuuagc

SEQ ID NO: 163528 - RNA, 60 nt, Homo sapiens
ugguucagcuuucuugucuuucacauaauuagagaggaggcaugacuuacugaggguugu

SEQ ID NO: 163529 - RNA, 44 nt, Homo sapiens
uuuuuuuuuuccccacagcaauacaaguucuugcguuuuaggag

SEQ ID NO: 163530 - RNA, 100 nt, Homo sapiens
ggacauuacgcuaagugaaauaagccagucacaaaaagacaaauacuguaugauuccacuuauaugagguaucuaaaauagucaaacucuuaaaaaacag

SEQ ID NO: 163531 - RNA, 38 nt, Homo sapiens
uccaggaggaagugauguuucaauuucccaccgcagau

SEQ ID NO: 163532 - RNA, 55 nt, Homo sapiens
acccaauuagugagauuuuauguagagguuaaaaaaaauuaaauaauauguguuu

SEQ ID NO: 163533 - RNA, 46 nt, Homo sapiens
ccuugcaggaccugauguugcuuucucaauauucuccuucacgaag

SEQ ID NO: 163534 - RNA, 29 nt, Homo sapiens
auugaauuaaaucuuacacagcuuaagag

SEQ ID NO: 163535 - RNA, 52 nt, Homo sapiens
uuucagacaccaaaaucuagccagaugccucggccuucagugccaccauuag

SEQ ID NO: 163536 - RNA, 45 nt, Homo sapiens
uuuucuaauccuucuccaucuaccucuauuagugcugaggguaag

SEQ ID NO: 163537 - RNA, 47 nt, Homo sapiens
guaguggggacaaaaaaaugcaugaguucaggagagauugguagacg

SEQ ID NO: 163538 - RNA, 44 nt, Homo sapiens
gcugcuugcugcagccuucugacuagucaugcagcuuuggguga

SEQ ID NO: 163539 - RNA, 42 nt, Homo sapiens
uaauuuggggguuaaacguguauacaugggaauacaguuuag

SEQ ID NO: 163540 - RNA, 58 nt, Homo sapiens
cuaacuucauguuacuugguacuuuuuaugucaccuuauaauauuaguuacgugucac

SEQ ID NO: 163541 - RNA, 264 nt, Homo sapiens
aacuggugcaucuuuuggucuugggaaaccauuuaagauaugaagagaagccugggcaacaugaugaaacucugucucuacaaaaaaguuuuaaaaaauuagcgaggugugguggugcgcaccuauagucccagcuacuuaugaggcugacgggggagaaccgcuugaacccgggagguagagguugcagugagccaagauuaugccauugcacuccagccugggugacagagugagacccugucucaaaaaaauaaaagauaa

SEQ ID NO: 163542 - RNA, 53 nt, Homo sapiens
auauauucacauuguuaugcagucaucaccaccauccaucuccagaaccuuuu

SEQ ID NO: 163543 - RNA, 47 nt, Homo sapiens
uuaaccuccuuuuucacgauagaauggcaguauggcagaugugccaa

SEQ ID NO: 163544 - RNA, 66 nt, Homo sapiens
ucucuaaacaucaguuuuuauaucuggaagaugggagugaugauaaugguagcuagcuaccucaua

SEQ ID NO: 163545 - RNA, 96 nt, Homo sapiens
aauaagaaaggauauugcaucuuugaaacaaaaauaggaugcuaaaauuaaaaagaacagaugauguuaaagagcucuugaaauuaagaacuugau

SEQ ID NO: 163546 - RNA, 56 nt, Homo sapiens
uuacacugcugauacaacuacagaugggacaguaaauguucagcauucuuggauca

SEQ ID NO: 163547 - RNA, 47 nt, Homo sapiens
uuaaguguaguuucauuuacugaaggauaaaaaugguaacagugcag

SEQ ID NO: 163548 - RNA, 44 nt, Homo sapiens
aguuuugcuuucuuuuucuggagcaaaacauuaagugauugcag

SEQ ID NO: 163549 - RNA, 41 nt, Homo sapiens
cagccucuguaguguuaaauggcuaauuaaaauaggaagau

SEQ ID NO: 163550 - RNA, 57 nt, Homo sapiens
cagagaacugggaaauuguccuagaaauaaaccuuguacaguugaguggacauggau

SEQ ID NO: 163551 - RNA, 39 nt, Homo sapiens
ucauuucuucccccagcuccuuuccaagcagcuuucugu

SEQ ID NO: 163552 - RNA, 62 nt, Homo sapiens
cugggcagugccaugggggaugcaggcccuccucuccuccccaggcacagccaagaggaaag

SEQ ID NO: 163553 - RNA, 52 nt, Homo sapiens
guggggaggcggggagcucuggcuugguuugggcagacuuagcggguauggg

SEQ ID NO: 163554 - RNA, 45 nt, Homo sapiens
accccaagaggggcaagcaucugccaaauggccacucggcaaggu

SEQ ID NO: 163555 - RNA, 48 nt, Homo sapiens
uucuaacaggaagagcaguccaggggcggggagcugcuucgucagugg

SEQ ID NO: 163556 - RNA, 22 nt, Homo sapiens
ugaggggagaggucaggcugcg

SEQ ID NO: 163557 - RNA, 45 nt, Homo sapiens
aaguuaagauaugccaacaacagcaauuacaagaaugaugucaug

SEQ ID NO: 163558 - RNA, 45 nt, Homo sapiens
acaacaucaaaaauugguucccuuauugaugucaaucaauccaag

SEQ ID NO: 163559 - RNA, 48 nt, Homo sapiens
caagauuaaaccaaucuagacugaauauugguguggacauggggggug

SEQ ID NO: 163560 - RNA, 196 nt, Homo sapiens
uuucuccacaucagacuuuuuuuuucauucuauauuuuuaaaaaauaauagagauggggucuugcuauguugcccagacuggucucagacucauggacucaaguauuccuccugucuuggccucccaaagugcugggauuacaggcaugagccacugcacugucccagacucuuauuacugucacuuacugccuag

SEQ ID NO: 163561 - RNA, 43 nt, Homo sapiens
auuuauauguguugccauuucaggucuaagaagagccacaaga

SEQ ID NO: 163562 - RNA, 45 nt, Homo sapiens
gacuuggaacgggaucugugccgccgaucucgggaccugcugcgg

SEQ ID NO: 163563 - RNA, 41 nt, Homo sapiens
ugagaauaugcccaacuuagccugcuagaggaugacacaga

SEQ ID NO: 163564 - RNA, 41 nt, Homo sapiens
aagucucgguagcuucuccggcggugaucaggugauggcac

SEQ ID NO: 163565 - RNA, 45 nt, Homo sapiens
uuagugcucuggaagaggacauggaugauguggaguccagugaag

SEQ ID NO: 163566 - RNA, 46 nt, Homo sapiens
aacuauugcacagugagagagucugugauaucauucugccccgacu

SEQ ID NO: 163567 - RNA, 46 nt, Homo sapiens
guaaagggggcauaugaugcaaggcagggauuaacauaagaugcac

SEQ ID NO: 163568 - RNA, 42 nt, Homo sapiens
gcuucguguuggccuuacccagccugccucugucugucuccc

SEQ ID NO: 163569 - RNA, 63 nt, Homo sapiens
accuuuguacaaugacuaucgaaaaaucaagagccagaaccgaaauggggguaaguauggugc

SEQ ID NO: 163570 - RNA, 45 nt, Homo sapiens
agcaaucaauugcagugccugucagccucauguaaagugccccca

SEQ ID NO: 163571 - RNA, 48 nt, Homo sapiens
aaugauagcaggcuggguugcaacaguguuaagcucagggauccggau

SEQ ID NO: 163572 - RNA, 46 nt, Homo sapiens
caccagauauugaggguuggugccauggaugcugugcgcauccuuc

SEQ ID NO: 163573 - RNA, 37 nt, Homo sapiens
ucugaaccuggaugugaggcauuaaaggauccgacgg

SEQ ID NO: 163574 - RNA, 63 nt, Homo sapiens
cccuuccuacuucucuuuucuaaccccggaauugaagagucuucugcugugacaguuggaaaa

SEQ ID NO: 163575 - RNA, 43 nt, Homo sapiens
acacagaugauacuaaauugccuguguguaaucuucguagacc

SEQ ID NO: 163576 - RNA, 46 nt, Homo sapiens
uuggcaggcccuuguuggaucgaaaacugcacuaccaaaccuauag

SEQ ID NO: 163577 - RNA, 59 nt, Homo sapiens
ucauucaacccauuuugccuauucuuaaauauaacugggcgaauugguuucccaguagg

SEQ ID NO: 163578 - RNA, 48 nt, Homo sapiens
caccgagauucacauccagauuggacaguuuguguugauugaagggga

SEQ ID NO: 163579 - RNA, 79 nt, Homo sapiens
cguauguugcuaaauugcuugaguuguucgaagauggugaguuugggacuggaauaauaaaccauuccuugucaugaau

SEQ ID NO: 163580 - RNA, 43 nt, Homo sapiens
gaagguuaguaauauauuuugcaagugcuacuucguuacaagu

SEQ ID NO: 163581 - RNA, 46 nt, Homo sapiens
agcacagaaaugugggaguggggcacagcuccacaaggaggauuag

SEQ ID NO: 163582 - RNA, 67 nt, Homo sapiens
guguauagauucuagaauccucucuuggugcuccauuggaugacuuuagucuuucucugaagaaagc

SEQ ID NO: 163583 - RNA, 44 nt, Homo sapiens
uguaauucuugugugugugugugugugugugugugugugacagu

SEQ ID NO: 163584 - RNA, 41 nt, Homo sapiens
uccuccuccuaagaaacgugcucgaguacagugguuugucc

SEQ ID NO: 163585 - RNA, 49 nt, Homo sapiens
uucugguaugauuacccggccugugacagcaacauuaaugcggagacca

SEQ ID NO: 163586 - RNA, 45 nt, Homo sapiens
uuuagccccaaaggaugugguaccgacgaaucugaaaaaugagaa

SEQ ID NO: 163587 - RNA, 53 nt, Homo sapiens
auaaaccacaagagagugcagccaagugccagaaacccgugagagccaagagu

SEQ ID NO: 163588 - RNA, 42 nt, Homo sapiens
ccaguggauuguccccaggaaccccacuucucucuauuggca

SEQ ID NO: 163589 - RNA, 48 nt, Homo sapiens
ugaagggauucucuagcauuugaaauugaguuuucagguagaaacaua

SEQ ID NO: 163590 - RNA, 40 nt, Homo sapiens
cccucacaggccuugcaguucagcaggaagcgcaaugaga

SEQ ID NO: 163591 - RNA, 47 nt, Homo sapiens
auauaaguacacgauuuacuuguaucuauauaaaauaguucugggag

SEQ ID NO: 163592 - RNA, 45 nt, Homo sapiens
uuuugcuauaucagcauuuguuacagccaauauuuaaggacaaaa

SEQ ID NO: 163593 - RNA, 73 nt, Homo sapiens
aacaacuucaucuucaacuuuuuauuucucccugauguuacaguuugguagauuucaaacuggaauagcuagc

SEQ ID NO: 163594 - RNA, 44 nt, Homo sapiens
cacuucucuggauuuaaaauaucuugagguauuuugccacuggc

SEQ ID NO: 163595 - RNA, 44 nt, Homo sapiens
agcuaacuaaaaguuugguuuuuggaagcuggcauggacuagau

SEQ ID NO: 163596 - RNA, 32 nt, Homo sapiens
acauugaugaggaagaugaugauguuccaggu

SEQ ID NO: 163597 - RNA, 22 nt, Homo sapiens
uuacuuaaagaaccuaaucauu

SEQ ID NO: 163598 - RNA, 46 nt, Homo sapiens
agcuucccuuucugcuaauaccuuugcaauuacuggucaugcagaa

SEQ ID NO: 163599 - RNA, 38 nt, Homo sapiens
aauauaaucaaaccuauaauacugugccgaggucaugg

SEQ ID NO: 163600 - RNA, 24 nt, Homo sapiens
ugaaagcuuuuauauauuuucaug

SEQ ID NO: 163601 - RNA, 44 nt, Homo sapiens
auauagcugguauugaagagguaugaucacuuugcaaguuguua

SEQ ID NO: 163602 - RNA, 61 nt, Homo sapiens
auagcaacuucagucauaaguaaucagaucaagucacucccaugcuuaaaaccuuucaaug

SEQ ID NO: 163603 - RNA, 47 nt, Homo sapiens
gccauaucccucaucucuggccaggacggcuacaggagccuccugac

SEQ ID NO: 163604 - RNA, 51 nt, Homo sapiens
uuucuuucucaguaacuaguauaauuuucaaccuguuugcucaggccaaga

SEQ ID NO: 163605 - RNA, 38 nt, Homo sapiens
aaagauuuaacccucaagacuuaauaaacugauccagg

SEQ ID NO: 163606 - RNA, 61 nt, Homo sapiens
cacugugucauuuacacugaugauaaccacaguuccuggggaugagcacaagggaagggaa

SEQ ID NO: 163607 - RNA, 47 nt, Homo sapiens
gggcuucaguuuccugcuccucgucaucucuucugauggacauaaug

SEQ ID NO: 163608 - RNA, 60 nt, Homo sapiens
uauaaucucuucuugcccuagcaccguuccccucccauucuaacucuuaggccacuccag

SEQ ID NO: 163609 - RNA, 45 nt, Homo sapiens
uauaaagggauaauuagaguuucuaccucauaaaguuguugugaa

SEQ ID NO: 163610 - RNA, 46 nt, Homo sapiens
agguuuuggagaucauauucauuggaggacacuggaagaugggaag

SEQ ID NO: 163611 - RNA, 25 nt, Homo sapiens
cgguuuacccggcccuugaccaugg

SEQ ID NO: 163612 - RNA, 61 nt, Homo sapiens
aagaugguacaguucuacaucugcaccugcccuuuuuucauaccacaaaaguauuuuuuga

SEQ ID NO: 163613 - RNA, 55 nt, Homo sapiens
ugguuuguauccuugagaaacuuuguuuuuguggaaguaagaaaguuaucuacua

SEQ ID NO: 163614 - RNA, 39 nt, Homo sapiens
aaccuggugaagaggacuaacuagcuguugggggaggug

SEQ ID NO: 163615 - RNA, 42 nt, Homo sapiens
uuucagaacucucccauaauuuuguuaugguaaaucuugagg

SEQ ID NO: 163616 - RNA, 60 nt, Homo sapiens
gauuuuaagacuuuuaaaguuaguaucauucgugcauauucauuacagcuucauuagugg

SEQ ID NO: 163617 - RNA, 71 nt, Homo sapiens
gccuuauaggccacugcaaggacuugggguuuugcccugacaaguggggaagccacugaaugguuuugagg

SEQ ID NO: 163618 - RNA, 68 nt, Homo sapiens
gaugaauuguaacaugaaugugccccuucuuucaucagaguuaguguucuggaaggaaagcagcaggg

SEQ ID NO: 163619 - RNA, 48 nt, Homo sapiens
cccauuuccucccacuuuacucaccuuaguggugaaaggagacuagua

SEQ ID NO: 163620 - RNA, 47 nt, Homo sapiens
ccugggaauaauugugggcuucuucccaaauuucuacagccucuuuc

SEQ ID NO: 163621 - RNA, 51 nt, Homo sapiens
agauaccaagaaguugccuauaaucaagaagaaagugaggaaguuggaaga

SEQ ID NO: 163622 - RNA, 52 nt, Homo sapiens
uaacaagaagauacaauucaaugcucauaucuggaccaaaucaaaauuccuu

SEQ ID NO: 163623 - RNA, 59 nt, Homo sapiens
auuguaguuaaguucuacaauagaaauauauauauagggugcuugguguguguagagcg

SEQ ID NO: 163624 - RNA, 58 nt, Homo sapiens
aguuugaucaauguuuccccugaaugcuucuauauuuaguaggcuguguuggguaugg

SEQ ID NO: 163625 - RNA, 59 nt, Homo sapiens
agggucauguuagaauacuuagaauacuagcaguuagggaagacauugacuccaacaga

SEQ ID NO: 163626 - RNA, 48 nt, Homo sapiens
aggagagcuuccaggaagauacuuucccaggcugcaaaaagaauaagc

SEQ ID NO: 163627 - RNA, 37 nt, Homo sapiens
agucacauugcacagaagguuguggaaugaaugagaa

SEQ ID NO: 163628 - RNA, 42 nt, Homo sapiens
uaaggccaaauaugaugcaauauuugauaguuuaagcccagu

SEQ ID NO: 163629 - RNA, 46 nt, Homo sapiens
aaccaguguugcucaacucuaaguuaccuguggauauccuuggaag

SEQ ID NO: 163630 - RNA, 31 nt, Homo sapiens
agauucccagaugugggauugcagagccgaa

SEQ ID NO: 163631 - RNA, 46 nt, Homo sapiens
aaaagcuaaauaugaugaaaucuuccugaaaacugauaaagauaug

SEQ ID NO: 163632 - RNA, 46 nt, Homo sapiens
uucaaaggaucaguuugccuuggcuuuucacuuaaucagucagaag

SEQ ID NO: 163633 - RNA, 42 nt, Homo sapiens
aaggaacuagauacucuuaacaaugaaauaguugaccuacag

SEQ ID NO: 163634 - RNA, 29 nt, Homo sapiens
gaaguucuuggcaguggaaaagaugaaac

SEQ ID NO: 163635 - RNA, 43 nt, Homo sapiens
uggcagcuucuuguuccauaggauuaaggaagacucugaggaa

SEQ ID NO: 163636 - RNA, 46 nt, Homo sapiens
aacuuugguuuuguguauacaauuuaaaauaagacaauauaacugg

SEQ ID NO: 163637 - RNA, 46 nt, Homo sapiens
agucaggaaucgcagaucuccacuuacgaagaagaauuggcaaaag

SEQ ID NO: 163638 - RNA, 46 nt, Homo sapiens
cgucuacagcaagaaacagcagaauuggaggagaguguagagucag

SEQ ID NO: 163639 - RNA, 43 nt, Homo sapiens
ugaggugacuacagcuguuacugaaaaaguuuguucugaacuc

SEQ ID NO: 163640 - RNA, 42 nt, Homo sapiens
uccuuuugccacuucaagcacugacccuuucagugcagccaa

SEQ ID NO: 163641 - RNA, 84 nt, Homo sapiens
uuuucggguuggaaauuaacucccaacaugaguagcaagagugaggaauacaaaaaggagauauguagaaaauaagauuuaaug

SEQ ID NO: 163642 - RNA, 46 nt, Homo sapiens
ucugucagcaacguagugauuacaaaaaauguauuugaggaaacau

SEQ ID NO: 163643 - RNA, 45 nt, Homo sapiens
gaagaagauaugaucgaaugggccaagagggaaagugagagagag

SEQ ID NO: 163644 - RNA, 41 nt, Homo sapiens
gcaguauucuccccugauuggaaugguugagugaggguaag

SEQ ID NO: 163645 - RNA, 48 nt, Homo sapiens
uuagcaacaaaacacaccagaaauaucuggguaaucauccagcaagag

SEQ ID NO: 163646 - RNA, 56 nt, Homo sapiens
caauauccuucuugcuccucacuccaaggagguaccaacagccuuuaaagggagag

SEQ ID NO: 163647 - RNA, 47 nt, Homo sapiens
gcacugagguucauggccuccucauccuguccaauguuggcccggau

SEQ ID NO: 163648 - RNA, 52 nt, Homo sapiens
uaaaugguauaacacagucacuuuuuaaaaguuuuacuaggcaugaacagga

SEQ ID NO: 163649 - RNA, 43 nt, Homo sapiens
auaacuuucucuaguaguaugcaguauuaaaagcuuuaauaaa

SEQ ID NO: 163650 - RNA, 49 nt, Homo sapiens
gggggcuaugguggugguggaccaggauauggaaaccaaggugguggau

SEQ ID NO: 163651 - RNA, 41 nt, Homo sapiens
uuuuugaugaaguugugcagauuuuugacaaggaaggcuaa

SEQ ID NO: 163652 - RNA, 78 nt, Homo sapiens
cuucagucaacaaagccaauuauugacuuauaugaagaaauggggaaagucaagaaaauagaugcuucuaaaucuguu

SEQ ID NO: 163653 - RNA, 53 nt, Homo sapiens
acgaugucuugagaggggaaagaguagugguaggagugaugacaacagagaga

SEQ ID NO: 163654 - RNA, 48 nt, Homo sapiens
gaaggcagauguaucuuucguucucuuuuuugacuguaauaaugaggu

SEQ ID NO: 163655 - RNA, 45 nt, Homo sapiens
aaaggaagaacccagauucacaguauggugaacuuauugaaaagu

SEQ ID NO: 163656 - RNA, 49 nt, Homo sapiens
aaauucuccaauuaaucuggcugaagcuaaugcagcucacagggcaccu

SEQ ID NO: 163657 - RNA, 73 nt, Homo sapiens
agucaaaugaggggagaauggaaggugaaaaguugagaaagugaggucgguggcagaucaggacuuuugauua

SEQ ID NO: 163658 - RNA, 73 nt, Homo sapiens
cagacaguauaguaccaucgccacggugucugggagaagguuucacagaggaagugacauucgaguuggauug

SEQ ID NO: 163659 - RNA, 47 nt, Homo sapiens
auucaccagacaucauggagccuauauauccuuuugcacggccccag

SEQ ID NO: 163660 - RNA, 60 nt, Homo sapiens
aacuuugucauaugggccauguagaaauugaagguucuugaaaaaagaaaacacugucaa

SEQ ID NO: 163661 - RNA, 56 nt, Homo sapiens
auuuucagaauguccauguaaugugaaagaauuguccagucaauuuauaugccaga

SEQ ID NO: 163662 - RNA, 52 nt, Homo sapiens
aaucaaagugaggugauaaaacauucaaauauucauacacagaaaaauaaag

SEQ ID NO: 163663 - RNA, 39 nt, Homo sapiens
ugcagacauucugauugcuucauuguaauaccuuguaca

SEQ ID NO: 163664 - RNA, 49 nt, Homo sapiens
cugguacuuuuaauaaccauauagacucaacauuauauacuaucacuag

SEQ ID NO: 163665 - RNA, 51 nt, Homo sapiens
ggaaaagcacaaugugauauauccauacaagggaauguuauucagcaauca

SEQ ID NO: 163666 - RNA, 87 nt, Homo sapiens
uacaaggccacaguaugguacuguuuauaugaaauguccagaauaggcaaauucagagauagaaaucauguuagaccgucaggggcu

SEQ ID NO: 163667 - RNA, 45 nt, Homo sapiens
cagccgucuaccaaagcaguaauuaucagucaugaaugcaccaga

SEQ ID NO: 163668 - RNA, 45 nt, Homo sapiens
agcagugacaauagugaagaugaagaggaaccucccgacaaugca

SEQ ID NO: 163669 - RNA, 47 nt, Homo sapiens
aaugaaggggacauuacaauuuuuccugaaaguuugcaaccuucuga

SEQ ID NO: 163670 - RNA, 46 nt, Homo sapiens
uuaauacagggacagggugucuccugaagauacuuagggaaaacag

SEQ ID NO: 163671 - RNA, 45 nt, Homo sapiens
aaugugccaagagcccagggaguccuaaagaagcaaagaauggag

SEQ ID NO: 163672 - RNA, 47 nt, Homo sapiens
uucuucugaguuucugauucuggggcuggggauucaguaugccacaa

SEQ ID NO: 163673 - RNA, 69 nt, Homo sapiens
uggcuuuuugugagaccacuaccauucccgagauacuucugauuagccaugcacucugccauagccuca

SEQ ID NO: 163674 - RNA, 41 nt, Homo sapiens
aaccagaugaauaguacucagggauccuuagagauggacgg

SEQ ID NO: 163675 - RNA, 45 nt, Homo sapiens
auacauugauuguucuacaauuuguuaauaaagcaauuaugguag

SEQ ID NO: 163676 - RNA, 71 nt, Homo sapiens
uuauacuucagucucuggaaagaaacuugagcagugggaagggaaugggaaaggaaagauaacccucaaac

SEQ ID NO: 163677 - RNA, 187 nt, Homo sapiens
uccauuuaaaccucagccaguucccuucaccuuguaccuuccccuuuuuuguucuuccuagacauacugucaagacagcaaucuaugauaugcuuugauauuccaggaaagaaagugugauuacaguauucucugauuagaguguuaaacucugggcuaagauaaaagaaaagccaggaagauuaug

SEQ ID NO: 163678 - RNA, 48 nt, Homo sapiens
agugcucuuacaaacaaaccugagagcaacaggccuccagagaccgcc

SEQ ID NO: 163679 - RNA, 36 nt, Homo sapiens
guuuauuuucacuugucaaaaauauauaugaucuaa

SEQ ID NO: 163680 - RNA, 30 nt, Homo sapiens
ucacugguucuugagcugcuuaauuucugg

SEQ ID NO: 163681 - RNA, 50 nt, Homo sapiens
guucugcuaugccagaaccagagagcuugagagcauuugauuccgaugga

SEQ ID NO: 163682 - RNA, 35 nt, Homo sapiens
caacaaaacaacccuuacuuacccaucaguccucu

SEQ ID NO: 163683 - RNA, 42 nt, Homo sapiens
guagcuuguccuuuuuaguuucaaauucuuauucauaggcag

SEQ ID NO: 163684 - RNA, 46 nt, Homo sapiens
ccucuuucauauccaaaccagaacacauuuggguauuccugagacu

SEQ ID NO: 163685 - RNA, 71 nt, Homo sapiens
cuugcccaagaucacacagcuaauuggugucagagcugggagucucugcaaagcccuggcucguuccacgu

SEQ ID NO: 163686 - RNA, 40 nt, Homo sapiens
gaguccagggucccuaacaccaccucuuagcuuccagagg

SEQ ID NO: 163687 - RNA, 41 nt, Homo sapiens
ugaucaggucagacccagcugcuuuugagucccgccuggag

SEQ ID NO: 163688 - RNA, 42 nt, Homo sapiens
gggcauuccaggcaaggugauuuuaucaaauguguggaacag

SEQ ID NO: 163689 - RNA, 46 nt, Homo sapiens
cuuuaacauugagaugguaaaagaaaaaacugcagaagaaauaaaa

SEQ ID NO: 163690 - RNA, 50 nt, Homo sapiens
agagagaggcuuucuagucagagccaauaacauguaaaaaggcaugggaa

SEQ ID NO: 163691 - RNA, 38 nt, Homo sapiens
acagacaccccucucuuuuuuguacagauuuggcagca

SEQ ID NO: 163692 - RNA, 34 nt, Homo sapiens
ucuuagagauggucaccaucuacugcuugaccau

SEQ ID NO: 163693 - RNA, 54 nt, Homo sapiens
ccuacaugaauucaacagccagaagaagagucugcgcuuuuugugauguuuuag

SEQ ID NO: 163694 - RNA, 46 nt, Homo sapiens
uagcugaaauacugagcugccagaaggccuaagggaaaaggaauag

SEQ ID NO: 163695 - RNA, 46 nt, Homo sapiens
cugccaagaagggaagguuaugaguuuuuuguaggacaauggacag

SEQ ID NO: 163696 - RNA, 33 nt, Homo sapiens
cacugaagguauuacucuucugccaaagcucau

SEQ ID NO: 163697 - RNA, 48 nt, Homo sapiens
gauaagagauuguagacaaguaaauggcuucuuaauuauagggaagag

SEQ ID NO: 163698 - RNA, 60 nt, Homo sapiens
caucauuuauaguguuuuucuuuccuccuuuucccacuccuagaugagaaucacugagau

SEQ ID NO: 163699 - RNA, 46 nt, Homo sapiens
caacucaccaaaucucccuuguuuauuagggcaaaugagauuagaa

SEQ ID NO: 163700 - RNA, 36 nt, Homo sapiens
uucauaaaagugugauuggaguagacuuaagagagg

SEQ ID NO: 163701 - RNA, 25 nt, Homo sapiens
cagugcaucgccaaccaaguucagc

SEQ ID NO: 163702 - RNA, 46 nt, Homo sapiens
gagcaaagcggacuuggagcagaacugaaaugugcccagaaccaaa

SEQ ID NO: 163703 - RNA, 47 nt, Homo sapiens
ccaaauacauuauauuuauuuauucuugugucuuuuuucccccacua

SEQ ID NO: 163704 - RNA, 62 nt, Homo sapiens
acugggaucauaucuuacuggacauuauauuccaaguguccagcacgaaacccggcagaggg

SEQ ID NO: 163705 - RNA, 91 nt, Homo sapiens
cccugcagagugucuauaucaaacuaaauccucaucuguggaaugggcucccaguggcucccuccccgccaggugacacucaccaacacgc

SEQ ID NO: 163706 - RNA, 44 nt, Homo sapiens
ggucaaaucagcuaugaacaccucggggcaacuguucuggaagg

SEQ ID NO: 163707 - RNA, 43 nt, Homo sapiens
cgggcaugacagugcaagaaacagcaggccacuggcuggggag

SEQ ID NO: 163708 - RNA, 46 nt, Homo sapiens
cucuccaagacggaguuccuaagcuucaugaauacagagcuggcug

SEQ ID NO: 163709 - RNA, 39 nt, Homo sapiens
gaccacaugaagaaacuggaugucagcagugaugggcag

SEQ ID NO: 163710 - RNA, 44 nt, Homo sapiens
gucaucaucuccuccucacagcccacauguccccugagcccagc

SEQ ID NO: 163711 - RNA, 42 nt, Homo sapiens
gggcuaagagggccccgugcguguuuuggcgggcuagguccu

SEQ ID NO: 163712 - RNA, 45 nt, Homo sapiens
ucuccggauucgguaagcaucuuuugcucguccuccagucccaug

SEQ ID NO: 163713 - RNA, 67 nt, Homo sapiens
acaaagaagaggcugcucaugaaagcugcagaaacagugccuggggggauaagcgggggcggugcug

SEQ ID NO: 163714 - RNA, 70 nt, Homo sapiens
ucagaaaacccagaucacaagcccacaugcccacagcuccaucaccuggccagucaacaccacugaagcc

SEQ ID NO: 163715 - RNA, 42 nt, Homo sapiens
ugcuggugacugucauugucaauaucaaguugauccuggaca

SEQ ID NO: 163716 - RNA, 46 nt, Homo sapiens
ggagaaacauucuaaaucaccugcccucucuuccuggggggaccca

SEQ ID NO: 163717 - RNA, 46 nt, Homo sapiens
ccaaguuugcugugguucuggaagaggaccuggacauugcugugga

SEQ ID NO: 163718 - RNA, 46 nt, Homo sapiens
ggaggaugacagccuguacugcaucucugccuggaaugaccaggua

SEQ ID NO: 163719 - RNA, 96 nt, Homo sapiens
aagagcuugcugaggaugcugcaaagaggauggagaagacggugggaaauuagagggcucuuuacaggucuaggacuucauuugugugucuuauag

SEQ ID NO: 163720 - RNA, 42 nt, Homo sapiens
agaagccacccucagucaccccaauuuuccuggagccacccc

SEQ ID NO: 163721 - RNA, 45 nt, Homo sapiens
cagauuuccaaagcuggauaaguuggucauugauuaaaaaaggag

SEQ ID NO: 163722 - RNA, 31 nt, Homo sapiens
caagguuuuaagagucuaccacgccaaaccc

SEQ ID NO: 163723 - RNA, 42 nt, Homo sapiens
ucauccauauuggguacuguccaugcuggucuagaagagucu

SEQ ID NO: 163724 - RNA, 955 nt, Homo sapiens
accaguugauguauuaauuuuuauuuuuauuuuuuugagaccgaguuuugcucuaucacccaggcuggagugcagugguacaaucucugcucacugcaaccucugccucccagguucaagcgauucucugccucagccuccugaguagcugggauuacaggcguccgccaccaugcccagcuaauuuuuguauuuuuaguagagacaggguuucaccauguuguccaggcuggucucgaacuccugaccucacgugaucugcccgccuuggcaucccaaaguuuugggauuacaggagugagugaccgugccuggccuuauuuuuuuuaauuuuuacuuuuugagaugaauuauuccucugucacccaagccagagugcaguggcacaaucucggcucacugcaaccuuugcuuccuggguucaagugauucuucugccucagccccccagguagcugggacuacgggcgccuaccaccaugcugagcuaauuuuuguauuuuuccguggagacaaggguuuuaccauguuggccaggcagguacugaacuccugaccucaagugauccaccugccucaacucccaaagugcugggauuucagccguaagccacggcaccuagccaauuuuuuuuuuuuuuaaacaucgucuugcugugucacccaggcugcagugcaguggcaugaucucagcucacugcagccucaaccuccugggcucaagcgauccuccucucucagccucccagguagcuggggcuauaggcgugugaccccaugcccagcuaauuuuuuguagagaugggguuuugccaugugcccagacuggucuugaacuccuugagcucaagugaucccacccaccucggccugccaaauugcugggacuacaggcgugagccacugcacccagccugauauaauaaacauuuuacuuacuuguauuuuacuuaac

SEQ ID NO: 163725 - RNA, 77 nt, Homo sapiens
cuacugaccuagcccaagcaauauuuggcaaauagugcucaaauaucugcugaacaaaccaaccuuugaagaugcuu

SEQ ID NO: 163726 - RNA, 46 nt, Homo sapiens
auauaggaaauguuguguuauucuugcagccuugauauucagggug

SEQ ID NO: 163727 - RNA, 44 nt, Homo sapiens
ggaaaacaaaggccuacagccacacuugaucaccuccacguuag

SEQ ID NO: 163728 - RNA, 45 nt, Homo sapiens
ugacaaggugggaaauaucagucacacaauuugaugaggaagcac

SEQ ID NO: 163729 - RNA, 46 nt, Homo sapiens
aagagccuccuccaccaggagugaaaccugaaguagaacucuccac

SEQ ID NO: 163730 - RNA, 27 nt, Homo sapiens
uucuaucuucucucuaauuucggguag

SEQ ID NO: 163731 - RNA, 44 nt, Homo sapiens
cagauaggacaggccagaugcuaauccaagugaguuaacaccug

SEQ ID NO: 163732 - RNA, 65 nt, Homo sapiens
agcagcuaucugaacuuugucuucaggugauuucucaguagcucccugggcuaccuugguaucaa

SEQ ID NO: 163733 - RNA, 64 nt, Homo sapiens
ccccaucuccagcugccucagacucuucuacagacagcuuagucuccuccugacuaggaaccag

SEQ ID NO: 163734 - RNA, 46 nt, Homo sapiens
gggagaacuggagccuccugcccaggcuuuucagagacuucugauc

SEQ ID NO: 163735 - RNA, 45 nt, Homo sapiens
caagaaccgccuuuccugccucguuuucagagguaacuaccuucu

SEQ ID NO: 163736 - RNA, 45 nt, Homo sapiens
acuguccuguucuuuaucaguuucaggcuuugccaaagacuuguc

SEQ ID NO: 163737 - RNA, 75 nt, Homo sapiens
aaaaauacauucccuuuaaacccucaaaaagccuaccaaguuucagcagauggccuaaaaauuaucugcccccua

SEQ ID NO: 163738 - RNA, 79 nt, Homo sapiens
cuagcagagcaacuuacugcaaaagaaacccaagcuuguuacacuagguauuguuuuacuugagcauucugauuaccag

SEQ ID NO: 163739 - RNA, 55 nt, Homo sapiens
gcacacauaaaaaauguacaagggcucuaaaaguacugcuauuaaaauaacugaa

SEQ ID NO: 163740 - RNA, 56 nt, Homo sapiens
gauucuguucuggauguuggcagaggcaguagggguuuaggaaaagaauggauuga

SEQ ID NO: 163741 - RNA, 46 nt, Homo sapiens
acaaaagacuagcugcuuccuggaaugcauugacagcugcuggaau

SEQ ID NO: 163742 - RNA, 41 nt, Homo sapiens
uuaccucuccacuuuaucugcagauguagaaggagcaggaa

SEQ ID NO: 163743 - RNA, 45 nt, Homo sapiens
cagccacugccgccgucgccgcggagcugguuucugccgacaagu

SEQ ID NO: 163744 - RNA, 46 nt, Homo sapiens
uugucggcagaaaccagcuccgcggcgacggcggcaguggcugugg

SEQ ID NO: 163745 - RNA, 46 nt, Homo sapiens
ggcaauuugggacgccagagacucacucagggacagaaaauggcag

SEQ ID NO: 163746 - RNA, 71 nt, Homo sapiens
ucgggaagcuucuggaauggaccuguauccagacucguggcuguagaagacagccucuauguauuuggcug

SEQ ID NO: 163747 - RNA, 59 nt, Homo sapiens
uggaaaaauaccuggcauauauaguaagcaguauguuggccauuaccaaaggcccuggg

SEQ ID NO: 163748 - RNA, 47 nt, Homo sapiens
ccgggaugcugugacaccccaggagcgcuacucagaagagcagaagg

SEQ ID NO: 163749 - RNA, 42 nt, Homo sapiens
ugcugcugccagggauagaggugccagaucugccacccagaa

SEQ ID NO: 163750 - RNA, 46 nt, Homo sapiens
agauugggaagacccuggaggaaauucugagccgccuacaggaaga

SEQ ID NO: 163751 - RNA, 45 nt, Homo sapiens
uggcugucucgaagccagucagauaucuuuucccguaagccccca

SEQ ID NO: 163752 - RNA, 45 nt, Homo sapiens
ggggacagcaaggcagcgugguggucauggcucuuagcuaaccua

SEQ ID NO: 163753 - RNA, 29 nt, Homo sapiens
cagccuucuuacuuguaccucaaacacug

SEQ ID NO: 163754 - RNA, 43 nt, Homo sapiens
accugagagcaagguggaaguugcaucagcuacugccccaagu

SEQ ID NO: 163755 - RNA, 44 nt, Homo sapiens
ggguccagagcugcagggcugcggucccuggcucacuuccacau

SEQ ID NO: 163756 - RNA, 46 nt, Homo sapiens
acugaggacacuguggucccagggggcaccagccauaagccuaggg

SEQ ID NO: 163757 - RNA, 44 nt, Homo sapiens
ugguccacuagcauauaagcuccauaagagcaggguuuuguggu

SEQ ID NO: 163758 - RNA, 45 nt, Homo sapiens
cucguaucaggccccaccccuuucccucaaccauuuccucaccau

SEQ ID NO: 163759 - RNA, 46 nt, Homo sapiens
ggcuccuggcagauugcuccuguacggacugccacagagcucugau

SEQ ID NO: 163760 - RNA, 42 nt, Homo sapiens
cagcgcaaaagugugggggagcugccgggggugcaggccaag

SEQ ID NO: 163761 - RNA, 44 nt, Homo sapiens
cugaagccggguaggaaggguccgcgguagccagcgcgcuccag

SEQ ID NO: 163762 - RNA, 48 nt, Homo sapiens
ucuuaauggcucugggaagcuggguccuuugccagguaccauggucac

SEQ ID NO: 163763 - RNA, 46 nt, Homo sapiens
gccaaagcgggugguggucuaugggggugaaggggacaaccugaag

SEQ ID NO: 163764 - RNA, 45 nt, Homo sapiens
gucuguguccuggaggacaugaccguccaccucccgaucaucgag

SEQ ID NO: 163765 - RNA, 62 nt, Homo sapiens
acucuuucagccucagcccuucauucauuuguucagccugccuuuaguuguuuggaugcagg

SEQ ID NO: 163766 - RNA, 46 nt, Homo sapiens
caugauuaguuauguucaugauuacuauucaugcuuccuagguugc

SEQ ID NO: 163767 - RNA, 44 nt, Homo sapiens
aaaauggaauuucaagcaguagugauggcaguagguggaggauc

SEQ ID NO: 163768 - RNA, 45 nt, Homo sapiens
cugcuuccaguugggaacaaaccuuuaauuugguacccauugaac

SEQ ID NO: 163769 - RNA, 46 nt, Homo sapiens
ccacaaugauccaagacgaacucuguaaagauaucagaaagagcag

SEQ ID NO: 163770 - RNA, 46 nt, Homo sapiens
gguuacaaccagggauguucaaaaggcucuaugugcagaauucaag

SEQ ID NO: 163771 - RNA, 24 nt, Homo sapiens
uagaaauuccagaguugauaauuc

SEQ ID NO: 163772 - RNA, 46 nt, Homo sapiens
caagccucauuuacccugugccucaguuucacaaccaagaaaguag

SEQ ID NO: 163773 - RNA, 202 nt, Homo sapiens
ugcaguuagccuuugguguuuauucaagcacacaaacuaugccaggugcaguggcucaugcauguaaucccagcauuuugggaggcugaggcaggaggauugcuugaguccaggaguuugagaccagccugggcaauauagggagaccccuugucuaaaaaaaaagaaaagaaaagaaaaagcacacaaacuacucuugggg

SEQ ID NO: 163774 - RNA, 46 nt, Homo sapiens
ggcagggguggcaugcaggcuggugauuuggaucauagccauuauu

SEQ ID NO: 163775 - RNA, 46 nt, Homo sapiens
agcuuaugaugcaucacuugcuauguugaugagaaaaggccaagau

SEQ ID NO: 163776 - RNA, 32 nt, Homo sapiens
guaagaagaccuagguuauuauuugcagagag

SEQ ID NO: 163777 - RNA, 46 nt, Homo sapiens
agcacaggaaagaggcugcucuucauggcuaaugaagcagacuugg

SEQ ID NO: 163778 - RNA, 46 nt, Homo sapiens
caaagaucauggccagaucuguauuucugggacuacagaugaugag

SEQ ID NO: 163779 - RNA, 45 nt, Homo sapiens
uccuaaccagcccuaauucccaaaauaccucucuuaauuugcagu

SEQ ID NO: 163780 - RNA, 45 nt, Homo sapiens
ucugcucucuguccagaagaaccaccaguccauucgucagcccag

SEQ ID NO: 163781 - RNA, 46 nt, Homo sapiens
ccaaggcagugucaucugcaacaaugcugugaucgagaagggugca

SEQ ID NO: 163782 - RNA, 46 nt, Homo sapiens
cuguuggccuuuggggcccuggcauuaggucuccgcauggccauua

SEQ ID NO: 163783 - RNA, 52 nt, Homo sapiens
ugcaucaggguuuuacaaaggcagcuaaaacaagauucaucuuucaguagca

SEQ ID NO: 163784 - RNA, 43 nt, Homo sapiens
uuuagccacaugaaaagagaagaaaaggaaaggaagaagggaa

SEQ ID NO: 163785 - RNA, 78 nt, Homo sapiens
gugggcagccgggugagccaggagcugcauuacaccaaggagaagcugggggaggaggcugcauacaccucucagaug

SEQ ID NO: 163786 - RNA, 69 nt, Homo sapiens
cugauacagaccgcacgccaggagggagagaacauccucacacccgaagcacuuggccuccaccuccag

SEQ ID NO: 163787 - RNA, 45 nt, Homo sapiens
aagucaggaguuccccuuauugaaaauggaaugauugagcgggua

SEQ ID NO: 163788 - RNA, 45 nt, Homo sapiens
gacccccugggucuggcagccucacaggccaacuucuacccccca

SEQ ID NO: 163789 - RNA, 42 nt, Homo sapiens
gccaucgagggggcccgggcagcaugcgcagaggccggccag

SEQ ID NO: 163790 - RNA, 45 nt, Homo sapiens
gccgucugcauccugcuggugugcacuuuccucgucugugcucug

SEQ ID NO: 163791 - RNA, 45 nt, Homo sapiens
ggaaccugcgggccgcccaugcccuugagcacacauuugcccccg

SEQ ID NO: 163792 - RNA, 46 nt, Homo sapiens
caaagguuacggccaccugcgagcagaaugagggagaucagguugg

SEQ ID NO: 163793 - RNA, 42 nt, Homo sapiens
ucguagugcuuguacuuaccucgcuucccaccuucggcagcu

SEQ ID NO: 163794 - RNA, 46 nt, Homo sapiens
gcugcgugacagucccagaccugacaccccccaacccagcuaggag

SEQ ID NO: 163795 - RNA, 42 nt, Homo sapiens
gugggggauuuugggcuggcagcccgguuggagccuccggag

SEQ ID NO: 163796 - RNA, 45 nt, Homo sapiens
gagcaggcuagcagacaaauaagcagcaagaaacggccccaguga

SEQ ID NO: 163797 - RNA, 41 nt, Homo sapiens
acugucuucccagauguccagcuuuaacgaagccaugacuc

SEQ ID NO: 163798 - RNA, 45 nt, Homo sapiens
gauggaagccugcucuaacggggcgcugauuccaggcaauguaag

SEQ ID NO: 163799 - RNA, 81 nt, Homo sapiens
guuugaccugcucaacaagaaggccaagcugcgcgugcuggaggacggcaagcaacaggugcaagugguggggcugcagga

SEQ ID NO: 163800 - RNA, 71 nt, Homo sapiens
gacgucuuccuccugaagaaucaacccugcuaccggaaguugggccuggaagucuaugugacauucuucga

SEQ ID NO: 163801 - RNA, 75 nt, Homo sapiens
aguggcaagacacaugugaguauugaggccuggcggggaaagagccuuucccuugugcaccccuggcucccuaua

SEQ ID NO: 163802 - RNA, 65 nt, Homo sapiens
uccuagcaagugucuccucuugguacaugaacccaaguugaaaguggacuuaacaaaguaucugg

SEQ ID NO: 163803 - RNA, 44 nt, Homo sapiens
aagagcacagaauaugugucuguguuaggaaacgcccacugaau

SEQ ID NO: 163804 - RNA, 46 nt, Homo sapiens
auuucgggcuacuuuggaaugucauccacuuacuaugacugauccu

SEQ ID NO: 163805 - RNA, 48 nt, Homo sapiens
ccccucugccaaucucuuccccagugcuuuguaccuggcuucucaacc

SEQ ID NO: 163806 - RNA, 84 nt, Homo sapiens
ucuugugaaggaaguggaaaaaaugaagaacaagcgagaagagaagaaggcccagaacucugaaaugagaaugaagagagcuca

SEQ ID NO: 163807 - RNA, 45 nt, Homo sapiens
cauuccauccgaggcagcucuucugcaaacccugugaacucaggu

SEQ ID NO: 163808 - RNA, 54 nt, Homo sapiens
cauuuacauaauuuaauuaaacauuauguaaaccaaucgugcgaaaagaaagag

SEQ ID NO: 163809 - RNA, 42 nt, Homo sapiens
gagacugcaggcaucaaguuuccagacuucaagucugcaggu

SEQ ID NO: 163810 - RNA, 46 nt, Homo sapiens
aggaguaccugcuacaggagcugcgcaagauugaggcccggaagaa

SEQ ID NO: 163811 - RNA, 46 nt, Homo sapiens
cuguggaagaccugaaggagcgguacuaccacaucugugcuaagcu

SEQ ID NO: 163812 - RNA, 19 nt, Homo sapiens
ggaccucuagucaagcaga

SEQ ID NO: 163813 - RNA, 34 nt, Homo sapiens
ucagcucgugguagugcuauuugucucuggggga

SEQ ID NO: 163814 - RNA, 66 nt, Homo sapiens
cuugagcagcuggguugggugauggugauauugacugaaaucuggacuggagaagauaauguuuga

SEQ ID NO: 163815 - RNA, 99 nt, Homo sapiens
ccauucucaucauagaccagggguaaguguaaacagcacugguuugcagacuauccuuuaaguagcacuguucaaagagaucacgucuuagcugcagau

SEQ ID NO: 163816 - RNA, 64 nt, Homo sapiens
auuauaaagacaaaauacaaguccauguuucuucauauuagauucaacagcauacaauugcugu

SEQ ID NO: 163817 - RNA, 46 nt, Homo sapiens
ugagaggaccaggcaagugugauuuuugcaagauauuguuggggag

SEQ ID NO: 163818 - RNA, 45 nt, Homo sapiens
gccacuuaauguacauuaccaaaauaaauauaucuaccccagacu

SEQ ID NO: 163819 - RNA, 46 nt, Homo sapiens
gcaaauuaggcugcaacuacuuuauaacuaacguucccugccuauc

SEQ ID NO: 163820 - RNA, 50 nt, Homo sapiens
acaguuuaccuaagauuacaaauuuaaggcaugccaucuuguuaccagua

SEQ ID NO: 163821 - RNA, 46 nt, Homo sapiens
acucugcaagccagaugugggaagaaaaacucugggugccuugucu

SEQ ID NO: 163822 - RNA, 104 nt, Homo sapiens
agcuagccaggaugaagcagaagagggugagacucgaagagggcagagauauggucaagggaauuggcucuuugggguacaugaaguguucagcaaagaccaaa

SEQ ID NO: 163823 - RNA, 38 nt, Homo sapiens
acacugauguuauguguucuccguugacaacccugaga

SEQ ID NO: 163824 - RNA, 48 nt, Homo sapiens
aggggugagcacccucaggguuucagaacuauguggcccauaucgagg

SEQ ID NO: 163825 - RNA, 40 nt, Homo sapiens
cugcguagcccuccgucaguucucucgugaguccaugguc

SEQ ID NO: 163826 - RNA, 25 nt, Homo sapiens
uaauggcacugguggcaaguccauc

SEQ ID NO: 163827 - RNA, 46 nt, Homo sapiens
ccaucuuccuaguguuugugaaauaaacuugguauuugucuggguc

SEQ ID NO: 163828 - RNA, 44 nt, Homo sapiens
ggggacacaggugcgcagcugcacagagucagcagcagcagccu

SEQ ID NO: 163829 - RNA, 45 nt, Homo sapiens
gucccaggaaaaccagcaauaaauaaaagugaggcacggccccac

SEQ ID NO: 163830 - RNA, 72 nt, Homo sapiens
ucuucuguggagucugcgugggcaucgugggcaguggggcugcccuggccgaugcucagaaccccagccucu

SEQ ID NO: 163831 - RNA, 27 nt, Homo sapiens
ccaagcugggaugggggagaguggaag

SEQ ID NO: 163832 - RNA, 41 nt, Homo sapiens
agggugguggcgggaauccauuccaguguguucuacacauu

SEQ ID NO: 163833 - RNA, 38 nt, Homo sapiens
aggcaacaacugaccgcguauuucccaaagguccaugu

SEQ ID NO: 163834 - RNA, 45 nt, Homo sapiens
cgccgucgccgccaugacggggcuagcacugcucuacuccggggu

SEQ ID NO: 163835 - RNA, 46 nt, Homo sapiens
acguaugaacacuauaaaccaaauuauuuugaaaacuggugcauca

SEQ ID NO: 163836 - RNA, 37 nt, Homo sapiens
aacgcugaagucucugaaagugaaguuguaaaaagaa

SEQ ID NO: 163837 - RNA, 42 nt, Homo sapiens
aucaacucaagauaccgggaagauuauauugagccugcacua

SEQ ID NO: 163838 - RNA, 42 nt, Homo sapiens
aguagccucagacaugcgcuucaaugagauuuucacagagaa

SEQ ID NO: 163839 - RNA, 39 nt, Homo sapiens
ugguuaagagagaugauguauacacacuggaugaagagc

SEQ ID NO: 163840 - RNA, 44 nt, Homo sapiens
gguccaagugagauggacagacggccaagucuauggagccaagu

SEQ ID NO: 163841 - RNA, 42 nt, Homo sapiens
uggauguguucucgguguucagccaaugcccuagaggaggug

SEQ ID NO: 163842 - RNA, 49 nt, Homo sapiens
gaccaaggggggugagcagacgcuggggcuagguggacagaggagggag

SEQ ID NO: 163843 - RNA, 45 nt, Homo sapiens
ggggaaaccugaguucagugucuauggaggauguagacuuaggag

SEQ ID NO: 163844 - RNA, 41 nt, Homo sapiens
gugggaggugcaggaagccaauaaauaacaccuguccuuuu

SEQ ID NO: 163845 - RNA, 25 nt, Homo sapiens
ucuccuuguuguugauacucauaac

SEQ ID NO: 163846 - RNA, 45 nt, Homo sapiens
cccaagggcaaacgggaguucucacugugcacaguuaugccaaag

SEQ ID NO: 163847 - RNA, 46 nt, Homo sapiens
agcaguaugagaugacggagugcccggcagcccucgccccugugag

SEQ ID NO: 163848 - RNA, 46 nt, Homo sapiens
ggacaaagaggcaccgaguuugucuugaaauaccacaggaggugag

SEQ ID NO: 163849 - RNA, 64 nt, Homo sapiens
ccaggggaucugugcucugaggagaauuuauccugggccauaugggaaagaaaggaggaaccgu

SEQ ID NO: 163850 - RNA, 41 nt, Homo sapiens
gaggacauggaagggguggaggauggagaggaaggagaccu

SEQ ID NO: 163851 - RNA, 26 nt, Homo sapiens
ggacgugggggugaguuggaagcagc

SEQ ID NO: 163852 - RNA, 51 nt, Homo sapiens
acccaguaugacugguguuuccacuaaagacccaaauguuaaagaaaaaau

SEQ ID NO: 163853 - RNA, 28 nt, Homo sapiens
uggaauaaucuucagaagagauuaaaaa

SEQ ID NO: 163854 - RNA, 46 nt, Homo sapiens
ucaccauugagggugugaacaccccauaccuguacuuuggcaugug

SEQ ID NO: 163855 - RNA, 46 nt, Homo sapiens
ccacgcuauagugaguuugaagagcucgagcggaaauacuggaaaa

SEQ ID NO: 163856 - RNA, 56 nt, Homo sapiens
ucuaccuugcuggccaaccugcugaccgaugagagaauuuacauaaaggcauguug

SEQ ID NO: 163857 - RNA, 73 nt, Homo sapiens
cggggcagucuggccucuuuacucaguacaacauacagaagaaagccaugacuguucgagaguuccgcaagau

SEQ ID NO: 163858 - RNA, 46 nt, Homo sapiens
cagaauggguucugagauugguccuuuccaaucuucaaggccaaug

SEQ ID NO: 163859 - RNA, 60 nt, Homo sapiens
aagcuucggguacagggaccgagagugggcuggcuaaggagaaugaagaguugggacuga

SEQ ID NO: 163860 - RNA, 24 nt, Homo sapiens
gaaaaugucucagugagggagugu

SEQ ID NO: 163861 - RNA, 44 nt, Homo sapiens
ugaccaaccuguuccuauuggugcagagagaggagaagcagcuu

SEQ ID NO: 163862 - RNA, 47 nt, Homo sapiens
gccaugagguagucccugaccaucugagaaccaagccugacccugaa

SEQ ID NO: 163863 - RNA, 88 nt, Homo sapiens
cuugaauaaaauguguucaaaccuucuggagaaaaucagcaaagaggagcgagaaucagagaguggagguaugaugggacugguggcu

SEQ ID NO: 163864 - RNA, 45 nt, Homo sapiens
aggauuacagcaggugcagauggcaggagcuccaagccagcagca

SEQ ID NO: 163865 - RNA, 42 nt, Homo sapiens
gugaaauuaccuuuugcucaaggcucaccuagauggguacaa

SEQ ID NO: 163866 - RNA, 42 nt, Homo sapiens
gcgggcaacggcggagcgcucggagggagcagggccagagag

SEQ ID NO: 163867 - RNA, 50 nt, Homo sapiens
uggauggaagggaaaaggugccuggcaaaguuaggguagcggggggaggg

SEQ ID NO: 163868 - RNA, 74 nt, Homo sapiens
gcgcccucgccccggccugggcccugccggcgaugggcggccagcaagcccgauggugggggagcaaguaagga

SEQ ID NO: 163869 - RNA, 48 nt, Homo sapiens
ccgagcugcgugagggccgggagccaugcgugucagcccacggaggug

SEQ ID NO: 163870 - RNA, 69 nt, Homo sapiens
uggggccugaccacggugggccuaaagaagccgggccuccuggaggugaggggugugcggggcagggag

SEQ ID NO: 163871 - RNA, 47 nt, Homo sapiens
gccuagcccaacggggccccucccugagggaggggaagauuccugcg

SEQ ID NO: 163872 - RNA, 48 nt, Homo sapiens
auccucggauuccuccuugccugugcugggacacuuaugucccuacga

SEQ ID NO: 163873 - RNA, 33 nt, Homo sapiens
aagagaguucaggaaggguccagagggauggga

SEQ ID NO: 163874 - RNA, 61 nt, Homo sapiens
gaagguaagauucuccaguaagagaccuggaauugagaguuaucuuguggaggaagagggg

SEQ ID NO: 163875 - RNA, 49 nt, Homo sapiens
gagauaagacacagaaccagacaagacaccugcaaugccucauugcaga

SEQ ID NO: 163876 - RNA, 52 nt, Homo sapiens
cagaggguagcccuggauccggggaucuaugaauaagggucaaaggaaucag

SEQ ID NO: 163877 - RNA, 62 nt, Homo sapiens
uaaagcccggcaucccaggggcccaccucauagacaauguagagggagagugccaccaguga

SEQ ID NO: 163878 - RNA, 62 nt, Homo sapiens
ucccagccaucccuccccuucgcuagcugaggacauggaucugaaccucucuggaaaggaga

SEQ ID NO: 163879 - RNA, 46 nt, Homo sapiens
gggucacagcgccagguauaggugcucagccagcccgacaucagga

SEQ ID NO: 163880 - RNA, 42 nt, Homo sapiens
cugagaagcauggccuagauaggcgcccaccuaagugccuca

SEQ ID NO: 163881 - RNA, 30 nt, Homo sapiens
ucauguuuuuuuuuuaaaucuguuucagcu

SEQ ID NO: 163882 - RNA, 50 nt, Homo sapiens
ugugaauauacuaaaaaucacuaaacuguacacuuuaaaaggaugcauuu

SEQ ID NO: 163883 - RNA, 46 nt, Homo sapiens
ugguaaugauaacuuggucaauguguggccuagugcuccuggagag

SEQ ID NO: 163884 - RNA, 41 nt, Homo sapiens
aauggagcagccuggggaauauauauccucuguggccugga

SEQ ID NO: 163885 - RNA, 87 nt, Homo sapiens
uacagccaaaaggccacuccuggcuccagccggaagaccugccguuacauuccuucccugccagaccguauccuggaugcgccugaa

SEQ ID NO: 163886 - RNA, 45 nt, Homo sapiens
ccagauggagguggccagcuuccuccugagcaaggagaaccagcc

SEQ ID NO: 163887 - RNA, 44 nt, Homo sapiens
guuugcuaggaguggucugaaccuuggaacuggauuugccuggg

SEQ ID NO: 163888 - RNA, 55 nt, Homo sapiens
gcgcaaagccaaggaagccgcaggcccggcccccucacccaugcgggccgccaac

SEQ ID NO: 163889 - RNA, 52 nt, Homo sapiens
cggagggcacggugagaggugguggggcugagccgagguggggccguggcca

SEQ ID NO: 163890 - RNA, 75 nt, Homo sapiens
acgagcuuggguugggaccuguugcaucacagggacaucaaggugacaauugacucaggacggagauguagguug

SEQ ID NO: 163891 - RNA, 43 nt, Homo sapiens
gcagcccccgccccuccaccgagagcacccuacagcaccagaa

SEQ ID NO: 163892 - RNA, 45 nt, Homo sapiens
aggucaucagcauuuugggcaccgugacaguggagaaccacaugu

SEQ ID NO: 163893 - RNA, 44 nt, Homo sapiens
caccagcaggaugaggagguuccccagcacagugagcacguaaa

SEQ ID NO: 163894 - RNA, 46 nt, Homo sapiens
auguuggacagcauuugggggacauugguggauguguagcaaaugu

SEQ ID NO: 163895 - RNA, 41 nt, Homo sapiens
aauagugaugauuauaacauuuccagccaccguugauaaau

SEQ ID NO: 163896 - RNA, 48 nt, Homo sapiens
uguccagaaucagaguucagguuucuauucacugcccugcauggcguc

SEQ ID NO: 163897 - RNA, 28 nt, Homo sapiens
cagggcaggggaaaagauggcuagaggc

SEQ ID NO: 163898 - RNA, 62 nt, Homo sapiens
uucugcuagaccucaguggguuggaagggauagggaggaccaacagcagugauggaggcugc

SEQ ID NO: 163899 - RNA, 42 nt, Homo sapiens
cuucgagaaggcgggggugcagcagccuguguaugccaccau

SEQ ID NO: 163900 - RNA, 42 nt, Homo sapiens
uugccuaauauuaacccuuuccaaucuucaucuguagccuca

SEQ ID NO: 163901 - RNA, 46 nt, Homo sapiens
aaguagugcuguccuccccauagaggcgcagaaacaugccuugccu

SEQ ID NO: 163902 - RNA, 89 nt, Homo sapiens
ccucacacgccuuagaaccugaauccaccccacccccaggaauguucugcauccugccacaggcggacugugcugcaggcacagacagg

SEQ ID NO: 163903 - RNA, 50 nt, Homo sapiens
auacacaacaaauccaggaccauccccaggcuuccugccuucucgcauag

SEQ ID NO: 163904 - RNA, 98 nt, Homo sapiens
ucuucaccuacuucaaaguuccugagacuaaaggccggaccuucgaugagaucgcuuccggcuuccggcaggggggagccagccaaagugacaagaca

SEQ ID NO: 163905 - RNA, 47 nt, Homo sapiens
ggccugcucccagcagcccuaaggaucucucaggagcacaggcagcu

SEQ ID NO: 163906 - RNA, 103 nt, Homo sapiens
gaugucagccgagccgggccuggggcuccuuucuccagccagcaaugauguccagaagaauauucaggacuuaacggcuccaggauuuuaacaaaagcaagac

SEQ ID NO: 163907 - RNA, 62 nt, Homo sapiens
ccuucuucacccagcuaaucuguagggcuggaccuauguccuaaggacacacuaaucgaacu

SEQ ID NO: 163908 - RNA, 44 nt, Homo sapiens
uccauuaggauuugccccuucccaucucuuccuacccaaccacu

SEQ ID NO: 163909 - RNA, 52 nt, Homo sapiens
cugcaaacucacugcucaagaagacauggagacuccugcccuguuguguaua

SEQ ID NO: 163910 - RNA, 44 nt, Homo sapiens
caacuuguaaauacaccaccucacuccuguuacuuaccuaaaca

SEQ ID NO: 163911 - RNA, 47 nt, Homo sapiens
ccggccuugguggcggguggcuggcgguuccguuaggucugagggag

SEQ ID NO: 163912 - RNA, 42 nt, Homo sapiens
gggcgccgccgcccugcgcgaccugagcuucuucgggggccu

SEQ ID NO: 163913 - RNA, 51 nt, Homo sapiens
acucgcucagcgaagagauggagcuggaguuccgcaagcggagccccuaca

SEQ ID NO: 163914 - RNA, 60 nt, Homo sapiens
gguugccacgucgccagcaggggcugccuggcccuuucugugugugugugggggcggggg

SEQ ID NO: 163915 - RNA, 42 nt, Homo sapiens
guugcugcagcacacaccuucuucgugggcaauccugagcac

SEQ ID NO: 163916 - RNA, 42 nt, Homo sapiens
gugaaggaggccgacuucaaggaucuugagacucaaccccau

SEQ ID NO: 163917 - RNA, 42 nt, Homo sapiens
cccggaaaguacucaguuucccugcccuggguaagccuugcc

SEQ ID NO: 163918 - RNA, 47 nt, Homo sapiens
uaggauucauggacuccagaagaagugauucccaagagauugcaaga

SEQ ID NO: 163919 - RNA, 48 nt, Homo sapiens
ggaaacagccguacgcaucucccaggagauugggaaccuuaugaagga

SEQ ID NO: 163920 - RNA, 46 nt, Homo sapiens
accucaggagauggcuaccggggucagaccuccccacauacuccca

SEQ ID NO: 163921 - RNA, 43 nt, Homo sapiens
cuguucgccaaagcuaugagaaugcuuucuuuagaaaggcuga

SEQ ID NO: 163922 - RNA, 45 nt, Homo sapiens
gugcggcgcaucauggaguccuacuuccgccuggauacgccccuc

SEQ ID NO: 163923 - RNA, 72 nt, Homo sapiens
uccccugccaagaagagagcuaugccgucucccgaggugcucccuugcuaacaugugugacauuggccccag

SEQ ID NO: 163924 - RNA, 41 nt, Homo sapiens
acuuuuauuucacugaacuggaugccaagaccgugacggug

SEQ ID NO: 163925 - RNA, 46 nt, Homo sapiens
ucaggcagugaaucgaagcccaaggaugagcuaugacagcguccag

SEQ ID NO: 163926 - RNA, 44 nt, Homo sapiens
gaauaaaugauucaugguuuuuuuuacuugguuuguucagacaa

SEQ ID NO: 163927 - RNA, 43 nt, Homo sapiens
accuucuuguccccgccggcaggcgccgccgaugugaggccgc

SEQ ID NO: 163928 - RNA, 42 nt, Homo sapiens
acaccccgggaggagccgcagcugccgcagccggccccaguc

SEQ ID NO: 163929 - RNA, 73 nt, Homo sapiens
gggugugaugguaacuaggccggcggcggcgguggggcugcucagggcucucugggguccgcucuccgcuccc

SEQ ID NO: 163930 - RNA, 29 nt, Homo sapiens
ugucccgccauucucgcuaguucgaucgg

SEQ ID NO: 163931 - RNA, 65 nt, Homo sapiens
aaguagaagugaucuuaauguuugucuuuaccauaauuauuaccucccuugggaauuuuauaucc

SEQ ID NO: 163932 - RNA, 48 nt, Homo sapiens
uugaaugccuauguaugucaggcccugugcugagccaugaggauuaaa

SEQ ID NO: 163933 - RNA, 57 nt, Homo sapiens
ugaugucauuuugauuuugaaauugaacacuagaacuguuaaucaccuuuaaaaaga

SEQ ID NO: 163934 - RNA, 47 nt, Homo sapiens
agaguauaguaguugacugucuugggagacgggaguggacuagaagg

SEQ ID NO: 163935 - RNA, 100 nt, Homo sapiens
aguugucuggggaagagugucccaggcagaaggaacagcuagcugguggaaaggccuggagacaaaagccucgggaaguguuaaaaauaaugagaaggcc

SEQ ID NO: 163936 - RNA, 39 nt, Homo sapiens
ccgucagcaugggccucauuuauaaaaugacuuuaaauc

SEQ ID NO: 163937 - RNA, 69 nt, Homo sapiens
uuagaagggccuuuagagguccaacuccuuuaagaaagaaagaaagaccaggcacgggaaaggccuccg

SEQ ID NO: 163938 - RNA, 42 nt, Homo sapiens
cuuaaaaagcaaagaccuguguauuugucucugagggcagca

SEQ ID NO: 163939 - RNA, 39 nt, Homo sapiens
gucucagauauggcaaagguaagggacagaaaagcagac

SEQ ID NO: 163940 - RNA, 45 nt, Homo sapiens
acuguuuucaagucagccuauacaaauauaucuuugaugccaugg

SEQ ID NO: 163941 - RNA, 46 nt, Homo sapiens
caauuaaguuucugaacauacuuuugcugauuccuacccugcaguc

SEQ ID NO: 163942 - RNA, 46 nt, Homo sapiens
aggguucucagacuugagugacucagaguuccuggaguuucuggac

SEQ ID NO: 163943 - RNA, 47 nt, Homo sapiens
ccuaugcuuuuauucagcauccuuuaucugugacuucaugcucugau

SEQ ID NO: 163944 - RNA, 43 nt, Homo sapiens
uuucacugcuucauaucucuguccacuuucugaaugagaacuu

SEQ ID NO: 163945 - RNA, 55 nt, Homo sapiens
aaaucuggucuuacuuucaugcuguuaugauuucaccuggugaaucaguguuuua

SEQ ID NO: 163946 - RNA, 48 nt, Homo sapiens
auacagaacucguuuuauuuguauacuuauauggaaucugcaugugag

SEQ ID NO: 163947 - RNA, 66 nt, Homo sapiens
aaucggguauuuugugguaaaugaaacuuaagaacauugcucuguguuagcucauuagggguauuc

SEQ ID NO: 163948 - RNA, 45 nt, Homo sapiens
agcuuuuugcugcauuugguuuuuaugauagccaacccacucuua

SEQ ID NO: 163949 - RNA, 63 nt, Homo sapiens
uagaagaguacucuguacuaaacaaagacauccaggaggauucuggcauggaaccccgcaaug

SEQ ID NO: 163950 - RNA, 46 nt, Homo sapiens
uuuccuuugacgaagguguauguuguggaagguaaggcuaccuggg

SEQ ID NO: 163951 - RNA, 42 nt, Homo sapiens
aaauucacaccucugccugagggaaagcuuaaagaagaaauu

SEQ ID NO: 163952 - RNA, 47 nt, Homo sapiens
agugugaguauuuuuaguuaucaggugacuuucuuccaugugguaag

SEQ ID NO: 163953 - RNA, 45 nt, Homo sapiens
agacuuucuggacgguucugugguuaugcuggcuuuggaccagaa

SEQ ID NO: 163954 - RNA, 42 nt, Homo sapiens
uaaaagauggauaguuuaaagugugggugagauugugggaaa

SEQ ID NO: 163955 - RNA, 44 nt, Homo sapiens
uauauaaaacaacaacucauguaccaccggaguuaggacagauc

SEQ ID NO: 163956 - RNA, 43 nt, Homo sapiens
uggacaguguaucuuugggagaccuuccuagcacagcggcagg

SEQ ID NO: 163957 - RNA, 48 nt, Homo sapiens
aagggacgagugucgguguggcaccggugcacgcugaaggagccggcg

SEQ ID NO: 163958 - RNA, 41 nt, Homo sapiens
uggggcuggggcuuuuccuguagaaacuaggagggacuagg

SEQ ID NO: 163959 - RNA, 46 nt, Homo sapiens
agaaacacuagcuguccugcauuguccauuuccuuuagccccaggc

SEQ ID NO: 163960 - RNA, 75 nt, Homo sapiens
agaaggauuaguugcaagcuggaucugagcucaggcuugggcaugaaggaaacugucucccaugugguuuggaag

SEQ ID NO: 163961 - RNA, 73 nt, Homo sapiens
cauaugguaacagaagauggcaaaggauaagauucagaucuuagaucuuuccaaguagggcauguuagaugau

SEQ ID NO: 163962 - RNA, 49 nt, Homo sapiens
ugucuaagcaccugaacagaggacugaaaccuccacugcaggcugguuu

SEQ ID NO: 163963 - RNA, 46 nt, Homo sapiens
ucacugaaauauaccucaggcugaaauuuggggugggauagcaggu

SEQ ID NO: 163964 - RNA, 42 nt, Homo sapiens
cuuugcccucccuucacaccaugggauaaaucuguaucaaga

SEQ ID NO: 163965 - RNA, 46 nt, Homo sapiens
agaaacuuggccugguauucgaugacguggugggcauuguggagau

SEQ ID NO: 163966 - RNA, 46 nt, Homo sapiens
aacagguggcuuacauauacaagugugucaacacgacauugcaaau

SEQ ID NO: 163967 - RNA, 46 nt, Homo sapiens
gagccacaaagaaggagccagcuguacuugaacuggagggcaagaa

SEQ ID NO: 163968 - RNA, 46 nt, Homo sapiens
auccagagucucuaucuuaguggaguuuggucugauuaggguaaua

SEQ ID NO: 163969 - RNA, 24 nt, Homo sapiens
cuaauugcauuugauucaucaguu

SEQ ID NO: 163970 - RNA, 47 nt, Homo sapiens
gguacauaaaauaugguucuguucaucuuuguagugaagaauaugca

SEQ ID NO: 163971 - RNA, 45 nt, Homo sapiens
gcuugcugguccuguggcagaguacuugaagaucaguaaagagau

SEQ ID NO: 163972 - RNA, 42 nt, Homo sapiens
gccuggaggcaguaucucauaccucugacaugcaccgugggu

SEQ ID NO: 163973 - RNA, 44 nt, Homo sapiens
aaaacgcaaguagucccggguugcuguagugugcuaaggaaagg

SEQ ID NO: 163974 - RNA, 58 nt, Homo sapiens
ugauaacuuagcugagacuuaaaugacaauaggaguucuagaggggcagaugggaaag

SEQ ID NO: 163975 - RNA, 39 nt, Homo sapiens
uugaaauuccuauacuuuaguuaauuauagacuuacagu

SEQ ID NO: 163976 - RNA, 38 nt, Homo sapiens
auagaauccauagaauuggaggcugauuaugggaauga

SEQ ID NO: 163977 - RNA, 49 nt, Homo sapiens
ugugacuggaauucuaguaauggcuggggaaguggaggaagugagaugu

SEQ ID NO: 163978 - RNA, 52 nt, Homo sapiens
agcuacauagggaauccggaaaagggauuuccaggcagagacuacuacaggu

SEQ ID NO: 163979 - RNA, 40 nt, Homo sapiens
uguggcaaagaauacaguucuucuggaguuuacaguggga

SEQ ID NO: 163980 - RNA, 50 nt, Homo sapiens
uguggggcucucucuucaagagaaaauccgggggcauaucagcacauuua

SEQ ID NO: 163981 - RNA, 81 nt, Homo sapiens
uaaauguugaugaguguuaggaaagaacagggugcucugaaaguauguaacaggggguucaggaaaagcccuucugaagaa

SEQ ID NO: 163982 - RNA, 138 nt, Homo sapiens
cugagugucuguggccauaggugccuuaaacuucuuucagccuccuuuuguucaucuuuuaaguggagaucucugcugaccccacaagauuaaauucagcguaacaaauuguguuuauucugugccagcauuuuccca

SEQ ID NO: 163983 - RNA, 43 nt, Homo sapiens
cggcugcugcucuuacuuugacaagccaggcuaacauugaagg

SEQ ID NO: 163984 - RNA, 53 nt, Homo sapiens
aaaauuauuccagagcuuuuguuguaacucuaacccuaacccagcgagaucag

SEQ ID NO: 163985 - RNA, 34 nt, Homo sapiens
gagauauuaauggauuugcaagaugaugggagga

SEQ ID NO: 163986 - RNA, 86 nt, Homo sapiens
cagaagugagaaacaacauuugugcuuuauuuucugagucuucugaaugcugguuguuucacaaauuauagaaauaaaaauauucu

SEQ ID NO: 163987 - RNA, 84 nt, Homo sapiens
cauucaguaguaagagucugaauucaaggagggacagguaauacaaucccuguuuuccaggauggaaaaacuggagcuacagaa

SEQ ID NO: 163988 - RNA, 41 nt, Homo sapiens
ggucuucuaacucauuuguagagucugauguauuucaggaa

SEQ ID NO: 163989 - RNA, 44 nt, Homo sapiens
acaaugauggccuggaaauacaaacuaccaacuauaugcuaaga

SEQ ID NO: 163990 - RNA, 96 nt, Homo sapiens
cguacauaggagcacaguuccuuuuguguuuguuuaaaccuacaagaggagaaacaaaugauuuuuggcagucugacuaguaagcaagcagaauau

SEQ ID NO: 163991 - RNA, 73 nt, Homo sapiens
agcaguguuuguaccaaaagacugucugaucaagggagauaugggaugcuugggggagggauaugaaaggaga

SEQ ID NO: 163992 - RNA, 365 nt, Homo sapiens
guauuugccacaacugacaaaggcaguccuuuuuuuuuuguuuuuuuuuuuugagauggagucuugcugugucacccaggcuggagugcagugacuccaucucggcccacugcaaccuaagccucccaaguucuagccauucuccugccucagccuccugaguagcugggacuacaggcgcccgccaccacgccuggcuaauuuuuuguauuuuuaguagagacaggguuucaccguguuagccaggauggucucaaucuccugaccucaggugauccgccagccucggccucucaaagugcugugauuacaagcgugagccacugcacccagccaaaggcagucuuuuagaaggacugagacuu

SEQ ID NO: 163993 - RNA, 71 nt, Homo sapiens
aaaguuaaaauaucuguguaaccacaacucaacugaauuucaauucaagaaacggaauaucacaagaaaua

SEQ ID NO: 163994 - RNA, 46 nt, Homo sapiens
guccucugucagcccacacagguuaaggucauaagaaaaaucgaag

SEQ ID NO: 163995 - RNA, 47 nt, Homo sapiens
aggguccgagaggcauucacaaaggugucccuuauggccaggucugg

SEQ ID NO: 163996 - RNA, 46 nt, Homo sapiens
uugcauuuagaaaaaguacacuugaacuuuuuagucgaauuggcag

SEQ ID NO: 163997 - RNA, 41 nt, Homo sapiens
agagcaacugcucugauauccuuaggaaaggcagcagcugg

SEQ ID NO: 163998 - RNA, 62 nt, Homo sapiens
uggauaugcuaaaauagacauauuagcccugguaccuguuugaacuucugacagggaagcaa

SEQ ID NO: 163999 - RNA, 45 nt, Homo sapiens
ccaucauuuaauagccccaggagaugggcacugagaaagugauug

SEQ ID NO: 164000 - RNA, 45 nt, Homo sapiens
cuaagccagguggacccagaaauggcugccaagcugcauccacau

SEQ ID NO: 164001 - RNA, 42 nt, Homo sapiens; identical to SEQ ID NO: 81877

SEQ ID NO: 164002 - RNA, 46 nt, Homo sapiens
auuugcauugaggagucugccuucugccuugaacagauggauacug

SEQ ID NO: 164003 - RNA, 52 nt, Homo sapiens
ggugggugaaauaccuguagcugcacucuuugcuaccuucagucucaucuuc

SEQ ID NO: 164004 - RNA, 45 nt, Homo sapiens
ccucugugaucgaaucaucauuggggaucgcgaaugggcagguag

SEQ ID NO: 164005 - RNA, 51 nt, Homo sapiens
ugagguaauuguuggcauagugguaguugcuaaaacugugauaaaaagaag

SEQ ID NO: 164006 - RNA, 27 nt, Homo sapiens
cauuucuguccuccacuuguauccuug

SEQ ID NO: 164007 - RNA, 26 nt, Homo sapiens
cuucucugugccagcacaggcagcgg

SEQ ID NO: 164008 - RNA, 44 nt, Homo sapiens
auuccacaggugacacuggggagagccucuuuuaugccaggcag

SEQ ID NO: 164009 - RNA, 24 nt, Homo sapiens
ggacccaggggccauucugaguca

SEQ ID NO: 164010 - RNA, 40 nt, Homo sapiens
acgcagggcucacaccaccuguccuggccuccgacccggg

SEQ ID NO: 164011 - RNA, 42 nt, Homo sapiens
ugggcguggaggacuucggccugggccuccugcuggccgcca

SEQ ID NO: 164012 - RNA, 45 nt, Homo sapiens
gguguuuggagaggucaccgaaggccuagaugucuugcggcaaau

SEQ ID NO: 164013 - RNA, 46 nt, Homo sapiens
agggaagcagcuuccaccgcaucaucccccaguucaugugccaggg

SEQ ID NO: 164014 - RNA, 46 nt, Homo sapiens
uccucagguguacauggacaucaagauugggaacaagccggcuggc

SEQ ID NO: 164015 - RNA, 46 nt, Homo sapiens
aggaagaagggucagagccucccaaagcagagacccaggaggugag

SEQ ID NO: 164016 - RNA, 46 nt, Homo sapiens
aggauuucaugaaguguuagaccaauuuacaauugagaagagaaau

SEQ ID NO: 164017 - RNA, 42 nt, Homo sapiens
aagcaccgaggauuugcuuuuguugaauuugaguuggcagag

SEQ ID NO: 164018 - RNA, 41 nt, Homo sapiens
ugaaacaggugaguuagugucucucacguucagaauccucu

SEQ ID NO: 164019 - RNA, 74 nt, Homo sapiens
gcaguaaucccaggacuagaugagagucugaaagaagggcgaagagaggaauauuuuucauaaguauggguggg

SEQ ID NO: 164020 - RNA, 78 nt, Homo sapiens
gcgcuguagugaggauggaucaugauaauaugggccuggcugcgggacaaaugacccauccaucuggagaagcgaggg

SEQ ID NO: 164021 - RNA, 44 nt, Homo sapiens
auuauggcccuucggauccucucguucauuuguuuuacaaacau

SEQ ID NO: 164022 - RNA, 46 nt, Homo sapiens
cgcgagcaagauggccaccaccaagcgcgucuuguacgugggugag

SEQ ID NO: 164023 - RNA, 59 nt, Homo sapiens
uuugugaauacauuuaguaaaaccuguaacaaaaucaagcuucucacugaguguacucu

SEQ ID NO: 164024 - RNA, 91 nt, Homo sapiens
uaaaugaugaauaaggaaagaagaucucugugccauugcuuuaagauucagauugucuuaagaugauaugaaaucccuuuuuauugcucag

SEQ ID NO: 164025 - RNA, 53 nt, Homo sapiens
gcuggggaacuagggugggggugggucaaccuuuagggaauaagaggucucag

SEQ ID NO: 164026 - RNA, 45 nt, Homo sapiens
gauucugcugggcccagcuaggggagcaggaauaggagcagagca

SEQ ID NO: 164027 - RNA, 56 nt, Homo sapiens
uauucuaggagacucagacccugcccuggagggacaguugaaguucagcuggaggg

SEQ ID NO: 164028 - RNA, 45 nt, Homo sapiens
augugaggcuugcaggaggagaggacagcgugugcaggggcuccg

SEQ ID NO: 164029 - RNA, 41 nt, Homo sapiens
aaagagagagagagagagagaggaagggagggagggaggga

SEQ ID NO: 164030 - RNA, 41 nt, Homo sapiens
ucugcuguguccagcuggacggucacaucugagccugcaca

SEQ ID NO: 164031 - RNA, 42 nt, Homo sapiens
gcggaugaaguugugaacgugacccaaacucacugcccccau

SEQ ID NO: 164032 - RNA, 25 nt, Homo sapiens
agccugcgaggagauguuacggcag

SEQ ID NO: 164033 - RNA, 48 nt, Homo sapiens
agcgcuggggaggggggcggccgaaaggggggcgguggucgggccgcg

SEQ ID NO: 164034 - RNA, 42 nt, Homo sapiens
cagcuuaaagggaccacgacccccaggaggauugaaggagac

SEQ ID NO: 164035 - RNA, 42 nt, Homo sapiens
ccuuuccuagacucuaggcagacguagaaaaggaauccuucg

SEQ ID NO: 164036 - RNA, 46 nt, Homo sapiens
cauaaaagcaugaucaggaauccgaaugccuacaagcuguaaggca

SEQ ID NO: 164037 - RNA, 34 nt, Homo sapiens
aacccuugaugaaaccuuuugaauccuaagaaag

SEQ ID NO: 164038 - RNA, 59 nt, Homo sapiens
accaagcccuuggagcugcugguuuagccuugcaccuggggaaaggauguauuuauuug

SEQ ID NO: 164039 - RNA, 62 nt, Homo sapiens
uauuuucauauaucagccaaaagcugaauggaaaaguuaagaacauuccuagguggccuuau

SEQ ID NO: 164040 - RNA, 88 nt, Homo sapiens
ggugaccaaaggcuccugaagcuagaaccagguuuggauaaagauugaagagccacaggccacucuucccucugagccauugggccua

SEQ ID NO: 164041 - RNA, 57 nt, Homo sapiens
caguccaaauggaagaauauugggaaauaaaccuccacuauccuuuauagccaggga

SEQ ID NO: 164042 - RNA, 94 nt, Homo sapiens
gauguugaccuguaguaauuuacagaagguagcaacacuggcuucauuuaacacacacacaaucugaaaaauacuaaacaugggaaggccaggg

SEQ ID NO: 164043 - RNA, 53 nt, Homo sapiens
caccucaaggacacccagccccaguuagguaacugauauuaagccccaccaga

SEQ ID NO: 164044 - RNA, 67 nt, Homo sapiens
aguggcucaugugaggggccuguaaaugggcgugaggugcugauguccuugccuugcuggaagaugu

SEQ ID NO: 164045 - RNA, 42 nt, Homo sapiens
gcgccgcgggcucccguaccacgaguaguagaaggcgugcag

SEQ ID NO: 164046 - RNA, 30 nt, Homo sapiens
agcgcggcggcugcaggagcgcacagucgg

SEQ ID NO: 164047 - RNA, 53 nt, Homo sapiens
aaaggcaaguagaaugcugaauggcgauaaguguuauggagaaaaauaaagca

SEQ ID NO: 164048 - RNA, 31 nt, Homo sapiens
cuucaugagaaagugauauuugagcagagau

SEQ ID NO: 164049 - RNA, 66 nt, Homo sapiens
acggugcugaagaacauagugucuuuccucuauuguggaccuaaagagguggggaagcaaggacaa

SEQ ID NO: 164050 - RNA, 41 nt, Homo sapiens
cugaauccuugacaaaagaaaaagugguuuugaugauuuaa

SEQ ID NO: 164051 - RNA, 45 nt, Homo sapiens
gcaacauuugaggggaugaguagcucaccuuggauuuugagaaaa

SEQ ID NO: 164052 - RNA, 43 nt, Homo sapiens
agagugaaaaauagucacugcauuacaaugcggcaagcagggc

SEQ ID NO: 164053 - RNA, 57 nt, Homo sapiens
gucuucggccgggcuugggaacauaaaaguuuguuucaccacguaagccggaccucg

SEQ ID NO: 164054 - RNA, 40 nt, Homo sapiens
cggagcaccaucaacccguccaaggccagcacaaacccag

SEQ ID NO: 164055 - RNA, 42 nt, Homo sapiens
gaacacucaggcugacagccuuggguccucuccaguugagag

SEQ ID NO: 164056 - RNA, 92 nt, Homo sapiens
cugccuuuuguagaucgagugcagggagcaggaggccaaaacaugagggaccgggccaccauccggcgccugaauauguauaggcaaaagga

SEQ ID NO: 164057 - RNA, 42 nt, Homo sapiens
aguguuaacuuuugguuaaggacauggguagcuggcggugaa

SEQ ID NO: 164058 - RNA, 66 nt, Homo sapiens
aguagagccaaauauuaaaugguuuggugaguauuauccccuguuacuuugcucuacaaaauauau

SEQ ID NO: 164059 - RNA, 40 nt, Homo sapiens
uaucuuugagucucuuauacuuucagugggauacuuccua

SEQ ID NO: 164060 - RNA, 26 nt, Homo sapiens
gcagucaucauuacaaaaauuucaag

SEQ ID NO: 164061 - RNA, 108 nt, Homo sapiens
gaaguuacuaaaggugacccggcguuugugagaauuuagacugauacuugucacaagcauguauguauaugauaugggccuuuuuuugguaugcauguaugagcagug

SEQ ID NO: 164062 - RNA, 46 nt, Homo sapiens
cccgacuugcagacuguggguaagaugguccucaaugacuggcaga

SEQ ID NO: 164063 - RNA, 53 nt, Homo sapiens
ggggccggauuccuuucuuugucaagccacccaaugcagagccacuuguggcc

SEQ ID NO: 164064 - RNA, 432 nt, Homo sapiens
cauuuuauuauuuuuuuaaauauauaaaaauauuuuuggggccgggcauggguggcucacgccuguaaucccagcacuuugggaggccgagguagguggaucacaaggucaggaguucaagaccagccugaccaauauggugaaacccugucucuacuaaaaauacaaaaauuaaccuagcaugauggcacgcuccuguagucccagcuacucgggaggcugaggcaagagaauugcuugaacccaggagacaaguugcagugagccgagaucgugccacugcacucuagccugggcaauagagggagacuccaucucaaaaaaauaaaaaaaaauuuuuuugagggugaagcacuguugggagccacugcuggcccauggcgaucacuccacccucucucauucuagagugccagugccauggccuugcua

SEQ ID NO: 164065 - RNA, 43 nt, Homo sapiens
ccuguaucuuuucuuaugcuuacgaaacagaaucauugcuaag

SEQ ID NO: 164066 - RNA, 45 nt, Homo sapiens
cgaaaaacagcccuggcccucaaaaaaccugugauccagugggaa

SEQ ID NO: 164067 - RNA, 52 nt, Homo sapiens
cuacccuccucaucuuuggaaguugucccagaagcagcccagaacaauccag

SEQ ID NO: 164068 - RNA, 92 nt, Homo sapiens
ucaguuuucuggggaugaccugguuccuguggaggugucagaucuugaggaagagcuugagagcuuuucugaugaagaggaggaggaacagg

SEQ ID NO: 164069 - RNA, 101 nt, Homo sapiens
aaugugggaaacgacaccaaagccguuauuaaagcacuggaugagaagauugccaaauaucagaaguuucuagacaaagccaaagccaaaaaguuuucagc

SEQ ID NO: 164070 - RNA, 32 nt, Homo sapiens
aacuguaaauuuuguaaaauucagcugccugc

SEQ ID NO: 164071 - RNA, 48 nt, Homo sapiens
gaauauccaagggacugagugaaaagauauuugcaaaaccugaagaac

SEQ ID NO: 164072 - RNA, 41 nt, Homo sapiens
auccagcaccuuccaaaaagggaaagaagcggaaggcacaa

SEQ ID NO: 164073 - RNA, 46 nt, Homo sapiens
ugcgcuacuaugaaacacacaacgugaaaaauaggaacaggaacaa

SEQ ID NO: 164074 - RNA, 46 nt, Homo sapiens
guaauguuuaaaagguuuuuauuaaauuauacaaaaacaggcaguu

SEQ ID NO: 164075 - RNA, 60 nt, Homo sapiens
gucuauuagauaucuucaugaagauaaugaggaagcagaagacuauaugguccuggaguu

SEQ ID NO: 164076 - RNA, 24 nt, Homo sapiens
agccagugucgguggauuauagug

SEQ ID NO: 164077 - RNA, 45 nt, Homo sapiens
ugguaggaaugagauggcacagggaggaaguagaaccacaggaug

SEQ ID NO: 164078 - RNA, 41 nt, Homo sapiens
aaagguuuuugaaggguugggaauuaagaguuauguuaccu

SEQ ID NO: 164079 - RNA, 87 nt, Homo sapiens
aguuaccuuuguucugaaaaggagggaauuauuuuuccuucuccuuucuggacuaaauagucucuuguuuuuagggcuguggaccug

SEQ ID NO: 164080 - RNA, 34 nt, Homo sapiens
ucuaaagaguauuguuaaucuaacugcccuuuaa

SEQ ID NO: 164081 - RNA, 44 nt, Homo sapiens
uguauuuuugggauaaaaaaauaaaauuuguaaauauagcccca

SEQ ID NO: 164082 - RNA, 46 nt, Homo sapiens
ugccggcuccacgcccacagucuuguggugaaucagcccguuguag

SEQ ID NO: 164083 - RNA, 27 nt, Homo sapiens
ggggaagagaagcagcuuugccuggaa

SEQ ID NO: 164084 - RNA, 29 nt, Homo sapiens
gggagcggugguuucuagcucaggcuuua

SEQ ID NO: 164085 - RNA, 45 nt, Homo sapiens
gcagagccggacgggccccucaacgucaacgucuucacgucggcg

SEQ ID NO: 164086 - RNA, 42 nt, Homo sapiens
ccgcuccagacgcugccgcuccgccucuucccgcgaccgagc

SEQ ID NO: 164087 - RNA, 40 nt, Homo sapiens
aacuuguuccuuccucugggaggugcccccucccccaggc

SEQ ID NO: 164088 - RNA, 38 nt, Homo sapiens
cacuguuccugagucauuuccugagugcaugaguugau

SEQ ID NO: 164089 - RNA, 93 nt, Homo sapiens
ccagugggagcugcuuagagcuaguggcauucuucauggcaggagggguguccgggggagugucggggaccagggcugacauuggugguggug

SEQ ID NO: 164090 - RNA, 39 nt, Homo sapiens
cuaagagcuccaagaggggcugugccuggggucugcaga

SEQ ID NO: 164091 - RNA, 39 nt, Homo sapiens
cgaugcguccggcacccggggugggggagggggcagcug

SEQ ID NO: 164092 - RNA, 46 nt, Homo sapiens
gucgaggcagguggcccgcgagucucggaggugccggucgcccggg

SEQ ID NO: 164093 - RNA, 35 nt, Homo sapiens
cgccgagcuaacccguggcuaggcgaguggggcgg

SEQ ID NO: 164094 - RNA, 50 nt, Homo sapiens
ucaauuucuuuaucuauaaaauggggauaguaaugucuaccuaauauuaa

SEQ ID NO: 164095 - RNA, 48 nt, Homo sapiens
cuauggugcccuggucacccagcuauguaaggacuaugaaaaugauga

SEQ ID NO: 164096 - RNA, 79 nt, Homo sapiens
uuaacauuggaguccggcugauugaagauuucuuggcucggucaaauguugggaggugccaugacuuucgggaaacugc

SEQ ID NO: 164097 - RNA, 54 nt, Homo sapiens
gugugacgaggcgcuauuaaagaguuuuaaacauggaaauuacucgaucugaug

SEQ ID NO: 164098 - RNA, 41 nt, Homo sapiens
agcccagagagaucaagugacugauccaaagucccacagug

SEQ ID NO: 164099 - RNA, 45 nt, Homo sapiens
cagaaaguccggcggguuuuagggacguuaaccaugcuugcguga

SEQ ID NO: 164100 - RNA, 42 nt, Homo sapiens
ccaucauaugcuggugacucucagaucugucuucagcccaga

SEQ ID NO: 164101 - RNA, 42 nt, Homo sapiens
cuuccgccaccauggaguaccucaucgguauccaaggccccg

SEQ ID NO: 164102 - RNA, 39 nt, Homo sapiens
gggcaggccggcuuccaucucucagauccucccugguac

SEQ ID NO: 164103 - RNA, 65 nt, Homo sapiens
uccugggucagugcucugcucuggccuucgcuaaaugcuucuugcuuggugagaguugccuaaag

SEQ ID NO: 164104 - RNA, 53 nt, Homo sapiens
guuuaagcgccugcccagagccuggcucucuagauccccgaaucucugauaag

SEQ ID NO: 164105 - RNA, 49 nt, Homo sapiens
auuaacuacuuaaauauaaggaaaaccuggcagccauugcucuggaaaa

SEQ ID NO: 164106 - RNA, 42 nt, Homo sapiens
auuugccuuaugaguuuguauaaguuauuuugcagugcccag

SEQ ID NO: 164107 - RNA, 51 nt, Homo sapiens
auaguauaguauaguauaguauaguauaguauaguauauuauaguacuuag

SEQ ID NO: 164108 - RNA, 129 nt, Homo sapiens
uuuguagaaguuuuguuuguaagccaguccuuccaaaggagugaauuuguuuugagaguaaauuuguccauuauuuugaauacuaaggucuuugacaagcaagugauuuuaacauuaagucaugucuag

SEQ ID NO: 164109 - RNA, 61 nt, Homo sapiens
uaguuaguaguagguugguuuuuaaauuaaugaguucaagagcaaauccuaagaguaauaa

SEQ ID NO: 164110 - RNA, 43 nt, Homo sapiens
gagcuuguuuagaguaggcaagaaugcugaaaaaauaguaacc

SEQ ID NO: 164111 - RNA, 47 nt, Homo sapiens
gauuauucagcacuauuugaaaaaugaaaagugaaagugaaagugag

SEQ ID NO: 164112 - RNA, 46 nt, Homo sapiens
gccauuggcuggauuccuucaguuucuucugucguucuguuccuug

SEQ ID NO: 164113 - RNA, 38 nt, Homo sapiens
uuaguuuuucugucacccagaaguuccugugguguuca

SEQ ID NO: 164114 - RNA, 47 nt, Homo sapiens
ucuuuucaacuuauuauuucuacuguuuacuugcuaagcauuuacaa

SEQ ID NO: 164115 - RNA, 45 nt, Homo sapiens
acaaccagacuugaauuuuuauuuauuuauuuauuuuuuuaggga

SEQ ID NO: 164116 - RNA, 46 nt, Homo sapiens
cuuucccauucccuaaaaaaauaaauaaauaaauaaaaauucaagu

SEQ ID NO: 164117 - RNA, 45 nt, Homo sapiens
guaagcuggcucugucugucaagaugcccaggcuguguggcagca

SEQ ID NO: 164118 - RNA, 64 nt, Homo sapiens
uacuuuugucucccagccuuaacaggacauaaaguaaaaacuggaaacaaauggcuacauuuag

SEQ ID NO: 164119 - RNA, 58 nt, Homo sapiens
cuaagcaugcccaugaauaucuaaucuaugaauucugaacaucaaagcugauucaucu

SEQ ID NO: 164120 - RNA, 30 nt, Homo sapiens
ugcuaguaugcaaaauagugcauucugaaa

SEQ ID NO: 164121 - RNA, 42 nt, Homo sapiens
aguaauacagcugauuugcccaccaaaauaacuacuagccac

SEQ ID NO: 164122 - RNA, 48 nt, Homo sapiens
uuacugagaacacccaauacccagauaaaugacuguaucaggauuuca

SEQ ID NO: 164123 - RNA, 42 nt, Homo sapiens
ugaagaugaugagguuccaguggggguggagauggcagagaa

SEQ ID NO: 164124 - RNA, 45 nt, Homo sapiens
ucuuuuucaccuaaugucuguguccuguuugcuuaguuuuauaua

SEQ ID NO: 164125 - RNA, 44 nt, Homo sapiens
uuccuuuccuauuugaaugcguuauauuuauuuuucuugccugg

SEQ ID NO: 164126 - RNA, 45 nt, Homo sapiens
uuaggaaguacucaagaccaugcacucucucaagaauccucagag

SEQ ID NO: 164127 - RNA, 57 nt, Homo sapiens
agaacuggguucaguggaaaaaugccaaggaagagcagggggaucuaaaauguggag

SEQ ID NO: 164128 - RNA, 47 nt, Homo sapiens
aaacuaaauuuuauguucuguaaauuuuuggaauucuuacagggacg

SEQ ID NO: 164129 - RNA, 46 nt, Homo sapiens
auuauuuaguuccugcugcuuucaaaacucuguaacagccagaguc

SEQ ID NO: 164130 - RNA, 30 nt, Homo sapiens
guccacugaaagcuuuuuauuuuaaaagau

SEQ ID NO: 164131 - RNA, 46 nt, Homo sapiens
uggugaucuugaaucagaggcaguaucuacuccacauagcugggag

SEQ ID NO: 164132 - RNA, 45 nt, Homo sapiens
caauguaguaucauuggcaagugccccugcugcucagccuacagu

SEQ ID NO: 164133 - RNA, 46 nt, Homo sapiens
uuguaaaaccucagcaauuccucaguaucaccuagccaugucagau

SEQ ID NO: 164134 - RNA, 37 nt, Homo sapiens
acaaucauaaaaguuugaaaaucacugauuucaaaua

SEQ ID NO: 164135 - RNA, 35 nt, Homo sapiens
uuuuuacuucaauccauguuaaagaaauuagaaga

SEQ ID NO: 164136 - RNA, 46 nt, Homo sapiens
uagaagaaaaaaguuauaucagaugcugcaaucauuuugaagugca

SEQ ID NO: 164137 - RNA, 46 nt, Homo sapiens
augaaugauacaugauuccaaguuugagaucugugaguaauaagag

SEQ ID NO: 164138 - RNA, 39 nt, Homo sapiens
uuaacgagcuauaugaaacuuuuccugaguaguaauuaa

SEQ ID NO: 164139 - RNA, 46 nt, Homo sapiens; identical to SEQ ID NO: 82087

SEQ ID NO: 164140 - RNA, 42 nt, Homo sapiens
uuuuaauuugcuuaauauuuguuuaaggucaucaucggagac

SEQ ID NO: 164141 - RNA, 44 nt, Homo sapiens
ucuaacaaugcuaggaaauguaugguagaaagaacaaaccagua

SEQ ID NO: 164142 - RNA, 63 nt, Homo sapiens
ugggagagauuaguauauauuaguaguuuuaaacaguaaauagucuuuuauucuagguuggau

SEQ ID NO: 164143 - RNA, 45 nt, Homo sapiens
gagagauaaguaauaaaguugacagaauuuguccagggggaaauc

SEQ ID NO: 164144 - RNA, 55 nt, Homo sapiens
aaauucuagguaggccugccugaugucuuguuuuuauauuugugggcagucggaa

SEQ ID NO: 164145 - RNA, 48 nt, Homo sapiens
aagugggaucguuggcauguccugauuuaggagaaagauuuuggcuac

SEQ ID NO: 164146 - RNA, 39 nt, Homo sapiens
aucuuuaguacaucagagucuggaaguuaacuggggaga

SEQ ID NO: 164147 - RNA, 43 nt, Homo sapiens
uggggccgcgauucugauugaggcccaugccgggcggcggaga

SEQ ID NO: 164148 - RNA, 39 nt, Homo sapiens
gccgacaaaauggaagcccagcgcgggggcgggggcgag

SEQ ID NO: 164149 - RNA, 48 nt, Homo sapiens
ucuugcugcuggcuuagaagcaaauucaacaaugccuuucccuguaga

SEQ ID NO: 164150 - RNA, 46 nt, Homo sapiens
aucaucuaguuguucaagugguuccacaaugacuggacgaggaguu

SEQ ID NO: 164151 - RNA, 42 nt, Homo sapiens
aaguguuauccacaucuuuuagaauucaaugugaagaaaccu

SEQ ID NO: 164152 - RNA, 51 nt, Homo sapiens
aguauagacacauuuagacaagucccauaacuugaacuauucacauuagau

SEQ ID NO: 164153 - RNA, 46 nt, Homo sapiens
uuuauuucuaacacccaaucacuaaaccacggcagcaagcacuggc

SEQ ID NO: 164154 - RNA, 47 nt, Homo sapiens
acaaauuaaagcuaguaagaacacacuaacgucacaaguuucucauu

SEQ ID NO: 164155 - RNA, 44 nt, Homo sapiens
aaaggcccagaccaacauccuggcucucuaaaaccuguccaaaa

SEQ ID NO: 164156 - RNA, 49 nt, Homo sapiens
aagccagcuucagcuuugauaaucucacccaccuaccccauuuaaggag

SEQ ID NO: 164157 - RNA, 45 nt, Homo sapiens
cuguugagcaggaguugguaaauaaacuaauggagccugaaagac

SEQ ID NO: 164158 - RNA, 46 nt, Homo sapiens
uacuucaacagaagaacaauauaaaauuaauaucuauuaccaagga

SEQ ID NO: 164159 - RNA, 45 nt, Homo sapiens
aaaccuucucuucagaaaagaagaaaaauucagaaaucaguagau

SEQ ID NO: 164160 - RNA, 90 nt, Homo sapiens
guuucgccgaugaauugagucauuugcugacauugguuuccaaauuugaauuugucuuuuguuugaaauuccuguaucgagugcugagug

SEQ ID NO: 164161 - RNA, 46 nt, Homo sapiens
uccaugaucguacauuacuaucugugauugacagucuuccagagau

SEQ ID NO: 164162 - RNA, 46 nt, Homo sapiens
uugauacugaggagaugacugggacccacuuacauaggacuaucaa

SEQ ID NO: 164163 - RNA, 45 nt, Homo sapiens
uucacaaguugacuucuauaacaguacacaaauucaaagugauau

SEQ ID NO: 164164 - RNA, 49 nt, Homo sapiens
auaaaggcaauuuuuuagaauuguuagaaaugagagcaaaagauaaagg

SEQ ID NO: 164165 - RNA, 46 nt, Homo sapiens
uucuaauuggaaaaaaacccuggaaaaauucagaaagcaugaaaaa

SEQ ID NO: 164166 - RNA, 45 nt, Homo sapiens
acuaugucacccaaaauguacauccaaaguacaaaaaguuaaagg

SEQ ID NO: 164167 - RNA, 32 nt, Homo sapiens
uuagagacauuuuaaauccaaaggaugugauu

SEQ ID NO: 164168 - RNA, 74 nt, Homo sapiens
uuccuucuaagagaacuuguucaaacugcucaaaguauauaauucuaaauuaugcccccuuuuauuucccuacc

SEQ ID NO: 164169 - RNA, 89 nt, Homo sapiens
uuuuuuuuuuuuuugaaacacaaacgcuuuauuuaaaggagcaucucaguuacguguggcggacaaaaaaaaggagcagauugugacag

SEQ ID NO: 164170 - RNA, 41 nt, Homo sapiens
cgugcucacccuuuuggagucagagcgagaagcccggaggu

SEQ ID NO: 164171 - RNA, 42 nt, Homo sapiens; identical to SEQ ID NO: 153583

SEQ ID NO: 164172 - RNA, 50 nt, Homo sapiens
agcuugauaggcugcacacggcugguguccaugauggcggcgcggcggcg

SEQ ID NO: 164173 - RNA, 40 nt, Homo sapiens
aguagccagcugguugugggggaagucguggugcugggga

SEQ ID NO: 164174 - RNA, 63 nt, Homo sapiens
ugaaugugagugcgugucgcugugugucugugccgagugugucacugugugggucugugggcg

SEQ ID NO: 164175 - RNA, 44 nt, Homo sapiens
uggggcuacuucugcacccagcugccaaugccuaaaagaguggg

SEQ ID NO: 164176 - RNA, 49 nt, Homo sapiens; identical to SEQ ID NO: 82155

SEQ ID NO: 164177 - RNA, 44 nt, Homo sapiens
ccaggggaggggcuggauaucucugcaagaucugggacuccagu

SEQ ID NO: 164178 - RNA, 24 nt, Homo sapiens
augcuauggugcucagggcuguau

SEQ ID NO: 164179 - RNA, 45 nt, Homo sapiens
cuguuaauuugugaaugaacagucuuggggcaguguauagcugug

SEQ ID NO: 164180 - RNA, 51 nt, Homo sapiens
aauagagguaugagacccaagaggagcuggcaauugugguguccugggauu

SEQ ID NO: 164181 - RNA, 57 nt, Homo sapiens
uuguucuagacacucaaaaugcugcagcacacaaacagacacagucccugcccuucu

SEQ ID NO: 164182 - RNA, 42 nt, Homo sapiens
cauacccaggguugcagcucaacuuuaguuggagcgagugau

SEQ ID NO: 164183 - RNA, 45 nt, Homo sapiens
gacaaucuaggagucacacaaauuuaaaaugguaacaauauaaga

SEQ ID NO: 164184 - RNA, 54 nt, Homo sapiens
gagaaagcuuccccgaggaagcaacaacugggcugagaucugaaggguguguag

SEQ ID NO: 164185 - RNA, 50 nt, Homo sapiens
agggaucaugggacugacaaaagacuguccuggcugccgcagagaaagca

SEQ ID NO: 164186 - RNA, 46 nt, Homo sapiens
cuuccucacuuguuuuucccucccauugauuuuguuuaguaaugga

SEQ ID NO: 164187 - RNA, 41 nt, Homo sapiens
ccaagacaagagcaaggagaacauggauugaugccagaggg

SEQ ID NO: 164188 - RNA, 43 nt, Homo sapiens
ugucugacugugccucuuccacuacuauuaaucacgcuugcaa

SEQ ID NO: 164189 - RNA, 48 nt, Homo sapiens
aucugacguagccuaacauuuugguaccucuuuccagcacagccauuu

SEQ ID NO: 164190 - RNA, 48 nt, Homo sapiens
cuccuguuucuaugacauggcauuuuccugacuucccuccuaccccuc

SEQ ID NO: 164191 - RNA, 59 nt, Homo sapiens
acucccacauguccgccuccagccccgaucuccccacugaaucccagaaccaaacaucc

SEQ ID NO: 164192 - RNA, 45 nt, Homo sapiens
cuaugccaagcucaaggugcucaaccccgacccuaccaccuuucc

SEQ ID NO: 164193 - RNA, 51 nt, Homo sapiens
gucauccucgacuccucccgcccccucaucccccacgucuaaucaggcuca

SEQ ID NO: 164194 - RNA, 42 nt, Homo sapiens; identical to SEQ ID NO: 82177

SEQ ID NO: 164195 - RNA, 46 nt, Homo sapiens
caugcucagcuuaggacuuaaaaucagagggucugccuguggagag

SEQ ID NO: 164196 - RNA, 81 nt, Homo sapiens
ccacucuauuggcgugcagguggaagaggacaagagguaaagucacggugggagugcccaggcuucgcugggagacaggag

SEQ ID NO: 164197 - RNA, 126 nt, Homo sapiens
ggcugauagcaguggauacagagagaagugggccaauuugagcagcauuuuggagugaaagucagggaagggcagggacaggcagagaacguggccuuccuugcucuuguguaagugcuuggugag

SEQ ID NO: 164198 - RNA, 45 nt, Homo sapiens
auucaaaguagccauguguccagcauaaaauggugggguucuguu

SEQ ID NO: 164199 - RNA, 46 nt, Homo sapiens
uggagagaaguaggcaggcaggcagggagagaaggccugggcagca

SEQ ID NO: 164200 - RNA, 39 nt, Homo sapiens
ggcccacaaucccuucugaccauguagggguggagguag

SEQ ID NO: 164201 - RNA, 41 nt, Homo sapiens
ccuugaucuucuguuuaucccccaccucccacaucuccuga

SEQ ID NO: 164202 - RNA, 24 nt, Homo sapiens
cacacaacuucuccugucccagaa

SEQ ID NO: 164203 - RNA, 52 nt, Homo sapiens
cugacacagaguaagugguuauaagugucgaauaaaggaaugaauugacuua

SEQ ID NO: 164204 - RNA, 48 nt, Homo sapiens
uaugcuuuacaugaggaaaaggaacgacuuuucauauugugaaaccag

SEQ ID NO: 164205 - RNA, 36 nt, Homo sapiens
gaaauguuggcagacuagguccuggggucaacaaua

SEQ ID NO: 164206 - RNA, 42 nt, Homo sapiens
gaaugguucaucaggggaaaggacccccagcccguggaggag

SEQ ID NO: 164207 - RNA, 29 nt, Homo sapiens
ccagggacuuggguggaugcgcugauaga

SEQ ID NO: 164208 - RNA, 46 nt, Homo sapiens
ggccacacaaaaagugaugcucgcccugggcuagccucagcagacc

SEQ ID NO: 164209 - RNA, 73 nt, Homo sapiens
caugccccucgcugcuggucauccugcacguggccuaccgugaggagcgggagcgccggcaccgccagaaaca

SEQ ID NO: 164210 - RNA, 42 nt, Homo sapiens
gcagcgaggggcaugugacgaagaugagcugcagggcccaga

SEQ ID NO: 164211 - RNA, 45 nt, Homo sapiens
gucaaaguccuucugcucauccccccacacgcgcucugcagccac

SEQ ID NO: 164212 - RNA, 46 nt, Homo sapiens
ugcugguauacgugguggcugcagagcgcguguggggggaugagca

SEQ ID NO: 164213 - RNA, 33 nt, Homo sapiens
cagguaggcacggcccccaccaggcgccaugga

SEQ ID NO: 164214 - RNA, 34 nt, Homo sapiens
gcauuccaggcagaaggaaucaguaaaaagcccc

SEQ ID NO: 164215 - RNA, 46 nt, Homo sapiens
guuuucagcaaggcagcuuggagggaggggacaggagggugggcag

SEQ ID NO: 164216 - RNA, 70 nt, Homo sapiens
cucugcuccuucuaagcccucguggugggggaagggagugggauagcauggaacacggaguuccaccugg

SEQ ID NO: 164217 - RNA, 87 nt, Homo sapiens
agugugucagguggaagcagccgucagggucccucucugcucucuguccggacagacagggcuccaaccuucacuucaguucuugug

SEQ ID NO: 164218 - RNA, 41 nt, Homo sapiens
uugggugcugucugcccagucccuccugacacaccccaggg

SEQ ID NO: 164219 - RNA, 49 nt, Homo sapiens
cauaaaaauugugcccccuagagggcgagggccacgggaagggggauca

SEQ ID NO: 164220 - RNA, 57 nt, Homo sapiens
aaacagagauggagagguaaguaacuuaucuaacuuuauauaacuacgugauagagc

SEQ ID NO: 164221 - RNA, 88 nt, Homo sapiens
ugccuagggagguccagaccugggugcaggcacgccacccugagaguggugaggaggcuguggccuugguggaggauuggcaccgaga

SEQ ID NO: 164222 - RNA, 41 nt, Homo sapiens
acucugggagaaggaccguggcucugucucuggcccagagg

SEQ ID NO: 164223 - RNA, 41 nt, Homo sapiens
ccucuugaaggacucaccguagaugcaggaagacauuggau

SEQ ID NO: 164224 - RNA, 42 nt, Homo sapiens
uagaaagugguaagugucacagagacauggaaauaaaagaga

SEQ ID NO: 164225 - RNA, 35 nt, Homo sapiens
aucagggaggcaauucuuggagggcaggacaugaa

SEQ ID NO: 164226 - RNA, 44 nt, Homo sapiens
gccggagaugggaagggucauacaggggucggggaugaggaggc

SEQ ID NO: 164227 - RNA, 37 nt, Homo sapiens
aggugagaggggagaaagaagcuuauaugugggggug

SEQ ID NO: 164228 - RNA, 42 nt, Homo sapiens
uugugaagugggugucucggugggugaguccggguggcgggg

SEQ ID NO: 164229 - RNA, 45 nt, Homo sapiens
cauguacagagcccagagaagcccccuacauccccccgggaaaaa

SEQ ID NO: 164230 - RNA, 85 nt, Homo sapiens
uuuguuuuggaaauaacagaaaagauauuuauuggccaggaaguuggugcugcuaagaccgagaaauuuaaagaaucggacagau

SEQ ID NO: 164231 - RNA, 46 nt, Homo sapiens
auccuggcugcgagaaggcuuucacucagcucuccaaccuccaggu

SEQ ID NO: 164232 - RNA, 58 nt, Homo sapiens
aagagguggcagaagcaagauuugagugcagagcaccaagaagcagcccaguucagaa

SEQ ID NO: 164233 - RNA, 50 nt, Homo sapiens
caggaaaccaaacaaacaacaaaagaggauucuaucaacauuuggaagac

SEQ ID NO: 164234 - RNA, 52 nt, Homo sapiens
cuguugacuagaacaaaugauucugcuuaguuaauuguaauaaucaacaaua

SEQ ID NO: 164235 - RNA, 45 nt, Homo sapiens
agccaugguuacaaauuugauuuacccaauuauauccuguuagga

SEQ ID NO: 164236 - RNA, 39 nt, Homo sapiens
aagccaaagauuaccaagauugcagucccucuguucaga

SEQ ID NO: 164237 - RNA, 52 nt, Homo sapiens
gcacgggcacggguaccagcaccccguccacacccaccaccaccagccagag

SEQ ID NO: 164238 - RNA, 90 nt, Homo sapiens
ccuucuccaaggggccagguggcagggaggccauggaggacaggacuggaaggugggccauaagcuuugaccucagggaggccacggugg

SEQ ID NO: 164239 - RNA, 66 nt, Homo sapiens
ugacauuccucccugggcugccuguccucuuucuguccauuugucuaggucugaaagucuccaggu

SEQ ID NO: 164240 - RNA, 45 nt, Homo sapiens
aauauauguuauauuucaaaacacucacagcaucuaccucauggg

SEQ ID NO: 164241 - RNA, 42 nt, Homo sapiens
ggaagcugaggcacagagguauuuagguaucauggagcaguu

SEQ ID NO: 164242 - RNA, 41 nt, Homo sapiens
ggggauuaugaaccucauuauaaggaaaccaagacucagag

SEQ ID NO: 164243 - RNA, 65 nt, Homo sapiens
aaucucgcccaagcccuggggugacccuuggacccugaggcaagugagcuuggcccuuugcaguu

SEQ ID NO: 164244 - RNA, 48 nt, Homo sapiens
ccugccuacacuguggcaaauggcacugauaacuugguuguccagagu

SEQ ID NO: 164245 - RNA, 44 nt, Homo sapiens
gagcaacuggaguaacuggagcacagcaagugcagugaugggag

SEQ ID NO: 164246 - RNA, 53 nt, Homo sapiens
auuuuagcugagaucuaaaggagaaauaggaauuugcaaauuuggggccucag

SEQ ID NO: 164247 - RNA, 40 nt, Homo sapiens
uucugcuagaccagccuggcagggaggguaggugccaggu

SEQ ID NO: 164248 - RNA, 45 nt, Homo sapiens
ggccaaauccaguccaccaccuaauuuuaugaaguuuuauugacu

SEQ ID NO: 164249 - RNA, 28 nt, Homo sapiens
gccacaucugccccugggaagcaagcug

SEQ ID NO: 164250 - RNA, 44 nt, Homo sapiens
gucugcugggugugggaguucccucugacguccucguccucauc

SEQ ID NO: 164251 - RNA, 47 nt, Homo sapiens
uuuucuguacacgaucucauuuuauucucacaacagcccugugaggu

SEQ ID NO: 164252 - RNA, 23 nt, Homo sapiens
agguagauaaccagggaaagggc

SEQ ID NO: 164253 - RNA, 77 nt, Homo sapiens
cuuguuuacaaaaaaaaaaaaaaagaugaaauaaagaaaauauuuaguauuuuagauggaaaaugcuguagagagaa

SEQ ID NO: 164254 - RNA, 55 nt, Homo sapiens
acacaggaguggggaggguauucugcaggacauggugggaacaaagguuugaagg

SEQ ID NO: 164255 - RNA, 41 nt, Homo sapiens
uggcugcugggcuggcggggcgcaggccgcgggacccgagc

SEQ ID NO: 164256 - RNA, 38 nt, Homo sapiens
gccaugugagcuugguauugcuauccuguuuucaagau

SEQ ID NO: 164257 - RNA, 58 nt, Homo sapiens
ggugggaauggaggguaggagagacggcugccuuguuccuugggucagauugugcuaa

SEQ ID NO: 164258 - RNA, 45 nt, Homo sapiens
aagcaggcaugaugucacagacaccaacauaguauguucccagaa

SEQ ID NO: 164259 - RNA, 47 nt, Homo sapiens
cuggaagguuacucuuuugcuuaaaauccuucaaagaaaaagaaaaa

SEQ ID NO: 164260 - RNA, 52 nt, Homo sapiens
gugucauuuucucuguaaaauauacuuaaccucucuaggcagcucguugccu

SEQ ID NO: 164261 - RNA, 31 nt, Homo sapiens
ugcagugguagcagaacucagucuggcaacc

SEQ ID NO: 164262 - RNA, 44 nt, Homo sapiens
ugagaucucuuucauacaaagccaacagaauucacagccacaca

SEQ ID NO: 164263 - RNA, 45 nt, Homo sapiens
ugccaaugaccauggcaggaauggcaaugccagcaaugagagaaa

SEQ ID NO: 164264 - RNA, 42 nt, Homo sapiens
aagaaagcacagcagugaauaugccagcaugugggggcggga

SEQ ID NO: 164265 - RNA, 53 nt, Homo sapiens
guugcaauagccaagaaagacaaaaaaaaaaaaaaaaaaaagaaaaaauacau

SEQ ID NO: 164266 - RNA, 40 nt, Homo sapiens
aagcagccucuacgcagcugguuucacaaaggggggcggu

SEQ ID NO: 164267 - RNA, 45 nt, Homo sapiens
gcacccuggcuagggggugcuggcucgauggcaucgccaguggcc

SEQ ID NO: 164268 - RNA, 42 nt, Homo sapiens
ugcggccuucccuuccugagcagugcccucgucgcugcaggc

SEQ ID NO: 164269 - RNA, 46 nt, Homo sapiens
guguagggccacucuccggccccgagggaguggauggcucuguagc

SEQ ID NO: 164270 - RNA, 69 nt, Homo sapiens
cagugaccucacaaggacagcacaguuuuugcagcuuagagaucacccaccugccccuaccuagcuacu

SEQ ID NO: 164271 - RNA, 46 nt, Homo sapiens
uggccuuaagaggagaaccagauggcugaugggagaauccacagga

SEQ ID NO: 164272 - RNA, 48 nt, Homo sapiens
ggcucagggauuuggggaguaggguaaacaaaaccuacuuggaaaaga

SEQ ID NO: 164273 - RNA, 52 nt, Homo sapiens
cuugaguaagacauuuauaaaaaccuagacggggcaguguccuccccagccc

SEQ ID NO: 164274 - RNA, 61 nt, Homo sapiens
auuuacaacagugggagaaaaaaagacaagaaguuguuucacauuacagaccuccccccac

SEQ ID NO: 164275 - RNA, 45 nt, Homo sapiens
ugaaugagggguggaaccgagggaagaaggugcgucggaguggca

SEQ ID NO: 164276 - RNA, 52 nt, Homo sapiens
gccccucuuaaacagguagagagcugugagccccagccccaccugacuccag

SEQ ID NO: 164277 - RNA, 50 nt, Homo sapiens
gccuccuuuagcaucuccugggccugcuggagcuuggcauccaccagcug

SEQ ID NO: 164278 - RNA, 156 nt, Homo sapiens
uuguuuggcucuuaccauuuuagcugcuaacuaugaaaaaaucuagaguucucacauaacucuagauuucuggcuuuucuuuauuuaaaaaaaaaaaaaaaaaaaaaaagccugacugcacccagccuguaguuuugccugcucucaguuggcuag

SEQ ID NO: 164279 - RNA, 42 nt, Homo sapiens
ggguuccuucucuccauugacuacuggaguugguucaggcuc

SEQ ID NO: 164280 - RNA, 46 nt, Homo sapiens
uccaguuggcggcucagcuccucagagacaucacgaagggccccag

SEQ ID NO: 164281 - RNA, 49 nt, Homo sapiens
uuccgaggagccuggcugcugccgggaccuucugcuucuacugcaggag

SEQ ID NO: 164282 - RNA, 42 nt, Homo sapiens
cuugguucuucauugugaugagcgaugcugggucaggagaag

SEQ ID NO: 164283 - RNA, 67 nt, Homo sapiens
uggucuuggcgggucaggagagcccgacgugccggggcaggcuuucggggcgcagcucccacagcgg

SEQ ID NO: 164284 - RNA, 50 nt, Homo sapiens
gcggggaguuggcgugauuuccccacaggccgagaacaucccggcccgca

SEQ ID NO: 164285 - RNA, 65 nt, Homo sapiens
ccugaacuuuaggucuauaagcagaagggcauggauuucaccugagccagaaggagauguguagc

SEQ ID NO: 164286 - RNA, 42 nt, Homo sapiens
cuaaggcaaugcacuaccguaauucaaacagaaagaagaggc

SEQ ID NO: 164287 - RNA, 46 nt, Homo sapiens
gcugaccugcuuuaugaagguuccagagcugaagguuggucccagg

SEQ ID NO: 164288 - RNA, 175 nt, Homo sapiens
ggagagagaaccaccuaagggaugaacaaccauggucugcacauuucccuuucaagaaagaccaguacucucuucuugggaagacuauuugauauacugaaacaagagguauuuuuccaaucauacauuaaauuuuuuuauuaaguaccuauggugugccacacaguucuaggua

SEQ ID NO: 164289 - RNA, 42 nt, Homo sapiens
agcaaugugucuaucuuguacaagcaacaccaaggucaguag

SEQ ID NO: 164290 - RNA, 46 nt, Homo sapiens
cucuugcugccgugacugcucucaugaugccaugcugccugggcua

SEQ ID NO: 164291 - RNA, 46 nt, Homo sapiens
cucuggcgcccccacucaagacuaccaaagccaggacaccucaagu

SEQ ID NO: 164292 - RNA, 49 nt, Homo sapiens
cgcugacgcagcgccccgccugggagccgcgggcaggcgagacuggcgg

SEQ ID NO: 164293 - RNA, 75 nt, Homo sapiens
aggcuggggucaccgccccauuggggccucuuccgccggcccuuagccuggaucccaggccggaccccgcguggu

SEQ ID NO: 164294 - RNA, 41 nt, Homo sapiens
gcacgaugcggaaguggccccucucgccccaggcugggccc

SEQ ID NO: 164295 - RNA, 47 nt, Homo sapiens
guaucucucuggccucccaaggcucacuggcguguggcuguagaugc

SEQ ID NO: 164296 - RNA, 46 nt, Homo sapiens
aggacaggcgucaugugucccagagaauggauugagacacgaucgg

SEQ ID NO: 164297 - RNA, 46 nt, Homo sapiens
ugggcaccauccgcccaucuuccucggucaugaacaugcaugaaau

SEQ ID NO: 164298 - RNA, 41 nt, Homo sapiens
uccagggucaugccccagaaggcgcugugguucccagccug

SEQ ID NO: 164299 - RNA, 79 nt, Homo sapiens
gguagggaggggauggccgggaauuuuaagggguagcagacuuggugaauaaggcagugccgggguccaggugagaggu

SEQ ID NO: 164300 - RNA, 32 nt, Homo sapiens
agggagggaacguuucagcaugugucugggug

SEQ ID NO: 164301 - RNA, 47 nt, Homo sapiens
caggucagggauggaggcugcuggagggcagagagaccuaggacagg

SEQ ID NO: 164302 - RNA, 47 nt, Homo sapiens
gcagguagaggaaccaagacagauggcagagagagggacaguggagg

SEQ ID NO: 164303 - RNA, 25 nt, Homo sapiens
agcagguggggccuguucagagggg

SEQ ID NO: 164304 - RNA, 62 nt, Homo sapiens
uggcuacacucccuuuccugugaucaguguucuuuauccaaacccuccuccuaccuccaaau

SEQ ID NO: 164305 - RNA, 85 nt, Homo sapiens
aagggaguguagccaggggagaaaaagaacaggggcauggguaguuuagaaauuggaggagacugaacccagaaagggaaugggg

SEQ ID NO: 164306 - RNA, 55 nt, Homo sapiens
accugcaguaagcagcaauccccaucucugcuugguuagggaagagaauucuugc

SEQ ID NO: 164307 - RNA, 62 nt, Homo sapiens
ugugcgagggguaggcagagaaagccauuggacuucugaugugcaguagagggucccaaggc

SEQ ID NO: 164308 - RNA, 79 nt, Homo sapiens
uaagugaacagagcucccagugccgugacaagguccugcucugugcaagggagugugauuggccugacucauccugaua

SEQ ID NO: 164309 - RNA, 49 nt, Homo sapiens
cccuccugcuguagaccuagggcucucaaggggcaaagaggucccgucu

SEQ ID NO: 164310 - RNA, 30 nt, Homo sapiens
cgagguucaaaucuaugucaguaguuuauu

SEQ ID NO: 164311 - RNA, 49 nt, Homo sapiens
augagagauacuuaaggaacagcagugccauagcaagucaguggcagag

SEQ ID NO: 164312 - RNA, 45 nt, Homo sapiens
gccagcaugaccaagccuaccacaaucaucgaaaagaauggggac

SEQ ID NO: 164313 - RNA, 43 nt, Homo sapiens
uagggugagaauguccccauucuuuucgaugauugugguaggc

SEQ ID NO: 164314 - RNA, 68 nt, Homo sapiens
cuuccugcccuguauuccuacaccuuuucuugguccacaucaugugaccucuuuagccaacaagaggg

SEQ ID NO: 164315 - RNA, 37 nt, Homo sapiens
cucugcauuuuguacaaauccacgaauucuucugggg

SEQ ID NO: 164316 - RNA, 46 nt, Homo sapiens
gggcaaggcacacaucaaaagacagcaaggcagcaaagaagaagaa

SEQ ID NO: 164317 - RNA, 44 nt, Homo sapiens
ggacuagucagcucugggagccaaauauggaacugaguagauuu

SEQ ID NO: 164318 - RNA, 47 nt, Homo sapiens
guuugagaagccugacccuacaaggaauccuucuagaaaaagaaaga

SEQ ID NO: 164319 - RNA, 30 nt, Homo sapiens
uaagccccuauuuaucauuagcauagaggg

SEQ ID NO: 164320 - RNA, 76 nt, Homo sapiens
cggaaccacaccuuugcuuuugaaagaguguguguguaagacccacaaaaacagagaccaugacuugucugccauu

SEQ ID NO: 164321 - RNA, 53 nt, Homo sapiens
cucagaauacuucagccaacacugaguugaagaccccuuccuacuauucaaac

SEQ ID NO: 164322 - RNA, 46 nt, Homo sapiens
gaccauggaaaacuugccugcucucuacacuauuuuccaaggagag

SEQ ID NO: 164323 - RNA, 27 nt, Homo sapiens
acagcagaagucuguaagcaacaaugu

SEQ ID NO: 164324 - RNA, 46 nt, Homo sapiens
guggaggaggggacuugaucccucaggcucaguggugugaacagac

SEQ ID NO: 164325 - RNA, 97 nt, Homo sapiens
accuuccauagagaacuacuuguucagagcccugaggcacuugggaggaaaaugacuaaaagcacaaagagccaguguggcugguacaaagagaaug

SEQ ID NO: 164326 - RNA, 48 nt, Homo sapiens
ugaugcuaugagugccugaaauaagcaggaagguuuuucagaggaaaa

SEQ ID NO: 164327 - RNA, 47 nt, Homo sapiens
uuuuugaucagggccuacuguaugccccccugagagagacagugaug

SEQ ID NO: 164328 - RNA, 29 nt, Homo sapiens
cucccuucuucaagagcgcccaucguggc

SEQ ID NO: 164329 - RNA, 56 nt, Homo sapiens
cugcccuucucagcugagggugcugacagcaaggggugggaggcgggccccgaguc

SEQ ID NO: 164330 - RNA, 43 nt, Homo sapiens
uuuaguucagcgcagcgacucggggaccuggagcugacgccua

SEQ ID NO: 164331 - RNA, 30 nt, Homo sapiens
augcaaccaguuucccauauucucuuccac

SEQ ID NO: 164332 - RNA, 47 nt, Homo sapiens
aaccccucuuugagugaagagagacaccaacaccgggaggcucaaaa

SEQ ID NO: 164333 - RNA, 49 nt, Homo sapiens
acaaacauucuguggucauaaauuuaucuuaaaacaguucauuuuaaac

SEQ ID NO: 164334 - RNA, 42 nt, Homo sapiens
uuaccuaaagaggcaaggcaguuucucaaaccagagaaaacc

SEQ ID NO: 164335 - RNA, 49 nt, Homo sapiens
aggaguuuaucacugacgcacacuaaacacaccuucauucuaaaaggaa

SEQ ID NO: 164336 - RNA, 46 nt, Homo sapiens
cccuccagagcaagugcuugaaaaucaugauucaguucauccaugg

SEQ ID NO: 164337 - RNA, 45 nt, Homo sapiens
uccugguguaccacuuauuacccuaagggcauuugggggagggug

SEQ ID NO: 164338 - RNA, 47 nt, Homo sapiens
ucauggacuuggguuacugccuggaccaaagcaguuugccauacauu

SEQ ID NO: 164339 - RNA, 56 nt, Homo sapiens
caccaaaaccaaaugucaauggggagaaaucaacaauggaggacacagcagcagac

SEQ ID NO: 164340 - RNA, 47 nt, Homo sapiens
aaagauuugguauagugacuugacauaguacagagagauuugcagaa

SEQ ID NO: 164341 - RNA, 26 nt, Homo sapiens
uaucuccucuuaccgacaucccaagu

SEQ ID NO: 164342 - RNA, 42 nt, Homo sapiens
uuuggagacuaagaaaggaaggugacaguacugaaccuugac

SEQ ID NO: 164343 - RNA, 66 nt, Homo sapiens
auaaucaguuuaaauuacuggguuucacagcaaccaguuauccuaaaauggcggccacaccuauca

SEQ ID NO: 164344 - RNA, 48 nt, Homo sapiens
cauuacucugauaaauacuuuaaauccugaaacaucugagguagggca

SEQ ID NO: 164345 - RNA, 55 nt, Homo sapiens
ggaagcuccuuaaaaauacugauuccaaggaacaaaacaccaccacccccacccc

SEQ ID NO: 164346 - RNA, 64 nt, Homo sapiens
cauauguagagaccuguauguaugaggcauggugauagagcccuauauacugugggucccaacc

SEQ ID NO: 164347 - RNA, 48 nt, Homo sapiens
uaaacuggaagacauuuuguuuguccuaauguugaauucaacccauca

SEQ ID NO: 164348 - RNA, 74 nt, Homo sapiens
cgaagagcuuucuguuuucccccaaaagggggaugaccacggacagccagaugacccuauguuaacuaucuucc

SEQ ID NO: 164349 - RNA, 44 nt, Homo sapiens
caagaccauuucucgcgccugcauucacuacaagggcaccaguu

SEQ ID NO: 164350 - RNA, 46 nt, Homo sapiens
ggucaagcugcucgauguccucuuauaaaggucacugcugccaguc

SEQ ID NO: 164351 - RNA, 22 nt, Homo sapiens
uuaaguccugagacacgaaaua

SEQ ID NO: 164352 - RNA, 50 nt, Homo sapiens
agacaauggccaaccaaccccucaauugagaagggcucagugaguucaga

SEQ ID NO: 164353 - RNA, 54 nt, Homo sapiens
aucacuuuaaaaacuuuggacuucuucagccuucaacugccacugccaacacca

SEQ ID NO: 164354 - RNA, 37 nt, Homo sapiens
ggugacuccacauaaaagaaaaacagaacacagcaug

SEQ ID NO: 164355 - RNA, 29 nt, Homo sapiens
auguaccaggcuaugcaccaugcugggca

SEQ ID NO: 164356 - RNA, 47 nt, Homo sapiens
ucccugucuaacucuucuuuagccuugccuucuccugcaaagccggc

SEQ ID NO: 164357 - RNA, 51 nt, Homo sapiens
agacaauggccaaccaaccccucaauugagaagggcucagugaguucagag

SEQ ID NO: 164358 - RNA, 102 nt, Homo sapiens
caaaugcacacccuccccucggaaggggaaccgauccgauucccaaaaaguggccauggucugggcacacccacgaggcaaaagccaggcucacucccaccc

SEQ ID NO: 164359 - RNA, 28 nt, Homo sapiens
gcauuuggguacuguccugcagguagag

SEQ ID NO: 164360 - RNA, 44 nt, Homo sapiens
ucacaugagcugggggcuggggagaaaggaccaaaugugacaac

SEQ ID NO: 164361 - RNA, 36 nt, Homo sapiens
acccagugagcuauggaggugcaggcggggagaggu

SEQ ID NO: 164362 - RNA, 42 nt, Homo sapiens
caucaucgggaaaggagucaucauccccagagcccuccaggu

SEQ ID NO: 164363 - RNA, 45 nt, Homo sapiens
ccuccccgcccaccacggcggcugucuuggacaccgaggccccaa

SEQ ID NO: 164364 - RNA, 45 nt, Homo sapiens
ugccccuggggaccacugccccuggacccacagagguggcucagg

SEQ ID NO: 164365 - RNA, 44 nt, Homo sapiens
gcuucucggcaggaaucccccaaggauuguuacuaaggcagcug

SEQ ID NO: 164366 - RNA, 42 nt, Homo sapiens
gcagugugaccaagaaggcagcaaagagggcgcccaccaccc

SEQ ID NO: 164367 - RNA, 82 nt, Homo sapiens
ucuuugcugccuucuuggucacacugcucaucuaucguaugaagaaaaaggaugagggcagcuacacgcuggaggaacccaa

SEQ ID NO: 164368 - RNA, 49 nt, Homo sapiens
ggccccaguucuucucugcccucucucccaaggucugcccaggcugcca

SEQ ID NO: 164369 - RNA, 95 nt, Homo sapiens
cacagucuggggcagauggcagcagccccucuuccucggggaagaucugugugaggcuggcagccugggcagaccuugggagagagggcagagaa

SEQ ID NO: 164370 - RNA, 73 nt, Homo sapiens
cagugagcacugugggugccaagucagggcucaggcucaucucaagccccacccuuucuuccaccaccagcca

SEQ ID NO: 164371 - RNA, 40 nt, Homo sapiens
gguuuccaggacaaacauuugguaaacacagcccuugaaa

SEQ ID NO: 164372 - RNA, 51 nt, Homo sapiens
ggucucucugggguuguugaaucucuccucuugccugccaaguacacaugu

SEQ ID NO: 164373 - RNA, 47 nt, Homo sapiens
aagaugcagaaagaaaugaagucuggguacauguguacuuggcaggc

SEQ ID NO: 164374 - RNA, 48 nt, Homo sapiens
aaaauauggugauagugugggcaauggugucugugcagaguccccuca

SEQ ID NO: 164375 - RNA, 91 nt, Homo sapiens
accauugcccacacuaucaccauauuuucacucagucacacacaagacaaaagcaugcaaugacaaaaccauacgcaauccugaccgccca

SEQ ID NO: 164376 - RNA, 41 nt, Homo sapiens
ugacaguguggccuccuccuaccccaaauacacccacacuc

SEQ ID NO: 164377 - RNA, 41 nt, Homo sapiens
ggagacaauguguguggugccagaguguggguguauuuggg

SEQ ID NO: 164378 - RNA, 46 nt, Homo sapiens
ggguggaaucgagccagaacaaucagcccauauugggucccccuaa

SEQ ID NO: 164379 - RNA, 49 nt, Homo sapiens
ccagccuggaaaagacaggcugugggacagccccuggaaccucccccuc

SEQ ID NO: 164380 - RNA, 75 nt, Homo sapiens
cuccaucuuccagucccaaaacccuccuucacagggcccagaggcuugugaggaagccagguggacccagccuua

SEQ ID NO: 164381 - RNA, 87 nt, Homo sapiens
gaagagugggcauggggggccccugauaucuggagggggcggguuggccucagucaucuuuggagcagaagggcuggguccuggggc

SEQ ID NO: 164382 - RNA, 65 nt, Homo sapiens
ggcucagccucccuacccugcucccuggggugcugcugucuuggagagcacagcucuggugagac

SEQ ID NO: 164383 - RNA, 70 nt, Homo sapiens
ucuggggcugggggcccaagcccuuuucuccucuauccucccugguuucucagccucggccugcccaggc

SEQ ID NO: 164384 - RNA, 45 nt, Homo sapiens
uugggcuccaggcacuggcuucucuucucuguguccuuagcauuu

SEQ ID NO: 164385 - RNA, 34 nt, Homo sapiens
caggcuuuauccuccugaggaugaggagucugac

SEQ ID NO: 164386 - RNA, 41 nt, Homo sapiens
gcagagggucugcucccuguguccaggggcccccaccagga

SEQ ID NO: 164387 - RNA, 44 nt, Homo sapiens
guaaauagaagcccgcaaacuguacagauuuacagaggcaucga

SEQ ID NO: 164388 - RNA, 44 nt, Homo sapiens
uguaaauauuuuucguaggcagcguggcuccagagagcccccug

SEQ ID NO: 164389 - RNA, 36 nt, Homo sapiens
accccaggcagguucuguacaggagaaaggacucac

SEQ ID NO: 164390 - RNA, 61 nt, Homo sapiens
cccuguaaccuguuuauuaaccauaccuguccugaguucauggccaaaaccuuaaauaaga

SEQ ID NO: 164391 - RNA, 47 nt, Homo sapiens
gguuuuggccaugaacucaggacagguaugguuaauaaacagguuac

SEQ ID NO: 164392 - RNA, 55 nt, Homo sapiens
uguuuguuuguuuuuuuaacacuuccugugcugugcccauuuauaagaggaaaua

SEQ ID NO: 164393 - RNA, 45 nt, Homo sapiens
ccguggugcccauagacaagcgcccggacccgggcaggcucggcg

SEQ ID NO: 164394 - RNA, 46 nt, Homo sapiens
ggaaauggaggaguguucaucagagcuguaccaguuccuuacaacg

SEQ ID NO: 164395 - RNA, 46 nt, Homo sapiens
ccuuggaucauauuuaugucagauggauugauaggggccgccagca

SEQ ID NO: 164396 - RNA, 49 nt, Homo sapiens
ucucaugcaaauaguuuaccuuucuggaccucaguuuucccauuuauga

SEQ ID NO: 164397 - RNA, 34 nt, Homo sapiens
ucaagugguucuucagaguguuggacauacacag

SEQ ID NO: 164398 - RNA, 37 nt, Homo sapiens
cagcucaauaguguuagaagccaucugugcccaggga

SEQ ID NO: 164399 - RNA, 51 nt, Homo sapiens
cauaggucccuggucacaucugccagcuuuuuccaccaaagccccccagga

SEQ ID NO: 164400 - RNA, 46 nt, Homo sapiens
uggacugugauccuucuuccacugggacaaccaaaagccucgaagu

SEQ ID NO: 164401 - RNA, 59 nt, Homo sapiens
uccaggagaugaacagggagaugaucuguuuacaucgugccucauaccucccugcaggg

SEQ ID NO: 164402 - RNA, 43 nt, Homo sapiens
gcccuaggaaugacaauaaggcagagaacauuuacuuguacaa

SEQ ID NO: 164403 - RNA, 64 nt, Homo sapiens
uggaucaauagcuucauuucaauuacaugaaaaccuuuccaaguccauguuucuggucuguggu

SEQ ID NO: 164404 - RNA, 41 nt, Homo sapiens
aggcggcgggaaagggggaugauucauccggaggagcccga

SEQ ID NO: 164405 - RNA, 45 nt, Homo sapiens
uauaauucccggcuucucgagaagacacuacagccucaaggaggu

SEQ ID NO: 164406 - RNA, 46 nt, Homo sapiens
gcaaucacagcucucugccuaugcuacaaggugaaccaugaccuuc

SEQ ID NO: 164407 - RNA, 51 nt, Homo sapiens
cuuuggcuuugcuaccaguuccauaugaugagaaauaaacguucgcugagg

SEQ ID NO: 164408 - RNA, 42 nt, Homo sapiens
ugcaagaaaauccgcuugcuguuggcagguuggccugagaau

SEQ ID NO: 164409 - RNA, 43 nt, Homo sapiens
ugccuucucuccccugucauuuccagauuucauuaccuccuac

SEQ ID NO: 164410 - RNA, 49 nt, Homo sapiens
ccauacuccuaagcaggagagggaaaucuacaggucuagguugggcuga

SEQ ID NO: 164411 - RNA, 35 nt, Homo sapiens
gaagccugaaugcaugcaggcuugcaaagcuaagg

SEQ ID NO: 164412 - RNA, 44 nt, Homo sapiens
agggcauccacagagaaggacagccuaacaugguguacaaagaa

SEQ ID NO: 164413 - RNA, 30 nt, Homo sapiens
auggauaacuacaauaagagaaaaguuggg

SEQ ID NO: 164414 - RNA, 45 nt, Homo sapiens; identical to SEQ ID NO: 82496

SEQ ID NO: 164415 - RNA, 57 nt, Homo sapiens
uuaacuuucuauaggcacggguauagcaaaaaguuuucauuaaaaaaaaaaagagcc

SEQ ID NO: 164416 - RNA, 26 nt, Homo sapiens
cuuggcucucauggcacagagguuuc

SEQ ID NO: 164417 - RNA, 69 nt, Homo sapiens
cuuuccuuuuaauuuccagcucugcaaagaguuucauugucuguuuauauacagcuuguuugaacuaca

SEQ ID NO: 164418 - RNA, 84 nt, Homo sapiens
agaaugugugugccugugggucucuacaagugacagauguguuguuuucaacaguauuauuagguuaugaauaaagccucauga

SEQ ID NO: 164419 - RNA, 45 nt, Homo sapiens
guggcccuguucucagcccucuuccccagcuauguggcccugcac

SEQ ID NO: 164420 - RNA, 64 nt, Homo sapiens
guuguaauggugaucauggagagcaaauaugaacuuggccuggauuuuaaauggccuagaauuu

SEQ ID NO: 164421 - RNA, 49 nt, Homo sapiens
uaauauacucuaugggcucccucucccaccugucugcauagaaaggcag

SEQ ID NO: 164422 - RNA, 386 nt, Homo sapiens
ggacuuggaauuaaaacuuugaaaccuauacuacucggcugggugcgguggcccacgccuguaaucccagcccuuugggaagccgaggcagguagaucacuugaggucaggaguucgagaucagccuggccaacacuggugaaaccccgucucuacuaaaaauacaaaaacuagcugggcauaguggcacacgccuguaauuccagcugcucaggaggcugagacauuagaaucacuugaaccuggaagguggagguuucaguuagccaagaucgcaccacggcacuccagccugggugacggagugagacucugucucaagaaaaaaaaaaacaccaaacaaacaaaaaacacuugcacuacuaccuagugcugcugacuuaaga

SEQ ID NO: 164423 - RNA, 46 nt, Homo sapiens
uugcagauagcauagaagccaauguggaaagcucagaggugcacgu

SEQ ID NO: 164424 - RNA, 61 nt, Homo sapiens
aauagauuauuuucuguuuauggagaaagcaugcuuuguagagccuuaaaaacacacgugu

SEQ ID NO: 164425 - RNA, 32 nt, Homo sapiens
acccacuucuuaguugagacagauugccagag

SEQ ID NO: 164426 - RNA, 66 nt, Homo sapiens
gcaaggacuuugauguguucaaagaagagcaaggaggcuaguuuggcuggaguaccguuagaaaag

SEQ ID NO: 164427 - RNA, 46 nt, Homo sapiens
uugugcuugaaaaucaucuuggagccuuauaaacaggagaucagca

SEQ ID NO: 164428 - RNA, 44 nt, Homo sapiens
caaccacauagcaaguaaggcaugguagaguuguugguggaauu

SEQ ID NO: 164429 - RNA, 89 nt, Homo sapiens
uucggaaaucagacacaaugacugguauuugaaaggugggaugacuucauuuuaauaaagagaauucaccaacagcauuucaauuuaca

SEQ ID NO: 164430 - RNA, 45 nt, Homo sapiens
ucagccccuggcuccucggaaaucagcaacuuucaauuaagggaa

SEQ ID NO: 164431 - RNA, 52 nt, Homo sapiens
aguucugcccccacggugcugggaccaaaacagccgacuugacagcccgagg

SEQ ID NO: 164432 - RNA, 46 nt, Homo sapiens
cccugauccccagggcucaaacaugauguuugcauucuuugcccag

SEQ ID NO: 164433 - RNA, 46 nt, Homo sapiens
agacuuugacaaauguguguuaauaaaaauucauauugacucaagu

SEQ ID NO: 164434 - RNA, 46 nt, Homo sapiens
cugucauaauauuuuucagaugcauuugcauugacuaugggagaaa

SEQ ID NO: 164435 - RNA, 45 nt, Homo sapiens
gcucuauaauuugugauagcauucucauaaauggaguccuacaca

SEQ ID NO: 164436 - RNA, 351 nt, Homo sapiens
gaauguuuuuuuacaugaaugaacagauuaaaaauggaauaauauggucgggugcgguggcucacgccuguaauaccagcaauuugggaggccaaggcggguggaucauuugagguuaggaguuugagaccauccuggccaacaugguaaaaccccaucuguacuaaaaaaauacaaaaauuagccgggccugguggcaugcaccuguaaucccagcuacccaggaggcugaggcaggagaacugcucgaaucccgggaggcagagguugcaaugagcugaaaucgcaacacugcacugcagccugggcaauggagugagacuccgucucaaaaaaaaaaaaaaaaggaau

SEQ ID NO: 164437 - RNA, 51 nt, Homo sapiens
agguagcaaagauuugaaccgucugucuuuuuaaguaagggcagaaagcaa

SEQ ID NO: 164438 - RNA, 51 nt, Homo sapiens
ggugaaacaauucaaugcauaaguauggagcuaagugccuuuuggaggauu

SEQ ID NO: 164439 - RNA, 53 nt, Homo sapiens
agaagauguugcaucaaaaggaucaaaugauuuuagagaaagagaagaaggua

SEQ ID NO: 164440 - RNA, 44 nt, Homo sapiens
guuaucugauggccaccuuaccucugcaguucagcucagcaagu

SEQ ID NO: 164441 - RNA, 39 nt, Homo sapiens
uguguagagaaauguuggcuauuagaugugguuuaggau

SEQ ID NO: 164442 - RNA, 31 nt, Homo sapiens
aguuauggguuuaaauagacucuauucaguu

SEQ ID NO: 164443 - RNA, 52 nt, Homo sapiens
gaagcaugaagaauuacuuuuaggagcuuagccuagaacuuagaagagaggu

SEQ ID NO: 164444 - RNA, 49 nt, Homo sapiens
auaauucccggguuucuuauuugggugaauagauagagccuuaacugag

SEQ ID NO: 164445 - RNA, 72 nt, Homo sapiens
gcucuggauggaaugcuggcucugccagguucucugcggggaucuugggcaaguuuucucaucuguaaaaug

SEQ ID NO: 164446 - RNA, 45 nt, Homo sapiens
ugugcuggcugugcacacuuucauacaaacggguccuucagaaga

SEQ ID NO: 164447 - RNA, 43 nt, Homo sapiens
ccugagaucugcucucccacucuuucuccguuggacuucaggu

SEQ ID NO: 164448 - RNA, 65 nt, Homo sapiens
ugugugucaaugugcucgggugugugucucugucagaaggucagugccuguuuguucuguguaug

SEQ ID NO: 164449 - RNA, 45 nt, Homo sapiens
acuaaggccagcaucacauagguccgugucacuguugucucugaa

SEQ ID NO: 164450 - RNA, 52 nt, Homo sapiens
ggaugcccccgaaggcucaagauugggguagggaaacaucuaccccaucagg

SEQ ID NO: 164451 - RNA, 39 nt, Homo sapiens
cccuucuuuccgccugaaucucuaggucucugggcagac

SEQ ID NO: 164452 - RNA, 45 nt, Homo sapiens
agcacguagaccacgcugagcggccggcuccgcgcgcagccccgg

SEQ ID NO: 164453 - RNA, 46 nt, Homo sapiens
ggugggccagcagcaacacgccccuccucgcggcccuggcgcgacg

SEQ ID NO: 164454 - RNA, 61 nt, Homo sapiens
cugggacucugggcugugggcuaaaggaagggguagggagccugagcuaaaggaaggggac

SEQ ID NO: 164455 - RNA, 61 nt, Homo sapiens
accacgaaaggagaccaaaaggucuggaacuccgggccugggaagggggaggacggaugug

SEQ ID NO: 164456 - RNA, 42 nt, Homo sapiens
gagcgguggugacauccccaaucgagcguucucgugguggcu

SEQ ID NO: 164457 - RNA, 31 nt, Homo sapiens
cagaucuuuagaccaccuuucucuccacuca

SEQ ID NO: 164458 - RNA, 60 nt, Homo sapiens
uuguuuuuaccauugacauguuuuauuuauucauauuauaaaaauaaaucugccauagaa

SEQ ID NO: 164459 - RNA, 45 nt, Homo sapiens
acgagccacagagaaaaugaucuggaugaguauuuucucaauucu

SEQ ID NO: 164460 - RNA, 44 nt, Homo sapiens
caggaaguagcccgcauccaggaugaugggcggcagcaggaaga

SEQ ID NO: 164461 - RNA, 370 nt, Homo sapiens
uggaguuacuguauagauuaaaugaggcaacauaggccagacacaguggcucacgccuguaaucucagcacuuugggaggccaaagagggagcaucgcuugugcccgggagcuugagaccagcccaggcaacauaaugagaccccauaucuacaaaauaaauaaauaaauaaauaaauaaauuagcugggugugauggccagcaccugcagucccagcuacuugggaggcuaagaggggaugaucauuugaggaguuugagggugcagugagcuaugauugugcuacugcacuccugagugacacugucugugugacaggagacucugucucuaaauaaauaaauaaaaaugaggcaauacacauucaga

SEQ ID NO: 164462 - RNA, 44 nt, Homo sapiens
ggcagggccggccucaccagccccagcaguucugccaaauggau

SEQ ID NO: 164463 - RNA, 31 nt, Homo sapiens
agccagagacucuuugguuagaaacuaagau

SEQ ID NO: 164464 - RNA, 46 nt, Homo sapiens
cagacccugccaaguucauuucaguacuguguaccucccuggccac

SEQ ID NO: 164465 - RNA, 46 nt, Homo sapiens
ggacgugauugggggcaaaagaguuuuacagucuugcuaggugaga

SEQ ID NO: 164466 - RNA, 71 nt, Homo sapiens
uuagcuucccagaucucuggcuuagacggugggugguuguacuaaucacugaggcaggaaaaggaggaggg

SEQ ID NO: 164467 - RNA, 29 nt, Homo sapiens
uugucgaggcuggggagcugggccgagga

SEQ ID NO: 164468 - RNA, 45 nt, Homo sapiens
gcugcacggugcgggcaucuguaagugguucaacgugcgcauggg

SEQ ID NO: 164469 - RNA, 41 nt, Homo sapiens
gaccggaguugugggggagggccggagcuggagccggaggg

SEQ ID NO: 164470 - RNA, 43 nt, Homo sapiens
cucuccagggagcuuaccuggggcuaacuuuagacacacaggu

SEQ ID NO: 164471 - RNA, 40 nt, Homo sapiens
gguaaaacauuauuagaacagugcuugagugagucagcuc

SEQ ID NO: 164472 - RNA, 43 nt, Homo sapiens
aagcuggagguagcugcaucugguacuacgaggaugggcugcu

SEQ ID NO: 164473 - RNA, 47 nt, Homo sapiens
uggggagucccagcccaaucaggaacacagagggaugcacacagaag

SEQ ID NO: 164474 - RNA, 47 nt, Homo sapiens
aucgggccacaucugcagccagauguucgaaggccagauccuggacg

SEQ ID NO: 164475 - RNA, 68 nt, Homo sapiens
gguuagaacuuuccacuagcucacuagcugugguaucuugagcaagcaacuucgcaucucucugucuc

SEQ ID NO: 164476 - RNA, 47 nt, Homo sapiens
guccucaggugugggccgcaccucucccuaccucagaggaacugcga

SEQ ID NO: 164477 - RNA, 46 nt, Homo sapiens
gccucuggcugugacuucugcucacuggggacucagugaccccagu

SEQ ID NO: 164478 - RNA, 45 nt, Homo sapiens
cugggggcagguauagccccuucaaugguaggaaauauaggggag

SEQ ID NO: 164479 - RNA, 43 nt, Homo sapiens
ccuuuaaggugauaagcugcuccucaaaccacaccuuugggga

SEQ ID NO: 164480 - RNA, 31 nt, Homo sapiens
cccauggguaggugccaccaccagagcccau

SEQ ID NO: 164481 - RNA, 68 nt, Homo sapiens
ugaaggaccuuuugaccaacucccugucauuccuaaccuaaccuuagagucccucccccaaugcaggc

SEQ ID NO: 164482 - RNA, 45 nt, Homo sapiens
gucagaggucaagaugugggagcugccuucagccugugccacucc

SEQ ID NO: 164483 - RNA, 36 nt, Homo sapiens
acucaaauccccacucggaacccagagccuggccca

SEQ ID NO: 164484 - RNA, 25 nt, Homo sapiens
cugaauaaaguuaaaacguuauuua

SEQ ID NO: 164485 - RNA, 19 nt, Homo sapiens
gaguagcuggcaguagcug

SEQ ID NO: 164486 - RNA, 74 nt, Homo sapiens
gggcgcacucggcggggcggcugcgcggcugccgggacucggcgcgggacugcauggaggccaaggagaagcag

SEQ ID NO: 164487 - RNA, 52 nt, Homo sapiens
gagcggcugaucucuggggacuaugaaauugacggggggaccaugcugauca

SEQ ID NO: 164488 - RNA, 82 nt, Homo sapiens
gccaugggcacagccacggcaccaccaaccagcaggaggagaaccccagcguccgagcugccuucauccaugugaucggcga

SEQ ID NO: 164489 - RNA, 46 nt, Homo sapiens
acuacucggaggacaugaaggacugucaggcaugccagggccccuc

SEQ ID NO: 164490 - RNA, 46 nt, Homo sapiens
auuccugacuuagggguggcuuuuguuuacaagaugcaagagggga

SEQ ID NO: 164491 - RNA, 58 nt, Homo sapiens
cccagccuccccaggggcagugcugaguuugucuugacuguucuggcccaagguggga

SEQ ID NO: 164492 - RNA, 45 nt, Homo sapiens
cgagagcccucaauggaagccaggauccugcgaugagucucagag

SEQ ID NO: 164493 - RNA, 48 nt, Homo sapiens
agggaaaaggcuggcuugguuguccaaaggccgagaaggcagaguccu

SEQ ID NO: 164494 - RNA, 48 nt, Homo sapiens
cugaggucacagccugggugcagccggugucccccugccuuggagggc

SEQ ID NO: 164495 - RNA, 43 nt, Homo sapiens
ucauuucuuucauucauucacgcaaugcuaaaaaaauguugaa

SEQ ID NO: 164496 - RNA, 18 nt, Homo sapiens
aaagggguaagacugggg

SEQ ID NO: 164497 - RNA, 50 nt, Homo sapiens
uuucaccgaaacuguaagaagauauuccagauucaacucaacagugcccc

SEQ ID NO: 164498 - RNA, 49 nt, Homo sapiens
acaggcaguguauucugcacaaucaacugggauaaggaaaguccugaaa

SEQ ID NO: 164499 - RNA, 42 nt, Homo sapiens
ugaauuuccuccagggaaagauccuucuucuuuggaggggaa

SEQ ID NO: 164500 - RNA, 52 nt, Homo sapiens
cuuacagucuggaucuggaucuaccuauacaguccuacauuagcuucuaaaa

SEQ ID NO: 164501 - RNA, 28 nt, Homo sapiens
caugcguuagcaacacauggaccccacc

SEQ ID NO: 164502 - RNA, 22 nt, Homo sapiens
gauuaagcuaaauauaagagcc

SEQ ID NO: 164503 - RNA, 78 nt, Homo sapiens
guacuauccaagcccaggauucauucuugaagaugagauguaaaagcacugcugggcccuugcaaagggagagaucag

SEQ ID NO: 164504 - RNA, 47 nt, Homo sapiens
cuacccuugggagacgaggugucauucacuucacgauacacaugggg

SEQ ID NO: 164505 - RNA, 47 nt, Homo sapiens
uuucaacuagaaaagguaaugauaagguuuucugaagaccauuugua

SEQ ID NO: 164506 - RNA, 71 nt, Homo sapiens
augaacuucacgcgggaacagagucgacacccagcguggugguucaugucugugaaagugaaacugaagag

SEQ ID NO: 164507 - RNA, 36 nt, Homo sapiens
uguagugcugaaagccaaaaauauucgcuuccacuu

SEQ ID NO: 164508 - RNA, 56 nt, Homo sapiens
aucucaggaggauuguccgauagacuugaggggcuaggcccacucucuccccauau

SEQ ID NO: 164509 - RNA, 47 nt, Homo sapiens
aaauggaagguuuuagaauuaugauuucaauagcuggcuggggcuua

SEQ ID NO: 164510 - RNA, 44 nt, Homo sapiens
ucaucgucaucaucaucguuccuuuuuaaaagaagucaggucag

SEQ ID NO: 164511 - RNA, 475 nt, Homo sapiens
agugagaaagaagcauggaucuagcuugggggcugggggcagaagcugguggcuuccuccucuggccccacacccuagcuugcaaggaacagggagaaaagcaggcugggggcaaugggcaugguacagugggcaugguacagagggcacagguguagaggggguacagguguggcggaggcacagguguggaggggcacagguguggagggggcacagguguggagggggcacagguguggaggcgcacagguguggagggggcacagguguagagggggcacagguguagagggggcacagguguggagggggcacagguguagagggggcacagguguggaggggcacagguguaaagggggcacagguguggaggggcacagguguagagggggcacagguguggaggggcacagguguggagggggcacagguguagagggggcacagguguggcggaggcacaggugug

SEQ ID NO: 164512 - RNA, 42 nt, Homo sapiens
augaagugaaaaagacauuuuccaucacacgcaggaaaauga

SEQ ID NO: 164513 - RNA, 53 nt, Homo sapiens
ggagacaggcucuggggucuugacccugccauugaauuguugugggaccgugc

SEQ ID NO: 164514 - RNA, 39 nt, Homo sapiens
aaaagaagaaacucagagagacagagagauggaggagug

SEQ ID NO: 164515 - RNA, 46 nt, Homo sapiens
gcggggaugcgcccucaccuccugugggucaucuuugaaggugcug

SEQ ID NO: 164516 - RNA, 42 nt, Homo sapiens
gggaggggagcugccuugccaggggugggcaaggcccccucc

SEQ ID NO: 164517 - RNA, 47 nt, Homo sapiens
guuuguuuucaguaaacuccagcccacauggccuauaggcaucuggg

SEQ ID NO: 164518 - RNA, 100 nt, Homo sapiens
aagagaaggugggccuugggaaggccccgaaggaagggaauggguuaaagaguaggagguauacuccaggugguggggcuguaccagguagguugggaug

SEQ ID NO: 164519 - RNA, 42 nt, Homo sapiens
uagaacuaagaauuuggcuucuagaaagucuuaaugaauaag

SEQ ID NO: 164520 - RNA, 39 nt, Homo sapiens
uguugguguccuuguccaagacugaacuaaacuaucaga

SEQ ID NO: 164521 - RNA, 51 nt, Homo sapiens
gcuaugaagaaaaagaaacaagaggacuucugaccugccugaacccaaggg

SEQ ID NO: 164522 - RNA, 24 nt, Homo sapiens
cauuuaggagagagcaggcaacaa

SEQ ID NO: 164523 - RNA, 49 nt, Homo sapiens
gcccacagaucuucaaguucuuaaaagucuguugaggagcaguuagaaa

SEQ ID NO: 164524 - RNA, 42 nt, Homo sapiens
cccgggaaaguguuugauuuauguugagguuugggugucgag

SEQ ID NO: 164525 - RNA, 49 nt, Homo sapiens
agauucgcaagacauucaauaucaaaaaugacuuuacugaagaggagga

SEQ ID NO: 164526 - RNA, 42 nt, Homo sapiens
cacuaugccuucaauucaguugcagaguuuugauggagagau

SEQ ID NO: 164527 - RNA, 46 nt, Homo sapiens
uccagagcaacguaggaagucuauucagcagaaacucgacauuguu

SEQ ID NO: 164528 - RNA, 54 nt, Homo sapiens
uagggagagugucugagccacagcgucaggaugggggaaaccacaugggaucca

SEQ ID NO: 164529 - RNA, 57 nt, Homo sapiens
uguuggaaauugguuuguuuugccuuuuauugaaaagguaagaucaugugauuggaa

SEQ ID NO: 164530 - RNA, 48 nt, Homo sapiens
uuguaaacuauaagacguaguuuuaauuaauaaauauugcccccagau

SEQ ID NO: 164531 - RNA, 50 nt, Homo sapiens
cgauaaacugaggacuugccuuggaaauggaaucuggggaggcaggaaua

SEQ ID NO: 164532 - RNA, 46 nt, Homo sapiens
acaagcaaagauggccuuugucaacucuguggccaagccaccucgu

SEQ ID NO: 164533 - RNA, 46 nt, Homo sapiens
gaaaguucauugucaccgagacuuuaaggaagaaagacccgaagag

SEQ ID NO: 164534 - RNA, 46 nt, Homo sapiens
agcuggauuuacugggcgcagaaugaauuccaagaugcagguguau

SEQ ID NO: 164535 - RNA, 49 nt, Homo sapiens
uuuggggggcauguugaauuucagugugcaguaauuuccucugggcuuc

SEQ ID NO: 164536 - RNA, 109 nt, Homo sapiens
gcacuuggagauaaaggacuuaaaaaaaaugacucuaaaagcacugguaaaaacuuggacucaguucagaaauuacccaaggugaacaaaaccaagucagagaagccgg

SEQ ID NO: 164537 - RNA, 47 nt, Homo sapiens
caaccaugucuuuugaauccuaccucagcuaugaccagccccggaag

SEQ ID NO: 164538 - RNA, 47 nt, Homo sapiens
acaaccuaaagacuccagaagggaaagucaaaacuaauuuggauaga

SEQ ID NO: 164539 - RNA, 71 nt, Homo sapiens
ggccgcuucagacaaccaccugaaaaagccaaagcacagagacccagagaaagccaaauuggacaaaagca

SEQ ID NO: 164540 - RNA, 46 nt, Homo sapiens
gcccucuccaaagaggagaaccgaaggccacccucaggggacaaug

SEQ ID NO: 164541 - RNA, 46 nt, Homo sapiens
ggaggaccaggagcccauuguuucacaccagaagccugggaaaggc

SEQ ID NO: 164542 - RNA, 46 nt, Homo sapiens
cucgagagaccucacaaagugucucacggucaugagaggagagaug

SEQ ID NO: 164543 - RNA, 45 nt, Homo sapiens
agugauuuaaaauuuuccuuuaagugaaggaauuggcauuagucu

SEQ ID NO: 164544 - RNA, 47 nt, Homo sapiens
gcagaaagacaggauuuguucuuccaguuagugcuaggcuuugagau

SEQ ID NO: 164545 - RNA, 47 nt, Homo sapiens
auauuaaguuaaacgcguucuuguaccuuuucaucuuucugucacuc

SEQ ID NO: 164546 - RNA, 42 nt, Homo sapiens
gaaggggcccuggaccuucugaagaagcugcacagcugccag

SEQ ID NO: 164547 - RNA, 52 nt, Homo sapiens
uccccuggacccccaaaaggagaaaaaggagaggaaagagaaaaggcaaaga

SEQ ID NO: 164548 - RNA, 43 nt, Homo sapiens
cuggaagccagaagcaggccuuucuccaccaaggaaaaaacga

SEQ ID NO: 164549 - RNA, 46 nt, Homo sapiens
uuguugacuuuaaacacuaaaaacaaaauacauuuuguggaaccaa

SEQ ID NO: 164550 - RNA, 24 nt, Homo sapiens
cgagaaaggaguaagaccugucca

SEQ ID NO: 164551 - RNA, 48 nt, Homo sapiens
ggacagugaaugacuagaacuacaaugauugcuccccucguccaagga

SEQ ID NO: 164552 - RNA, 26 nt, Homo sapiens
acauuagaugucagaucuguaauacu

SEQ ID NO: 164553 - RNA, 53 nt, Homo sapiens
agucacugcuaugacgagaacccauuucccacucauucugagcuacccuauug

SEQ ID NO: 164554 - RNA, 31 nt, Homo sapiens
uugguaacaaagcaauaaacaauccuaagau

SEQ ID NO: 164555 - RNA, 46 nt, Homo sapiens
guuuucuuugucuccugagucccacugucuguacucacccccaugu

SEQ ID NO: 164556 - RNA, 52 nt, Homo sapiens
cuggguguaggcauugcuauugguagauuccacguuuuuaccuauucgaguu

SEQ ID NO: 164557 - RNA, 46 nt, Homo sapiens
ucaucugcuuuuuuaaagaagggagcacuguguccagguccaagaa

SEQ ID NO: 164558 - RNA, 42 nt, Homo sapiens
cagaggcugcccuaggauccagaaacaacccaccaaggagcc

SEQ ID NO: 164559 - RNA, 32 nt, Homo sapiens
aggucacacagcaaggaaguaaagccaugggg

SEQ ID NO: 164560 - RNA, 46 nt, Homo sapiens
gaauuguguucuucguaaagacugaggcaagcaagugcugugaaau

SEQ ID NO: 164561 - RNA, 82 nt, Homo sapiens
cgcugccucgccaggccacaccagguguuccugcacagcaguccccaagcaugugagacagaugcauucuaagggaagaggc

SEQ ID NO: 164562 - RNA, 46 nt, Homo sapiens
acccagccacagugcauggugcucugcugagugggcugcgagaagc

SEQ ID NO: 164563 - RNA, 47 nt, Homo sapiens
gacuaugauuuaauggcucagccaaucacuccuggccccucgauucc

SEQ ID NO: 164564 - RNA, 62 nt, Homo sapiens
aagugacgaugugauuguuggccgaugccuggccauucucaaagggauuuuugguagcagug

SEQ ID NO: 164565 - RNA, 49 nt, Homo sapiens
uacuguuggcacuaguggcaggagaagcugcugguaucauggaaaacau

SEQ ID NO: 164566 - RNA, 88 nt, Homo sapiens
uucccuuccccauccaggcugucaaguccugucagugcuagccuuacaaucucuugcaaaccuauuuacuuuuuucuauugccuaccu

SEQ ID NO: 164567 - RNA, 50 nt, Homo sapiens
aggcuguaaaaauaagacauuggccuugucagugcagacacaucagcuaa

SEQ ID NO: 164568 - RNA, 201 nt, Homo sapiens
uaccugccuucaaggagcucccaacuuaguggggauacaguaagcggggaagcaggcuuagaacagggcaguagguggccugaugggcugaacgcccagguuacuggagguccacucagccuggagggauaggcccagggaggcuuccuaccaggggaagcuugcguucucauucucagacugacuugccccugauucuuu

SEQ ID NO: 164569 - RNA, 50 nt, Homo sapiens
ccuuacaggaauauagaauuugaaauauuuuggguuuucucaauauauau

SEQ ID NO: 164570 - RNA, 46 nt, Homo sapiens
uguggcuuuagcagaaggccuagacauuaaacugaauacagcagug

SEQ ID NO: 164571 - RNA, 25 nt, Homo sapiens
auacugagugauuuguucuuuaguu

SEQ ID NO: 164572 - RNA, 46 nt, Homo sapiens
aagcuagaagaaaaacuucaggaguuggaagcgaaucccccaaggu

SEQ ID NO: 164573 - RNA, 41 nt, Homo sapiens
gauugaacauuggaagaagauagugaaaacucaggaagaau

SEQ ID NO: 164574 - RNA, 42 nt, Homo sapiens
cuucaauguccucaauaauaagccugugucccuuggccaggc

SEQ ID NO: 164575 - RNA, 49 nt, Homo sapiens
ucauagacucucuuaagagcuuuguacauucaauucugaacuuauuggu

SEQ ID NO: 164576 - RNA, 75 nt, Homo sapiens
uuuucuuucucucacuucugccaucaauucaacaauaggauugcagauacaguuuacuuuggggcugaauuaagc

SEQ ID NO: 164577 - RNA, 149 nt, Homo sapiens
gggcagauugcccuucuugccagauucuuucugccacacacuggcucaucucguaguguuacuuguguuaucagugaaggagcagaggccaggguucaaaaucgucuguuggguugggaaguggaaaaacuguggaguuucaaaugaga

SEQ ID NO: 164578 - RNA, 127 nt, Homo sapiens
ccagaauauuuuuagagauuuagauuuucuuuaggcuaaggguaauucuuuaauuauaaagauacccugaucccucccauguauagucuuugggaacuuacuguuugaauaugauuuuuaaaucagu

SEQ ID NO: 164579 - RNA, 44 nt, Homo sapiens
ucuaccagucuuagguaccuuccugauauaaauggcaccaagua

SEQ ID NO: 164580 - RNA, 40 nt, Homo sapiens
aauccagugggcugcucagcaaacagagggaagaaacagg

SEQ ID NO: 164581 - RNA, 356 nt, Homo sapiens
aaacuguugacuaauaaacuagccuuuuuuuuuuuuuuugagacagagucuugcucugucaccaggcuggagugcaguggcacaaucuugacucacugcaaccucugccucccgggcucaaguaauucucgugccucagccuccugaguagcugggauuacaggcaugcgccaccacgccccacuaauuuuuuuguauuuuuaguacagacaggguuuuuccauguuggccaggcuggucuugaacucccaaccucagguaauccacccaccuuagccucccaaagugcuaggauuaccagcaugagccacugugccuggccuaaacuagcuuuugaacaagcuuaaaggacaagu

SEQ ID NO: 164582 - RNA, 48 nt, Homo sapiens
uuuuugaugggcuaauagccaaauggugguacuuacucacaugcuuag

SEQ ID NO: 164583 - RNA, 40 nt, Homo sapiens
ggagaaugguauggaugagcauauacauauauacacauau

SEQ ID NO: 164584 - RNA, 30 nt, Homo sapiens
uggcuuugaacugcuaauuuuuuaaaagag

SEQ ID NO: 164585 - RNA, 92 nt, Homo sapiens
uauuuuugaugguggaacagagugaauucccuguuuuugauaaagaaaaaaagcugcuucucaggcaggaaccaucuuuuagaagccaagau

SEQ ID NO: 164586 - RNA, 40 nt, Homo sapiens
uuguaguuagcucucaaauuuggggccuucauggacauau

SEQ ID NO: 164587 - RNA, 46 nt, Homo sapiens
aaagguaauuauuauaggcucuggggucucaggcuuggcagcagcu

SEQ ID NO: 164588 - RNA, 46 nt, Homo sapiens
uacugugcuuguccaccgaguucacaguuauuuagagcgucauggu

SEQ ID NO: 164589 - RNA, 46 nt, Homo sapiens
uaaaugacauaaauuguauuacauacaaauagacauauguuauuug

SEQ ID NO: 164590 - RNA, 55 nt, Homo sapiens
ugaauauagcucagagaugucauugauaugucugcuuuuuagccaccaccagcuu

SEQ ID NO: 164591 - RNA, 46 nt, Homo sapiens
aauauuaguaguauauaguaaagcauuucuaauguuucugccagca

SEQ ID NO: 164592 - RNA, 41 nt, Homo sapiens
uucugcuuuagagugacugcauucugaaaggugaugcugga

SEQ ID NO: 164593 - RNA, 51 nt, Homo sapiens
ugcauauaacagguccugggacuguuucuauuucacucucuugaacuaaag

SEQ ID NO: 164594 - RNA, 46 nt, Homo sapiens
gaaauacuauguacuuuguuccacugccuuucaacaagaaucaaca

SEQ ID NO: 164595 - RNA, 54 nt, Homo sapiens
gccguuaguaaaagacacucggaauccauuuucccccauccagacuauuaauau

SEQ ID NO: 164596 - RNA, 672 nt, Homo sapiens
acgaaacaauggcaacauuuuuuaaaaaucuaugaaauauauuauuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccuccgaaguagcugggacuacaggcgcccgccacuacucccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuauuauuauuauuuugagauggagucuugcucugucgcccaggcuggagugcgauggugugaucuugacucacugcagccucugccccccagguucaagugauucuccugccucagccucccgaguagcugggauuacaggcgagcaccaccacaccuggcuaacuuuuguguuuuuaguagaaauaagguuucaccaaguuggcuaggcuggucuugaacuccugaccucaagugaucugccugccucagccucccaaagugaugggauuacaggccugagccacugcacccggcucuacaaaauauuuuuuauga

SEQ ID NO: 164597 - RNA, 45 nt, Homo sapiens
gcuuaaauuagugaguuuauuguaugacauguauuauaguuggaa

SEQ ID NO: 164598 - RNA, 27 nt, Homo sapiens
uaauuggaaggaaguucucucuguuga

SEQ ID NO: 164599 - RNA, 29 nt, Homo sapiens
cuauaucuugcaugacuuucguagguacc

SEQ ID NO: 164600 - RNA, 49 nt, Homo sapiens
gaaaguaggagaaaauaaaugauuagaaaaaacauacagaaagccauau

SEQ ID NO: 164601 - RNA, 46 nt, Homo sapiens
ccacccccucaagccccaccugaggaagaaaaugaaagugagccug

SEQ ID NO: 164602 - RNA, 58 nt, Homo sapiens
accuauuaugagcugccuuguuccuuguuguaugcuuacuucccuuaaaaugugaggu

SEQ ID NO: 164603 - RNA, 41 nt, Homo sapiens
cuacggccgucggcggcccggcggcccgagauguuaucugg

SEQ ID NO: 164604 - RNA, 31 nt, Homo sapiens
ggcagaaugucucccgcaaagaaggguggcg

SEQ ID NO: 164605 - RNA, 46 nt, Homo sapiens
aaggaauaaggaauguccuauagggaauccaugugcgguuguccag

SEQ ID NO: 164606 - RNA, 47 nt, Homo sapiens
cuuugguuaccuauguaccuguuaccacuuucaaaaaucuacagaca

SEQ ID NO: 164607 - RNA, 65 nt, Homo sapiens
gauggcaagaggagcaggacauggagcccugggggcagagggaacaccuggagagaaagccugga

SEQ ID NO: 164608 - RNA, 54 nt, Homo sapiens
agggagcaaaggcuggaggccagaaguggguuuggcccuuggggaagauuccag

SEQ ID NO: 164609 - RNA, 70 nt, Homo sapiens
agcaagaagaagccuuugggguucuuccgcaggaucuggauggccaccaccaccaucucggagagugacg

SEQ ID NO: 164610 - RNA, 45 nt, Homo sapiens
acuuacccaauagguaguccacauugugggggucaagggucagga

SEQ ID NO: 164611 - RNA, 46 nt, Homo sapiens
cgagguccaggccguccagccucgugccccuggcuuucucgucacu

SEQ ID NO: 164612 - RNA, 49 nt, Homo sapiens
aaaagagacaggagccaucacuucugcaggguuccaagaugcccagaag

SEQ ID NO: 164613 - RNA, 41 nt, Homo sapiens
ggguggacaccaggauuuuuguuucauguacagucugggga

SEQ ID NO: 164614 - RNA, 44 nt, Homo sapiens
cucaaggccucagggggcaucucguugucugaguaccagucccg

SEQ ID NO: 164615 - RNA, 53 nt, Homo sapiens
cagaucggggugucccagaggccuccucccucccuucccccuccccgcuaaag

SEQ ID NO: 164616 - RNA, 21 nt, Homo sapiens
ccuguuccaccccucccacag

SEQ ID NO: 164617 - RNA, 22 nt, Homo sapiens
aucaggaaugggagggucuugu

SEQ ID NO: 164618 - RNA, 42 nt, Homo sapiens
cugccuccagagccccccgcauguaaccaucaggcuucacag

SEQ ID NO: 164619 - RNA, 42 nt, Homo sapiens
cuauguucuucagacacugagcaucauaucuugauguugggg

SEQ ID NO: 164620 - RNA, 41 nt, Homo sapiens
ugcguuuaacccuuucuuaccaagacugggcagggaagcag

SEQ ID NO: 164621 - RNA, 56 nt, Homo sapiens
ucaaagccccggucuggacaagaaaaaacagguaguugaggaagacgggacgcgaa

SEQ ID NO: 164622 - RNA, 45 nt, Homo sapiens
ccguuuucuccucgucaaacucaaucccgcacucacugcccagcu

SEQ ID NO: 164623 - RNA, 42 nt, Homo sapiens
ucaggauguccagcaccaaaggguuaucaggaucggccacca

SEQ ID NO: 164624 - RNA, 45 nt, Homo sapiens
gcgcucauacugcgugugcuggaguggccgcacggauaccugcag

SEQ ID NO: 164625 - RNA, 44 nt, Homo sapiens
guggaaaaacuucuuuuauauaaaaauuaucccaacucccaccc

SEQ ID NO: 164626 - RNA, 44 nt, Homo sapiens
cacauuggagcaggggagaggaggccccccaaaaaugcccaguu

SEQ ID NO: 164627 - RNA, 45 nt, Homo sapiens
cgaguggccuuggcuggggaguauggagcagucacuuacagguaa

SEQ ID NO: 164628 - RNA, 99 nt, Homo sapiens
uuccagggagaggcccagguaccagugcaccaggagaagggcaggagcgagcuccgggggccccugccuuccccuuggccaucaagaugauguggaaca

SEQ ID NO: 164629 - RNA, 43 nt, Homo sapiens
ccagacagagcaauacuauagaaacaggggcuggaaggaugcu

SEQ ID NO: 164630 - RNA, 46 nt, Homo sapiens
cugccucccugucuuucagucccuguuuuucagccccgucucccuc

SEQ ID NO: 164631 - RNA, 41 nt, Homo sapiens
guggggaccugcguggggaggaucccauuccugcggggaag

SEQ ID NO: 164632 - RNA, 46 nt, Homo sapiens
aaaaauaugaccgacaaggcaccuccuggugucuaacucccccaaa

SEQ ID NO: 164633 - RNA, 46 nt, Homo sapiens
ugaaaucaacaaccuguaucugguaucaggccgggagacagaugag

SEQ ID NO: 164634 - RNA, 41 nt, Homo sapiens
uuuagacuugagcaagugccucaauuuccuaaucuguaaag

SEQ ID NO: 164635 - RNA, 24 nt, Homo sapiens
guuuuuuuuuuucuccugggcuau

SEQ ID NO: 164636 - RNA, 38 nt, Homo sapiens
ggaacaagugcuuucccaaugagaaaacugaagaucag

SEQ ID NO: 164637 - RNA, 41 nt, Homo sapiens
gagauuugggugcacaggcuccugguuuuuggcugcuuggc

SEQ ID NO: 164638 - RNA, 60 nt, Homo sapiens
gagccucucaggguuuguauucuaaccucaccauucugcacauguaaccacugcugccua

SEQ ID NO: 164639 - RNA, 59 nt, Homo sapiens
ggaggugguggggauaacucaauuaaguccaaguuccagcgcccuagaaggcaacaggc

SEQ ID NO: 164640 - RNA, 39 nt, Homo sapiens
ucuccuccucuuccuagcgucaccgccucuguuucucuc

SEQ ID NO: 164641 - RNA, 44 nt, Homo sapiens
gccacuuaucauuuguuuugcauuaaaguucaugcucaaagcca

SEQ ID NO: 164642 - RNA, 41 nt, Homo sapiens
aaguagaggugggugucaucuggugaauguacgugugggga

SEQ ID NO: 164643 - RNA, 42 nt, Homo sapiens
gcugagagcgaggugaucuggguucuaauccagagucugcug

SEQ ID NO: 164644 - RNA, 49 nt, Homo sapiens
gaaugcucugcccuggcccagggaaggaaagaggggcagauggaguuug

SEQ ID NO: 164645 - RNA, 38 nt, Homo sapiens
cccucucaucauccagcauccgcucuaguguugcucuu

SEQ ID NO: 164646 - RNA, 64 nt, Homo sapiens
uggaagaggcacuggggaggccaagggcccuuccuacuaugaaaaaugaacuguaagaguggga

SEQ ID NO: 164647 - RNA, 46 nt, Homo sapiens
agaaauucagaaugacaaguuuccuuaguuucucuuucauucucaa

SEQ ID NO: 164648 - RNA, 22 nt, Homo sapiens
gggcagauaguuaggucaggaa

SEQ ID NO: 164649 - RNA, 57 nt, Homo sapiens
ugacucuuuggccucuugggaguuguaagaagcggcuggaaaaggauugcugugugc

SEQ ID NO: 164650 - RNA, 45 nt, Homo sapiens
uggaaaagguccugaaaccuuguguuaauucucacuauuacaucu

SEQ ID NO: 164651 - RNA, 56 nt, Homo sapiens
gaacugucuuugcccauuuaccuaucucccugcaucaaugggaagcagaagaagaa

SEQ ID NO: 164652 - RNA, 74 nt, Homo sapiens
uuugucuuuagaccauggauacuguuuaaaguaagggcaguaucuuacuaugugugauuuucaguaaaaagaau

SEQ ID NO: 164653 - RNA, 44 nt, Homo sapiens
aaaucuucgguugccaaugugauagucacuugagaugaacagug

SEQ ID NO: 164654 - RNA, 43 nt, Homo sapiens
cugcuuagggaauggguaauuggcuguaccguuagcaagagag

SEQ ID NO: 164655 - RNA, 83 nt, Homo sapiens
gggagaucuacagguuguuuagggugacggguaguguagggcacaaggguagaaguaacgggcagugaagcuaggcuccagaa

SEQ ID NO: 164656 - RNA, 116 nt, Homo sapiens
gccucucagagggugucaugcucugauugggucaugaaggaccaauaggaguacaccaagagaacggucccaucugagaaggaguauauauagaggcacaaggacacgauguuuuu

SEQ ID NO: 164657 - RNA, 48 nt, Homo sapiens
aauuaaaauauaguuugauauauuuuuaguaacagugacugauuauaa

SEQ ID NO: 164658 - RNA, 55 nt, Homo sapiens
acuccacugcacuugugagagaaugagaaugaaaaagguacauuacaucuuaguu

SEQ ID NO: 164659 - RNA, 46 nt, Homo sapiens
gcacuggaaaugcagaggaagaggaggaaguuggagagggaaagug

SEQ ID NO: 164660 - RNA, 32 nt, Homo sapiens
uaacagauaagacauaaagaucccugccggua

SEQ ID NO: 164661 - RNA, 31 nt, Homo sapiens
gugugaucaaggaaauggaaccacgcuuacc

SEQ ID NO: 164662 - RNA, 41 nt, Homo sapiens
agccgugaucaagaugagcacggaggcucgugucccagcac

SEQ ID NO: 164663 - RNA, 50 nt, Homo sapiens
uugaaccugugacuugacagaguaggagaagucaggcgaaggcaggagag

SEQ ID NO: 164664 - RNA, 139 nt, Homo sapiens
cugucagaugcucuaccagcagcagggggcaguugugggggggggcgccuggagugugggaggaagcggguuucccauggcugggugauaacccaaaccucggaaagccuuccccgggccuuaucuaagagccugagcc

SEQ ID NO: 164665 - RNA, 46 nt, Homo sapiens
aguucaucaaagccuacaagacgggcaacauggaccaggcgcuguc

SEQ ID NO: 164666 - RNA, 91 nt, Homo sapiens
gucucgugguggagacagcagcagugaacacaacauuguguggccgcugccaugaucagggagugaggacaugcugcacaggggucaagag

SEQ ID NO: 164667 - RNA, 50 nt, Homo sapiens
caugagugcaugcaggaugcuuggcucaccgguccgagcuguggugauga

SEQ ID NO: 164668 - RNA, 56 nt, Homo sapiens
acuacgaagcucaaucacuugaguuccagacugguaggcaucgggcaggucuguuc

SEQ ID NO: 164669 - RNA, 46 nt, Homo sapiens
gcccuggcggcggaucuggacguggugagccggaccgggggcaggu

SEQ ID NO: 164670 - RNA, 60 nt, Homo sapiens
aagauugaaguaaugauugcuggagagcccagaagagagaguacuuuagggagcugcagg

SEQ ID NO: 164671 - RNA, 58 nt, Homo sapiens
aaugcaaugugcgugaugugugaaaggaaggccacugggcagguggggcuugagugga

SEQ ID NO: 164672 - RNA, 51 nt, Homo sapiens
uuugugauaccuacuugugguuguaaccaguguccagcauggaguucauac

SEQ ID NO: 164673 - RNA, 53 nt, Homo sapiens
caccccaggcuauagcagcuccuuggccacaaagauccuuuugccaguagcag

SEQ ID NO: 164674 - RNA, 42 nt, Homo sapiens
uggcugugacaucuguaggagugcuggucuggcugggcccuu

SEQ ID NO: 164675 - RNA, 46 nt, Homo sapiens
gugcaaucacagcagccaggucccacuugagcuucccuaggaccag

SEQ ID NO: 164676 - RNA, 366 nt, Homo sapiens
aaaacugugggccgggcgcgguggcucacgccuggaaucccagcacuuugggaagccgaggugggcagaucauaaggucgggagauuaagaccauccuggcuaacacggugaaaccccgucucuacuaaaaauagaaaaaaaaacuaguugggcauaguggcaugugccuguagucccagcuacucaggaggcugaggcaggagaaucacuugaacccgggagguggagguugccgugaguugagauuggaccacugcucuccagccugggcaacagaguaaaacucugucccaaaaaaaaaaaaagaauacaaccuugcaggaugucucuccuggagacagcaagagggagaggagggagagggc

SEQ ID NO: 164677 - RNA, 40 nt, Homo sapiens
cgccccucuggagagagcagcuuuuuauuugucuguagac

SEQ ID NO: 164678 - RNA, 49 nt, Homo sapiens
ggagacgacuugccagagagcgcaucugaguccacagaagagucagacu

SEQ ID NO: 164679 - RNA, 348 nt, Homo sapiens
ggucuugggcagggugcggugguucacgccuguaauccuggcacuuugggaggcugaggcagggggaucaccugaagucaggaguuugagaccagccuggccaacauggcgaaaccccuucucuacugaaaauacaaaaauuagccgggcaugguggcaggcaccuauaaucccagcuacucaggaggcugaagcagaagaaucacuugaacccaugaggcagaggcugcaaugagcugagauugcaccaucgcacuccagccugggugacagagugaaacuccaccucaaaaagcagauuuugcacugagcuccuaggggcaggacuuggcaguugcucaggagaug

SEQ ID NO: 164680 - RNA, 43 nt, Homo sapiens
ggcuuccgggcagcggguaaaggugagucuggggcauggguuc

SEQ ID NO: 164681 - RNA, 83 nt, Homo sapiens
acaggcgggagaccuuugacuuugacgacgacugugacagccugacgugggaagagaaugaagacacgcugcugcucugggag

SEQ ID NO: 164682 - RNA, 45 nt, Homo sapiens
cccugcccuuuguugauucaauagauacuugccaaaggccugcuc

SEQ ID NO: 164683 - RNA, 95 nt, Homo sapiens
gagguggcaagccucagaauagagacacgcucaagagugauggaggcaaauucagagaccagagagcucaaaucaauuugcugauaaaggaagau

SEQ ID NO: 164684 - RNA, 57 nt, Homo sapiens
cgcacccuugucuggagcuauucaagagugaggaagggacagugggcauggcaagua

SEQ ID NO: 164685 - RNA, 29 nt, Homo sapiens
uagggucuaugcaggcccucgcaccccug

SEQ ID NO: 164686 - RNA, 83 nt, Homo sapiens
gccccgggcacugugggucuugcauguaccgggggcucaguaaauauuuggcaaaaaaugaaaaaguuccccucaaagccagc

SEQ ID NO: 164687 - RNA, 23 nt, Homo sapiens
cagugccuccacggcccucaaau

SEQ ID NO: 164688 - RNA, 46 nt, Homo sapiens
ugauugaaggaauaaaaagaggaaggaaggcggauccacgugguuu

SEQ ID NO: 164689 - RNA, 46 nt, Homo sapiens
ccaagguuuuguggacccugagacagauguguugaaucugaaagga

SEQ ID NO: 164690 - RNA, 45 nt, Homo sapiens
gaugccggcauuguucccgggggucuuaccuccccggagcagcgg

SEQ ID NO: 164691 - RNA, 41 nt, Homo sapiens
uugggguugcccgcauugccacuugccgaugagggagggga

SEQ ID NO: 164692 - RNA, 70 nt, Homo sapiens
uggugccucaaaaacccauugagugcuucuuaagugcuagguucuguugaccaccugccugguagguauu

SEQ ID NO: 164693 - RNA, 45 nt, Homo sapiens
gaaacgggcuccguguuugcguuuggggaaaacaagauggggcag

SEQ ID NO: 164694 - RNA, 24 nt, Homo sapiens
ccaagucuuccacugcagcccagg

SEQ ID NO: 164695 - RNA, 91 nt, Homo sapiens
gccaugggcuacucacacuccuuggugauagcaagagaugaaagugagacugagaaagagaagaucaagaaacugccagaauacaaccccc

SEQ ID NO: 164696 - RNA, 45 nt, Homo sapiens
cucgcggcagcugucauuuccaugugcacugggacgggaagucaa

SEQ ID NO: 164697 - RNA, 129 nt, Homo sapiens
ggacuuggggguggggcagaggugggaacauuuguaucaguugagucagcuugguggcucccuguggagccagggcugagccuugucacgcgcacucgccaauuaagagauggaccagccagcagucaa

SEQ ID NO: 164698 - RNA, 52 nt, Homo sapiens
ugguuugggugcuuuaaaauagauauuuaguucaguggugcuuaugggggag

SEQ ID NO: 164699 - RNA, 47 nt, Homo sapiens
gugaaggggaaucaaagaggagguugugauuuggucgaaggugccug

SEQ ID NO: 164700 - RNA, 47 nt, Homo sapiens
gggaauugggaagcgagguaauuccucaagggugcgagguugaggac

SEQ ID NO: 164701 - RNA, 79 nt, Homo sapiens
auuaggaaaaucuccagaucugagacaguguggccagaguuuaauuaaagaauuugaauggcagaagauaaacgccuag

SEQ ID NO: 164702 - RNA, 46 nt, Homo sapiens
guacaaauccauugagccuuauuugaagaagaaggaugaaucucag

SEQ ID NO: 164703 - RNA, 40 nt, Homo sapiens
uguugggaaccuuuccuugaaagauggacaagaauuaaag

SEQ ID NO: 164704 - RNA, 49 nt, Homo sapiens
gcaggaauagcaggaagagguaggcagcucucauggcaacaaagaggca

SEQ ID NO: 164705 - RNA, 46 nt, Homo sapiens
gugguagggacucaacacaucgcugcugaaugaaugaauguuggcc

SEQ ID NO: 164706 - RNA, 46 nt, Homo sapiens
gucagggaacggcggcagcggguccaggucauacuggcccugagcc

SEQ ID NO: 164707 - RNA, 101 nt, Homo sapiens
cugagacuucuuccaucgcaaugaccuguauuaaacacaagccccccaagcaaaagaagagguugaguuugcugccaggauucagaucagcccuucccagg

SEQ ID NO: 164708 - RNA, 39 nt, Homo sapiens
aguguacaaaucauaaaugcagaacucugugaaauuuaa

SEQ ID NO: 164709 - RNA, 52 nt, Homo sapiens
cauuucucaugugaauuaaacauccucucccuuuccuccaugagaugaggaa

SEQ ID NO: 164710 - RNA, 39 nt, Homo sapiens
uucuuucucucgcuuggaggaaacuaacauuuaaugagc

SEQ ID NO: 164711 - RNA, 65 nt, Homo sapiens
uguguugcccucuacuuuuggguaucugucuuguccccccgucugccuucugaguguuugagggu

SEQ ID NO: 164712 - RNA, 46 nt, Homo sapiens
ugugacggauuccagcagguacuucgugauccgcaucgaagaugga

SEQ ID NO: 164713 - RNA, 44 nt, Homo sapiens
ccugucugggaggggcaggugcugaggagggaggggcggggccu

SEQ ID NO: 164714 - RNA, 42 nt, Homo sapiens
ggguccgggacauggcaggugagugucaacaaucgcccgggg

SEQ ID NO: 164715 - RNA, 42 nt, Homo sapiens
gagaaguuucuggaaagauggagccaaagggacgcugggggg

SEQ ID NO: 164716 - RNA, 58 nt, Homo sapiens
ccuugaagcgcggccggggaauccgcaaggcgccgacucucuuccuccuugcaagccc

SEQ ID NO: 164717 - RNA, 46 nt, Homo sapiens
ggacucacugcccagcccacaggccuccaacugguccaggccagag

SEQ ID NO: 164718 - RNA, 41 nt, Homo sapiens
uccccagcaggugggguuggggucuccggagucccuggagu

SEQ ID NO: 164719 - RNA, 51 nt, Homo sapiens
ugcgaaagccagggggccugggucugcacauugaggggguggcugggcuaa

SEQ ID NO: 164720 - RNA, 48 nt, Homo sapiens
ucaacguguccagccgcuucgaggaggagaucaaggcagagcaggagg

SEQ ID NO: 164721 - RNA, 58 nt, Homo sapiens
ugacccugugcaggcucugggguagagaaaggcccugugcucgaagguuccuggaagu

SEQ ID NO: 164722 - RNA, 35 nt, Homo sapiens
cuauuagguguucaaaguacaccuaacuagagaag

SEQ ID NO: 164723 - RNA, 41 nt, Homo sapiens
ccagguggaggcuggaccacagcagcuuuggccugccugac

SEQ ID NO: 164724 - RNA, 46 nt, Homo sapiens
cucuuuuucuggauccucuaagccagcugcaaccucaguuccagcu

SEQ ID NO: 164725 - RNA, 69 nt, Homo sapiens
gcuuugauaaauaacaaaaagggagaaaugaauucauuaucaccuaguuucagggaaggcagguggcac

SEQ ID NO: 164726 - RNA, 83 nt, Homo sapiens
uccucacgcuggaacagcggggacagggggacccacguuacaggguuguuguauggcgcuuagcccagugcuuggcacagagc

SEQ ID NO: 164727 - RNA, 42 nt, Homo sapiens; identical to SEQ ID NO: 82992

SEQ ID NO: 164728 - RNA, 44 nt, Homo sapiens
uggccaccaagcugagccggcggcugcagauggagggcgagggc

SEQ ID NO: 164729 - RNA, 42 nt, Homo sapiens
cccaccuucgggggcggugccuggcccggggagugucaggaa

SEQ ID NO: 164730 - RNA, 23 nt, Homo sapiens
cagugggcacgaagaggggcaug

SEQ ID NO: 164731 - RNA, 49 nt, Homo sapiens
aggcgcacaaauacucugauucuggagaaugauaagugcuccgggaaaa

SEQ ID NO: 164732 - RNA, 41 nt, Homo sapiens
aagaggccuauagcugugaguuggacaaguugugugguggg

SEQ ID NO: 164733 - RNA, 40 nt, Homo sapiens
gaagggugaccagcacauuugcacaugcaaaaaaggagug

SEQ ID NO: 164734 - RNA, 43 nt, Homo sapiens
agaagagccaaaacccugaaagugaguucaagagagaagggga

SEQ ID NO: 164735 - RNA, 54 nt, Homo sapiens
aacucucuaaauucucagagugcaauucauuugaagucagugucugauauucug

SEQ ID NO: 164736 - RNA, 175 nt, Homo sapiens
acccuuuuuauggcagaggggacagcaacacagagagguuaaguaacucguguacuuaagaggugugaauagaaggacaaagggagggaagauucacacccagaucugauuucagggcugaagucggccucagcagacacauuuuucuuccaucucaucagcccugagggaggcc

SEQ ID NO: 164737 - RNA, 42 nt, Homo sapiens
cacaugacccaguugauagggaggcuggcccggccuggccug

SEQ ID NO: 164738 - RNA, 62 nt, Homo sapiens
cugcccgcggggaaagcccccggcuguggcugccucuuuugcugccaagacccgagaagugc

SEQ ID NO: 164739 - RNA, 41 nt, Homo sapiens
ccuuuccacccggggccggcuacuaagaccuggcaauuucc

SEQ ID NO: 164740 - RNA, 63 nt, Homo sapiens
aaaaaaacgaaaacaacaaaaaaaagaaauaccagggguaagagaucagcuaaaugccucucu

SEQ ID NO: 164741 - RNA, 45 nt, Homo sapiens
ccaaaaacaagggccaugcucagaucugagguaccagucccauga

SEQ ID NO: 164742 - RNA, 55 nt, Homo sapiens
aagguaacccucuguuaacuaucaaacaaagcaaaauaaugaaaaugaacugggg

SEQ ID NO: 164743 - RNA, 46 nt, Homo sapiens
gguuuuuuggauuucaccgaagcugcaaacuugacguucugcuugg

SEQ ID NO: 164744 - RNA, 46 nt, Homo sapiens
caaagauauucccaacuccaugaagcaaaaagcgauguucugacaa

SEQ ID NO: 164745 - RNA, 49 nt, Homo sapiens
guggagaaggagaagaggaggaagaugaagaagaaaacgaagaggagga

SEQ ID NO: 164746 - RNA, 50 nt, Homo sapiens
aggcccgggugaggcggcagacaucaggggcuccacgggaggaaugggag

SEQ ID NO: 164747 - RNA, 58 nt, Homo sapiens
gggcggaguggcaacaguuaauaccgggggacaggguggaggggaagagggaucugug

SEQ ID NO: 164748 - RNA, 46 nt, Homo sapiens
cucaugucgccgccgguuaaucugugugccaaaggcuuucccacag

SEQ ID NO: 164749 - RNA, 45 nt, Homo sapiens
cacaauguugacacggaaacauaaacguuucaaauacaucaccau

SEQ ID NO: 164750 - RNA, 43 nt, Homo sapiens
guuaccucugagcagucuucaagaguuucuucugaaguuguuu

SEQ ID NO: 164751 - RNA, 45 nt, Homo sapiens
ucugguucuggcuguggcucccaggcaggggcagggguugcuagu

SEQ ID NO: 164752 - RNA, 38 nt, Homo sapiens
gugcuaaaguuuaagguaccugauuauagacauccaag

SEQ ID NO: 164753 - RNA, 65 nt, Homo sapiens
gcagggugggugaagggaugggggaaggucaucacuggaggccgaggagcaagacuggcagagca

SEQ ID NO: 164754 - RNA, 47 nt, Homo sapiens
cagaaaagagcagccagacccucacgaucugagaggccugcuacugg

SEQ ID NO: 164755 - RNA, 30 nt, Homo sapiens
agcccauaggaaauccgauguuuuugccac

SEQ ID NO: 164756 - RNA, 49 nt, Homo sapiens
gggacccagcuaugaccaacauuaacaucgucauggcaaaagcaccaag

SEQ ID NO: 164757 - RNA, 26 nt, Homo sapiens
aagagcugaggagaagauuaagagug

SEQ ID NO: 164758 - RNA, 35 nt, Homo sapiens
ggcucaauaaacauuagaugaaugaaugaauaugg

SEQ ID NO: 164759 - RNA, 45 nt, Homo sapiens
ucaggguugucuuccccauuguaccagaccaggagcuccucgccc

SEQ ID NO: 164760 - RNA, 50 nt, Homo sapiens
auccaucccaaauuuggguaauacaccuugaaaauggagaaaaguaaaaa

SEQ ID NO: 164761 - RNA, 57 nt, Homo sapiens
uccggaaguccucgcagcacauguucggguaccucagccagggucucgguggccgcc

SEQ ID NO: 164762 - RNA, 55 nt, Homo sapiens
gccuauagucaguccuaaucaucaaggaguuuucacuuaagauucugcuggaaua

SEQ ID NO: 164763 - RNA, 47 nt, Homo sapiens
agaaguauguuccugucucauggguuuuuaacacugaucacugugau

SEQ ID NO: 164764 - RNA, 46 nt, Homo sapiens
uaaagauacacacaacaaagaaacuucuuugauuacaugaacccua

SEQ ID NO: 164765 - RNA, 41 nt, Homo sapiens
ggauucagcaaaagacguuccacgucucaaauacacccaaa

SEQ ID NO: 164766 - RNA, 41 nt, Homo sapiens
ccacccccaggagaugacuggaaacugggggagcugccagg

SEQ ID NO: 164767 - RNA, 344 nt, Homo sapiens
ucccugauuuuuucuguuuuguuuugagauggagucucgcucugucgcccaggcuggagugcaguggcgcgaucucggcucacugcagccuccacuuccugggcccaagcaauucugucucagccucccaaguagcugggacuauaggcgugcaccaccacacccaccuaauuuuuguauuuuuaguagagacgggguuucaccacauuggccaggauggucuugaucuccugaccucgugaucucucccugccucggccuccgaaagugcugggauuacaggugugagccacugugcccagccaccugauuaauuucucagcacuggaggguaaaaccaggug

SEQ ID NO: 164768 - RNA, 77 nt, Homo sapiens
cagcaauugcaaaaugcuggugcuauuuacugacguagcacuggauccaaggacuccguggauauaaauauuuccag

SEQ ID NO: 164769 - RNA, 45 nt, Homo sapiens
ggagccaagucuggugaacggucuuuccuucgguuauuuuggcaa

SEQ ID NO: 164770 - RNA, 45 nt, Homo sapiens
uggagguggcugguuuucuuacccguggagugacugguggccacg

SEQ ID NO: 164771 - RNA, 45 nt, Homo sapiens
cuuccaaaccuguagucucagugucaucuucuggcuggccugugc

SEQ ID NO: 164772 - RNA, 34 nt, Homo sapiens
uuguuguuguugugauuauuuuaaaaaagcuagg

SEQ ID NO: 164773 - RNA, 41 nt, Homo sapiens
ggcagaauuccaguuauucccuaccggggcucuagcucaca

SEQ ID NO: 164774 - RNA, 105 nt, Homo sapiens
accuccuucugccaggacccagagcgacgcgcuucccaaaacgaagagcagagcugacaccuuccacaucguucccguugaguuguugcucuccugggggccgag

SEQ ID NO: 164775 - RNA, 27 nt, Homo sapiens
uaaaaagcaccgcggccacaggcccag

SEQ ID NO: 164776 - RNA, 63 nt, Homo sapiens
gcagccggacagcaaacuuugcaguugagaacuuuccgagcggagucagcauuuaucucuccc

SEQ ID NO: 164777 - RNA, 45 nt, Homo sapiens
ccuggccugcacagcgagggccgucagaaggguuuguucgcggca

SEQ ID NO: 164778 - RNA, 45 nt, Homo sapiens
acucucaguagucauucauguuaguaaccucacaguuaaagaggu

SEQ ID NO: 164779 - RNA, 42 nt, Homo sapiens
ucuucgcccuccuacucuucauccacaccauccaccucagca

SEQ ID NO: 164780 - RNA, 56 nt, Homo sapiens
gggugaagucccuaagcucgaugguagauugguagauuaccaagagggacuacaug

SEQ ID NO: 164781 - RNA, 42 nt, Homo sapiens
uuggcuauugcccagcuccucugggaaaggacugcucaccau

SEQ ID NO: 164782 - RNA, 44 nt, Homo sapiens
uccagaugcuuuauaugagaaggauccgcuucuucgaaggcuac

SEQ ID NO: 164783 - RNA, 70 nt, Homo sapiens
ggguucagcuccagugagggugaauuccuuuuaggaauuccuuguuaggaaguguguuuaaaguuaauau

SEQ ID NO: 164784 - RNA, 69 nt, Homo sapiens
ccaucucuuguuuguuuugaggaaguggggggaggcuagguaagaacacggaaauagggaacgggguaa

SEQ ID NO: 164785 - RNA, 552 nt, Homo sapiens
cagugccugaugccaucagggaugaaucuagcagccccugagaaucuagcaagagagaaaugguggauucgggccuccuaagauccuagagccucugcaaaugggaccccuccccagcccccuuccccugccagcccucuuggccccuccccugccuccuugacacuugagguuuuaagguagaguuccuuggccauccagaucccaucugggcucagaccuggcccagaccuuccacgcugggcaguucccccggugccacgugucaugucgugcagcacauggugcucaggucagacuggugaugccgacacgcugggcucugggcauaacugcucccucugccaucaaaaugcagccgugcuaaagagcagcagcucaacagcaagucagucaacuguggcucugccgacagguacauggguggugcuggcccagggggagguggcaaggccuagccaggaccgaaagacacacgugccaggcacagaguggaaucagcagaugcuuggcgcccgagcauuuggggagcugucccggccucauacuacc

SEQ ID NO: 164786 - RNA, 473 nt, Homo sapiens
agaagcuccuccagguaguaaggguucggagggccaggaacugggaaaggguagaaggucuguggcguuaagugccacaugccuccccaucuguugggaauggcugccugagccccucuggggccuuaguauuggcagagccuugugcuuuuccugucccugcuaaauccuucccugugggacugagggcaggggagggagaucuuaggucucugacgugaagucuuuguggugugauacccugucaucucagagggcuggaguguagcaguuccauggccacaaccaggcuguggcguaaagugaaagcaggcuggagcagauagcacccuacugggcaccugcucucuuuugggggcugggggugugugaauggguaccagggugggguaaggaguguucacugggcaggacccuuuacagguucaucaagaggaagaaguucgaugaugagcugguggagagcagccugg

SEQ ID NO: 164787 - RNA, 42 nt, Homo sapiens
ccccacuggcccccuuugcccggguagaagauuuugccaggc

SEQ ID NO: 164788 - RNA, 734 nt, Homo sapiens
caaaaucuucuacccgggcaaagggggccagugggguggaaccagggcgcuguucggggagugaacccuccuccagugagaagaagaaggugaggaauugggagacuuaggggaugggagguagugccagauuucauguuuccccagaaccuuugccagcugccaagagcccugcagagcaggcuggugagaggaccaagcugccccagcccucaucucagaugccccccuccugggaacacaccucucccuacuccccauuucuugcugcagcccccacccccaacccugccauugcauccuguaucacauuccgugugggaggcauggagcaugcaucuauucugggagcagacagccuguucccagcauugcagaguguaaaaauaacccccagguggcauugcuguggcccuagacacugcaccagcaagagugauuucccgguauccuccccacccaacuuucacucuggggucggggauacugccagcaaagagaagaccccguauggucaaggacuauauagaaguaacuuggugggauggggguggguauuagaaagcugagcuccuuuccugugcuuccuguugugggcuggaguuggugcugaggcuggggcuggggcugccgcugccacagaguaugugaaacucuagucaugaagcgccagcugacuggaugcuggcuuugagcuugguuuguuccuguccucugcccagguauccaaagcc

SEQ ID NO: 164789 - RNA, 59 nt, Homo sapiens
cccagcacuccugugccacccagcccagccccagccccuggacucaccaagcgugugaa

SEQ ID NO: 164790 - RNA, 167 nt, Homo sapiens
agguccuggaacaugguaaguauggccucaugggguggugaggggauggaagcuccugccagaaucaagaggaccaguacaaggugcugguggccucagagcaucccuccuuaccaccccaccucaccccagagcugaugguggcugaccggcgccagaagcgagag

SEQ ID NO: 164791 - RNA, 46 nt, Homo sapiens
ucuuggcagccucagcccugaugagggcaaugagguccugguugau

SEQ ID NO: 164792 - RNA, 44 nt, Homo sapiens
agaagagagaaaaaaugguugauucucaaaugaaugugucccag

SEQ ID NO: 164793 - RNA, 43 nt, Homo sapiens
acauacaugaauugauguuguggaucuuaugcugcucuuucuu

SEQ ID NO: 164794 - RNA, 67 nt, Homo sapiens
auuucuccuuuuugugaaauguuuuuuaguaauuuauuuuuugcguaaaagaguuucagaugcccuu

SEQ ID NO: 164795 - RNA, 130 nt, Homo sapiens
acaacucucacaacaucagaaaauucacacuggagagaaaccuuauaaauguaacgaauguggcaaggucuucacucagaauucacaccuuguaagacaucgaggaauucauacuggagagaaaccuuac

SEQ ID NO: 164796 - RNA, 48 nt, Homo sapiens
agagcucguucaagcuuagcuauccaucaggcaacccacaguggagaa

SEQ ID NO: 164797 - RNA, 42 nt, Homo sapiens
uucguucaagccuagcuauucaucugguaauucacaccggag

SEQ ID NO: 164798 - RNA, 51 nt, Homo sapiens
uccauccccgccggacucgggccucuggcagcagcgggugacgcagacgga

SEQ ID NO: 164799 - RNA, 7378 nt, Homo sapiens
gguugcgucugcggccagcgcuggucccgcagacgccgagauggaggugagggcgacuugcggcauggggagcgggugcagcggggaggaggagcuggcucccucgccggaucguggcgaucggacgcagagccggguuucucucucugcaccagacucagcuucacacccuguggauacgaaaugaugcucucacucuugcucccuuguucuuacccuauucgagcuaagcaaaauggauuucuggcuccucacauuuaaauuauuugucucuuucgugaauccugacaaauauuugaacgcucucagugaacagauguucuugguuaccguggcccgggggacccaucguuuuuuucccacuagacucccauaauucccucuccuaccucugaaugugguuuuuaguuuccaccaaacuucggggaagggcgaggagaugaccccuuaggagcgggaugcacgggcggggugaaggaggcauuuaaaagcagcgcguccgaggacuugggccuccuuuucuucuucccgguccuugcaggggcgguaucuguugugggcagaaacaauggcgagagcuggauggccgagugcgcaguggggauaagcggggcgcagcugcuucugugaagggagagaaggccccucccaggcacuauuccacuggaagggaagcaaccaaggcagcagcagcugucucggaucccccgucuaauuuaggggggaugaauaaguguaggaaugaauuagagaaccaggcgcaguugguuggcucucaguccggcacuuuucucuuuuuggccucuggccuuaagaaaaaaaaaaauuaguaccacucgcugccgagacuuauggguuuggguugggcaggggaugcugacaguacugagggggcuggaaagaugggggaagcugccaggcggguaaauuggauaugcuuccaggcuuugcaucugggaacaaaguaauugcuccuuccaauuuuuauuuucuuggccuucgaccuguuuugagauauuuugugagucggagcccaaagauuucugggauuuuccuauccuuagacagaaugaaaguaauacugcuccgaagaugagucuugaugcagaaucauuauacaguaagaaaaugguagcguaauuuaccauugaggcuuuuggcacaguaguuauauuuggguagcugggguuaaguaacauuaauguuaguaaucauuuaaagaacuuuuaguggugaggguagguuuagugacauaggaacuccugauaguuccuguaguuuugagugauuaagauaagauuacuuccaaauuaaaauauauucaguguugcuuuuuuuuccuuaaggaaaugguucuuuuggguuacuagggcucuuuaacuuggauuucuguuccaaggcuuaagggguuugacacaaagcaauuauguguaaaugugcaguucucuacaaaaauuguuuauaguuuuuccucagcuucucaaaggggucugccauccaaacuuuggaaaaaugaauguuucaccagaggucuuauuaauaucugaaugcagaguaauuuuaagccuaaagcaagucaacauuuuugacuugaaguugcuauuuuaaaugaaaauugauuuuaaguucaaacgugaguauagauguuaucacuaccguauuaaauuagugauauuuucauuugccagauggggaaauugaguucuacuagguagaaccuguaauaaaacucggaucugccuuuaaaagugagccguuucccacccaucuugcucugccauguucuuaccaaaaaaaacauauuuggcgguucaauuuauugaauaacauuguuauuuuuaccuuccuaguauagaaauauuaggaauuuuauuuuuuuauccaucuuaucacugacacauuuuuuuuuugguugacauuauagugugauuuuuuuuuuugucuuuuaaaaugucaguuuccuguuuaacaaaauucagaauuacugcaauucaugauauaaacuaaguuugagcacacaugcuuaauauauaugucacaacuuaaucuguuuugcacuuggaaaaugaauauuuuauaaaugacuuuuucuuguuuggaaguaugaucuaagguguuuuucuaaacagaguaaacccagcauucaugaauuuuuuuuuuuuuuuuuuuuuggugacaaagcugauuuucccagaaauagccuuccuauguauucaguuacuuuuuuucuuuuugcuugauacuaauaggucaauggagcacuuguuuuuuaguuauccuuuuggcaguguggaacucuucuguguucauccucaucucuauugacuagauugauuaaauagucaccuguauaccaauaaugugaugucaagaugccugaagcacauuuuauuuuuguagguugcauuucauggcauuuuggaauuuuguaaacuggacuggguagguggcuuugucacuuacauauguagaccagagauuuaugaugaacauagggucacacaagugccaagggucuuaacaaugaaguuagacuugacuuaaggucauuuuaccuucuauuccaguaccguaccagaucuccuccccacaacuuuuuggucacagauaguuuuauuauagcauauauugccuagcauagauuugugcaucauuaaugaagauuacuucugccaauuuuuuuuaauggaugaauagaacuuugcaguguagaaguuguuuuuuguugcuugugacauaugaaugucaggauaaauauauuugcaagaauaacauuuauuacuaguuuaggaaucagacuguaguuagaguauucaauuuaggcugcgagauaaaguuuuuguaauauuccagaagguggaaaucagggugacuaauucugauuucuuuguagacauuugugugguagcacaguagauacuguaguuuuaugacaaaaggggaacuuuuccccacauuuuauacuauuuaguuugguuucaugguuauuacagaaaaagagaaacagauuggcuuguauuaaauguaguuuucuuuuaggaugaugaagauaaucuuguguucuaaucuuggcaacaaccauacaguuuauauauauggguuaaauacguuguuauccccauaguaucuaauaucauuuuaucaguuuuucuguuagcuuagaugacagcuguuuaaguuucuaggaaguuuggggugagaauguauuauuuaagauguguuuuggucagaaauuggucuauaaugguauguuuacuauuuucgaagaccaauucuauuuaauuauuucuuucuaccaggaaauauuugaugaugcgucaccuggaaagcaaaaggaaauccaagaaccagauccuaccuaugaagaaaaaaugguauguucuaggcuugugaauagagucuauaaggaaaacuuuuuaucaggugauuaaauguacuaaacaucuaucuuaguccauuuuguguuacaacaauaccacagacuggguaauuuauaaagaaacgaaauuuauuucuuagaguucuggaggcuggcaaguccaaggucaaggccagcauuuguugagggccuucuugcagugucauuauauggaggaaggccaagagaagagagcaagacaggacugaacuuucuuuuauaacaagcucacuggugauaaccuccuccugagauacugacaguaaucuuuuccuaaucaccucuuauuaggcccuaccucccaacacuguugcguuggggauuaaauuacaacaugggagauuuggagggggacacagucaaaccauagcaaugucuguuuaauuuuuguaauuauggcacagauauccauuugaaauauguguaauauggaauacuauaacuuccauaucuuaugugucuauguaagccaaauggaaguauuauaugaauuaacauaauaugaugucauuaucuaguuauguuaacaacaccuuuaaaaauuuaaccuuggaagcgaggugaagaccagaauaguuacucaguguauguuuauucugcacuugacuagcauuguacucugcuaguuaccaaaaaaagaaauaugcuccuuguucacagcauuuuuauauuauagauggggucuuuacaaaaagaacaugacauuauauuggagucauucaagucccaguucacguuccguaucuucuaagaaacuucucaaaacuaugacuugacuuaaacaguaccuacacagagcuuuaaauuuaaauucaguuuuaguaauaguaguaguggcuaacagugaauguuuacuccguaucugacccuguuaggaaugcuuuauauggauuaaacucauuuaauuguauugaaaucucaaaaaguuaaaauaacaauguauuaaauaagaauaccacuacacagugugcuccuguaggguaaaaacagugucuuaaucuuucuuucugucuucaguacccagaacaguaucuggcacauagcagaucuuacauauuuuuuaaaacauacuuuuuucuuguccuuugacuuucucuuccaaaucaguaaauauuuuugaaugucuuaaauagcuucaaaaucuuaaaauuaugguauguauuuuaugugcauguauaauaugcacaauacauauaacacuauguaaauuauaaaugauauaucuuuagguuugauuuguuauauauuuuacauauguauauauguaacugucaccuuuuuugcuaucaaacuuagagaaaaaauagauuugccgcucuguuuuuuuaaagugaauacuacuuugaauacagucuacauauuuuaauacugcuuuaacccuuuauaguuuagauucugacacacucugcuggugaaucuaauugccaauucugaggcuuaguuuuaguuucuugauuugugcuugacauuguugaccauuccucaaaaaucuugacuugccuugaaagacauuuuuucccgugauaauauccucuuugcuuuuuuauuccuuuguccuuccuuauuaaaauuugaacauuucuuccuagacaguuugauucuuacugguuuuuaccugguaucuuuaaacugaauauuuucaaauacuuaaccucuagcccagaagccuguaauccguauuuucauuuacuuuaaaauccuauucauaccucuuacuugagaauauccaaaacugaauucauaauuuuuacuuagcauaccuuaguguuaccucaaugaaugaaaguuccucuucagguauacucaagauguucaugacaguacugcauacuuguaaacaauaaguuuacuuacgaguuuauucucuuuuccauaucacccuaguuuaguauuuuucuauuauugcauggauuauuuugugcuucuguauuugccuccuuucuuaugaucuggccccuuccaaguuucuuaacauuuuugcaaaguguuauuuauaacacaaauuugacugugaaauggagguuuuucaguggcucucuacaaugcuuuucauuuucuuaguggccuuuauuggaacucuuuucguuucuuccagguuuuucagucucccagcauuauuuccuuuuuugacaucaugaucuucaccugcacaguuuucuucuaagcaagaagcucccuugucaucugcuaguucuaaccauagauaaguucacuauccacuccucguucuugaacccagaaugcugaguacuacuucagaaaacuaaauacuagugcugauuggugccaguauaaguuuaugguuuuuauuuucuuggaccuugaguauuuauugccuaucagucucauuuagccauucuaaaauguccccacucugaucagucuuucuucuccauuucuaccaugcccucauuuccaaucuuccuccacaaagaauugcaggccugucuuuauuuucuuucucuuuucaaacauauguauagccucuauuauccuaccucauuucuuccuguuucagagaaagaagcuaguccaaagcuauucacuuuaauuuccguuugauuuuauaauugauuucuuucagguuccuaaucauacucucuuguuucugcuuuuuagguucuguugguuuuucucccucaagacauuucaguuuuaaccuuuucauucuuucaagcaguuuaucuugauuccaaacauaauuacaauaauuauuuuuucaguccaaacaucuuguagaugcgugcucuuggcuuuuguuucauuaucuauaaauuaagaaauguaauuauguaaaauaugcauucacauauguaucuuguucagcacuuuaaaaacagucuguaaucuuggaaaacauaaauaacagaggcuugucaucuguaggacauuacugggguucuagcauguucacagucuuguuacugugcagauucauuugcugcuaugacugccauuugugacccaaugaaacacuauaaccaugugccuuccuaauagcaaauugggcuucaguuuuuacauuggugugaccuuaaaaaaugauuauguuccuuuuaaaaauacguaguuguuacaacauuauggcauuuggauacuucuuguguuugcuagguaaaaugucuuuuuguaauuuauucccaaacugacauuuuaaacauuuauagacagagauguugaguaguugguuucccuguuuauugagcuuuucuugucuugcuucuccuuuguuucaucaaacuauuauuguuuuuguauaaaggcugccuaauggcucccaauuucauuauuuuuaugaaaauuugucuucgaggcucuuaagguuuuuuuugcccaaguaaauuuuuuccauucucucgguauuauaauagggaacauucaaaggggcagauggcagauacgaaaggaaggaauaguaucaaucccaauaccguuuuaaaauuugucacagccuaacuaaugaaugagcacugcauuuuuuccagcuucugaguaaauucacuuguauugcacaguguuuaauauuuuaaaaauuguuccgaucaacuguauugaaguauaauugacauaaaauaauuuuaaguuuguaauucaaugaguuuuagcaaauauuucuuuaaauaccaucacaaucaugaugcagaguaguuccaucauccccaaaguuugcuccugcuccuuucuaaucaguucuugcucccaccuccuugccacuucugaucugcuuucuaucacuaguuagcauuucauuuaaguggaaucauacagcauguagucuuuuguguuuggcuucuuucacuuugcauagugcuuuugaaacucauccauguugcauuuaucuguaguucucuuuuuuuuuuugcugaguucauuguauggaggcaugcugaaacuuugauuucugaaguuuuaauugauacucugauaaaauguaucuuaaauuuuuuuuuuucagcaaac

SEQ ID NO: 164800 - RNA, 2878 nt, Homo sapiens
agacuccaacuucaccuuugaagaugaaaccagggcgcccacgaauaaaaaaagaugagaagcagaacuuacuauccguuggcgagugaguaauaguuuaaacuucauaguucaaccaaacuuauuuucgauagucuucaguggaagcauaaaaucacuaugauaaauaacuuaaaauuauuuuagugccauuauuuauuuggcccuguuuggcuuggcaugauuuagccauaaauguauaaguauauaaaaauacgcauaaugguuagagcacaguggcucuugccuguaaucgcagcauuuugggacgccaaggugggaggauugcuugaguccgggaguaugagagcagccugggcaacguagggagaucccaucucuacaaaaaaaaaaaaaaaaaaaaaaaagaauaaaacugcauaacgccuuauuuuuuguagcauuauauaguuuaugaauuguaacaaucauguugaguauggaauuuagaugucacgucauuccucagagaggaaacaaaugcagagguuaaguggcuuguuuaacaucacauugaagaaugauccagacuugaauuugaaucugacuugggugugcucuaggcuccuccaucacauacagauguugacaguauuuuaucuaaaguguggugugugggauauugugaugacuuacaucacggcagccuguuuaaaauuuuuauugcauacuuaguuguuuuuauauaaauugaagugucacguuguaugccguccuuugguggugguugaaaauaauucuuacauguugaauuuggaaauucucuagaauuuucauucugguuggauaaauaagauguuuaauuaguaauaguagauuuagggcagucuuggcucccugaaauggcuuuguguaauucccaaagugaaaacugugauuaguaauuaaaauacaaaagauuguuuaaaagaagaaguaucaacaagguuaaauucacuacacaguuuguugaaagagggaaguaugaucuucaucuugaagggguuaucguuguaagcauaauaccuuuuauuugggguauuccacucauucauuauaucuuauuucucauccauugugaccaaagcacuauuuuaauacuuacgaaacuuugaagggacaauuuugcccuucagcuguauuuaaaauauuucagacuucagaaguuugcauuagugucauggcaugaaacuggaaacuacuguacugaauauuguuaugggauagucaguaugaugucucgaaaagaaacacuucuuuuauucuuuucuauuuuauuauuauccuaauuuaucuuuuuuauaagauaaaaaagauucuauuggaaauaguaauaauaaauuguuaggcuuaauguauuaaauaguguuauuagggaaaaaaguccuaguuaacagauuucuuuacuccucaaaccaucuuaaaugggaagcuaauuuaccuaaaguaaugagggucauaguauugucuuuggguaucaggaauacauuuuuuuaaaucuuuuuuuguuuguuuguuuuuauugagacagagucuugcucuguggcccaggcuggagugcgugcaguggugugaucucgguucacugcaaguugugccucugggguucaagcgauucuuggaccucagcugggauuacaggcucacgccaccacgcccagcucauuuuuguauuuuugguagagaugggguuucaccauguuggccaggcuagucucgaacuucugaccucaagugauccacccaccucugccuccuaaaguguugggauuacaggcgugagccacugugccuggccaggaauacguuuuuuuuuuaagucauucacgauuauauucaauuuuuaacaauaaaugacaucucagcuuuuaaguuuuacaacuguaauaaucaaacauuuugagaguaacuauaaaggauauuuuauaaaaagaauuuaaaauuaucucccaguuuauggagaauaaauaggggauggaaguagaucuuuguacucaauuucauaggcucagaaugcagagaaguacaaggaauaacagacuaggauguacugauuaugauuagaagcauauauaacaaacaagaaggcccuugaauuucugaggaaugcuucuaucuuggaaggccgcuuauccuuuuagcaagcaugugguuuugguagaaaugaaguuacaaauuagauucagcggucucaacagaggcauaacgugccuuuuucuaaauaagaugaaaauauuuguugaaagugucagaauuggggaguaaguauuaauaguuuuacugaaccaagcccuuuagagauuaauuggcaguauuaaaacuuuagaaaaucaguuuuuaaggggguaguauaucugauucucuuaggauguagaauuuagauguguauuuaaaaauuuuuuugaugaauccguggucacugcuuaaauuucugaguccuuaugcugcagcuuuugcucgaaguuacaauuuuaaacaugugguuucuggaacuuuuuuuuccuuggcaaaaagauuuuuaaaaagguacacuuuaaaauucaaauaaugagauuuucugacuacauaguucuugaaauuugacuaucauauuugaguuuauuggguucugguuaauguaucguacugguguauuuuaauaacuaauguauauuuuaaauaauuauuuaaaacauugcagauuuaaauguacucauauuuucuacuguccacugguugaugccuguuaaaaauuuaauuuuguggaaucuuggucagccacuugacuaugauguuuaaacaguagcugauaauuaaagccaaaacucaaaucagguuauuuuauuuucaucuuaacaguuaccgacaccguagaacagag

SEQ ID NO: 164801 - RNA, 1028 nt, Homo sapiens
gauuugaagacucuccaucguguauguuaaacacacuugauuuuuuuaaaaaauugcccuuugagaucuccuuugguuaauguuuuggauuuguguuggcuacuauuugugaagcaaauuuuuaguagucuuagauguuuauugguuaugaaauaaacuucagauuuugauggagaugagagcauauuacaggauaguagugcuguauuucaaaguuauauaaaaugucauuguguuuguuauugcccugaaguauauguaaaucuaaggaucguuuugcuuuauauuugucccacauaagaaaacuaauuuauuuuaaaaaagguacuucaugaacacauuugcuuacuucugauguuuuuauauuaauuuaauuuuuugugaaauguauuuguuuauugguuagcuuuuuauccucaaguguuuuucaaaaggagauggagggcuacacuguguacauauuaaaaaagaaaaaucaggugaccguuauguauauuugguaauuauucuggggagcaaaauaaguaguauacccugaaagagagugcauuggaauguauaagauauauuggacaaguaacuuaggaauuuccuauuucuuuuuuuuuuuuuuuuacuagaaagaaaauaaaauccccagauaaccuguaucuggucuuuaugaaagcugaaaauacuugguuaggaacacuugguuuuucauuaaaaagacgagaggccaaagagucucucagaccaguauauggguaacguaagaacugaguuguuggaguggguacucugaugcccgcagucauguuucccgcacuugauuaucuuccauguccagcuuuuccacuucagaccauggcagcuaccucuaguauuuuggaacuugcagaguuccuauucaagaauccguuaguaaugaaaauaaagucaguagauauguguaggcuuagaugaagagauugccuuguauuucuugucuuaaaaugccuauugugcuuuucuuuuguucuuagauguaaaaugggguaaacugagag

SEQ ID NO: 164802 - RNA, 71 nt, Homo sapiens
cucauaugguuuugguuccuaagucuacauuacacaacuggaugagugaauucaagagauggguaccaaca

SEQ ID NO: 164803 - RNA, 1480 nt, Homo sapiens
cuuagaucuguuuguuugauaggagauaaagaacaaagaguaaguuucuaguauuucauuacauuuuugaggcuaaaauaauuugaauucaggcuuggguauggguauagcuggaagaaggauaaaugagacgggaucuucgcaaauauuaguauuuacaaauguagcauugucuugguggauaaaaaacagcacuuugggaggccgaggcggguggaucaugaggucaggagaucgagaccauccuggcuaacacagugaaaccccguuucuacuaaaaacucaaaaaauuagcugggugugguggcacgcauggccuguagucccagcuacuugguaggcugaggcaggagaaucgcuggaaucugggagguggagguugcagugagccgagauggcgccacugcacuccagccugggcaacaaagcaagaccaucuuaaaaaaaaaaaaucauacugggaagaagacauuagaaaugguagaaagcuguaagacuguaguuuguuucucucccuuuugggagugguuguauaaaaucauugguugugcucucauuagaaguuauuuucuuguuuuuaaaagauauuuugaaaugugaguugguuggaaauuuaaggagccacauuuuuagaugaauguguguagugguaauagucacagaauuagaguuuuuaaagacggguugagucauauauaguaauuuggugauuuauuaugauauuuaacaaaauaaguuaaaauuucgaucaguugacaacauccuugugggaagaagagauggaaauaaugacauuaguauauaaagcucagauuuggaaauuuauucagacucuacugaauagcuguguacuuguuuuuuauuuccucuucauuuaccugugagugauaagucuauauuuuucucucccuuucuaguuauguuggauauuuuaaguuaucaauuuuuguuuguuuguuugggagcccaaagagugguaauuacuuaaccagucuuugcuucaguuuccuuaccuuuaaaauaauacuauuaggaauguguuaauacauuuauaaaccugaaaggaaugcagaugccuacuacugcuaacuaucuuuccacccucuuccuuucuuuauguuaaaaccucccucuuuuuugucuaaaccugccuccuaagaauuucccgaucuaguggaauugcagaaagacauuuuaagugucuauugaauuuuucacugguuaacuuugucaguuuuuuaaaacuuaaugguucugacauuuaaaugauuaaugacguuacuuuagucuuaggaaagcugguucuaaacguuugcauaauauagcuagcuacucuacuccuuuuuaguauucccaccucuuuuuauauacuagauuacuugucaucaguaaauguaaugcguaguuuauuucuacgugauguaauuuuuuucucuuguuacacaggcugcuuuugucagagacguuuuauuaccgggag

SEQ ID NO: 164804 - RNA, 1788 nt, Homo sapiens
gcagauguaaguauuuccuggugcuuucugguuaauaauaauauuuugcuuaaugcuauauauuuuuguaauaaaaguggccugccuuuuagcauggcuugagguuauuauuaauuuuuuaugcuuuuauuuacauaguuagccugguguuaucuccuagguugucucuguauaaugggaauuuacuuuugugccuuugguuucaaucuuauuucauuauuauuauuauuauuuuauuuuuuuugagacguagucucacucugucaccuaugcugaagugcaguggugugaucuuggcucacugcagccuccaccuccggaauucaggugauucuugugccucagccuuccgaauagcugagaucacaggugugugccaccaugcccggcuaguuucuguguuuuuuguagagaugagguuuugccauguuguccaggcuggucucaagcuccuggccucaagcgaucugccugccucagccucccaaagugcugggauuacaggcacgagccaccacaccaggccucagucuucuuuaaaucauuguuuucucuaucugaaauggcauaaauugucacuccuauuugguaagucagguuggccugacuuuguuucaguggcucuagguugacugguuauguuuuuaaggugcugcucaagguauuccugaagugauuuguauaccucacauugcuuauguuuuaagucccaaggaugacugucaaauuuagugaaaucugucuggcuuuucuuauauuauagucuaacaaacaaauagaaccuaaucuuuauggauuauuuauagucauagaaaggauaguaaugguuaauuagcuauuugaacuguuaauaguaauauaauaacuaugucaagaguuugugcuauuagaaauugcaguuuuuuuugccuggaccaguguuuauuuuugaagcuuuguuugcauagcuggcgucuuauguguauuggagggauuugaagagcuccauguuaguauauuuuuguacaauuaaguuauaaaaagguauuaauuaauuuuguuuuuuuucuguugaagauuguuuugaaagaauagauuguguuguaaaaagauauuuaaucagacuccaaaagcaauuuuagcuucgauuuuauguauuuugauguuuuugagauaauuccuguuucucacuacauugacacuuucauuuacuuuaaagcagugaauucuaagauuauguuuacucaaaaacaaagcacauauauaauacauauguucaagagaugagguuagggaaacugcccuuguugaaaucguaaccaaauauuaaugaaaugcugguaauuucaauuucauuuaguaaguuugauuaaaauugacauuguucguaaacuuguauuugaguagugcgaauggucucagagaacaaacuauaaaauguuuuaauuuucaagcuuuuaugaaacuugaaagauacuuuacaagaauauuaauuuucuaauccuauagaacuugcucuccaacuuuuuacugugaaacuuguuauuuugauguuuuugagaagaauguuuagaagguagugugauuucugaacuacuuguuuuaaaauuaguaacaaugacacaugaaaaccaggauuggacuaagugauuuuuuuuuguggguuacaauucaaauuacuaauucuagaaaucauuucuauaucugguauuauaggguauuuguuaauauuaucucugaucugaguauauuuuuuguuuguuuaucuaggacuuugauuccugguuugauacaaacaacugccuuggg

SEQ ID NO: 164805 - RNA, 1957 nt, Homo sapiens
ugguuuuagacaagcugcucccuaaguuaaaagaacaagguaucgguuacccguaucaaauuaucaaaacuguuuuaaaaugcucauguuaaaacaaaggagcacuguacuuugaaaugacugcucugaugcuuuccaagguugacguguagaacauuaaaaaaaccuguucauuaucugagcucuaacccccacuccugauuuuaggccuuaagucucuuagaagguaagcaauaguuagagcaaccauacucccuugauuuugggaagaguucauacuuuauauauacuuuccuagaaauuauagcuuucugucauaaaaugugaagaaugcaucucccucccacacaugguuaccagauccauuguuagacaguggugguguguucaugauauuguuuuuuaauuauuuauguggaguuuuaauuuaauaagguaccauguacauggaccugaaacauuuuuauuuguaguaugcugacuuuuuuuaugaaaauggguaugucuguguuguguguuuggguauauuuaaauuacacgaaugcagaaagaacuuagaagccagcuucugauuuuaacuaauaaaaacguuuuuagucugcuauacccuuccuccucccagauuauucgaagcaaacgccagacacuauagccuuucauaaauuauuacauaucucuuaaagauacgaaauaucacugcuauaguauuaagugugcagauucaaguuuguguuucucucuauauuuuaauaagaaugacauuuggaccaguaggugaaucuccucuaugauacuaucaaaagcauguuguaagaguugucagugaauggguuuacuuuuuccuuuucauaccuuuuuguagagauagauuuuuaaaaaaugcuuuccuugaaagcaaaguaauuaaaggaguuaaauugguggggaggaguggcaggaacguggugggaauacucagauauuaaugaaagguauauuaaacucugcagggaaaauggagacuauuaaguagucucaugucccagcacuuuuuggaaggcugaggugggcagaucaccuaaggucaagaguuugagaccagccuggccaacauggugaaacccugucucuaucaaaaauacaaaaaaaguuagcugggcaugguggcaugcaccuguagucccaguuauuuggaaggcugaggcagaagaaucacuugaaccugggaggcagagguugcagugaacugagauggcgccgcugcacuccagccugggugucagagcaagacuccaucucaaaaaaaaaaaaaaaaaaaaauucuuaugcauuugaggugcaggaacgugugacaacagcagauugucagccucugcuucuaggacaggaucauuucauaaucauuacuuuucaaaaugauccuuugucuugauauauucuacugaagguauuauguagcugccuaaagaaguggaaggcagucggauaguuugaaucauggcagauaagugauaagugaaggauagucauuguagauauaugaggcacauauuaugguccuuugaucuagaauggaucuucagaaccaggcugagaccaggauuauuagguguguguuggagguuuggggagucauaugcauugaagaguuguugugaaguaguggaaaguuauuuuuaaauguauaugggguaacaagauaaugauuaucuuacccuuugggauggcaaagccuuccagaccagaggcaaauaugcuuuucuguacaaauguuacccuuuuuuauuugugccauggugagaaaaaagugggaaaugacugacuuggauaauaauguguagauuuuuuucccccuuguaaccaaguagguagcuuuggaauuaaggauaauugauuagucuuaguuuugguuacccuuaaauuuuucuacuuuugaagccacugauaauagauuguuauauuccccaacagguucacg

SEQ ID NO: 164806 - RNA, 1471 nt, Homo sapiens
auccccaaguagaucuucaggcuaugguaagagauaacgaauaaauauauucugugcuuaguagauggcguuaguuaggacaggcuaauucuacaaauaucagugacuuaacccaauagaauuuuauuuuucucuaaucuaaugguucagugagaguauauugaggugaucuuccaucuaaauaaggguauuuccaucucagggaucugccauaucuuaggacccuggaguccucugcuauacugcauccuauuggcagaagggggaaacgauagaguuggggauuucccaggaaauucuuuaugggucagaccuugaaagagccuccuugucucuccacccccuugaucaaagaauuagacagaacucaaaucauguagcauaacugacugcaagggaauugguaaauuauaguauaguuauaucacaggaccaaagagaauuggguuugaugagcaacuagccugucuuccacuuuaguuauuuaaaagaacaccugugugagaguaccuggucagaucaggaagauuauuuuuagauugagagaauugauacugcagauuggccugacccaugauauuggugaccacaaacccaacuuuaaucucugucauuagucacuuucuuuuuuuuuuuuuuuugagauggaguuucgcucuuacugcucaggcuggggugcaauggugcagucuuggcucacugugaccuuugccucccagguugaagugauucuccugccucagccucccgaguagcugggauuacaggugugcgccaccacgccugacuaauuuuguauuuuuaguagagaugggguuucaccauguuggucaggcuggucucgaacuccucaccuucaggugauccacccaccuuggccucugaaagugcugggauuacaggagugagcuacuacacccagcccauuagucacuuucaucuuguacucuuacuaagggugacaggggaaaauggaccaauuauuagaaauaagggaguuuuuuaggaauguaguuagcaaaaguaaaacaaauucauauucagauuaguuugacuacuuguauauaguuaauuggguaauauuuaaagguuagaauuuuuguguuguuugcuaaguuguuucaugucacuucuuugccugauagcagugacaauuuggguuugauuuagauagaaaaacauuuugaauuuaaaccuaggaaaaaagacuuaaaaucuuuccucaucagacuuaaaaauuauaauguuguauauuguuuggagacauuauguguuuuaucucaguguaaccuagcagaauucaucugauuccuuacagaugcaguguuauuacaaauuuuuaaaaguuuuauauuucagaauauuuuaauuuuuuuucucaguguacccauuucaguguuauuuaugugacuuuuaaacuaaauucaaaauaacaugguaauuuauuuaggaccgagcacauagaauuggg

SEQ ID NO: 164807 - RNA, 3061 nt, Homo sapiens
augaaacucagacuggauucaauagucauucaacaagguaagccauggaacuuuaaaacuuuaccaaguuggauugacacaaccuguuuuuguuugaaaaucgucuuagaagauucuuguuacuaagcauccauugagucaagcuugcagccaguagagaugacuuguauugcaaauacaguaaacuuuaguuuugucauuaaaaagauggauuugggcucaggacaguugagguuugaauaaugagucugccaguuagcaguucucucugguuacaugaacccauuuccucaucuguuaaguggggauaaaaauaacuacacuuaaggauuuuaaaggauuaaaggggauaauguauauaaaauaucugacauucaguguggugguuaaugauuuauauguacuaacuacucuugauuacuguggggaaaacugaagaaauaaaaaucaaagagccugauuuuauucuuuuuucuugucugcaauuuacugaguacccaccagaugcuaggcaccguucuuggugcugagaauucagugguaaauggaacaaacaaguauucuuacuuucaaagaguuuacaauuuaguugggagggagagaugaaguaaacaaggguauaaguaggaguagggggugagagugggauuuuauuuuggaucaauugaaggaaacuuaaguucucauuccagaucagcuuuuaaggaugacauaauuuauguuuucaugaagccuacuauaaaguugaugaugggaaauauaaaauucaagaaaaggggugggaaacuuaauaauuucaagugugcauugguuuccuuuguaacugcauuugugagcauguauuuacuaucugucuauaaagcugaaaggcauacuguuacauuguuuacugauuauguagguaucuugauuuugucagucucugauguccauguaagagaguauuguacaugucuuugguaucccuaaugcuauucauaguguuagccauaugucugcauaccugaagacaauaaauuauugcuuauuuuuacaaaucguuucccuuaauaaaguguuuacuuugugccaggcagugugcuauauacuuaacauuucauuuucuccuuuagucuucaugccaacuugagauguuagcaucagagauaaaggcuuuugagagguuaaauuacuuguucauuguacauacagcugggaagugacucaagggggaucaagaacuuuguuaacucuuaaguguuuaauuagaaaagucucuggggacuucucgaggcugccaccccgugauguuaucucaugggugauauaauggcuaauguuuuauuuuucuucacacauccauguguuuugaaauacaccugccguguguuucuuguucucaguuauuuucauccaugaaacacuuuuuuuuuuuuugagauggaguuuuguucuuguuacucaggcuggagugcaauggcacgaucucggcucacugcaaccuccgcuuccuggguucaagcaauucugcugccucagccuccugaguagcuggauuuacagaugcccgccaccacaccuggcuaauuuuuuuguauuuuuaguagagacaggguuucacuuuguuggccaggcuggucuugaacuccugaccucaggcgauccacccaccucagccucccaaagugcuggauuacagguaugagccaccacgccuguccaaaacacuuuuuuuaaagauaaaaaagaccuuaauugauucauaauuaauuuagaaaucuugagguuuuuuuacuucauauuuacuguggcaauuuuuggagcaaaccuucaggcuaauagcuuucuugugccguuuguagacauguuagucaaacagcaagccuuaagugcauaccuuuguguuacuguuuuuuauuugagggacauaauuaaaaacgagaguacacaagcacuuuacaucugaagguuccggaaccuuccugcccaacuuggaaguaguuuguauaagcauaagaacauuuugguagcaaugguagcauccaauccaaggaaacauaccuuguggauaucuccucacuuacaaagucauggauguuuggcuguauauccuauuaugggucccaaaccaugauacaaguauuuaaagaaguuguugaaaacuuggaucuuuuuccacuuacuuacaaguugguuggcauauaaaaaucaaagcuuuguuuagguguaugugagugacccuugaggagggugaaaacaagucuuucuggguuuuuguuuguuuuuuuauaccuguauuuuugaaaaauuacaagguuguccaaacuccugccaacugaaaauauuuauuaauuuauuaauggugaguuucuucgaugauccagauacauuuucucaccaggugugguagugcaugccuuuaguccuagcuacuugggaagcugagacaggagaauggcuugagcagggaguugaaggcugcagugacuaugguccugucauugcacuccagccuaagcaacagagcaagacuccaucucaaaaaaauaaacgaauaaaauaaguuuuuaggaguuucaguucuucuggaaguuuucuuuaaaaagaaacugauguuacauauuucaguucuguguaaaguuuggccuaggugaaggauuuuuuacuuuacuuuucuaaggagaaaagcugauuuggggaguauuaguuaauaacaccuuucugcucaucagaaacuuguguguauaaugcuuccaucuguugaaacuuguagguuuuugaaaauuuuucauaugcagcuuucacaaaagauuauauuucguuggcacaguauacagcagguuucauuauauaauacauaagguuuaggaauguuuuguagcuuaccaacugaaaauuuggcauuaaauuuagugcaaaaaucaaaauuauuagaugugaauaaacaguaaacagaaaugauugacauuugagauaaaauuauaaagcauuaaaccuuacauuuaaaguuucaaguuuccaguaaaauaaagucuguucaguuaacauuauacaacacaaucuuuuuucagggaggcuugug

SEQ ID NO: 164808 - RNA, 53 nt, Homo sapiens
aagugagaucacugaugaagauaucgaugguauuuuggaaagaggugcaaaga

SEQ ID NO: 164809 - RNA, 812 nt, Homo sapiens
aaaaacaaaagguaauuuagaaauagguuuggguuacaugaaagcuuuauuuuacuggaaacuuggaauuuuaaguguuacuguaaugucuuauaauuuugcuuaaaacaguagucauuuuugcuuauucacaucugaauauuuucaucauuauguaaaauuuaaugccaguuuuucaguugguaagcucugaaauauuuuuaaaguuuuuguaaugaaguuugugguauauguuuacagugaaauauauucuuguaugggaugaauaguaauuugggaugguaaccugauucauuuuauuuuaaacagcagaauuggcugguaauaaagggaaaaauuucuuaacuucauaaguaauacuugguaauauagagauaaauugaaaaauacccagagauuagaagaaaaaaauaauucuacccaguguuuuucuuguuaauauuuaggucuauaucuucagaauuuuuuguaggcuaauuaugugucuacauuuuucuccuaguuuagauuuauaccaaacauucuguagcauuucucccucauuuaacaguuguuccuuuaagcaagaaauacugaaugcuuacucuguugacuagacacugucucguguuaauuauauacauaauauugagcaaaguaucauagucuccacccucauagagcuuauagcccaggauuuugugaauaucuuuacauuuacaaacauccuucuugaugaugauuuguuacuguguauaauaaaaguuggugauuugaguuguuucccaugugcuagauugcauucacagaguggauugaaccaccuaaacgag

SEQ ID NO: 164810 - RNA, 45 nt, Homo sapiens
cguuuauuugaauuacuggaaaaagaaauucuguuuuacagaaaa

SEQ ID NO: 164811 - RNA, 835 nt, Homo sapiens
aagcuucuaacacagguauagccuuuaaucaguacaaacuuuaguaacaguuuguuguaaaggacuguguuagguuauguuggggcauaaaaauaaauacaaguuucugcuuuuaaagauggaauaauuggagacaauaaaguaugggcauguggauaaaugcuccaucugauugucacuaguugagguaguugagaagacuacagauuuuauuacucuggcucgguagaguggguaucuuuuuuaucaccuuacuuugaauguucccgucuuuccuaugaauuuuccacauugcuacccagucaccauuuucaacuauaaaucuuggcuugguuauuuuuuaaacauccuuugguguucaucaaggucuuucagaaucuggccuuugacuuaccuuuaaagcuucauuuuccuuccauuuuucuacuugcucauauuuuugcccuuuauguuauucacucuuucuggccaacugcuaguaauccuucaaagcucagugaaacugucaccuuuucauacaguauuccuuacucucagccacucauauuuaauugcuuggguauuugagcaauauauaauguguugucaaaaguguauauuuauguacacgaaaaguuaccacucuaaaagaacuuaauaaacuagugaaaauuuguuuuuguaauauuuagaagguuugcuaauagcauguuuuccaaguuuaaugugcugugauuaaauauuuuguuucuguuccugugaagggauuuaccaauuggaauaagagagauuuuaaccaguuuaucaaagcuaaugagaaguggggucgugaugauauugaaaauauagcaagaga

SEQ ID NO: 164812 - RNA, 1022 nt, Homo sapiens
ucagguaauucuuuuaagcaggcuguuggaguuuaguaagagcuguuggaagguucuuguuuucuuauucugaauuauguugugauuagcuaauuuugucacaguguaguuaguaccuucuucauuauuuuuuacaaauuagaaaauguucuguuuccagaaauggcguaaugguuuccuuuuuaaaaauuuuuuaacccuagcuaacucuagcgacagcaaagaaaaucagaauaagucacuggauaauugcccuugcauuuuuaucuuaauuucucugcauaacuucaaguauuauguguuguguuuccugaagucaguuguauuauuagguuaacaugugaggguaugcuguggugagucugcuuagaauagcagaaauuuaagaauuagaagauaaauaauccaguugaucccauuuuuuuuacauuaaagaaauaaaaauauaaaugauuuguuuacuuuguccaacuuuuacagcuguguuuugggaaaggugcaacgagcuccaggacauagagaagauuauggcucagauugaaaggggagaggcgagaauucaaagaagaauaagcaucaagaaagcacuugacacaaagguaauuugcuuguuaauaaguuagguaguuaauaaaauaacuccuagcugugaguaugagagagugacuuuuuauaaaggaaaagaaguaaggguuuacaauuuaaaauuucuucagaguagcauucaaacaugguauugucagcagaauuuaccuauacacuagacugauagaucugagucaaagacacuaagauuagcuuuuuacuaaguagaaucaggaagucuuagucuguauuucucuuuauaauaauaaagacuauaaaggucuuucgggacaaagauuauauaaagcaauugaagugcucuagauagaaaauucugauuugaaaugcaacauuuuagcuaauuauacuaaagcugaguuugaaauacagauuauauaggauuuguauuuuauauaauauaaaaucugacuuucaua

SEQ ID NO: 164813 - RNA, 42 nt, Homo sapiens
uuucaucagcugagaauaucauaugguacuaacaaaggaaaa

SEQ ID NO: 164814 - RNA, 84 nt, Homo sapiens
ggagcuccagaggagauguaauaccuuaauuacuuugauugaaagagaaaacauggaacuagaagaaaaggagaaggcagagaa

SEQ ID NO: 164815 - RNA, 42 nt, Homo sapiens
gcuuagcugcuuucuguucauaugguuguuuaucuuuggcug

SEQ ID NO: 164816 - RNA, 46 nt, Homo sapiens
uaggccaggguguucacuuuugaucuuugggcgauguucagagcaa

SEQ ID NO: 164817 - RNA, 337 nt, Homo sapiens
cuccuuugcagacauggucuguggacauaaaauaagagccaaaaauacagcaaaauuguuaccuauaaacauccaaagacgacaagaucaucuuuaaggaccacauuuuccuuaacagcauuuugcuuucgaagucuuauauaaguaaaaaccuaaaaucgucugccuggaacucuuaagauauucaggugagucacugggguggcaaaguugaagcucaugaguugccuacuaccugccuaaggcccuccuagccgaaaaccacaccugcacccccugagcuccgucccucuccugccucaccuuccaucucuccgaacacuucuuggagaauucc

SEQ ID NO: 164818 - RNA, 54 nt, Homo sapiens
gcgaaauugacggaagaguccggguguuucuucuugugcucuucccggcagguc

SEQ ID NO: 164819 - RNA, 68 nt, Homo sapiens
gccuggugcgagcuuuuccucagagucccgcagagcggccggacccaacggagacgcuucccucacgg

SEQ ID NO: 164820 - RNA, 42 nt, Homo sapiens
gacgacgacgacaucuccgcggcccugacgcuuggcagcucc

SEQ ID NO: 164821 - RNA, 29 nt, Homo sapiens
uuguuguucauuugaaguggcaucuauaa

SEQ ID NO: 164822 - RNA, 45 nt, Homo sapiens
uacaaaugugaagaauguggcaaagcuuuuaaccauuucucagac

SEQ ID NO: 164823 - RNA, 42 nt, Homo sapiens
ggucaucaaaacuuacuguacauaagguaauucauacuggag

SEQ ID NO: 164824 - RNA, 47 nt, Homo sapiens
caauuccucaauccuugcuaaacauaagauaauucauacugggaaga

SEQ ID NO: 164825 - RNA, 70 nt, Homo sapiens
aaaugugaagaauguggcaaagcuuuuagccauuucucagcccuuagaagacauaagauaauucauacug

SEQ ID NO: 164826 - RNA, 47 nt, Homo sapiens
aagcauuucucagcccuuagaaaacauaagguaauucauacuaggga

SEQ ID NO: 164827 - RNA, 45 nt, Homo sapiens
caauccucaucccuuagaaaacaugagauaauucauaguggagag

SEQ ID NO: 164828 - RNA, 45 nt, Homo sapiens
gguaaagcuuuuaagugguugucaaaacuuacuguacauaaggua

SEQ ID NO: 164829 - RNA, 45 nt, Homo sapiens
ggcaaagcuuuuaaugauuccucaacccuuaugaagcauaagaua

SEQ ID NO: 164830 - RNA, 45 nt, Homo sapiens
aaugcgaagaauguggcaaagauuuuaacaauuccucaacccuua

SEQ ID NO: 164831 - RNA, 46 nt, Homo sapiens
gugugcgcgcgccagggcgcgcggcccggggaggggccucgcaagg

SEQ ID NO: 164832 - RNA, 30 nt, Homo sapiens
cuuguuguucauuugaaguggcaucuauaa

SEQ ID NO: 164833 - RNA, 331 nt, Homo sapiens
cuccuuugcagacauggucuguggacauaaaauaagagccaaaaauacagcaaaauuguuaccuauaaacauccaaagacgacaagaucaucuuuaaggaccacauuuuccuuaacagcauuuugcuuucgaagucuuauauaaguaaaaaccuaaaaucgucugccuggaacucuuaagauauucaggugagucacugggguggcaaaguugaagcucaugaguugccuacuaccugccuaaggcccuccuagccgaaaaccacaccugcacccccugagcuccgucccucuccugccucaccuuccaucucuccgaacacuucuuggag

SEQ ID NO: 164834 - RNA, 45 nt, Homo sapiens
gaggacauuuugccccgcggcuuguuggggucuccuuuacccaug

SEQ ID NO: 164835 - RNA, 49 nt, Homo sapiens
caggucgggauggggugccaguggcaacucccccugacuccuaaauuga

SEQ ID NO: 164836 - RNA, 42 nt, Homo sapiens
ugucgauccuggagcccccgcaccgguaccacauccaccggc

SEQ ID NO: 164837 - RNA, 44 nt, Homo sapiens
gggcgagggcggcugagcggcuccaucccccggccugcucaucc

SEQ ID NO: 164838 - RNA, 46 nt, Homo sapiens
aaucaagguccugauuuccacugcugugcuccuccugcagucuuuc

SEQ ID NO: 164839 - RNA, 34 nt, Homo sapiens
gacaccugcugagagaggcccaggaugguggagg

SEQ ID NO: 164840 - RNA, 46 nt, Homo sapiens
ugagcaccauccccugcaggaugccuggggcacccaccuucaccag

SEQ ID NO: 164841 - RNA, 46 nt, Homo sapiens
gccuugaggugcagcgugugccgcagguccugcaggugugugaggu

SEQ ID NO: 164842 - RNA, 83 nt, Homo sapiens
gugggugaugccaagauccucugagcucugccugcuucaucaggaagacggagaucaaaacuuaaggaaaugaaaaaggaucu

SEQ ID NO: 164843 - RNA, 37 nt, Homo sapiens
gccuuuuaaaccugccuccccggcgaucaccuggaga

SEQ ID NO: 164844 - RNA, 52 nt, Homo sapiens
cagugcuuggcgcagacuaguuguucaguaaguggcagaggcuuauuuugag

SEQ ID NO: 164845 - RNA, 46 nt, Homo sapiens
uggaccccgagcggcaugagagacuccgggagaagaugaggcggcg

SEQ ID NO: 164846 - RNA, 55 nt, Homo sapiens
accaagugcuagaaagagacgaaccaaaccuaaauaauaugaaguuucugccuuc

SEQ ID NO: 164847 - RNA, 45 nt, Homo sapiens
gaggggcccaggagagcccauaagcucccuccaccccacucucac

SEQ ID NO: 164848 - RNA, 47 nt, Homo sapiens
cagugucuguugagggguuuguuguacuuuggccaacaagcaucacc

SEQ ID NO: 164849 - RNA, 162 nt, Homo sapiens
aaggcuggcucaacccaaggcuggaaugcuuagggcagcugcucuacucuguaaaaagugggaaagcugggcauaguggcacgugccuguagucccggcuacuugagaagcugaggcaggaggauggcuugagcccuggcguuugagagcagugagacucag

SEQ ID NO: 164850 - RNA, 51 nt, Homo sapiens
gugaagcuguccaagcuggaggugccacaggagaucaaggacgugauugag

SEQ ID NO: 164851 - RNA, 42 nt, Homo sapiens
ggcuuggugccaggccuccacuucuacacccucaaccgcgag

SEQ ID NO: 164852 - RNA, 43 nt, Homo sapiens
gucugugccauggcuagcugggcacaucgaaggcuccagucuc

SEQ ID NO: 164853 - RNA, 42 nt, Homo sapiens
ccgagaggaagauguacgucccaucuucugggccuccagacc

SEQ ID NO: 164854 - RNA, 18 nt, Homo sapiens
ugucuauucugagccuug

SEQ ID NO: 164855 - RNA, 49 nt, Homo sapiens
ucuguagaaucugggacugggcaaauguuuguguggccuccuuaaacua

SEQ ID NO: 164856 - RNA, 42 nt, Homo sapiens
uugcaaacggauuggccuaaucaagaaguucaaccuggagag

SEQ ID NO: 164857 - RNA, 46 nt, Homo sapiens
aagcugaggauggccaugcccacgccaaagcggcccguguccguga

SEQ ID NO: 164858 - RNA, 64 nt, Homo sapiens
augagcacuuccacgucucccucccagcuccugcagggugugcaauccuuaugccuauuguaca

SEQ ID NO: 164859 - RNA, 89 nt, Homo sapiens
acggugcugggacccggggggcaagcccagucccugaccccgcgcgggggaggugagccgccuacaagccccucccgcgcaccuuccuc

SEQ ID NO: 164860 - RNA, 56 nt, Homo sapiens
augcugggaccggcgcugcccgcugggagggucugaguccgggagggggcggcccu

SEQ ID NO: 164861 - RNA, 40 nt, Homo sapiens
guucaacccuaccagcuugugguaacuuacugucacauag

SEQ ID NO: 164862 - RNA, 34 nt, Homo sapiens
gcauggggugggcagugaggucccuguaccagcg

SEQ ID NO: 164863 - RNA, 44 nt, Homo sapiens
uagaggauauguuugcauggcaaauugauuucaaugguggggac

SEQ ID NO: 164864 - RNA, 46 nt, Homo sapiens
ccguggccgacuggaaaaucuucuacuuccuacggagccugcauag

SEQ ID NO: 164865 - RNA, 47 nt, Homo sapiens
uauggacucuucaaaaaugucaauuacaagaaagaccaaaagacuag

SEQ ID NO: 164866 - RNA, 43 nt, Homo sapiens
caggagacgggggacuuccugaggccacauacugaaucuaaca

SEQ ID NO: 164867 - RNA, 29 nt, Homo sapiens
gaaacaggagugaaggugaguaugggagg

SEQ ID NO: 164868 - RNA, 43 nt, Homo sapiens
uuucagagggagagauacauucugggaaggagaacuugcagag

SEQ ID NO: 164869 - RNA, 46 nt, Homo sapiens
accacacuuugaagauguuaucaacaaaguggaucuuguccugaau

SEQ ID NO: 164870 - RNA, 49 nt, Homo sapiens
agcaccuguguccugagauacgcugccugagacagagagagucccucau

SEQ ID NO: 164871 - RNA, 39 nt, Homo sapiens
uagauuugguaagggggauggaggguggccccggggaug

SEQ ID NO: 164872 - RNA, 53 nt, Homo sapiens
aauccaggcaagcgauguuugguggcuuguaucuagcgggugguaguggaaga

SEQ ID NO: 164873 - RNA, 56 nt, Homo sapiens
uuuuaaaagaauugcucuggguaagguauugagaauggaucaaggggaguggggca

SEQ ID NO: 164874 - RNA, 46 nt, Homo sapiens
ugucuggcuccuuucucuacacaggagguaagauuuggccuguccu

SEQ ID NO: 164875 - RNA, 42 nt, Homo sapiens
ucucagguccugggggagaagauuaacauccugucgggagag

SEQ ID NO: 164876 - RNA, 93 nt, Homo sapiens
gucucucauggaugccggcacaaaacugccuuaaaauauucauaguuaauacagguauaucuauuuuuauuuacuuuguaagaaacaagcuca

SEQ ID NO: 164877 - RNA, 39 nt, Homo sapiens
aaaaaaaucauauguaccaaggauguuacaguaaacagg

SEQ ID NO: 164878 - RNA, 91 nt, Homo sapiens
cagaagacuucaagccuuaaaaggaggcugccguggagcacggauacagaaacugagacacguggagacuggaugagggcagaugaggaca

SEQ ID NO: 164879 - RNA, 79 nt, Homo sapiens
cgcuacgcugaguauagccacuuuguuuugggcaaugaacucaacagcuaucgccucuuccuggggaacuacacuggca

SEQ ID NO: 164880 - RNA, 45 nt, Homo sapiens
accggcucuccagacagccaacccggcugcguguagagauggagg

SEQ ID NO: 164881 - RNA, 41 nt, Homo sapiens
cauggagacuucaggcggaggcuggaccaucauccagagac

SEQ ID NO: 164882 - RNA, 41 nt, Homo sapiens
ugccaaccuuagcagccugcugagugaacugaacaagaagc

SEQ ID NO: 164883 - RNA, 44 nt, Homo sapiens
acucaagcuuugagaaaggcuagcaaagagcaaggaaagagaga

SEQ ID NO: 164884 - RNA, 47 nt, Homo sapiens
ccugcggggccaucauccuggccaagcucuccauucucccugugcac

SEQ ID NO: 164885 - RNA, 41 nt, Homo sapiens
gcggggccggaggcggcggggccgucggggccgggcuccau

SEQ ID NO: 164886 - RNA, 48 nt, Homo sapiens
accguccaacaccagcacguugccauaggucuuacugcgggcggagug

SEQ ID NO: 164887 - RNA, 41 nt, Homo sapiens
ugcugguguuggacggugucauccagugcacggagagagac

SEQ ID NO: 164888 - RNA, 45 nt, Homo sapiens
caggggacacugggguaccuuucgcggguugggguggcugcagag

SEQ ID NO: 164889 - RNA, 45 nt, Homo sapiens
aggcauccugauucuguuucaugaacucaaaaccgucacccacau

SEQ ID NO: 164890 - RNA, 43 nt, Homo sapiens
ggccccgccgaaagucucuucaaggaguccuauuaccagcuca

SEQ ID NO: 164891 - RNA, 129 nt, Homo sapiens
uccaggugcagccacuggcacucgccugggggccccuaagcaucagcauccggcagggccugcccugccccaccccgccccgccccagugcuccaggccuguggcucacccuggcagcagaggacacca

SEQ ID NO: 164892 - RNA, 45 nt, Homo sapiens
guggccuaugccuacugcaccauccccaccuaccccagcggccag

SEQ ID NO: 164893 - RNA, 76 nt, Homo sapiens
gaacuuccaggagccggugcagccgcugacacagcagcagguggcgcagaugcagcugaaguacuacaacuccgac

SEQ ID NO: 164894 - RNA, 34 nt, Homo sapiens
caccacugaugccacccaggaccucggaccuugg

SEQ ID NO: 164895 - RNA, 42 nt, Homo sapiens
cggacugucugugugucugucucucuggcguuccaccuccaa

SEQ ID NO: 164896 - RNA, 76 nt, Homo sapiens
gguugcuccuacccauucaguggccugagcagugggagcugcagaccagucuuccauggcaggcugagcacuccug

SEQ ID NO: 164897 - RNA, 44 nt, Homo sapiens
guguucacgagaaauggugccacgcaugcgcagaacuucccgag

SEQ ID NO: 164898 - RNA, 46 nt, Homo sapiens
uagguuaacauaagaugccuccgugagaggcugguggucagcccug

SEQ ID NO: 164899 - RNA, 65 nt, Homo sapiens
aucuggaagucaagauuggugccaccuaaguggguuccugcuacaaggaacuuaaggacauccuc

SEQ ID NO: 164900 - RNA, 31 nt, Homo sapiens
uuucuuuaaaaaaaaagacuagaauaacaca

SEQ ID NO: 164901 - RNA, 57 nt, Homo sapiens
uccacagaccaggacauuccaugugccucauggcacugccaccuggcccuuugcccu

SEQ ID NO: 164902 - RNA, 85 nt, Homo sapiens
cacaccuaugaacucuuggccaaaccagggcaguuuauccacaccaacuggacaggccaugguggcaccgugucauccucgucau

SEQ ID NO: 164903 - RNA, 45 nt, Homo sapiens
uuuuaccacugcccucuccuucuaugacggguacagacaugagau

SEQ ID NO: 164904 - RNA, 48 nt, Homo sapiens
auuccuaggaaagauaaaggaugcauuugaucgaaacccggaacuuca

SEQ ID NO: 164905 - RNA, 51 nt, Homo sapiens
uuuggcuggacucucaauuaugguggcaucgcccugauguggagagggggc

SEQ ID NO: 164906 - RNA, 52 nt, Homo sapiens
uuggcccuucugggaucuccacugcugaugagaauaagacugguagacauaa

SEQ ID NO: 164907 - RNA, 104 nt, Homo sapiens
ggagaagcugucuuugcucggugcuuaucaucucugaaggaugagagaauucaagcuagcaaaaagcugaaggguccccagaaguuccaguuugauggugauaa

SEQ ID NO: 164908 - RNA, 47 nt, Homo sapiens
uaaaguccucuguuaguucccugagauuuuacuucauuuugucuaug

SEQ ID NO: 164909 - RNA, 40 nt, Homo sapiens
caccugcugccaaagaucagggacagcgcggggcagaagg

SEQ ID NO: 164910 - RNA, 51 nt, Homo sapiens
cgagcagagccugcuggcaaccgugagcauuggucagcguggacauuggac

SEQ ID NO: 164911 - RNA, 42 nt, Homo sapiens
auaccaccugaugaaagacgugcugggcauggcgcaggacga

SEQ ID NO: 164912 - RNA, 44 nt, Homo sapiens
gagggagcaggccacuucgugaagauggugcacaacgggauaga

SEQ ID NO: 164913 - RNA, 44 nt, Homo sapiens
ucucauuaacugaaccacacuguuucuuuacacaggccccacau

SEQ ID NO: 164914 - RNA, 51 nt, Homo sapiens
agaccucaaggccaagggaauuuuauuuguggggagcggagucaguggugg

SEQ ID NO: 164915 - RNA, 42 nt, Homo sapiens
ggugacaucaucauugacggaggaaauucugaauauagggac

SEQ ID NO: 164916 - RNA, 41 nt, Homo sapiens
uaauguuaacuggagccuuguagggggaagauugaauaaua

SEQ ID NO: 164917 - RNA, 20 nt, Homo sapiens
gauagcucaggggaggcuga

SEQ ID NO: 164918 - RNA, 23 nt, Homo sapiens
gcaaagggaaccaaagugguggg

SEQ ID NO: 164919 - RNA, 40 nt, Homo sapiens
cgcucuucgguucugcucuguccgccgccauggcccagug

SEQ ID NO: 164920 - RNA, 66 nt, Homo sapiens
cugaaaguugaaaacccugagaaauacggcuuugaaccaaagaagcuguuggaccaacugacggau

SEQ ID NO: 164921 - RNA, 67 nt, Homo sapiens
uggaccccgauuggcugcaaugcugaacuuuaaucuucagcaacuuuguggccccaagugccgugac

SEQ ID NO: 164922 - RNA, 47 nt, Homo sapiens
aaggcguuaaggagagauccuucuguucucgagaccacggcgggagg

SEQ ID NO: 164923 - RNA, 48 nt, Homo sapiens
ccagucgccccacagacuacuacagccgcuuguucccugagcagccuc

SEQ ID NO: 164924 - RNA, 44 nt, Homo sapiens
aagacaacccuguagcagcagcaguggcggccaaaggaggcugc

SEQ ID NO: 164925 - RNA, 45 nt, Homo sapiens
cuuauuacccucugcuucccagguuacccagcuaggcagcgcggu

SEQ ID NO: 164926 - RNA, 54 nt, Homo sapiens
uuuugaugaauaauacuugguggggcgagggggaaagaguagggguggaggggu

SEQ ID NO: 164927 - RNA, 48 nt, Homo sapiens
gcugcuggagguggaagugauagagggcacccugcagugcccggaauc

SEQ ID NO: 164928 - RNA, 48 nt, Homo sapiens
ugccguguguauccccaacccuugacccaaugacaccaaacacacagu

SEQ ID NO: 164929 - RNA, 49 nt, Homo sapiens
gcacaugucacaguuaaaacauuucacuggggaaaguuuaaaaauucua

SEQ ID NO: 164930 - RNA, 42 nt, Homo sapiens
ccagcgaguggaacaucucggucgcacucucauugguuccag

SEQ ID NO: 164931 - RNA, 35 nt, Homo sapiens
accuacgugccggacuucaaguucccgcguggggu

SEQ ID NO: 164932 - RNA, 75 nt, Homo sapiens
caaggaagaggcgugcucuccgcccuuaccuuuuccaagccucuggguuugacgccaucccucaaggcguguccg

SEQ ID NO: 164933 - RNA, 101 nt, Homo sapiens
gaugcgggauuuuccucaaagacccucucggccucgcuaggaagaaacucagaaaggcugcgguaggcgcagucgagggggaaagugcccccgcccuugau

SEQ ID NO: 164934 - RNA, 49 nt, Homo sapiens
uauagcaaauaaaauuacuuguuaaugguuuccuuuuuuccagcaucuc

SEQ ID NO: 164935 - RNA, 42 nt, Homo sapiens
aaggaggcugguggcuggagugggaagaacagggggacgaca

SEQ ID NO: 164936 - RNA, 49 nt, Homo sapiens
cuuauuaaaccaagucuaaauguuuaaaaugaggaagcugagauagguu

SEQ ID NO: 164937 - RNA, 42 nt, Homo sapiens
cagcaacaagcaaaggauaggcucuacuccguucucagugga

SEQ ID NO: 164938 - RNA, 52 nt, Homo sapiens
uaguaaaacacacugacuugaauuucauuuucuccuuaggcccucucacucu

SEQ ID NO: 164939 - RNA, 54 nt, Homo sapiens
gacaacaccgugcuccucgaccccccacugaucgcgcuggauaaagaugcgccu

SEQ ID NO: 164940 - RNA, 46 nt, Homo sapiens
cagugguaguggauaaauccacuggugagggagucauucgcuccaa

SEQ ID NO: 164941 - RNA, 44 nt, Homo sapiens
gcagaaagacuauucauucaccauccaggccuaugauuguggga

SEQ ID NO: 164942 - RNA, 46 nt, Homo sapiens
aacuguucauauucaggugaacgacgugaaugaguacgcgcccgug

SEQ ID NO: 164943 - RNA, 68 nt, Homo sapiens
gguggaggccguggaugccgacugcuccccucaguucagccagauuugcagcuacgaaaucaucacuc

SEQ ID NO: 164944 - RNA, 45 nt, Homo sapiens
agguuauauaaaaaacacagagaaauuaaacuacgggaaagaaca

SEQ ID NO: 164945 - RNA, 57 nt, Homo sapiens
cugaccgucacugccuaugacugugggaagaaaagagccacagaagauguuuuggug

SEQ ID NO: 164946 - RNA, 44 nt, Homo sapiens
acaggauggaacaacaggauugaguaugagccgggcaccggcgc

SEQ ID NO: 164947 - RNA, 28 nt, Homo sapiens
cacaguggagcuagaaaccagccacaua

SEQ ID NO: 164948 - RNA, 41 nt, Homo sapiens
ccacgugucgcaugaaacgccccaguugcauuuugguccug

SEQ ID NO: 164949 - RNA, 60 nt, Homo sapiens
guuuugguuuucguuguaacaucugcacuucucagcaauccucaggaggaggcaggaagg

SEQ ID NO: 164950 - RNA, 50 nt, Homo sapiens
acagccauguggaacccagccagcugagaaggcaguggcuggagaggcug

SEQ ID NO: 164951 - RNA, 63 nt, Homo sapiens
uauaccugcaaggaggggcuggaccugcagguccucgaagacaguggcagaggcgugcaggua

SEQ ID NO: 164952 - RNA, 67 nt, Homo sapiens
ccaagcacaccccagccaguugguauugaccuuggagggagaagaccucggggaauuggauaaggcc

SEQ ID NO: 164953 - RNA, 77 nt, Homo sapiens
augcagcacaucucguaccugaacucccggcaguuccccacgcccggaauucgcagacucaaaaucaccagcacaau

SEQ ID NO: 164954 - RNA, 103 nt, Homo sapiens
cauuucgguccccccgguagauggcuacgugaugguuuuacagcccgaggagcccaagaucagccugaguggcguccaccauuuugcccgagcagcuucugaa

SEQ ID NO: 164955 - RNA, 50 nt, Homo sapiens
cccugagcuucgcaucaucagcaccaucacgagagaaguggagccugaag

SEQ ID NO: 164956 - RNA, 48 nt, Homo sapiens
gaccuggauaccugugaggucacgguggagggagaggagcugaaccac

SEQ ID NO: 164957 - RNA, 48 nt, Homo sapiens
cuugcuugaccggaaguuuaagcucaucugcucagagcugaauggccg

SEQ ID NO: 164958 - RNA, 65 nt, Homo sapiens
agccacaguucgugcacccggaacaccgcuccuuuguugaccugucaggccacaaccuggccaac

SEQ ID NO: 164959 - RNA, 68 nt, Homo sapiens
gaucguggugugcgucagcuuccugguguucaugauuauccuggggguauuucggauccgggccgcac

SEQ ID NO: 164960 - RNA, 91 nt, Homo sapiens
aucggcggaccaugcgggaucaggacaccgggaaggagaacgagauggacugggacgacucugcccugaccaucaccgucaaccccaugga

SEQ ID NO: 164961 - RNA, 69 nt, Homo sapiens
gcagugaggaggaggaggaagaggaagaggaagaggaaagcgaggacggcgaagaagaggaugacauca

SEQ ID NO: 164962 - RNA, 66 nt, Homo sapiens
ccagcgccgagucggagagcagcgaggaggaggagggggagcagggcgacccccagaacgcaaccc

SEQ ID NO: 164963 - RNA, 46 nt, Homo sapiens
ucccaaggguccacgauguacaaagucauuucggccaguaggugug

SEQ ID NO: 164964 - RNA, 38 nt, Homo sapiens
ccugcugguaaaaggagaaacugagagguguccugcag

SEQ ID NO: 164965 - RNA, 49 nt, Homo sapiens
cccgucccuguagcugcucuguuuagacagcggacagacgcucacgccc

SEQ ID NO: 164966 - RNA, 46 nt, Homo sapiens
cgccgcgcgguuucccuucgcagauguguauacucaugauagguca

SEQ ID NO: 164967 - RNA, 81 nt, Homo sapiens
cuggaggaucugaggcaggagaagacgagaccugaccuauauuggggaucgaccccuggucuuggggggagaaugggugca

SEQ ID NO: 164968 - RNA, 52 nt, Homo sapiens
acaaccaggguggacacugggaggaaagacccccuguaaacuuggcucccac

SEQ ID NO: 164969 - RNA, 44 nt, Homo sapiens
gauccggcagcugcccugggcucaccuugcagacagcucugcag

SEQ ID NO: 164970 - RNA, 41 nt, Homo sapiens
auggggccaaguccagguagagaagggcaagcgccggcccg

SEQ ID NO: 164971 - RNA, 47 nt, Homo sapiens
ccucggccccgcagagagcuucuggcacuaaauacacauucagagag

SEQ ID NO: 164972 - RNA, 41 nt, Homo sapiens
ugcugcaggccgcugaccaggcugaccaggcuacugacuac

SEQ ID NO: 164973 - RNA, 37 nt, Homo sapiens
aaaccuccaggcuuaagcacuaaaaacuuccuauaaa

SEQ ID NO: 164974 - RNA, 43 nt, Homo sapiens
uugugauucuuaaccauuagcauucucugagucuuaccacugg

SEQ ID NO: 164975 - RNA, 52 nt, Homo sapiens
gagaggaaagagucauguccuaacagaaagucgaacagaaagauuaaacuau

SEQ ID NO: 164976 - RNA, 28 nt, Homo sapiens
aaaugagcucgcccuaacccagcaaagu

SEQ ID NO: 164977 - RNA, 45 nt, Homo sapiens; identical to SEQ ID NO: 83420

SEQ ID NO: 164978 - RNA, 25 nt, Homo sapiens
gcaaauuguuuaaaaagaagaaaaa

SEQ ID NO: 164979 - RNA, 38 nt, Homo sapiens
gggggacguuuagaggcguggcacuaggagugcacauc

SEQ ID NO: 164980 - RNA, 27 nt, Homo sapiens
gggccggcagagcuuuggagcucuggc

SEQ ID NO: 164981 - RNA, 48 nt, Homo sapiens
gccagagcuccaaagcucugccggcccuggugccacugccaccucugc

SEQ ID NO: 164982 - RNA, 55 nt, Homo sapiens
agcagcccggagugucuagcugcccugggguugugcugugugcgugucugguggc

SEQ ID NO: 164983 - RNA, 38 nt, Homo sapiens
guguggccgaggcagggugugcagccuggguuucagag

SEQ ID NO: 164984 - RNA, 62 nt, Homo sapiens
cuggggugugggccauggcccagggguggcuucuagccacacuugcuccccaggggcccauc

SEQ ID NO: 164985 - RNA, 44 nt, Homo sapiens
cccaaaggcgugcggccgcugggcccggggacaggccgaggucc

SEQ ID NO: 164986 - RNA, 35 nt, Homo sapiens
agcccauucuggccaccagagcccacuuggcccca

SEQ ID NO: 164987 - RNA, 46 nt, Homo sapiens
gcagaagaaggacuugcagagccacaugaucaaacuucauggagcc

SEQ ID NO: 164988 - RNA, 44 nt, Homo sapiens
ucugcaagccccagcuguucacgguugccaccuuccugagagga

SEQ ID NO: 164989 - RNA, 46 nt, Homo sapiens
uccccuugaggacaagaaacccgaggacugcaaagugcccccaagg

SEQ ID NO: 164990 - RNA, 42 nt, Homo sapiens
agguauuugguuuuaccaucagccaaggccagccugcccaag

SEQ ID NO: 164991 - RNA, 42 nt, Homo sapiens
gcaguuuucagauguucuagcaacacaauggaacacugagga

SEQ ID NO: 164992 - RNA, 79 nt, Homo sapiens
ccagauuaaaccugaauauuuagccuugaggucuguuggcaucagaagagagaaaaaaaggaaaggccuucaguuaacu

SEQ ID NO: 164993 - RNA, 48 nt, Homo sapiens
ccuguggugaguaauacacauugaucacccugaaugucuguccaccag

SEQ ID NO: 164994 - RNA, 24 nt, Homo sapiens
aaaucccacuucaugacaaaaacc

SEQ ID NO: 164995 - RNA, 68 nt, Homo sapiens
auuaugccugcgugucacaugaaaucuuuacugugugauuauccuuucuacugaguaaagcuaguuag

SEQ ID NO: 164996 - RNA, 45 nt, Homo sapiens
ccaaauagucaacgcagggaagacugcaaauuuuuaaaaaagaaa

SEQ ID NO: 164997 - RNA, 77 nt, Homo sapiens
agucuucccugcguugacuauuuggaaugugaucugggacagacagaauuuaccccuccugguugcauuucuuugcu

SEQ ID NO: 164998 - RNA, 55 nt, Homo sapiens
gaagaugguauauuaugggaaaccuucuuguaaaaacaacuaugagaauuauauu

SEQ ID NO: 164999 - RNA, 72 nt, Homo sapiens
gacauagugaaauauguguucagcgcuuacaagagagaguccccucucaucgucaacacuaugggauggguu

SEQ ID NO: 165000 - RNA, 45 nt, Homo sapiens
gucagagcggaacugaaccacguggcugggagacagcaaucggau

SEQ ID NO: 165001 - RNA, 33 nt, Homo sapiens
agaugacauggauggcuuguacacaaaaagcaa

SEQ ID NO: 165002 - RNA, 46 nt, Homo sapiens
gggcaucgggggcugcagcuggcuaagguaacucaagauggacaga

SEQ ID NO: 165003 - RNA, 45 nt, Homo sapiens
aguauauggguaggggcgacaucagaguggguaauccggagugcg

SEQ ID NO: 165004 - RNA, 42 nt, Homo sapiens
aaagcccaagcagucacagauuggagucugggcaagcaggau

SEQ ID NO: 165005 - RNA, 45 nt, Homo sapiens
acauggagaagcggcuguaccacauccucaccccugugcccccgg

SEQ ID NO: 165006 - RNA, 45 nt, Homo sapiens
caacgagcagacaauucacgguccuuagcucuuccgggggcacag

SEQ ID NO: 165007 - RNA, 46 nt, Homo sapiens
ggauuacaauuuuaaacuuccuggagcaucagagaaaauuggagca

SEQ ID NO: 165008 - RNA, 46 nt, Homo sapiens
guaaaacagcagagaacaguuugugugccauuaaaacagagauucc

SEQ ID NO: 165009 - RNA, 48 nt, Homo sapiens
aaaaugugaagaaggaggagaagaggaaggcuagaagccugagcaagu

SEQ ID NO: 165010 - RNA, 411 nt, Homo sapiens
aguacaggugagcaccuggccagcgugggucccucaggcuacuugggcucccacccuccaucacuguuccagcuuuggagccuggccccuaguccaagcuucucauuuggugcagcccuggagacugaccacagaucacuugggugcuucaguaguuauucaugucagcccuguuuacccugugacacucuugagggcgcugaggccaagggagaugggccuagauugagucugugaugagcugagaccuucccucccagauaccccuccucgacacccugcuucucuggccugaggggaugaggcuuaccugggcugggcagggcagacuguggcuuaacugccuacccccacccccucucucuuggucagcacccgcuuggcugugcugagcagcagccugacccauug

SEQ ID NO: 165011 - RNA, 30 nt, Homo sapiens
auccugccgcugcugggccgggaggugagc

SEQ ID NO: 165012 - RNA, 42 nt, Homo sapiens
aguccccaaaucagcagccugugcuagggaccagagcaccgg

SEQ ID NO: 165013 - RNA, 56 nt, Homo sapiens
acucagacaucugaggagagggugcugcucugcuagggcuggugucucugaggaga

SEQ ID NO: 165014 - RNA, 47 nt, Homo sapiens
cugggaaacuagggaguggugaucagcgagggggcggccuggcuaca

SEQ ID NO: 165015 - RNA, 45 nt, Homo sapiens
gcagggaggcuggugggcaggggagagggagcggggcuuccagga

SEQ ID NO: 165016 - RNA, 45 nt, Homo sapiens
auaaaaagaagaagaagaaacucaaggacaagaaggagaaaaaag

SEQ ID NO: 165017 - RNA, 45 nt, Homo sapiens
cucuccuccugaccaaguccugggcaucgcuugggaccacugaga

SEQ ID NO: 165018 - RNA, 45 nt, Homo sapiens
ggcauggcuagguguccucccucggcuggccgggggcaguaagca

SEQ ID NO: 165019 - RNA, 46 nt, Homo sapiens
gguacauaucaaaagcuaagucaucuagcggagagauauagucaga

SEQ ID NO: 165020 - RNA, 45 nt, Homo sapiens
cggcacgauacugcuccaucugcugcuucuucuccuuggcgagau

SEQ ID NO: 165021 - RNA, 42 nt, Homo sapiens
gaggcaguugucagcagccgccaguucacugagcaggggcag

SEQ ID NO: 165022 - RNA, 40 nt, Homo sapiens
guaaaggaggugcuuagaguccgggcuggcucaggccggc

SEQ ID NO: 165023 - RNA, 362 nt, Homo sapiens
auccuacgaaguccacguugauuucuuuuuugguuuuuuucgagacagagucuugcucugucacccaggcuggagugcuguggcgugaucucagcucacugcaaccucugccucccggguucaagcaauucuccuugcucauccucccaaguagcugggauuacaggugcccaccaccacgcccagcuaauuuuuuuuuguaguuuuaguagagacgggguuucaccauauuggcuaggccagucuugaacuccggaccucaggugauccgccugccucguccucccaaauugcugggaugacaggcaugagccaccacgccuggccaguacauguugauuucauccccacucugcagauga

SEQ ID NO: 165024 - RNA, 60 nt, Homo sapiens
ggcaugaccuccacgccuuggcacaaaaacccagccaggaggaacgacggcugggcaggc

SEQ ID NO: 165025 - RNA, 29 nt, Homo sapiens
gggagcuaguggcccggggcucaguuacu

SEQ ID NO: 165026 - RNA, 50 nt, Homo sapiens
gugccaaccaagucuggcugccugccgagcaccagcuggagagauugaug

SEQ ID NO: 165027 - RNA, 50 nt, Homo sapiens
auuaacccaaguuguguuaauacuucaggucuguuucccagacccagaaa

SEQ ID NO: 165028 - RNA, 47 nt, Homo sapiens
ggccguggagggcaauguccgcaggauggagcgucugcggguggaga

SEQ ID NO: 165029 - RNA, 56 nt, Homo sapiens
cagcuuccgggguuuccaauccuccuuagaacaacuggacucaagccuuuuccuga

SEQ ID NO: 165030 - RNA, 55 nt, Homo sapiens
guguguaugugugcugugcguauaugccccauacauguguguuguguguauacau

SEQ ID NO: 165031 - RNA, 38 nt, Homo sapiens
gagagagcugcuggggccgcaggggguccuggcugcag

SEQ ID NO: 165032 - RNA, 63 nt, Homo sapiens
aaagaagaggcagcaccaccgugcccugcagccaggacccccugcggccccagcagcucucuc

SEQ ID NO: 165033 - RNA, 46 nt, Homo sapiens
gccuacuauucaacgguacagcacaaagucgccaaggugcggucuu

SEQ ID NO: 165034 - RNA, 47 nt, Homo sapiens
cuaugagauuucaguucaagaagagaucacugcucgacugcacuuca

SEQ ID NO: 165035 - RNA, 46 nt, Homo sapiens
agccugccuggacuucaucaaagaccaucucgucaacacagagacc

SEQ ID NO: 165036 - RNA, 40 nt, Homo sapiens
aagggggacaggccaguguuguccagaaaccccuugaucu

SEQ ID NO: 165037 - RNA, 45 nt, Homo sapiens
agacucuguggaugcagccgagagggcggagaaguuccggcagaa

SEQ ID NO: 165038 - RNA, 41 nt, Homo sapiens
cgugauguuggcauucggaccccagcucgcugggggugggu

SEQ ID NO: 165039 - RNA, 41 nt, Homo sapiens
auguccagggaccaccucucagaaaaggaggcggggagcgg

SEQ ID NO: 165040 - RNA, 60 nt, Homo sapiens
ccgugccccaccccacccagcacgcacucauucaguccauugccuuaacacaagccugau

SEQ ID NO: 165041 - RNA, 41 nt, Homo sapiens
cccucgcagccacucggagacuuaccaagugcuccccaaac

SEQ ID NO: 165042 - RNA, 65 nt, Homo sapiens
gagagugucgcugucaacgagugugugucagcaagugugugagugugagcacauguguaugagug

SEQ ID NO: 165043 - RNA, 45 nt, Homo sapiens
gggcuggaagaucacacagaacugcagcguuuccaggggcaggau

SEQ ID NO: 165044 - RNA, 31 nt, Homo sapiens
accccagggguaaaugcagguggcguggagc

SEQ ID NO: 165045 - RNA, 89 nt, Homo sapiens
agacacucuugggagaugcauuuuccgucuggcucacagggggagggugaggcuuugcaccccagccccugcccaggccacugugaggg

SEQ ID NO: 165046 - RNA, 52 nt, Homo sapiens
agaauguauuuugacaaguauguucuuaagccggccacagaaggaaagcagu

SEQ ID NO: 165047 - RNA, 48 nt, Homo sapiens
ccaucaaugaccgcaucaaugagaugguccacuucgaccugccagggc

SEQ ID NO: 165048 - RNA, 45 nt, Homo sapiens
cgagcagauccgggcgcaggcugaggagaggaggaagacccugag

SEQ ID NO: 165049 - RNA, 71 nt, Homo sapiens
aaggcguggccagauggguagauggguuuguugggugguugcuagcaguuuccacguaacaagggaagcgu

SEQ ID NO: 165050 - RNA, 41 nt, Homo sapiens
gccgagggcggcggggaccgcggguugggagaccggccggc

SEQ ID NO: 165051 - RNA, 29 nt, Homo sapiens
gggugccuagccaggugcaguccccgccc

SEQ ID NO: 165052 - RNA, 41 nt, Homo sapiens
agcccuagcugggagccgcagaaggagaggcuggguugaga

SEQ ID NO: 165053 - RNA, 45 nt, Homo sapiens
ugcacaucauuguccaagagcugaggggcuccauucucgguaugc

SEQ ID NO: 165054 - RNA, 55 nt, Homo sapiens
accgaguuccccuucggccagcacagcucgggugaggcugcccaggaugcggugc

SEQ ID NO: 165055 - RNA, 40 nt, Homo sapiens
agcccagagagagcccuagaucccauggccagugugcagu

SEQ ID NO: 165056 - RNA, 44 nt, Homo sapiens
ggggaggggcgguguagggggcaucagccuccaccccggaggug

SEQ ID NO: 165057 - RNA, 30 nt, Homo sapiens
cucgagggugagccugugccccgugggcgg

SEQ ID NO: 165058 - RNA, 33 nt, Homo sapiens
ccuugaucuccagcucaucaucuaccuguggag

SEQ ID NO: 165059 - RNA, 37 nt, Homo sapiens
acaccagccggaaguucuguggggcagggacagguca

SEQ ID NO: 165060 - RNA, 45 nt, Homo sapiens
gguggccguggggcugggggcuuuggcaccugcccaggugaagac

SEQ ID NO: 165061 - RNA, 50 nt, Homo sapiens
gagcgcggggugaccgcgugguuggugcgcgccucccggggcgccgcgau

SEQ ID NO: 165062 - RNA, 49 nt, Homo sapiens
cgaggaagagcggggcgagcgaucggcagaggagaaggggcggcuggga

SEQ ID NO: 165063 - RNA, 38 nt, Homo sapiens
cugcucugggccgggcccugcuccccuggcagcagaag

SEQ ID NO: 165064 - RNA, 26 nt, Homo sapiens
gcccccagccuccagccaucccgccc

SEQ ID NO: 165065 - RNA, 40 nt, Homo sapiens
acguauguguauggaugaggcaggugagcacauggguggg

SEQ ID NO: 165066 - RNA, 42 nt, Homo sapiens
cgaggggaagccccuggaggaccagcucccgcugggggagua

SEQ ID NO: 165067 - RNA, 59 nt, Homo sapiens
cagcagcaccuacgagguacggcugacgcagaccguggcccaccugaagcagcaaguga

SEQ ID NO: 165068 - RNA, 19 nt, Homo sapiens
cuagcaggggagccugggg

SEQ ID NO: 165069 - RNA, 44 nt, Homo sapiens
ggagucaaagcccgaagcuaggaacucguccaccgucagcuccg

SEQ ID NO: 165070 - RNA, 34 nt, Homo sapiens
gcugccguguacaggagagauuagauauauucag

SEQ ID NO: 165071 - RNA, 358 nt, Homo sapiens
uuuagaaaauaaaacaugcggccaggcguggugacucacaccuguaaucccagcacuuugggagcccaagguggguggaucacgaggucaggagaucaagaccauccuggcuaauacagugaaaacccgucucuauuaaaaauacaaaaaauuagcugagcgugguggcaugcuccuguagucccaccuacucgggaggcugaggcaggagaaucgcuugaacccaggagguggagguugcagugagcugagaucgugccacugcacuccagccugggugacagagugagacucagucucaaaaaaaaaaaaaggaagaaaaaagaaaauaaaacauguuucuuugaauacgaagauu

SEQ ID NO: 165072 - RNA, 51 nt, Homo sapiens
agaauauaacaaauagagucacuguuagaaggaaacaaacaaggcuuccug

SEQ ID NO: 165073 - RNA, 44 nt, Homo sapiens
auuauaauacaaguauugaaugaaccauugaaacacuagaaguc

SEQ ID NO: 165074 - RNA, 45 nt, Homo sapiens
aaguggauaugcacgaugacucauugaauacaacggcgaauuuaa

SEQ ID NO: 165075 - RNA, 27 nt, Homo sapiens
auauggugcaauugaacaguacaaugc

SEQ ID NO: 165076 - RNA, 42 nt, Homo sapiens
ccaggccuaagcagggcagggucaaucaagucagggcgacua

SEQ ID NO: 165077 - RNA, 71 nt, Homo sapiens
aaucuuugaacagaagauaaugugaaaauauaauacauuagguuucuugcauuuuuuuuuccccaaucagc

SEQ ID NO: 165078 - RNA, 41 nt, Homo sapiens
auuuuggaguagaaaaguaugaauggaaagucagagacaua

SEQ ID NO: 165079 - RNA, 28 nt, Homo sapiens
uuuuuaccaugugccucaaaaccguuag

SEQ ID NO: 165080 - RNA, 42 nt, Homo sapiens
agucacauuuaaugacugcacuuggucacacaagaccaucca

SEQ ID NO: 165081 - RNA, 47 nt, Homo sapiens
cauacguuagugcuauguauuuauuaaagaagaaucagaaaacagag

SEQ ID NO: 165082 - RNA, 42 nt, Homo sapiens
cugcacucuucucgcaauacugguccuggauaaaaccucuga

SEQ ID NO: 165083 - RNA, 60 nt, Homo sapiens
cucauccauccaccaguccccacaaguugagagagugucucccccucaucauuuucauaa

SEQ ID NO: 165084 - RNA, 133 nt, Homo sapiens
ggaacagacuuaaguaugcccugacaggagaggaaguaaagaagauuugcaugcagcgguucauuaagaucgauggcaagguccgcacugauauaaccuacccugcuggauucauggaugucaucagcauuga

SEQ ID NO: 165085 - RNA, 63 nt, Homo sapiens
agggucacuuugcuguacaucguauuacaccugaggaggccaaguacaaguugugaaaaguga

SEQ ID NO: 165086 - RNA, 60 nt, Homo sapiens
acacugguaaccuguguauggugacuggaggugccaaccugggaagaauuggugugauca

SEQ ID NO: 165087 - RNA, 47 nt, Homo sapiens
ccaacagagagaggcacccuggaucucuugacgugguucacaugaaa

SEQ ID NO: 165088 - RNA, 70 nt, Homo sapiens
gcugaagagagagacaagagauuggcaaccaaucaaagcaguggguaaaauggucccuggauggcauguu

SEQ ID NO: 165089 - RNA, 57 nt, Homo sapiens
cauauaauguagugguaucuuuucauuuugaauuugggccuuucaaaaaggaggggu

SEQ ID NO: 165090 - RNA, 45 nt, Homo sapiens
cauuuaggcuuuuuggugugaagugucauaauacagacagugagc

SEQ ID NO: 165091 - RNA, 41 nt, Homo sapiens
uagucuaauguuuagugaauaguuuuagacuucuuaacaga

SEQ ID NO: 165092 - RNA, 38 nt, Homo sapiens
gagaucagugaacucugguuuuaagauaaucugaaaca

SEQ ID NO: 165093 - RNA, 55 nt, Homo sapiens
ucuuggacuaguccugcaagguauaaagaauaaaaaucccagugagauacuugga

SEQ ID NO: 165094 - RNA, 44 nt, Homo sapiens
ucuagguaauuggcagauucuaaauaauauaauuuccagauagu

SEQ ID NO: 165095 - RNA, 44 nt, Homo sapiens
ugauuuaggauuuuguuaacugaaugguucuaucaaauauaaua

SEQ ID NO: 165096 - RNA, 61 nt, Homo sapiens
caaacgaagaucaaaaugaaaaagguugcaaggaacgaauauaugugauuaucacuguaag

SEQ ID NO: 165097 - RNA, 54 nt, Homo sapiens
cacugugaauuauacaacuaugauucacaccccugaaaacccaguuauccguua

SEQ ID NO: 165098 - RNA, 44 nt, Homo sapiens
auugaaaaucuccuggaauuuuuaauaauucauguuguuuuaug

SEQ ID NO: 165099 - RNA, 59 nt, Homo sapiens
guugaaaagacuugcuuuuccucauuggcuugcuuuggugucuguacugauaaucaaau

SEQ ID NO: 165100 - RNA, 26 nt, Homo sapiens
aaccugucugguuuuauuaggucuaa

SEQ ID NO: 165101 - RNA, 42 nt, Homo sapiens
ucucccacugucaaucaaagacuuaaagacucauggguagaa

SEQ ID NO: 165102 - RNA, 46 nt, Homo sapiens
uacucuuggcagggcagcauacauccucaacuacuagugcuuggau

SEQ ID NO: 165103 - RNA, 46 nt, Homo sapiens
aauugaugacauucuccaaacuuuacuagaugcuacauacaaguaa

SEQ ID NO: 165104 - RNA, 48 nt, Homo sapiens
aaaucaucuuuaucuuuuaauuacagacgcagggacagagcucaucgg

SEQ ID NO: 165105 - RNA, 51 nt, Homo sapiens
cucauaauuuuaacagcuagccauuguuugcauggaaaggaaaucagaagu

SEQ ID NO: 165106 - RNA, 47 nt, Homo sapiens
aauugcugugcccauaguaggaagcaacaucugcccacagggcagca

SEQ ID NO: 165107 - RNA, 47 nt, Homo sapiens
uauaauugaaaaagaaacaaaggaauacuuugagaguuggggagaaa

SEQ ID NO: 165108 - RNA, 47 nt, Homo sapiens
uuauaauaaccuaaauggauuuuaugauaaaacaaaaauguguuuua

SEQ ID NO: 165109 - RNA, 73 nt, Homo sapiens
acaaugcuguuacuucaucaaaaggacuuccugccuacccauuccugccugaaauucuaacauaagcgcuguu

SEQ ID NO: 165110 - RNA, 46 nt, Homo sapiens
aaagggcuuccuguacaaauaauggaaucaaugauaacuuagcaua

SEQ ID NO: 165111 - RNA, 45 nt, Homo sapiens
augucuacagucgccugacaacaccuguguuugggaagggaguug

SEQ ID NO: 165112 - RNA, 26 nt, Homo sapiens
uacauuuauucuguucacuaucacaa

SEQ ID NO: 165113 - RNA, 42 nt, Homo sapiens
cguaaacagaaauugaaaacuugaaggauauuucagugucau

SEQ ID NO: 165114 - RNA, 52 nt, Homo sapiens
gacagccugcgcuuagauuuuaccggucuguaaaauggaaauguugagguca

SEQ ID NO: 165115 - RNA, 41 nt, Homo sapiens
aagaccaucaccauccuggcgcugggccagguggacggcga

SEQ ID NO: 165116 - RNA, 41 nt, Homo sapiens
gccguggccguggccuacaucgccggcuuccuccuggaaga

SEQ ID NO: 165117 - RNA, 57 nt, Homo sapiens
ggggguccgggcccaggcggcgggccaggggccaggccaggggcccgggccggggca

SEQ ID NO: 165118 - RNA, 58 nt, Homo sapiens
acaaauggucaggcggcggcggcggagaaggaggcggaggcgcaggggggagccgagc

SEQ ID NO: 165119 - RNA, 69 nt, Homo sapiens
uacggggcgccuggaaaccgguccgagggcgcgcgaggcagaggagagggagcgaguugagggauugac

SEQ ID NO: 165120 - RNA, 50 nt, Homo sapiens
cagcaucuaccugugaagucuuucacuuucauuaacauacuucacaagcu

SEQ ID NO: 165121 - RNA, 60 nt, Homo sapiens
acugauaaacagaaacagcuccuguuuugacuuguauugaguuuguagacuaguggagua

SEQ ID NO: 165122 - RNA, 51 nt, Homo sapiens
ugaaaaauuguagacaaccugaaagucugucaauaggaaauuaguuaagua

SEQ ID NO: 165123 - RNA, 46 nt, Homo sapiens
cgguggaauggguuauccucguuuagguggagaagguggaaaaggu

SEQ ID NO: 165124 - RNA, 46 nt, Homo sapiens
agucagaaacccucaggauaggugggacaauaauugauaacugaaa

SEQ ID NO: 165125 - RNA, 66 nt, Homo sapiens
uggcauguagaaauggcgguauuucauguaguacagagcaaagaggaagagaggaaggguugagca

SEQ ID NO: 165126 - RNA, 63 nt, Homo sapiens
uuagguggauuuaugauaggaaaaacaaaugacauucuaaguagaggaaaagcaugagcagaa

SEQ ID NO: 165127 - RNA, 54 nt, Homo sapiens
ggucaauauuucaacuuucuugaaaaaaaaaucccauuuguuuuuuauaauagc

SEQ ID NO: 165128 - RNA, 58 nt, Homo sapiens
ugaagacacgaaagcguguaauugaugugccuuccugcagaacauuuaggucgauuuu

SEQ ID NO: 165129 - RNA, 28 nt, Homo sapiens
uuuuccuuuaauguccacagccuguuuu

SEQ ID NO: 165130 - RNA, 44 nt, Homo sapiens
cugcuugguaggaauggugguauuacaguugaugaggaugguca

SEQ ID NO: 165131 - RNA, 48 nt, Homo sapiens
gugcuccaaccuuuuugucugaacuuuuguaaacaauagcagcaacag

SEQ ID NO: 165132 - RNA, 47 nt, Homo sapiens
uuggaccuggggccugucagcaucauucacuaccaugaagggccaau

SEQ ID NO: 165133 - RNA, 44 nt, Homo sapiens
aaaacuguguuggugggguucauugcaacuugaugcuuugcggc

SEQ ID NO: 165134 - RNA, 46 nt, Homo sapiens
cuuuuccgugcuggaaaacacccacguaagaguagguggugcuaag

SEQ ID NO: 165135 - RNA, 60 nt, Homo sapiens
acauaguugcgagauuugaguaauuuauuucuagccuccagcucugaaauaaaugacaug

SEQ ID NO: 165136 - RNA, 35 nt, Homo sapiens
ugcucauauguguuucugucuuaugaacuucugcu

SEQ ID NO: 165137 - RNA, 56 nt, Homo sapiens
uugugugugggaagugcuuacuuagccagugccuggaacauuauaacuucuccaga

SEQ ID NO: 165138 - RNA, 101 nt, Homo sapiens
uuggcuugacaaguuguauaugguggugggaacuuuggcugccaucauccauggggcuggacuuccucucaugaugcugguguuuggagaaaugacagaua

SEQ ID NO: 165139 - RNA, 45 nt, Homo sapiens
ggaaauuuagaagaucugaugucaaacaucacuaauagaaguaag

SEQ ID NO: 165140 - RNA, 56 nt, Homo sapiens
uaauauuuacaagcauuacaacacacaacugaagugccagcagagauauguagaaa

SEQ ID NO: 165141 - RNA, 87 nt, Homo sapiens
guggauuugagcaauaaaucccagaaauuuaguuuuggacauuguuauauguugggcuuucuggaaguagaugcaggaauggaaaag

SEQ ID NO: 165142 - RNA, 22 nt, Homo sapiens
aaacuaugacuccauuguuaaa

SEQ ID NO: 165143 - RNA, 82 nt, Homo sapiens
augugucugagugugugugugugugucuguguguuagggguaaaguuaugaaauacuuuuauaauguacuuuuuauccaaaa

SEQ ID NO: 165144 - RNA, 39 nt, Homo sapiens
uaggugauaucaaugauacaggguucuucaugaaucugg

SEQ ID NO: 165145 - RNA, 40 nt, Homo sapiens
aguagugaaguuuaaaaagugggaauauuggaauacugua

SEQ ID NO: 165146 - RNA, 32 nt, Homo sapiens
agaccaacccaaugcacuuaucaacugaugcu

SEQ ID NO: 165147 - RNA, 47 nt, Homo sapiens
cugaggcuuagaaaaguuaagcagcuugccuaagauuacauaacagu

SEQ ID NO: 165148 - RNA, 46 nt, Homo sapiens
auuuuggugccuggcagcuggaagacaaauacacaaaauuagaaaa

SEQ ID NO: 165149 - RNA, 45 nt, Homo sapiens
auaaugcgacaggagauaggcugguuugaugugcacgauguuggg

SEQ ID NO: 165150 - RNA, 43 nt, Homo sapiens
aguagagcaaaacaagauacuuucugaggaaauuucugagcaa

SEQ ID NO: 165151 - RNA, 46 nt, Homo sapiens
acacgugguuggaagcuaacccuugugauuuuggccaucaguccug

SEQ ID NO: 165152 - RNA, 46 nt, Homo sapiens
uguauaagcagcauuuauguauacauuuauuuuuacuuuacaaaag

SEQ ID NO: 165153 - RNA, 46 nt, Homo sapiens
ccaauaagaaacugauuugcacaaaacaaaaaaacaaaaggccuaa

SEQ ID NO: 165154 - RNA, 45 nt, Homo sapiens
auucagaaauguucacuucaguuacccaucucgaaaagaaguuaa

SEQ ID NO: 165155 - RNA, 43 nt, Homo sapiens
cugaaaacauucgcuauggccgugaaaaugucaccauggauga

SEQ ID NO: 165156 - RNA, 46 nt, Homo sapiens
augauggagucauuguggagaaaggaaaucaugaugaacucaugaa

SEQ ID NO: 165157 - RNA, 49 nt, Homo sapiens
agucuaauaagaaaaagaucaacucguaggaguguccguggaucacaag

SEQ ID NO: 165158 - RNA, 34 nt, Homo sapiens
cacccuuaccucccgcaaugaaaccagggggaac

SEQ ID NO: 165159 - RNA, 46 nt, Homo sapiens
aaaaugccuaaagauguuagaccacccaacuccucaucuuaguaac

SEQ ID NO: 165160 - RNA, 30 nt, Homo sapiens
gucugaucuccugcuuuagcaaagacauca

SEQ ID NO: 165161 - RNA, 55 nt, Homo sapiens
caaggucuaguacuuaguauuguaaggcauucaaaccugaauggucccuguguuc

SEQ ID NO: 165162 - RNA, 46 nt, Homo sapiens
uaaggcagggacaucucugagguagaaccuguaagaaugggucacu

SEQ ID NO: 165163 - RNA, 42 nt, Homo sapiens
gugucacaggaagagauugugagggcagcaaaggaggccaac

SEQ ID NO: 165164 - RNA, 44 nt, Homo sapiens
uagguggcugguuuagcuaccuccuuguaagacugccgcacugc

SEQ ID NO: 165165 - RNA, 22 nt, Homo sapiens
ugauccugacuucggccaagag

SEQ ID NO: 165166 - RNA, 909 nt, Homo sapiens
gaauagcuuuaauaaaguugccaauauucuccaacuauaaagaagaagaguuuuauaauuucuggagcuaaauauugacauucauaauuucuaagaauuccaagucuucauaaacaguuauaagacgcugcccagaaagcuguuugacaaggauucaaccaaauacauacuaagcauggcucucucuggaacaggaaagagcaagaagagagugugucucucacugugggucacaucacagucuuaauauuuuuaagcaguuacguguuuucaguuuuuaugggcaagaucuuccuuauauauuuuaaaaggauucuguaucagagcuauccaggccuggaauuuuauuugucaaaagguguauaauuacucauacuaauaaauaauucauuauguguuauuuuaauuucagaauacauuugugguuacuaaauacucauucucucauaucuccaaacacauguucaagaccaguaaguaucccauuuuccuuccucauacacacucaugaacuaagguuaugucugauacagugcucugcaguccacuguuaguuauguggaaugccuuguuuuuucccuuauccuuaaggucuggguugcauuucucuguguaagcugugucaaguccuuucugaauguacacagacuaaauauaggaaaacuucuaagcuaaacguaauaauuacagaacuaguuaaauaaguaauuacagaaccauuacaaaagggcaaaaaauuaaauaugcacaaauuucugcuacaaugucuauguaaaaaccguaaucaaaaaguuaaaaaaaaaaaaaacacaaaaccaaaaaaccaaaccugaaaucaaguuuucacuacauaaaaugcaaccaacuagaaccagaggugguugguuuggcuguuaccugaggccaguu

SEQ ID NO: 165167 - RNA, 46 nt, Homo sapiens
augccuccuagucccguaagcugucauaccugccuggcuggcacau

SEQ ID NO: 165168 - RNA, 44 nt, Homo sapiens
ggcuuccguugugaaugacagguucuguaggagcagcacaguau

SEQ ID NO: 165169 - RNA, 46 nt, Homo sapiens
uugugaaaaguugaacauuauuaacaaagucuaaucauaucuuuag

SEQ ID NO: 165170 - RNA, 45 nt, Homo sapiens
gugguggagguaauuuuggccgugauggaaacuuugguggaagag

SEQ ID NO: 165171 - RNA, 44 nt, Homo sapiens
uacggcaagauugaaaccauagaaguuauggaagacaggcagag

SEQ ID NO: 165172 - RNA, 36 nt, Homo sapiens
cugcccacugaccaggaaaaucugccuggugaggga

SEQ ID NO: 165173 - RNA, 52 nt, Homo sapiens
ugaaagcuugucacugauucuuugcuucaggagucucagcuagggaguugaa

SEQ ID NO: 165174 - RNA, 49 nt, Homo sapiens
uuuucacauuuuuguuuguguuuaaggugaguucuucuuaaaaggauaa

SEQ ID NO: 165175 - RNA, 28 nt, Homo sapiens
uugcuucugaucucauugcucccuaguc

SEQ ID NO: 165176 - RNA, 47 nt, Homo sapiens
aaguccgcugauucagucuuuuaaauaucuuccaauucauccucuuc

SEQ ID NO: 165177 - RNA, 95 nt, Homo sapiens
uaggaauuuuguaaagaaacuuauucucaugaauauuuuaguuagggauaguuugauuuuaaacaaucaauaaaccugucaaaugagcucaaaca

SEQ ID NO: 165178 - RNA, 46 nt, Homo sapiens
aauccaaucugcuuuuuuaaugucccauuuuuauuugacaagaagg

SEQ ID NO: 165179 - RNA, 40 nt, Homo sapiens
uuaaaauguuuucauuuccuuuauguuuuucaagaaugug

SEQ ID NO: 165180 - RNA, 57 nt, Homo sapiens
guauuaggaaguuagauaauaacaaguaugaaugaaaaugauggcaaagggaacucu

SEQ ID NO: 165181 - RNA, 68 nt, Homo sapiens
aauucaauuaccaauaagcauaugaaacauacugauccucccuaaauaucaggaaaaguaaaauuaag

SEQ ID NO: 165182 - RNA, 120 nt, Homo sapiens
ugacuuaaauaggauuguuagucacauuauagaacuaaguucuacaaaucaauaggaaaaacgaacaacauacuagaaaaaaaguggauguagaauauaaaaagauaacucacaggagga

SEQ ID NO: 165183 - RNA, 44 nt, Homo sapiens
uauuuagacaucgugggagauccaacauaggucuaauaagaauu

SEQ ID NO: 165184 - RNA, 48 nt, Homo sapiens
uaguuccaguuucuuuaucaauauauauuugucucuagauguauagua

SEQ ID NO: 165185 - RNA, 49 nt, Homo sapiens
augagaauguccugauuuccuauuucugucucuagaugggcuuucuugg

SEQ ID NO: 165186 - RNA, 49 nt, Homo sapiens
uaagguuuucagguaguuuugaaugaauaaggagcaaagcaguugagau

SEQ ID NO: 165187 - RNA, 43 nt, Homo sapiens
ucggcuaccuuuuugguaagauaaaauuuguuaaugcucuacu

SEQ ID NO: 165188 - RNA, 64 nt, Homo sapiens
ccaugaaagcauaggguguugaaugagucaucugcauauucaucuaagucacugagacuaacaa

SEQ ID NO: 165189 - RNA, 34 nt, Homo sapiens
uaucauugcauugugcaugauagugaaaguugaa

SEQ ID NO: 165190 - RNA, 52 nt, Homo sapiens
caaguuccagacaggauucugagagugcaaggccagaaucugaaacagaaga

SEQ ID NO: 165191 - RNA, 42 nt, Homo sapiens
ugcauucaguucucaaaaauuuuuacucuuaaaccagcuuua

SEQ ID NO: 165192 - RNA, 46 nt, Homo sapiens
acucauuacgucgucauguggacaggacuucugaagguguucuucg

SEQ ID NO: 165193 - RNA, 45 nt, Homo sapiens
guaauuucaaauuucauaguuuaaaagcuaaaagguugguuagaa

SEQ ID NO: 165194 - RNA, 56 nt, Homo sapiens
ccauuuggaaguacauagggaaggagaugguucuaguaccacagauaacacacaag

SEQ ID NO: 165195 - RNA, 45 nt, Homo sapiens
ccagauuguuuccacaagaacacccaaaccuccucuaaguacagg

SEQ ID NO: 165196 - RNA, 34 nt, Homo sapiens
uccuaaaacaacauucuagugcauagucuuagca

SEQ ID NO: 165197 - RNA, 71 nt, Homo sapiens
agcugugugauuuacugcuuucugaaauaaugccuccagcaccacaccuugagguuccuucagggcugcug

SEQ ID NO: 165198 - RNA, 32 nt, Homo sapiens
gauagucaagcaaauaaagagcagcagagagg

SEQ ID NO: 165199 - RNA, 42 nt, Homo sapiens
uaaagaaggaaagagaaguaggagauccaugagaaaauagua

SEQ ID NO: 165200 - RNA, 51 nt, Homo sapiens
ccccaaggaguuugauuugauaauagguuggauagaggaaggagacuagug

SEQ ID NO: 165201 - RNA, 46 nt, Homo sapiens
cuaaaacucuauagaagagcgagaggggagacaagccuggggaggu

SEQ ID NO: 165202 - RNA, 48 nt, Homo sapiens
uaguuuuaauuauuauuuuacuaaaaaguauguggugcauugaaauag

SEQ ID NO: 165203 - RNA, 44 nt, Homo sapiens
gaauuaauagcuugcuuuucagaguuucuuaaaugagauucaga

SEQ ID NO: 165204 - RNA, 65 nt, Homo sapiens
ugcugacaaaauuagacagcauuuauccuggcacaugauuggccucugauguuuguugcaugggg

SEQ ID NO: 165205 - RNA, 56 nt, Homo sapiens
uuacuguauuggagaaaguuguggaaagaaggaggaaaugagauagccccagaggu

SEQ ID NO: 165206 - RNA, 49 nt, Homo sapiens
ccagcuuugggauucauuuaguaauuuaaaugagaaacuagccugagua

SEQ ID NO: 165207 - RNA, 46 nt, Homo sapiens
aaauggcguccaaagucacagaugcuauagucugguaucaaaagaa

SEQ ID NO: 165208 - RNA, 70 nt, Homo sapiens
uauguuuguuuaugugcauguugggggaguacaggaguuggacagguagaguuuucaauucuagcccuca

SEQ ID NO: 165209 - RNA, 63 nt, Homo sapiens
ucugcaauauguaaaaccuuuuaaaucuuaauguauuggugacugagugacaugucaguaaau

SEQ ID NO: 165210 - RNA, 153 nt, Homo sapiens
guauaugguauauuugugaaccuguguagcuagaauguaagguauguguagcuagaauguauggaugggagguuggggagggcggguaauugaaacugugugaaacaaaguagagacgauagaugcuacugacuggagaaauaauaaaucuau

SEQ ID NO: 165211 - RNA, 26 nt, Homo sapiens
aauugagguaacuuuucaaauagauc

SEQ ID NO: 165212 - RNA, 52 nt, Homo sapiens
uguaugugugaaggccagcuuuaaaugauaaugguauguaaaugugguuggg

SEQ ID NO: 165213 - RNA, 31 nt, Homo sapiens
aauaaauaauuuuaagagagaacuaguuggg

SEQ ID NO: 165214 - RNA, 59 nt, Homo sapiens
auuacugucauuuuauagaugagcaaaccaagacuuaguuuaacuaauuuguucaagau

SEQ ID NO: 165215 - RNA, 48 nt, Homo sapiens
ggcggcggcggcgggcaggaggagauggugaggcugagcgugcagcag

SEQ ID NO: 165216 - RNA, 41 nt, Homo sapiens
ucagccuccgcuuccuugucucagccggugccgcgcaaacu

SEQ ID NO: 165217 - RNA, 59 nt, Homo sapiens
ugugucgcugccgcggcccccaccgccaccgucucggagaaagaaccguuuggcaagcu

SEQ ID NO: 165218 - RNA, 53 nt, Homo sapiens
gcuccauugggcaagccacgcugagggauccaccuaagagccaaucaaaggca

SEQ ID NO: 165219 - RNA, 60 nt, Homo sapiens
guuugaaaagcaagaauuguuuuuuuagguuucuguauuuuagcguuuaguaagcacacu

SEQ ID NO: 165220 - RNA, 46 nt, Homo sapiens
uaaacuugcuggauucaugcagccagcuuugcagguuaucagagau

SEQ ID NO: 165221 - RNA, 45 nt, Homo sapiens
uacauaauuaaauucaaaaacaaguaaauugauguugacaugcuu

SEQ ID NO: 165222 - RNA, 46 nt, Homo sapiens
cuccuccccuaccugaaagaacuccugaaucguuuguguuagcaag

SEQ ID NO: 165223 - RNA, 38 nt, Homo sapiens
gaaaggcagcccaaaguuccagggagaaacaugcauuu

SEQ ID NO: 165224 - RNA, 45 nt, Homo sapiens
gaaagcauuucuacuaggaaaguauugccaauguccauugcuaga

SEQ ID NO: 165225 - RNA, 23 nt, Homo sapiens
cugauggugcugugacccagaau

SEQ ID NO: 165226 - RNA, 46 nt, Homo sapiens
aggacauguaacguggucauuucauggaccugaaaaugccauaccc

SEQ ID NO: 165227 - RNA, 42 nt, Homo sapiens
ccagaagaaucccagaauucagacacaccuccaaggccagac

SEQ ID NO: 165228 - RNA, 63 nt, Homo sapiens
agaacuuccagggaaaaaugaaucaacaauugaacagauagauaaaaaauuggaacgaaauuu

SEQ ID NO: 165229 - RNA, 44 nt, Homo sapiens
augcuuaaguaauucguuuagacacuuuuuuuuagguauaagua

SEQ ID NO: 165230 - RNA, 45 nt, Homo sapiens
uaucuugauaagauuuguguugcacagauguguguauuuguccaa

SEQ ID NO: 165231 - RNA, 37 nt, Homo sapiens
augcaguauaagagaauuucaucuaucccuggaguuc

SEQ ID NO: 165232 - RNA, 56 nt, Homo sapiens
aagcuucugaggguguacuguaugcugggaaugcaacaaaaaacaaacuggcaaaa

SEQ ID NO: 165233 - RNA, 42 nt, Homo sapiens
aaauguuaaaaagaacagauacaaggacauacugccauguaa

SEQ ID NO: 165234 - RNA, 27 nt, Homo sapiens
ugggaagaagcuagauuauagggugaa

SEQ ID NO: 165235 - RNA, 114 nt, Homo sapiens
acugagucuuuuaagaaagguaaacagucauuuguguuuuacaaaguugaaucugauagcaguaugaaggguggcauuuuggaagcuguugaaauauaagaagugagaugugag

SEQ ID NO: 165236 - RNA, 38 nt, Homo sapiens
caugguaaaugauaaagguaaugcugggaaaguuaggu

SEQ ID NO: 165237 - RNA, 45 nt, Homo sapiens
gaaauggcaucaacaugaugcugcccauuccacugaaguucugaa

SEQ ID NO: 165238 - RNA, 56 nt, Homo sapiens
auucugaaaucugauuaugagaaggauacacaguuaaugccuguaaaaugaauggg

SEQ ID NO: 165239 - RNA, 81 nt, Homo sapiens
auauugcgcaagacuggggcguuggaaacccuguaggucuggggaaugaaaaaggaagugggacuuugggaagugguugcu

SEQ ID NO: 165240 - RNA, 77 nt, Homo sapiens
agucuuguucaugaaauugcucuagauacacuauugcuuuagcacacugugagggggucagauccgaaggcgugaga

SEQ ID NO: 165241 - RNA, 51 nt, Homo sapiens
ggguggggguggggaacuugggaacaauaguccugguggggcggaggcgac

SEQ ID NO: 165242 - RNA, 47 nt, Homo sapiens
aggcccagguuugagguggucuugggguccgugugacuauagguuca

SEQ ID NO: 165243 - RNA, 46 nt, Homo sapiens
uuguugauggcagaacggcccuuuuucuucuugucauccuucuuug

SEQ ID NO: 165244 - RNA, 27 nt, Homo sapiens
acuaaucuacaagcgugguuauggcaa

SEQ ID NO: 165245 - RNA, 61 nt, Homo sapiens
gagguggaaugaagaaaaagaccacccauuuuguagaagguggagaugcuggcaacaggga

SEQ ID NO: 165246 - RNA, 46 nt, Homo sapiens
ccagaagaagcuguaaggauucacacugauguccaaacaaagaaau

SEQ ID NO: 165247 - RNA, 50 nt, Homo sapiens
aguacacuuucuccuuuauaucaggaauaauacgucuuucuucugaaagu

SEQ ID NO: 165248 - RNA, 52 nt, Homo sapiens
ccaugucuguuggucuucacuguaguguuaguugucacuggcagacuaggau

SEQ ID NO: 165249 - RNA, 42 nt, Homo sapiens
agauuuggaccuuuugaccuugcagcuauucccaucggagcu

SEQ ID NO: 165250 - RNA, 50 nt, Homo sapiens
gauuauagacuagaagaagauguaacuaaauccaagaaaggaaaagaugg

SEQ ID NO: 165251 - RNA, 46 nt, Homo sapiens
gauuacaggagauaaaggauuuuuuaagggcuuggcaguuauguua

SEQ ID NO: 165252 - RNA, 43 nt, Homo sapiens
guccuuacuaugcauuguuaacaauaauguuuucuaaauacau

SEQ ID NO: 165253 - RNA, 44 nt, Homo sapiens
uaauaaaccuaggagggaaguaacguucucuccauuuuauaggu

SEQ ID NO: 165254 - RNA, 37 nt, Homo sapiens
cuaaugaaacagaaagcaaauguuuaacagaauaaga

SEQ ID NO: 165255 - RNA, 83 nt, Homo sapiens
gccccagccuucagcagaauauauacacugcagacucuuguuacagcgggguuccaaugaagcgaaaguggagggguguggau

SEQ ID NO: 165256 - RNA, 34 nt, Homo sapiens
guauugaaauuagauguuguucuucuaaccuacu

SEQ ID NO: 165257 - RNA, 50 nt, Homo sapiens
ggagggugaaguguuugcugcaggacagcugaguggagagcgggcacagg

SEQ ID NO: 165258 - RNA, 41 nt, Homo sapiens
cuacagcccagagugagcucuauaagcauugcuggccuaau

SEQ ID NO: 165259 - RNA, 64 nt, Homo sapiens
caggugggccuggcgagcugccuggggaugccaugucacaacaaucaugggggcacgugggcag

SEQ ID NO: 165260 - RNA, 56 nt, Homo sapiens
uaucuggccaccuggugggcacaccugcagacuuggugaggacgauuauggcccca

SEQ ID NO: 165261 - RNA, 43 nt, Homo sapiens
cugccucacaggcaaucaggugcugcaugugcacagccuccag

SEQ ID NO: 165262 - RNA, 45 nt, Homo sapiens
aucacauccucuagcaucugaguggcaagaugacaggcuucccag

SEQ ID NO: 165263 - RNA, 51 nt, Homo sapiens
ggcuugugguggaucaccacgagcuaccauaaucccaucgcuggccuccag

SEQ ID NO: 165264 - RNA, 45 nt, Homo sapiens
cccaaacuucagguccuggauguccuucuccaacauggcagacag

SEQ ID NO: 165265 - RNA, 47 nt, Homo sapiens
caccucugucaccagaaagugagcauccuucugcuucacuuggagag

SEQ ID NO: 165266 - RNA, 46 nt, Homo sapiens
gccacauuaauuccagacuuaaucguuuucuucagcaucucuagca

SEQ ID NO: 165267 - RNA, 56 nt, Homo sapiens
agaaugugucagccauggcugcgugcagcugcugggucugaaugaaggcagcccug

SEQ ID NO: 165268 - RNA, 63 nt, Homo sapiens
gacgucaugaaaucuaguuuggucaccaggauaugggguugacaaagaccuuguggcaggccu

SEQ ID NO: 165269 - RNA, 40 nt, Homo sapiens
ggaaggugaggcccuggaccccuagugaccugaugguuag

SEQ ID NO: 165270 - RNA, 35 nt, Homo sapiens
uucucuucuaugugccccacccucugacagggaag

SEQ ID NO: 165271 - RNA, 42 nt, Homo sapiens
uucccugcccgugugcucauucauuuaugcuacgcauguggu

SEQ ID NO: 165272 - RNA, 24 nt, Homo sapiens
aauaauuaguauaaaaauuuguau

SEQ ID NO: 165273 - RNA, 55 nt, Homo sapiens
gcacugaugacuccaguaguuaucugugcugcuugugauaauuuauaaggcaaug

SEQ ID NO: 165274 - RNA, 32 nt, Homo sapiens
uuagggcucuuuacccauaucuuagugacaua

SEQ ID NO: 165275 - RNA, 63 nt, Homo sapiens
agacacaguauauuggggcaguuuauugcaucuuuggucaucucuuuuccucugggucccuag

SEQ ID NO: 165276 - RNA, 32 nt, Homo sapiens
uggcuuuuagagcccucaauguagcaagaaga

SEQ ID NO: 165277 - RNA, 84 nt, Homo sapiens
aguaaauuacaccccaaccuccuuuuccuuguuuuuguugaaauuauugucucuuaacuuuggaacauugcaguugcgguaagc

SEQ ID NO: 165278 - RNA, 43 nt, Homo sapiens
ggaguccuugagggccucugggaggccuagcgagggguagacc

SEQ ID NO: 165279 - RNA, 58 nt, Homo sapiens
ggggaggggacagggcuugggcggaggagacuguggugcggucggcguuggcggccug

SEQ ID NO: 165280 - RNA, 42 nt, Homo sapiens
gcuggcgaugaccucauccugcagcagcggguggggccaaag

SEQ ID NO: 165281 - RNA, 45 nt, Homo sapiens
aguugccgucgcugccuccuauacuucucuuggccucggggaagg

SEQ ID NO: 165282 - RNA, 59 nt, Homo sapiens
auugcuucgcucuuuugagcaagaauacucuguguggcaucuuugguacuguggggaac

SEQ ID NO: 165283 - RNA, 44 nt, Homo sapiens
gccgggcagggcgugcgcacccgucccuugcccgcgagcuggcc

SEQ ID NO: 165284 - RNA, 46 nt, Homo sapiens
agcaucucgccuccgcgcgaguccucggcuccauucgcagccagcg

SEQ ID NO: 165285 - RNA, 46 nt, Homo sapiens
uaaggucauuuccaacuuccuuuucuaugaaugcagacacauaaga

SEQ ID NO: 165286 - RNA, 40 nt, Homo sapiens
aggguaaaauuauaagagugacacaaguuuacugaggugg

SEQ ID NO: 165287 - RNA, 44 nt, Homo sapiens
aaucaaaggaaagaacuaauaccugcuaaaagaucauggguuuu

SEQ ID NO: 165288 - RNA, 46 nt, Homo sapiens
ucgaucucuucaaucuggcuaaucaugguuccaagaucguccaucc

SEQ ID NO: 165289 - RNA, 50 nt, Homo sapiens
ggaagcacaucaaggaaauauauacauguugaauaauguaacugaaaaau

SEQ ID NO: 165290 - RNA, 46 nt, Homo sapiens
uggaaaucaguguaaaucuugcaacauagcucucaagauaccacug

SEQ ID NO: 165291 - RNA, 42 nt, Homo sapiens
cuuuaugaagggaagauugucuagguugcaguaaguugaaau

SEQ ID NO: 165292 - RNA, 45 nt, Homo sapiens
ugcucgaaaacaaacucagagagcccaaagugagaaucuugagcu

SEQ ID NO: 165293 - RNA, 70 nt, Homo sapiens
gccagucggguuuaucaaacaguagucacaauuguaguaacaagccaaguauaggaaagaaccacagacg

SEQ ID NO: 165294 - RNA, 46 nt, Homo sapiens
uuugucauuucuuuguuuaggaaauacagaauuaacaggucaagaa

SEQ ID NO: 165295 - RNA, 43 nt, Homo sapiens
gaucaggaggcaaaaaucuguaagaaaaaugauggaggaugga

SEQ ID NO: 165296 - RNA, 42 nt, Homo sapiens
guggccggagagagaaccgggaauggggaaaaaggcagaaca

SEQ ID NO: 165297 - RNA, 53 nt, Homo sapiens
acaagauaaauaaauaauuguagguuagagaguguuaagugcuaagaagaaga

SEQ ID NO: 165298 - RNA, 38 nt, Homo sapiens
uugccauguaaaaauucuuauuagcauaagcuauaugu

SEQ ID NO: 165299 - RNA, 58 nt, Homo sapiens
acuucaguaaauaguaaucuggaagaaagagcuguggaguugcccuuaacuccuaauu

SEQ ID NO: 165300 - RNA, 54 nt, Homo sapiens
ucucgaauaucaagaaaugcaguaaccagcaugucaauaaggggucauaggugg

SEQ ID NO: 165301 - RNA, 80 nt, Homo sapiens
uugcuaaugcaauaaaggcuucauugccucauggucccaugaaaucuaauaaggaagguacaagguguauucaaguugaa

SEQ ID NO: 165302 - RNA, 46 nt, Homo sapiens
agcucaaaaagcacuggaugauauuauauacagagcccagcuagaa

SEQ ID NO: 165303 - RNA, 55 nt, Homo sapiens
agguauaaguagcaggauaccaguuucuucaggauucauggugcaaauguuaaca

SEQ ID NO: 165304 - RNA, 49 nt, Homo sapiens
uuuuccugguauaacuuacucaggaauguauuacagacaaauguucugu

SEQ ID NO: 165305 - RNA, 85 nt, Homo sapiens
acauuccuuuuguuguguuacaaugcugccuuaacuuacaugcccaguguuucucuucagucacugugucaaauuuguucaaggu

SEQ ID NO: 165306 - RNA, 46 nt, Homo sapiens
guuugucaaaagugguauacaguggaccucauccucaaagggagau

SEQ ID NO: 165307 - RNA, 24 nt, Homo sapiens
aucuguuucugaccuucacagaaa

SEQ ID NO: 165308 - RNA, 83 nt, Homo sapiens
uuuguuuuuucauacaccaaaugacucauagcccauucuuccaaauauaacuuucuggggauugggagacauacaagcguaca

SEQ ID NO: 165309 - RNA, 58 nt, Homo sapiens
guaacauauccuggaguccaguccaauauggaucuauguaucucugggaugaaacuac

SEQ ID NO: 165310 - RNA, 41 nt, Homo sapiens
agacauuaccagaaacaucuuuaccaaauuaugccacaaau

SEQ ID NO: 165311 - RNA, 46 nt, Homo sapiens
aauguuuacuucagagaaagggguuguggaggaaugguugucagag

SEQ ID NO: 165312 - RNA, 49 nt, Homo sapiens
gcaucacagacaagaagcacaggacaggcugcacuggggccaaacacag

SEQ ID NO: 165313 - RNA, 50 nt, Homo sapiens
ccaaggcagaagaaauccuggagaaggaucuaaaggugcagaaguaugag

SEQ ID NO: 165314 - RNA, 53 nt, Homo sapiens
caagcucugccucaacaucuguguggaggagaguggagacagacuaacccgag

SEQ ID NO: 165315 - RNA, 47 nt, Homo sapiens
uagcgcuuaauuuaacuacagcaauggccucauugcauaggagagaa

SEQ ID NO: 165316 - RNA, 41 nt, Homo sapiens
aaucaugaaacuucaagugaguccugauagggaaauggaga

SEQ ID NO: 165317 - RNA, 42 nt, Homo sapiens
auagaauucagucauuuguacuugacuuaaugaaaacauaau

SEQ ID NO: 165318 - RNA, 41 nt, Homo sapiens
uauccaaauugguucccugaaguacuucugaaguacuuuaa

SEQ ID NO: 165319 - RNA, 46 nt, Homo sapiens
ccgucgcugucgcugagagccucacgagucgagguccugcaggugg

SEQ ID NO: 165320 - RNA, 70 nt, Homo sapiens
cucucccggcuggguugucagucagugagaggagggggaagauggcucaccgggacccguucugcuagga

SEQ ID NO: 165321 - RNA, 44 nt, Homo sapiens
ccauccaguuucuccaaauccacaccaugggggggcagcagaga

SEQ ID NO: 165322 - RNA, 46 nt, Homo sapiens
uugucugagaacccauuugcuucacuuaguccugaugagcagaaag

SEQ ID NO: 165323 - RNA, 77 nt, Homo sapiens
gggaaggaauuguaaaagauauggagguuugggaaucaucagggcaguggauguuuucuguuuauucaccagugaaa

SEQ ID NO: 165324 - RNA, 63 nt, Homo sapiens
gagaguuugggcauuguuuaaaguauucgaguauucuagccaaacuucauaauuuagagauua

SEQ ID NO: 165325 - RNA, 48 nt, Homo sapiens
acaguugauaguguuuauugccaaugaaaaaaauuaaaacuuucaagc

SEQ ID NO: 165326 - RNA, 48 nt, Homo sapiens
agggacgugaucugauuagaaaaagcuaacucagcaugcugugugagg

SEQ ID NO: 165327 - RNA, 56 nt, Homo sapiens
aaauccaaggugauuccuaggguuuuuuggccugagaggucaguaaagauggggaa

SEQ ID NO: 165328 - RNA, 44 nt, Homo sapiens
accagaggaauugaggcuugaauaccauaacuucuuaaccagca

SEQ ID NO: 165329 - RNA, 68 nt, Homo sapiens
gcuccuugcuaacugcccagggccccuuccauagguuagaaugugggacaacccacccauagcugacu

SEQ ID NO: 165330 - RNA, 39 nt, Homo sapiens
auuuguuuaucaucugccuguuaaugaauauuacacuga

SEQ ID NO: 165331 - RNA, 59 nt, Homo sapiens
agucucauuuguagugauagaaagcagacagagugguugccagggaccaggagcaagaa

SEQ ID NO: 165332 - RNA, 45 nt, Homo sapiens
ccugaagucacaucggcugcaucauuuucauucaaaagcccugca

SEQ ID NO: 165333 - RNA, 43 nt, Homo sapiens
cucugcuggagcaggcagcagaguggacgcacaguaacauggg

SEQ ID NO: 165334 - RNA, 60 nt, Homo sapiens
cccgaaaacuggaccaugcaguucccacaagaguccucccggggguagaggucccaggag

SEQ ID NO: 165335 - RNA, 48 nt, Homo sapiens
cccuggcucccaacagccccccgagcuccccgcuaacccagcccccag

SEQ ID NO: 165336 - RNA, 45 nt, Homo sapiens
ugcaggccccagaugaucccccagaacucuuccuucugccccccg

SEQ ID NO: 165337 - RNA, 35 nt, Homo sapiens
auugcagcgggaugagaccacaucaucagguuuug

SEQ ID NO: 165338 - RNA, 48 nt, Homo sapiens
agcagcaguggagauaggaaggaagggagggaggggccgaggaaggaa

SEQ ID NO: 165339 - RNA, 45 nt, Homo sapiens
gugagaccuucugugugggagaggaugccaaggccgccgcccgag

SEQ ID NO: 165340 - RNA, 46 nt, Homo sapiens
agguaccggcugagcgcccaggccgagggccugcaguugcugccag

SEQ ID NO: 165341 - RNA, 55 nt, Homo sapiens
accauccccacacccucaaaugcacccccaccaaaaggcuguccccucccucugg

SEQ ID NO: 165342 - RNA, 50 nt, Homo sapiens
aaugccugggcuuuauuuaaaauaaggggguggagucagaggcagaggag

SEQ ID NO: 165343 - RNA, 46 nt, Homo sapiens
cugacgcaccuaggagagcgggguggguggcagggcauauguacgu

SEQ ID NO: 165344 - RNA, 42 nt, Homo sapiens
ccgggagauggaguccacgagcuugcgcgaggcuugcuggga

SEQ ID NO: 165345 - RNA, 57 nt, Homo sapiens
uuccuggccauccucuucacccuccccacaccguuucucuuuccacuccccggaacu

SEQ ID NO: 165346 - RNA, 44 nt, Homo sapiens
ugugguaaaguacacaaaacauaaaauacagcauuuuaaccauu

SEQ ID NO: 165347 - RNA, 333 nt, Homo sapiens
ggaucaaaaggaaaaguacuagccgggugccuguaaucccagcacuuugggaagccaaggcagaaggaucucuugaggcuagccugggcagcauagcgggacccugucucuacaaaauaccaaaaaaaaaaaauuagccggaugugguggcaugcaccuguacucccagcuacucuggaggcggaggcgggaggauuacuugagccccagagguugaggcugcagugaacaaugauugugccauugcgcuccagccuggcaucagaaugagacccugucucaaaaaacaaaaaggaaacauacucagaguauggugcugggagcaaggagcag

SEQ ID NO: 165348 - RNA, 45 nt, Homo sapiens
uccugaauccuaucuuagccuccuuagcccccugacugacucucu

SEQ ID NO: 165349 - RNA, 41 nt, Homo sapiens
gcuccgcccgcgggcgucugacgcggcccgguggcccgcag

SEQ ID NO: 165350 - RNA, 103 nt, Homo sapiens
agcucuccuuggcagcucauuucucccagcugguuugggcaaccaaacaaagcaaucuggagccgugacuggucauuaacaaugguaccacaguucuccagcu

SEQ ID NO: 165351 - RNA, 49 nt, Homo sapiens
ugaggcaaagaaauucaggaaaugaagguauuaaugucaggaaggggag

SEQ ID NO: 165352 - RNA, 105 nt, Homo sapiens
ggugaggaccaguucuuaugccucuuuggggcuacuuagaaagccuuaacugaaacacuucauuucuucaguagcuaucuggagaugucaaccaacuuagcauuu

SEQ ID NO: 165353 - RNA, 71 nt, Homo sapiens
ugggucucucugagccucacuuuuuauaaauggcgaugcuaauggaggagucagggagaaaugagggagag

SEQ ID NO: 165354 - RNA, 45 nt, Homo sapiens
aguacaugaugaagugcuacccagagaucaaggagaaggaagaaa

SEQ ID NO: 165355 - RNA, 78 nt, Homo sapiens
ugcaggguaauuaugaucaguacgugaagacgcggcuagagcuggaggagaaccagaugaagagguuucacugggagc

SEQ ID NO: 165356 - RNA, 46 nt, Homo sapiens
auaauacuucaguuucuuguugugcaugugaaugauauugguacag

SEQ ID NO: 165357 - RNA, 49 nt, Homo sapiens
accaaccaccuggaccuagaugcuugcgugugguuggaagaagaacuaa

SEQ ID NO: 165358 - RNA, 45 nt, Homo sapiens
ucuagguccaggugguugguaggcucauccaggagcagcaugaag

SEQ ID NO: 165359 - RNA, 60 nt, Homo sapiens
ugucccguccugugucacauccauuauaauucugaggugcuucugucuccuuuaccgucc

SEQ ID NO: 165360 - RNA, 45 nt, Homo sapiens
accugccaugcagcgcaagaagcuaaaagacuucagugggggcug

SEQ ID NO: 165361 - RNA, 45 nt, Homo sapiens
agcuucuugcgcugcauggcaggugugaaacccaguccaugcaag

SEQ ID NO: 165362 - RNA, 150 nt, Homo sapiens
auggaagucgacacagagcgggccaugcuggagaaagaggcagagcggcuggcucaugaggaugguagggcuccagaccugggcauaggggugggcguccucccagaaaggcccccaggagccucauggccauacacuguccacagcgga

SEQ ID NO: 165363 - RNA, 57 nt, Homo sapiens
acaugauuaguuacagcaggugcuggagaaguuggucaggggcgugugaagcugugg

SEQ ID NO: 165364 - RNA, 41 nt, Homo sapiens
agcugcucagugacaccaaacuggaauuaaacucaggccgu

SEQ ID NO: 165365 - RNA, 50 nt, Homo sapiens
gaagaaagcugcugcucgagcugucacuggcguccuggccucucacccca

SEQ ID NO: 165366 - RNA, 36 nt, Homo sapiens
agaggaaaggagaauuagucugcaaguuguaacaga

SEQ ID NO: 165367 - RNA, 27 nt, Homo sapiens
uugugaggaggggaucaguucccugcc

SEQ ID NO: 165368 - RNA, 40 nt, Homo sapiens
cagagaagaaugaggccaauggcagagagaccacagguga

SEQ ID NO: 165369 - RNA, 72 nt, Homo sapiens
ggaggcugccaaagcucgacagcggcccagaaaaggacaugaagaaaauggagauguugucacagaaccaca

SEQ ID NO: 165370 - RNA, 45 nt, Homo sapiens
gagcuuuggcagccuccuucuuuuuggcugccuucuucuuggcca

SEQ ID NO: 165371 - RNA, 43 nt, Homo sapiens
ccgugggggacuggugccugugggaagagauguuaagauuaga

SEQ ID NO: 165372 - RNA, 51 nt, Homo sapiens
cgagugcgucccggcaagaggcugggcucgacggccgggugauguggagag

SEQ ID NO: 165373 - RNA, 69 nt, Homo sapiens
agggcucugcgagggggaagauagggcuaagggagagaagcugacgggcggggugggggaggacccggg

SEQ ID NO: 165374 - RNA, 38 nt, Homo sapiens
cucccuacagcuccccuuccccuaacucacugggccuc

SEQ ID NO: 165375 - RNA, 46 nt, Homo sapiens
guuggaccaugugugaucagacugcuaucugaauuaaauaagauuu

SEQ ID NO: 165376 - RNA, 44 nt, Homo sapiens
gguuugguggccacugagguguuaugugguuuuaugucggagag

SEQ ID NO: 165377 - RNA, 355 nt, Homo sapiens
ucgaacccuggcugggcacgguagcucacgccuguaaucccagcacuuugggaggccgaggcagguggaucaccugaggucaggaguucaagaccagccugaccaacaugaagaaaccucaugucuacuaaaaauacaaaauuagcugggcgugguggugugcaccuguaauaccagcuacucgcaaggcugaggcaggaaaaucacuugaaccugggaggcagagauugcagugagccaauaucgcaccauugcacuccagccugggcgacgagagcaagacuccgucucaaaacaaaacaaaaacaaacaaaaaacaucgaacccuaauuuaacaccaaugaaugugagacuu

SEQ ID NO: 165378 - RNA, 29 nt, Homo sapiens
gagugaguuggggcugagaagggagaaac

SEQ ID NO: 165379 - RNA, 58 nt, Homo sapiens
cuaacaagauacuacuuuugauagccccagguucucagauugccaaaggugagcaacg

SEQ ID NO: 165380 - RNA, 41 nt, Homo sapiens; identical to SEQ ID NO: 84090

SEQ ID NO: 165381 - RNA, 42 nt, Homo sapiens
ugacaaggaauacaucaauggggacaaguauuuccagcaggu

SEQ ID NO: 165382 - RNA, 53 nt, Homo sapiens
ucuucuuucuucaagaguuuggucaucgagcuggacaaagaucuuuauggccc

SEQ ID NO: 165383 - RNA, 41 nt, Homo sapiens
accagaaauauuugucagcguccaacagacauggcaaggcu

SEQ ID NO: 165384 - RNA, 31 nt, Homo sapiens
auuaaccacuguuguagaugaaagucugcag

SEQ ID NO: 165385 - RNA, 26 nt, Homo sapiens
acacgugugcacgcagacacacagau

SEQ ID NO: 165386 - RNA, 42 nt, Homo sapiens
aauuuuuuuucugcaucaucaaggcauuccagcuguuccagg

SEQ ID NO: 165387 - RNA, 64 nt, Homo sapiens
gcuggaagaggcacugacaggagcaaccuaggacgccucgcugaggcuggcgggcugcucacug

SEQ ID NO: 165388 - RNA, 42 nt, Homo sapiens
gguaauaugaguggccgcaugauccacguucccaucacacgc

SEQ ID NO: 165389 - RNA, 34 nt, Homo sapiens
acacaguccuuaaauguacauguucccagagguu

SEQ ID NO: 165390 - RNA, 46 nt, Homo sapiens
gauuuuuuuucccucuguuccaaaucauuuuccacacagcugcuag

SEQ ID NO: 165391 - RNA, 43 nt, Homo sapiens
ugaguuaaaauaugagugugccucuuuuauggaaaaagcuaau

SEQ ID NO: 165392 - RNA, 32 nt, Homo sapiens
cugaaagguaaauaaauacauuuuaaaugcau

SEQ ID NO: 165393 - RNA, 59 nt, Homo sapiens
ggucuuugagcagaaaacuuuuucauuuugcccuuaggugcuggcagguagccaagagu

SEQ ID NO: 165394 - RNA, 46 nt, Homo sapiens
ggaccaucuccaaaaaaauucuauccccguuucacucgaggcccaa

SEQ ID NO: 165395 - RNA, 42 nt, Homo sapiens
gcgaucaagaguugagagacuugggcuaucagaaacaugcuu

SEQ ID NO: 165396 - RNA, 75 nt, Homo sapiens
cauccuaucugcaguggaugcagacugaauucaaggcuugugagacuuuuuuucuagguuucuagucauguaaaa

SEQ ID NO: 165397 - RNA, 46 nt, Homo sapiens
gaaacagaaaugagcaagaggcguccccgagagcgccaccagcugc

SEQ ID NO: 165398 - RNA, 75 nt, Homo sapiens
acugcacuucaaaugggaucuugucccccuuucugagcuaggacgagcggagggagccacugcaccaauaaagua

SEQ ID NO: 165399 - RNA, 45 nt, Homo sapiens
agacaguauuuccaugaacuuggacaguaugauaguggcauggau

SEQ ID NO: 165400 - RNA, 64 nt, Homo sapiens
auuuuccgaaaaaggcgaccauauggaucucccgaaggccaggacaccaugacacacaacucuu

SEQ ID NO: 165401 - RNA, 21 nt, Homo sapiens
cccccuucaccuaguacuuca

SEQ ID NO: 165402 - RNA, 58 nt, Homo sapiens
aggaggaagccuagagcuuucccccuuccucuucucucuacccuauaauaagacaaaa

SEQ ID NO: 165403 - RNA, 82 nt, Homo sapiens
agagagcagugugugcccauguaguugaucgcuuaccauuauuauuucuugcuguuugucucacccucgcaguucugugaua

SEQ ID NO: 165404 - RNA, 25 nt, Homo sapiens
cuucugacagagcggggcguaugcu

SEQ ID NO: 165405 - RNA, 42 nt, Homo sapiens
cacagguugugcccguucugaaccuaaaaugagugcccaugu

SEQ ID NO: 165406 - RNA, 47 nt, Homo sapiens
uugccuuuaggucuuucuggauauaaggauucuagucaugguauugc

SEQ ID NO: 165407 - RNA, 43 nt, Homo sapiens
uaaccccaaauccauuccugauucaaaaguuaagcuuacucuu

SEQ ID NO: 165408 - RNA, 42 nt, Homo sapiens
gcaguguuguggcugcauuuuccgaccuucuucacguccgaa

SEQ ID NO: 165409 - RNA, 89 nt, Homo sapiens
uucagaaucaagaaggaaugacaucaaaacugagccaggcacuuuauauuuugcgucaccuuuugguccuuccccaaauggucccagau

SEQ ID NO: 165410 - RNA, 81 nt, Homo sapiens
ccuacaucauauagagaguuaaauaaucuaauagacaguuaaguauuagauuauuuaaucuaauuaaauaaucuaauagac

SEQ ID NO: 165411 - RNA, 46 nt, Homo sapiens
aaacucuaggaccuaaaccauuucagcugcccuucagaccccagga

SEQ ID NO: 165412 - RNA, 36 nt, Homo sapiens
cauuuaguacagagcuuauuuuuaagucucaaaggu

SEQ ID NO: 165413 - RNA, 90 nt, Homo sapiens
agugaaaccaagaaacagcgaagcaaacggacucagaggacgggugagaaagcagcaccucgcucaaagaaaaggaaaaaggacgaagag

SEQ ID NO: 165414 - RNA, 45 nt, Homo sapiens
agcuuacugauuuccauacucgagaauaacguuugaagaaaagga

SEQ ID NO: 165415 - RNA, 82 nt, Homo sapiens
uccuauagccaucuacaagcauuuccuucccuucugcaguaaguaagcaggaauaagggguuccccagccccagggagguca

SEQ ID NO: 165416 - RNA, 48 nt, Homo sapiens
auaaaacuggaaaaggcugagacagaguccugcccaggccaagaggag

SEQ ID NO: 165417 - RNA, 46 nt, Homo sapiens
accccuucagcagucuccacaacaccaacagcaaauggggcagguu

SEQ ID NO: 165418 - RNA, 46 nt, Homo sapiens
gugugauauguugaguuaggaugauagaccaugugugauauucaga

SEQ ID NO: 165419 - RNA, 45 nt, Homo sapiens
cugauaaacauucaccacagaaaaaauccacuguuaccaaugagg

SEQ ID NO: 165420 - RNA, 46 nt, Homo sapiens
uaaucaguguguaucuguugaaccaaaaaaaaaggaacaagaaaac

SEQ ID NO: 165421 - RNA, 45 nt, Homo sapiens
aggucauucuguccauucaucuucuauggucaugaggacucugaa

SEQ ID NO: 165422 - RNA, 42 nt, Homo sapiens
gagcuugccaguucagcagcacaacauacugggccaagcaua

SEQ ID NO: 165423 - RNA, 41 nt, Homo sapiens
gauuuccaggagguagucaugguaccaugccgagucaagag

SEQ ID NO: 165424 - RNA, 45 nt, Homo sapiens
cugggaacauuaggucuccuguugccccuccuuuaggaccuagau

SEQ ID NO: 165425 - RNA, 46 nt, Homo sapiens
gccccuucaaaugaaugagacaacagcaaauaggccauccccuguc

SEQ ID NO: 165426 - RNA, 46 nt, Homo sapiens
ccccaucccggauucccauccaggauagucuuucucaggcucagac

SEQ ID NO: 165427 - RNA, 50 nt, Homo sapiens
gauuccaugaaaaggcagcaacagcaagauagcauugaucccagcucucg

SEQ ID NO: 165428 - RNA, 72 nt, Homo sapiens
gcaagugauccuaacaacucuuggacaucaucagcucccacuguggaaggagaaaaugacacaaugucgaau

SEQ ID NO: 165429 - RNA, 25 nt, Homo sapiens
cagaguucacgaccauuaagugaag

SEQ ID NO: 165430 - RNA, 45 nt, Homo sapiens
ugcacugugugugaggccugugggaaggcaacugacccaggaaga

SEQ ID NO: 165431 - RNA, 47 nt, Homo sapiens
uauuuuccuguagaauuggaaacuuauacucuucuagcaucuggagu

SEQ ID NO: 165432 - RNA, 22 nt, Homo sapiens
uuaaaaaucaauaagcuaauca

SEQ ID NO: 165433 - RNA, 45 nt, Homo sapiens
caggauauguguguaguuuguggcaguuuuggccaaggagcagaa

SEQ ID NO: 165434 - RNA, 42 nt, Homo sapiens
uagauuauacuuuauuuucuuucaugacuggaagaacuauug

SEQ ID NO: 165435 - RNA, 61 nt, Homo sapiens
caguaugccagaugucaggagcaugaguaaaaugagaaaagagaaauggcuuuugacaaca

SEQ ID NO: 165436 - RNA, 44 nt, Homo sapiens
aucuaggcucaagcccugggaaacuccagggcuuuggaagucaa

SEQ ID NO: 165437 - RNA, 46 nt, Homo sapiens
uugaauuugcugaugauuugcauugaugaaguguugggggagagga

SEQ ID NO: 165438 - RNA, 352 nt, Homo sapiens
uguaaggccauaccugaaggguuagaaaacgccagacauggcuggccgugguggcucacgucuguaaucccagcacuuugggaugccaaggcugguggaucacaaggucagguguuugagaccagccugaccaacaugguaucgcuccuaaaauacaaaaauuagcugggccugguggcgcaugccuguaaucccagcuacucaggagacuugaggcaggagaaucgcuugaaccugggagguagagguugcugugagccgagaucgcaccaccgcacucuagccugggugacagagcgagacuccaucucaaaaagaaagaaagaaagaaaaugccagacauuuauugagg

SEQ ID NO: 165439 - RNA, 49 nt, Homo sapiens
uuuagcuguuucugcauggcaaaagacgugugcaguaaaacuaggccac

SEQ ID NO: 165440 - RNA, 48 nt, Homo sapiens
gaaaguauuucauuauguccugaggaacaguugguuauagaaaggcua

SEQ ID NO: 165441 - RNA, 82 nt, Homo sapiens
auuggaaaaacagauuucuaaugaaguugauagugaagaccugaaaaugucuucugaagugaagcauauuuguggcgaagau

SEQ ID NO: 165442 - RNA, 49 nt, Homo sapiens
cucaaaggcauaaggaaguaaaugggcaaaagauaagaccagaccacau

SEQ ID NO: 165443 - RNA, 48 nt, Homo sapiens
ugcaauacuuuuccuugagauuuuucuggacccauaaugccuccuuug

SEQ ID NO: 165444 - RNA, 46 nt, Homo sapiens
ggcucaucaccguuguguggaguggucacuaggaguaugccagaug

SEQ ID NO: 165445 - RNA, 94 nt, Homo sapiens
cgcuuuuuguuacuguggggaaaaaaguuccuuaggacaaggagacuuaaaacaauucagaauaacgccuggauuuaucuugccauggagaaac

SEQ ID NO: 165446 - RNA, 43 nt, Homo sapiens
acuauaauuuagugaagagcagcucacuuccuuuuagaugaug

SEQ ID NO: 165447 - RNA, 46 nt, Homo sapiens
uagugaagaugguaggguggaaagacuuaauuuccuuguugagaac

SEQ ID NO: 165448 - RNA, 798 nt, Homo sapiens
aggcuggguaaguuugccuuaaggaugaaaggggccuuggaguggaaguagaaugaaggauuuuuuuuagagagguggggauaucuaaagguuuuuaugacgcacggcuguuugcaggcucuaacuaaaggaccauuguuuauuugauguugauuuaaguaguggauccuuagagauagugguauggcggucuugaauuguaucaaaaaucuugguuuucucuaggcaauuuuuuguuccaauucaguugaauacucuucaguggauucaaaccaugaaaaaauaagucaccaggggaggauagcugaaauaauuccuaaggcggugccuguuuuaauggagaagauaugggguggagccugcguuuuaaacaaacccagaucugaugcaggauguacuuaacuacguugagaaaaacugaucugcgcaauugaggcguuacugaaauauuaggugguggagauuugagaauaaggguuuucgucuuuuaccucaugggaacucuggaaguccuuuuguuaggauaaauccuaauaagaccaagauaguacuguaaaaugaaguuuaauuaucauggguccccgcuuaagaaacugaagaacuuauuuucuuuuuuugccccggggugaauaauaauugguuuacuauugcuuuagggggaaaccuuagauauuuuaauuuaccuucucucuggauaguaguguuguaagagagcagaaacccauacuugaaaaugugcuuuucuuuuuuguuuucuaggauggguuuguggaguucuuccauguagaggaccuagaa

SEQ ID NO: 165449 - RNA, 31 nt, Homo sapiens
uuuggugccuuuguggcuaaacacuugaaga

SEQ ID NO: 165450 - RNA, 186 nt, Homo sapiens
aaggagaaggaugucaggccagccacuuccaccacaucaugucugggaugggauggcagaggggaaagagcaucuugagccaggagcgggccuagugcccuccucuggaggagccccccgcuggcccuuucaugccccgcuagccacccauuuccuuccucccccagcccagggacacucacagua

SEQ ID NO: 165451 - RNA, 46 nt, Homo sapiens
auccacuggggaaugggacgauuuugcuuuuguuucuuggccagga

SEQ ID NO: 165452 - RNA, 42 nt, Homo sapiens
uaaaucuuaacuccuuuuaauuauucugaauuuuagugggau

SEQ ID NO: 165453 - RNA, 75 nt, Homo sapiens
ugugggcccugaagugggagaaugucuaugauacauuguugaacuagagaaaaaccuuuccaaaaguuguaaagc

SEQ ID NO: 165454 - RNA, 56 nt, Homo sapiens
aaaauaugcaucaauggacuaccaugcaguuuuaaaucaagacauagagauagauc

SEQ ID NO: 165455 - RNA, 46 nt, Homo sapiens
ggaaguaggacuggaguugaggaaucgauuaggauaaguauuuaaa

SEQ ID NO: 165456 - RNA, 46 nt, Homo sapiens
gauuccagucacugcaaaggaggaauucggcaguuucuggcauaga

SEQ ID NO: 165457 - RNA, 47 nt, Homo sapiens
ggcuucugacugugugacuagaacagaggcuguguguaguggugagg

SEQ ID NO: 165458 - RNA, 39 nt, Homo sapiens
cucauuauuuuuguguuaauguuaaaaaauuuuucugaa

SEQ ID NO: 165459 - RNA, 41 nt, Homo sapiens
cucauugaacugucgggaguggaagggugcgcugggacgug

SEQ ID NO: 165460 - RNA, 45 nt, Homo sapiens
uuguaaauuaagacaccguuuuagugccagcgaacugcucggcuu

SEQ ID NO: 165461 - RNA, 44 nt, Homo sapiens
ugagcguacaguagggcuggaccccagcuuauuagaggaccaga

SEQ ID NO: 165462 - RNA, 50 nt, Homo sapiens
guuuuggagacguagccagcguccccucguaaggcagaauaccaagagca

SEQ ID NO: 165463 - RNA, 46 nt, Homo sapiens; identical to SEQ ID NO: 84220

SEQ ID NO: 165464 - RNA, 82 nt, Homo sapiens
gggcuguuagcagguuuuggcuugccucugagugcuacagaccuaccugccauuggcuccuguccgcuguaucuacgggaag

SEQ ID NO: 165465 - RNA, 1766 nt, Homo sapiens
aucggaggggagcgaggugagcggagucugacgcucgcggaaaagccccgaggaggcggggguucccgggauuugggggauuccaagggcggaaugcggcuccggccggugacugcucaguuucgcggaggggauggcugccuaggcugguccgccggagcaggcccggagaucuagggcuagaucgauccagcgcccuuguaucaaugccaucgguggugcggaaguuucuggaaauuucuaguucgggaauuguggcguccuuuagguuugccuccugauuugguggcacuuccacgccaccuuugcacuaccaaguuagcaugaaauauuuuauguuugcaaugggacaguucggaaagcauauccugggauaugcgucugcugggccccaggaaacuauauuugccacaugagauaauauaucagcacgugcuguguuauuuauacguuaaagggacuuguuugcucauugcuuuugccuuauuacugauucuuaauuuagagguccguucagaugagcaaacauuuucucuuaauuugccauugggaaaaugcgcucaacguagugaugguguugccuagguuacauagccgcucagaaguuccuaaggccuggugaauuagggagcguguugcuuuguaacuggauuggccuuguucuggaacacguuggaauugcuggccaggcaauguguuugaaugcauguacaggacacacacacguuuacacguacauucaguuuguugcaacuagcuagggcuagguuuaaucucaccugucuuagcugcuaucuagaggaggaauuuuuacagcuuuugcuucagagguugcaugaggcaguuugcucagagcacaaaggcugcagguauacguaacacguggcaaguccgcccacccaaagacuguuuaauuuucucccguugguugcuuggugauuggaaauucucaguaccucuugaagaaauuacucaggauuuaaaacuauuuguauuuaaugauaucucuuacauggugcuaaucuuuuggcuacuauaauugguuaugauccuuaguguaauguuucaaaucuguuuauauacauacaugacaguagguagacuaaauuugaauauuagaauaaaauaagauucacuaauucuagugaguauauucaaaggaaaugaaguuuguaugucaaagagguaucugcacucccauguucauugcagcauuauucaugauagccaagauaauggaaucaaacuagguuuccaucuacagauggauuuuuuuuaaaauuugauauaugugcacaguggaguacuauucacccauaaaaaauaaugaaaucuugucacuucugacaacaugaauuaauauggaggacauuauguuacaugaaauaagcugggcacaggaagacaaggcaugaucucacuuacaugugguuucuaaaaaguugaccuugaaguagagaauggaaugguggauuucagggguuggguagauguugaucacgagagaccuaauuucaguuagaaagggggaauaaauuuaagagaucuauuguauaacauaaugacuauaguuaguagcaauguguuguguucuugaaauugcaaaaaagaaaaauuacaguaaaggggaacuugguaauucaugauugaucugcuaccauaauuauaccaaccuucuuuuuaucauuugucuauuugguuguuuugcauacugacaagauuuucuuuucuuuuaguuggucgaauugucuuagaauuguuugcag

SEQ ID NO: 165466 - RNA, 46 nt, Homo sapiens
uuggacacacgacugggaaaccucuccauuucaaaggaugcccuuu

SEQ ID NO: 165467 - RNA, 2064 nt, Homo sapiens
auuuauggugaaaaauuugaagaugaaaauuuccauuacaagguaaaguagagaaaaugcauguuauugcugauaaaaagauuguuauauaucuggaauacuuguuggauuaagacaccaaaaaauguuucaagugugcuuagauucuccauuucuuguaauaggaaucacuuuuguaaauaaugguucuuuaauauggaaaaguuuucauucaguaaugauuaauucagcauuauuucauugugauccaguuuuuauaugcuucaguuaagccagugaguuuuuaaaugcgaccagcaucuggcaaaauuguuuccaggaaaaauguuuccauuguuggaaggaugguaacuugugcauccuuauccuugaauuugaagagcaacaaaaccaucacuaauauccaggaugucaggggauuugcacacuagcagauauaguuaaauguccaagcuccuaaaggacuucaguggugccugugccuucuugucuucguugucccaagauguaauugggguauauugcaucauucaaguuauaagaauggacauguaaguacaaaaguaaagugauauuuuuggaaauaaggaauaugagcaaggguauuaggauaauuugaaaaaaugucgucagucuuccagucaguguuuauugagccacuaucacuggcaccaaaggguuuauaaaaaugaaaggccuugaugacaaggaauuuauaauccuaccucagagacaagauuaagauacaugggacuacuggagaauaauaguauauaaauaaaugcuaaauugauugaauauccuugcuuguauaacauugcuaauacugucuauauacugcaggagaaagaugugauuuaugcagucugaauuauuauggaagucauugaggaggaauggcuacuugggcugugcagacugggucuugcaaggcggcaacaugucugagauuugguuaggcaggaacuguaguauugaugcagaauuuaaaaagggacgucggugaggaaagacaaaggcaagagacguugaggaaauaaaguucuaguuacuguuguaccaaaggaagcuaccagaaggaugaaaacuaaaggugaugugaugaucacauugacauagagaaaaggggccuauagacaagacacaugauucuugcuuucuauaaacgugguggccuuaaaaucugaauuugauuuagacugaggggaguaaaaggcauuuuggugggguggggggugucaugaaacauuauauaacaugagaguuacggugcaugcaccaacaaggaauacauuuagaaagccuaggagauaaagugaaaagguuaagaaauuggguuucauagauccuuugacaggauuaugccaagguagaauuuugauuucaagauguaugcagcaguuucuuuugagcacucuccgaagaggugauucaucugggaugaaaaccuaauccaaauccuguaugauuuggauucuuuugagauuaggaaaguaccaaacugaaugucuuggguaaauucaguaucccauuauuguuccaguuuauugauguuuuguaaaggaagacuuauacuguaggcauauuuaugaauuuggaagaccguucaggucuucccagaaaaaaagagcauucaucauaaagagggcaaaauauauuacaagaguuucauaaugcugcaucuucauuuuaaaggugaaguguaaguauuuucucauggccaauuuagaaauaacccuccccccgacuauuguuucuguuaccuauuuacuuugauaagguuuuuuaaaguuuaaagugauuaagugccccauguuuugugaauuaaagguugcaguuuauaaaaaaauaaaaaguaauuaaaaaauuuuauaagugaaaaguaaaaaaaaguaguuugaucuaaaugguaguauagugcaccccaguuuuauguucaguaaaagaacaguucagacuaacacacaauucagaaaagaacacaucuaaccuugguuuucuuuuaauuuuuauuucuacagcaugaucgggaggguuuacugagcauggcaaaugcaggccgca

SEQ ID NO: 165468 - RNA, 1374 nt, Homo sapiens
gugaaaggugaaaaaccugcuaaaguaaguaaaaaguuacagugaaauacacuuauuaucuuaguugcuaucuuuuugagacggagucucgaucuguuccaggcuggagugcaguggugcggucucggcucacugcagccucugucucccagguucaagcuauucuccugccucagccuucugaguagcagggauuacaggcgcgcgcuacaacacccggcuaauuuuuucuguauuuuuaauagagacgggguuucaccauguuggccaggcuggucucaaacuccugaccuugugauccgcccaccucggccucccaaagugcugggauuacaggcaugagccaccgcacccagccuguuaguugcuaucuuaaagaaauauaaguaaaaggaucaggugauuauuagcuggaaaaauguuauaauaauuuuggguauaggagccaggaucugccacuuuuuuuuuuuuuuuuuaacuuuucuacaaugggaaagacaauuaggguaguuuuaaaggagauuuuuauuauuucaacuuucauuuggugaucuuugcuaguuuacguuaagucuuccuauaccugcaaaacuguucaguugguauguauaguaguacauaguggaaugaggauaauaagcccaaaaucuugucuggauuguagcauuaacuagaggcuuggccuugacuuuguuacuuaacuuuuccacacguguuuucuccugucuaaauuacuuauggguuuagacuagauuaucucugaagacccuuguguacuuaaugucugugaaucaaaaugaccuuaauauuggcugggcaugguagcucaugcuuguaaucccagcacuuugggaggcugaggugggaggaucacuugagaccaggaguuggaaaccagcuuuggcaacauagugagaugcugucucuauuaaaaaaaaaagaaaaaaagaaaaaccccuaaacgaccauaauacuacccagccuaagugacaggguugugagugggaguuggaagcucaguuacuuguaggagguaggcugucacucaguguaugacaagaauaguaguaaaccggaagcucaugccccaccuaaugccacuuacauagacaaugauaaaauugccaacuuauucuguguuuauugagcuccugaauagcaauaaaaugcuuauguaaauacuaacauugucguauuaguuggaauguauaaaaacagcauuauaguacauaaaugagccuucucacauaaaucugugaauuggacagugcugcacaugacuucagcuguauagcuuuuaucucucauuauuacgauagugcacuucuacaauuuaggguuauuuuuacaguugugcguuauugcagaaugugg

SEQ ID NO: 165469 - RNA, 48 nt, Homo sapiens
agggacccaccaggcggaggaaaagaugguggcgaucaccuccucggg

SEQ ID NO: 165470 - RNA, 56 nt, Homo sapiens
guacuuucaaccgaaaagacacccuuuuuacuuccagaagaaccaggagggguacu

SEQ ID NO: 165471 - RNA, 111 nt, Homo sapiens
aaguacuuuucagccuauaagaaacaugcauuugaaacuggaacuauccacagauugaaagugugcaucuccagucuugggauuuagagaaaugaaggagggguagagagg

SEQ ID NO: 165472 - RNA, 74 nt, Homo sapiens
accuggcacccccgagggcggguucgggccacagcucucugaaguuugaggaagcacagugauggagaugaggc

SEQ ID NO: 165473 - RNA, 46 nt, Homo sapiens
aaacuuuuccuuaacuuuuauaucaccagaaauuggauuuugccaa

SEQ ID NO: 165474 - RNA, 46 nt, Homo sapiens
ugggcuggggaucaccauagcuuuucuagcuacgcugaucacgcag

SEQ ID NO: 165475 - RNA, 101 nt, Homo sapiens
aguaguagcaguuacaaccaaacaaauaugaacauucguaacauuggaugguugauaugcguucugcauauccccacuacagagaaucugugauguagaau

SEQ ID NO: 165476 - RNA, 94 nt, Homo sapiens
cugcuaagguacaguuucuuuucucgcuccagguauacauccccagauuuccucuauauucguucuuggcucccuuguauauuuuucucaggag

SEQ ID NO: 165477 - RNA, 39 nt, Homo sapiens
uggcaggcugaaagaaaguaaauuaaaaaaaacaacaaa

SEQ ID NO: 165478 - RNA, 46 nt, Homo sapiens
guuuuaaucacaugaaugaaaucgaauacuugggaagcugccaccu

SEQ ID NO: 165479 - RNA, 63 nt, Homo sapiens
aguuuugugucagugcccaaaggagguagguugauggugcuuaacaaacaugaaguauggugu

SEQ ID NO: 165480 - RNA, 80 nt, Homo sapiens
aauaggaauaauauuuauccaaaagauuuuuaaaaauagggcuguguuuaaaaaaaaaaacaaaacaagaaaagcagcag

SEQ ID NO: 165481 - RNA, 30 nt, Homo sapiens
auugaaauacauggcagacagguauucauu

SEQ ID NO: 165482 - RNA, 46 nt, Homo sapiens
caaucuuagugagccaaaauuguuuguuuguuacuacagaauagag

SEQ ID NO: 165483 - RNA, 41 nt, Homo sapiens
gaccuaauuugcaaguauugggucuuaaacuucaagugcaa

SEQ ID NO: 165484 - RNA, 42 nt, Homo sapiens
acacccuccacugaacccucaaccuucgaaauacuccaguuu

SEQ ID NO: 165485 - RNA, 57 nt, Homo sapiens
aagcuuagaggaacuugccugugagcgcuggucuuuguguuugguuuugugauguaa

SEQ ID NO: 165486 - RNA, 63 nt, Homo sapiens
aguuaauuuguuuuacaggaauuuuguuuuuuaaaaaaauaggaucauucugaacuuuggaau

SEQ ID NO: 165487 - RNA, 48 nt, Homo sapiens
aaaaaaauuuccaaugaagaugucagcauuuuaugaaaaaccagaagu

SEQ ID NO: 165488 - RNA, 49 nt, Homo sapiens
aauaguaugaacaaaauuugcacucuaccagauuugaacaucuagugag

SEQ ID NO: 165489 - RNA, 44 nt, Homo sapiens
gaggaggaaugggaguucuuguuuaaugaguauagauuauucau

SEQ ID NO: 165490 - RNA, 47 nt, Homo sapiens
aaacagauuauagcauuauggaaggaaaauguuaauuuggagaaaac

SEQ ID NO: 165491 - RNA, 47 nt, Homo sapiens
uguauuuucagagucagcuguauaucaacaauauauuuccuuaauga

SEQ ID NO: 165492 - RNA, 344 nt, Homo sapiens
gaagugcuuaucuuugggaaaauagaagggggcugggcgcaguggcucacgccuguaaucccagcccuuugggaggccgagguggguggaucacgaggucaggagaucgggaccauccuggcuaacauggugaaacccugucucuacuaaaaauacaaaaaauuagccgggcuugguggcaugugccuguagucccagcuacuugggaggcugaggcaggagaaucacuugaacccggcaggcagacguugcagugagccgagauugugccacugcacuccagccugggagacagagcgagacuccaucucaaaaaaaaaaaaaaaagaauagaagggauuuuu

SEQ ID NO: 165493 - RNA, 47 nt, Homo sapiens
agaaaauuuaugaaaucuuuauguuaaaacuuuugaccugcccaaaa

SEQ ID NO: 165494 - RNA, 46 nt, Homo sapiens
caucgguggaauacaacauaauggaguuggaacaagaacuugaaaa

SEQ ID NO: 165495 - RNA, 64 nt, Homo sapiens
aaugugguggaggaaaugacaaaaugaagauuucccagaucuaaaggacaugaauuuggagauu

SEQ ID NO: 165496 - RNA, 63 nt, Homo sapiens
auuagagaaccagcucaggagauccaguguccaacuuagaggaguuccaaauugaggagagaa

SEQ ID NO: 165497 - RNA, 36 nt, Homo sapiens
uaccccagaauccccaaaagucccaaaaaguggcac

SEQ ID NO: 165498 - RNA, 45 nt, Homo sapiens
aauaaauacuggacuuugggaaauucuguuaucuuggaagcaaaa

SEQ ID NO: 165499 - RNA, 53 nt, Homo sapiens
aauaucauagucuuugaacuuaauaauucaacucaguuucuuuagauacgauu

SEQ ID NO: 165500 - RNA, 74 nt, Homo sapiens
cagaaucacuuggagagauuucuuaggaaggcccauaguggagacugccaaggacacaccaacguugagaggca

SEQ ID NO: 165501 - RNA, 62 nt, Homo sapiens
uaugugguaaacauuugucccauaaguaaauuaauagaugaaaaacgcacaugauggagagu

SEQ ID NO: 165502 - RNA, 32 nt, Homo sapiens
uagagagauguccacagagcucacugugaucu

SEQ ID NO: 165503 - RNA, 53 nt, Homo sapiens
uuuuuuuguugucacauaucuuucauaacuaauuacaccuauccugcucacau

SEQ ID NO: 165504 - RNA, 44 nt, Homo sapiens
uacuugaaauuuaaccuguucuuugcuaauuuuucuuuauuuua

SEQ ID NO: 165505 - RNA, 75 nt, Homo sapiens
ugaacaucugagauugggccacaggagaaaagggauucaagguauuuucuuuuauagaacgaaagaauuagaaau

SEQ ID NO: 165506 - RNA, 48 nt, Homo sapiens
uccaccucugggaagauucagauugucucugcuugaaucugcucagau

SEQ ID NO: 165507 - RNA, 47 nt, Homo sapiens
auuuugauuagaaaggguauauauauaaagauauaauuaaggcuggu

SEQ ID NO: 165508 - RNA, 40 nt, Homo sapiens
auguaaaauuuaugacagauuaauucauaaacccaagauu

SEQ ID NO: 165509 - RNA, 62 nt, Homo sapiens
cuuugcuucucucuucuuaccguggcagcgguguguguuucuauuuuauuaggaccaucucc

SEQ ID NO: 165510 - RNA, 45 nt, Homo sapiens
gggcggaugcagagcuugaauugaaaaucaaauuaagcagaauuc

SEQ ID NO: 165511 - RNA, 47 nt, Homo sapiens
gaggccuggaguccuccaucuggucauuugaguuuuauguuguaggc

SEQ ID NO: 165512 - RNA, 52 nt, Homo sapiens
uucacccagaauguuaaguaugagacauuauucagucauauguagaaagaaa

SEQ ID NO: 165513 - RNA, 45 nt, Homo sapiens
auuguaguuugaaauauuuuguaacuccagcagauggagcuagaa

SEQ ID NO: 165514 - RNA, 37 nt, Homo sapiens
ugacagauuuuauccucaggggauuaaaugaggaaau

SEQ ID NO: 165515 - RNA, 40 nt, Homo sapiens
uuaugugggaggacaaaagagauugcugacaggcaugagc

SEQ ID NO: 165516 - RNA, 91 nt, Homo sapiens
cagaauggcccaaauacacccuugacacugaagcagaugggugcucagaauuccagagaccugagcagagagucuuggaggacauuaggca

SEQ ID NO: 165517 - RNA, 359 nt, Homo sapiens
ucucuaagacuugauguuuuuuuuuuuuuuuuuuugagauggagucucacucugucgcccaggcgggagugcaguggugcgaucucggcuuacugcagccuccaccuucugggugcaagugauucuccugccucagccucccuaguagcugggauuacaggcaugcacuaccaugcccagcuaauuuuuguauuuuuaauagagacagggcuucacuauguuauccaggcuggucucgaacuccugaccucagauaaucugccugccuugacuuccuaaagugcugggauuauaggcaugagccacugcgccuggccaagacuggauaauuaauuggaugugagcacaacaguauauaa

SEQ ID NO: 165518 - RNA, 52 nt, Homo sapiens
gagugaugaggacccuggaccuaguugguagugugcugggaauagaagugaa

SEQ ID NO: 165519 - RNA, 46 nt, Homo sapiens
uuaaaaaaauucauuggcaugguuucaugaacuguagacacagaag

SEQ ID NO: 165520 - RNA, 48 nt, Homo sapiens
gcacuugaaguacuccauggauuccauaaccucuaaaaauucugaaga

SEQ ID NO: 165521 - RNA, 58 nt, Homo sapiens
auacuuaaugauuucuuaauauuaugcuaucaguuuaaacuugcgggacuuuugagag

SEQ ID NO: 165522 - RNA, 46 nt, Homo sapiens
ucuuauguccaacuaagaauagugcuaggcuauuuaguaucuggga

SEQ ID NO: 165523 - RNA, 39 nt, Homo sapiens
ccagggaaucugacuacucuuagagucauccucuuagac

SEQ ID NO: 165524 - RNA, 58 nt, Homo sapiens
gcaguguacuguaagcuccaugagggcuauaacuuuguucacugcuaugucccaguuc

SEQ ID NO: 165525 - RNA, 25 nt, Homo sapiens
cuuucaucucccccagcccccacgu

SEQ ID NO: 165526 - RNA, 39 nt, Homo sapiens
gcggcuuccugggaggcgaggggucccgacuaggggcug

SEQ ID NO: 165527 - RNA, 53 nt, Homo sapiens
agcgcccguuuccgggcagcggcgguggcggcugcggagggucuggucuuugc

SEQ ID NO: 165528 - RNA, 93 nt, Homo sapiens
uuccuccuccucaccacugcugucguacaagccgcuauuuuucccagacuccagggcucccagaauauagucaagaccgucgcgugcaaagcu

SEQ ID NO: 165529 - RNA, 81 nt, Homo sapiens
uguauccucgucgucguccucgcucugcgcuucugcuuccugcgccuucuuuuccuuuucuacgucucccuccuccuccuc

SEQ ID NO: 165530 - RNA, 26 nt, Homo sapiens
cgcccggcguccuugccggaacgcgg

SEQ ID NO: 165531 - RNA, 50 nt, Homo sapiens
auuaccaguggcguuguugcauguuugaaaugaggucuguuuaaaguggc

SEQ ID NO: 165532 - RNA, 41 nt, Homo sapiens
uucaagaucgacaaggaguacuugcuaaaaauggcaacaga

SEQ ID NO: 165533 - RNA, 407 nt, Homo sapiens
gugacauacugcggcugaucaagguagcggagagccagagcuccucccggggcgugggguggagguggcuccguuucccagaguggggugauucacgucuugaggucucggccggugugagagcccagccuguuccccuuucugcgcccauccccggcucggccgccaccccgcccgcccgccccauuccguuccccugagcuggccgggccggagccucauuuuguuuucuacuuuuuucucuccuaugugcauccccccaggagcuggcuaaauaugaauacauggaagaacaaguaaucuuaacugaaaaagguaauucaacaguggcgggacgggggacaagcguucggugccugucaccuucgccaaggccauuaccgccccugcucccccuucuugcagau

SEQ ID NO: 165534 - RNA, 45 nt, Homo sapiens
guucaaguacaggggccugguccgcaaagggaagaaaagcaaaag

SEQ ID NO: 165535 - RNA, 46 nt, Homo sapiens
gucacucgccgagguuccuugggucauggugccagccugacugaga

SEQ ID NO: 165536 - RNA, 46 nt, Homo sapiens
uguuuacuaauuccaguaacuaccauuucuuuuucagcuagaugag

SEQ ID NO: 165537 - RNA, 406 nt, Homo sapiens
augcagacagguacuaguaccuacagcuaggugggaugcggaacaggacugggcaagggaagggcagugaugagaggggaggaggcucuggggccucagggccuacuguauacuccucugugacucugaaccugaggcuugggaguuccgccgugaugcuaggucugucccaauccucuccgggcccugcuggagagucagcugggugaggggcuuuuccaguccagcuuuaguuuucucucuccuuggcugaaggcaagguugccauuccauccccuuggagccucaagccucgaagccugggcggugccacauuccucuggugaguaccaagggggugcugugggaucugagaccuccuuguuuccucagggucaaggagcugagcccccacagugggcccagu

SEQ ID NO: 165538 - RNA, 1117 nt, Homo sapiens
ugggccuggaagucuaugugacauucuucgagaucuacaaugggaagguagcuggcaggaagccccuuguuuacacuguuggggcccagcacuuuuuaaaaccuugaagcuggcuagaaguugaggccaaaaaccuauuagcugauuagcugucaagccacugaugggccauucugcccuggcauacacauguaggugguuuaaucugauggugagauggcaccuaaguucaagaaguauggcaagaauacuccucagggcgcccuuucaggugcaagguuugccuguguguguccugaccucccucggccgaccuccuucaucccuucuuccccgauugugcacguucagucucauauucauucuuucccugcccgcaccaccauauaucucuuccaccccucucucuauucacugugugcuucugcagaguugcuuuccuuagagugggaucuagauaauaaaaauagcuaauauuuaucauuaauaagauauuaggggccaggcgugauggcucacaccuguaaucccagcacuuugggaggccgaggcgggcaggucaccugaggucaggaguuugagaccagccuggcuaacauggugaaaccccaucucuacuaaaaacacaaaaaauuagcugggcaugguuaggggcaccuguaaucccagcuacucgggagucugaggcaggagaaucgcuugaauccaggaggcagagguugcagugagccgugaucgcaccauugcacuccagccugggcgauacgagcgaaacuccgucucaaaauaauaauaauaauaagauauuaggagcuaugcacuauucuaagcacuaccugucucaccuuuacagaugagaugcaaggcuagagugguuauuaacuugcccaggcucacacagcuaguaaguuaccagagucacagcaaacugaggcaguucggcucagaucccaaguauauugaccucugcuaggcugacauccaucaguucguauucucugccuuuccugcugcuggcucuuguccgagcugggcaggcuaguaggaggaagcagucggguggggugccgggugcccaguggccuuagccucauucccccugccuggcacagcuguu

SEQ ID NO: 165539 - RNA, 46 nt, Homo sapiens
caaucuuugaagguggaaaagcaacuuguuuugcauauggccagac

SEQ ID NO: 165540 - RNA, 13 nt, Homo sapiens
caggcuucucacc

SEQ ID NO: 165541 - RNA, 35 nt, Homo sapiens
ccaaacacauaacaauaaaaaccaaacucuguguc

SEQ ID NO: 165542 - RNA, 40 nt, Homo sapiens
guagagcccacugcucauuguauaagccccgaggccuaga

SEQ ID NO: 165543 - RNA, 43 nt, Homo sapiens
uuccaacaggaagugcaaacuaauucgaagucacacuucacca

SEQ ID NO: 165544 - RNA, 50 nt, Homo sapiens
agcgaggcaugaggccugcucacugguagaacuucuuguuagggcuguua

SEQ ID NO: 165545 - RNA, 45 nt, Homo sapiens
cuugagccgguccacuaucuucugggcgccauacagauccacaaa

SEQ ID NO: 165546 - RNA, 38 nt, Homo sapiens
acugucucuucuguacucaagcuguaagccuuuaucag

SEQ ID NO: 165547 - RNA, 46 nt, Homo sapiens
cucucccaaucagugaaaucgcugcugucagcaaaagaccugagaa

SEQ ID NO: 165548 - RNA, 46 nt, Homo sapiens
aagcuguguuugaggaccuuagucuuaagcacagagugcuaaagga

SEQ ID NO: 165549 - RNA, 46 nt, Homo sapiens
augacaaagugaagaagaaagcucuaacaucauuugaaagggauuc

SEQ ID NO: 165550 - RNA, 42 nt, Homo sapiens
aaacuaacguuuauugaauguccaugggccagagcacaccug

SEQ ID NO: 165551 - RNA, 46 nt, Homo sapiens
ugaccaaagaaucaaaggccuugaugggacucuaccauggucaggu

SEQ ID NO: 165552 - RNA, 47 nt, Homo sapiens
ccccagaacaauacuguaaaauggguauuguuuuucccauuuuuaag

SEQ ID NO: 165553 - RNA, 57 nt, Homo sapiens
cuauuccauuugucaggcaacagguuuacaaaaaaguggaagaaaaagugcgaaagc

SEQ ID NO: 165554 - RNA, 52 nt, Homo sapiens
augaacacaaaaagacuagauaacaguguuauaaacacucauguacccaagg

SEQ ID NO: 165555 - RNA, 57 nt, Homo sapiens
auuuuuauaggaccaggacuaaaaccuccagaggaacggacaauagaauaccuagaa

SEQ ID NO: 165556 - RNA, 29 nt, Homo sapiens
cuuaaauacuugauagaauuaaccaguaa

SEQ ID NO: 165557 - RNA, 45 nt, Homo sapiens
uuagacauugugguaagucaagaaaaagaaacaaaugacaucuau

SEQ ID NO: 165558 - RNA, 45 nt, Homo sapiens
aaaugaauuuagcuaaaccacaagauacaagguccauguccaaaa

SEQ ID NO: 165559 - RNA, 48 nt, Homo sapiens
aacggauaaacaaacuaugguacauuucuacaauggaguaacacucag

SEQ ID NO: 165560 - RNA, 45 nt, Homo sapiens
gacccuucaagaaguaacacagcuaucacaagaagcacagagaau

SEQ ID NO: 165561 - RNA, 45 nt, Homo sapiens
ucuugugauagcuguguuacuucuugaagggucuugcaagcggcu

SEQ ID NO: 165562 - RNA, 46 nt, Homo sapiens
auaagaaccaguguacaaggauguuugguccuguguagugugaaau

SEQ ID NO: 165563 - RNA, 43 nt, Homo sapiens
gugagaguccaugcuuuucccccaucuaaauuugguguauucu

SEQ ID NO: 165564 - RNA, 51 nt, Homo sapiens
acuucccgcugaaauucaaaauacuauacguucacacugacauuacugaaa

SEQ ID NO: 165565 - RNA, 49 nt, Homo sapiens
accagacucagaaaguuggggaguuaggaagccugaaaucgccgcagga

SEQ ID NO: 165566 - RNA, 46 nt, Homo sapiens
agaaaagcggcugaggaugccaaucgcccggcaggccaccaucuug

SEQ ID NO: 165567 - RNA, 40 nt, Homo sapiens
cgaaaggucguauucuccgggggaggacgggggcccggag

SEQ ID NO: 165568 - RNA, 45 nt, Homo sapiens
caccgaggcguccucagggcaggugaugucuccaucugaagaaug

SEQ ID NO: 165569 - RNA, 46 nt, Homo sapiens
gcacugagagccugacucguugaaggaggaagcugaaggcaaaacg

SEQ ID NO: 165570 - RNA, 62 nt, Homo sapiens
cugcaaaauuuuucuuuuucuuuuuaaauggccagcuugacugaaugagacuuuauccaaag

SEQ ID NO: 165571 - RNA, 34 nt, Homo sapiens
auugaucuuauccuccgugacugucaccucaucg

SEQ ID NO: 165572 - RNA, 27 nt, Homo sapiens
gacucugggcaggcugccuaaucugaa

SEQ ID NO: 165573 - RNA, 83 nt, Homo sapiens
uuacuucgcugcagcgggagaacuaaguccucuuaccugaggcacugcugaacugguucgcaagcagucacucuacccccaag

SEQ ID NO: 165574 - RNA, 62 nt, Homo sapiens
cagagggggcacagagaacaaacccccucagaagugaagaggagagcggaaggaaccgagag

SEQ ID NO: 165575 - RNA, 46 nt, Homo sapiens
gggacggacaggagcugaggaggaaagaggaggggagaggggucag

SEQ ID NO: 165576 - RNA, 45 nt, Homo sapiens
gugaccgacauggaguggaggugcugucaggguuaugggggcgau

SEQ ID NO: 165577 - RNA, 42 nt, Homo sapiens
cuggcuccagugcaggcagcccccucaguggacuggggggag

SEQ ID NO: 165578 - RNA, 43 nt, Homo sapiens
gguccuggggagucagagaaggugcagcagcuggaggaacagg

SEQ ID NO: 165579 - RNA, 53 nt, Homo sapiens
gcugcaaggccugcggggcguccugcaaggacugagcgggcgccuggcagagg

SEQ ID NO: 165580 - RNA, 41 nt, Homo sapiens
agcagggccccagccccagccucagccccuccgggccccag

SEQ ID NO: 165581 - RNA, 46 nt, Homo sapiens
ugcucuccagagcugggccggcgacuggcagagcuggagcgcaggc

SEQ ID NO: 165582 - RNA, 87 nt, Homo sapiens
cuggagggauuacaagagguugugggccggcuccaggaucguguggaugcccaggaugagacagcugcagaguucacacuacggcug

SEQ ID NO: 165583 - RNA, 57 nt, Homo sapiens
gggcaaccaaggaccguaucauuucugagauuaacaggcugcagcaggaggccacag

SEQ ID NO: 165584 - RNA, 42 nt, Homo sapiens
cugugaacgguuggacacuguggcugggggacugcagggccu

SEQ ID NO: 165585 - RNA, 86 nt, Homo sapiens
acccuugcugcagucaggguugccacugcccccuccaacccugacccccgcuggcagccccaggcuugacauuccacucugaacuu

SEQ ID NO: 165586 - RNA, 69 nt, Homo sapiens
cugaagagacagcgggggcggcgggcuccuggggucucgccugagacggggcaccuagcccugggcgag

SEQ ID NO: 165587 - RNA, 28 nt, Homo sapiens
gaucccccaagaaccccuccagggccgg

SEQ ID NO: 165588 - RNA, 53 nt, Homo sapiens
cgcccagagcgaggagcagggcggcagcccagggcaccagggucguaagacua

SEQ ID NO: 165589 - RNA, 46 nt, Homo sapiens
ugaugaaaguuuggaccaggguccuccagagaacaguucuggagau

SEQ ID NO: 165590 - RNA, 24 nt, Homo sapiens
ccaucugcaagagggaggggaagg

SEQ ID NO: 165591 - RNA, 44 nt, Homo sapiens
cccacagguuccacuucuucccccaugaugacccgcguggccaa

SEQ ID NO: 165592 - RNA, 46 nt, Homo sapiens
guacuggucauuuccacacccaacaccacgucagcacccgccaagc

SEQ ID NO: 165593 - RNA, 46 nt, Homo sapiens
caguguagaagucagcugugccgagacuggcauagaggcuguagcc

SEQ ID NO: 165594 - RNA, 45 nt, Homo sapiens
cacauggacaucaaucaauccugggagaaaauggaagcagcaaga

SEQ ID NO: 165595 - RNA, 128 nt, Homo sapiens
caguggccugggcccauagggcggggcagaaggaaaagggcucagggaagcaaggguggcugguaggggcauaugggucuccaauaccaggaagagugcaguggcucaccuucugggccagggccaga

SEQ ID NO: 165596 - RNA, 42 nt, Homo sapiens
gagaaggucucauugagguaaagcuucagcccggcugcagac

SEQ ID NO: 165597 - RNA, 45 nt, Homo sapiens
gcuccaggucaucauggcuuaggaacaggugguggggagccaccu

SEQ ID NO: 165598 - RNA, 45 nt, Homo sapiens
uggagaagggcauguggcugggaauuguccacucaugcuccagau

SEQ ID NO: 165599 - RNA, 48 nt, Homo sapiens
cggcagauggaagcggccaucaggaagcccugggaugccacggcgggg

SEQ ID NO: 165600 - RNA, 42 nt, Homo sapiens
ugucucgguacuggugguggaggguagcaggugccaucaggg

SEQ ID NO: 165601 - RNA, 54 nt, Homo sapiens
gcaaaaaaaaaaaaaaaaaaaaaggaaguguuaucgugcagcccauggauggcu

SEQ ID NO: 165602 - RNA, 23 nt, Homo sapiens
agcguugcugccaggccuugggg

SEQ ID NO: 165603 - RNA, 42 nt, Homo sapiens
aacuccuucccauacuauaaugaagagggugauggugccauu

SEQ ID NO: 165604 - RNA, 42 nt, Homo sapiens
ucaggacagggcuacuugcuccucucuucaauguguccaggg

SEQ ID NO: 165605 - RNA, 45 nt, Homo sapiens
caauuggccugcauaauaugugaaaaggauggaggcaagcuggca

SEQ ID NO: 165606 - RNA, 72 nt, Homo sapiens
ugauuaaaggggaacuacagccuacgggaacaagaagagcggguaaagggagacacugauguccacguguag

SEQ ID NO: 165607 - RNA, 45 nt, Homo sapiens
guccaugcagggguaaaggcuacuagagcaguaagacuggacaga

SEQ ID NO: 165608 - RNA, 44 nt, Homo sapiens
auaagcagggaaaagaauuucaaguugccgcucagaugacagaa

SEQ ID NO: 165609 - RNA, 46 nt, Homo sapiens
ugggggacacaggcacagggcaaguuucuguaaauuccucuggggu

SEQ ID NO: 165610 - RNA, 47 nt, Homo sapiens
ggcaauccucugugcagccagcccaggggacaaggaaagguaggaua

SEQ ID NO: 165611 - RNA, 46 nt, Homo sapiens
gacaauaaccgaagcuccccauuuucaucacgcuggcugaucuuug

SEQ ID NO: 165612 - RNA, 105 nt, Homo sapiens
gucuuccucuucuuccuccgccucaucugacucauccucacuguccucaaagaacuuggacuuagcaacucgaggcagcuugucagaggcugaagagcaggaagg

SEQ ID NO: 165613 - RNA, 46 nt, Homo sapiens
cuccauguccaucguagacagaaaacauggcugucucacuguccag

SEQ ID NO: 165614 - RNA, 46 nt, Homo sapiens
cguccccggagcacuucaccguguugggcugggagagguaggcacc

SEQ ID NO: 165615 - RNA, 46 nt, Homo sapiens
ccgcagccugcgcuucagcuccagcucggguuccggggccccggau

SEQ ID NO: 165616 - RNA, 46 nt, Homo sapiens
cauuuaacuugauucauuuuuggcucaggucauugggaacccauua

SEQ ID NO: 165617 - RNA, 46 nt, Homo sapiens
ccuccccuguuuucaaccagcgcugcaagaagaggaugaggaaaau

SEQ ID NO: 165618 - RNA, 45 nt, Homo sapiens
uuccucauccucuucuugcagcgcugguugaaaacaggggaggac

SEQ ID NO: 165619 - RNA, 42 nt, Homo sapiens
uagugaccauuaacuuuucauaaugcaagagaugaccagaga

SEQ ID NO: 165620 - RNA, 77 nt, Homo sapiens
ccugccuuuagauuguaagaaucccaaugcaccauuccagauccggcacagugacccagagagugacuuuuaucggu

SEQ ID NO: 165621 - RNA, 46 nt, Homo sapiens
ggaucuggaauggugcauugggauucuuacaaucuaaaggcaggag

SEQ ID NO: 165622 - RNA, 45 nt, Homo sapiens
guuggcugaggguuggugcaggggugggucauggacuuccaccag

SEQ ID NO: 165623 - RNA, 46 nt, Homo sapiens
uagacaauaaccuaaaaguaauguguuuaaauccuggcaacuuuag

SEQ ID NO: 165624 - RNA, 46 nt, Homo sapiens
uauaaucuaaaguugccaggauuuaaacacauuacuuuuagguuau

SEQ ID NO: 165625 - RNA, 59 nt, Homo sapiens
ucuucccuuacuuuaccgaaaggagcacgaagaacaggcacggagcccaaggaaugccc

SEQ ID NO: 165626 - RNA, 44 nt, Homo sapiens
acgaccuggagcguugcgaaguggugcuaacaugagaaggucau

SEQ ID NO: 165627 - RNA, 46 nt, Homo sapiens
gggaugcgaguuuuguugagaaaagugccaugggugcuucccagau

SEQ ID NO: 165628 - RNA, 49 nt, Homo sapiens
uggcacuuuucucaacaaaacucgcaucccaccucgcaccuacugucga

SEQ ID NO: 165629 - RNA, 44 nt, Homo sapiens
gaccucuuagacuugggaagugugguuccuccaaagggaucaga

SEQ ID NO: 165630 - RNA, 41 nt, Homo sapiens
agcggacagcuuuucuuuccgccuuuuuggcccugucugaa

SEQ ID NO: 165631 - RNA, 42 nt, Homo sapiens
uucuugauaauugcuuccagcuuucacuuuauugggcauggg

SEQ ID NO: 165632 - RNA, 40 nt, Homo sapiens
uugauauuguggcuuugcauuguuguagaguugaagaaga

SEQ ID NO: 165633 - RNA, 37 nt, Homo sapiens
ugcaaauacguuaucagcuauauauggcaauccccag

SEQ ID NO: 165634 - RNA, 63 nt, Homo sapiens
gauggagauuagagaggauugagaaaaguagugcucaaacuuguauaaccagaggaaggauga

SEQ ID NO: 165635 - RNA, 579 nt, Homo sapiens
uuuuuuauaucauauuccauaaauauauguccagcaaucauaccuucuuuuuuuuuuguuuuuuguuuuuguuuguuuguuuugagacagagucucguucuuuagcccaggcuggagggcaguggcaugaucucugccuccuggguucaagugauccucucaccucagccucccaaguagcugagauuacagguguaugccaccaugcccagcuaauuuuuguauuuguauuuguguuuuuuauuuuuaaauuaaaauuuuuuuugaaauggagucucgcucuguugcccaggcuggaaugcaguggcgcgaucucagcucacugcuaccuccaccucccagguggauucuccugccucagccuccugaguugcucauuacgggcaugcaccaccuugccuggcuacuuuuuguauuuuuaguaaagaugggauuucaccauguuggucaggcuggccucaaacuccugaccucaagugauccacccaccuuggccucccagagugcugggauuacaggcgugagccaccaugcccagccucacaaccauacuucuuaaaaacucuggcacacauuagu

SEQ ID NO: 165636 - RNA, 49 nt, Homo sapiens
cccagugagggcugcauaccauagaaggggagaaugaauuuugggagaa

SEQ ID NO: 165637 - RNA, 45 nt, Homo sapiens
auacagaccugaaaauacuccagagccugucaguacaagugugag

SEQ ID NO: 165638 - RNA, 101 nt, Homo sapiens
uucaguggugccaaguucauauccugcugguuuaacaggugagauuuaaauggacaauuauguugucuguuugagaacaucaccuuggguaauauauacuu

SEQ ID NO: 165639 - RNA, 395 nt, Homo sapiens
uagaaugauggugaaggcccugcaguuaaucagggaaagcuaucucaagaagaaaucauuugagcugagauuuuuuuuuuuuuuuuuuggaguuggagucucucucugucacccaggcuggagugcaguggcgcagucuuggcucacugcaaccuucugccucccagguucaagccauucucuugccuuagccucccgaguagcugagauaacaagaaacaaacaccacggcacccggcuaauuuuuuuuguacuuuaguagagacgggguuucaccacguuggccaggcuggucuuaaacuccugauuuaggggaugugccugccuuggccucccaaagugcugggauuacaugcgugagccaccgcacccagccuugagcugauauuugauaa

SEQ ID NO: 165640 - RNA, 45 nt, Homo sapiens
agaccuuucauuuaagaagggugaaagauuucaaauaauuaacaa

SEQ ID NO: 165641 - RNA, 47 nt, Homo sapiens
uuacuucuacaauuugugcugcugugguucugccauaaacaguagag

SEQ ID NO: 165642 - RNA, 40 nt, Homo sapiens
acuguuucuuuuuucuggaaugugauuucucaucuuucca

SEQ ID NO: 165643 - RNA, 43 nt, Homo sapiens
gggaaggagauuggugggaagcaagaucaaucgcuacaggaaa

SEQ ID NO: 165644 - RNA, 33 nt, Homo sapiens
ccagaugguauuuuggcaaaauggggagaaaag

SEQ ID NO: 165645 - RNA, 47 nt, Homo sapiens
ucgugauugggaugagauaaggggugacaaugugaaacacuacaaaa

SEQ ID NO: 165646 - RNA, 89 nt, Homo sapiens
cuagcaaaagaugcuugggaaaucccucgagaaucuuugcgacuagagguuaaacuaggacaaggauguuucggcgaaguguggauggg

SEQ ID NO: 165647 - RNA, 67 nt, Homo sapiens
gaauggaaccacgaaaguagcaaucaaaacacuaaaaccagguacaaugaugccagaagcuuuccuu

SEQ ID NO: 165648 - RNA, 43 nt, Homo sapiens
aacucauugucccaugcacuccagcauaaacccacuguucugc

SEQ ID NO: 165649 - RNA, 79 nt, Homo sapiens
aggaagcuuauuagauuuccuuaaggaaggagauggaaaguauuugaagcuuccacagcugguugauauggcugcucag

SEQ ID NO: 165650 - RNA, 57 nt, Homo sapiens
cugaugguauggcauauauugaaagaaugaacuauauucaccgagaucuucgggcug

SEQ ID NO: 165651 - RNA, 86 nt, Homo sapiens
cuaauauucuuguaggagaaaaucuugugugcaaaauagcagacuuugguuuagcaagguuaauugaagacaaugaauacacagca

SEQ ID NO: 165652 - RNA, 48 nt, Homo sapiens
aauaaagucugaugucuggucauuuggaauucugcaaacagaacuagu

SEQ ID NO: 165653 - RNA, 21 nt, Homo sapiens
uacugaaguauccuaauguug

SEQ ID NO: 165654 - RNA, 48 nt, Homo sapiens
uguaccaaugaugaauuuaucagcguauuucaggguccaaacaaaaua

SEQ ID NO: 165655 - RNA, 46 nt, Homo sapiens
uauucauguucauggaacugaaagaauaagaacuuuuucacuucag

SEQ ID NO: 165656 - RNA, 42 nt, Homo sapiens
uuuuuaaggcaauauauaauugaaacuacuguccaaucaaag

SEQ ID NO: 165657 - RNA, 51 nt, Homo sapiens
ccagaucagggacuugaaugcacuuuugcucauggugaauauagaugaaca

SEQ ID NO: 165658 - RNA, 46 nt, Homo sapiens
agaguugccaccgucagccucacccucuuccugacacacugcagau

SEQ ID NO: 165659 - RNA, 45 nt, Homo sapiens
cucccccagcuccugcacaggcagagcacccaacugcuggcacag

SEQ ID NO: 165660 - RNA, 46 nt, Homo sapiens
gggagggugauaguaaaaauacugaacuagagguguaggcugaagg

SEQ ID NO: 165661 - RNA, 48 nt, Homo sapiens
uaaaaagcaagaucccagcaaagccuuaaaacacauuucauguuaauu

SEQ ID NO: 165662 - RNA, 41 nt, Homo sapiens
cauuccucaggccacagauggagcguguguugagcaucuca

SEQ ID NO: 165663 - RNA, 23 nt, Homo sapiens
ccaucacucggcucccgugacac

SEQ ID NO: 165664 - RNA, 45 nt, Homo sapiens
gcugcauguccucacuugccuaugcugucuucucuagucuuggag

SEQ ID NO: 165665 - RNA, 31 nt, Homo sapiens
ucagcaaauucugucagaagcacggcaaacg

SEQ ID NO: 165666 - RNA, 47 nt, Homo sapiens
ugugaaaaucaaugucguguaucauauuaauagaaugaaggacaaca

SEQ ID NO: 165667 - RNA, 46 nt, Homo sapiens
gccguggacuccguggucagccugcuggacggcgugguggagaagc

SEQ ID NO: 165668 - RNA, 49 nt, Homo sapiens
gaacuggagggugaucgagaauggagcacagagacugaaaaaucaaagu

SEQ ID NO: 165669 - RNA, 58 nt, Homo sapiens
ggaauagagcagaaaccuguggcauguuucaccagagcccaccaguggguggggacag

SEQ ID NO: 165670 - RNA, 48 nt, Homo sapiens
gugccucuguuguguguggcucaggcgguggaauccauccaggccgag

SEQ ID NO: 165671 - RNA, 44 nt, Homo sapiens
cagcccgcggcggccagcguguggaagaggaagcgcauggaucg

SEQ ID NO: 165672 - RNA, 45 nt, Homo sapiens
gaccuagugaauauugagauguuccugacggccaaagagguggag

SEQ ID NO: 165673 - RNA, 42 nt, Homo sapiens
ucugcuuucuauccgucaagaugauaaagucgugugcccgag

SEQ ID NO: 165674 - RNA, 46 nt, Homo sapiens
ucccacgcuccagccugccgcggcguuucuguuucuugcgaccaaa

SEQ ID NO: 165675 - RNA, 36 nt, Homo sapiens
gagagaaaauaagguuucauaaguuuguacuugaaa

SEQ ID NO: 165676 - RNA, 29 nt, Homo sapiens
caguccuaauguagagcggcccuggguuu

SEQ ID NO: 165677 - RNA, 50 nt, Homo sapiens
ggacacggggccccgaccauggucacacucaucacugagaagcugcagag

SEQ ID NO: 165678 - RNA, 37 nt, Homo sapiens
uagauuuuccagaagagaacucgcgugguaguuuuga

SEQ ID NO: 165679 - RNA, 24 nt, Homo sapiens
cugggucccacuccucaccuguug

SEQ ID NO: 165680 - RNA, 63 nt, Homo sapiens
gaagggauuuacggugcaguuacaaggagccuuugggagcgaggacggcgacuuaaugccaga

SEQ ID NO: 165681 - RNA, 45 nt, Homo sapiens
gaaugcggugggaagacuggagugaugccagagccgggagggagg

SEQ ID NO: 165682 - RNA, 29 nt, Homo sapiens
cggaggauagauccuagaacagcggcaac

SEQ ID NO: 165683 - RNA, 36 nt, Homo sapiens
aagaggagggagcccuugggggugaagcauacacac

SEQ ID NO: 165684 - RNA, 54 nt, Homo sapiens
uuugauuuauuugaagcucuucaauauuaccccaaaauggaaacugacauuguu

SEQ ID NO: 165685 - RNA, 55 nt, Homo sapiens
ugaucuuccuucaaaggguuauccaaggcaucuacucaaugaaaaaccaugauca

SEQ ID NO: 165686 - RNA, 31 nt, Homo sapiens
ucagagggaagcccgagaaacacaggagagc

SEQ ID NO: 165687 - RNA, 46 nt, Homo sapiens
gaaaauagcauuuaaaauggaaagcuguguuuggaaaauuguguau

SEQ ID NO: 165688 - RNA, 46 nt, Homo sapiens
uccuuccgcagcagcguccuggaaggcgggauggggguccgguucc

SEQ ID NO: 165689 - RNA, 44 nt, Homo sapiens
uccgcuuuaacugaaaaugcuucaccgggggagugagggguccc

SEQ ID NO: 165690 - RNA, 45 nt, Homo sapiens
ucccaaaauauccugaacguugggauucugcuccuccagcuccag

SEQ ID NO: 165691 - RNA, 39 nt, Homo sapiens
gcggcaucuuucucgaggagcucuccugggcggcugaag

SEQ ID NO: 165692 - RNA, 65 nt, Homo sapiens
cucuggucgcucgcacugccguccgcgcgggcgcaccgagcccggcuuggcgcgggcaacagaag

SEQ ID NO: 165693 - RNA, 52 nt, Homo sapiens
uuguuuuuuaaacuaugcaccagguuucugaugaugaaauaaagcaccuguu

SEQ ID NO: 165694 - RNA, 46 nt, Homo sapiens
uggcuggccggggcccaggccugcuucaccacgugguccgggcucu

SEQ ID NO: 165695 - RNA, 42 nt, Homo sapiens
cucacuggggccaccucugacugcuuggggaggcgcccggug

SEQ ID NO: 165696 - RNA, 42 nt, Homo sapiens
gcuccuggcagggcgggguggacugguuugccaccgccaucg

SEQ ID NO: 165697 - RNA, 41 nt, Homo sapiens
cugccccugcugcccgggcuguuggagagccacggccgugc

SEQ ID NO: 165698 - RNA, 26 nt, Homo sapiens
ugcgggccaauaaggggcaggguugg

SEQ ID NO: 165699 - RNA, 42 nt, Homo sapiens
caguccgccaggugauccgugaggagggcuuggagaggcccc

SEQ ID NO: 165700 - RNA, 46 nt, Homo sapiens
acaggagagucagucgggggugacgguggagggcgggagaggccug

SEQ ID NO: 165701 - RNA, 33 nt, Homo sapiens
gguuaaaagucagucccagcucuacaguggcug

SEQ ID NO: 165702 - RNA, 41 nt, Homo sapiens
cugaacugucaccuucuuccucguugcucucagggucacug

SEQ ID NO: 165703 - RNA, 48 nt, Homo sapiens
cucuuccuuugccaauucugccuccgucuucauccuguuagagggcug

SEQ ID NO: 165704 - RNA, 48 nt, Homo sapiens
acucaguuggcaccaaacguuucaacacagaaaagaggccaggagaaa

SEQ ID NO: 165705 - RNA, 30 nt, Homo sapiens
accuuccugagggcccgugcgcgagacacc

SEQ ID NO: 165706 - RNA, 55 nt, Homo sapiens
uaaugcuuuuaggacgccucggcgggaguggcggggcagggggggggcggggagu

SEQ ID NO: 165707 - RNA, 42 nt, Homo sapiens
auggaauuaucuuaguacccuuguugaaaauuaaucguccuu

SEQ ID NO: 165708 - RNA, 46 nt, Homo sapiens
cuucuuucaauuaaacauuuuaaaauaguuuacaaauaguaaacaa

SEQ ID NO: 165709 - RNA, 48 nt, Homo sapiens
uacuugccaaauuguugaagguugagguaccaauuucauuauugcuga

SEQ ID NO: 165710 - RNA, 38 nt, Homo sapiens
uuugcugaccugggauucagggguauagaaguuaccau

SEQ ID NO: 165711 - RNA, 45 nt, Homo sapiens
uguuucuagguuuaugaacugacguuacaucauacacagcaccaa

SEQ ID NO: 165712 - RNA, 46 nt, Homo sapiens
ucaccgcugcuaaggaggagucugguggccgaagccguagugggag

SEQ ID NO: 165713 - RNA, 73 nt, Homo sapiens
cuggcugggacaugggauauauccugucucuuuuaagccuuuuugguauuuuucccccauugagagcuguguc

SEQ ID NO: 165714 - RNA, 46 nt, Homo sapiens
ugccuaauucugaauauauauauauauauaucuuuucaccauaaaa

SEQ ID NO: 165715 - RNA, 41 nt, Homo sapiens
cuauauuagcugugugagacuagugacaggagcugugggaa

SEQ ID NO: 165716 - RNA, 48 nt, Homo sapiens
cauaaacacaugcaguuggcagcuguucugugcugaguauuuuaaagu

SEQ ID NO: 165717 - RNA, 54 nt, Homo sapiens
uuuagaacccauaaaggaacucuguacucuuuacccaaaaccuccaugccucca

SEQ ID NO: 165718 - RNA, 51 nt, Homo sapiens
cccugguugcaggugauggcuggagaggccuccugauuuucaguaagggaa

SEQ ID NO: 165719 - RNA, 61 nt, Homo sapiens
aucuuccuucauaccucaaacugcaugauguccugaaagcuacacacgcuaacuacaaggu

SEQ ID NO: 165720 - RNA, 70 nt, Homo sapiens
ugcacacauacuuacgucuaauggauaguugauguuuuucuuaugauuuguaggauguauaagcccuuug

SEQ ID NO: 165721 - RNA, 22 nt, Homo sapiens
gcugguccugcagguacccucu

SEQ ID NO: 165722 - RNA, 109 nt, Homo sapiens
uuaguucauuuuuuuuuuuaacuuuaaaauuuucuguucaucugcaauuuguuagauaugaaguaugugucuaauuuaauuuuuguuuuugguuguccccaauaauguu

SEQ ID NO: 165723 - RNA, 45 nt, Homo sapiens
caguaaccguguguucucuccuucaccuucccaaggucacgcugg

SEQ ID NO: 165724 - RNA, 46 nt, Homo sapiens
aaaguuuggaggguuucuccgcucagccuuggauguucuuucucag

SEQ ID NO: 165725 - RNA, 42 nt, Homo sapiens
guguguugaagagauccuaggauaccugaaauccugcuuuag

SEQ ID NO: 165726 - RNA, 45 nt, Homo sapiens
cacaaacuuggccucccaguuugauggcuuaucuuccaaccccag

SEQ ID NO: 165727 - RNA, 45 nt, Homo sapiens
ccaggcuuguaccacuacugcuucauggccccguacacccacuuc

SEQ ID NO: 165728 - RNA, 47 nt, Homo sapiens
ucugaucgugugaaugugaaauugguuugagcaggaguauaucugag

SEQ ID NO: 165729 - RNA, 29 nt, Homo sapiens
aaguuaaaauucuuuuaguaccuaaaaug

SEQ ID NO: 165730 - RNA, 23 nt, Homo sapiens
caggggugggguuagaguagauc

SEQ ID NO: 165731 - RNA, 58 nt, Homo sapiens
uuacugagacucauccaguaccaucagguaagaggaauguauguuggaacugucgugg

SEQ ID NO: 165732 - RNA, 43 nt, Homo sapiens
uaccugccauuucauccucagugaggaaggugauacacagaga

SEQ ID NO: 165733 - RNA, 45 nt, Homo sapiens
uuuccauuuuuugugagggcuugugaaauuucugcugcauauuaa

SEQ ID NO: 165734 - RNA, 27 nt, Homo sapiens
auuauaaaguaaaugugguucugguua

SEQ ID NO: 165735 - RNA, 46 nt, Homo sapiens
caugacuccgagcacuuaacguggcucauuguaaaucacauucaag

SEQ ID NO: 165736 - RNA, 50 nt, Homo sapiens
gagcuguuuucugggggagaaggugccagcucugggacaguguuggggua

SEQ ID NO: 165737 - RNA, 57 nt, Homo sapiens
cacuccguguggcuggggaacagcaucacaccccugagggaggaggaaugggacgag

SEQ ID NO: 165738 - RNA, 46 nt, Homo sapiens
ccgccugcuggagagcacgcucaggagcagccaccugcccagcagg

SEQ ID NO: 165739 - RNA, 45 nt, Homo sapiens
ggcuggcaugugugcacugaugagacgggaacgugaugguugcuu

SEQ ID NO: 165740 - RNA, 48 nt, Homo sapiens
ugcugacagggguacagaaaggagcacguccagacauuugcugaccag

SEQ ID NO: 165741 - RNA, 27 nt, Homo sapiens
gggggcggggccggaaccgcggggagg

SEQ ID NO: 165742 - RNA, 68 nt, Homo sapiens
aaacaaacccaaaucaaaugagcgaggcccggaugugcugacgcugcgguuacgcgcgcggagcugga

SEQ ID NO: 165743 - RNA, 43 nt, Homo sapiens
cagccuuggcugggucagggagcggggcacaugaguguguucc

SEQ ID NO: 165744 - RNA, 57 nt, Homo sapiens
aggacaugggucagagugaacagaaggcagauccuccugcuacagagaagacccucc

SEQ ID NO: 165745 - RNA, 49 nt, Homo sapiens
uguuuaggcugggacuuaggagaggaagcagaaaauugcaaguacaaga

SEQ ID NO: 165746 - RNA, 56 nt, Homo sapiens
ccuggacuuggagcucuugcuccuugccacuguacagugauuaccugaagacugaa

SEQ ID NO: 165747 - RNA, 62 nt, Homo sapiens
uuuuucucuuuuaggaaaaauauaaacgagcuuuggcagacacugagaacuuacggcagagg

SEQ ID NO: 165748 - RNA, 44 nt, Homo sapiens
cuuguuggagguggcagacguucuggagaaggcaacacagugug

SEQ ID NO: 165749 - RNA, 46 nt, Homo sapiens
cuuagcugcuguugaugggguggguguuuuuaaacucacuugaugu

SEQ ID NO: 165750 - RNA, 41 nt, Homo sapiens
aaggaacucaauuuguuuaaaaaagagcaacaguggggaag

SEQ ID NO: 165751 - RNA, 45 nt, Homo sapiens
ucgaucuccacgucgucgucaucauaguugacagagagcccgcug

SEQ ID NO: 165752 - RNA, 49 nt, Homo sapiens
uuugaaauagacguacugcucaugugcuuuuuuaguagugggauaaaga

SEQ ID NO: 165753 - RNA, 46 nt, Homo sapiens
aaugguacauuauuuaauauuauauuaaaccuccuauagcguggau

SEQ ID NO: 165754 - RNA, 46 nt, Homo sapiens
ccuuuucaagauuuauauguuuguauaaucauaagaaaauugagcc

SEQ ID NO: 165755 - RNA, 42 nt, Homo sapiens
gggcauggggaaucaaacugaaugaacuuuucucugcacugu

SEQ ID NO: 165756 - RNA, 41 nt, Homo sapiens
cacgaaggccuccagccggucgauccugcuguagaugcgcc

SEQ ID NO: 165757 - RNA, 42 nt, Homo sapiens
ccggccccgggcagcaggcaggcggcguagcccgcagcggcg

SEQ ID NO: 165758 - RNA, 50 nt, Homo sapiens
ggagucagcugcucaucugcaggcuaauggcaggaaauggucauauuugg

SEQ ID NO: 165759 - RNA, 81 nt, Homo sapiens
ccaaaggaaauccggacguucuuuauucacuuucaacagcagugagcccugggcagaugccccggccccagggcuuccccc

SEQ ID NO: 165760 - RNA, 47 nt, Homo sapiens
caagaucgaagcccaaccccagggcaugccuucaggggagccuggug

SEQ ID NO: 165761 - RNA, 402 nt, Homo sapiens
ccaugucagcugucucacauggagucuauuagucuguucucaugcugcucauaaagacauacccgagacuggguaguuuaugaagaaaaaagguuuaauggacucacaguuccaccuggauagggaggccucacaaucauggcagaaggcaaaugaggagcaaagucacgucuuacaugguggcaggcaagagagcgugugcaggggaacugcccuuuacaaaaucaucaggucucaugagacuuauucacuaucacaagaacagcacaggaaagacucacccccaugauucaauuaccucccaccaggucccucccacaacauguggacauuaugggagcuacaauucacgaugagauuugguuggggacacagccaaaccauaucgaggagguuacagau

SEQ ID NO: 165762 - RNA, 45 nt, Homo sapiens
cggaggcccuacguuuccuaugugaacaacagcaucgcccgggua

SEQ ID NO: 165763 - RNA, 45 nt, Homo sapiens
aauggagauuguggcgggacagcuugugacugagauccggcagua

SEQ ID NO: 165764 - RNA, 46 nt, Homo sapiens
ugccuguggcaaacgacugcuacauugugcugcucgaccaggauac

SEQ ID NO: 165765 - RNA, 46 nt, Homo sapiens
ccacaguucuccuggcacguugacccguuuggcgccucugccacga

SEQ ID NO: 165766 - RNA, 46 nt, Homo sapiens
gccaggucaugcaugacgaggcugugacgcaccuugaugaccagau

SEQ ID NO: 165767 - RNA, 41 nt, Homo sapiens
guucugucugcccucuucaagaaauaaaaaucaccaagaaa

SEQ ID NO: 165768 - RNA, 40 nt, Homo sapiens
agaaaaugaagaugaauguugacauacuuuguagaagugg

SEQ ID NO: 165769 - RNA, 48 nt, Homo sapiens
gcaaaacagaacaaguaaaacuccuggcagaugaguuuuuauuugcug

SEQ ID NO: 165770 - RNA, 44 nt, Homo sapiens
agguucagaaggguaagcuaucucccaagaugacgucccuggug

SEQ ID NO: 165771 - RNA, 41 nt, Homo sapiens
agaaacauugguuacuuuuaaaauuucuuuuucuagcucuu

SEQ ID NO: 165772 - RNA, 25 nt, Homo sapiens
gucuguggacacagguggaagugaa

SEQ ID NO: 165773 - RNA, 38 nt, Homo sapiens
aaauauuuaaccucauuuccucaucuauguaaugggaa

SEQ ID NO: 165774 - RNA, 42 nt, Homo sapiens
gaaccagacgucguguguguucauuuuuaaaugauggggugg

SEQ ID NO: 165775 - RNA, 73 nt, Homo sapiens
ugagcuagagcuaggcuagaacuggguguuguugaugcagauaauaucaaauucauuauuuuauaaucuuuua

SEQ ID NO: 165776 - RNA, 24 nt, Homo sapiens
uucaguuucauuugaaaagauaua

SEQ ID NO: 165777 - RNA, 46 nt, Homo sapiens
uuuaaucuugaacaaugcuuguuucuugcagaggcaaauuaugcaa

SEQ ID NO: 165778 - RNA, 44 nt, Homo sapiens
acauuggcaaacugagagauuuucuucuggaacacaggaaagau

SEQ ID NO: 165779 - RNA, 44 nt, Homo sapiens
ggugguagacugcuuaaagccuuucuuuuuuacucuucugcccu

SEQ ID NO: 165780 - RNA, 56 nt, Homo sapiens
augucugaauaugggaggaugacagacacagaacgagaccagauagaccaggaugc

SEQ ID NO: 165781 - RNA, 61 nt, Homo sapiens
acaaggagauacauucccagcaagugaaggagcacaggaccgcuguuuuggauuucauuga

SEQ ID NO: 165782 - RNA, 46 nt, Homo sapiens
ccuucaaaagacucugaagaaaacccugccacugaagaacguccag

SEQ ID NO: 165783 - RNA, 52 nt, Homo sapiens
aggaaaaucagcgacuaauuggugaaaugaacagcuuguuugaugaagugag

SEQ ID NO: 165784 - RNA, 28 nt, Homo sapiens
cuggggugggcauguggccugaauccac

SEQ ID NO: 165785 - RNA, 51 nt, Homo sapiens
caagacauggcauuuucuaaaugaaucagaggagcuuuuuucuuggaacag

SEQ ID NO: 165786 - RNA, 46 nt, Homo sapiens
caggaagcugagauugacagcauucaccaguuaguugugggggcaa

SEQ ID NO: 165787 - RNA, 40 nt, Homo sapiens
cgcuaacuaaacagcgaagagaacacagucuccaauccaa

SEQ ID NO: 165788 - RNA, 40 nt, Homo sapiens
uuuucguguuauauuuuguuaguugaauucuucaaacagu

SEQ ID NO: 165789 - RNA, 48 nt, Homo sapiens
accacuuacuaugauguuuugggggucaaacccaaucaaugcuacuca

SEQ ID NO: 165790 - RNA, 50 nt, Homo sapiens
guucucucugaugcaaagaaaagggaauuaauuauaugacaaaggaggag

SEQ ID NO: 165791 - RNA, 54 nt, Homo sapiens
guuuuggcucccccauggacaucuuugauauguuuuuuuggaggaggaggaagg

SEQ ID NO: 165792 - RNA, 49 nt, Homo sapiens
ucugcaaaagaaugcaauuugugacaaaugugaagauagaggagguaag

SEQ ID NO: 165793 - RNA, 80 nt, Homo sapiens
ggagcagaucaguccuaaagauagaugugaaagcugcaauggaaggaagauacuucgagagaagaagauucuagaauuuc

SEQ ID NO: 165794 - RNA, 119 nt, Homo sapiens
auauugacaaaggcaugaaauauggccagaagauaacauuccauggugaaggauaccaagaaccaggacuggagggagaagauauuaucauuguguuagaucagaaggacgaugcuguu

SEQ ID NO: 165795 - RNA, 37 nt, Homo sapiens
gcauuccagaagccaauaucuacucuugacaacugaa

SEQ ID NO: 165796 - RNA, 44 nt, Homo sapiens
auggaucaaguagaacugguggacuuugauccaaaucaggaaag

SEQ ID NO: 165797 - RNA, 40 nt, Homo sapiens
cagaggugguguucggugucagaccucuuaaugggccagu

SEQ ID NO: 165798 - RNA, 45 nt, Homo sapiens
agcaaagcacuaucacaaggaauauaggcagauguacaggacuga

SEQ ID NO: 165799 - RNA, 46 nt, Homo sapiens
ggcguuugucaucagaaucagagguaucaauggagugagcccaaag

SEQ ID NO: 165800 - RNA, 45 nt, Homo sapiens
uugauugcucgaucucuugguaaauacggcaucaucugcguggag

SEQ ID NO: 165801 - RNA, 50 nt, Homo sapiens
ugaacuaaggugucuaccaugauuauuuuucuaagcugguugguuaauaa

SEQ ID NO: 165802 - RNA, 45 nt, Homo sapiens
aaacuguccaacuucaguuuuucauaagauuaaacuucuuacgau

SEQ ID NO: 165803 - RNA, 44 nt, Homo sapiens
cuuuccauauugucuuuuucagugaagagaaaugcauucaagau

SEQ ID NO: 165804 - RNA, 47 nt, Homo sapiens
uuauaaacuauuguucauagaagauauuauguacauuuauuucagau

SEQ ID NO: 165805 - RNA, 82 nt, Homo sapiens
cugcuuuuaaaccucaccauugccuugacuuugcuuaaugcagaucaaagacacagcucuccccuucuaucaagcgcaagag

SEQ ID NO: 165806 - RNA, 78 nt, Homo sapiens
uucuugcuaguuguuugaacuugggacagucuguauauuggugggacccgcuguugaugucuuuguuuucuagaugaa

SEQ ID NO: 165807 - RNA, 47 nt, Homo sapiens
uacagaguuccagggacuggaguauucagugcuaccauugcccagug

SEQ ID NO: 165808 - RNA, 51 nt, Homo sapiens
agagguaguuguagaugacauuaagaucgacuuaucagcaguggucaggaa

SEQ ID NO: 165809 - RNA, 53 nt, Homo sapiens
ugcaguugacuacuugggccuuaacacuuagccuugugaauuguacuuucguu

SEQ ID NO: 165810 - RNA, 49 nt, Homo sapiens
uccuuuuucagaguuuuuacuggaaucagaauuccuuaucugauucuug

SEQ ID NO: 165811 - RNA, 54 nt, Homo sapiens
gccccuucaucaucccuguuugugcucaucaguuaccuuuauccucuuuuagaa

SEQ ID NO: 165812 - RNA, 63 nt, Homo sapiens
uuucugauccaguggaggacaagaaagagcaggagucugaugaggaagaggaagaagaggaag

SEQ ID NO: 165813 - RNA, 58 nt, Homo sapiens
uaaagaugaauccaauaaagaaacagcuaaccuacaagaaagaaguauaagcaaugua

SEQ ID NO: 165814 - RNA, 85 nt, Homo sapiens
uuuucuacagaugaauauagcagcagugaaacuacuggugaaaagccagagcagaacgaugaugacaccauaaaaucucaggagg

SEQ ID NO: 165815 - RNA, 54 nt, Homo sapiens
uaaaaccaguucugagacaaauagcacuaccucaagggucauggaagaaaaagg

SEQ ID NO: 165816 - RNA, 46 nt, Homo sapiens
auagaaacagcacaaaggcaguguccugaaacggagccacaugaca

SEQ ID NO: 165817 - RNA, 62 nt, Homo sapiens
agaggaagaaaggcauaugccuaaaagaaaaagaaagcagcauuaucucucuucagaagaug

SEQ ID NO: 165818 - RNA, 49 nt, Homo sapiens
gacaacgcagaagccauaagcggucacaguguugaagcagauccuaaag

SEQ ID NO: 165819 - RNA, 45 nt, Homo sapiens
agaacaaaugaagaaauucauagcgaaucuuauaacaaaggaggu

SEQ ID NO: 165820 - RNA, 73 nt, Homo sapiens
accgagccagcuggcauguucuccauccuaccucagucccuugaguccaccagcagcugucuuuuccccaguc

SEQ ID NO: 165821 - RNA, 80 nt, Homo sapiens
acagcugaacuccagagggagccuuuguuggugaaugaaucacuaaauguaagucacuguaaugguuuugauuuuugugg

SEQ ID NO: 165822 - RNA, 52 nt, Homo sapiens
caggugcuguguuccuggauccacaugguauuccagaccacagucugggcuc

SEQ ID NO: 165823 - RNA, 43 nt, Homo sapiens
ggcucuauuaacuugccucucacuuuuuaaaauagauuaggga

SEQ ID NO: 165824 - RNA, 52 nt, Homo sapiens
gaaaaauggugaaauucuggcaccaccagaaagucugugugggggaaagcca

SEQ ID NO: 165825 - RNA, 66 nt, Homo sapiens
gaaauuucccagaaaagaaagaaaagagccuuccaagcaaagagaauguuguguucuagacucaga

SEQ ID NO: 165826 - RNA, 46 nt, Homo sapiens
uguuuugggaggauugaaacugaaagccaacuugaaaauggaggua

SEQ ID NO: 165827 - RNA, 13 nt, Homo sapiens
aggguuuccacag

SEQ ID NO: 165828 - RNA, 49 nt, Homo sapiens
cuguaggaacaaaaggguccucaugggcuggacuugaagggacagagga

SEQ ID NO: 165829 - RNA, 28 nt, Homo sapiens
acagugacacuuuaaagcaugacaauug

SEQ ID NO: 165830 - RNA, 44 nt, Homo sapiens
acugagcuuauuuuucaggugaaaugaguuucuaguuuagaaua

SEQ ID NO: 165831 - RNA, 241 nt, Homo sapiens
uuuaggacagucuuccaaaagaugguuuugguuccagaaagauaaaauaucuauaaauuuuuuucucauaucauaauguugcaaaauaacucucaucaaacuugaaggucaaacuucucuaaaagcuacuuguguuuaaaaguuuaaagccuuuggcccauuucucauguguggggagagaaaaagcaggaggcugaggcaugggaaguccacauguuauuuacaugacugcugcaacuua

SEQ ID NO: 165832 - RNA, 48 nt, Homo sapiens
ggacagcagggggcaguagcacagcaaguuauucagcaggaaggggcu

SEQ ID NO: 165833 - RNA, 39 nt, Homo sapiens
agggcaaggccauccaagugcuguuugugcggaaaaaga

SEQ ID NO: 165834 - RNA, 77 nt, Homo sapiens
aagucccagaaugugaaguugcucacacaucaccaagugaaaaagaagaugaggacaucaucaccucuguagaaaau

SEQ ID NO: 165835 - RNA, 46 nt, Homo sapiens
ugaaugcaaaugaaaauaauguugacagcaugaguggcacagagaa

SEQ ID NO: 165836 - RNA, 49 nt, Homo sapiens
acaggguuaggagaagaaagugaaggggucuugauuugugaaagugcag

SEQ ID NO: 165837 - RNA, 45 nt, Homo sapiens
ugaugaaggcauugugacuagcacaggcgcaaaagaggaagacga

SEQ ID NO: 165838 - RNA, 35 nt, Homo sapiens
gggauaacagaagauggagaggggccagcaaguug

SEQ ID NO: 165839 - RNA, 46 nt, Homo sapiens
guuguccugggagauaaugaugcaccaccaggaacaagugccagcc

SEQ ID NO: 165840 - RNA, 46 nt, Homo sapiens
ugaaguugaaagugauggagcaguuacaagugcuggaacagagaua

SEQ ID NO: 165841 - RNA, 46 nt, Homo sapiens
caagcacuaaggaaggggaaaguggggagugugcuguggcugaauc

SEQ ID NO: 165842 - RNA, 89 nt, Homo sapiens
gaaggaaugaaaacagugagguagacaccagugcuggaaguggcucugcacccucuguuuuacaccaaaggaacggacaaacugaggau

SEQ ID NO: 165843 - RNA, 94 nt, Homo sapiens
uaaagcagacaauuaaagcaacaguagagaauggcaagaaggauggcauugcuguugaucauguuguaggccugaauacagaaaaauaugcuga

SEQ ID NO: 165844 - RNA, 111 nt, Homo sapiens
aguugacaguagucaugaaaaggccagagguaauaguucacucauggaaaagaaauuaaguagaagguugugcgaaaaucggagaggaagcuugucacaagaaauggccaa

SEQ ID NO: 165845 - RNA, 120 nt, Homo sapiens
cacuuccaccaggcuugagagaaaguugucagauggccacaaaagcagaagcuuaaagcauaguaguaaagacauaaaaaagaaggacgaaaauaaaucagaugacaaggaugguaaaga

SEQ ID NO: 165846 - RNA, 46 nt, Homo sapiens
acagaaggauucuagucauagagccaaguuaccauuagcaaaggag

SEQ ID NO: 165847 - RNA, 46 nt, Homo sapiens
acaggcaaccacuccaaaaccagacaaggagaagaacacagaagaa

SEQ ID NO: 165848 - RNA, 45 nt, Homo sapiens
ugugauauggacuccacuaacauggauaguaauuugaaaccagaa

SEQ ID NO: 165849 - RNA, 61 nt, Homo sapiens
gauggaaagccaguuucugaauauauuauaaaaacagaugagaauguucguaaagaaaaca

SEQ ID NO: 165850 - RNA, 55 nt, Homo sapiens
aacaaagcuuucuucagaugauaaaaccgaacgaaaaaguaaacauaggaaugaa

SEQ ID NO: 165851 - RNA, 63 nt, Homo sapiens
cacaagagauguaaaaaggcaaguagaacgcucagaaauuugcaccgaagagccccagaaaca

SEQ ID NO: 165852 - RNA, 70 nt, Homo sapiens
aauuagaaagagaacauaaaagacggacaucuaccccuguuaucauggaggggguacaggaagagacuga

SEQ ID NO: 165853 - RNA, 29 nt, Homo sapiens
aaaucagugccugugauauacuggaagga

SEQ ID NO: 165854 - RNA, 46 nt, Homo sapiens
uuagaagaaucaucaacaaagaguuuggaaccuaaagccgccagaa

SEQ ID NO: 165855 - RNA, 43 nt, Homo sapiens
aaggcaaaucaauagagaaaaacuugaagaaaaacgaaaacag

SEQ ID NO: 165856 - RNA, 40 nt, Homo sapiens
ccuuucaucuuuugaagaagauacugaggaggaaguugua

SEQ ID NO: 165857 - RNA, 75 nt, Homo sapiens
aaagaaauuugaucacucaaaaaagagugaagauacacagaaaguuaaagaugaaaaacaagcaaaggaaaaaga

SEQ ID NO: 165858 - RNA, 48 nt, Homo sapiens
acagacaaaggugaaaagaagccagacagcaaugagaaaggagaaaga

SEQ ID NO: 165859 - RNA, 47 nt, Homo sapiens
caaacucauccacauuaaaagcuguauagaagaaagguagaaagaac

SEQ ID NO: 165860 - RNA, 47 nt, Homo sapiens
uccgaaaauacaauguagugcaagaauugcucgaaugguagcaugua

SEQ ID NO: 165861 - RNA, 55 nt, Homo sapiens
aagagcagucagugagauggauggaaaaccacaguacagucuagaauucuggaag

SEQ ID NO: 165862 - RNA, 37 nt, Homo sapiens
cgugggggugggagcgcaaagauaaggaggcaaaccu

SEQ ID NO: 165863 - RNA, 91 nt, Homo sapiens
uaugaaaaccgaauauacagccuuaaaauagaauauggaccuaaauacucagaagcaccccccuuuguaauauuuguaacaaaaaauuaau

SEQ ID NO: 165864 - RNA, 62 nt, Homo sapiens
agauggcagccaccacaggcucaguaguaaaagucccuugcaauuuccaacuguuggaagaa

SEQ ID NO: 165865 - RNA, 41 nt, Homo sapiens
uucuccuggguaaaaugaguauaaugauacucucuacccca

SEQ ID NO: 165866 - RNA, 40 nt, Homo sapiens
ucacauuuuucuguuuucauacagguccucaugcugauac

SEQ ID NO: 165867 - RNA, 48 nt, Homo sapiens
gcauuauauucaaaggaaaaacuugguuaaagauuggcagugggagaa

SEQ ID NO: 165868 - RNA, 42 nt, Homo sapiens
uaaggggugaggaaagacaagcuaagaaggggaauaaugggg

SEQ ID NO: 165869 - RNA, 63 nt, Homo sapiens
aauguaaaaguuuuuuuggauaaaugauugauuuuuuaaaauaaaugaauugugaugaagaua

SEQ ID NO: 165870 - RNA, 45 nt, Homo sapiens
uacuacugugacaacauuaacgguaaugccuuuuaacagugcgau

SEQ ID NO: 165871 - RNA, 45 nt, Homo sapiens
aacuggugcaggccugcaggauuugguuucagcauguccuucucu

SEQ ID NO: 165872 - RNA, 46 nt, Homo sapiens
auuuaacuaacaagggcauuggagaagaaauagauaaugaacaccc

SEQ ID NO: 165873 - RNA, 48 nt, Homo sapiens
ugauaagaguuugguuugcucauuccugaguuuaauuaaggggaaaca

SEQ ID NO: 165874 - RNA, 38 nt, Homo sapiens
aaauuuaaaauuuucacaguaaauaguauacauuuaga

SEQ ID NO: 165875 - RNA, 48 nt, Homo sapiens
gaaaaaugcugucauacuugugcagagagaugcuauuuggaaguguga

SEQ ID NO: 165876 - RNA, 106 nt, Homo sapiens
agucaucuauggcuugagggaaauaggaugaaacuguugagucgacuuacucguuuguagauagucuuaauacuugccuaauaagguuauuguagaauuaagaagu

SEQ ID NO: 165877 - RNA, 45 nt, Homo sapiens
gucuguaauuaaaaaaaauuaggaaaauauauuugugggagggga

SEQ ID NO: 165878 - RNA, 47 nt, Homo sapiens
ucaaaaaguagauuuuauaguuagaugauguuuuggugguauauauu

SEQ ID NO: 165879 - RNA, 45 nt, Homo sapiens
acagaaguuuuuuaaauauuccguggaugaaaagucagauaaagg

SEQ ID NO: 165880 - RNA, 47 nt, Homo sapiens
gguuuuucagcccauguuaauggaauauuuuaccuaugaagagcuua

SEQ ID NO: 165881 - RNA, 45 nt, Homo sapiens
augaauaugaacaguuaaauuaugcaaaacaacugaaagagagau

SEQ ID NO: 165882 - RNA, 44 nt, Homo sapiens
agaugggcauuuaugaauaggaggugguaaagauggauuucaug

SEQ ID NO: 165883 - RNA, 46 nt, Homo sapiens
cagauugaaaaugaauacauuauugguuugcuucaacaacgcagcc

SEQ ID NO: 165884 - RNA, 39 nt, Homo sapiens
uuuuuuuuuuggcuuuguuuucacuucaucaaaucaaca

SEQ ID NO: 165885 - RNA, 46 nt, Homo sapiens
ugguuauucuuuuaacugcuaaauuuacuaacuuuagguaccgggu

SEQ ID NO: 165886 - RNA, 58 nt, Homo sapiens
uaucuacuuuuuagguuguuuuaagaauuaaauauauaaaaacacuaggguaauuucu

SEQ ID NO: 165887 - RNA, 61 nt, Homo sapiens
aucuugccuuuuaucucugggggauggguagugggguggcaaaauuacugccuuggugaga

SEQ ID NO: 165888 - RNA, 45 nt, Homo sapiens
uaguaggucauaaaucucuuuuguggguccgaaacagcauuaaaa

SEQ ID NO: 165889 - RNA, 53 nt, Homo sapiens
uuuugggaacaaucugcuaagaaaucuccugcuaauucacugaccuuucagac

SEQ ID NO: 165890 - RNA, 41 nt, Homo sapiens
uuauggaaagguuuuucaccuuuguuauccagacaacagug

SEQ ID NO: 165891 - RNA, 53 nt, Homo sapiens
uugugaccucccaaaauaaagaaucacaauuuaauuuacuugcagacuaaggc

SEQ ID NO: 165892 - RNA, 47 nt, Homo sapiens
auuuuuuacuuagcaguauuauaguguuuuuauccucucuggcuuuu

SEQ ID NO: 165893 - RNA, 79 nt, Homo sapiens
cuaggucacuaaaauuaggauuucacccagacaucagguauaaaugauuaaagcucuccauuugagugcaguaugcagc

SEQ ID NO: 165894 - RNA, 57 nt, Homo sapiens
agagaaacgaccaauucuaccaguuauucuacaauguggguuuucacugcucuguuc

SEQ ID NO: 165895 - RNA, 45 nt, Homo sapiens
augaaaaucaccuuggaguguaugaaccagcguccuggccccgcc

SEQ ID NO: 165896 - RNA, 47 nt, Homo sapiens
aacuacuguggugaucucaaagugcggggagauguaguccagaccaa

SEQ ID NO: 165897 - RNA, 42 nt, Homo sapiens
ucuuucugugagcgcagauuccgggcaacuuguuuccaauag

SEQ ID NO: 165898 - RNA, 40 nt, Homo sapiens
gguggggugggugggguugugggggugggggagcuuuuug

SEQ ID NO: 165899 - RNA, 40 nt, Homo sapiens
gugguugucugauuugccugggcaaagugaaucagggugg

SEQ ID NO: 165900 - RNA, 43 nt, Homo sapiens
cccuucugcuugcaugcgcggggacccgcggcuaucgcuagau

SEQ ID NO: 165901 - RNA, 24 nt, Homo sapiens
gcagaagcagcgaggcuaacucga

SEQ ID NO: 165902 - RNA, 42 nt, Homo sapiens
aacccauaguugcaggaagucauuaucagggagaugccucca

SEQ ID NO: 165903 - RNA, 45 nt, Homo sapiens
gcaugcugcugcuaugcaacacauacagguuaucagagagagcag

SEQ ID NO: 165904 - RNA, 40 nt, Homo sapiens
uugcaauguagaagaggcauuucuuaacgaaagaaauuua

SEQ ID NO: 165905 - RNA, 49 nt, Homo sapiens
ccauuaugcuuauuggaaauaacaguaauuuagaaucuagaagagaagu

SEQ ID NO: 165906 - RNA, 72 nt, Homo sapiens
cagaggggcagcaggagcuguauuauguauauuacauauguaauaguguaugauauuacaaugagagauaca

SEQ ID NO: 165907 - RNA, 30 nt, Homo sapiens
cacaauugguguugaauuugguacaagaau

SEQ ID NO: 165908 - RNA, 45 nt, Homo sapiens
ggccgugagacguuucgggagccggagucucuccaccgcagacau

SEQ ID NO: 165909 - RNA, 53 nt, Homo sapiens
uuucuagaggaaaagcaugccucucuagagaaaagggcuuuggggagagaccc

SEQ ID NO: 165910 - RNA, 51 nt, Homo sapiens
gaugugccacaguucacaagugcaggagagaauuuugauaaauuguuagcu

SEQ ID NO: 165911 - RNA, 73 nt, Homo sapiens
cagccucucuacuucuuuuaacuccccuuuucuugugagagcaggaucccuaggauaguuaauagcagccuaa

SEQ ID NO: 165912 - RNA, 45 nt, Homo sapiens
ccucugaaggcagggaagacucgaaccuuuuauggucugcaucag

SEQ ID NO: 165913 - RNA, 74 nt, Homo sapiens
caggacuuccccagcguggugcuaguuggccucggcaaaaaggcagcuggaaucgacgaacaggaaaacuggca

SEQ ID NO: 165914 - RNA, 46 nt, Homo sapiens
agggagcggugcuuggucucuaugaauacgaugaccuaaagcaaaa

SEQ ID NO: 165915 - RNA, 46 nt, Homo sapiens
aaccagauuugcugaaauuauugagaagaaucucaaaagugcuagu

SEQ ID NO: 165916 - RNA, 46 nt, Homo sapiens
uaguuuaaucauuuuaacaaguggauggcaaaugccggaggagcau

SEQ ID NO: 165917 - RNA, 29 nt, Homo sapiens
cugcaaauauggaccucaugagggcugac

SEQ ID NO: 165918 - RNA, 38 nt, Homo sapiens
aucauguauauaaauacaaagaugaacauugguucuuu

SEQ ID NO: 165919 - RNA, 84 nt, Homo sapiens
ucugucugccucacaccaaguguaguuugcugauugcugacagagcuccacuuuccuguguuugaggcuucuuuucuaacuccu

SEQ ID NO: 165920 - RNA, 42 nt, Homo sapiens
uguuccaggcacuaggaggacaguggugaauaagacagacaa

SEQ ID NO: 165921 - RNA, 46 nt, Homo sapiens
ccacaguggggcuggaagagugucugggccugguguggaauaagau

SEQ ID NO: 165922 - RNA, 22 nt, Homo sapiens
gacacauccugcagaugaaagu

SEQ ID NO: 165923 - RNA, 49 nt, Homo sapiens
gaagaacucuuugccagauaaugaguucauuuuaguuuuaugcucccau

SEQ ID NO: 165924 - RNA, 48 nt, Homo sapiens
caagcugaugccuuaggaaauugaaaauucaacuguucuuagcaugug

SEQ ID NO: 165925 - RNA, 53 nt, Homo sapiens
aggcuguagccgagcgcgggcaggacucgucccggcaggguuccagagccaug

SEQ ID NO: 165926 - RNA, 42 nt, Homo sapiens
ccaggcgaagcuggugguggcgcugagccgcaccuaccgcac

SEQ ID NO: 165927 - RNA, 54 nt, Homo sapiens
cuaaauaaauauuuuaauuugucugcauuauuauggcuagugcuuucaucaguc

SEQ ID NO: 165928 - RNA, 45 nt, Homo sapiens
gcagcaaaguuuguuaccucauuucaccaaucagauauggaagau

SEQ ID NO: 165929 - RNA, 46 nt, Homo sapiens
cuggcgcuuucacgacuucaggaucccaaggaugaugaaugcccag

SEQ ID NO: 165930 - RNA, 45 nt, Homo sapiens
uuuuuagcauaugcuacuuugauugaaaaugauucaaauccagaa

SEQ ID NO: 165931 - RNA, 66 nt, Homo sapiens
gcuuuguauuggugugcccuuugugaauauuugaaaucaaaaggagaugaaggugaagaauuuuua

SEQ ID NO: 165932 - RNA, 46 nt, Homo sapiens
accuuuugaaagagacagagcaacuugaaauuaaagaaguccacau

SEQ ID NO: 165933 - RNA, 29 nt, Homo sapiens
aaugaacaucauuuauuguuguacuuuug

SEQ ID NO: 165934 - RNA, 47 nt, Homo sapiens
uagcugguggcuucuuuuauuugacgaagucugugggccauuauagg

SEQ ID NO: 165935 - RNA, 44 nt, Homo sapiens
agugguuagguaagucuuaugucucagaucacuguuguuuagga

SEQ ID NO: 165936 - RNA, 50 nt, Homo sapiens
cuuacagaugaugguagucugaacaagauaaugacaguggauuuggaaag

SEQ ID NO: 165937 - RNA, 52 nt, Homo sapiens
agcaaauacuuauugagugcguauuaugugccagcaacuguucuagacuuag

SEQ ID NO: 165938 - RNA, 58 nt, Homo sapiens
caacugaugacguucgggauugaaccauuuaaaacuaaaaaaaucaaaacacuucauu

SEQ ID NO: 165939 - RNA, 45 nt, Homo sapiens
ugacaucaaauucaagucccccaugaauuauaucuauaaugauau

SEQ ID NO: 165940 - RNA, 46 nt, Homo sapiens
aaugcuuugaagaagcuuuucuuccaacccugcaaacacuggccaa

SEQ ID NO: 165941 - RNA, 46 nt, Homo sapiens
aaauugauaucacaaauguugcugaguuacuuguagauuugacaag

SEQ ID NO: 165942 - RNA, 59 nt, Homo sapiens
acuuaagcuggguuguuuuaauccuuuaauggcauuuggucaaacuuguuaccauuuuu

SEQ ID NO: 165943 - RNA, 171 nt, Homo sapiens
augaauuggugagcagaaagaaaagaauauuaauaaagaaagcagcugaaaaucuguauaauucgcuuguagaaaaaguacuagaaaguaauaguagaaagaauagaaauugaccuaauaaagaauuauggguacaagaaucuaaaagaaagagcuugagaggcaagggag

SEQ ID NO: 165944 - RNA, 90 nt, Homo sapiens
aggagcuguugacauaguuuaauuggggaguacucucaugaucagugucuuggaagaguaagggaaaaguagauuggggcauagcccuaa

SEQ ID NO: 165945 - RNA, 56 nt, Homo sapiens
uuggacaagguccaccaaaguccaccauugucagccuggaucaguacugcagcugg

SEQ ID NO: 165946 - RNA, 51 nt, Homo sapiens
uuuuuuaggccuuaacaguacaugacaauuuggcuaugaaaauuugcaaug

SEQ ID NO: 165947 - RNA, 46 nt, Homo sapiens
gucugagagcuuuggagaaaaucaagauucaguuagaaaaaggaaa

SEQ ID NO: 165948 - RNA, 41 nt, Homo sapiens
cccaucuuauuucauauuuucccaacuuauuucccaagggc

SEQ ID NO: 165949 - RNA, 50 nt, Homo sapiens
uaaguuuuaaucuugcuuggguuccuuuuucuguggcagugauaacuggu

SEQ ID NO: 165950 - RNA, 55 nt, Homo sapiens
uuagugaucaugaaguuccagaaccagaaucagaaaugaagaugagacuaccaag

SEQ ID NO: 165951 - RNA, 395 nt, Homo sapiens
ccacguuacuuuggccuguauuaaagcaguagagcagcaucaguuauuauaguccagaaaaagugugcaucagucagucacacagauuuaucacaaucugaggugggccuaggaaucucauuuuuaaauagucucuccaagugauucuuaugaacucuuuauguuuaaaaucaugucauuauggaaaacuuacaaguguaacuagcuaguagcuugcauuugagaagcuuaugacuuagaugggcagaaucaacaaagaugaaaccgccugaggacacauuuaacaaguaacauuucuagggaaaaugaaggaaguaccacaaacuggcuagaaaggagcuuaucaaucaccagugaggaagaccaguauaacguucaacaacaguuauuuugac

SEQ ID NO: 165952 - RNA, 48 nt, Homo sapiens
uuaggcuuaucaucuacuagaggccauuuacuuaaggugaaauuuuaa

SEQ ID NO: 165953 - RNA, 28 nt, Homo sapiens
aauuugcaggggguugggagaaggacug

SEQ ID NO: 165954 - RNA, 49 nt, Homo sapiens
auaaagauagugcaagaagaacugcaaucuauuucucuucgcuuuugag

SEQ ID NO: 165955 - RNA, 41 nt, Homo sapiens
ugaaggauacagagaaacuagcagguggaugaggcagucag

SEQ ID NO: 165956 - RNA, 52 nt, Homo sapiens
cucuguugaagagagaaaauaguaacaugaaguggguagagagagaggagaa

SEQ ID NO: 165957 - RNA, 46 nt, Homo sapiens
gagacaguuggaccgcaucauugccaaacuucaauccaaggaauau

SEQ ID NO: 165958 - RNA, 41 nt, Homo sapiens
acaaagaauuacauccggacauguacagauaucaagccaga

SEQ ID NO: 165959 - RNA, 46 nt, Homo sapiens
uaauuuaaaagguuuuauuuaguuuaaguaugcuguguuaacggcu

SEQ ID NO: 165960 - RNA, 46 nt, Homo sapiens; identical to SEQ ID NO: 85004

SEQ ID NO: 165961 - RNA, 48 nt, Homo sapiens
agagacacgugugucgcaauaaaacuuugccgucuuuaagucugaggu

SEQ ID NO: 165962 - RNA, 56 nt, Homo sapiens
ucgccccacggaggccaagaaagccgcagaugaggccaagaugagauuugcccaca

SEQ ID NO: 165963 - RNA, 69 nt, Homo sapiens
augugcagcaauguaaauggacuguuuuuaaaugguccauuuauaggaaaaguguugaaauaagaggca

SEQ ID NO: 165964 - RNA, 51 nt, Homo sapiens
aagaaguuuguuguugugauguaguuguaaucuuccaacuacaucucaguu

SEQ ID NO: 165965 - RNA, 50 nt, Homo sapiens
uuaguuuuuagagaaaguguggggcaagaacuaauggauuguguacuuac

SEQ ID NO: 165966 - RNA, 53 nt, Homo sapiens
uuaaaggauaaauugaaaaaaauuuaaauguaaaauuauggcuuaguuuagac

SEQ ID NO: 165967 - RNA, 51 nt, Homo sapiens
uugagccuuuucuauauauguacuccaauggcacccgaacaaacaugaauu

SEQ ID NO: 165968 - RNA, 48 nt, Homo sapiens
acucugaugagagcccuggaacuuuugaauuaccuggcugcuuuaaau

SEQ ID NO: 165969 - RNA, 45 nt, Homo sapiens
auuaagucuuacaugauagcauuaaaacuaaaaaaggugacaguu

SEQ ID NO: 165970 - RNA, 41 nt, Homo sapiens
agacaguauuuaauauguaauucuaggcuuuuuuuucuuuu

SEQ ID NO: 165971 - RNA, 38 nt, Homo sapiens
uuucaccauagggucuguuccauauuagucaaugcggu

SEQ ID NO: 165972 - RNA, 44 nt, Homo sapiens
gugaguuccuggaaugcagaagcuucaucuagauccugucaaac

SEQ ID NO: 165973 - RNA, 52 nt, Homo sapiens
cuacacuuccaccucagcagcagcaacgcauuuuugagccuccaccucccaa

SEQ ID NO: 165974 - RNA, 48 nt, Homo sapiens
agccuguaagagaauaaagcgugaaguugaugauuugggcccugaagu

SEQ ID NO: 165975 - RNA, 48 nt, Homo sapiens
uacacauccuguugagaucuucuauacuccagaaccagagagagauua

SEQ ID NO: 165976 - RNA, 46 nt, Homo sapiens
agguuauaguuaugagcgcuacucuagaugcaggaaaauuccagau

SEQ ID NO: 165977 - RNA, 46 nt, Homo sapiens
agauauucuaauggguguucugaaggaaguuguaagacagagauca

SEQ ID NO: 165978 - RNA, 48 nt, Homo sapiens
uugucuguguacaacucuucgucauuuauggcacucuguuuaggggug

SEQ ID NO: 165979 - RNA, 50 nt, Homo sapiens
uaacauauuuuaauucaggaaaucaccuucaguuuuuugaaggagcugau

SEQ ID NO: 165980 - RNA, 45 nt, Homo sapiens
uauaagcuaaaaagaggaaucuuuuguucuguaauacacuguuag

SEQ ID NO: 165981 - RNA, 103 nt, Homo sapiens
aggagaguggcugcaaugaguguggcucagagaguugcugaugagauggaugugauguugggccaggaaguugguuacuccauucgauuugaagacugcagua

SEQ ID NO: 165982 - RNA, 45 nt, Homo sapiens
ucacuuccacagugcauuaauccguucaccaacuuaccccauacu

SEQ ID NO: 165983 - RNA, 123 nt, Homo sapiens
caacaaaugcuaugcuuaucagugcuggauuaccaccuuugaaagcuucccauucagcucacucaacccacucagcacauucaacgcauucaacacauucugcucauucaacgcaugccggac

SEQ ID NO: 165984 - RNA, 84 nt, Homo sapiens
ggucuaaagaucgagaccgagaacgugauagaggagauagagagcgagagagggagaaagaaaaggagaaggaguugcgagcuu

SEQ ID NO: 165985 - RNA, 61 nt, Homo sapiens
aacuacaccucguuggcauuuuggagcaauguaaacacuuaauuaacagucaccuuaggcc

SEQ ID NO: 165986 - RNA, 56 nt, Homo sapiens
uagaauguauuuuauacauccuuuguuugguuugguaaugaagcaucugaugaagu

SEQ ID NO: 165987 - RNA, 55 nt, Homo sapiens
ccuaucuauacucuacaaaacauauugauagccacaucuuauaggugagggaaga

SEQ ID NO: 165988 - RNA, 48 nt, Homo sapiens
guauuugcacacauccuugagagguuccuggaaauaagauugacggau

SEQ ID NO: 165989 - RNA, 51 nt, Homo sapiens
cacuacaauccuguaugguagaugagguuaaaugaacuugccacagggaac

SEQ ID NO: 165990 - RNA, 45 nt, Homo sapiens
gcuuuaugauucccuuguauauuauuuagaauuugccuauggaua

SEQ ID NO: 165991 - RNA, 35 nt, Homo sapiens
gaacugaugucucucacaggaggucagauuggaac

SEQ ID NO: 165992 - RNA, 46 nt, Homo sapiens
cuuuuugaggcuuugccauauguugaauuauucaauagaaagcaaa

SEQ ID NO: 165993 - RNA, 48 nt, Homo sapiens
gugauacagaaucacugugucaagucaccuguauagcuguuuugaauu

SEQ ID NO: 165994 - RNA, 48 nt, Homo sapiens
ccgguuggaccuaggggaggauuaccccucuggcaagaagcgugcggg

SEQ ID NO: 165995 - RNA, 39 nt, Homo sapiens
aucaagaaauuauugcuaauuuuuaagauauaauaaaug

SEQ ID NO: 165996 - RNA, 46 nt, Homo sapiens
uaagaguagacaaaucaguggaacagaagaguggauccaaaaauag

SEQ ID NO: 165997 - RNA, 46 nt, Homo sapiens
uaaguuuaaaaaaaauauuuaggugacuacaugcaaaucuagggga

SEQ ID NO: 165998 - RNA, 356 nt, Homo sapiens
augcaguuggccgggugugguggcucaugccuggaaacccagcucuuugggaggcugagguagguggaucauuugagcccaggaguucaaaaccagccugggcaacauagcaagaccucgucucuaccaaaaauauaaaaauuagcuaggcaugguggugcaugccuauaguuccagcuacuagggaggcugaggugggaggaucacuugagcccaggagguuggggcugcagagagccaugaacacaucauugcacuacagccuggguaacugagugggacccugucucaaaaaaaaaaauacuaugcaguuacuaagaagaaggaauuagaacuacugcauaugaauuagaagg

SEQ ID NO: 165999 - RNA, 41 nt, Homo sapiens
aaacuucuacuuauaauuacaugaguuugggaaaaaaguuu

SEQ ID NO: 166000 - RNA, 40 nt, Homo sapiens
uuccugggcuggcugggugcagcucucuuuucaggagaga

SEQ ID NO: 166001 - RNA, 45 nt, Homo sapiens
gacucggcggaguggauccgagacauguacgccaaggucacggag

SEQ ID NO: 166002 - RNA, 46 nt, Homo sapiens
ggggcugcgcggcguccagcguggccgacggcugcaccuggcaggc

SEQ ID NO: 166003 - RNA, 41 nt, Homo sapiens
acagcuccagccgcgccauccacgugcaccaguucggggac

SEQ ID NO: 166004 - RNA, 42 nt, Homo sapiens
cgaaguugccgaagucgcccgggugcugcgggugcggcacgg

SEQ ID NO: 166005 - RNA, 42 nt, Homo sapiens
ggccgccucgcucgcgggcccgcacuccaucgugggccgggc

SEQ ID NO: 166006 - RNA, 47 nt, Homo sapiens
uucccguucuccacgcuggccugguugccgccgcggcccaggucguc

SEQ ID NO: 166007 - RNA, 58 nt, Homo sapiens
guggugggcgugugcgggcccgggcucugggagcgccaggcgcgggagcacucagagc

SEQ ID NO: 166008 - RNA, 50 nt, Homo sapiens
agaagcucaaaggcagaggggggccucgggggucccuggccgccgccggg

SEQ ID NO: 166009 - RNA, 64 nt, Homo sapiens
gcuucuccucugcuccaacagacacccuccacucugaggucucaccuucgccuuugcugaaguc

SEQ ID NO: 166010 - RNA, 75 nt, Homo sapiens
ggagagggcugcggggagacuucagcaaaggcgaaggugagaccucagaguggagggugucuguuggagcagagg

SEQ ID NO: 166011 - RNA, 43 nt, Homo sapiens
aggguuggggcgguccucaggauggaaggauggugggucucgg

SEQ ID NO: 166012 - RNA, 28 nt, Homo sapiens
ccacucaguaggucugaaggccuccauu

SEQ ID NO: 166013 - RNA, 31 nt, Homo sapiens
gcugucagcgugagcgggguguuucgguaca

SEQ ID NO: 166014 - RNA, 22 nt, Homo sapiens
gcucccugagguaccuuuccac

SEQ ID NO: 166015 - RNA, 50 nt, Homo sapiens
gagcgccuaggaggaaccugaaggcgggaagggggaagaucgucagguca

SEQ ID NO: 166016 - RNA, 61 nt, Homo sapiens
guuccuccuaggcgcucagaggccgcucugggggguugccucgaguccccccaccccuccc

SEQ ID NO: 166017 - RNA, 238 nt, Homo sapiens
acugaaccgcagccagaaaccugucuccagggguuauuuuuaccucuaacuaggacuaacuuauuuuaaaaucuuuccuugagcccaagugacaacugaagagaaaggcuauugccuggugauuuugcuccaccaguugguucucacugguuugaauacuaacuugaacuguacucaucgacacugaaaggggaugagcaaacagugucucuaaaucuccugauccugaucucaaaua

SEQ ID NO: 166018 - RNA, 66 nt, Homo sapiens
gacuuuuccaccuucuaguuaacauacaaucaaucagagugaugcuuguaaagagugaauaugauc

SEQ ID NO: 166019 - RNA, 41 nt, Homo sapiens
aaauacaucgacugugugacuuguuacuugaacauucacaa

SEQ ID NO: 166020 - RNA, 46 nt, Homo sapiens
uauuucccuaucuuuggaaaagagcaaauguauauaaaccucagga

SEQ ID NO: 166021 - RNA, 50 nt, Homo sapiens
uuggcuuggucaggaaauuuaaaccacuuugcugagccaguuccuaccaa

SEQ ID NO: 166022 - RNA, 49 nt, Homo sapiens
ucacgugaauuuugaaaauugaaaauuuuugaaagcauucugagagaag

SEQ ID NO: 166023 - RNA, 42 nt, Homo sapiens
gugauugaaauuuaaagcaaguuagggauaggugacugagag

SEQ ID NO: 166024 - RNA, 47 nt, Homo sapiens
gauaucaguuaggaaacuauuuagaaggagaggucuugagaauucua

SEQ ID NO: 166025 - RNA, 44 nt, Homo sapiens
ucugcacugcuauguucuuuucagcauuuuucacaauagccaag

SEQ ID NO: 166026 - RNA, 107 nt, Homo sapiens
cuguauuuuacugaauugcaaagauggaguuacuaauuuugauguggagaugcagguuauuaguagguuauuagugaauccuuuuuuuuuuuuuuuaaauauccaga

SEQ ID NO: 166027 - RNA, 26 nt, Homo sapiens
uauuaagauauuuuauguugcauuua

SEQ ID NO: 166028 - RNA, 47 nt, Homo sapiens
uauccauauucuuaacuuacuaucaaguuuaacuuaguguaaucgac

SEQ ID NO: 166029 - RNA, 33 nt, Homo sapiens
uuuuuuuuuuaccugccuguggugaagaaugca

SEQ ID NO: 166030 - RNA, 37 nt, Homo sapiens
ucuccccccgcuuuagaggcuuauguaauuaugauag

SEQ ID NO: 166031 - RNA, 245 nt, Homo sapiens
uuaugcuaauuuugugguggaggaagcuaagauccaaagauguuaagaaguuugccgaagauuacaucuuuaauaaauaguggaauugcgauuugagcuuaggucugacuccagacuugguggucuuugugaaauucuucuuaucccuuugagagacugauuauuuggaggaggauauggguugauagguaaacaguuacuugcaacuauaauaguuaugcauaaaauguuauuaagagugcaga

SEQ ID NO: 166032 - RNA, 43 nt, Homo sapiens
cacuuuauccucucucuuuguauuuuagacuauauuugguuuu

SEQ ID NO: 166033 - RNA, 52 nt, Homo sapiens
uggugguguggugggguacagguggggaaauauguaggagugaaauaaucag

SEQ ID NO: 166034 - RNA, 46 nt, Homo sapiens
cauuugaugcauuuuguaauucuguguuugguguggcucagcuaga

SEQ ID NO: 166035 - RNA, 33 nt, Homo sapiens
cuucaauaugaucuuuuauuucuguccccacua

SEQ ID NO: 166036 - RNA, 74 nt, Homo sapiens
ugaucuggccuucgcuuauacuuuuucuguuaauuaucuaauuaagugggaauaaugccuacuuugugggcaaa

SEQ ID NO: 166037 - RNA, 46 nt, Homo sapiens
uuaucuaaaggaaaaguaaggcaggaaguauagauauguauucuag

SEQ ID NO: 166038 - RNA, 53 nt, Homo sapiens
gcccuuauagcugcaauagaucuuaguaaguaucucuacuugcuuuauuuuag

SEQ ID NO: 166039 - RNA, 46 nt, Homo sapiens
cucuucaaacaauacauaaacaaauggaugaugacaaagauggugg

SEQ ID NO: 166040 - RNA, 48 nt, Homo sapiens
uaagucucucuguaggcaguuuauaacaugacaaugggguucccucag

SEQ ID NO: 166041 - RNA, 236 nt, Homo sapiens
cuguuauguauuuuguuucaggauaucugaaauggguguauugggaaaccuuacauaaaugucugauauuccccaaaacauguauuaaaccuuccaauauaaucagagugaugcucauuuauucauguuuuaaacuuugacauugauucaacauggacauauaaaaaccacucaaaauauuuugucuaacacuuuugcauauacuauguaugccuuuuaauuuaaucuuuguaacc

SEQ ID NO: 166042 - RNA, 50 nt, Homo sapiens
ucgacuacucauaaaaugguacauucaacaucaguguguuuaucacccua

SEQ ID NO: 166043 - RNA, 31 nt, Homo sapiens
ggugguguucggguugacccaggaguucuag

SEQ ID NO: 166044 - RNA, 38 nt, Homo sapiens
aagaguuauaaaaagacaaauucacuauuggcaggaac

SEQ ID NO: 166045 - RNA, 40 nt, Homo sapiens
uaagugcugauccaaaauagugacaugguggugggaccga

SEQ ID NO: 166046 - RNA, 73 nt, Homo sapiens
gagugaugagcagaagacuuauacuuuacugaaauaaacaguuguugaaguaacaaucauacagauaaguagu

SEQ ID NO: 166047 - RNA, 210 nt, Homo sapiens
augcuaugcauaaaagcuacuaagggauuaauaaucaggggcuggguguggugucucauaccuguaaucucagcacuuugagaggcagaggaguucaagagaucagccuaugcaacauagcaagacccuaucucuacaaaaaaaggaaaaaaaagguuauauaguaauguucagaaagguucacuugaagaauuaaaguuuuagcugaga

SEQ ID NO: 166048 - RNA, 50 nt, Homo sapiens
aagaaggacauaguaugaucuguccuaagaaaugaaagacaacuagagua

SEQ ID NO: 166049 - RNA, 45 nt, Homo sapiens
cucuucagugguugauagaguuuguugaacuaccccaauaugaga

SEQ ID NO: 166050 - RNA, 71 nt, Homo sapiens
gaaaacagaaauguugcuguagaaaagcaaaauuuagagcgcaaaaugauggaugaaaucaauuaugcaaa

SEQ ID NO: 166051 - RNA, 24 nt, Homo sapiens
aaaaagaagagaagcacagucuuu

SEQ ID NO: 166052 - RNA, 65 nt, Homo sapiens
cauuccacccuauccaauugcuggaggaguugaugacuuagaugaagacacacccccaauagugu

SEQ ID NO: 166053 - RNA, 77 nt, Homo sapiens
cacgccgcagcauugugccguccucgccucagccucagcgagcucagcuugcuccacacgccccccacccgucacac

SEQ ID NO: 166054 - RNA, 46 nt, Homo sapiens
aaauucuuccauuggaaggaaacagucuccuccuuuaagccucgag

SEQ ID NO: 166055 - RNA, 42 nt, Homo sapiens
cucugcaagugaaacuguauagaguuuauaaaaugacuaugg

SEQ ID NO: 166056 - RNA, 47 nt, Homo sapiens
aaggcucuugauuccuuaugcaaguggaagaguugaaacuugauuga

SEQ ID NO: 166057 - RNA, 45 nt, Homo sapiens
uaacugcaaaggauuuacgguuugugaaaaauguguacuguggaa

SEQ ID NO: 166058 - RNA, 49 nt, Homo sapiens
ggagugaagaugggaggagcuguuagcaaggcccacugcugcuccuggg

SEQ ID NO: 166059 - RNA, 51 nt, Homo sapiens
uaauuuuuagggaagucgcagggcuuccagaaaaaaaaaauuaaagcaugu

SEQ ID NO: 166060 - RNA, 46 nt, Homo sapiens
gggcuucuccagcucaaucuggugcagcaguggggugaaaauacgc

SEQ ID NO: 166061 - RNA, 26 nt, Homo sapiens
ggaguccucccgacucggggucgggc

SEQ ID NO: 166062 - RNA, 35 nt, Homo sapiens
acuccugccaccaccaugucacuccuacagcacuu

SEQ ID NO: 166063 - RNA, 63 nt, Homo sapiens
acgugaguguguguuucuuuuuccaguuccugcauccuauuuugacacugguuguaagaagau

SEQ ID NO: 166064 - RNA, 43 nt, Homo sapiens
uugaaacaaguuuugguugaaagagucuguugaaaauuuuauu

SEQ ID NO: 166065 - RNA, 38 nt, Homo sapiens
gacuugacuugaagagcucuaagagacugaaaacuuau

SEQ ID NO: 166066 - RNA, 50 nt, Homo sapiens
cuaguuuaagguuuugccuggaaaauucccucucauuuuuuccuuuuuuu

SEQ ID NO: 166067 - RNA, 24 nt, Homo sapiens
uuuuuuuuuuaaacaaccaugcag

SEQ ID NO: 166068 - RNA, 45 nt, Homo sapiens
uucugguuugacuugugcuccacuuuuguaacucuaaaucugagg

SEQ ID NO: 166069 - RNA, 45 nt, Homo sapiens
ggggacgccagggaagcacgucuguggccaucaucugcauacggu

SEQ ID NO: 166070 - RNA, 22 nt, Homo sapiens
ccaguguaucacuauuagaagc

SEQ ID NO: 166071 - RNA, 41 nt, Homo sapiens
uuuguauuacuauuuuagguuaugguuguugagcagcauau

SEQ ID NO: 166072 - RNA, 45 nt, Homo sapiens
aguaccagcuuuauaggguuguuauaaggaauacagaguaccuua

SEQ ID NO: 166073 - RNA, 48 nt, Homo sapiens
auuuugggaccagguaguucuuugcugugcggaacuguccuguguauu

SEQ ID NO: 166074 - RNA, 85 nt, Homo sapiens
ugugauuacucaucuuauucauucuauuuuaauucuuuaauuuuauuuuuauuccuuagcgaaugcugaugucuuaaaggcgaug

SEQ ID NO: 166075 - RNA, 42 nt, Homo sapiens
uguucuuuccucucuagagaauuguugugguuagucaugaga

SEQ ID NO: 166076 - RNA, 46 nt, Homo sapiens
auccucauuuauuagccaaaagggaaauuaacugacauuacuggau

SEQ ID NO: 166077 - RNA, 32 nt, Homo sapiens
acacauaaaauuuaguacuguuaccauuuuaa

SEQ ID NO: 166078 - RNA, 45 nt, Homo sapiens
aagaagaaaggcuaucguuguacaacagaagcagagcaagauauc

SEQ ID NO: 166079 - RNA, 51 nt, Homo sapiens
gaagaugauuuuuacaccagaagaagauaugugcaaguuccaguguuaauc

SEQ ID NO: 166080 - RNA, 55 nt, Homo sapiens
cuuuucugcaccccacauuuaacacugccccuuccagcccagcucaugugauucc

SEQ ID NO: 166081 - RNA, 40 nt, Homo sapiens
ccuuccuuuuccaguuccuauguucucagaagccagccca

SEQ ID NO: 166082 - RNA, 91 nt, Homo sapiens
cgucuaggguuuuccugguuacuucuguucaaucuuuccuucguuugccuuuucugaagugaccuuuauuuucuuuccuacucccuccuuu

SEQ ID NO: 166083 - RNA, 71 nt, Homo sapiens
uuacaggguuagaacuuuuagcugcaaucccugaucucugggaagggaaaggggcuggagauuggguucac

SEQ ID NO: 166084 - RNA, 66 nt, Homo sapiens
cauauuauggaaacaguaguuacacaaacuaaguagaucugguggaucuuaguuccugggugggug

SEQ ID NO: 166085 - RNA, 45 nt, Homo sapiens
ggaggauaggggacaacaagaggcccccaugcauuuccaugugau

SEQ ID NO: 166086 - RNA, 47 nt, Homo sapiens
agauuugcuuuucaacucucauguuuccaggugaugcuggcuaagua

SEQ ID NO: 166087 - RNA, 47 nt, Homo sapiens
uagagaaaagaagggcagauagcuucacgguggguaguggcaaugcc

SEQ ID NO: 166088 - RNA, 47 nt, Homo sapiens
guuugauugcugggacacauaggugcauaaucagguuccacuuggau

SEQ ID NO: 166089 - RNA, 47 nt, Homo sapiens
uacacugacuuagcaguuuggccuucacuuuuucauagaaaccagag

SEQ ID NO: 166090 - RNA, 42 nt, Homo sapiens
cagugccauuauggcgugugaagucaccacccugacacauaa

SEQ ID NO: 166091 - RNA, 44 nt, Homo sapiens
cuuugccaaacaccacaugcuugccauccaaccacucagucuug

SEQ ID NO: 166092 - RNA, 59 nt, Homo sapiens
aucuucaaagccuucaaaaccagaaaaagauaaggagcccagaaaaggaaaaggaaaaa

SEQ ID NO: 166093 - RNA, 59 nt, Homo sapiens
gaugacucucaaucugaugagaaagaccaagaugcuauagaaacugaugccaugaucaa

SEQ ID NO: 166094 - RNA, 42 nt, Homo sapiens
accuuacuccauacucacuucaagcuauaaaggcaucuagac

SEQ ID NO: 166095 - RNA, 76 nt, Homo sapiens
uuuuccccucaaaugcuuguugcuucuuauggccuauauuuuccaaagauacuauuugaaugcaguauuaagagua

SEQ ID NO: 166096 - RNA, 45 nt, Homo sapiens
cacuuauggacacauauuauuugaugaaagaagacuuugagaaua

SEQ ID NO: 166097 - RNA, 42 nt, Homo sapiens
gcauaugcgauggugaccuaguggacagccagauccggagua

SEQ ID NO: 166098 - RNA, 60 nt, Homo sapiens
uucucacauacuucaugucccccucacacgcacagccucucccacugccaacauccccca

SEQ ID NO: 166099 - RNA, 75 nt, Homo sapiens
cucgaguggucauggcuaggagauaaaaguguguacccacaucugugcgugugcauguguguguguggugucuau

SEQ ID NO: 166100 - RNA, 44 nt, Homo sapiens
gcaaaguuugguaaauuuuccggcaaagaugauggcucuaguuu

SEQ ID NO: 166101 - RNA, 46 nt, Homo sapiens
gguaggaaagaguaugugucccaaggucugaagccaugugacagca

SEQ ID NO: 166102 - RNA, 51 nt, Homo sapiens
aagggacaguuuggcaaagacaauaaaaaaggaaacagauguguuuuggaa

SEQ ID NO: 166103 - RNA, 54 nt, Homo sapiens
gaugaagaaagaguccaaacuggagagaacaccccaaaaaaauguccaaggaaa

SEQ ID NO: 166104 - RNA, 52 nt, Homo sapiens
cacacugcauuuaguugugucuucuuagucuucucccgucgaugacauuucu

SEQ ID NO: 166105 - RNA, 43 nt, Homo sapiens
augguccauccagguuauuccgguuagagaaaucuagggaaug

SEQ ID NO: 166106 - RNA, 34 nt, Homo sapiens
uguuggcucacauaacuaaacuaugggcagggag

SEQ ID NO: 166107 - RNA, 75 nt, Homo sapiens
agauggccuguugaaucugauucggacuaugccaggcaagaaauccaaguaugaaauagcaguugaaacugaggu

SEQ ID NO: 166108 - RNA, 47 nt, Homo sapiens
uauacaccaucuuagguuuuuuuaaauugguguuuuuagaaaaagaa

SEQ ID NO: 166109 - RNA, 63 nt, Homo sapiens
caggaaaugucagcaagaaaacaaauuaucuugucaugggucgugauaguggacaguccaaga

SEQ ID NO: 166110 - RNA, 47 nt, Homo sapiens
ccagcaaacuuuccaugccaagguuauuuaugaugugaaaugagaaa

SEQ ID NO: 166111 - RNA, 478 nt, Homo sapiens
gaguugccuuuuuucccuuuuuucccauaaaacaguaaaaauuuuuuauuaagcauuauaaguugcauucaguagccuucagauaugccacaccacaauccauuggcagaccauccaacccagcagcaguuuguucuuguacaauccaugaguucgggcaaaacucccuucaacuuacaguuaagauccuacuuagcucuugcgggcagggauuggggaauuagaccucauuucugaucacuaauguggugaaaagcaucagaaguauuugaaaaugauaagaagugauucugauuuuaaaguacauuguuucgaaacauuaacagaaacaucaaaaugauaggaguauaccugcuucuauuaaauucuuguugggaaaguucuuaagaacaagcaguuuccugaauagcaagaguuucuacagauggauugcauuugguuguuuauuuauaguuaugcaaguuaacuaguaguuuag

SEQ ID NO: 166112 - RNA, 37 nt, Homo sapiens
uuauauuauacauuaugagaguuaucuuuccaaucca

SEQ ID NO: 166113 - RNA, 42 nt, Homo sapiens
ugguuggcugcugcuuuucaagcccauuuuaaguuuauuaau

SEQ ID NO: 166114 - RNA, 46 nt, Homo sapiens
gaaacgcacuaauuaucaagcuuaucgaagcuacuuaaaucgagaa

SEQ ID NO: 166115 - RNA, 26 nt, Homo sapiens
uauauuuuagugcagaacagugaaau

SEQ ID NO: 166116 - RNA, 46 nt, Homo sapiens
uucucccaaggccaguucuaagcuggcaauuaugaaaagaaaagaa

SEQ ID NO: 166117 - RNA, 53 nt, Homo sapiens
aagcgggagaaacguuuucaucuguccaagccaauuuaaguaaagcagaaaaa

SEQ ID NO: 166118 - RNA, 52 nt, Homo sapiens
uauuugucacauuugacacuuuuaaaauuuguuuaggcucgaaaggacacag

SEQ ID NO: 166119 - RNA, 52 nt, Homo sapiens
uaauaaaauaugccucauuugccuuggaaauuuuguggaugaaugaaugaca

SEQ ID NO: 166120 - RNA, 25 nt, Homo sapiens
uacuuccagauuuacagguugggau

SEQ ID NO: 166121 - RNA, 46 nt, Homo sapiens
aagaguuugccagaacauuagccauguuggaugaagaacccaagac

SEQ ID NO: 166122 - RNA, 29 nt, Homo sapiens
uuuuagauaauaaauagaaauaagaaagc

SEQ ID NO: 166123 - RNA, 42 nt, Homo sapiens
cagaucaguuugcagacugaaugguaggugagagaugucagc

SEQ ID NO: 166124 - RNA, 28 nt, Homo sapiens
aauuacagcuugaugaagaugcggaggu

SEQ ID NO: 166125 - RNA, 32 nt, Homo sapiens
aguccccugaguuaaagaaagccugccccaua

SEQ ID NO: 166126 - RNA, 46 nt, Homo sapiens
uacuugauuauuuuggaacuggaaguguccaaagaucuaauaagaa

SEQ ID NO: 166127 - RNA, 46 nt, Homo sapiens
ggccuggcacugguaaauguggggaugaugguugaauuuuggagau

SEQ ID NO: 166128 - RNA, 23 nt, Homo sapiens
cuuuaaaauguuaagggcaaagg

SEQ ID NO: 166129 - RNA, 44 nt, Homo sapiens
uuuguacacuaaaauucuguauaaaagaaacuaaauuuagaauu

SEQ ID NO: 166130 - RNA, 46 nt, Homo sapiens
agcucccguaaagaggaugacuucaaacaaaagcaaccaagcaaga

SEQ ID NO: 166131 - RNA, 24 nt, Homo sapiens
agagcugauguuuuaguuggaguc

SEQ ID NO: 166132 - RNA, 48 nt, Homo sapiens
ggaguaauaccaaguggaaagaaacuuguaagugaaacaguaaagaag

SEQ ID NO: 166133 - RNA, 47 nt, Homo sapiens
cuuuaaaaaaguuauuaguuugacuuaaaauaaauuuuaaagaagag

SEQ ID NO: 166134 - RNA, 49 nt, Homo sapiens
ccgagggcauggagaggauauuuuauuuuguuuagaugaguucauagga

SEQ ID NO: 166135 - RNA, 46 nt, Homo sapiens
ugauucagcaagccacaacaguuaaaaacaaggauaucaggaaauu

SEQ ID NO: 166136 - RNA, 46 nt, Homo sapiens
ccucuccccuuuuagguguugcuuguucaguaucucaagcccagaa

SEQ ID NO: 166137 - RNA, 59 nt, Homo sapiens
agguucuuuuggugcauggaguuuuacauggaauaaauuagugccucugcaauuuaaau

SEQ ID NO: 166138 - RNA, 48 nt, Homo sapiens
aaaauaggcaucugugggucuuuaagcgauagagcugagagcaaagac

SEQ ID NO: 166139 - RNA, 43 nt, Homo sapiens
aguguuuguguuucagaaugaagacuauucucagcaaucagac

SEQ ID NO: 166140 - RNA, 58 nt, Homo sapiens
cuccacuaaauaaacgucauaauuaacucuuucuuuagguauuugggagauauuuuug

SEQ ID NO: 166141 - RNA, 79 nt, Homo sapiens
cuucaagauuuuguaucuggugaucuugcagacaggagcaccugggaugaauauaaaggaaaccuaaaacgccagaaag

SEQ ID NO: 166142 - RNA, 30 nt, Homo sapiens
ucacauuuauauaagaaauacuucaauuua

SEQ ID NO: 166143 - RNA, 46 nt, Homo sapiens
auuuuaguuucuugcaauuauuuacuuuuucuaaaaccuacuuaaa

SEQ ID NO: 166144 - RNA, 46 nt, Homo sapiens
uagguugaagaauauauuacuccugaaaaauucaaauacugggaaa

SEQ ID NO: 166145 - RNA, 39 nt, Homo sapiens
ggauauuuagguuagaaaaauauugccauugagguuuga

SEQ ID NO: 166146 - RNA, 42 nt, Homo sapiens
uagguuuauuuagaucaucauuuuugguagcauugcccugag

SEQ ID NO: 166147 - RNA, 48 nt, Homo sapiens
gaacagaguucagaggcagcagaaacuggaguuagugaaaaugaagag

SEQ ID NO: 166148 - RNA, 63 nt, Homo sapiens
gaagcacuggcacugagacuggaagcaauauuaauguaaauucagagcugaacccuucaaccg

SEQ ID NO: 166149 - RNA, 42 nt, Homo sapiens
cagugccagugcuucuaacauaggguuuccuucccguugcug

SEQ ID NO: 166150 - RNA, 46 nt, Homo sapiens
uuuucagguuguguaaaaaauuucauugggaggacuggguccuuug

SEQ ID NO: 166151 - RNA, 46 nt, Homo sapiens
cguguauacagugcacagccuguuuugcuugguguggaguaccccu

SEQ ID NO: 166152 - RNA, 45 nt, Homo sapiens; identical to SEQ ID NO: 85280

SEQ ID NO: 166153 - RNA, 45 nt, Homo sapiens
uagcuucuucuggaucaugugaucuaaccuuuaaauauucuguaa

SEQ ID NO: 166154 - RNA, 47 nt, Homo sapiens
uuuuauaguuuuagguuuuuauauguaugucuauauucauucugagu

SEQ ID NO: 166155 - RNA, 41 nt, Homo sapiens
cgccaacccggcccugccagccccaggcucacggggcuccu

SEQ ID NO: 166156 - RNA, 47 nt, Homo sapiens
uuuaccuccuccucaugcgggcggaaggugcaucgagcgcccgggcc

SEQ ID NO: 166157 - RNA, 46 nt, Homo sapiens
gaacauuuuuccauguucauggguguuuaagucaguccaaguauug

SEQ ID NO: 166158 - RNA, 43 nt, Homo sapiens
gggcaucuuucagggccgaacggcugcaaagauucgggguugg

SEQ ID NO: 166159 - RNA, 42 nt, Homo sapiens
aggugcgaagccagggaaguuuguuuguuuuguuuggggguu

SEQ ID NO: 166160 - RNA, 52 nt, Homo sapiens
gggcuuggcggaguccuuucuggcacaagcgccuuuggguggauugaaacag

SEQ ID NO: 166161 - RNA, 116 nt, Homo sapiens
accuccccagaucccuucugauuuagguaccguccucugugcucccugugauuaaaucagccucuacacauauuacacaaucacuaugcucugauuuccguuuacuuguuucucuu

SEQ ID NO: 166162 - RNA, 42 nt, Homo sapiens
agucccgaggcguuccagaagcucagugcauucaggaauggg

SEQ ID NO: 166163 - RNA, 39 nt, Homo sapiens
gcagcaaaugcuaaucugauuauuaaagugauaugguaa

SEQ ID NO: 166164 - RNA, 45 nt, Homo sapiens
uugaucucugcauacucauuugccagagcaugaaacuugaccuag

SEQ ID NO: 166165 - RNA, 43 nt, Homo sapiens
aauguuagucauuauauacacuuguauauauacauuucuggaa

SEQ ID NO: 166166 - RNA, 45 nt, Homo sapiens
uguuuacccaucaaaucugacuuaaaagguuaaauggaagguuuu

SEQ ID NO: 166167 - RNA, 58 nt, Homo sapiens
gggggaggaguugugggggaauaaugugcauuucagucucaacgcauagauaaauuua

SEQ ID NO: 166168 - RNA, 63 nt, Homo sapiens
caucaacucuuauaaaauucaugcugaucuucauuaccguugcaugauuggaaauguuuaaaa

SEQ ID NO: 166169 - RNA, 64 nt, Homo sapiens
guauuuagguuuuuuuuuuuuuuuuuggaaugaaguucagagguagauccuccuggaagaaaga

SEQ ID NO: 166170 - RNA, 23 nt, Homo sapiens
gaacugagagauuuaguuuuuuu

SEQ ID NO: 166171 - RNA, 150 nt, Homo sapiens
ugauuaacauagguuauucugaccaccaccucuuccuuccuuaaucuccuuagaaucugacagucucaaagcugucacacaaauuagacuaauuuugacacuuugaaaugaaaacuucaaggaagaaguagccacggacaguuauguuua

SEQ ID NO: 166172 - RNA, 123 nt, Homo sapiens
uucaaaagaaguacccugucaauaugugcuuucuaggaaaacaguaaaauaggccacaauuuggagugacaccauucagaucaaggucuauccaguuuuuucuuuucaugcuaagugccuaca

SEQ ID NO: 166173 - RNA, 54 nt, Homo sapiens
auauugaaauuuguagauauuauaugaggaauggcaccuagauuugaaaauuau

SEQ ID NO: 166174 - RNA, 46 nt, Homo sapiens
cccauuuucuucuggggguucacaucuuuuggccucucuuucccug

SEQ ID NO: 166175 - RNA, 46 nt, Homo sapiens
aacuaggucucagugugagguagaaaggagguuguucucaggucuu

SEQ ID NO: 166176 - RNA, 48 nt, Homo sapiens
ggauuuuaacaaacaaguuggugacucaauuugauccagaguuuccag

SEQ ID NO: 166177 - RNA, 48 nt, Homo sapiens
auuacauaauuauauuaaguugauaaaugaaugaauaaaauauaccac

SEQ ID NO: 166178 - RNA, 32 nt, Homo sapiens
guauuccauuauccaaguaggcuaacaagguc

SEQ ID NO: 166179 - RNA, 50 nt, Homo sapiens
uaagguccagccuccagaaauccugucauaguaucauuuuuuuuuuccag

SEQ ID NO: 166180 - RNA, 45 nt, Homo sapiens
uucagauugacuuugaugugagucugguucacugacuugacaaca

SEQ ID NO: 166181 - RNA, 47 nt, Homo sapiens
ugguucaccuaaacauuacuuauuuucacaucuuaucaaggcugcca

SEQ ID NO: 166182 - RNA, 43 nt, Homo sapiens
aacacauuauaucacggauaaaaugguuucagaaaucagugga

SEQ ID NO: 166183 - RNA, 29 nt, Homo sapiens
uggaauuucucuaaauaggguugagggag

SEQ ID NO: 166184 - RNA, 47 nt, Homo sapiens
agcggggaaauggcagauggacugaaugcaaggaggauggcuacaag

SEQ ID NO: 166185 - RNA, 94 nt, Homo sapiens
gcagauagauguaucuuucauucugugugugugugguuuuuuaacuguaauaauaagaucuguauugaaugauguccugagagaggaaagagua

SEQ ID NO: 166186 - RNA, 57 nt, Homo sapiens
ugacuuauauaaagaaaugggggaaagucaagaaaauaaauguuucccaaucuguug

SEQ ID NO: 166187 - RNA, 47 nt, Homo sapiens
ugagcacugaauuucaaaagccgacugagauaaucuguugugaguga

SEQ ID NO: 166188 - RNA, 45 nt, Homo sapiens
gacuguuuccgcuuuccagcagcauccccggacuauuuuuguaug

SEQ ID NO: 166189 - RNA, 407 nt, Homo sapiens
uuuaaaaaucuaguuuuacaauaaaaucuaaauauauaaacuuuuaaaauaucuuaacgcaguagugucuuggguuuuuuguuguuguugagacagagucucgcucuguugcccaggcuggaguacaguggcuugaucuuggcuuacugcaaccuccaccucccagguucaagcgauccuccugccucagccuccugaguagcugugacuacaggcacuugccgccaugcccggcuaauuuuuguaucuuuaguggagaugggguuuugccacauuggccaggcuggucucgaacuccugaccucuggugauccaccugccuuggccucccaaagugcuaggauuacaggugugagccacugcacccggccuaauaguguuuuuaaaaaguaaaaauaaaagaagac

SEQ ID NO: 166190 - RNA, 56 nt, Homo sapiens
agcuuuauuaaagguaaaguugaaauagagauugcaguuugggcuugaagccagaa

SEQ ID NO: 166191 - RNA, 45 nt, Homo sapiens
uggcaucugggucuuacaacuacccuucuuuuguuccaggguuug

SEQ ID NO: 166192 - RNA, 32 nt, Homo sapiens
uucaugaaagaaucucauuuguugaucuaggu

SEQ ID NO: 166193 - RNA, 43 nt, Homo sapiens
aggcgacaauaguuuggaucucugaggauuggcaaaaacugga

SEQ ID NO: 166194 - RNA, 52 nt, Homo sapiens
aauugacccuauauuguuuuagaacaguuuuagauaaaccaaacuuuaagag

SEQ ID NO: 166195 - RNA, 51 nt, Homo sapiens
uaaagcacaaauauacuugaauauugcuuaaagaauugugugaauagcaac

SEQ ID NO: 166196 - RNA, 42 nt, Homo sapiens
auaaaaauuuaucaacauuccuuaacaggaaauuacaugguu

SEQ ID NO: 166197 - RNA, 46 nt, Homo sapiens
uuuaaaaacucugauaaacuucagcuucucuccacacucugcauuu

SEQ ID NO: 166198 - RNA, 47 nt, Homo sapiens
gacuaauaauagaaaauugcuuuuaugauccucuaacuauggaagac

SEQ ID NO: 166199 - RNA, 45 nt, Homo sapiens
agauguaaaagaaaauggugaaguaaaaccuuauucuauugaaau

SEQ ID NO: 166200 - RNA, 44 nt, Homo sapiens
ucaaaaaucauuugagcuuguguagguugcucacuuuucuaaaa

SEQ ID NO: 166201 - RNA, 50 nt, Homo sapiens
cuuacagcaagauuaagagaauagaugauauccucauuuaacacuugagg

SEQ ID NO: 166202 - RNA, 51 nt, Homo sapiens
acuguggcuaaguuagaggaagcaaggggaagagggauuuaaagaguuaag

SEQ ID NO: 166203 - RNA, 45 nt, Homo sapiens
cugauuucagagacaaaguuuuggagugguuauguuaacugcaua

SEQ ID NO: 166204 - RNA, 44 nt, Homo sapiens
ugcuuucaguaacuacacagauuaacuaucucaacaaggcacug

SEQ ID NO: 166205 - RNA, 61 nt, Homo sapiens
agaaaaaucuuugugaaaaaucugaacaaauuaucauaauggcucucuugaaauuuugcac

SEQ ID NO: 166206 - RNA, 41 nt, Homo sapiens
uuucucaauuugucacauuaucucauuuuaaauaaugcaag

SEQ ID NO: 166207 - RNA, 55 nt, Homo sapiens
uaauaaaaccagaaaaacugaacuaaaugcuauuuagccccgccaacaaagcuuu

SEQ ID NO: 166208 - RNA, 46 nt, Homo sapiens
cuggagauccuccaacucacgcauucuaaaguaaacuaaggaccag

SEQ ID NO: 166209 - RNA, 39 nt, Homo sapiens
cucagguguaacaggacuggaucauuguuauuaaacuaa

SEQ ID NO: 166210 - RNA, 58 nt, Homo sapiens
cccugucgcugcgagagcgagcgggcggcggaggcggcggcggcggcggggccgggau

SEQ ID NO: 166211 - RNA, 53 nt, Homo sapiens
augcuaguuucaauuaccacaguauucuagagacggguugcaaugacaagggg

SEQ ID NO: 166212 - RNA, 66 nt, Homo sapiens
agagauuaugaagucauuaauuuauacugaaauuggauugacuuacuaccuaacacugagcgcugu

SEQ ID NO: 166213 - RNA, 49 nt, Homo sapiens
cagaaucagggacagggcccccaaaggaguuugcuguaaaauaggcagu

SEQ ID NO: 166214 - RNA, 65 nt, Homo sapiens
uaauaauuuaucucugcuccuaauauuacuaucccauuguaauuauuuauaacccucaagccagu

SEQ ID NO: 166215 - RNA, 26 nt, Homo sapiens
accaugccucgaaaauaaguccagaa

SEQ ID NO: 166216 - RNA, 38 nt, Homo sapiens
cucagacaaccccuguggaaacacucauuaaaagaacc

SEQ ID NO: 166217 - RNA, 41 nt, Homo sapiens
gucagcaccacccgccuacccaguuccuccaguggagacca

SEQ ID NO: 166218 - RNA, 46 nt, Homo sapiens
gauuuaaauauaaaaguugaugggcgugcuauugugcguggaaaug

SEQ ID NO: 166219 - RNA, 51 nt, Homo sapiens
ugaggcaagaacugaaaacagagaagucauuugaaaaucuguauaagaagc

SEQ ID NO: 166220 - RNA, 46 nt, Homo sapiens
uuggaggcugccaacccacagggcucacauacacuuuucaaauaaa

SEQ ID NO: 166221 - RNA, 47 nt, Homo sapiens
cuaacaugagagauaauggcuuuugacgacaugcaacuuuuuacugg

SEQ ID NO: 166222 - RNA, 45 nt, Homo sapiens
agcuguaagaucaccaugaaauuaaauaauuuuagugccauggag

SEQ ID NO: 166223 - RNA, 36 nt, Homo sapiens
guuucaguaaacucgauaaggccaauuuuuccugua

SEQ ID NO: 166224 - RNA, 42 nt, Homo sapiens
uaggcccaugggacgugcaugugcacagugauuuggcaaagg

SEQ ID NO: 166225 - RNA, 46 nt, Homo sapiens
uaauggugauagaaaauuaaaacuuccaaaagaguaggccuauuga

SEQ ID NO: 166226 - RNA, 46 nt, Homo sapiens
gcgaugaugaugaagaugauguucaugucacuauaggagacauuaa

SEQ ID NO: 166227 - RNA, 69 nt, Homo sapiens
uaaauuucuguuauggacugaguacuccaugaauaguugaaaaaggauuuauuaacaauaucaaaugca

SEQ ID NO: 166228 - RNA, 45 nt, Homo sapiens
guugaguuauuggcaaaaagguuuuugaaauggaaacaagucagg

SEQ ID NO: 166229 - RNA, 46 nt, Homo sapiens
uuaggaguuaugguacagcaccuguaaaucuuaacaucaagacagg

SEQ ID NO: 166230 - RNA, 48 nt, Homo sapiens
acagggacaaaagucaaaggaguagaccuugaugcaccuggaagcauu

SEQ ID NO: 166231 - RNA, 66 nt, Homo sapiens
uaggugcugaucuuucugauuauuuuaauuauggguuuaaugaagauaccuggaaagcuuacugug

SEQ ID NO: 166232 - RNA, 62 nt, Homo sapiens
aaaaacaaaagaggauacgaaugggacuugaaguuauaccaguaaccucuacuacaaauaaa

SEQ ID NO: 166233 - RNA, 50 nt, Homo sapiens
guuuuaaagggucaucaguuuuuucuggguuauauugucuauauaggcau

SEQ ID NO: 166234 - RNA, 36 nt, Homo sapiens
agguagccguuaugaauguguauuuuauauacauac

SEQ ID NO: 166235 - RNA, 59 nt, Homo sapiens
gguauuuagaaaaggaacuggcagcaggaugggcuguagaaugaaaggggugugaaaca

SEQ ID NO: 166236 - RNA, 51 nt, Homo sapiens
uaggugcuuaucauacagcuucaacacuuaacaguguuuugacauucuuga

SEQ ID NO: 166237 - RNA, 28 nt, Homo sapiens
agacaaacaaauggauaaucaaguugac

SEQ ID NO: 166238 - RNA, 48 nt, Homo sapiens
uuuacuaaaaacagacuacagaguuacuuagggugggugaaaacaggg

SEQ ID NO: 166239 - RNA, 26 nt, Homo sapiens
gaauuagaaagagaaaauaugggcac

SEQ ID NO: 166240 - RNA, 42 nt, Homo sapiens
uuacagcauuuuguauauuuaugggaaugaguuauuaaagga

SEQ ID NO: 166241 - RNA, 25 nt, Homo sapiens
uucauaagaacaguaacgaaggcag

SEQ ID NO: 166242 - RNA, 88 nt, Homo sapiens
uuucccggcaaaauaauaugcacacuuaucuggugagagugaggcuguuggaaauaagaggccauuggaagguagcauugaguguuug

SEQ ID NO: 166243 - RNA, 54 nt, Homo sapiens
uuuuuuucaagaugagaggaauuacaguauuuuuauaugcugaugggaaugagu

SEQ ID NO: 166244 - RNA, 46 nt, Homo sapiens
uucccauaaaaguauuuuuuuuguuuuauucguuauauuuauggag

SEQ ID NO: 166245 - RNA, 39 nt, Homo sapiens
cuacugaccuaagcacuguauuuccauuguuuacaaucu

SEQ ID NO: 166246 - RNA, 50 nt, Homo sapiens
uccuguugcuuugaaagagcaucuuauuaguucuguaaaguauuggcaau

SEQ ID NO: 166247 - RNA, 81 nt, Homo sapiens
guccagugauuggcaagagaaaauaguagaaaaggaaauagagcgaaaauaaaaauuuugacaauggagggcagcaauuaa

SEQ ID NO: 166248 - RNA, 54 nt, Homo sapiens
augcacaccuguauuuaguaggauguuggaauaugaaauguuuguauaucagag

SEQ ID NO: 166249 - RNA, 31 nt, Homo sapiens
ucauucaugaucuuugggaucaugaggaaau

SEQ ID NO: 166250 - RNA, 44 nt, Homo sapiens
gcuugaacauuuuuaaauuguacuaaaguuauagagaagggaag

SEQ ID NO: 166251 - RNA, 46 nt, Homo sapiens
cuggggcaauugauguuaucggucagacuauaacuaucagccgagu

SEQ ID NO: 166252 - RNA, 46 nt, Homo sapiens
ccuccuccauuucuuccaccuccuccgacugucagcacugcuccac

SEQ ID NO: 166253 - RNA, 127 nt, Homo sapiens
aaggugccaguugugauccgaguacagaaccaaauccagggucugaauaguccuucccuaacauauucauccuuggccucuaaaugucagccacugcuucugucuuucaucuucagugccuuugauu

SEQ ID NO: 166254 - RNA, 53 nt, Homo sapiens
gacuuguggcuuuagagggucuguugucucaacaauaguggaaggaagagguu

SEQ ID NO: 166255 - RNA, 97 nt, Homo sapiens
aaaugaggacuucugugauuucuaugugaauccuuuguccucugaaaaagaauuagauaaauaaaagguagaaauaauuaauguuucaacauauuug

SEQ ID NO: 166256 - RNA, 46 nt, Homo sapiens
uaauauauucaucaccucacauacuuaacauuuuuuuguggagaga

SEQ ID NO: 166257 - RNA, 50 nt, Homo sapiens
ucugauugacucuuggaaauuuacagaggucuuauugcauaaguagauaa

SEQ ID NO: 166258 - RNA, 86 nt, Homo sapiens
ccuuaaacacacaccugcaaacguauaugaaacuuugcuaguaacacagagaggacaaaguauuucuggccauaauagauuuguau

SEQ ID NO: 166259 - RNA, 55 nt, Homo sapiens
gguuuuuacuguuugccuggcuuguguuaagaagucuguguuuagcugaagucag

SEQ ID NO: 166260 - RNA, 44 nt, Homo sapiens
gcccacuaaacuccuucccuccuaaggauagccccuguaaccuc

SEQ ID NO: 166261 - RNA, 35 nt, Homo sapiens
aacaaaauacuuuccuuauuuaagucuguugucua

SEQ ID NO: 166262 - RNA, 50 nt, Homo sapiens
uuuuugucuguccuaugauacugcuguaguaagauuaacauuaaaggcag

SEQ ID NO: 166263 - RNA, 36 nt, Homo sapiens
cuacauuuuguggaaguuuaacaacuuaaauguuuu

SEQ ID NO: 166264 - RNA, 57 nt, Homo sapiens
uagaaauagagauucugagaaaauucuuaccuauucaauuugugaagaaaacaguau

SEQ ID NO: 166265 - RNA, 45 nt, Homo sapiens
agguggcuguucuuagaguggugauuguuuauuguuguaauagua

SEQ ID NO: 166266 - RNA, 59 nt, Homo sapiens
uuauuucuuuuuauagugugauaucacaccugguagcaagugugucuuccugaguucag

SEQ ID NO: 166267 - RNA, 67 nt, Homo sapiens
aaauaggauuguggacuuuaggacuaaugugguaauugccaaauuuuguacuuuuaagauguuuaau

SEQ ID NO: 166268 - RNA, 46 nt, Homo sapiens
cuccaccaggcgcuccaccuccaucucuuauaccaacaauagaaag

SEQ ID NO: 166269 - RNA, 48 nt, Homo sapiens
uauuuguaccagacauaaaaauauaucuuuuucuucaacaguggacau

SEQ ID NO: 166270 - RNA, 45 nt, Homo sapiens
ccagaagagagaaagaccgagauagagagagagacagagacagag

SEQ ID NO: 166271 - RNA, 45 nt, Homo sapiens
agagagggagcgugaucacaguccuacaccaaguguuuucaacag

SEQ ID NO: 166272 - RNA, 47 nt, Homo sapiens
cagggaauaugcagaaagagguuaugagcgucacagagcaagucgag

SEQ ID NO: 166273 - RNA, 33 nt, Homo sapiens
agacacaaacacaaaaaaucuaaaagaagcaaa

SEQ ID NO: 166274 - RNA, 57 nt, Homo sapiens
aaauaggaggaaaaacaaacugcaggaaacuggauaggaaguuauaaaaggaauggg

SEQ ID NO: 166275 - RNA, 41 nt, Homo sapiens
auuuauauacauauaccaaguagacaaaaguaugccugaug

SEQ ID NO: 166276 - RNA, 92 nt, Homo sapiens
uagcuguggaacaggccgagaugcuuacagaggaaggauggaccucuguauaagcucuguagccuucucaguaaaaaguaaacagaaaaaaa

SEQ ID NO: 166277 - RNA, 39 nt, Homo sapiens
gcuaauuggagcuugcaccugcagaccccagccuuggag

SEQ ID NO: 166278 - RNA, 26 nt, Homo sapiens
aaaucugguuuccauggggguagaca

SEQ ID NO: 166279 - RNA, 55 nt, Homo sapiens
gcuggaaagcccggcccaaugccccucccccugcaucccuccucaguccgcgucc

SEQ ID NO: 166280 - RNA, 46 nt, Homo sapiens
ggcuaaggucuucaucugggccggcccggaccgcagccggggccca

SEQ ID NO: 166281 - RNA, 47 nt, Homo sapiens
uuuaaaaaugugcuuuggcuagcaggaaguagccuuuaggaacgcag

SEQ ID NO: 166282 - RNA, 47 nt, Homo sapiens
cgaugugggaugccaaaacuacauuuauaaguaaaacagaauccugu

SEQ ID NO: 166283 - RNA, 52 nt, Homo sapiens
aaauuuuagggaagucuucacagagaguagguaucugcugguucuccaaggu

SEQ ID NO: 166284 - RNA, 51 nt, Homo sapiens
aacuaacugccuaugaggagauucugauaugggagggaaucugggagauaa

SEQ ID NO: 166285 - RNA, 40 nt, Homo sapiens
gaaaauuaguuaauaaaugccaagaacagacaaggucuuc

SEQ ID NO: 166286 - RNA, 78 nt, Homo sapiens
cuguuaaauaccuuucuggaaaaacuggcuguaaaauaaacucaaccaggaaaaaaaaaaaaaaacaacaacccgauu

SEQ ID NO: 166287 - RNA, 62 nt, Homo sapiens
uuuaauagugucuauccaaccuuuuuuuuuuaaguugcaagggauccaccagauggaauuaa

SEQ ID NO: 166288 - RNA, 42 nt, Homo sapiens
gagaaaaagagaagaucaaaagcacuggaacucaacgaguaa

SEQ ID NO: 166289 - RNA, 38 nt, Homo sapiens
gucagagguguacaagaagugugaaucauuuaacaugu

SEQ ID NO: 166290 - RNA, 47 nt, Homo sapiens
gauccuugucuuuaaaacuagggguauggagggaaggguggguauaa

SEQ ID NO: 166291 - RNA, 122 nt, Homo sapiens
cagaauauguaauauaagaaacauaaguccuuugaguugagggagaucagauagauuuaauaaaagucauuuagacuuuauugcauauucuggaaguccaaagaagaaugacucugguugca

SEQ ID NO: 166292 - RNA, 44 nt, Homo sapiens
gguaaugauuuuguggcuuuauuagaagugcuaugcaaccagag

SEQ ID NO: 166293 - RNA, 38 nt, Homo sapiens
uuaaguugcagucccacuccacccaguccagccuccua

SEQ ID NO: 166294 - RNA, 35 nt, Homo sapiens
uagcuguauaaaggcuagaauuaggaggcuggacu

SEQ ID NO: 166295 - RNA, 77 nt, Homo sapiens
agauggagauuccgaugcagguaucuguaucaauuucaauacagucacauuuguguuuauuugaacucuagaacuag

SEQ ID NO: 166296 - RNA, 25 nt, Homo sapiens
agggagagaauaaaggcacugaggg

SEQ ID NO: 166297 - RNA, 23 nt, Homo sapiens
aaaggcaaggacugaagccagau

SEQ ID NO: 166298 - RNA, 59 nt, Homo sapiens
caugauggcugcuauaaaaaaugucuuaucacccaauucagauacaauaauaacugaua

SEQ ID NO: 166299 - RNA, 38 nt, Homo sapiens
uuuuauagaaauaauuuuaaguuuacaaagcagcaaaa

SEQ ID NO: 166300 - RNA, 42 nt, Homo sapiens
cuguauuauuugccauuuuuggcauuagaaugcuucgggaag

SEQ ID NO: 166301 - RNA, 49 nt, Homo sapiens
uggaccgggagauguugaaacggguacaagcauaacaguaccucagaaa

SEQ ID NO: 166302 - RNA, 45 nt, Homo sapiens
aauggggugaucgcucucaacuaacuacaauuguauuggcagcua

SEQ ID NO: 166303 - RNA, 58 nt, Homo sapiens
uuauuuuuuaauuuuucuuuugaugggaauagcaagguuuuauaugaggcgccuguca

SEQ ID NO: 166304 - RNA, 72 nt, Homo sapiens
uuccuuggaacuaucauaaaagaacaaguucuuuaauuauaggcugugguuuaaaauacaagacaguugaag

SEQ ID NO: 166305 - RNA, 72 nt, Homo sapiens
ccguggguggaacuguggggcacugccugugcacgggauuggcaguaauuggaggaagaaugauagcacaga

SEQ ID NO: 166306 - RNA, 53 nt, Homo sapiens
caaagucauuuuuaucgaauucauaguagcuucuuguuaacauauuaucuuag

SEQ ID NO: 166307 - RNA, 40 nt, Homo sapiens
guagcacugauuuugugaguuugacccauuauuaugucug

SEQ ID NO: 166308 - RNA, 48 nt, Homo sapiens
aaguuguuuauaauaccuagaaauuccaaaaaacguucaaugauaagg

SEQ ID NO: 166309 - RNA, 29 nt, Homo sapiens
aaacaaaugguguuagauuagaagacaua

SEQ ID NO: 166310 - RNA, 55 nt, Homo sapiens
uuaaugaaaauaaagaucaaauacaaauuaauaagacaaauguagagcagauaga

SEQ ID NO: 166311 - RNA, 58 nt, Homo sapiens
gaccugauuacauaaaaauuaaaauguuauguaagaauuaugaaauuaagcugggaaa

SEQ ID NO: 166312 - RNA, 93 nt, Homo sapiens
ccaaauuuaccacaaauaagugugcuacucagaguuuuggaauuaaagaauuuaggauuaucaucuugacaguagaaaaaaaugacgaagaua

SEQ ID NO: 166313 - RNA, 53 nt, Homo sapiens
uaaagaggucguuuuauaucuuuagggacugcuauuauccuaacaaguuggau

SEQ ID NO: 166314 - RNA, 35 nt, Homo sapiens
auguauauggcuaaugaauauauaaaggcuuugag

SEQ ID NO: 166315 - RNA, 44 nt, Homo sapiens
ugccuucccaauuucauuuuuauuuaauauauacuucaacaugc

SEQ ID NO: 166316 - RNA, 42 nt, Homo sapiens
ugaugcuaaaugauggaaaagagaaauaugaaaaagaaaaaa

SEQ ID NO: 166317 - RNA, 44 nt, Homo sapiens
gcuaaauguggcaagguuucucagucuuugcacuaugacauuuu

SEQ ID NO: 166318 - RNA, 48 nt, Homo sapiens
ccccuaacacuucuguauauacacaggguucugugcuacaaauugaug

SEQ ID NO: 166319 - RNA, 44 nt, Homo sapiens
aauaggccaucucuuaugaaccaggcaaaacugcugguugacua

SEQ ID NO: 166320 - RNA, 45 nt, Homo sapiens
cuuccuuugguauauagucucgcauauuauauuauagcaggccaa

SEQ ID NO: 166321 - RNA, 28 nt, Homo sapiens
ugugcaaugggauacuuauuaaauaauu

SEQ ID NO: 166322 - RNA, 54 nt, Homo sapiens
cccugucuaacuguagacaaaucuuuaaaaaaaaauaauaauaaucuggugccu

SEQ ID NO: 166323 - RNA, 130 nt, Homo sapiens
uacaacaauaugugguguucuuuuuuuuacacaagcauuggcuagccuuuuuaaccuggucagagaaggcagguggucacugacauuucccaaguccaugcuuuaaaggguuugcaagaaguuaggguua

SEQ ID NO: 166324 - RNA, 91 nt, Homo sapiens
uguaaaaugccaugcuuauguuuauaaguuuugagauuuuuuuuuuuucugaaaaggauaccaaagugcgauaacugaacauuuccaauug

SEQ ID NO: 166325 - RNA, 51 nt, Homo sapiens
augguagcugguaggguuggauguguguaguuucaagauagaaaguugguc

SEQ ID NO: 166326 - RNA, 46 nt, Homo sapiens
gccaauaaaccagaauuugaucaccuugcagaauaucuagguaagu

SEQ ID NO: 166327 - RNA, 51 nt, Homo sapiens
gguuuuuguuauaaccugguaaauuguauuuuucuuuuuaaaaugguaaga

SEQ ID NO: 166328 - RNA, 46 nt, Homo sapiens
gcaaaaaaauuuggaguauugucagacaacuuuaaaggcaaaagaa

SEQ ID NO: 166329 - RNA, 45 nt, Homo sapiens
ccccuccucaggaacaagaugacaccccagacuggguagccaggu

SEQ ID NO: 166330 - RNA, 45 nt, Homo sapiens
gacauccacagaaugccuuauuuucauuaugguuggcuacugggu

SEQ ID NO: 166331 - RNA, 42 nt, Homo sapiens
aacacuucaugggaagauagcuguggcacauaauggcgaauu

SEQ ID NO: 166332 - RNA, 42 nt, Homo sapiens
uguuccauaaaguuguuuucguauauuuuuuucugcccagac

SEQ ID NO: 166333 - RNA, 47 nt, Homo sapiens
ccugccuuccacuucuggguauguauucaacagaaaugcauacauau

SEQ ID NO: 166334 - RNA, 46 nt, Homo sapiens
aguuaaucuucauuuaguuuuguggagaacacaggauuugauuguc

SEQ ID NO: 166335 - RNA, 34 nt, Homo sapiens
cuauaguugcuuuucugugaaagaauuguaagau

SEQ ID NO: 166336 - RNA, 41 nt, Homo sapiens
caugugaucacucugggacucguggggcugcagcaccggug

SEQ ID NO: 166337 - RNA, 67 nt, Homo sapiens
uuucuuuuaauccaauccacuaacacuuuaguuauauucacugguuuuacacagagaaauacaaaau

SEQ ID NO: 166338 - RNA, 46 nt, Homo sapiens
augagugccaugcauccaauucccaaggacaggcuucagcaucagc

SEQ ID NO: 166339 - RNA, 47 nt, Homo sapiens
auucagacccgggguggcccagaaaagcaugaaguaacuggcugggu

SEQ ID NO: 166340 - RNA, 43 nt, Homo sapiens
ggaacaaggucuguggcacagacuuuaagagacauccuaggcu

SEQ ID NO: 166341 - RNA, 46 nt, Homo sapiens
guguauccuuuuugcuaugaaagugguaugacucucugguccuggg

SEQ ID NO: 166342 - RNA, 47 nt, Homo sapiens
gcacugcagaugacuugguugcuuucuggaguugccgagggugggua

SEQ ID NO: 166343 - RNA, 40 nt, Homo sapiens
auauucuagaaaaaaauggcaugugcaaaggcuaggggcu

SEQ ID NO: 166344 - RNA, 53 nt, Homo sapiens
augcagaccucucugacuugcugagauguauguauauucaaugacagcaugga

SEQ ID NO: 166345 - RNA, 46 nt, Homo sapiens
aauugggaaauucccuuuccuuugcauuucauuuucuauuacuuuc

SEQ ID NO: 166346 - RNA, 62 nt, Homo sapiens
cuuuuagcauuuuccuuuucauuggcuguuugguuugucuccugacauuuccuggaucggug

SEQ ID NO: 166347 - RNA, 34 nt, Homo sapiens
aaaccugcaguccauccugguggaagaaagaaga

SEQ ID NO: 166348 - RNA, 51 nt, Homo sapiens
aauguccaccuuccaggguguguugacgaguaaagaaaugaagguaugaag

SEQ ID NO: 166349 - RNA, 41 nt, Homo sapiens
uugaccucuguuuuaucccaaguuggauuaauggcaaaaug

SEQ ID NO: 166350 - RNA, 39 nt, Homo sapiens
uugaagauuccauuuaauaaaaagaaguugauacaaaga

SEQ ID NO: 166351 - RNA, 37 nt, Homo sapiens
gaagccuuucccacagcagaaacuuuccacagcagag

SEQ ID NO: 166352 - RNA, 46 nt, Homo sapiens; identical to SEQ ID NO: 85590

SEQ ID NO: 166353 - RNA, 42 nt, Homo sapiens
cgacgcgugcggcugcugcccuaugugcgcccgcggcgaggg

SEQ ID NO: 166354 - RNA, 44 nt, Homo sapiens
aaauaguggcugcauguugaacaauucagcaucauauacuucca

SEQ ID NO: 166355 - RNA, 45 nt, Homo sapiens
aauaaauguauaucuuuauuuuuuaaucuacuaugucacacucug

SEQ ID NO: 166356 - RNA, 43 nt, Homo sapiens
ugagaauuuaauaccacugggaagaaguaugguagugguggau

SEQ ID NO: 166357 - RNA, 63 nt, Homo sapiens
acuuugaacuggaaugcuauuuacaaaaguuuuguguauuaaucuguguauuaaucucucugg

SEQ ID NO: 166358 - RNA, 46 nt, Homo sapiens
uacugaaaagaaauauguggaucuuacugugucauuugcuccagac

SEQ ID NO: 166359 - RNA, 81 nt, Homo sapiens
gaauccagaucccagugagauuaaaagcuauuguuaugugucaaaagaagaacuaaaagaacuuggggaaaaaagcagcca

SEQ ID NO: 166360 - RNA, 58 nt, Homo sapiens
gugggcuucagcucggggaugucaaggucccgcagugagggauggaauuaccaccgga

SEQ ID NO: 166361 - RNA, 45 nt, Homo sapiens
cuuuaccugguuuacugaccauucugaugcaggugcugaugaguu

SEQ ID NO: 166362 - RNA, 45 nt, Homo sapiens
agaguugaagugacagaauuugaagauauuaaaucagguuacaga

SEQ ID NO: 166363 - RNA, 52 nt, Homo sapiens
gaaaguagaacagaaauauaacaaacuccgccaaccauuuuuucagaagagg

SEQ ID NO: 166364 - RNA, 52 nt, Homo sapiens
agcaagaagcgauugaacacauugaugaaguacaaaaugaaacagacagacu

SEQ ID NO: 166365 - RNA, 48 nt, Homo sapiens
aauguguucaaucgcuucuugcuguucuuuuucucccuucuucagcaa

SEQ ID NO: 166366 - RNA, 46 nt, Homo sapiens
gacuauuuugacaggccaagagcauacacaguauaaaaccacauag

SEQ ID NO: 166367 - RNA, 28 nt, Homo sapiens
aacagauuaaaaauaucuuugugagaua

SEQ ID NO: 166368 - RNA, 46 nt, Homo sapiens
uagguggaaaauuugcagccagaaauaaaaacuauugccaggcauc

SEQ ID NO: 166369 - RNA, 38 nt, Homo sapiens
uugcacaggaucacauggauaaguaugcauugugaauu

SEQ ID NO: 166370 - RNA, 84 nt, Homo sapiens
auucaaaugggauauuucaaaaauaguggcuuucuuguuuucagguugugagcauggggaaaaaaaaccggaaacaaaacagga

SEQ ID NO: 166371 - RNA, 49 nt, Homo sapiens
gucgcaguuacuugaccuuuuaaugcugaauccuuuuuucugaggaauc

SEQ ID NO: 166372 - RNA, 31 nt, Homo sapiens
gguagcagauaauaaaugaaagauuuuaagu

SEQ ID NO: 166373 - RNA, 46 nt, Homo sapiens
uugggagcaauuugucuacaucaguaggacauaguggcaucugguc

SEQ ID NO: 166374 - RNA, 46 nt, Homo sapiens
cuccugccccaucaucaguaccguuagggucagaaaagcccagcaa

SEQ ID NO: 166375 - RNA, 49 nt, Homo sapiens
cagacaacauuuuuccccgcuuaguuuguugacuccguguucaucagca

SEQ ID NO: 166376 - RNA, 66 nt, Homo sapiens
caauauggacucgccauaugguucuguaacaccuucuucaacacauuugggaaacuuugcuucaaa

SEQ ID NO: 166377 - RNA, 56 nt, Homo sapiens
caaauucagauccuuuacaucagucugauacuuccaaagcuccagguuuuagacca

SEQ ID NO: 166378 - RNA, 82 nt, Homo sapiens
aauucagauccuuuacaucagucugauacuuccaaagcuccagguuuuagaccaccauuacagagaccugcuccaagucccu

SEQ ID NO: 166379 - RNA, 64 nt, Homo sapiens
aucuguuguuucaucucagucaacaccagaaucuaugcuaucaggaaaauccucauauuugcca

SEQ ID NO: 166380 - RNA, 46 nt, Homo sapiens
aaaauggaaaccccugcuauuagaccacccccucauggcacaacug

SEQ ID NO: 166381 - RNA, 46 nt, Homo sapiens
acaacagucacaaccacggcaagcaacaacaacacugcacccacaa

SEQ ID NO: 166382 - RNA, 86 nt, Homo sapiens
aguucaucagcuucaacggugccugguacaucuacaaauggcaguccaaguucaccuucuguccgaaggcagcuuuuugucacagu

SEQ ID NO: 166383 - RNA, 41 nt, Homo sapiens
uuacuuuaaaguaaauucauguuccuuugaaaaagaguuuu

SEQ ID NO: 166384 - RNA, 46 nt, Homo sapiens
uggugcacacauagauauugauaaacagaaagacaagacuggagac

SEQ ID NO: 166385 - RNA, 67 nt, Homo sapiens
caaaugggaaguuaacaguagcaaguccuaagcgugggcaaaagagggaagaaggauggaaagaagu

SEQ ID NO: 166386 - RNA, 41 nt, Homo sapiens
acauuuccaaaggaagagagaaaaucuguuucuggcaaggc

SEQ ID NO: 166387 - RNA, 44 nt, Homo sapiens
uuuccagcugcagcgaugaaaguaguaacagcaacagcagucgu

SEQ ID NO: 166388 - RNA, 60 nt, Homo sapiens
guucucaugguaaaagaaauaauaccauaacuacaaccaguucaaagaggaaaaacagga

SEQ ID NO: 166389 - RNA, 94 nt, Homo sapiens
aaggaagaacaaagaaggaaacuagaagaaauugaagccaaaaauaaagagaacuuugaacuccaagcugcucaagaaaaagaaaagcuuaaag

SEQ ID NO: 166390 - RNA, 58 nt, Homo sapiens
ucggaggcuggcuuuggcugcgaaaagagaaaaaagaaaagagaagagaaggaagaaa

SEQ ID NO: 166391 - RNA, 58 nt, Homo sapiens
gccaaagauagacaggcugcugaagcaaacaaaaacgccagcauuuuguuagaggagu

SEQ ID NO: 166392 - RNA, 46 nt, Homo sapiens
gguggugcgcuacuuagucaaagaagucaaucaguuuccaucagau

SEQ ID NO: 166393 - RNA, 42 nt, Homo sapiens
aucggaacacugcccuuacuuuagccugcuuccaaggaagaa

SEQ ID NO: 166394 - RNA, 67 nt, Homo sapiens
gcugguggccacgaggaacugguacaaacacugcuagagagaggagcuaguauagagcaccgagaca

SEQ ID NO: 166395 - RNA, 93 nt, Homo sapiens
acccacaguauugcugcauccauuucccaaccucagacuccaacuccaaguccuaucaucucuccuucagccaugcuuccuaucuacccugcc

SEQ ID NO: 166396 - RNA, 103 nt, Homo sapiens
agggcuggggcaaggaauucugacagaaacacaacaaggguuaaugguagccagcccugcucagacccucaaugacacgcuggaugacaucauggcagguggg

SEQ ID NO: 166397 - RNA, 69 nt, Homo sapiens
uugccucuggcggcaggucccuugccuccaggguccaucgcaaaucuuacagaacugcaaggagugaua

SEQ ID NO: 166398 - RNA, 69 nt, Homo sapiens
agagcagcuuucugagggagacuaugcacgguuacagcaaguggauccuguuuuacuuaaagaugaacc

SEQ ID NO: 166399 - RNA, 46 nt, Homo sapiens
cucaaagaauucaacuucagcaacagcagcaacagucuugccaaca

SEQ ID NO: 166400 - RNA, 45 nt, Homo sapiens
guccuuggaacuggcucaugcugaccaacuuaccaaggagaagau

SEQ ID NO: 166401 - RNA, 82 nt, Homo sapiens; identical to SEQ ID NO: 85669

SEQ ID NO: 166402 - RNA, 44 nt, Homo sapiens
cucaccguuugaaaguauguaacucaaauguuugugcagaauug

SEQ ID NO: 166403 - RNA, 45 nt, Homo sapiens
gggcauguggaacuugcggcuuuacuuauugaaagaggagcuagc

SEQ ID NO: 166404 - RNA, 38 nt, Homo sapiens
aauccauguuuccaguuuuuuaggagaggaaugggaag

SEQ ID NO: 166405 - RNA, 45 nt, Homo sapiens
ggagauguaaaugcugugcgaaaguuacucauugaagggcgaagu

SEQ ID NO: 166406 - RNA, 46 nt, Homo sapiens
cacuuacccguaugagagcugaaagcacagcaaaugcagggcaguc

SEQ ID NO: 166407 - RNA, 65 nt, Homo sapiens
caggauaaccucgcugucuuuaggucaacaaugcuauauaacguaacuuaauuuugggaguaaaa

SEQ ID NO: 166408 - RNA, 41 nt, Homo sapiens
ggguuuauauaaaguccuugggaguucaguacuucauugag

SEQ ID NO: 166409 - RNA, 91 nt, Homo sapiens
aaucauugacacuuacuaaaagaaaaauuuagaaaaaauauaaaaucuuuuuggagggauuuuucugcauugacuggauuuauuaagagau

SEQ ID NO: 166410 - RNA, 55 nt, Homo sapiens
ugugcuuugaauaucagugaauauguuuuauauguaugaguuauauaauucaucc

SEQ ID NO: 166411 - RNA, 41 nt, Homo sapiens
uauucagucacugucauaaaaugaucauaaacucaaguuuc

SEQ ID NO: 166412 - RNA, 35 nt, Homo sapiens
ccaggcuuacuugagagccagaaauuauuauaauu

SEQ ID NO: 166413 - RNA, 47 nt, Homo sapiens
cuuguaguugucuuuuauacuacuacuaaauuuaauuugcuauuggg

SEQ ID NO: 166414 - RNA, 39 nt, Homo sapiens
gaaauaaagaggauggugugguagaaagauaaggagaga

SEQ ID NO: 166415 - RNA, 46 nt, Homo sapiens
caccagugugugacauaguuccugacacaaugcaauaaccaaacag

SEQ ID NO: 166416 - RNA, 57 nt, Homo sapiens
uuguugugaauuacauuuuuuucuuccauuuuacauuuuauuuucucauggguuauu

SEQ ID NO: 166417 - RNA, 45 nt, Homo sapiens
gaggcaacaacauuggcccuuuacugguucugaauugugagaggc

SEQ ID NO: 166418 - RNA, 55 nt, Homo sapiens
uaguauaacuagaaguaugugaaucaauguauuacucuuauaugaaaguaaaggc

SEQ ID NO: 166419 - RNA, 54 nt, Homo sapiens
guccagcuaauuuugucucacagagguggaagugcagaaguagaagaagaugaa

SEQ ID NO: 166420 - RNA, 43 nt, Homo sapiens
auugccaagauuguggacuaaugguaaauagugaauucuaggu

SEQ ID NO: 166421 - RNA, 42 nt, Homo sapiens
uggguugaggauuugacugaacccuuuagguuggaacugaau

SEQ ID NO: 166422 - RNA, 35 nt, Homo sapiens
aagaggaaaaaugucuuccaauuuuauaucccaaa

SEQ ID NO: 166423 - RNA, 37 nt, Homo sapiens
uacuuagaaauaguaguauaaacuuucaucaaaggag

SEQ ID NO: 166424 - RNA, 66 nt, Homo sapiens
uucaggaagauuauuuuacuguggggagagggcuugggagaagaagcugcaaagggaagcuaggcg

SEQ ID NO: 166425 - RNA, 96 nt, Homo sapiens
auaaaaccuggguaauucagauaaagaggcuuuaugguggugagugguauuccuaauacuuagacuguugagauaauuuauuaacuauuucacauc

SEQ ID NO: 166426 - RNA, 46 nt, Homo sapiens
aaaagccaguuuguaguuucuguuuaagccaggucucaacaaugua

SEQ ID NO: 166427 - RNA, 43 nt, Homo sapiens
guagaaaagagaaaaagagagauacuauaaaguaaugauuaaa

SEQ ID NO: 166428 - RNA, 69 nt, Homo sapiens
gagaggagguguaacuuugauuugugauucuugaaaaguagaaaugaugaacuaagaauaaaucuggau

SEQ ID NO: 166429 - RNA, 49 nt, Homo sapiens
gggggaauuuguauuuuaucagaaggagauuuuuuuuuaaaggguagau

SEQ ID NO: 166430 - RNA, 48 nt, Homo sapiens
agcaguauuuuauuuagugagaauauacccaaauauuucccaaacaau

SEQ ID NO: 166431 - RNA, 27 nt, Homo sapiens
gaaucuaugccaagaaacugagauaga

SEQ ID NO: 166432 - RNA, 47 nt, Homo sapiens
uuaagcaaaaaaaaaaucuuuaauuauuugaauauuacaaaguagua

SEQ ID NO: 166433 - RNA, 37 nt, Homo sapiens
ugugugugguguguauuucuuucuguugguagauauu

SEQ ID NO: 166434 - RNA, 121 nt, Homo sapiens
acuuggguaguuuuuacuuccugauuauuuuccaugcccuugaugcuaucuugaguuacuuggaacuguuucuucauucccccagagugguagaaaccggugacucaagaaaauugucuuu

SEQ ID NO: 166435 - RNA, 48 nt, Homo sapiens
cuugcuuuugaauccugcuuuaacacugugugauuuggggacaguuac

SEQ ID NO: 166436 - RNA, 13 nt, Homo sapiens
agagagcaaguag

SEQ ID NO: 166437 - RNA, 71 nt, Homo sapiens
auauaucuuaaucaaauacgaaggucuuccugaccucacuaccauaagcagaaguuuuucugaaaacuuug

SEQ ID NO: 166438 - RNA, 52 nt, Homo sapiens
gugaccuauaaggauuuucauaaauuaauuguuaaaacugaaguaugaauaa

SEQ ID NO: 166439 - RNA, 75 nt, Homo sapiens
aagugcucaaaaugugaagugggaagaaugcuguuuuagacccuccuauaccucuuaauucaugcuguuagguaa

SEQ ID NO: 166440 - RNA, 49 nt, Homo sapiens
ucccuaacuccugucuugggaacauucauggauuaaucuugggauggau

SEQ ID NO: 166441 - RNA, 161 nt, Homo sapiens
ugaauaccgucuuacucaaauuuauguauagugaccuauccccaaguaggauaaccagagagaaaugauggaguaaggaggguuauggaagaccuccuuacuccaaaacacuuuaccugaauguagcuaguuaauacugcucuguuuuauuucaucuuguu

SEQ ID NO: 166442 - RNA, 46 nt, Homo sapiens
ucuggccaccuaccauuugugcaaaccuuucuuccaacaccuaauu

SEQ ID NO: 166443 - RNA, 43 nt, Homo sapiens
auagcaguugacugauucuugcuucuuaaaauguaauccucuc

SEQ ID NO: 166444 - RNA, 21 nt, Homo sapiens
gcauucauuuuacagguaaac

SEQ ID NO: 166445 - RNA, 49 nt, Homo sapiens
uacaccaaugaauaaauauuauaaguuuggggaggugugagagugagcu

SEQ ID NO: 166446 - RNA, 66 nt, Homo sapiens
aauuucuuaauuccuuuucguagugaugaugaucuucucuaaguauuaaggggagagccaguuaaa

SEQ ID NO: 166447 - RNA, 36 nt, Homo sapiens
acauuuuuagugaauaacuaguacuuagggaggauu

SEQ ID NO: 166448 - RNA, 72 nt, Homo sapiens
ugaugcucuuucaaauuaguggacaaaauuaauuaaauugcuuuugacuauuacaagaaaaaaaucuuauaa

SEQ ID NO: 166449 - RNA, 45 nt, Homo sapiens
ucuguaucugccaaaagaggaaaaauggaaggaaacgagaaucaa

SEQ ID NO: 166450 - RNA, 69 nt, Homo sapiens
uuuaaacuuaguucuaagaggagaccaagugauucaucuaaaaguaccacuuacuauuuauucucuucc

SEQ ID NO: 166451 - RNA, 46 nt, Homo sapiens
auaacuuuauaauuuuuccuggguccacagacaggcggcguugcag

SEQ ID NO: 166452 - RNA, 46 nt, Homo sapiens
gggaccaacuaggagguugaucaacuucucccaguugugaggugga

SEQ ID NO: 166453 - RNA, 42 nt, Homo sapiens
agguggcggcggcggcaccagcaguaacaacagcgaggaaga

SEQ ID NO: 166454 - RNA, 49 nt, Homo sapiens
aguugaguauugaucagaacaugcaugugaagaaacuacccagaacugg

SEQ ID NO: 166455 - RNA, 45 nt, Homo sapiens
uugucuggacccggaagccccuuuucuaaagaaagucauccagaa

SEQ ID NO: 166456 - RNA, 47 nt, Homo sapiens
aguauuuccacuauuuacuguuauuuuaccugauaaguuauugaacc

SEQ ID NO: 166457 - RNA, 19 nt, Homo sapiens
uuuaguucuguuucuuggg

SEQ ID NO: 166458 - RNA, 36 nt, Homo sapiens
uuuuucacuauaggaugacuauaauucuggucacua

SEQ ID NO: 166459 - RNA, 48 nt, Homo sapiens
guuuugaccauuuuguuaugaggaauuauacauguaucacauucacua

SEQ ID NO: 166460 - RNA, 46 nt, Homo sapiens
ccagugcuugcagacccugcagggaauucaccccaagaacauccaa

SEQ ID NO: 166461 - RNA, 41 nt, Homo sapiens
cucaauccugcaucccccauaguuaagaaaaucaucgaaaa

SEQ ID NO: 166462 - RNA, 24 nt, Homo sapiens
cauauuuaauuugaagauagaagg

SEQ ID NO: 166463 - RNA, 63 nt, Homo sapiens
aauauuucuucgugaugacauaucacaugucagccacugugauagaggcugaggaauccaaga

SEQ ID NO: 166464 - RNA, 45 nt, Homo sapiens
ugacauauaccguuuccgaauucugccguguguauccccaacccu

SEQ ID NO: 166465 - RNA, 48 nt, Homo sapiens
ugcuggagguggaagugauagagggcacccugcagugcccggaaucug

SEQ ID NO: 166466 - RNA, 46 nt, Homo sapiens
cugaaagaaaccuuugggaauggauaucagaagauuuggccuuaau

SEQ ID NO: 166467 - RNA, 45 nt, Homo sapiens
cuggggacuuccagcuacacacuaaugucaaugaugggacagaau

SEQ ID NO: 166468 - RNA, 46 nt, Homo sapiens
agaccaaauacaaguggugugaguauggucugacuuucacagaaaa

SEQ ID NO: 166469 - RNA, 40 nt, Homo sapiens
ccagggaacccccgagcacagcgucagccaaucacgcauc

SEQ ID NO: 166470 - RNA, 45 nt, Homo sapiens
cuggaagucuuccugaguuaaaacucggcuagugcugauggcugc

SEQ ID NO: 166471 - RNA, 42 nt, Homo sapiens
caucagcauccuccuccucacugagacugguacuuucccauc

SEQ ID NO: 166472 - RNA, 44 nt, Homo sapiens
cuccauauucuuguacucuugcuucuauggaggccucuguaggc

SEQ ID NO: 166473 - RNA, 42 nt, Homo sapiens
aaauucuggcccauagaguacaaugagguaaaaaggagucac

SEQ ID NO: 166474 - RNA, 45 nt, Homo sapiens
acucuuauccuuguguguuuuauacugagccaggucuuggagaag

SEQ ID NO: 166475 - RNA, 45 nt, Homo sapiens
uugguggggcugcagaaaccuuugcaaaaagggauagaaauugaa

SEQ ID NO: 166476 - RNA, 42 nt, Homo sapiens
uucggagucacuguccuguuuuucaucuucaucuuucccaag

SEQ ID NO: 166477 - RNA, 36 nt, Homo sapiens
ucuuucucuccuauaauucagaugcauacauuuagg

SEQ ID NO: 166478 - RNA, 42 nt, Homo sapiens
ggccggcgggucucgcuugauuagauucuguaacugcggcag

SEQ ID NO: 166479 - RNA, 48 nt, Homo sapiens
gcaguuuuaaaaaaacucagacggccggcaccccgcaaucccugccag

SEQ ID NO: 166480 - RNA, 100 nt, Homo sapiens
ccaacucaccaaaauguaaaaaaacuaacaaaaauauuuggucuucaauaaugcuaaauaucuacauuuuuagaauuuaucaacauuuaacuagauaauu

SEQ ID NO: 166481 - RNA, 46 nt, Homo sapiens
ugcccuauacuuccugugacaaucauuuugcugacagaaugaugga

SEQ ID NO: 166482 - RNA, 77 nt, Homo sapiens
cugaucuucaguucauaauucuuccaggaaaacucagucuuccaacugcaauaaaauacuggguagaaucaaauggg

SEQ ID NO: 166483 - RNA, 45 nt, Homo sapiens
cauucuggccagagguuaaagagcaggcugacauggcuggccauu

SEQ ID NO: 166484 - RNA, 38 nt, Homo sapiens
cauucgaaccuaaacauugccuuugcuuggugaagaaa

SEQ ID NO: 166485 - RNA, 28 nt, Homo sapiens
gaaucuucaagaacaagcagcagcccaa

SEQ ID NO: 166486 - RNA, 45 nt, Homo sapiens
caucauggcgcuggguguguucuuugguuugguuuuuaccuggcu

SEQ ID NO: 166487 - RNA, 45 nt, Homo sapiens
auccuaaaagcagccaagagguuccaaaucaacauuuaugucaaa

SEQ ID NO: 166488 - RNA, 52 nt, Homo sapiens
ccaagcagaugagagguuuguuucugccauagaaggcaugcacccaaaucag

SEQ ID NO: 166489 - RNA, 46 nt, Homo sapiens
cagacaaugccggcuucuguauaccugagggaaacugccugggcuc

SEQ ID NO: 166490 - RNA, 45 nt, Homo sapiens
aagaugagguccuuuaugucuucccaucugacuuuugcagguaaa

SEQ ID NO: 166491 - RNA, 44 nt, Homo sapiens
gacugguggauaacagacaagugcaauaugauuaauggaacaga

SEQ ID NO: 166492 - RNA, 44 nt, Homo sapiens
cuacuuuuucucccccuugaucuaauuaaaacuguugugucugu

SEQ ID NO: 166493 - RNA, 45 nt, Homo sapiens
aacuggagaagacaguuaccuuaacuuuacaaaaauuguggaaug

SEQ ID NO: 166494 - RNA, 57 nt, Homo sapiens
caaguuuuaaaaaauuauaugugugagagacaggaguccuaaaaguagggccucacc

SEQ ID NO: 166495 - RNA, 29 nt, Homo sapiens
ugaaggcuauaaaguagguuaacagaauc

SEQ ID NO: 166496 - RNA, 24 nt, Homo sapiens
aggcauuugacuccugggagaagc

SEQ ID NO: 166497 - RNA, 51 nt, Homo sapiens
uuugccacuacugaggaagcaaagauuucugaaaaccuuaaacaccaauau

SEQ ID NO: 166498 - RNA, 43 nt, Homo sapiens
cucuccagucaguaaagcuauuuuauuccagguggcaauggau

SEQ ID NO: 166499 - RNA, 43 nt, Homo sapiens
ugucugcuugcuguagccuuugaaguggugugcgccuggggau

SEQ ID NO: 166500 - RNA, 45 nt, Homo sapiens
ucacgcugcugguggcccgggucuuccagaaggcuguagaccaga

SEQ ID NO: 166501 - RNA, 58 nt, Homo sapiens
cggccccauccgcccggugcacccggggccgcgcucgccaggccgcggagcccagagc

SEQ ID NO: 166502 - RNA, 61 nt, Homo sapiens
aaagaugccugccuugccuaaaggaaaauauucaucguagcucuaagauauucccuccaaa

SEQ ID NO: 166503 - RNA, 46 nt, Homo sapiens
gggaccgagacacaggcaacagcaucaccauugaccaccugcggcg

SEQ ID NO: 166504 - RNA, 45 nt, Homo sapiens
aucauaaaaaauuguauuguuauaaaauguuuuuguuauaaugaa

SEQ ID NO: 166505 - RNA, 80 nt, Homo sapiens
ucaguuauagauguggguccuuuacagcagugucuuccaaaguaagaaauauaguucaucuuaugauccaacacacaugc

SEQ ID NO: 166506 - RNA, 46 nt, Homo sapiens
ugaaucacagaacaaaauagaacuacuucugcaacaacaccaagau

SEQ ID NO: 166507 - RNA, 45 nt, Homo sapiens
auauuuaauauggaaucaaaagcuugggaaucaaauaaugaagau

SEQ ID NO: 166508 - RNA, 50 nt, Homo sapiens
aggaaccaaaagaaccaaagagggaaccauucauacuucaagaucucuaa

SEQ ID NO: 166509 - RNA, 48 nt, Homo sapiens
agagguccaccuuaaguaguagccauacaaaaagaaaucaaggugagg

SEQ ID NO: 166510 - RNA, 46 nt, Homo sapiens
gacugguucuagaagaauguagaucaguucuguaagauccccaguc

SEQ ID NO: 166511 - RNA, 45 nt, Homo sapiens
aucucccucguauagucauagagagguuaaauauuguucucaagg

SEQ ID NO: 166512 - RNA, 41 nt, Homo sapiens
gcuguccaauuaucugguaccuuguauguguugaggcaguu

SEQ ID NO: 166513 - RNA, 49 nt, Homo sapiens
uugcucuuuauuaugggaaaaugaguuaguuuacauacacugcuuaagu

SEQ ID NO: 166514 - RNA, 41 nt, Homo sapiens
agguguugguugcagguacaagcggggcgcggcccgggaga

SEQ ID NO: 166515 - RNA, 42 nt, Homo sapiens
accccugccuccagcucggagugacaguuacgcagcauuucg

SEQ ID NO: 166516 - RNA, 46 nt, Homo sapiens
cagcugcauacugugcuggagaagaguccagagaacagccccccag

SEQ ID NO: 166517 - RNA, 45 nt, Homo sapiens
gagggcgauuuccaggaagaccacaaugccaaccucuggaggagg

SEQ ID NO: 166518 - RNA, 49 nt, Homo sapiens
gugggcuaggggcuuggucaccccgucugaauuccacugucaggacagc

SEQ ID NO: 166519 - RNA, 56 nt, Homo sapiens
uguaguaugucaguugcacuuuuuuucugccauaauguaacguagcuugccccguc

SEQ ID NO: 166520 - RNA, 57 nt, Homo sapiens
auucagcguuauuuaagcacauaaagaccaaaaaaaaaaaaaagaaauccaaaagau

SEQ ID NO: 166521 - RNA, 46 nt, Homo sapiens
aggaaaggcuguagaaggaaauauaccuuaacaggcugauuuggag

SEQ ID NO: 166522 - RNA, 26 nt, Homo sapiens
aagcaaaggaacuuguuucuucaaac

SEQ ID NO: 166523 - RNA, 48 nt, Homo sapiens
uuuuccucuuuaaguuuuugucaaccucacugucagaaucacugccag

SEQ ID NO: 166524 - RNA, 36 nt, Homo sapiens
cagaggagcagcagcagagaugguaacauguuucag

SEQ ID NO: 166525 - RNA, 44 nt, Homo sapiens
caaucucugguuuuccaaaggcccuggaaacuucaugauauccu

SEQ ID NO: 166526 - RNA, 45 nt, Homo sapiens
aguacuaauuaagcaacucauaaaacaaaauaagaaugcuaugag

SEQ ID NO: 166527 - RNA, 44 nt, Homo sapiens
uacuguacagcauaacuauuacagauauacauacagggcccccu

SEQ ID NO: 166528 - RNA, 82 nt, Homo sapiens; identical to SEQ ID NO: 85881

SEQ ID NO: 166529 - RNA, 45 nt, Homo sapiens
cggccgcugggucggucagcgaauuaguuccaugaugacccccgg

SEQ ID NO: 166530 - RNA, 42 nt, Homo sapiens
cgaggggaaauggugaaagggggggaggggagaaaagaaaag

SEQ ID NO: 166531 - RNA, 52 nt, Homo sapiens
ggauggaaggagggaggacguuuucucguggcuaagaaaagccgaagguccg

SEQ ID NO: 166532 - RNA, 45 nt, Homo sapiens
acucguccccaggcucuuagaaggauucacugggaaggggcuacu

SEQ ID NO: 166533 - RNA, 39 nt, Homo sapiens
gauuuguugaccuagcaaaguauuacguguucuuaccgu

SEQ ID NO: 166534 - RNA, 64 nt, Homo sapiens
agccccagccccggggggagcuggcgcccgcgauggacagauagaugcucgugggguggaagga

SEQ ID NO: 166535 - RNA, 42 nt, Homo sapiens
auggaaaaaauaauuucagaaaaauugcacuaugaauuggaa

SEQ ID NO: 166536 - RNA, 46 nt, Homo sapiens
auaugaguuguggagaggagagucucagcagcucuccucccaguga

SEQ ID NO: 166537 - RNA, 55 nt, Homo sapiens
ggagggaaggugcugauaccuucaauuuguuacuuuucaagauuuuuaaaaauaa

SEQ ID NO: 166538 - RNA, 48 nt, Homo sapiens
aaugguuuaucauagauuucacccuccccccuucucagaagagugagu

SEQ ID NO: 166539 - RNA, 25 nt, Homo sapiens
gcaagcuaagccuggagcuguaucc

SEQ ID NO: 166540 - RNA, 26 nt, Homo sapiens
cuguagguguuuuaaccauuuaacac

SEQ ID NO: 166541 - RNA, 59 nt, Homo sapiens
caucgauuaauuuauaucuucuguugugauuuuuuucaacuauauaacaagugccaacu

SEQ ID NO: 166542 - RNA, 44 nt, Homo sapiens
cccuuaccugugaaauuccugagcggugcucugccaacuuuuca

SEQ ID NO: 166543 - RNA, 61 nt, Homo sapiens
aggguaaaaaagaagcagcccauauaucuaaacuacaggaugucuugaacaagauucacag

SEQ ID NO: 166544 - RNA, 46 nt, Homo sapiens
gaaaugcugcuuuccucagcauugucuuguuaaaccgcaugccauu

SEQ ID NO: 166545 - RNA, 45 nt, Homo sapiens; identical to SEQ ID NO: 85903

SEQ ID NO: 166546 - RNA, 47 nt, Homo sapiens
aucuuugauaugaaauuuuggacuuuuuacuuuucuuagccccuccg

SEQ ID NO: 166547 - RNA, 46 nt, Homo sapiens
cagauggauccgaagcuaugcugaacagagugaugacaaaagauaa

SEQ ID NO: 166548 - RNA, 38 nt, Homo sapiens
guuuaguaaaggcuaggacacaaguuaccaauauucag

SEQ ID NO: 166549 - RNA, 43 nt, Homo sapiens
uuagcuauauaauguugaaagacuuagcauuucuggaccuguu

SEQ ID NO: 166550 - RNA, 26 nt, Homo sapiens
cuuuauucuuucuucagacuggaaau

SEQ ID NO: 166551 - RNA, 47 nt, Homo sapiens
uugcccauccugggcauuaaacugggaauacaggaaaaagggaauua

SEQ ID NO: 166552 - RNA, 42 nt, Homo sapiens
cucaaauugaaauuuagcucccaguguacaaaauggucacca

SEQ ID NO: 166553 - RNA, 46 nt, Homo sapiens; identical to SEQ ID NO: 85913

SEQ ID NO: 166554 - RNA, 24 nt, Homo sapiens
uuaagccaagaaugaugaaaagga

SEQ ID NO: 166555 - RNA, 45 nt, Homo sapiens
ugugcaauuuguuuucagaaaauuauaucaaacuguauuccuuga

SEQ ID NO: 166556 - RNA, 52 nt, Homo sapiens
auugcuggaucaaaguaauuacacauuuaauauuugauacaucuugucagau

SEQ ID NO: 166557 - RNA, 25 nt, Homo sapiens
gccagaggaagagaaugagguagag

SEQ ID NO: 166558 - RNA, 46 nt, Homo sapiens
uuggauaauucugcuuuguuuguuuuuaacuacccaacugcuaaga

SEQ ID NO: 166559 - RNA, 47 nt, Homo sapiens
gauacaguaagugggacugauauuuguaaaauguagaaaagugugcu

SEQ ID NO: 166560 - RNA, 39 nt, Homo sapiens
ccacaagcacaaugaaaucagcagaaaucuucaagaagc

SEQ ID NO: 166561 - RNA, 45 nt, Homo sapiens
uaccgccgucuuggagauggcugcggccacuccaccugccaggaa

SEQ ID NO: 166562 - RNA, 1079 nt, Homo sapiens
gcuuaucugcagugaucugcuugcuggcaugcugcaccuaacagacaggaaggaagccaacagggacaguuauaaccauggggaagggaaagagaagagcuuaugccaucucgaucaaugcccuuuaagguaggcuccccucucucaaaucuagucuucguauaucauacuggcuggacccucccaacccucugaggcugucacaggggaagaggugaucugcaccaguagcauuaagccuccaccccucugaguggagagggggcauccuccagcggacccgugaccuucagaccuaggagaaaggucauuaccucaaacccagguucagaggcauuagggcgagucccacauagggcgcggucaccuuggggaccgcagccuacgccucaagucuccugagcugcuuccgucucgcuccgcccccacuccgcucccagaggugacccgagcgccgccgccgccagcccuacacgcuagcccaggagcgcccucuagagccggcacuggagagcgcgcggcgcagggaggcaggcggagacgcggcggcagcggccgcggcugcgcgggggcggacguaaaaggcacacgcgcuucccggcgccggcuuccggcccggcgagguuugagcgcguccgcgggcugggaggccgcuggacccgggcgcauggccucccccgggcaguuaucuccuugccgcgaccuugaggucuucgguaagaacuggcguuccucuuucuaacgccggcuuucggccuucgcccuugacgcccaggcccggggaggccgucacucagaaacugcuccauccgaguccgccgccucggagaugccgagagccugguccugcccucugcccccggccccuuccuagacucacuacuucaggucacuaaaggcgccucccaccaguuugacuucuguucugccucugcgccccgcucuggccucuccuaagccgcuucccuggccaugucuuuagaguucgcuccccgccaccccucgggcgcccgccuucugugcgacccuuccccccacuuccugguugggcuccuggaucccaggacguaccugcagca

SEQ ID NO: 166563 - RNA, 42 nt, Homo sapiens
ggcaccacccgaugccagauucccugcaaaguagagccaaaa

SEQ ID NO: 166564 - RNA, 47 nt, Homo sapiens
aucagauuuguagaucuuaaccaggcagucaccgaggccucggaauu

SEQ ID NO: 166565 - RNA, 273 nt, Homo sapiens
ccggaagcauuccugggaauaggaaagagaugcuuuuaccaaaaagcagaguuuuacugacuuccuuuccccacauccccuaaacacgucaucuguacacaaggguugcauuggaugaucuuggcuuccuuuagcaauuaaaaaaacaacucuuuagcucuuggacuguuagguugguacaaugcucuuuuaaacugucuccuaagaacacaacguuaaagcccacagcaaacuuacccuuugcagugucauagauaccgaaguaggcggcuc

SEQ ID NO: 166566 - RNA, 44 nt, Homo sapiens
ccacuguagcuguguagguguaugaggguaauguccuguuggaa

SEQ ID NO: 166567 - RNA, 44 nt, Homo sapiens
guaaucauguggugugcgugugugugugugugugcgugcgugcg

SEQ ID NO: 166568 - RNA, 38 nt, Homo sapiens
aggcucuuacguuaguauaaugauggcuaggaaggcag

SEQ ID NO: 166569 - RNA, 93 nt, Homo sapiens
agguggcaggagccaccuucaaaugaaucuucaaauuggaaaauacugcuucaccaccuggagacaaagaagaaaaaauagaagucacucugg

SEQ ID NO: 166570 - RNA, 46 nt, Homo sapiens
caaauggaauaauuuaguaugguuuguagcuauuuugaugaccacc

SEQ ID NO: 166571 - RNA, 24 nt, Homo sapiens
cucuuccugcaaauccuccucuag

SEQ ID NO: 166572 - RNA, 76 nt, Homo sapiens
aucuucuucacugguucuucuuccuuaaagguaauaaagcagaacccacgccucuuauuggucuuguuguccaugg

SEQ ID NO: 166573 - RNA, 46 nt, Homo sapiens
caacaaaaauuuuuuuaaccggcucuuuuguuuucauggcuuuggc

SEQ ID NO: 166574 - RNA, 51 nt, Homo sapiens
cacucuccgauucuuuaaauagcacaaagccaaaaccccuugaucgcccug

SEQ ID NO: 166575 - RNA, 26 nt, Homo sapiens
ccaguaaauuuggcaugagacuacuc

SEQ ID NO: 166576 - RNA, 51 nt, Homo sapiens
gguauaagaccauaaucucaaacauuuaaagcaaaaacaugagccuagucu

SEQ ID NO: 166577 - RNA, 49 nt, Homo sapiens
gcauuaccacagaccaaauaccauguaacggcaucaauuuugcccaaag

SEQ ID NO: 166578 - RNA, 43 nt, Homo sapiens
aauaacucaguggggugggggaaggguagaugcuaggccggag

SEQ ID NO: 166579 - RNA, 44 nt, Homo sapiens
aagguaccccacgacaggcgggaaaaaauccuggcggcuaaguc

SEQ ID NO: 166580 - RNA, 42 nt, Homo sapiens
guggcugcaaaggcuccugcgccucucccuggccugcccccu

SEQ ID NO: 166581 - RNA, 36 nt, Homo sapiens
cgcugcacuaaaaaagaauaagcaccagcggcggcc

SEQ ID NO: 166582 - RNA, 26 nt, Homo sapiens
gcaguauccuuagaagaaaaugaagc

SEQ ID NO: 166583 - RNA, 44 nt, Homo sapiens
ugauagaaucuuucuggucccuuaggauuuuggaacagcggucu

SEQ ID NO: 166584 - RNA, 44 nt, Homo sapiens
agaaauguauauucuggggccuugaugcugcguuuuucggggag

SEQ ID NO: 166585 - RNA, 42 nt, Homo sapiens
gaauuuugucgaaauuuauauagaaugcuuagguucacucca

SEQ ID NO: 166586 - RNA, 46 nt, Homo sapiens
uaccacaugguguuauugugaagauuaaaugaaauaaugugcuuga

SEQ ID NO: 166587 - RNA, 55 nt, Homo sapiens
ggaaaagcauuuccuccauuuuauaggcugcuuuugugcauauuaugcauuguau

SEQ ID NO: 166588 - RNA, 56 nt, Homo sapiens
agugguuuucaucucuagagugaaagucaauaacaucuagaguuuacugugcgaag

SEQ ID NO: 166589 - RNA, 48 nt, Homo sapiens
uuaguauaaaauaaucuaagaggauauaaaaguaagagaucuuagcaa

SEQ ID NO: 166590 - RNA, 78 nt, Homo sapiens
agguaucgucagauccuggaaaaagccauucaguuaucuggagcagaacaacuagaagcuuugaaagcuuuuguggaa

SEQ ID NO: 166591 - RNA, 41 nt, Homo sapiens
ggaauuccuuuggaaacaggacaaaaguauaguaaauagug

SEQ ID NO: 166592 - RNA, 61 nt, Homo sapiens
uucuuacauucuaguacaggaaacagauaaacaaauaaauacaaaauuguguaguauguua

SEQ ID NO: 166593 - RNA, 37 nt, Homo sapiens
gugggggaguuuucaaaaaagguaggaagaaaaacag

SEQ ID NO: 166594 - RNA, 46 nt, Homo sapiens
aucucaaaugauaaccgaaggacguaugaauggauuuauugaccag

SEQ ID NO: 166595 - RNA, 52 nt, Homo sapiens
agacaggcugauaccucucuaaauucgaggucacagguccucagcacuacau

SEQ ID NO: 166596 - RNA, 92 nt, Homo sapiens
ggggaaaaaagccaucaguaugaaauauuuuaauuuccuuuuuuaguuauuuuuuucucucauucaauuugaaauuuuaacuucuuuaucag

SEQ ID NO: 166597 - RNA, 43 nt, Homo sapiens
agcagauccaaucacuuuguuuccaagugaauaaccuuuugga

SEQ ID NO: 166598 - RNA, 74 nt, Homo sapiens
caucuugaaccagacugcccagcagaaaagguuuaaggaaucaaaugauggaacaccuguuuugccagacucug

SEQ ID NO: 166599 - RNA, 42 nt, Homo sapiens
gaagagcugaccacaguuccugcaauggugucgucuuucugu

SEQ ID NO: 166600 - RNA, 47 nt, Homo sapiens
gccgaggcugaggcggcggcggcggggacccagcgaggacgaggacg

SEQ ID NO: 166601 - RNA, 46 nt, Homo sapiens
uaacuguccacugccuucaguuuaaaguuaauucuuuuggcaaaaa

SEQ ID NO: 166602 - RNA, 47 nt, Homo sapiens
ggcacugggaacagcugugcguagaccagaccagugacuuauaaggu

SEQ ID NO: 166603 - RNA, 102 nt, Homo sapiens
uuucaagguguugucucuuguggauguugggaaguauuguacuugaauauuugaagauaaauauggagaaaagcaguggugagaacuaaaggaaaaugaucc

SEQ ID NO: 166604 - RNA, 47 nt, Homo sapiens
agagauugaagagugggacuuuuggggaaaaugaguuuagauauugg

SEQ ID NO: 166605 - RNA, 38 nt, Homo sapiens
aaaaaauagaaguguggccagcacugcuauuuuccuac

SEQ ID NO: 166606 - RNA, 39 nt, Homo sapiens
agaauguaugucccaugacuuaucccuaacacauugccu

SEQ ID NO: 166607 - RNA, 51 nt, Homo sapiens
ccacauguuuaguaaucaccuucugagccuaucuuccaagcaaguuguaag

SEQ ID NO: 166608 - RNA, 57 nt, Homo sapiens
uacaguagucagagaaacgugcaucuuuuccagugaaggaacaaagcugauuucuuu

SEQ ID NO: 166609 - RNA, 45 nt, Homo sapiens
guaaaaauaagcuggucagugggugguagguaagcugagggaaaa

SEQ ID NO: 166610 - RNA, 51 nt, Homo sapiens
ggauugaaagcagggugaacaagaaaaggaaagggagagaagaaacugaaa

SEQ ID NO: 166611 - RNA, 50 nt, Homo sapiens
ugaggcugccccaaaugguguguuucccaggaacuugauucaacucugag

SEQ ID NO: 166612 - RNA, 35 nt, Homo sapiens
aaggagacugggugguagcguuuacagagaagaaa

SEQ ID NO: 166613 - RNA, 373 nt, Homo sapiens
uugauuugggguggaugagaggacugcuuuccuuuuucuacuuuuuuuuuuuuuuuuuuuuuuuuuuuggugacggcgucucgcucugucaccaggcuggagugcaguggugcaaucucggcucacugcaaccucccccucccagguucaagcgauucuccuaccucagccucccgaguagcugggacuacaggcgcuugccuccacgccuggcuaauuuuuuguauuuuuaguagagacuggguuucaccguguuagccaggauggucuggaucuccugaccucgugauccacccgccucggccucccaaggugucgggauuacaggcgugagccaccgcgcccggcucgugcuuuucuuuuucaaguggag

SEQ ID NO: 166614 - RNA, 49 nt, Homo sapiens
uuucuucuucucaacacagugguuuauccucugcuuccauuuuauugag

SEQ ID NO: 166615 - RNA, 24 nt, Homo sapiens
auauuuuaauaggugcuugucuau

SEQ ID NO: 166616 - RNA, 61 nt, Homo sapiens
auuuuauuuaauguauuuaaaaacauuuuucugauagugcuguuauugucagacugcuaca

SEQ ID NO: 166617 - RNA, 44 nt, Homo sapiens
ccuggcuguuucuugccugaggucacaaagguggagcaacgccu

SEQ ID NO: 166618 - RNA, 65 nt, Homo sapiens
cuuccucccuuaugcuuccucuuuaaugcugaggugagauguuaaagggagcugccaagccucag

SEQ ID NO: 166619 - RNA, 57 nt, Homo sapiens
auccucuaccccaccuuccgacaugcccuggaacuaggaacaaagccacaagacugu

SEQ ID NO: 166620 - RNA, 51 nt, Homo sapiens
cagguaccaugcuuugugagauggugcaugugugagugagagagaucauau

SEQ ID NO: 166621 - RNA, 37 nt, Homo sapiens
caguuuaccagguggcaguuguuuuuguucccaggga

SEQ ID NO: 166622 - RNA, 30 nt, Homo sapiens
uagcaaagcccaugaaggaaaacacagaag

SEQ ID NO: 166623 - RNA, 34 nt, Homo sapiens
guuucuuuauaggcccuaaaucaguacaggaaga

SEQ ID NO: 166624 - RNA, 25 nt, Homo sapiens
agugcagguggggcauagagguuuu

SEQ ID NO: 166625 - RNA, 37 nt, Homo sapiens
ucucaacuuugacguaaauaauauucaaaauacaauu

SEQ ID NO: 166626 - RNA, 40 nt, Homo sapiens
cuuuaaggagaugccaauuauagcggguaguaggagguga

SEQ ID NO: 166627 - RNA, 39 nt, Homo sapiens
cagcagccuguuuaaaauguaauugacagugguuucucc

SEQ ID NO: 166628 - RNA, 49 nt, Homo sapiens
ucaguuuuagguaucaaugagucacauuuugucguuagauaauaaauag

SEQ ID NO: 166629 - RNA, 84 nt, Homo sapiens
cauuuugaaagguaaauuaacaugucucuccuuagaauugaugugacuuuuuagucacguuugcccaaguguagagucguucuc

SEQ ID NO: 166630 - RNA, 44 nt, Homo sapiens
aacaguuuguacaaugacgacagaaaccugcuucgaauuagaga

SEQ ID NO: 166631 - RNA, 46 nt, Homo sapiens
ugcgucuggaccacuuucuguuggcaacauuagccacaauccaaag

SEQ ID NO: 166632 - RNA, 31 nt, Homo sapiens
ugacacagauggaagagagaagagggcucca

SEQ ID NO: 166633 - RNA, 72 nt, Homo sapiens
cucgaaaugcuugagagagagugguuaauguauaaaucaugcccauuuaugauuuggaaaucauaacuuggg

SEQ ID NO: 166634 - RNA, 40 nt, Homo sapiens
uagugaauaagacagagugcuugcuuucauggagaucaga

SEQ ID NO: 166635 - RNA, 53 nt, Homo sapiens
gagagcaaccauucugugauuucccagggcaguuaauuuauguauugacuugu

SEQ ID NO: 166636 - RNA, 44 nt, Homo sapiens
gaaugaaugaauugcagguggggaguugaauaaugaagggacag

SEQ ID NO: 166637 - RNA, 51 nt, Homo sapiens
uuuaucuuuuguuuguguauaacucagcccagccaccauuuagcaauaaac

SEQ ID NO: 166638 - RNA, 23 nt, Homo sapiens
uccccauuuguuuuguuugcaug

SEQ ID NO: 166639 - RNA, 51 nt, Homo sapiens
uuguuucagcugcuuuucaaaaugaccagcaguacauuuuagugugauggg

SEQ ID NO: 166640 - RNA, 45 nt, Homo sapiens
caguuccucagacucagagagcgagagcaguucaagugacagcga

SEQ ID NO: 166641 - RNA, 49 nt, Homo sapiens
gaaacuacacuguguuucuggggcucuuuguuuccuuauaugauacuaa

SEQ ID NO: 166642 - RNA, 40 nt, Homo sapiens
aucauaauucauucucaaauauacuaacuuuugccaauuu

SEQ ID NO: 166643 - RNA, 42 nt, Homo sapiens
ucccuauggcucccgagaccagacuuccaaagacaagcccaa

SEQ ID NO: 166644 - RNA, 60 nt, Homo sapiens
cggauaccccagccucccgggaaggggagccgccagaggaaagcagaagauaaacagccg

SEQ ID NO: 166645 - RNA, 65 nt, Homo sapiens
cccgcagggaagaagcacagcucugagaagaggagcucagacagcucaagcaaguuggccaaaaa

SEQ ID NO: 166646 - RNA, 59 nt, Homo sapiens
gggugaagcagaaagagacugugauaacaagaaaaucagacuggagaaggaaaucaaau

SEQ ID NO: 166647 - RNA, 59 nt, Homo sapiens
ccucaaagaaggaaaugcuccccccgccacccguguccucguccucccagaagccagcc

SEQ ID NO: 166648 - RNA, 45 nt, Homo sapiens
gcaguaccaagagcaaccacaaagacucuuccauucccaagcaga

SEQ ID NO: 166649 - RNA, 420 nt, Homo sapiens
cccccaccaagauagagucucacucugucacccaggcuggaguguaguggcaugaucuuggcucacugcaaccuccaccucccggguucaagugauucuccugccucagccucccaaguaguugggacuacaggcaugagccaucaugccuggcuaacuuuuuuuguauuuuuaguagagacggguuucaucauguuggucaggcuggucucgaacuccugaccucaaaugauccgccugccucggccucccaaagugcugggauuacaggcgugagccacugcacccagccacuucuugcucuuucuuccuccauuuccuccuccccuccuuauuuccacuucuccuucuuuguuuacccucucuccuccccuugcuguccucccauccuuuuucacucuuggucuuaucuugcccuag

SEQ ID NO: 166650 - RNA, 46 nt, Homo sapiens
cauaaugucauuaaaauccuucucagaugccacagcgccaacacaa

SEQ ID NO: 166651 - RNA, 42 nt, Homo sapiens
uugcacauuggaagccucaaaaacaguccagacauuuguuuc

SEQ ID NO: 166652 - RNA, 50 nt, Homo sapiens
gauuugguugaggaggaacuguggcccuccguaaguuauugccauagugu

SEQ ID NO: 166653 - RNA, 40 nt, Homo sapiens
uaugcagauugugccagagcaugugcguguucuguuggca

SEQ ID NO: 166654 - RNA, 78 nt, Homo sapiens
cacuguuuuauuuuuuaaaguguuuaauguuucuguccuuucugugaauuauugaauuuaagagcccugcuaaauaau

SEQ ID NO: 166655 - RNA, 49 nt, Homo sapiens
aaauuauacuggguucggauugugaaaacauuggccaccuaguagcagu

SEQ ID NO: 166656 - RNA, 28 nt, Homo sapiens
uccaucuuaaaguagauuaaggccugag

SEQ ID NO: 166657 - RNA, 56 nt, Homo sapiens
auauauuuuuugcuuucuuauaacuuuggaggaaagucaaaucuugguauuauuaa

SEQ ID NO: 166658 - RNA, 43 nt, Homo sapiens
caaaaauguaauuguucaucuuuaaauucuuuccuuuucauaa

SEQ ID NO: 166659 - RNA, 52 nt, Homo sapiens
cugagacgagucuggucccgacgaugcugugcucugccuccuccugcugcug

SEQ ID NO: 166660 - RNA, 27 nt, Homo sapiens
aaggggaauuuaauuuuacuauuuucu

SEQ ID NO: 166661 - RNA, 66 nt, Homo sapiens
uauggcacaggugaugccuaggaggcaaaagcaaaucacugcaauucucaugguagugaguuuucc

SEQ ID NO: 166662 - RNA, 47 nt, Homo sapiens
ugauuugcuuuugccuccuaggcaucaccugugccauaccagugagu

SEQ ID NO: 166663 - RNA, 46 nt, Homo sapiens
ccugcuuuuccucagaacuuccagaaucagccuguuuaaccuuaga

SEQ ID NO: 166664 - RNA, 55 nt, Homo sapiens
cuucuuuuaaugucuucauuaagcagucuaauugcagugacccccaaggcagcuc

SEQ ID NO: 166665 - RNA, 46 nt, Homo sapiens
ucuggagauguuaauuuuucugguuuauuauuaggauucaacaccu

SEQ ID NO: 166666 - RNA, 48 nt, Homo sapiens
aaauacccagaugcuguggccacauggcuaaacccugacccaucucag

SEQ ID NO: 166667 - RNA, 47 nt, Homo sapiens
augggucaggguuuagccauguggccacagcaucuggguauuuguug

SEQ ID NO: 166668 - RNA, 45 nt, Homo sapiens
ucagaaugcuguguccucugaagaaaccaaugacuuuaaacaaga

SEQ ID NO: 166669 - RNA, 156 nt, Homo sapiens
uucaucagaauggugagacucaucagacuggugagaaucaucagugucaucuacaucaucagagucguucgagucaauggaguccuggcuguccacauggucaucaucaucuucaucauccauaucauccauguggucauggcuuucguuggacuu

SEQ ID NO: 166670 - RNA, 48 nt, Homo sapiens
gaccacauggaugauauggaugaugaagaugaugaugaccauguggac

SEQ ID NO: 166671 - RNA, 147 nt, Homo sapiens
gaacgacucugaugauguagaugacacugaugauucucaccagucugaugagucucaccauucugaugaaucugaugaacuggucacugauuuucccacggaccugccagcaaccgaaguuuucacuccaguuguccccacaguaga

SEQ ID NO: 166672 - RNA, 53 nt, Homo sapiens
acuucuuagauuuugaccucaguccauaaaccacacuaucaccucggccauca

SEQ ID NO: 166673 - RNA, 60 nt, Homo sapiens
cacauaugauggccgaggugauagugugguuuauggacugaggucaaaaucuaagaaguu

SEQ ID NO: 166674 - RNA, 78 nt, Homo sapiens
auggugcauacaaggccauccccguugcccaggaccugaacgcgccuucugauugggacagccgugggaaggacaguu

SEQ ID NO: 166675 - RNA, 44 nt, Homo sapiens
cccacggcugucccaaucagaaggcgcguucagguccugggcaa

SEQ ID NO: 166676 - RNA, 61 nt, Homo sapiens
cucaucauuggcuuuccgcuuauauaaucuggacugcuuguggcuguggguuucagcacuc

SEQ ID NO: 166677 - RNA, 85 nt, Homo sapiens
augaaacgagucagcuggaugaccagagugcugaaacccacagccacaagcaguccagauuauauaagcggaaagccaaugauga

SEQ ID NO: 166678 - RNA, 88 nt, Homo sapiens
gauagucaggaacuuuccaaagucagccgugaauuccacagccaugaauuucacagccaugaagauaugcugguuguagaccccaaaa

SEQ ID NO: 166679 - RNA, 61 nt, Homo sapiens
auagcaaaaugaaagagaacaugaaaugcuucuuucucaguuuauugguugaauguguauc

SEQ ID NO: 166680 - RNA, 42 nt, Homo sapiens
augaauagaaauuuauguagaagcaaacaaaauacuuuuacc

SEQ ID NO: 166681 - RNA, 67 nt, Homo sapiens
cauuuuaugucacuauaaucuuuuguuuuuuaaguuaguguauauuuuguugugauuaucuuuuugu

SEQ ID NO: 166682 - RNA, 36 nt, Homo sapiens
cagggugauaucuguggggcaaaaguaacaagaaga

SEQ ID NO: 166683 - RNA, 28 nt, Homo sapiens
ggcgggcgccgggaagaaaggaacaugg

SEQ ID NO: 166684 - RNA, 42 nt, Homo sapiens
ccucgccgccccgggcggccucugcgagcagcggggccugga

SEQ ID NO: 166685 - RNA, 36 nt, Homo sapiens
ccuggggggaugccccuggcaucuccuggguugagg

SEQ ID NO: 166686 - RNA, 49 nt, Homo sapiens
uucacagaaggcuccuuauuggaugggcuguacuggaagaugcagccca

SEQ ID NO: 166687 - RNA, 46 nt, Homo sapiens
cuccgagucagaaauggauccugcucuaucccccaggacuugagag

SEQ ID NO: 166688 - RNA, 34 nt, Homo sapiens
gcucccuuugggccccgaaauggaaccgcguaag

SEQ ID NO: 166689 - RNA, 47 nt, Homo sapiens
gaucuacacaagugaaaaagacuugaaugguaguagccacuggggaa

SEQ ID NO: 166690 - RNA, 337 nt, Homo sapiens
auauucaucaaaguuuucuguaugagguauaagaaaucaaaggcaggccaugcacaguggcucauaccuauaaucccugcacuuuagggaacugaggugggaggaucacuugagaucaggaguuugauaccagccugggcaacauagugagaccccaucucuaaaaaauaaaaauaaaaaauaaaucaaaggcagagucauaaucaagaccaugacaccauguaaauucugugucugcucuugacucuauuauaacuucuaagauuuuuuucaagauguuuucccuucauccuuaucacuuaauuaagcauccgucacuuccuuccugugguuucag

SEQ ID NO: 166691 - RNA, 58 nt, Homo sapiens
uauaauggugagcccuuauaauuaauacauuggugaagaaaaauauacuagucauauu

SEQ ID NO: 166692 - RNA, 48 nt, Homo sapiens
agucacaccauuuuguuuauccauucaucuauugaugucuucucucuc

SEQ ID NO: 166693 - RNA, 46 nt, Homo sapiens
cgaugacuucaguacuuuccaagaguguauguaaguauauaugaaa

SEQ ID NO: 166694 - RNA, 47 nt, Homo sapiens
guugcuauaugaccaccaauuauuuaaaaccaguuauuuuaaguaag

SEQ ID NO: 166695 - RNA, 44 nt, Homo sapiens
guuugccuauauucuuacuccuguugaauauuguugccauauau

SEQ ID NO: 166696 - RNA, 44 nt, Homo sapiens
ugcauagauaucucgaauuaauauugcuguugauaaaagugauu

SEQ ID NO: 166697 - RNA, 46 nt, Homo sapiens
cgagggugacuguugucaagguuuaggguuaagauguuuuaccuag

SEQ ID NO: 166698 - RNA, 45 nt, Homo sapiens
uucacucaauuccguaucauuuugggcgauaucaacuuugcagag

SEQ ID NO: 166699 - RNA, 63 nt, Homo sapiens
aaaaaaauaccguggaugacauuucagagagucugcggcaaggaggaggcaaguuaaacuuug

SEQ ID NO: 166700 - RNA, 74 nt, Homo sapiens
cacaaaguacgaccaagauggagaccaagaacugaccgaacaugaacaucagcagaugagagacgacuuggaga

SEQ ID NO: 166701 - RNA, 53 nt, Homo sapiens
guuucccucgaagccuggaugacucugaggaggaugacgaugaagauagcgga

SEQ ID NO: 166702 - RNA, 46 nt, Homo sapiens
gccgugaucgugaagcuagagauuauggagcgagccaaacugaaga

SEQ ID NO: 166703 - RNA, 52 nt, Homo sapiens
gaugaaaggcugggucgugacagugaaauccauagggaacagauggaacggc

SEQ ID NO: 166704 - RNA, 70 nt, Homo sapiens
aucuuccucccaaucuacagaaggcauggaaggugcagguggaaaugggaguucuaauguccacguauga

SEQ ID NO: 166705 - RNA, 67 nt, Homo sapiens
uauguguguuucaguauguguguuucuaauaagugaggaaguggcuguccugaauugcuguaacaag

SEQ ID NO: 166706 - RNA, 47 nt, Homo sapiens
aguuucauuuccagucacaaaaaucaguauuguuauuuuuuuccaag

SEQ ID NO: 166707 - RNA, 47 nt, Homo sapiens
cucuaauuugaauaagcugaguaaaaccaccaaagaucaguuauagg

SEQ ID NO: 166708 - RNA, 34 nt, Homo sapiens
auguugaguaaggugacauuuugagcgcuaauaa

SEQ ID NO: 166709 - RNA, 50 nt, Homo sapiens
auuuaucaauaauugauuuagaggagucaguuuuuuucuauggcuaauaa

SEQ ID NO: 166710 - RNA, 38 nt, Homo sapiens
uguagauucaguuacauccaucugucaucugaagaagg

SEQ ID NO: 166711 - RNA, 36 nt, Homo sapiens
cucauccccuuuaucaccugaguguaaagacccuau

SEQ ID NO: 166712 - RNA, 80 nt, Homo sapiens
cuuuuuugaggggucuuaauuuacuuugcuuaauuggugcaauauugcuuuaacuccguucacuaaagacaaacacauca

SEQ ID NO: 166713 - RNA, 47 nt, Homo sapiens
cugagcaccucgugucauagauuuuauacucuuacagacuuggaaug

SEQ ID NO: 166714 - RNA, 46 nt, Homo sapiens
gaaauaacacauuucuuaauaauagcuuuuuugacauaguuuggag

SEQ ID NO: 166715 - RNA, 41 nt, Homo sapiens
uucccuaucuuaaugacaagcuguauuuucuguguuuuugu

SEQ ID NO: 166716 - RNA, 33 nt, Homo sapiens
caccuugucauauaccaucaauaaaguacccug

SEQ ID NO: 166717 - RNA, 42 nt, Homo sapiens
auaaccucaaaaaauuuguauguggaaucuucaccaacccag

SEQ ID NO: 166718 - RNA, 44 nt, Homo sapiens
gcgcuacugaacagaaagagccagaguauuugcaguggcaagug

SEQ ID NO: 166719 - RNA, 46 nt, Homo sapiens
ugcggaacagagaccggcguccgcugcucgacagagaccugcaggc

SEQ ID NO: 166720 - RNA, 74 nt, Homo sapiens
aaagcuuaacugggcaagagcacauucagcaguaauucccccacuaaaacagcacuguuccccaucagcuaaag

SEQ ID NO: 166721 - RNA, 47 nt, Homo sapiens
cuaucauccuguauuuggguguguuguauuuauuuuuaucuuguauc

SEQ ID NO: 166722 - RNA, 53 nt, Homo sapiens
auugccagugguaguucuggcaaggccugcauccaaauagcaggugaaggcac

SEQ ID NO: 166723 - RNA, 96 nt, Homo sapiens
augucuggaguuacgcuguucuuuauguauugagagaacuguuucuuguaagcaucuucaucuucuuccauuaaguagcgcauguaaucugcaaca

SEQ ID NO: 166724 - RNA, 88 nt, Homo sapiens
aaguauuaagauauuaagaugaugaacguaugggaccaagagucacaacacugacauagcuuaacugagaccaaggacuggacacagg

SEQ ID NO: 166725 - RNA, 620 nt, Homo sapiens
uaaaucaauguugguaaacacuuuaacuucuaaauguaacucaccuuuuccuaacaaauucccaauuuucaccuuaugcaaugugaauuaucacuacagaacuccaucuuacucaagaaaaaaaucaggccagguguggugguucaugccuguaaucucaagcacuuugggagucugaagugggaggaucacuucagcccaggaguuugagaccagcuaaggcaacacagugagaccugucuccauaaaaaaacuaauuagccagguggcaauuauuaaugguggcaugcaccuguagucccagcuacaggacuacacgugaguccaggaggucaaggcugcaguggcacaaucacagcucacuggaccccagccuagaugacagaaugagaccucaucucuaccaaaaauuaaaaaaaaaaaaaaaaaauuagcagggcaugguggugcacaccuauaaccccagcuaccucgagaggcugaggugggagaauugcuugagcccagaagucugaaguugcaaugagcuauaauugugccauugcaccccagcccaggaaacagaacaagauccugccucaaaaaaaaaaaguaagaaaacaaaaagaaaaaucugcaug

SEQ ID NO: 166726 - RNA, 44 nt, Homo sapiens
uucuuuucauagacuggauucucucguauagcagcaugagcuuu

SEQ ID NO: 166727 - RNA, 66 nt, Homo sapiens
aucugguuauaauaaauggauggaagaaauauuucccacugaugguuggucuguugcuugccaaau

SEQ ID NO: 166728 - RNA, 47 nt, Homo sapiens
aacgcguacaggaagaucuuggccugcugcaauaccacauuugcgga

SEQ ID NO: 166729 - RNA, 46 nt, Homo sapiens
uaucaguuugaugaacucaacacagagauucugaauaacuuagcag

SEQ ID NO: 166730 - RNA, 41 nt, Homo sapiens
uguggcgaaaaauaccgaguuuuggcacgucgggugacacu

SEQ ID NO: 166731 - RNA, 40 nt, Homo sapiens
agucuggcuuuuacuaucuuucuuaaaaaaaaaaaaaagu

SEQ ID NO: 166732 - RNA, 45 nt, Homo sapiens
auguuauggauauugucauaaaaagguaucuuuuaaaaaucagaa

SEQ ID NO: 166733 - RNA, 44 nt, Homo sapiens
uauacacacguguauauauaugugugugauuaugugaccuaugc

SEQ ID NO: 166734 - RNA, 57 nt, Homo sapiens
ugaaaugucuguaguaacuguuagucauguuugaauaaguguaguaugaacaaagua

SEQ ID NO: 166735 - RNA, 47 nt, Homo sapiens
uugauuuuccccuagcuauuaauuuaagguugccuuuccugcagcug

SEQ ID NO: 166736 - RNA, 50 nt, Homo sapiens
ccuuuaauucuaacugaacaccagcaguauuuuuagaaauuuuucuuuaa

SEQ ID NO: 166737 - RNA, 51 nt, Homo sapiens
uauuaucuguguuggggguagaacuaacuguuuugggccacuuuauugagu

SEQ ID NO: 166738 - RNA, 55 nt, Homo sapiens
gcuuucuacuuuaugaaauauaagugguugagauauuuagaaauguggcugcugg

SEQ ID NO: 166739 - RNA, 44 nt, Homo sapiens
uggaaauuaaucaucuccuuugauuuauguuaugaguaggaugu

SEQ ID NO: 166740 - RNA, 88 nt, Homo sapiens
ggggcaugggcugguagaagcacuccuucuggccggcgggaaggguaaaggugaagucgcuaucgagggaaggugugaagccggccgc

SEQ ID NO: 166741 - RNA, 56 nt, Homo sapiens
ugggggaguucuguuccuuucccucccggcaccuuggaugcgcugggacugguccu

SEQ ID NO: 166742 - RNA, 190 nt, Homo sapiens
aggaggccgggcgcaguggcuuacgccuguuaccucagcacuuugggaugucgaggcggaaggauugcuugagcccaggaguucgaggccagccuuggcaauauggcgagccacugucucuauaaaauuaaaaaaaaaaaaaaaaagaggaaacugucacuuccgucccccacccccgcccccgcuucuu

SEQ ID NO: 166743 - RNA, 63 nt, Homo sapiens
ggugugcgugugcaaaccuacaaacacauuguuaauuagggccgaaagaugauguuguuaagg

SEQ ID NO: 166744 - RNA, 49 nt, Homo sapiens
uuuaagaugaaauauauaguaccaaaugguauuauagaauuugcccaau

SEQ ID NO: 166745 - RNA, 71 nt, Homo sapiens
uugcuugcaaauguugcuuccuuaagacaugaacugaagauaacagaauggaguuugcagaguuuagggga

SEQ ID NO: 166746 - RNA, 51 nt, Homo sapiens
aguguuaguccaagugaaaauucugauuaugccccuaauccuucaaggucu

SEQ ID NO: 166747 - RNA, 53 nt, Homo sapiens
gaaaagcuaauuuuggauguucagccuagccacccuggacuuuugaauuauuc

SEQ ID NO: 166748 - RNA, 58 nt, Homo sapiens
uuaaaagccuucgagagaaacuaaauaaacuuaggcaacagaaugcuuguuuggucac

SEQ ID NO: 166749 - RNA, 23 nt, Homo sapiens
uuuauguaaaauaaaucuugcua

SEQ ID NO: 166750 - RNA, 52 nt, Homo sapiens
cuaugcuugagucugcucaacagcaggcagccagugucccaaucuuagaaga

SEQ ID NO: 166751 - RNA, 46 nt, Homo sapiens
agccagaaaaugguaauugaaaaggaacagaguuugcaggagucca

SEQ ID NO: 166752 - RNA, 41 nt, Homo sapiens
gagcugaacgacaaaggaaugaagcacuauauaaugccgaa

SEQ ID NO: 166753 - RNA, 47 nt, Homo sapiens
ggucuauauaaaagugaacuugaaauucugaaagagaaauuaaggua

SEQ ID NO: 166754 - RNA, 47 nt, Homo sapiens
cacaacuaacugaaucuagacaaaguauuuugaagcuagagagugag

SEQ ID NO: 166755 - RNA, 46 nt, Homo sapiens
gaaaguagcaaauuaaguaguuuagaaacagaaccuguaaagcuag

SEQ ID NO: 166756 - RNA, 46 nt, Homo sapiens
agcuuuaaaagcauuacagaaccaaguaucugaagaaacaaucaag

SEQ ID NO: 166757 - RNA, 42 nt, Homo sapiens
aacagcagcaaauguuacaacaagagacaauuagaaauggag

SEQ ID NO: 166758 - RNA, 63 nt, Homo sapiens
ucaaaaacaaagggaaaguucagcugaaaaguugagaaaaauggaggagaaaugugaaucagc

SEQ ID NO: 166759 - RNA, 46 nt, Homo sapiens
aguuacagcacaguacugaaacugaacuaacagaagccuugcaaaa

SEQ ID NO: 166760 - RNA, 46 nt, Homo sapiens
gauggagauugaagacaaaaagcaggagcuccuugaaauggaucag

SEQ ID NO: 166761 - RNA, 46 nt, Homo sapiens
cauuuggauaugacuauucgugagcacagaggagaaauggaacaaa

SEQ ID NO: 166762 - RNA, 59 nt, Homo sapiens
caggcaggacccagggagggcgaagaccccagcccaggcaggaccgcgggagggcaggg

SEQ ID NO: 166763 - RNA, 34 nt, Homo sapiens
ccccagcccaggcaggacccagggagggcgaaga

SEQ ID NO: 166764 - RNA, 46 nt, Homo sapiens
gccugaagccuccaugccccggcagagggacggacacgcggacguc

SEQ ID NO: 166765 - RNA, 46 nt, Homo sapiens
aacaccugccccaccugcaggauugugauccaccagagccaccccc

SEQ ID NO: 166766 - RNA, 45 nt, Homo sapiens
aaaggugaaaccaaagcagacgacaguucaaacaaagaggccgcg

SEQ ID NO: 166767 - RNA, 44 nt, Homo sapiens
agcaucugccuggaguguaacagcagcaaacugcgcgggcugaa

SEQ ID NO: 166768 - RNA, 35 nt, Homo sapiens
guuaggaucagagcucuccuggcauccguggggag

SEQ ID NO: 166769 - RNA, 47 nt, Homo sapiens
uuacucaguuaccuaagcuugcuauucauccaaaucauuuucuagag

SEQ ID NO: 166770 - RNA, 57 nt, Homo sapiens
uaagaaaggauuaaacaguuacaagccuccaaauucaaauaaaauuaaaucacaguu

SEQ ID NO: 166771 - RNA, 56 nt, Homo sapiens
auuagacaucuguuuaaaugguaauguagcauuuauuuugcuaaauugaaagggaa

SEQ ID NO: 166772 - RNA, 32 nt, Homo sapiens
ucuguuuccucaggaagucauuacugcgccac

SEQ ID NO: 166773 - RNA, 24 nt, Homo sapiens
uaugagcaugagagaugacuugcu

SEQ ID NO: 166774 - RNA, 42 nt, Homo sapiens
uuacaggcacucagaaugguccagcauuugauauaccaucgu

SEQ ID NO: 166775 - RNA, 46 nt, Homo sapiens
auaccaagaagguugggaaagcaccaaaaucugcauguggcaugug

SEQ ID NO: 166776 - RNA, 52 nt, Homo sapiens
cuuaucgaggagcagaaaauuguugugaaaguguugaaggcacaagcacaga

SEQ ID NO: 166777 - RNA, 44 nt, Homo sapiens
gaagaaagcuuugaaaaaagcucagagaauaaaagaacuugagc

SEQ ID NO: 166778 - RNA, 2231 nt, Homo sapiens
acaguggcaacaaacccaugucaaaguaagugacuuugacuuuuccauuuuaggugcaaucuuccccauuuggauacuugaaguagucugcagagagaaucuaugcauaagaaaguuguaauacuguuuuaccguuguuuugaagauuagcaacaaagggucaacauugucuguguaagugugccuaaguaaagugaagauaauuuugauucccauuuaggcauucaguaaauauuaagaagauaacuauguacaaugaacaucuucccagcauauuuuauaagccagguacuggggcuauaccacaggagaccaccucaggccuugucccaacugaguuuauauuuagagaagaaaacucaucauuaaugaagugcuuuaauaguacaguguaaacauuacaaaggagcuauaacagguacuguaagggaacaagagguacucagccuccacuuuuauuauuagggcagauuucuuugagaaaaugacaucuaaacugagauuugaaaagaguaagagccaaguacaaagcuacaaggcgguaugauguugaucugggcuugaauucuuuguuauuaaugagcauuaugaccuuggagaagcuguuuaacucuguuuccucaucuguaagauaggggcaguacauuauuggguugugaggauucaaacgauaaguguuaguaaagcuuguaacaguucuuuacauguaguaagagcuuaguaaauuuuuuuuaaaggggggaggugagcacguacaaguaacaaaucccugugguaaaaacuuggggccuggaagguggguggucugagaagagauuagagagguaaaguccagaacauaaagagcuuguaagccaccgauaacauuuuaaguagaggggauaugaugugaucacauuugagcuuuagaaugaucacugucaguagggagaggcaacuacugcugugauccagguauaagaugauggccugaacccagggaguugcaaugggaauggggaacuaugcaguuuugaaaaguaagaggcagaauuaacaauauuuuggugaacuucugcauauuugccacaacuuagucuuuugauuugucaagaguuuuugaaacuuaaguugcuacauauuuauauuugaauaugcaaaaauuauauauuaauguaagcauuccaauaaaauaaaauucuagaacaauguauauauauauuuuuuaaugucuuugucaucuguguaaaaagccauagcuucauggugguaauaugguaccggggagucuagauauugccccucuuaaggaucuuucuuuucauccuuuuggugagaagucaguguuaacugagcagaaauuauuggggguuuuaggcucugauccuauuuagaaucuuauuuagaauguuuuugaaacccccagguguuuuguuuuggugagaauuauuagcuaugauuuccauuugugcugcugcauucuuccaauguagguaaaauauuuuaucugcaucgaaucucuucauacauuuuuuucuaaaugcugcacuuguuaacuaugucuauuuggaaguaguugaaggcuuagauacccauuaauacugaaacucaacuuauuccuaaaacaacugguaacagcuauacaaaaguaaaauagaaagucauaauuaaggcugggcgcaguggcucaagccuguaaucccaacacuuugggaggccaaggcaggcagaucacuugaggccaggaguuaaagaccauucuggccaacauggugaaacccuaucucuacuaaaaauauaaaaguuagcugggcaugguggcaugugccuguagucccagcuacuugggagggugaggcacaagaaucucuugaacccaggagguggagguugcugugagccaagauugugccacuguacuccaacuccagucugggcaacagaacaagacuuugucgccaaaaaaaaaaaaaaggcauaguugaaauauuuaccuuauauggguaaauagauuacaguuauguuugaaagcuuccaaggaugccauuuuuuaaaaaaacauuucuuaguaauucugggugauugguacugauuuuaaugauuuaguacuuuuuauucauagaccauuguauauguuuauuagauuuuuuuuuugcacugccggugucuucaaggaagucauucuuguaugauaagucuuaacaguugacauuuaacuuuuuuucaugcagaaaagaaaugauugcccagca

SEQ ID NO: 166779 - RNA, 45 nt, Homo sapiens
uacuggauuucgucuuucagauuuaauuucuuuuaugggucuguu

SEQ ID NO: 166780 - RNA, 47 nt, Homo sapiens
uauaguuuucuuacaaauauaacuuacgagaaaaaaauuugauugga

SEQ ID NO: 166781 - RNA, 67 nt, Homo sapiens
cuuuuuuuauugaaggccauuuaauaaaacacagcuggucagcccagugcaaaccuuauuaucugcc

SEQ ID NO: 166782 - RNA, 46 nt, Homo sapiens
aaagauccuacuucuagcugggccccucauguauccauuggccgac

SEQ ID NO: 166783 - RNA, 25 nt, Homo sapiens
gcucugaccccacggcccggcccac

SEQ ID NO: 166784 - RNA, 37 nt, Homo sapiens
cccgcagccuccugucccccauccuggggucccgcag

SEQ ID NO: 166785 - RNA, 50 nt, Homo sapiens
gcuacagcggcauccugucuggguccaacggauugcuugcgggcaacgag

SEQ ID NO: 166786 - RNA, 75 nt, Homo sapiens
aggugaagcuccgugacuaguaccagaagcaggggcacaggcccucccacaacuacagccacuacuacaggacca

SEQ ID NO: 166787 - RNA, 42 nt, Homo sapiens
uccugcagaucaacaaugcucaacuggcugcagaugacuucu

SEQ ID NO: 166788 - RNA, 48 nt, Homo sapiens
cugccaagauccugagugacaggcaaagccaauaugagaucauggcca

SEQ ID NO: 166789 - RNA, 46 nt, Homo sapiens
uuagguugcgaccuuuccuuccccagcaauaaacuggucucuggag

SEQ ID NO: 166790 - RNA, 42 nt, Homo sapiens
gcuuugaggaaccacagccaucaacaucgacgucagaccucu

SEQ ID NO: 166791 - RNA, 42 nt, Homo sapiens
ugguggggcugcugcggaccuuggucgagggucgcgguugca

SEQ ID NO: 166792 - RNA, 46 nt, Homo sapiens
cacauccucaacaaccucguggaagcauaccucauccagcauccag

SEQ ID NO: 166793 - RNA, 30 nt, Homo sapiens
cguggcagggacugggugaacacuuagcgg

SEQ ID NO: 166794 - RNA, 53 nt, Homo sapiens
cuuggcagaacuuuugagagacucugguaacuguuacacuggaaccuuuuggg

SEQ ID NO: 166795 - RNA, 46 nt, Homo sapiens
gaaauucaaucauaucugugaacagacaagguucaaaaacuaagca

SEQ ID NO: 166796 - RNA, 46 nt, Homo sapiens
gaacaguuacaaaaauccccgcacgcaggaccucaccgccaagcuu

SEQ ID NO: 166797 - RNA, 56 nt, Homo sapiens
uaugggcacauguuagaaccuuggcuguugaguaagaugcacuuugugaagaagau

SEQ ID NO: 166798 - RNA, 45 nt, Homo sapiens
gcaauucuucaagggcugagaaaguugauuucuuuaguggcaaaa

SEQ ID NO: 166799 - RNA, 46 nt, Homo sapiens
uagguaauuugugaaagaagcaaaaauaaaucuguggaacugaagg

SEQ ID NO: 166800 - RNA, 59 nt, Homo sapiens
gugguccccagaccagacggcugaggccucucacgucagccgcuauggaggcagcccca

SEQ ID NO: 166801 - RNA, 42 nt, Homo sapiens
cccugagagccuucgcagggccccugaguccagccaagguga

SEQ ID NO: 166802 - RNA, 45 nt, Homo sapiens
accauguccuguggagccccaagguuguccucaucucaaaccauc

SEQ ID NO: 166803 - RNA, 45 nt, Homo sapiens
uuucugggcuguuuuguugaucugucuucccaggaaggccugcaa

SEQ ID NO: 166804 - RNA, 81 nt, Homo sapiens
ucacacagcaggaaauaggcaaaaaggcucaacaagaaacaggagaacgggaagccuccugccgagauaaagccaccacgu

SEQ ID NO: 166805 - RNA, 43 nt, Homo sapiens
aauuccauuuccgugagggcguuucuagaugaagaugacauga

SEQ ID NO: 166806 - RNA, 46 nt, Homo sapiens
gaggugcagcgccuuccccuuggagcaggaggcagaccucauagaa

SEQ ID NO: 166807 - RNA, 42 nt, Homo sapiens
ugaauuugcaaaauauaggacguagcguuuccaagacaccag

SEQ ID NO: 166808 - RNA, 80 nt, Homo sapiens
uugaaugugcagacgucgacccccaucaguucccggccgugcacagauggaagagugcuguccugugcuacucacccucg

SEQ ID NO: 166809 - RNA, 42 nt, Homo sapiens
gccaggcuguggauuuggguguuguggcucucugcacacagg

SEQ ID NO: 166810 - RNA, 46 nt, Homo sapiens
ccgcaguuggcccagucccgcggugaaaggaagguucaagucucag

SEQ ID NO: 166811 - RNA, 42 nt, Homo sapiens
uggcgcgccuggcugagcuugccgcccuguaggcuuggcgcu

SEQ ID NO: 166812 - RNA, 49 nt, Homo sapiens
gagaauuuuagaagauuuaaauguucuauauaacacuuagauuucugau

SEQ ID NO: 166813 - RNA, 118 nt, Homo sapiens
augaaagcaaacucaguuaccaauuuucuggaaaauauccaugugguaaugguagacuuuuuagguggcaauuucuaggucugaaauauagcagaggaaagggcgcugaggcaguugc

SEQ ID NO: 166814 - RNA, 48 nt, Homo sapiens
aagaugaacuauuugccgcccugucuuuuccuggguugggggguggca

SEQ ID NO: 166815 - RNA, 66 nt, Homo sapiens
agggagccaggagcgcgccucagacuugcagcaaccauugugauuuggguuguucggaauauuuaa

SEQ ID NO: 166816 - RNA, 39 nt, Homo sapiens
ugggagugauaccaggagcaacacagagcucagcagcgg

SEQ ID NO: 166817 - RNA, 45 nt, Homo sapiens
ucguaacuguccuccuccugccuggcaucugcgcgguggauguag

SEQ ID NO: 166818 - RNA, 61 nt, Homo sapiens
uagacgaauggacgauuuuauuaaacuucaaccccaagcuugccaggcggagcccagugag

SEQ ID NO: 166819 - RNA, 46 nt, Homo sapiens
gguccuucuccagggagccauccacgugguacugggaaugccugau

SEQ ID NO: 166820 - RNA, 94 nt, Homo sapiens
gcgauggugcaaacacagccgcguugucucauguguuacagcaagacucccagaaagcagggggagcagaggaugagcaggaaaaugaggacga

SEQ ID NO: 166821 - RNA, 53 nt, Homo sapiens
gcccagccgcccgcgccgggggucccaggccgcgccgggcccggggcugagcc

SEQ ID NO: 166822 - RNA, 30 nt, Homo sapiens
uggacuuagaagaagaaaauccccgugacu

SEQ ID NO: 166823 - RNA, 46 nt, Homo sapiens
acacauaugcagacacaugccagggccccccaagcccgagcaccgg

SEQ ID NO: 166824 - RNA, 45 nt, Homo sapiens
acacuccccucucccuccacaggcaagcugugcauugagcggaga

SEQ ID NO: 166825 - RNA, 64 nt, Homo sapiens
ggucaucugguuccaggcagugucuccccuuggcccugugaccauccccucugcacagcaggcu

SEQ ID NO: 166826 - RNA, 45 nt, Homo sapiens
ggcggggggcccugaguaccagcugcaggagagugugguggccga

SEQ ID NO: 166827 - RNA, 40 nt, Homo sapiens
ugcccgccaccuggugccugggcccugcagcgaggcccca

SEQ ID NO: 166828 - RNA, 26 nt, Homo sapiens
cuuugacuucccgaagacccccagcu

SEQ ID NO: 166829 - RNA, 46 nt, Homo sapiens
acccaagcugcccgacuuccugcagcgaaacccccugccccccauc

SEQ ID NO: 166830 - RNA, 46 nt, Homo sapiens
gucugacuugcacgucguccgccccaagcugcccaaaccccccacg

SEQ ID NO: 166831 - RNA, 48 nt, Homo sapiens
aagcaccuuagcaccccagggguggggcagccuccuacgugcccagac

SEQ ID NO: 166832 - RNA, 49 nt, Homo sapiens
gugugaacuaggucagugccugcucaccaggcccagcccaggaucacca

SEQ ID NO: 166833 - RNA, 46 nt, Homo sapiens
ggcaauguuugaggcaggcacccaaacccaggaaaaaauaacuggg

SEQ ID NO: 166834 - RNA, 45 nt, Homo sapiens
ucgccgucaagugcauuaacaagaagaaccucgccaagucucaga

SEQ ID NO: 166835 - RNA, 54 nt, Homo sapiens
gcgcccccggcccgcccgccccggcccgcgccuccgccugagucccccgcgccu

SEQ ID NO: 166836 - RNA, 42 nt, Homo sapiens
ccugugcuggagcuucgcuguaucaacucugaaggaacgguu

SEQ ID NO: 166837 - RNA, 42 nt, Homo sapiens
uuucaaaaagugguaaguccuaugaagggacacagaacagag

SEQ ID NO: 166838 - RNA, 31 nt, Homo sapiens
cuccuuagagacaguguccacucaggaacuc

SEQ ID NO: 166839 - RNA, 76 nt, Homo sapiens
agggacaaaagcugugaauauugcuuugaugaaccacugcugaaaagaacagauaaauaccgaacauacagcaaga

SEQ ID NO: 166840 - RNA, 49 nt, Homo sapiens
auugcauacauagaagaucacaguggcaauggaaccuuuguaaauacag

SEQ ID NO: 166841 - RNA, 49 nt, Homo sapiens
gaaaacgccguccuuugaauaacaauucugaaauugcacugucacuaag

SEQ ID NO: 166842 - RNA, 337 nt, Homo sapiens
guaaguugcugggcgugguggcucacaccuguaaucccagcacuuugggaggcugaggcggauggaucaccugaggucaggaguucgagaccagccugacccacauggagaaacccugucucuacuaaaaauacaaaauaagccgggcaugguggugcaugccuguaaucccagcuauucgggaggcugaggcaggagaaucgcuugaacccgggaggcagagguugcagugagccaagaucgugccauugcacucuagccugggcaacaagagugaaacucugucucaaaacaaaaaaaaagaugaguaaguuagcacucaagauucaacuuugcc

SEQ ID NO: 166843 - RNA, 62 nt, Homo sapiens
ugacuguagaugaucagucaguuuauccuaaggcauuaagagaugaauacaucaugucaaaa

SEQ ID NO: 166844 - RNA, 81 nt, Homo sapiens
guugccaggggcugggggcugagugcuggggacaggguagagugaggagugacugcuuaauugcuuaacagguacaggguu

SEQ ID NO: 166845 - RNA, 53 nt, Homo sapiens
agguaaagcuggcuuucgagaggaaaacauguaagaaaguagccauaaagauc

SEQ ID NO: 166846 - RNA, 78 nt, Homo sapiens
gggaaguuuuuuuuuuucuucuuccaaguucaaagucguuacaagauuguuuuuacaauaaaugacaggaaauuagag

SEQ ID NO: 166847 - RNA, 46 nt, Homo sapiens
aaaggacccagcucucaauguugaaacagaaauagaaauuuugaaa

SEQ ID NO: 166848 - RNA, 45 nt, Homo sapiens
cuuauguguacauucacacacaugccuagcugucauuuagcuggg

SEQ ID NO: 166849 - RNA, 49 nt, Homo sapiens
aggguauccauuaaguaugacaacauccuguccuuauaucugauuaaau

SEQ ID NO: 166850 - RNA, 83 nt, Homo sapiens
gagagcuguuugacaaagugguggggaauaaacgccugaaagaagcuaccugcaagcucuauuuuuaccagaugcucuuggcu

SEQ ID NO: 166851 - RNA, 46 nt, Homo sapiens
guaccuucaugaaaacgguauuauacaccgugacuuaaagccagag

SEQ ID NO: 166852 - RNA, 46 nt, Homo sapiens
aucugguaagaaauauuuucauugcugcacagacugguaggaggug

SEQ ID NO: 166853 - RNA, 45 nt, Homo sapiens
aucugacuuuucauuaugcugaaaaagaaaucuuuauaucugaau

SEQ ID NO: 166854 - RNA, 60 nt, Homo sapiens
uuccaugguguuuucuccugucaauucuguucuuauuuucuauuguuaguuucacaccau

SEQ ID NO: 166855 - RNA, 40 nt, Homo sapiens
cauuuuuaaaugcugaccucaucuggaacugccaagaguu

SEQ ID NO: 166856 - RNA, 33 nt, Homo sapiens
guuuuaacuugauucgcuccagcacccuuagau

SEQ ID NO: 166857 - RNA, 35 nt, Homo sapiens
uauacaucguucagaggucagaagccauaagggag

SEQ ID NO: 166858 - RNA, 49 nt, Homo sapiens
cuccauuuuccuuuauuuucagccuucuacuagucgaaagcggccccgu

SEQ ID NO: 166859 - RNA, 74 nt, Homo sapiens
ccuagagaaagcacugacuuggacaaagguacagaggagaaguucugugaugguuaaggguguggguaccaguc

SEQ ID NO: 166860 - RNA, 46 nt, Homo sapiens
gcaggugcugugcucuuggcucaguaacagcccaaauuaugaggag

SEQ ID NO: 166861 - RNA, 46 nt, Homo sapiens
guuagaacccagcaaguuaucccucugugaagcaaaauguccucaa

SEQ ID NO: 166862 - RNA, 76 nt, Homo sapiens
uuauggcaacugauaacuggccuggaggcauuucuucaacaggucccugcccugcacacccugcagaaucugggag

SEQ ID NO: 166863 - RNA, 45 nt, Homo sapiens
gugagaucuugcaauuauucaugggaggcuguugcugaggcaugg

SEQ ID NO: 166864 - RNA, 46 nt, Homo sapiens
acucggugagcgcguccacgaaguccggguccaucuugagggcgug

SEQ ID NO: 166865 - RNA, 51 nt, Homo sapiens
aucuggccugaguugcuacaaaugaagugugagagaaacgcggauacacaa

SEQ ID NO: 166866 - RNA, 63 nt, Homo sapiens
gggaugcagccuggccauggcugaagguuuuugcuccauucaguagaaacuggugcucuaauu

SEQ ID NO: 166867 - RNA, 50 nt, Homo sapiens
cuugauaggcugcacacggcugguguccaagauggcggcgcggcggcgau

SEQ ID NO: 166868 - RNA, 98 nt, Homo sapiens
uuuuuuuuuuuuuuuaacuugaaacacaaacgcuuuauuuaaaggagcaucucaauuccguguggcggaccaaaaaaaaggagcagacugugacagac

SEQ ID NO: 166869 - RNA, 44 nt, Homo sapiens
gcucuugcagcaggaauauauguuauuuggggucccauuacaga

SEQ ID NO: 166870 - RNA, 46 nt, Homo sapiens
gcuacaaggccugucugccuguccugcuuucaucagguggcuggaa

SEQ ID NO: 166871 - RNA, 34 nt, Homo sapiens
cuuuucaaagaaguccagaugacagagacucuua

SEQ ID NO: 166872 - RNA, 46 nt, Homo sapiens
aggucuuagaugcaagcugcuuguuggaugucuuaagaauguacag

SEQ ID NO: 166873 - RNA, 45 nt, Homo sapiens
ggaagacucacuaguaauauggucugcaaacacugugaacaccag

SEQ ID NO: 166874 - RNA, 46 nt, Homo sapiens
aaacauuucaaucugaaagggcuuugaggcauuuuauguggcucag

SEQ ID NO: 166875 - RNA, 42 nt, Homo sapiens
ccacugccuucaccacuucaucucaucagaaucagugcggga

SEQ ID NO: 166876 - RNA, 46 nt, Homo sapiens
accuucugccaggaacccucucucaacuagcaaucaguggcugugg

SEQ ID NO: 166877 - RNA, 102 nt, Homo sapiens
ucauuugugaagugaaggguuagauuugaugaccaccaaaguucagcccuuuucacgaaaaggagaaagcagcuuuugacuuuuuaaaaaacauauaacuac

SEQ ID NO: 166878 - RNA, 82 nt, Homo sapiens
gggcgucagggugcaaggggcagcuugaacuguacgguccguccugcacucacccgaugcagaccuugacuuugauguugaa

SEQ ID NO: 166879 - RNA, 78 nt, Homo sapiens
auaaacuugaaagaaacuggauugccugucuacuaggagcugacagaugacucgagugaaucucuccuuggcuacuga

SEQ ID NO: 166880 - RNA, 46 nt, Homo sapiens
ccuggacugcaguuacacaguccuguuuggcaaagcugaggcagau

SEQ ID NO: 166881 - RNA, 34 nt, Homo sapiens
ggauuaauuaauuaauuaacaggugaauaggcau

SEQ ID NO: 166882 - RNA, 88 nt, Homo sapiens
ucccagugaucacuacugaaccuuuaagaauccagaugcauuucaaguuuaauugaauaaaauucuuuguauaauaaauuccgcauga

SEQ ID NO: 166883 - RNA, 37 nt, Homo sapiens
uguguguguguguguguguguguguguguguguguga

SEQ ID NO: 166884 - RNA, 84 nt, Homo sapiens
gugccacuggcaccugguggguggagaccaaaggugcugucagcauccuacacugcacaggaugcacaggacagccccgaacac

SEQ ID NO: 166885 - RNA, 24 nt, Homo sapiens
gaaagguuacaccugggacuguuc

SEQ ID NO: 166886 - RNA, 27 nt, Homo sapiens
gcaaggcauuacaucagcuacucuaca

SEQ ID NO: 166887 - RNA, 57 nt, Homo sapiens
cugagccauaguuuccuccucaguaaaaugaagagaauagguguuggcuaccuuugg

SEQ ID NO: 166888 - RNA, 42 nt, Homo sapiens
gccauguugucagaaguccuacuggugucugcuccggggaaa

SEQ ID NO: 166889 - RNA, 46 nt, Homo sapiens
ccuuuaaggauuggguaccccuucucccugaugcuaauuuuguaag

SEQ ID NO: 166890 - RNA, 35 nt, Homo sapiens
uccuccggcuucaaccccacagcaaugggaaagug

SEQ ID NO: 166891 - RNA, 45 nt, Homo sapiens
ucggagcugccccccggggcgggcuugggcuccagcgccgccuac

SEQ ID NO: 166892 - RNA, 39 nt, Homo sapiens
uucccacagcucugacccacugguuuuucucuuuaggag

SEQ ID NO: 166893 - RNA, 46 nt, Homo sapiens
ccccaggccucaccagccguuccuucuuuuuuucuccaguucccag

SEQ ID NO: 166894 - RNA, 53 nt, Homo sapiens
cucucccuccuccaggaagccuuccccuaccccuugucgccccucccucccag

SEQ ID NO: 166895 - RNA, 54 nt, Homo sapiens
ugguggggcugggccauggagcuggcccagaggccccucagcccuuuguaaagu

SEQ ID NO: 166896 - RNA, 79 nt, Homo sapiens
ugaaggcccagugcgacaggcccuugguggggucugucuuuuccuugaggucagaggucaggagcagggcuggggucag

SEQ ID NO: 166897 - RNA, 69 nt, Homo sapiens
gugccucaaguuccucaucuaaguggcccuggccuccugggggcgggguugugggggggcugagcgaca

SEQ ID NO: 166898 - RNA, 44 nt, Homo sapiens
cucaucuuuggagcccgagucauaggguuucgugucugccagca

SEQ ID NO: 166899 - RNA, 44 nt, Homo sapiens
ucgccauggaggagaucagccguggcugcgccuccaccggaguc

SEQ ID NO: 166900 - RNA, 45 nt, Homo sapiens
ugggcugucuccaucugacccuaccccuuccaugucccaccccac

SEQ ID NO: 166901 - RNA, 60 nt, Homo sapiens
ccuuucaaaggacaacugucgggaagggagagccgaguugcgagguaggaggggagcacu

SEQ ID NO: 166902 - RNA, 47 nt, Homo sapiens
uuggcaccucuugcauccaggcagucuugugagaugggggcacauag

SEQ ID NO: 166903 - RNA, 47 nt, Homo sapiens
aucucuugggacagguucccccaggaguauaaacacaaggagccagg

SEQ ID NO: 166904 - RNA, 45 nt, Homo sapiens
uguccuuuccagcugccuuuugucuagccugcuauggggggccag

SEQ ID NO: 166905 - RNA, 49 nt, Homo sapiens
gauaguacacggaagcagaaccggaaacacccaggaacuguucagaaau

SEQ ID NO: 166906 - RNA, 48 nt, Homo sapiens
gcaacauggaauauuguccuccaugccccuccagaaggaccuaggaga

SEQ ID NO: 166907 - RNA, 45 nt, Homo sapiens
gcuggccuacucuggcauaauucaagugucuucuugccuugggga

SEQ ID NO: 166908 - RNA, 57 nt, Homo sapiens
uggauaugguuucuaaaaucucagcugagaacuucagaaaacagcagcaguauuuuc

SEQ ID NO: 166909 - RNA, 53 nt, Homo sapiens
agagcuacugggaucacguuagcgggcauuuaggcuuugaugagagggcacag

SEQ ID NO: 166910 - RNA, 44 nt, Homo sapiens
ugugucccuuaaaccagacucacuuuucugaaaaaucuccauug

SEQ ID NO: 166911 - RNA, 68 nt, Homo sapiens
gucaggggccuguuggucucucauuggacguuuuugggucucacucaugcuuacugaaacauugugcc

SEQ ID NO: 166912 - RNA, 100 nt, Homo sapiens
ccagcugacugaaaacaaggacagucagggugaaacuucuuuugccagaaguguggccugaguugaauuucugggaggaugacgcagaugucugcugcag

SEQ ID NO: 166913 - RNA, 68 nt, Homo sapiens
uuuguucucuuaucuguauuuugagcuuagugcuaggacugagaggcugcaccauagggaauguaugg

SEQ ID NO: 166914 - RNA, 63 nt, Homo sapiens
cuugaaaguuuuuuuguuuuuguuuuuguuuuguggcuccuccaagauauagguacaugaagu

SEQ ID NO: 166915 - RNA, 50 nt, Homo sapiens
aggaaggaacaucuuucuauggcuaacaaaaacuaaaggggaagugagga

SEQ ID NO: 166916 - RNA, 72 nt, Homo sapiens
uuugaguuugcuuuauuagauauguuuuuuaagagcucuguauauuugaacugcuccuuaugugacaaaaua

SEQ ID NO: 166917 - RNA, 42 nt, Homo sapiens
ucuuggugugaugggacugaaagaauuccagucagccagagc

SEQ ID NO: 166918 - RNA, 46 nt, Homo sapiens
gucacaguucagccaguuuugguuuaugccuagagcuacuucaagg

SEQ ID NO: 166919 - RNA, 47 nt, Homo sapiens
gggccuugcugccagggggcagggaugcuuuccagccugcagcaaca

SEQ ID NO: 166920 - RNA, 80 nt, Homo sapiens
uccuuaaucuggcucauuugaaauuucuucucccucucaaccaucccacuaaguuauagccaagaagggaaggagacacg

SEQ ID NO: 166921 - RNA, 80 nt, Homo sapiens
gauggucccaccuuuaguguuugagcuuugucauugcuugucucccuggcaugugccaguuauagacuguccagcaucca

SEQ ID NO: 166922 - RNA, 55 nt, Homo sapiens
gacguccugggauugaaagaaugugugugaagggguagaauuugugcgguaaaga

SEQ ID NO: 166923 - RNA, 38 nt, Homo sapiens
cuguuccuuuuuuuagguuagaaauuaacagcagggaa

SEQ ID NO: 166924 - RNA, 49 nt, Homo sapiens
gguaaacuggauccuuccugcucaaggauccucauuuguauaccuagug

SEQ ID NO: 166925 - RNA, 37 nt, Homo sapiens
acaaaaacaaagagaaaaaaacacacaucaauuaaag

SEQ ID NO: 166926 - RNA, 42 nt, Homo sapiens
caaaugacuauccugaacaggguggaggggugugggaaagaa

SEQ ID NO: 166927 - RNA, 46 nt, Homo sapiens
cgggugcagucaggcccccgcacacccaaccccuaugccucggaca

SEQ ID NO: 166928 - RNA, 50 nt, Homo sapiens
uaccaaagcuucagccucauccgggauuggagaagaaagaagaggaagaa

SEQ ID NO: 166929 - RNA, 51 nt, Homo sapiens
guguugggcauagcacagcucacgaugaaauuauaccuaugagcaucagaa

SEQ ID NO: 166930 - RNA, 90 nt, Homo sapiens
ugcguuccaacccugaggaccagauccuguaucaaacugagcgguacaaugaggagaccuuuggcuacgaagugcccaucaaagaggagg

SEQ ID NO: 166931 - RNA, 44 nt, Homo sapiens
uuuaccucugagacugaaaugugauaucuuauauuugcacaaaa

SEQ ID NO: 166932 - RNA, 44 nt, Homo sapiens
guaguuggaacaguauauuuauggagcacuggaaagccuuacug

SEQ ID NO: 166933 - RNA, 46 nt, Homo sapiens
ccacugggucuuuuuguuaaucuuuuaccuuuugccaugucuucuc

SEQ ID NO: 166934 - RNA, 54 nt, Homo sapiens
uuuguaugcauugcucagcuacucuuugauuucuugaggagaaauagaaagaaa

SEQ ID NO: 166935 - RNA, 47 nt, Homo sapiens
cauagguuuguaucccggggcaaugguuuuuugaggcuggaaaggag

SEQ ID NO: 166936 - RNA, 49 nt, Homo sapiens
cuucauuguauuuuagagaaaucuguuucgcugugaaugcauaaaggcu

SEQ ID NO: 166937 - RNA, 59 nt, Homo sapiens
gugcugaauuuuccaaggagccuaguuacuacauugucuaaaacuaagaaagagcagac

SEQ ID NO: 166938 - RNA, 37 nt, Homo sapiens
agaccuagagaaaacaacuuguucagugacacuucgu

SEQ ID NO: 166939 - RNA, 53 nt, Homo sapiens
gggcugccuuccuuucaccuggggaaggauuuggcuuuggggagguaagagcu

SEQ ID NO: 166940 - RNA, 24 nt, Homo sapiens
cauggaauuaaaaauagggcagaa

SEQ ID NO: 166941 - RNA, 58 nt, Homo sapiens
gggcuccagucuuuagcagcgguaacagcagccaaagccagacuuuauagcaggaggu

SEQ ID NO: 166942 - RNA, 51 nt, Homo sapiens
uaaucuuuguuucuucuguuggagggauuggaaaacagguuucagaaggaa

SEQ ID NO: 166943 - RNA, 45 nt, Homo sapiens
cccggcggcucaggcggagcggcccguggcgcuguuuuucugagu

SEQ ID NO: 166944 - RNA, 38 nt, Homo sapiens
gccauccugaagcgaggguaggaggacagggaggaguc

SEQ ID NO: 166945 - RNA, 17 nt, Homo sapiens
cccaaagcccuguggga

SEQ ID NO: 166946 - RNA, 42 nt, Homo sapiens
agucacaggauuccugcgacaaguaaugaguuauacacauaa

SEQ ID NO: 166947 - RNA, 44 nt, Homo sapiens
aguccagcuucuuucucuauaaaacagccaaaagaacuauguag

SEQ ID NO: 166948 - RNA, 46 nt, Homo sapiens
gaggggggcccagaauggcagcugcggcugggaauuaggccagcag

SEQ ID NO: 166949 - RNA, 49 nt, Homo sapiens
ccugccucauccacagcaaagaccucuccccagcuuccuuggggugccg

SEQ ID NO: 166950 - RNA, 45 nt, Homo sapiens
acuccaaugaaugggaaggacggggaggucugggguugagucuag

SEQ ID NO: 166951 - RNA, 58 nt, Homo sapiens
agaaguaucacuuguccaguggagaaaugucaggcaccgugcuuggcucugggaacgu

SEQ ID NO: 166952 - RNA, 66 nt, Homo sapiens
uguugggggauaagagaaacacaguuccugauuucaggacgcuuacauucuagcaggugggcagga

SEQ ID NO: 166953 - RNA, 50 nt, Homo sapiens
ggguaaggagcagaaagccuguuucuuaaaauagucuuccaagaccuaaa

SEQ ID NO: 166954 - RNA, 39 nt, Homo sapiens
uucagaacauugggccggagaauucacuuaaugacugag

SEQ ID NO: 166955 - RNA, 41 nt, Homo sapiens
cagcuuccugucuuuacaccaaaauaaaguauugacacaag

SEQ ID NO: 166956 - RNA, 35 nt, Homo sapiens
uuaaguauuugaguuugaacagauuagcucugggg

SEQ ID NO: 166957 - RNA, 36 nt, Homo sapiens
gcuccuguucagcaccucagucguccacaccaagug

SEQ ID NO: 166958 - RNA, 30 nt, Homo sapiens
agacucucccuucccuuccuuugcccaggu

SEQ ID NO: 166959 - RNA, 66 nt, Homo sapiens
uuuucuauuccauacuucugcccacguuguuuucucucaaaauccauuccuuuaaaaaauaaaucu

SEQ ID NO: 166960 - RNA, 48 nt, Homo sapiens; identical to SEQ ID NO: 152823

SEQ ID NO: 166961 - RNA, 55 nt, Homo sapiens
ccaugcccccaauuccaagaaaacggcaaaaaauuagcccaucccauuccucauc

SEQ ID NO: 166962 - RNA, 69 nt, Homo sapiens
gugaagaguuguuccuacaacuugcuaaccuaguggacaggguaguagauuagcaucauccggauagau

SEQ ID NO: 166963 - RNA, 39 nt, Homo sapiens
uccccuucauagcuuuaaaagguuuucgcacugcgugca

SEQ ID NO: 166964 - RNA, 84 nt, Homo sapiens
gcaggacugccaacuucucgagcaguguuugcuggaagggaagaaagcuggcagccuaagccgugggaggguuccagucgagaa

SEQ ID NO: 166965 - RNA, 51 nt, Homo sapiens
guuuccagccgggccgggaggagaucuugccagccuuccaguggggaguug

SEQ ID NO: 166966 - RNA, 42 nt, Homo sapiens
ggagugcgcuacucaggcgcuggagaaauacaacauagagaa

SEQ ID NO: 166967 - RNA, 46 nt, Homo sapiens
agguaaccaugugcgaccgaaaggccgugaucaaaaaugcggacau

SEQ ID NO: 166968 - RNA, 35 nt, Homo sapiens
cggccuuucggucgcacaugguuaccuagugggca

SEQ ID NO: 166969 - RNA, 27 nt, Homo sapiens
ucgcgcggcgaggggcggggccggcgg

SEQ ID NO: 166970 - RNA, 48 nt, Homo sapiens
cugcuauugccagcucucaacccaagucagugaauugucaaccugcau

SEQ ID NO: 166971 - RNA, 49 nt, Homo sapiens
ugcucgcuucauuugccuuguuuacucauccugcccuguaaugucugua

SEQ ID NO: 166972 - RNA, 52 nt, Homo sapiens
cagcacugguuuggaccguuacucugcacauggaccagaaaaaguauauggg

SEQ ID NO: 166973 - RNA, 47 nt, Homo sapiens
ugguaaccauacucuauuccauaacccucaugugaauccacuuccaa

SEQ ID NO: 166974 - RNA, 45 nt, Homo sapiens
agagcacgagagacccgaguucaucgccuacccccaucuccgcau

SEQ ID NO: 166975 - RNA, 46 nt, Homo sapiens
uacccaggccccuacaaaggcuucagaguagauaucucugccaaca

SEQ ID NO: 166976 - RNA, 44 nt, Homo sapiens
ccgaaaauggcacagaaaugguaucaagaaaccccgaucacaaa

SEQ ID NO: 166977 - RNA, 44 nt, Homo sapiens
acagagucauccucugcaggcagggaagugugaaguuuggaggg

SEQ ID NO: 166978 - RNA, 41 nt, Homo sapiens
gaucuggaagugaaugauaaagcucccgcccaggcucggcc

SEQ ID NO: 166979 - RNA, 38 nt, Homo sapiens
aaaguuaguuugggaauuuauccauuuuggaggcaaac

SEQ ID NO: 166980 - RNA, 44 nt, Homo sapiens
uaacaucauuaaggagaaagcagcucugggacagaguuucaaau

SEQ ID NO: 166981 - RNA, 38 nt, Homo sapiens
ccaccuggaaaugccacccauuguguuucuuuucuguc

SEQ ID NO: 166982 - RNA, 48 nt, Homo sapiens
aguucaaguuguggauuugcuuuuccuuuuauucuuauaaccuucagu

SEQ ID NO: 166983 - RNA, 43 nt, Homo sapiens
cuauccacaccccacugagagagaaacugcuagcggugaaaac

SEQ ID NO: 166984 - RNA, 48 nt, Homo sapiens
cgugucccauccaagcccuuuaaagccucagcuacccauuuuccuuca

SEQ ID NO: 166985 - RNA, 43 nt, Homo sapiens
agagaucuccaagcccucaaaucgggagaugaaguccuucagg

SEQ ID NO: 166986 - RNA, 91 nt, Homo sapiens
gagccccaucaaucaaguagggcagauugggaaaguccaggcccagcuugaauuuuucauucagccacuggcuucugucauagucaggagc

SEQ ID NO: 166987 - RNA, 45 nt, Homo sapiens
uucuuuuccucauagcuuaagucuguguauugcaggagcaggcag

SEQ ID NO: 166988 - RNA, 35 nt, Homo sapiens
cugccugcuccugcaauacacagacuuaagcuaug

SEQ ID NO: 166989 - RNA, 50 nt, Homo sapiens
uuggguaaaucgaggcuggaaaacuuaaguuuacaaagcugaguuaagug

SEQ ID NO: 166990 - RNA, 43 nt, Homo sapiens
gcgccgccggcccccgaguacuaccccgaggaggaugaagagc

SEQ ID NO: 166991 - RNA, 44 nt, Homo sapiens
ggcggcgcuccagccugggccggggccggggccagcagccccgc

SEQ ID NO: 166992 - RNA, 38 nt, Homo sapiens
uguccgugggccacgcucagcugcggucagaggcgaca

SEQ ID NO: 166993 - RNA, 42 nt, Homo sapiens
cagaccuuuugugauuaaauuuaucucugaauuguucccuau

SEQ ID NO: 166994 - RNA, 43 nt, Homo sapiens
cuuugcuuuuucugcacuaugauuacugcuacugacaggaacg

SEQ ID NO: 166995 - RNA, 44 nt, Homo sapiens
acacaguuugaaagugugaauaaugcaauauuuaugaccaagaa

SEQ ID NO: 166996 - RNA, 56 nt, Homo sapiens
agaggcuggcauugaggcuaaccuccaacacagugcaucucagaugccucaguagg

SEQ ID NO: 166997 - RNA, 68 nt, Homo sapiens
uagcaacccagaauguaaaaaagaaaaaacuggggggaaaaagaccaggucuacagugauagagcaaa

SEQ ID NO: 166998 - RNA, 42 nt, Homo sapiens
aauaauuugaugaccccaucacaguaccaaaauaccccccaa

SEQ ID NO: 166999 - RNA, 47 nt, Homo sapiens; identical to SEQ ID NO: 152616

SEQ ID NO: 167000 - RNA, 46 nt, Homo sapiens
uuucuucauaauauccaaauacuggaaacaucccaaaugcccauca

SEQ ID NO: 167001 - RNA, 49 nt, Homo sapiens
uucccguuggugaacaggccaguuuguuuagccauucucuauugauggg

SEQ ID NO: 167002 - RNA, 27 nt, Homo sapiens
uuucugaaaaagucuagcuggguauau

SEQ ID NO: 167003 - RNA, 43 nt, Homo sapiens
uuucugaaauguuuuaaagaaacucaaagaucaccccgggcaa

SEQ ID NO: 167004 - RNA, 61 nt, Homo sapiens
ggauggucuugauucagggaagcucuacaccuugguccugacagacccggaugcucccagc

SEQ ID NO: 167005 - RNA, 76 nt, Homo sapiens
aagcccgggaaaagugaaugaauuucugccgcaggccgaaccugccuggccacgccacaggccggguucccggugc

SEQ ID NO: 167006 - RNA, 108 nt, Homo sapiens
gacagcuccuaggguccuguccucacugaagcacuuaugccggaaagcccuucgaaguuuccuaacaacuuaccaaguccuagcacugccaauccccaagaaaaugaa

SEQ ID NO: 167007 - RNA, 75 nt, Homo sapiens
acuuuuuaagcaacaccacaucuugugcuucuuuguagcaggguaaaucguccugucaaagggaguugcuggaau

SEQ ID NO: 167008 - RNA, 105 nt, Homo sapiens
aguccaguuaugaacagcaaguguugaacucuuucugcuuguuuugauucaaagugcaguuacugauguuguuuugauuaugcaacuaaguaggccuccagagcc

SEQ ID NO: 167009 - RNA, 53 nt, Homo sapiens
ccuccgcugggaacgauggcuucugccuaguaccuauccuuguguuucugaug

SEQ ID NO: 167010 - RNA, 81 nt, Homo sapiens
ugaccgauccagacacuauuacuggcuuuuuuuuuuuuuuuuuaacaauggugugcaugugcaggaaaugacaaauuugua

SEQ ID NO: 167011 - RNA, 68 nt, Homo sapiens
cagauggcuacugaguuaucaguggccauuuauuagcaucauauuuauuuguauuuucucaacagaug

SEQ ID NO: 167012 - RNA, 62 nt, Homo sapiens
ucuaccaccuuuguugcuugaagaaaaacaugucuuuucaaaaugagaggcuuucauugaag

SEQ ID NO: 167013 - RNA, 45 nt, Homo sapiens
gccaaauauuagaaucauaaauguaauuuuggagauaauguuuac

SEQ ID NO: 167014 - RNA, 43 nt, Homo sapiens
augcagugccaaccccuucagaguuuucaacucuguaauaucu

SEQ ID NO: 167015 - RNA, 42 nt, Homo sapiens
aggcuaggaugguagaugucuugccugucccugggggaccgu

SEQ ID NO: 167016 - RNA, 39 nt, Homo sapiens
ggcuugcagacagcugcccucugaucgugaccucacgug

SEQ ID NO: 167017 - RNA, 42 nt, Homo sapiens
ccuugacugguccuccacuguagaacccaggugcccuugaag

SEQ ID NO: 167018 - RNA, 63 nt, Homo sapiens
ggaggcagggagaggggaaggaaggaggaagauaaggaaggaggggagguaggaagaagggaa

SEQ ID NO: 167019 - RNA, 39 nt, Homo sapiens
agggaguaaaggaagaaggaagggagagggggacagaaa

SEQ ID NO: 167020 - RNA, 53 nt, Homo sapiens
ugauggcaaguaauuuaaaauauuuuucacauuaaaacaaauacauuguggaa

SEQ ID NO: 167021 - RNA, 43 nt, Homo sapiens
agccaaagucauaaaauaaaccuguaggaaaaaguaauaagcu

SEQ ID NO: 167022 - RNA, 51 nt, Homo sapiens
ucuuuuggccuggacaauugaaauauaucugcucucaggggagacgcccac

SEQ ID NO: 167023 - RNA, 44 nt, Homo sapiens
cguagaaugucuucauucucuuguacguggaguguggauaaggu

SEQ ID NO: 167024 - RNA, 41 nt, Homo sapiens
gacaguuagcuagacagacagagagauagauauagauauau

SEQ ID NO: 167025 - RNA, 103 nt, Homo sapiens
cagcaugcucugcacggcucagucggaggccggggggccuggguuuuguuuccucagugucacccgucccugugggcuucuucaaaugaaucccuggaggaca

SEQ ID NO: 167026 - RNA, 45 nt, Homo sapiens
ccacuaaucaccuuccccucauuuuucaauaaagauucugagccc

SEQ ID NO: 167027 - RNA, 46 nt, Homo sapiens
aaaacaguuucucagugguacaccaguauaauuuuucacggcuggc

SEQ ID NO: 167028 - RNA, 52 nt, Homo sapiens
cagaauuuguucuacccuugucugagacugcaccucccaucuccaaagagac

SEQ ID NO: 167029 - RNA, 41 nt, Homo sapiens
cugggcaccacgaugguggcggggacgccgaguugccuggc

SEQ ID NO: 167030 - RNA, 64 nt, Homo sapiens
uuugcuuuucuauuucuacacggcauuguauuaucuucuauuaauggaaaauucuaggcagagg

SEQ ID NO: 167031 - RNA, 44 nt, Homo sapiens
uggguggaugggugauagauagauaagaacuucguaagccaugc

SEQ ID NO: 167032 - RNA, 51 nt, Homo sapiens
gcugugcagauggaugaugggugaguauguuggcagaugaaugaauggaca

SEQ ID NO: 167033 - RNA, 54 nt, Homo sapiens
gcuucuccuuccugaggguuugggaagguccuggggcagacucuggggcuccca

SEQ ID NO: 167034 - RNA, 37 nt, Homo sapiens
cagagcagggacagaacuucagucccaugaaaccuug

SEQ ID NO: 167035 - RNA, 42 nt, Homo sapiens
ugucaagguuucaugggacugaaguucugucccugcucugcu

SEQ ID NO: 167036 - RNA, 58 nt, Homo sapiens
gaagggacagguuggggcaaagcugauggcggggcaggaaucacagucggaauugggc

SEQ ID NO: 167037 - RNA, 94 nt, Homo sapiens
acuuccuccaugacccucugucacugugcaaagccugcaacccccagcccaauggggagaaugcuaucuccgcccgcuccgaccucaacccggc

SEQ ID NO: 167038 - RNA, 47 nt, Homo sapiens
ccagucacugguacaagacauggacuccauggucaggcugaugaggu

SEQ ID NO: 167039 - RNA, 72 nt, Homo sapiens
agugggcugcaggcccuaguggcccaguauggggacugguuuucuuaugacgggagcccccgggcccagauc

SEQ ID NO: 167040 - RNA, 22 nt, Homo sapiens
cuguucccaucucacagaugau

SEQ ID NO: 167041 - RNA, 28 nt, Homo sapiens
ucuugucagccaccaccaccaugccgcu

SEQ ID NO: 167042 - RNA, 45 nt, Homo sapiens
ugggcccagccccgggagccgggugcuuaccauccuggagcagau

SEQ ID NO: 167043 - RNA, 41 nt, Homo sapiens
ccuuguaguccacgaucauccacugguuguuauaccugccg

SEQ ID NO: 167044 - RNA, 49 nt, Homo sapiens
uagggagccacagaauauucuggaacagucaagcagcaugacgagagag

SEQ ID NO: 167045 - RNA, 42 nt, Homo sapiens
uacaggaagagcacuuggaaccugaagacucucaaggggaca

SEQ ID NO: 167046 - RNA, 28 nt, Homo sapiens
guacugccaccaaggcaccccuuccuag

SEQ ID NO: 167047 - RNA, 24 nt, Homo sapiens
ucaagagguucaacagcggcacgu

SEQ ID NO: 167048 - RNA, 44 nt, Homo sapiens
cugcagcucucuggggaccuggaagaccuggagcuggcccugaa

SEQ ID NO: 167049 - RNA, 84 nt, Homo sapiens
gcaagauggauggguggguuguuggaugaauggauggguggguggauguauguauguaugggugggugaguggguugacaggug

SEQ ID NO: 167050 - RNA, 67 nt, Homo sapiens
uccucucccugcccagcucugccccggauagggaccccaggccccuggaaguugcccugagagccuu

SEQ ID NO: 167051 - RNA, 43 nt, Homo sapiens
ggugccaucaguuauaggcuuugcaggcuaaaggcucucaggg

SEQ ID NO: 167052 - RNA, 30 nt, Homo sapiens
gaaauucacuggggucacagaaagcacugu

SEQ ID NO: 167053 - RNA, 45 nt, Homo sapiens
cucggugcuccuggacgucucggcgggccagcugcuuauggugga

SEQ ID NO: 167054 - RNA, 46 nt, Homo sapiens
agaagaagcgguuugugggacagucaggacaggaagacaagaagaa

SEQ ID NO: 167055 - RNA, 44 nt, Homo sapiens
agcggcgccgggcccagaagcugcacuuccugcagcgugguggc

SEQ ID NO: 167056 - RNA, 45 nt, Homo sapiens
cagcagggcgccuucggccggggugcccgcuccaagaagggcaag

SEQ ID NO: 167057 - RNA, 42 nt, Homo sapiens
ggaggccuaguuugggccgauguauuuuaaagcagaguggac

SEQ ID NO: 167058 - RNA, 54 nt, Homo sapiens
ccccauccucuccaccaaaucgcucccaauuuugagagccaaaggcuggcgcuu

SEQ ID NO: 167059 - RNA, 44 nt, Homo sapiens
uacuugcccccaggcuggaagagaagagacagaaagaccccaug

SEQ ID NO: 167060 - RNA, 73 nt, Homo sapiens
ggcagcugggaugaagagagauggcaugucaggcuggccccgaaucauagcucccugagagggccaagcagag

SEQ ID NO: 167061 - RNA, 54 nt, Homo sapiens
ccaggggauugaugauguugcagauggcuaggaagcagacuccaggauggaauu

SEQ ID NO: 167062 - RNA, 45 nt, Homo sapiens
guggagacccaaaggguuggaggcagcuggcacaagaggcugagg

SEQ ID NO: 167063 - RNA, 24 nt, Homo sapiens
ccagcucggggaggggguggaguu

SEQ ID NO: 167064 - RNA, 46 nt, Homo sapiens
ccagaaaacauugugcccucuuucuccccugggccuucagggagau

SEQ ID NO: 167065 - RNA, 45 nt, Homo sapiens
uuaccuggaugauacuaagcaggaaacagcuaaugggcccaccuc

SEQ ID NO: 167066 - RNA, 49 nt, Homo sapiens
acugcaaccaaccaugugacagaggggauuccuagacuggauucccagc

SEQ ID NO: 167067 - RNA, 70 nt, Homo sapiens
gccugagcaauucacacccuguggaggagagcaucauuaucccaugugaauucugugggguacagcugga

SEQ ID NO: 167068 - RNA, 63 nt, Homo sapiens
cugaugucaucuuccagaacuucuugcaacaggcugcaaguaaccaguuagacucuuugaugg

SEQ ID NO: 167069 - RNA, 55 nt, Homo sapiens
aggugacagcuaggcugagaccaaaggauggggagcuggccuugugaagaccugc

SEQ ID NO: 167070 - RNA, 62 nt, Homo sapiens
guccaggccccaggcuccccuccaggccccgcgauugccaccaugaagcugaacgagcgcag

SEQ ID NO: 167071 - RNA, 42 nt, Homo sapiens
gcgcugucuggagcacugaggccaccuucaggccuggacccg

SEQ ID NO: 167072 - RNA, 46 nt, Homo sapiens
cugggguguuaaccccaguccuggcguagguuuacagacucucaag

SEQ ID NO: 167073 - RNA, 51 nt, Homo sapiens
aacuaaugaguggggcuggauuugacccagggccgaugggauuuggccuac

SEQ ID NO: 167074 - RNA, 41 nt, Homo sapiens
ggcuggccuuggaaauguucuuuggacauggacguugggau

SEQ ID NO: 167075 - RNA, 41 nt, Homo sapiens
gucggcggccauuuuguucuucucgugguuccaguggggag

SEQ ID NO: 167076 - RNA, 30 nt, Homo sapiens
accaccgccucugcucguggcgugggaaag

SEQ ID NO: 167077 - RNA, 30 nt, Homo sapiens
gccgcugcgggagggucggcggugggaagg

SEQ ID NO: 167078 - RNA, 46 nt, Homo sapiens
ugagaggguccaagccugguaagaauguccagcuucaggagaauga

SEQ ID NO: 167079 - RNA, 80 nt, Homo sapiens
acgaucugccucuuacuggccuacaaaauaaaauauccugagaauuuuuuucuucucagagggaaccaugaaugugccag

SEQ ID NO: 167080 - RNA, 27 nt, Homo sapiens
uuuaccgauagcagccaucguggauga

SEQ ID NO: 167081 - RNA, 514 nt, Homo sapiens
gguuugaaaauagagcagaaaauuuuuauuuuuauuuuauuuuuuguaaggaugaguucucaccacguugcccagucuggucacaaauuccugggcucaagcaguccuccugccucggacuuccaaagugcuggguuacagguguaagccacugugcccggcuuagaaaaguuuuugguuuuuuuuguuuuuguuuuuguuuuuugagacagagucucgcucucucacccaggcuggagcgcaguggcaccaucucggcucacugcaagcucugccucccagguucacgccauucuccugccucagccuccugaguagcugggacugcagccacccgccaccacgcuuggcuaauuuuuuguauuuuuaguagagacggggcuucaccguguuagccaggauggucucaaucuccugaccucgugaucugcccgccucggccucccaaagugcugggauuacagacuugagccaccacgcccggcagaagaguguuuuuaacuauaaaaugaac

SEQ ID NO: 167082 - RNA, 42 nt, Homo sapiens
cucugugcuucuguacuuagguuuugguagaguuggauacau

SEQ ID NO: 167083 - RNA, 45 nt, Homo sapiens
ucuauggagcagauucggcgaauuaugcgaccaacugauguacca

SEQ ID NO: 167084 - RNA, 45 nt, Homo sapiens
ggugccaugaugaguguggaugaaacacuaauguguucuuuucag

SEQ ID NO: 167085 - RNA, 45 nt, Homo sapiens
ugaguauauuuccuaaauuaacugucuuuugaaucuccagauuuu

SEQ ID NO: 167086 - RNA, 59 nt, Homo sapiens
aaagccugcagagaaaaagaagccaaaugccacgagaccuguaacgccuccaaggggua

SEQ ID NO: 167087 - RNA, 45 nt, Homo sapiens
cauuaaguaaucuuuuuacaguugcaucaggccugaacccgucca

SEQ ID NO: 167088 - RNA, 50 nt, Homo sapiens
cuacauucuuuauucugcggugaaguugaggcuuauaaguuaaaacaaag

SEQ ID NO: 167089 - RNA, 45 nt, Homo sapiens
auacagaacucacaguaccuaugacuuuuuuaaacuaagaucugu

SEQ ID NO: 167090 - RNA, 30 nt, Homo sapiens
agagugaaaucaagcauucuaaagugauuc

SEQ ID NO: 167091 - RNA, 48 nt, Homo sapiens
ggaguuuuuugaauuuagcuggcaaacuguugcaccggugugggaugu

SEQ ID NO: 167092 - RNA, 45 nt, Homo sapiens
agucauaacucucuuuggugcaaagguuuccugugcagagaaugu

SEQ ID NO: 167093 - RNA, 46 nt, Homo sapiens
uauuuucaugcucaaaugcuucaaauuugugugugugucccgagau

SEQ ID NO: 167094 - RNA, 71 nt, Homo sapiens
uccauguaccaaugauaguuauguaagaaaauuuacauguaacauauacuuguacuucuagcuagauacaa

SEQ ID NO: 167095 - RNA, 68 nt, Homo sapiens
cuggcuucucgccccuccgaagccguucggacacugcccgaacagcuucgggagagcggggcgggcag

SEQ ID NO: 167096 - RNA, 28 nt, Homo sapiens
ucucauaguucucauccuucuaacccag

SEQ ID NO: 167097 - RNA, 43 nt, Homo sapiens
caacaucaugacaaaaauggaucugcugaguaaaaaagcaaaa

SEQ ID NO: 167098 - RNA, 49 nt, Homo sapiens
auaaagaugccauugcuauacuugaugggaucccuucaagacaaagaac

SEQ ID NO: 167099 - RNA, 43 nt, Homo sapiens
cagauaaacaugaugcuggcaaaccuguacaagaaggcugguc

SEQ ID NO: 167100 - RNA, 47 nt, Homo sapiens
auguuuacugucaaagauaguaguucucaaucuugccuguacauuag

SEQ ID NO: 167101 - RNA, 64 nt, Homo sapiens
gagguggcauccaugacaaugaaugugauccaaaccgugccuaacuuggacuggcucucugugu

SEQ ID NO: 167102 - RNA, 46 nt, Homo sapiens
agcuggagacaauaaaaacucuguccucaaguuugaacaggcacag

SEQ ID NO: 167103 - RNA, 55 nt, Homo sapiens
uagcaggagcauugcaguaaucuuggcuugagaggaauuuucaugggaaucugaa

SEQ ID NO: 167104 - RNA, 46 nt, Homo sapiens
ucugcuacuuaagggagcagcacuuaggaacaugggcagaguccaa

SEQ ID NO: 167105 - RNA, 46 nt, Homo sapiens
guuacuuagccuccaacaguauucgagaagcaaugguaauggcuaa

SEQ ID NO: 167106 - RNA, 42 nt, Homo sapiens
gccaaaacauuauuagauaaagcccugacccaaaggccagau

SEQ ID NO: 167107 - RNA, 49 nt, Homo sapiens
ggagaaggaggagagucccacggaugccacucaggaggaggauguggac

SEQ ID NO: 167108 - RNA, 34 nt, Homo sapiens
aagaaauggcagguccccugugagauaacccaga

SEQ ID NO: 167109 - RNA, 41 nt, Homo sapiens
cuucuugguauuucccuccaggucaaaauccuagacccuga

SEQ ID NO: 167110 - RNA, 58 nt, Homo sapiens
cuguggucgccccguccgcuguggcgggaaagcggcccccagaaccgaccacaccgug

SEQ ID NO: 167111 - RNA, 31 nt, Homo sapiens
aggugggucccgacaccgugccgagaaccac

SEQ ID NO: 167112 - RNA, 32 nt, Homo sapiens
acccuuuccagcaggcauccuuaucacuuuac

SEQ ID NO: 167113 - RNA, 43 nt, Homo sapiens
agagagaugugaccggccgaauacacagcagacgggcuccggg

SEQ ID NO: 167114 - RNA, 40 nt, Homo sapiens
ccggucgccagcgcugcgccccgcgggcucucggggcccg

SEQ ID NO: 167115 - RNA, 43 nt, Homo sapiens
aucucagcaacauuaacaucaaaacuguacugcgucaggacag

SEQ ID NO: 167116 - RNA, 51 nt, Homo sapiens
aagagagaaggaguuaauaagauggccagguuuaaguguuuaauagaggaa

SEQ ID NO: 167117 - RNA, 43 nt, Homo sapiens
gaaaagauaaaugcaaaaaagggggacucucuccuccgcgggu

SEQ ID NO: 167118 - RNA, 36 nt, Homo sapiens
ucauccucggaggaugaggaggagguaguggccagg

SEQ ID NO: 167119 - RNA, 41 nt, Homo sapiens
gccggagcccccuaugaugcuccccuugccgcugcaaccac

SEQ ID NO: 167120 - RNA, 29 nt, Homo sapiens
gccccaccacccagucuguagcagcccgc

SEQ ID NO: 167121 - RNA, 43 nt, Homo sapiens
gaagaaagaagcacguaauuccaggcagggaaaaugcgaugga

SEQ ID NO: 167122 - RNA, 42 nt, Homo sapiens
cacgccuccacccgggcaggcucggagcggcguucggagcag

SEQ ID NO: 167123 - RNA, 62 nt, Homo sapiens
auagucaucuacucgaagcagcacauuaacgucaaugaggagauuaccuaugacuauaaguu

SEQ ID NO: 167124 - RNA, 47 nt, Homo sapiens
uuaaaaacacaaaucuaagccuugacgguuuuuuuuucccuuuugac

SEQ ID NO: 167125 - RNA, 30 nt, Homo sapiens
acuagaccucccucuccccaggagccccag

SEQ ID NO: 167126 - RNA, 49 nt, Homo sapiens
cccucuauuaaauuuuaucauaucuucugacuucuaggaauguagccca

SEQ ID NO: 167127 - RNA, 46 nt, Homo sapiens
gagucugaauauccaauuauguguuccuuucuaggugggacuucag

SEQ ID NO: 167128 - RNA, 49 nt, Homo sapiens
aucagacacaucaagaagcuaacuccaaggggucugaugacugcccaag

SEQ ID NO: 167129 - RNA, 46 nt, Homo sapiens
aaugaaagaucugcagcauguauaauguuaucaaaggaaccauagc

SEQ ID NO: 167130 - RNA, 45 nt, Homo sapiens
caggauaagaagcuuguuaaagaacucaccccgaaaccagcagaa

SEQ ID NO: 167131 - RNA, 61 nt, Homo sapiens
cagugucguaccaaacugugacaucagcaaugggggcagccagaagcucuuuccugcagac

SEQ ID NO: 167132 - RNA, 52 nt, Homo sapiens
gaagucuggcaacaagaggucuucaucucacucuagcccagguaguccaaag

SEQ ID NO: 167133 - RNA, 72 nt, Homo sapiens
uugguuccauaccaaugcaggcaugucagcagaaggauguguuugccaauuaccuuacuucuaacuuccaag

SEQ ID NO: 167134 - RNA, 82 nt, Homo sapiens
agcaaaaucucaaaacaugacauuuuccaaauacauguguuuuuuuuuuccuucucuuuucaucauuaggaauggaggaucu

SEQ ID NO: 167135 - RNA, 47 nt, Homo sapiens
cucaaaauuggucaacuauccugguuuuaauauaucuacucccagag

SEQ ID NO: 167136 - RNA, 25 nt, Homo sapiens
cacuguuucaauugugguucugaag

SEQ ID NO: 167137 - RNA, 47 nt, Homo sapiens
uagaauuuuauugauuugcuuuucuauuuuuauugacauuauaaaaa

SEQ ID NO: 167138 - RNA, 42 nt, Homo sapiens
augauaacuauuccuuaauaaaauucacuaaagguaccauca

SEQ ID NO: 167139 - RNA, 45 nt, Homo sapiens
gccuugauaaauuggggcaaccgcuucuaaaugaaaacccucagc

SEQ ID NO: 167140 - RNA, 39 nt, Homo sapiens
gcauuacuggaaauguucaagagagagggcagugucauu

SEQ ID NO: 167141 - RNA, 42 nt, Homo sapiens
guggagaggaggacugagaccuagggcacucuaauacaugga

SEQ ID NO: 167142 - RNA, 39 nt, Homo sapiens
uuggacgcagaauaugagagcaaaagagucaucggagug

SEQ ID NO: 167143 - RNA, 46 nt, Homo sapiens
agcugaaaaccaguuaggaaguuauuguauucaacucaggugagag

SEQ ID NO: 167144 - RNA, 46 nt, Homo sapiens
aaauuuaguaaaaagauuugaggaacagcagaaaaaugauguggaa

SEQ ID NO: 167145 - RNA, 32 nt, Homo sapiens
uauuggugaacgauacuaaguuagauggaccu

SEQ ID NO: 167146 - RNA, 63 nt, Homo sapiens
aucucaaaauuauaaaaucagaccacucguuugcugaguuccccuucuaccccuuguacugag

SEQ ID NO: 167147 - RNA, 84 nt, Homo sapiens
cucugguaaccaucauagcucuaguuccauuuauguuauuggcccgaaguguuuaguggccacagcaauaacaagaagacuaag

SEQ ID NO: 167148 - RNA, 46 nt, Homo sapiens
aagauacaggcaugcagcuuaagugauggguuuauuauuguagccg

SEQ ID NO: 167149 - RNA, 63 nt, Homo sapiens
uggccuucaaggagcuuaguuuggggagauaagcuucaacaguuuaguuggggagacaagaca

SEQ ID NO: 167150 - RNA, 42 nt, Homo sapiens
gugauuaaggcuguaauuaagauaugacugaaguugauuaga

SEQ ID NO: 167151 - RNA, 171 nt, Homo sapiens
aauuuucccucuuuuuuuuuuuuuuuuuuuuuuuaaauagggucuuaccauguugcccaggcugggcucgaacuccugggcucaaaugguuguccugccucggccuccugagcaggcuggcacuacaucuagcuucuagacugaacaauauuuuacugugcaaauauacca

SEQ ID NO: 167152 - RNA, 37 nt, Homo sapiens
cagaaaugguucccauaccugcuaauaaucugguuca

SEQ ID NO: 167153 - RNA, 45 nt, Homo sapiens
ugugagauaaaugugaauguguauagacaugugaaauguaaugau

SEQ ID NO: 167154 - RNA, 28 nt, Homo sapiens
ucuuggauugaauuucuaaauaaugaag

SEQ ID NO: 167155 - RNA, 46 nt, Homo sapiens
acaaacuaauggagaugaaaaaacuuuuacgaggcuauggaauaag

SEQ ID NO: 167156 - RNA, 46 nt, Homo sapiens
aggacgaaugugaagaaauguugaaacuauuuaaagagguugcuag

SEQ ID NO: 167157 - RNA, 50 nt, Homo sapiens
auucacaguguugugcagccaucaccucuaucuacuuuuucaugacccug

SEQ ID NO: 167158 - RNA, 46 nt, Homo sapiens
ggcuguagagcuuuccagacaaugccaaauggaugacuguggaauc

SEQ ID NO: 167159 - RNA, 44 nt, Homo sapiens
caucaaucaaagaauucagaauucaucuggcacagauuauccug

SEQ ID NO: 167160 - RNA, 45 nt, Homo sapiens
auuaauuuggaaaaagucugggacauguuguuggaaaaauggcua

SEQ ID NO: 167161 - RNA, 22 nt, Homo sapiens
uauaauuaucaaaaucagaaau

SEQ ID NO: 167162 - RNA, 43 nt, Homo sapiens
uuuggaaguccaaaauggacauuuaaaacaaacuggccuaaua

SEQ ID NO: 167163 - RNA, 46 nt, Homo sapiens
ggaagagcauaugaacacgggccagcuagcaggauuuucacaucaa

SEQ ID NO: 167164 - RNA, 40 nt, Homo sapiens
uugccccauaaagaacucauguccugaauuaauaagucuu

SEQ ID NO: 167165 - RNA, 45 nt, Homo sapiens
ggcugagcagaacaggaugaugcccaggggcaggaagaacuccag

SEQ ID NO: 167166 - RNA, 52 nt, Homo sapiens
agaagcagaaugggaacccgggcagccugguuccuggcccugccauucaccc

SEQ ID NO: 167167 - RNA, 45 nt, Homo sapiens
aggagcuagaagaacuggaagaagaggaggaggagcuggaucuug

SEQ ID NO: 167168 - RNA, 38 nt, Homo sapiens
ugaucggugccacugguccagcgaggggcccggcagag

SEQ ID NO: 167169 - RNA, 45 nt, Homo sapiens
gucuccguucagcaaggaauaggcagguccccuaaugccagagga

SEQ ID NO: 167170 - RNA, 47 nt, Homo sapiens
uaggcccccggggaacgcaggcccuauaacuccugcuaaggggaccu

SEQ ID NO: 167171 - RNA, 46 nt, Homo sapiens
augcuauucuuacacuugcuauuuuauacuucaaauggccacauau

SEQ ID NO: 167172 - RNA, 46 nt, Homo sapiens
cuuaaguucauuaagggaaguugcaaagauugucaaacagagggca

SEQ ID NO: 167173 - RNA, 33 nt, Homo sapiens
gcuggaggaaaccuguagccuagggugagauaa

SEQ ID NO: 167174 - RNA, 24 nt, Homo sapiens
auaaugccugaccguuuucauucu

SEQ ID NO: 167175 - RNA, 49 nt, Homo sapiens
augugauuuuuaaauuaguguacaaauguguaaauacuguuugagagca

SEQ ID NO: 167176 - RNA, 30 nt, Homo sapiens
gccaggcggucaggcgguuugggguguccg

SEQ ID NO: 167177 - RNA, 28 nt, Homo sapiens
guggcaugaacuaccuguuuuugugagg

SEQ ID NO: 167178 - RNA, 44 nt, Homo sapiens
acauaggaaauucuuuuuuuuuuuuuuuuuuuaaagaaaagaug

SEQ ID NO: 167179 - RNA, 45 nt, Homo sapiens
acuucucaguuaccuggauuuccaaaauaucccucacacacaaaa

SEQ ID NO: 167180 - RNA, 42 nt, Homo sapiens
ccagguccugacucuagauccuacguuacacaugaagccaaa

SEQ ID NO: 167181 - RNA, 35 nt, Homo sapiens
uccucagcuauuaauuucuuccccuuuucccagaa

SEQ ID NO: 167182 - RNA, 52 nt, Homo sapiens
cuggugaauuugaacauaauuuucuuggugaaaauaagguuucugaaguaua

SEQ ID NO: 167183 - RNA, 42 nt, Homo sapiens
uuucuuacccaaaucuauaacuuuuuauuuccagcauauaca

SEQ ID NO: 167184 - RNA, 27 nt, Homo sapiens
ggaauaugugaaauaaaacgagaaaag

SEQ ID NO: 167185 - RNA, 46 nt, Homo sapiens
agaguuugacuuggugaaaaccuuacacaaaacuucaucuucugua

SEQ ID NO: 167186 - RNA, 46 nt, Homo sapiens
gauauuucacaguucugaauguuagccacugaaaaugccaguagau

SEQ ID NO: 167187 - RNA, 30 nt, Homo sapiens
ggucgcgagaggccgcuugcaugacccuga

SEQ ID NO: 167188 - RNA, 32 nt, Homo sapiens
ucgccugucuccgucggaagggagcccaagcu

SEQ ID NO: 167189 - RNA, 64 nt, Homo sapiens
aagagagccgaccaggguguggcccgacaaugacugggagagagagagggacuucagagaugac

SEQ ID NO: 167190 - RNA, 49 nt, Homo sapiens
aucgcuuccccacagggaggccgcgcgccccgccccaaucccggccugg

SEQ ID NO: 167191 - RNA, 45 nt, Homo sapiens
aauuccuccguuuucaacaacuccuucagcaccaacuaugacaag

SEQ ID NO: 167192 - RNA, 45 nt, Homo sapiens
ucacccgacagcagcaucuagcaccacagugacagggacguugag

SEQ ID NO: 167193 - RNA, 47 nt, Homo sapiens
uaaguuaaugccaaacguuauguuaaaguuauuuuuucaaauacagg

SEQ ID NO: 167194 - RNA, 46 nt, Homo sapiens
uuccuuuaaacuuuauuuaaaacaaacaacagaguuaaucugucac

SEQ ID NO: 167195 - RNA, 66 nt, Homo sapiens
aaaagaaaaacaacuucuacaccuauucuacaguccgcauuuaaaacaauaaauuccucuauuaaa

SEQ ID NO: 167196 - RNA, 46 nt, Homo sapiens
aaugucaccaaacuaaguaggcuagaaaaacaguuguaggaaauau

SEQ ID NO: 167197 - RNA, 44 nt, Homo sapiens
cagcugggaggcucaggcuguggggcuggggggcuguccgcugg

SEQ ID NO: 167198 - RNA, 47 nt, Homo sapiens
ggauuuggcagaugacagggaccagcagcaggacgcagcccagcgcc

SEQ ID NO: 167199 - RNA, 44 nt, Homo sapiens
cugccacugaauggaggcucuccaggauggcggggccaccgggg

SEQ ID NO: 167200 - RNA, 44 nt, Homo sapiens
cguugaggaagugaggaugggagagaaacaagggggcaccuaga

SEQ ID NO: 167201 - RNA, 43 nt, Homo sapiens
aagaugcaaaccagcugagcuccggggcuggaugucagggcgg

SEQ ID NO: 167202 - RNA, 46 nt, Homo sapiens
auccugcugauguucuggacccccgugaacaccgugaagagcccag

SEQ ID NO: 167203 - RNA, 45 nt, Homo sapiens
aucucacccacagugcgguucaugaaggcacguucgccgagggug

SEQ ID NO: 167204 - RNA, 44 nt, Homo sapiens
cuguacacguagggcccgcgcucccgcaccugcggcuucucgcc

SEQ ID NO: 167205 - RNA, 46 nt, Homo sapiens
ugaacaggcagggguaucaaugggacccugggaacuuucugccuga

SEQ ID NO: 167206 - RNA, 45 nt, Homo sapiens
cacuugugggccagcagagcucaaggucauguccaaacaggggga

SEQ ID NO: 167207 - RNA, 37 nt, Homo sapiens
gcagaggccaccgggaccagcuguggagucggccccc

SEQ ID NO: 167208 - RNA, 43 nt, Homo sapiens
aucugucucccugguugaaagggcaaugguaugcaaaguuagg

SEQ ID NO: 167209 - RNA, 34 nt, Homo sapiens
gacggggacggcgacagagacgacacaggcgggg

SEQ ID NO: 167210 - RNA, 48 nt, Homo sapiens
uaagaccaucacccucgagguggagcccagugacaccaucgagaaugu

SEQ ID NO: 167211 - RNA, 46 nt, Homo sapiens
cuccaccucgagggugauggucuuaccagucagggucuucacgaag

SEQ ID NO: 167212 - RNA, 33 nt, Homo sapiens
agaguccacucugcacuugguccugcgcuugag

SEQ ID NO: 167213 - RNA, 46 nt, Homo sapiens
uguuucccagcaaagaucaaccucugcugaucaggagggaugccuu

SEQ ID NO: 167214 - RNA, 49 nt, Homo sapiens
agaguccacccugcaccuggugcuccgucucagaggugggaugcaaauc

SEQ ID NO: 167215 - RNA, 102 nt, Homo sapiens
cuuucuggauguuguagucagacagggugcguccaucuuccagcuguuucccagcaaagaucaaccucugcuggucaggagggaugccuuccuugucuugga

SEQ ID NO: 167216 - RNA, 77 nt, Homo sapiens
gaagacccugacugguaagaccaucacucucgaaguggagccgagugacaccauugagaaugucaaggcaaagaucc

SEQ ID NO: 167217 - RNA, 46 nt, Homo sapiens
cuccacuucgagagugauggucuuaccagucagggucuucacgaag

SEQ ID NO: 167218 - RNA, 147 nt, Homo sapiens
auccaagacaaggaaggcaucccuccugaccagcagagguugaucuuugcugggaaacagcuggaagauggacgcacccugucugacuacaacauccagaaagaguccacccugcaccuggugcuccgucuuagaggugggaugcag

SEQ ID NO: 167219 - RNA, 46 nt, Homo sapiens
uguuucccagcaaagaucaaccucugcuggucaggagggaugccuu

SEQ ID NO: 167220 - RNA, 127 nt, Homo sapiens
agaguccacccugcaccuggugcuccgucuuagaggugggaugcagaucuucgugaagacccugacugguaagaccaucacucucgaaguggagccgagugacaccauugagaaugucaaggcaaag

SEQ ID NO: 167221 - RNA, 102 nt, Homo sapiens; identical to SEQ ID NO: 167215

SEQ ID NO: 167222 - RNA, 77 nt, Homo sapiens
gaagacccugacugguaagaccaucacucucgagguggagccgagugacaccauugagaaugucaaggcaaagaucc

SEQ ID NO: 167223 - RNA, 46 nt, Homo sapiens
cuccaccucgagagugauggucuuaccagucagggucuucacgaag

SEQ ID NO: 167224 - RNA, 131 nt, Homo sapiens
gcaucccuccugaccagcagagguugaucuuugccggaaaacagcuggaagauggucguacccugucugacuacaacauccagaaagaguccaccuugcaccuggugcuccgucucagaggugggaugcag

SEQ ID NO: 167225 - RNA, 46 nt, Homo sapiens
uguuuuccggcaaagaucaaccucugcuggucaggagggaugccuu

SEQ ID NO: 167226 - RNA, 70 nt, Homo sapiens
ccugacugguaagaccaucacucucgaaguggagccgagugacaccauugagaaugucaaggcaaagauc

SEQ ID NO: 167227 - RNA, 85 nt, Homo sapiens
gcauuccuccugaccagcagagguugaucuuugccggaaagcagcuggaagaugggcgcacccugucugacuacaacauccagaa

SEQ ID NO: 167228 - RNA, 102 nt, Homo sapiens
cuuucuggauguuguagucagacagggugcgcccaucuuccagcugcuuuccggcaaagaucaaccucugcuggucaggaggaaugccuuccuugucuugga

SEQ ID NO: 167229 - RNA, 46 nt, Homo sapiens
cucgaccucaagggugauggucuugccagugagugucuucacgaag

SEQ ID NO: 167230 - RNA, 49 nt, Homo sapiens
agaguccaccuugcaccugguacuccgucucagaggugggaugcaaauc

SEQ ID NO: 167231 - RNA, 46 nt, Homo sapiens
uguuuuccggcaaagaucaaccucugcugaucagaaggaaugccuu

SEQ ID NO: 167232 - RNA, 77 nt, Homo sapiens
gaagacccugacugguaagaccaucacccucgagguggagcccagugacaccaucgagaaugucaaggcaaagaucc

SEQ ID NO: 167233 - RNA, 147 nt, Homo sapiens
auccaggacaaggaaggcauuccuccugaccagcagagguugaucuuugccggaaagcagcuggaagaugggcgcacccugucugacuacaacauccagaaagagucuacccugcaccuggugcuccgucucagaggugggaugcag

SEQ ID NO: 167234 - RNA, 102 nt, Homo sapiens
cuuucuggauguuguagucagacagggugcgcccaucuuccagcugcuuuccggcaaagaucaaccucugcuggucaggaggaaugccuuccuuguccugga

SEQ ID NO: 167235 - RNA, 46 nt, Homo sapiens; identical to SEQ ID NO: 167229

SEQ ID NO: 167236 - RNA, 127 nt, Homo sapiens
agaguccacccugcaccuggugcuccgucucagaggugggaugcaaaucuucgugaagacacucacuggcaagaccaucacccuugaggucgagcccagugacaccaucgagaacgucaaagcaaag

SEQ ID NO: 167237 - RNA, 46 nt, Homo sapiens
uguuuuccagcaaagaucagccucugcuggucaggagggaugccuu

SEQ ID NO: 167238 - RNA, 50 nt, Homo sapiens
cgagguugagcccagugacaccaucgagaaugucaaggcaaagauccaag

SEQ ID NO: 167239 - RNA, 91 nt, Homo sapiens
cugggccugagcugccucaagcguggggccucccagcuguggcuccagagcuccucucagagcacugccaccaccaccuccaucuccaggg

SEQ ID NO: 167240 - RNA, 95 nt, Homo sapiens
gcuggggagccccgagcccuaggccccccccagcucugucagaggcuugggcuuccuucaccuguuccccguuguacccugggcugcugccauga

SEQ ID NO: 167241 - RNA, 44 nt, Homo sapiens
agguacaccccacucgggcagggucugcaaguggcucuccagca

SEQ ID NO: 167242 - RNA, 77 nt, Homo sapiens
ccugucgaagaaggagaagaagccucugaccaagaaggagaagaaagugcugcagaaaaucuuagaacagaaggaga

SEQ ID NO: 167243 - RNA, 85 nt, Homo sapiens
aaauuuaugcggcuauagugagcagauaaaacagaagaggccauuggguggguugcagcaucccauagaguugcuggagaagaca

SEQ ID NO: 167244 - RNA, 44 nt, Homo sapiens
gccaggcacuauucuaggcacuggagacauagcagaaagggaga

SEQ ID NO: 167245 - RNA, 49 nt, Homo sapiens
ugcacuauuuuuuuuuuccacucuggcuaaguguaggcucugaagccag

SEQ ID NO: 167246 - RNA, 53 nt, Homo sapiens
gcguuuugaaggaugccuuugacuuugaaagccgaucugagauugcaaaccuc

SEQ ID NO: 167247 - RNA, 398 nt, Homo sapiens
aucaagcuccuccucuuucuauuuauuuauuuauuuauuuauuuauuuauauuuuuaauuuuuuuuuuugagacggagucucacucugucgccaggcuguaguguaguggugggaucucggcucaccgcaaccucugacuccccugguucaagcaauucuccugccucagccucuugaguagcugggauuacgagcacgcgccaccacgcccagcuaauuuuuguauuuuuaguggagacggguuucaucauguuggccaggauggucuccaucuccugaccucguuaucugcccgccugggccucccaaagugcugggauuagaggcgugagccaccacgcccagccuucuuucuuuuuaagaauaugcuuuaggcuugagccuaauaaggaagcag

SEQ ID NO: 167248 - RNA, 48 nt, Homo sapiens
ggagucaucuuugguggaacugauguaaaugaagaugccaaccaggcg

SEQ ID NO: 167249 - RNA, 46 nt, Homo sapiens
accaaacgccgcuuuuaacuggaauaccuuucuucaacgcucuggu

SEQ ID NO: 167250 - RNA, 47 nt, Homo sapiens
uugaccucauauucaaaugccuaaccucaaauucuucugaccuacaa

SEQ ID NO: 167251 - RNA, 42 nt, Homo sapiens
caagucuugggacacauuaaaauucuuauuggaaagacuaug

SEQ ID NO: 167252 - RNA, 42 nt, Homo sapiens
gcaggaugguuugagcguggcuuugguuuucuauuaaagcuu

SEQ ID NO: 167253 - RNA, 46 nt, Homo sapiens
augacagcuuaaugacuuuccacaauaacuucuuauaucgaagauu

SEQ ID NO: 167254 - RNA, 35 nt, Homo sapiens
gagaauuuucauuguggcuugcgaugcuuuugccc

SEQ ID NO: 167255 - RNA, 46 nt, Homo sapiens
cacuaagagauuugaaagugaacugauguggaagguaaauccagaa
